United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 60

SEQ ID NO: 2719401 - RNA, 17 nt, Human
accuuuguccccaccgc

SEQ ID NO: 2719402 - RNA, 21 nt, Human
uccacugugccaugugccagg

SEQ ID NO: 2719403 - RNA, 20 nt, Human
accuuuuggucuggagggaa

SEQ ID NO: 2719404 - RNA, 13 nt, Human
accuuuuuuauac

SEQ ID NO: 2719405 - RNA, 13 nt, Human
uccagacacaugu

SEQ ID NO: 2719406 - RNA, 14 nt, Human
uccagaauuuccca

SEQ ID NO: 2719407 - RNA, 15 nt, Human
uccagaauuucccaa

SEQ ID NO: 2719408 - RNA, 15 nt, Human
acgaauauugcugau

SEQ ID NO: 2719409 - RNA, 18 nt, Human
acgaauauugcugauggu

SEQ ID NO: 2719410 - RNA, 23 nt, Human
uccaggcugggagagccuuccag

SEQ ID NO: 2719411 - RNA, 10 nt, Human
uccaggcucc

SEQ ID NO: 2719412 - RNA, 12 nt, Human
uccaggcuccuu

SEQ ID NO: 2719413 - RNA, 22 nt, Human
uccaggcuccuuuagcgcccag

SEQ ID NO: 2719414 - RNA, 20 nt, Human
uccaggcugggagagccuuc

SEQ ID NO: 2719415 - RNA, 21 nt, Human
uccaggcugggagagccuucc

SEQ ID NO: 2719416 - RNA, 13 nt, Human
acgcuggaccuug

SEQ ID NO: 2719417 - RNA, 23 nt, Human
acggagucccaccuuggcugcag

SEQ ID NO: 2719418 - RNA, 17 nt, Human
acgcuggagugcaguga

SEQ ID NO: 2719419 - RNA, 20 nt, Human
acgcuggaccuugaacuggg

SEQ ID NO: 2719420 - RNA, 23 nt, Human
acgcuggaccuugaacuggguac

SEQ ID NO: 2719421 - RNA, 15 nt, Human
acgcuggagugcagu

SEQ ID NO: 2719422 - RNA, 16 nt, Human
acgcuggagugcagug

SEQ ID NO: 2719423 - RNA, 21 nt, Human
acgcuacccgggaagggggcu

SEQ ID NO: 2719424 - RNA, 14 nt, Human
acgaauauugcuga

SEQ ID NO: 2719425 - RNA, 21 nt, Human
acgaauauugcugauggugca

SEQ ID NO: 2719426 - RNA, 15 nt, Human
uccagugaggcucug

SEQ ID NO: 2719427 - RNA, 16 nt, Human
uccagugaggcucugc

SEQ ID NO: 2719428 - RNA, 22 nt, Human
uccagugaggcucugcccuugg

SEQ ID NO: 2719429 - RNA, 23 nt, Human
uccagugaggcucugcccuuggu

SEQ ID NO: 2719430 - RNA, 16 nt, Human
uccaguaucuugaaga

SEQ ID NO: 2719431 - RNA, 18 nt, Human
uccaguaucuugaagacu

SEQ ID NO: 2719432 - RNA, 13 nt, Human
acggaugauuucu

SEQ ID NO: 2719433 - RNA, 12 nt, Human
acggccaggcca

SEQ ID NO: 2719434 - RNA, 16 nt, Human
acggcucacugcagcc

SEQ ID NO: 2719435 - RNA, 17 nt, Human
acggcucacugcagccu

SEQ ID NO: 2719436 - RNA, 18 nt, Human
acggcucacugcagccuc

SEQ ID NO: 2719437 - RNA, 14 nt, Human
uccaguaucuugaa

SEQ ID NO: 2719438 - RNA, 15 nt, Human
uccaguaucuugaag

SEQ ID NO: 2719439 - RNA, 18 nt, Human
acggcuuuuacuuaaacc

SEQ ID NO: 2719440 - RNA, 16 nt, Human
acggugaauggcuuug

SEQ ID NO: 2719441 - RNA, 20 nt, Human
acggugaauggcuuuguaua

SEQ ID NO: 2719442 - RNA, 19 nt, Human
acggugaauggcuuuguau

SEQ ID NO: 2719443 - RNA, 13 nt, Human
acguugugcauuu

SEQ ID NO: 2719444 - RNA, 15 nt, Human
acguugugcauuugg

SEQ ID NO: 2719445 - RNA, 14 nt, Human
acguugugcauuug

SEQ ID NO: 2719446 - RNA, 16 nt, Human
acguuucuaaaggcua

SEQ ID NO: 2719447 - RNA, 15 nt, Human
acguuucuaaaggcu

SEQ ID NO: 2719448 - RNA, 17 nt, Human
acguggcugcuucaagg

SEQ ID NO: 2719449 - RNA, 18 nt, Human
acguggcugcuucaagga

SEQ ID NO: 2719450 - RNA, 19 nt, Human
acguggcugcuucaaggau

SEQ ID NO: 2719451 - RNA, 21 nt, Human
acguggcugcuucaaggaucc

SEQ ID NO: 2719452 - RNA, 15 nt, Human
acuaauuuuaaaaug

SEQ ID NO: 2719453 - RNA, 22 nt, Human
acguuucuaaaggcuaccuuug

SEQ ID NO: 2719454 - RNA, 18 nt, Human
ucccagauacuugggggg

SEQ ID NO: 2719455 - RNA, 16 nt, Human
ucccagauacuugggg

SEQ ID NO: 2719456 - RNA, 16 nt, Human
acuaucucauuuccaa

SEQ ID NO: 2719457 - RNA, 17 nt, Human
acuaucucauuuccaag

SEQ ID NO: 2719458 - RNA, 15 nt, Human
acuaucucauuucca

SEQ ID NO: 2719459 - RNA, 21 nt, Human
acuaucuaaauguugaaagau

SEQ ID NO: 2719460 - RNA, 16 nt, Human
acuaucuaaauguuga

SEQ ID NO: 2719461 - RNA, 22 nt, Human
acuauauuguuugcuaagcauu

SEQ ID NO: 2719462 - RNA, 17 nt, Human
acuauauuguuugcuaa

SEQ ID NO: 2719463 - RNA, 18 nt, Human
acuauagccuaggugaca

SEQ ID NO: 2719464 - RNA, 20 nt, Human
acuauagccuaggugacaga

SEQ ID NO: 2719465 - RNA, 22 nt, Human
acuauagccuaggugacagagu

SEQ ID NO: 2719466 - RNA, 14 nt, Human
acuauguugcccag

SEQ ID NO: 2719467 - RNA, 22 nt, Human
acuauggcccuggccuagcaua

SEQ ID NO: 2719468 - RNA, 15 nt, Human
acuauguugcccagg

SEQ ID NO: 2719469 - RNA, 16 nt, Human
acuauguugcccaggc

SEQ ID NO: 2719470 - RNA, 16 nt, Human
acucaaugcacugaca

SEQ ID NO: 2719471 - RNA, 15 nt, Human
acucaauuuuaacaa

SEQ ID NO: 2719472 - RNA, 12 nt, Human
acucaauuuuaa

SEQ ID NO: 2719473 - RNA, 23 nt, Human
uccccacccugaaagcccugagc

SEQ ID NO: 2719474 - RNA, 15 nt, Human
uccccaccgcagaca

SEQ ID NO: 2719475 - RNA, 16 nt, Human
uccccaccgcagacag

SEQ ID NO: 2719476 - RNA, 18 nt, Human
uccccaggaggccagccu

SEQ ID NO: 2719477 - RNA, 12 nt, Human
uccccacccuga

SEQ ID NO: 2719478 - RNA, 11 nt, Human
ucccccagccc

SEQ ID NO: 2719479 - RNA, 17 nt, Human
uccccaggaggccagcc

SEQ ID NO: 2719480 - RNA, 20 nt, Human
uccccaggaggccagccuug

SEQ ID NO: 2719481 - RNA, 21 nt, Human
uccccaggaggccagccuuga

SEQ ID NO: 2719482 - RNA, 16 nt, Human
ucccccagccccaucc

SEQ ID NO: 2719483 - RNA, 13 nt, Human
ucccccagcccca

SEQ ID NO: 2719484 - RNA, 15 nt, Human
ucccccagccccauc

SEQ ID NO: 2719485 - RNA, 23 nt, Human
ucucaggaaaucaaauaugcaaa

SEQ ID NO: 2719486 - RNA, 21 nt, Human
ucucaggaaaucaaauaugca

SEQ ID NO: 2719487 - RNA, 14 nt, Human
ucucaggaaaucaa

SEQ ID NO: 2719488 - RNA, 23 nt, Human
ucucagauuuuauuauguaaauc

SEQ ID NO: 2719489 - RNA, 22 nt, Human
ucucagauuuuauuauguaaau

SEQ ID NO: 2719490 - RNA, 10 nt, Human
ucucaggcca

SEQ ID NO: 2719491 - RNA, 12 nt, Human
ucucaggccaaa

SEQ ID NO: 2719492 - RNA, 12 nt, Human
ucucaggccagc

SEQ ID NO: 2719493 - RNA, 13 nt, Human
ucucaggccagcu

SEQ ID NO: 2719494 - RNA, 15 nt, Human
ucucauuuccaagca

SEQ ID NO: 2719495 - RNA, 14 nt, Human
ucucauuugucaca

SEQ ID NO: 2719496 - RNA, 16 nt, Human
ucucauuugucacaca

SEQ ID NO: 2719497 - RNA, 15 nt, Human
ucuccaagcaggaca

SEQ ID NO: 2719498 - RNA, 16 nt, Human
ucuccaagcaggacau

SEQ ID NO: 2719499 - RNA, 21 nt, Human
ucucaggccagcugcuugggc

SEQ ID NO: 2719500 - RNA, 17 nt, Human
ucucaggccagcugcuu

SEQ ID NO: 2719501 - RNA, 18 nt, Human
ucucaggccagcugcuug

SEQ ID NO: 2719502 - RNA, 15 nt, Human
acuugucaauaaaau

SEQ ID NO: 2719503 - RNA, 21 nt, Human
acuugucuuuggacccugagg

SEQ ID NO: 2719504 - RNA, 20 nt, Human
acuugucuuuggacccugag

SEQ ID NO: 2719505 - RNA, 18 nt, Human
acuugucuuuggacccug

SEQ ID NO: 2719506 - RNA, 13 nt, Human
acuuguguaaaua

SEQ ID NO: 2719507 - RNA, 19 nt, Human
acuuguggacacagcucuu

SEQ ID NO: 2719508 - RNA, 22 nt, Human
acuuguggacacagcucuucuc

SEQ ID NO: 2719509 - RNA, 20 nt, Human
ucucacuauguugcccaggc

SEQ ID NO: 2719510 - RNA, 21 nt, Human
ucucacuauguugcccaggca

SEQ ID NO: 2719511 - RNA, 22 nt, Human
ucucacuauguugcccaggcag

SEQ ID NO: 2719512 - RNA, 23 nt, Human
ucucacuauguugcccaggcagg

SEQ ID NO: 2719513 - RNA, 23 nt, Human
acuugcagacucuacagaggcca

SEQ ID NO: 2719514 - RNA, 19 nt, Human
acuugcagacucuacagag

SEQ ID NO: 2719515 - RNA, 22 nt, Human
acuugcagacucuacagaggcc

SEQ ID NO: 2719516 - RNA, 17 nt, Human
ucuccucugcugcuggc

SEQ ID NO: 2719517 - RNA, 18 nt, Human
ucuccucugcugcuggcu

SEQ ID NO: 2719518 - RNA, 15 nt, Human
ucuccuccagaguca

SEQ ID NO: 2719519 - RNA, 15 nt, Human
ucuccucugcugcug

SEQ ID NO: 2719520 - RNA, 16 nt, Human
ucuccucugcugcugg

SEQ ID NO: 2719521 - RNA, 12 nt, Human
acuuuaccuuuu

SEQ ID NO: 2719522 - RNA, 17 nt, Human
ucuccgaccagacaccu

SEQ ID NO: 2719523 - RNA, 23 nt, Human
ucuccgaccagacaccuugacag

SEQ ID NO: 2719524 - RNA, 18 nt, Human
ucuccaagcaggacaugg

SEQ ID NO: 2719525 - RNA, 19 nt, Human
ucuccaagcaggacaugga

SEQ ID NO: 2719526 - RNA, 12 nt, Human
ucuccacccugc

SEQ ID NO: 2719527 - RNA, 23 nt, Human
ucuccccagcaagugagagcugg

SEQ ID NO: 2719528 - RNA, 17 nt, Human
agaaaaaauauuuuccc

SEQ ID NO: 2719529 - RNA, 14 nt, Human
ucuccuucaccuuu

SEQ ID NO: 2719530 - RNA, 15 nt, Human
ucuccuucaccuuug

SEQ ID NO: 2719531 - RNA, 16 nt, Human
ucuccuucaccuuugu

SEQ ID NO: 2719532 - RNA, 21 nt, Human
ucuccuuguguuacuaaguuu

SEQ ID NO: 2719533 - RNA, 13 nt, Human
ucuccuuguguua

SEQ ID NO: 2719534 - RNA, 23 nt, Human
acuuuuguucuugguuuguaaau

SEQ ID NO: 2719535 - RNA, 15 nt, Human
acuuuuguucuuggu

SEQ ID NO: 2719536 - RNA, 20 nt, Human
acuuuguuaguuucuccaag

SEQ ID NO: 2719537 - RNA, 13 nt, Human
acuuuuguucuug

SEQ ID NO: 2719538 - RNA, 12 nt, Human
acuuuuguucuu

SEQ ID NO: 2719539 - RNA, 21 nt, Human
acuuuguuaguuucuccaagc

SEQ ID NO: 2719540 - RNA, 14 nt, Human
acuuuguucuggcu

SEQ ID NO: 2719541 - RNA, 15 nt, Human
acuuuggaacaagau

SEQ ID NO: 2719542 - RNA, 13 nt, Human
acuuugaccucug

SEQ ID NO: 2719543 - RNA, 12 nt, Human
acuuugaccucu

SEQ ID NO: 2719544 - RNA, 12 nt, Human
acuuuggauaau

SEQ ID NO: 2719545 - RNA, 19 nt, Human
acuuuggauaauaaggaaa

SEQ ID NO: 2719546 - RNA, 17 nt, Human
acuuuggauaauaagga

SEQ ID NO: 2719547 - RNA, 16 nt, Human
ucuaggaaauauuuau

SEQ ID NO: 2719548 - RNA, 13 nt, Human
ucuagccagagga

SEQ ID NO: 2719549 - RNA, 17 nt, Human
ucuaggaaauauuuauu

SEQ ID NO: 2719550 - RNA, 22 nt, Human
ucuaguuguuugauucagacag

SEQ ID NO: 2719551 - RNA, 12 nt, Human
ucuaggaagacu

SEQ ID NO: 2719552 - RNA, 13 nt, Human
ucuauaaaccgaa

SEQ ID NO: 2719553 - RNA, 23 nt, Human
ucuaguuguuugauucagacagc

SEQ ID NO: 2719554 - RNA, 21 nt, Human
ucuaguuugauuaaauucuug

SEQ ID NO: 2719555 - RNA, 13 nt, Human
ucuagauacugua

SEQ ID NO: 2719556 - RNA, 21 nt, Human
ucuagcauggcauauuuuuca

SEQ ID NO: 2719557 - RNA, 18 nt, Human
ucuagcauggcugccaau

SEQ ID NO: 2719558 - RNA, 22 nt, Human
ucuagcauggcauauuuuucac

SEQ ID NO: 2719559 - RNA, 23 nt, Human
ucuagcauggcauauuuuucaca

SEQ ID NO: 2719560 - RNA, 16 nt, Human
acuucaucccucuggg

SEQ ID NO: 2719561 - RNA, 23 nt, Human
ucuaugggacucaaugcacugac

SEQ ID NO: 2719562 - RNA, 17 nt, Human
ucucacuauguugccca

SEQ ID NO: 2719563 - RNA, 19 nt, Human
ucucacuauguugcccagg

SEQ ID NO: 2719564 - RNA, 16 nt, Human
ucucacuauguugccc

SEQ ID NO: 2719565 - RNA, 12 nt, Human
uccugggcagcu

SEQ ID NO: 2719566 - RNA, 13 nt, Human
uccugggcagcug

SEQ ID NO: 2719567 - RNA, 18 nt, Human
uccugggagugagcuggu

SEQ ID NO: 2719568 - RNA, 19 nt, Human
ucuaaguaaaaccacagca

SEQ ID NO: 2719569 - RNA, 15 nt, Human
ucuaaguaaaaccac

SEQ ID NO: 2719570 - RNA, 14 nt, Human
ucuaaguaaaacca

SEQ ID NO: 2719571 - RNA, 21 nt, Human
ucuacagaggccaugggccuc

SEQ ID NO: 2719572 - RNA, 19 nt, Human
ucuacccagcgagcccugg

SEQ ID NO: 2719573 - RNA, 18 nt, Human
acuguucucugcccucca

SEQ ID NO: 2719574 - RNA, 16 nt, Human
acuguucucugcccuc

SEQ ID NO: 2719575 - RNA, 17 nt, Human
acuguucucugcccucc

SEQ ID NO: 2719576 - RNA, 21 nt, Human
ucuacccuggcacuauaaugu

SEQ ID NO: 2719577 - RNA, 14 nt, Human
ucuacccuggcacu

SEQ ID NO: 2719578 - RNA, 19 nt, Human
ucuacccuggcacuauaau

SEQ ID NO: 2719579 - RNA, 20 nt, Human
ucuacccagcgagcccuggu

SEQ ID NO: 2719580 - RNA, 14 nt, Human
ucuacccaggugcu

SEQ ID NO: 2719581 - RNA, 23 nt, Human
acuuaacuauucaggagaguaga

SEQ ID NO: 2719582 - RNA, 20 nt, Human
acuuaaauaaugugaaacug

SEQ ID NO: 2719583 - RNA, 13 nt, Human
acuuaagcacacu

SEQ ID NO: 2719584 - RNA, 19 nt, Human
acuuaaucuaaauggaacc

SEQ ID NO: 2719585 - RNA, 17 nt, Human
acuuaaucuaaauggaa

SEQ ID NO: 2719586 - RNA, 16 nt, Human
acuuacacuuuaugca

SEQ ID NO: 2719587 - RNA, 22 nt, Human
acuuaaucuaaauggaaccacu

SEQ ID NO: 2719588 - RNA, 15 nt, Human
acuuagguguggggg

SEQ ID NO: 2719589 - RNA, 22 nt, Human
acuuacuguacaugaaaacaca

SEQ ID NO: 2719590 - RNA, 17 nt, Human
acuuacacuuuaugcac

SEQ ID NO: 2719591 - RNA, 16 nt, Human
acuuacuguacaugaa

SEQ ID NO: 2719592 - RNA, 21 nt, Human
acuuacuguacaugaaaacac

SEQ ID NO: 2719593 - RNA, 23 nt, Human
agaaugguccgugcuaaggacuu

SEQ ID NO: 2719594 - RNA, 21 nt, Human
agaaugguccgugcuaaggac

SEQ ID NO: 2719595 - RNA, 14 nt, Human
ucugcuuguguuaa

SEQ ID NO: 2719596 - RNA, 21 nt, Human
agaaguuucugccgcagcccu

SEQ ID NO: 2719597 - RNA, 22 nt, Human
agaaguuucugccgcagcccug

SEQ ID NO: 2719598 - RNA, 23 nt, Human
agaaguuucugccgcagcccugc

SEQ ID NO: 2719599 - RNA, 13 nt, Human
agaauauguuuca

SEQ ID NO: 2719600 - RNA, 17 nt, Human
agaauauguuucaaacu

SEQ ID NO: 2719601 - RNA, 18 nt, Human
agaauauguuucaaacuu

SEQ ID NO: 2719602 - RNA, 19 nt, Human
agaauauguuucaaacuuu

SEQ ID NO: 2719603 - RNA, 21 nt, Human
agaauauguuucaaacuuugg

SEQ ID NO: 2719604 - RNA, 18 nt, Human
ucugugaacuugaaauuu

SEQ ID NO: 2719605 - RNA, 17 nt, Human
ucugugaacuugaaauu

SEQ ID NO: 2719606 - RNA, 14 nt, Human
ucugugaacuugaa

SEQ ID NO: 2719607 - RNA, 16 nt, Human
ucugugaaaguacauu

SEQ ID NO: 2719608 - RNA, 22 nt, Human
ucugugaaaggaaagagggagg

SEQ ID NO: 2719609 - RNA, 22 nt, Human
ucuguucuuuccaaaguacacu

SEQ ID NO: 2719610 - RNA, 13 nt, Human
ucuguucuuucca

SEQ ID NO: 2719611 - RNA, 12 nt, Human
ucuguuggccag

SEQ ID NO: 2719612 - RNA, 17 nt, Human
ucuguuggccaguguga

SEQ ID NO: 2719613 - RNA, 14 nt, Human
agaauucuguauag

SEQ ID NO: 2719614 - RNA, 13 nt, Human
ucuguuuagauaa

SEQ ID NO: 2719615 - RNA, 12 nt, Human
agaauucuguau

SEQ ID NO: 2719616 - RNA, 16 nt, Human
agacaggaccagggau

SEQ ID NO: 2719617 - RNA, 17 nt, Human
agacaccuugacagggc

SEQ ID NO: 2719618 - RNA, 18 nt, Human
agacaccuugacagggca

SEQ ID NO: 2719619 - RNA, 16 nt, Human
agacacauguccaaga

SEQ ID NO: 2719620 - RNA, 20 nt, Human
agacacauguccaagaagcc

SEQ ID NO: 2719621 - RNA, 12 nt, Human
agacacacauga

SEQ ID NO: 2719622 - RNA, 15 nt, Human
agacacacaugaagu

SEQ ID NO: 2719623 - RNA, 16 nt, Human
agacacaggcccggcu

SEQ ID NO: 2719624 - RNA, 12 nt, Human
agacacaggccc

SEQ ID NO: 2719625 - RNA, 13 nt, Human
agacacaggcccg

SEQ ID NO: 2719626 - RNA, 22 nt, Human
agaauuugauaugugaacaguu

SEQ ID NO: 2719627 - RNA, 21 nt, Human
agaauuugauaugugaacagu

SEQ ID NO: 2719628 - RNA, 17 nt, Human
ucugcagcaauaaagca

SEQ ID NO: 2719629 - RNA, 17 nt, Human
ucugcacuccccugcug

SEQ ID NO: 2719630 - RNA, 16 nt, Human
ucugcacuccccugcu

SEQ ID NO: 2719631 - RNA, 14 nt, Human
ucugcacuccccug

SEQ ID NO: 2719632 - RNA, 15 nt, Human
ucugcacuccccugc

SEQ ID NO: 2719633 - RNA, 15 nt, Human
agaaauguacagcaa

SEQ ID NO: 2719634 - RNA, 14 nt, Human
agaaauguacagca

SEQ ID NO: 2719635 - RNA, 21 nt, Human
ucugagacucgcgacaaugca

SEQ ID NO: 2719636 - RNA, 11 nt, Human
ucugauccagu

SEQ ID NO: 2719637 - RNA, 21 nt, Human
ucugaucauccacugugccau

SEQ ID NO: 2719638 - RNA, 17 nt, Human
ucugaucauccacugug

SEQ ID NO: 2719639 - RNA, 21 nt, Human
ucugauccaguuuuguuugga

SEQ ID NO: 2719640 - RNA, 14 nt, Human
ucugauccaguuuu

SEQ ID NO: 2719641 - RNA, 15 nt, Human
ucugacacacagcuc

SEQ ID NO: 2719642 - RNA, 12 nt, Human
ucugacacacag

SEQ ID NO: 2719643 - RNA, 13 nt, Human
ucugacacacagc

SEQ ID NO: 2719644 - RNA, 14 nt, Human
ucugacacacagcu

SEQ ID NO: 2719645 - RNA, 21 nt, Human
ucugaaggacauugcggacag

SEQ ID NO: 2719646 - RNA, 13 nt, Human
agaagaacugaaa

SEQ ID NO: 2719647 - RNA, 14 nt, Human
agaagaacugaaau

SEQ ID NO: 2719648 - RNA, 18 nt, Human
agaagaugguaccaccag

SEQ ID NO: 2719649 - RNA, 18 nt, Human
agaagauuuugaaauuuu

SEQ ID NO: 2719650 - RNA, 12 nt, Human
agaagcccagga

SEQ ID NO: 2719651 - RNA, 16 nt, Human
agaagcccaggaaagg

SEQ ID NO: 2719652 - RNA, 18 nt, Human
agaagcccaggaaaggcu

SEQ ID NO: 2719653 - RNA, 20 nt, Human
agaagcccaggaaaggcucc

SEQ ID NO: 2719654 - RNA, 21 nt, Human
agaagcccaggaaaggcucca

SEQ ID NO: 2719655 - RNA, 22 nt, Human
agaagcccaggaaaggcuccag

SEQ ID NO: 2719656 - RNA, 16 nt, Human
ucugcccacucccugc

SEQ ID NO: 2719657 - RNA, 17 nt, Human
ucugcccacucccugca

SEQ ID NO: 2719658 - RNA, 16 nt, Human
ucugcuugccaucccu

SEQ ID NO: 2719659 - RNA, 17 nt, Human
ucugcuugccaucccuc

SEQ ID NO: 2719660 - RNA, 20 nt, Human
ucugcuugccaucccucccu

SEQ ID NO: 2719661 - RNA, 23 nt, Human
ucugcuugccaucccucccucca

SEQ ID NO: 2719662 - RNA, 14 nt, Human
ucugcuugccaucc

SEQ ID NO: 2719663 - RNA, 13 nt, Human
ucugcuucagccu

SEQ ID NO: 2719664 - RNA, 14 nt, Human
ucugcuucagccuc

SEQ ID NO: 2719665 - RNA, 15 nt, Human
ucugcuucagccucc

SEQ ID NO: 2719666 - RNA, 17 nt, Human
ucugcucacauaucugu

SEQ ID NO: 2719667 - RNA, 19 nt, Human
ucugcucacauaucuguca

SEQ ID NO: 2719668 - RNA, 20 nt, Human
ucugcucacauaucugucau

SEQ ID NO: 2719669 - RNA, 14 nt, Human
ucugccgcagcccu

SEQ ID NO: 2719670 - RNA, 15 nt, Human
ucugccgcagcccug

SEQ ID NO: 2719671 - RNA, 18 nt, Human
ucugcccacucccugcaa

SEQ ID NO: 2719672 - RNA, 21 nt, Human
ucugcccacucccugcaaccu

SEQ ID NO: 2719673 - RNA, 18 nt, Human
ucugcccuccaagaccuu

SEQ ID NO: 2719674 - RNA, 19 nt, Human
ucugcccuccaagaccuuc

SEQ ID NO: 2719675 - RNA, 21 nt, Human
ucugccugcccaggccccugc

SEQ ID NO: 2719676 - RNA, 22 nt, Human
ucugccugcccaggccccugcc

SEQ ID NO: 2719677 - RNA, 22 nt, Human
ucugccgcagcccugcagaggg

SEQ ID NO: 2719678 - RNA, 13 nt, Human
agauccuggaaau

SEQ ID NO: 2719679 - RNA, 18 nt, Human
agaucucuaacuucacca

SEQ ID NO: 2719680 - RNA, 21 nt, Human
agaugcaguucugaagaagau

SEQ ID NO: 2719681 - RNA, 20 nt, Human
agaugcaguucugaagaaga

SEQ ID NO: 2719682 - RNA, 22 nt, Human
ugacagagugagacucugucuc

SEQ ID NO: 2719683 - RNA, 19 nt, Human
ugacacgaauauugcugau

SEQ ID NO: 2719684 - RNA, 16 nt, Human
ugacacgaauauugcu

SEQ ID NO: 2719685 - RNA, 21 nt, Human
ugacagggcacaccgggcacu

SEQ ID NO: 2719686 - RNA, 22 nt, Human
ugacagggcacaccgggcacuc

SEQ ID NO: 2719687 - RNA, 17 nt, Human
ugacaggcaaugcuggc

SEQ ID NO: 2719688 - RNA, 19 nt, Human
ugacaggcaaugcuggcug

SEQ ID NO: 2719689 - RNA, 13 nt, Human
ugacauguuuuau

SEQ ID NO: 2719690 - RNA, 22 nt, Human
agauguauguacuucaugcugu

SEQ ID NO: 2719691 - RNA, 17 nt, Human
agaugugaacacaucag

SEQ ID NO: 2719692 - RNA, 22 nt, Human
agaugugaacacaucagcuugc

SEQ ID NO: 2719693 - RNA, 15 nt, Human
ugaccuuuaagagaa

SEQ ID NO: 2719694 - RNA, 21 nt, Human
ugacuguuuucucuugagagg

SEQ ID NO: 2719695 - RNA, 12 nt, Human
ugaccuuucaau

SEQ ID NO: 2719696 - RNA, 13 nt, Human
ugaccuuucaaua

SEQ ID NO: 2719697 - RNA, 14 nt, Human
ugacuaugacauaa

SEQ ID NO: 2719698 - RNA, 17 nt, Human
agauuucacucuccuug

SEQ ID NO: 2719699 - RNA, 19 nt, Human
agauuucacucuccuuggu

SEQ ID NO: 2719700 - RNA, 21 nt, Human
agauuagagaguguugaaacg

SEQ ID NO: 2719701 - RNA, 23 nt, Human
agauuagaauucuguauagauua

SEQ ID NO: 2719702 - RNA, 22 nt, Human
agauuagaauucuguauagauu

SEQ ID NO: 2719703 - RNA, 16 nt, Human
agauucauauuuacuu

SEQ ID NO: 2719704 - RNA, 13 nt, Human
agauucauauuua

SEQ ID NO: 2719705 - RNA, 20 nt, Human
ugacuuacuguacaugaaaa

SEQ ID NO: 2719706 - RNA, 12 nt, Human
ugacuuacugua

SEQ ID NO: 2719707 - RNA, 16 nt, Human
agauuagaauucugua

SEQ ID NO: 2719708 - RNA, 15 nt, Human
agauuagaauucugu

SEQ ID NO: 2719709 - RNA, 16 nt, Human
agcaagggugauggga

SEQ ID NO: 2719710 - RNA, 14 nt, Human
agcaaggagauuua

SEQ ID NO: 2719711 - RNA, 19 nt, Human
agcaaggagauuuacaacu

SEQ ID NO: 2719712 - RNA, 17 nt, Human
agcaaggagauuuacaa

SEQ ID NO: 2719713 - RNA, 22 nt, Human
agcaagggugaugggaaagcau

SEQ ID NO: 2719714 - RNA, 20 nt, Human
agcaagggugaugggaaagc

SEQ ID NO: 2719715 - RNA, 16 nt, Human
agcaagugagacccug

SEQ ID NO: 2719716 - RNA, 15 nt, Human
agcaagugagagcug

SEQ ID NO: 2719717 - RNA, 16 nt, Human
agcaagugagagcugg

SEQ ID NO: 2719718 - RNA, 12 nt, Human
ugagccacugca

SEQ ID NO: 2719719 - RNA, 13 nt, Human
ugagccacugcac

SEQ ID NO: 2719720 - RNA, 20 nt, Human
ugagccagauuucacucucc

SEQ ID NO: 2719721 - RNA, 21 nt, Human
ugagccagauuucacucuccu

SEQ ID NO: 2719722 - RNA, 14 nt, Human
ugagccacugcacc

SEQ ID NO: 2719723 - RNA, 18 nt, Human
ugagccagauuucacucu

SEQ ID NO: 2719724 - RNA, 19 nt, Human
ugagccagauuucacucuc

SEQ ID NO: 2719725 - RNA, 18 nt, Human
agcacaugccucucucag

SEQ ID NO: 2719726 - RNA, 16 nt, Human
agcacaugccucucuc

SEQ ID NO: 2719727 - RNA, 19 nt, Human
agcacaugccucucucagg

SEQ ID NO: 2719728 - RNA, 20 nt, Human
agcacaugccucucucaggc

SEQ ID NO: 2719729 - RNA, 21 nt, Human
agcacaugccucucucaggcc

SEQ ID NO: 2719730 - RNA, 22 nt, Human
agcacaugccucucucaggcca

SEQ ID NO: 2719731 - RNA, 17 nt, Human
agcaagugagagcuggg

SEQ ID NO: 2719732 - RNA, 21 nt, Human
agcacagcuucauuuccugug

SEQ ID NO: 2719733 - RNA, 16 nt, Human
agcaccaucucuccuc

SEQ ID NO: 2719734 - RNA, 23 nt, Human
agcacaugccucucucaggccaa

SEQ ID NO: 2719735 - RNA, 13 nt, Human
agcaccuccugcc

SEQ ID NO: 2719736 - RNA, 14 nt, Human
agcaccuccugccu

SEQ ID NO: 2719737 - RNA, 16 nt, Human
agcaccuccugccucg

SEQ ID NO: 2719738 - RNA, 16 nt, Human
agauuuuccugaaaac

SEQ ID NO: 2719739 - RNA, 20 nt, Human
ugagaagcagaggaaggaga

SEQ ID NO: 2719740 - RNA, 15 nt, Human
agauuuuccugaaaa

SEQ ID NO: 2719741 - RNA, 14 nt, Human
agauuuuccugaaa

SEQ ID NO: 2719742 - RNA, 11 nt, Human
ugagacagagu

SEQ ID NO: 2719743 - RNA, 21 nt, Human
ugagacagaguuuucacucuu

SEQ ID NO: 2719744 - RNA, 13 nt, Human
ugagacagcccgg

SEQ ID NO: 2719745 - RNA, 20 nt, Human
ugagacucugucucaaaaaa

SEQ ID NO: 2719746 - RNA, 22 nt, Human
ugagacagcccgggcucugccu

SEQ ID NO: 2719747 - RNA, 17 nt, Human
ugagacagcccgggcuc

SEQ ID NO: 2719748 - RNA, 18 nt, Human
ugagacagcccgggcucu

SEQ ID NO: 2719749 - RNA, 19 nt, Human
ugagacagcccgggcucug

SEQ ID NO: 2719750 - RNA, 20 nt, Human
ugagacagcccgggcucugc

SEQ ID NO: 2719751 - RNA, 16 nt, Human
ugagagacacacugaa

SEQ ID NO: 2719752 - RNA, 17 nt, Human
ugagagacacacugaag

SEQ ID NO: 2719753 - RNA, 19 nt, Human
ugagagacacacugaagaa

SEQ ID NO: 2719754 - RNA, 20 nt, Human
ugagagacacacugaagaag

SEQ ID NO: 2719755 - RNA, 21 nt, Human
ugagagacacacugaagaagc

SEQ ID NO: 2719756 - RNA, 22 nt, Human
ugagagacacacugaagaagca

SEQ ID NO: 2719757 - RNA, 14 nt, Human
ugagagcugggugu

SEQ ID NO: 2719758 - RNA, 10 nt, Human
ugagaggaaa

SEQ ID NO: 2719759 - RNA, 11 nt, Human
ugagaggaaau

SEQ ID NO: 2719760 - RNA, 12 nt, Human
ugagaggaaauc

SEQ ID NO: 2719761 - RNA, 13 nt, Human
ugagaggaaauca

SEQ ID NO: 2719762 - RNA, 14 nt, Human
ugagaggaaaucac

SEQ ID NO: 2719763 - RNA, 13 nt, Human
ugagaugugaaca

SEQ ID NO: 2719764 - RNA, 23 nt, Human
ugagaggacuuuucuuuguggcu

SEQ ID NO: 2719765 - RNA, 17 nt, Human
ugagaggaaaucaccga

SEQ ID NO: 2719766 - RNA, 19 nt, Human
ugagaugugaacacaucag

SEQ ID NO: 2719767 - RNA, 18 nt, Human
ugagaugugaacacauca

SEQ ID NO: 2719768 - RNA, 24 nt, Human
ugagaugugaacacaucagcuugc

SEQ ID NO: 2719769 - RNA, 13 nt, Human
ugaaagaaaauaa

SEQ ID NO: 2719770 - RNA, 18 nt, Human
ugaaacuggauuaaacuu

SEQ ID NO: 2719771 - RNA, 17 nt, Human
ugaaacuggauuaaacu

SEQ ID NO: 2719772 - RNA, 22 nt, Human
ugaaaauauuuguaucacaaau

SEQ ID NO: 2719773 - RNA, 21 nt, Human
ugaaaauauuuguaucacaaa

SEQ ID NO: 2719774 - RNA, 20 nt, Human
ugaaaaucuuauaauuuaaa

SEQ ID NO: 2719775 - RNA, 17 nt, Human
ugaaaauauuuguauca

SEQ ID NO: 2719776 - RNA, 20 nt, Human
ugaaaacacauuuuucuuag

SEQ ID NO: 2719777 - RNA, 19 nt, Human
ugaaaacacauuuuucuua

SEQ ID NO: 2719778 - RNA, 17 nt, Human
ugaaaacacauuuuucu

SEQ ID NO: 2719779 - RNA, 15 nt, Human
ugaaaacacauuuuu

SEQ ID NO: 2719780 - RNA, 13 nt, Human
ugaaaacacauuu

SEQ ID NO: 2719781 - RNA, 12 nt, Human
ugaaaacacauu

SEQ ID NO: 2719782 - RNA, 14 nt, Human
ugaaaacacauuuu

SEQ ID NO: 2719783 - RNA, 18 nt, Human
agagaccaucccugaagg

SEQ ID NO: 2719784 - RNA, 19 nt, Human
agagaccaucccugaaggc

SEQ ID NO: 2719785 - RNA, 21 nt, Human
agagaccaucccugaaggccc

SEQ ID NO: 2719786 - RNA, 22 nt, Human
agagaccaucccugaaggcccc

SEQ ID NO: 2719787 - RNA, 23 nt, Human
agagaccaucccugaaggccccg

SEQ ID NO: 2719788 - RNA, 22 nt, Human
ugaaagacuguacaaaguagaa

SEQ ID NO: 2719789 - RNA, 19 nt, Human
ugaaagacuguacaaagua

SEQ ID NO: 2719790 - RNA, 18 nt, Human
ugaaagacuguacaaagu

SEQ ID NO: 2719791 - RNA, 16 nt, Human
ugaaagacuguacaaa

SEQ ID NO: 2719792 - RNA, 15 nt, Human
agagaguguugaaac

SEQ ID NO: 2719793 - RNA, 16 nt, Human
agagaguguugaaacg

SEQ ID NO: 2719794 - RNA, 11 nt, Human
agagacuccug

SEQ ID NO: 2719795 - RNA, 12 nt, Human
agagacuccugc

SEQ ID NO: 2719796 - RNA, 13 nt, Human
agagacuccugca

SEQ ID NO: 2719797 - RNA, 14 nt, Human
agagacuccugcag

SEQ ID NO: 2719798 - RNA, 16 nt, Human
agagacacacugaaga

SEQ ID NO: 2719799 - RNA, 14 nt, Human
ucuuuguacagaca

SEQ ID NO: 2719800 - RNA, 15 nt, Human
ucuuuguacagacaa

SEQ ID NO: 2719801 - RNA, 20 nt, Human
ucuuuguacagacaacaaac

SEQ ID NO: 2719802 - RNA, 14 nt, Human
ucuuuguggcuucc

SEQ ID NO: 2719803 - RNA, 17 nt, Human
ucuuugucuacaccauu

SEQ ID NO: 2719804 - RNA, 15 nt, Human
agacuuuggaaagac

SEQ ID NO: 2719805 - RNA, 17 nt, Human
agacuuuggaaagacuu

SEQ ID NO: 2719806 - RNA, 15 nt, Human
agacuuuggaaagag

SEQ ID NO: 2719807 - RNA, 20 nt, Human
agacugguuccauggccucu

SEQ ID NO: 2719808 - RNA, 21 nt, Human
agacuggugacugauucuuca

SEQ ID NO: 2719809 - RNA, 20 nt, Human
agacuggugacugauucuuc

SEQ ID NO: 2719810 - RNA, 19 nt, Human
agacuggugacugauucuu

SEQ ID NO: 2719811 - RNA, 15 nt, Human
agacuuuuccaaccc

SEQ ID NO: 2719812 - RNA, 19 nt, Human
agacuuuggaaagaguagg

SEQ ID NO: 2719813 - RNA, 15 nt, Human
agagacacaagccuu

SEQ ID NO: 2719814 - RNA, 16 nt, Human
agagacacaagccuuc

SEQ ID NO: 2719815 - RNA, 19 nt, Human
agagacacaagccuucggc

SEQ ID NO: 2719816 - RNA, 22 nt, Human
agacuccaaagaaauguaaggg

SEQ ID NO: 2719817 - RNA, 12 nt, Human
ucuuuccugagg

SEQ ID NO: 2719818 - RNA, 18 nt, Human
ucuuuaaugucacaggca

SEQ ID NO: 2719819 - RNA, 19 nt, Human
ucuuuaaugucacaggcag

SEQ ID NO: 2719820 - RNA, 20 nt, Human
agacaggcaagcaccuccug

SEQ ID NO: 2719821 - RNA, 22 nt, Human
agacaggcaagcaccuccugcc

SEQ ID NO: 2719822 - RNA, 15 nt, Human
ucuuuaaugucacag

SEQ ID NO: 2719823 - RNA, 21 nt, Human
agacuggcacaguuuucugag

SEQ ID NO: 2719824 - RNA, 20 nt, Human
agacuggcacaguuuucuga

SEQ ID NO: 2719825 - RNA, 23 nt, Human
agacuggcacaguuuucugagaa

SEQ ID NO: 2719826 - RNA, 13 nt, Human
agacuccugcagg

SEQ ID NO: 2719827 - RNA, 18 nt, Human
agagcuguucacagccag

SEQ ID NO: 2719828 - RNA, 21 nt, Human
agaggcagccccauucugccu

SEQ ID NO: 2719829 - RNA, 22 nt, Human
agaggcagccccauucugccug

SEQ ID NO: 2719830 - RNA, 21 nt, Human
agaggcagggucucacucugu

SEQ ID NO: 2719831 - RNA, 23 nt, Human
agaggcagccccauucugccugc

SEQ ID NO: 2719832 - RNA, 20 nt, Human
agagguucaaagauauuuug

SEQ ID NO: 2719833 - RNA, 19 nt, Human
agagguucaaagauauuuu

SEQ ID NO: 2719834 - RNA, 16 nt, Human
agagguucaaagauau

SEQ ID NO: 2719835 - RNA, 15 nt, Human
agagggagguaagga

SEQ ID NO: 2719836 - RNA, 15 nt, Human
agagggagugacaga

SEQ ID NO: 2719837 - RNA, 20 nt, Human
agagggagugacagaggcag

SEQ ID NO: 2719838 - RNA, 13 nt, Human
agagguucaaaga

SEQ ID NO: 2719839 - RNA, 22 nt, Human
agaggcugccucucccaucacu

SEQ ID NO: 2719840 - RNA, 17 nt, Human
ugaagauuuaccacuug

SEQ ID NO: 2719841 - RNA, 20 nt, Human
ugaagauuuaccacuugugu

SEQ ID NO: 2719842 - RNA, 15 nt, Human
ugaaguaauaugcac

SEQ ID NO: 2719843 - RNA, 22 nt, Human
ugaaguaauaugcacacauuuu

SEQ ID NO: 2719844 - RNA, 21 nt, Human
ugaaguaauaugcacacauuu

SEQ ID NO: 2719845 - RNA, 20 nt, Human
ugaaguaauaugcacacauu

SEQ ID NO: 2719846 - RNA, 16 nt, Human
ugaaguaauaugcaca

SEQ ID NO: 2719847 - RNA, 13 nt, Human
ugaagucacacag

SEQ ID NO: 2719848 - RNA, 12 nt, Human
ugaauaauacag

SEQ ID NO: 2719849 - RNA, 13 nt, Human
ugaauaauacagu

SEQ ID NO: 2719850 - RNA, 22 nt, Human
ugaagaagcaccaaucaugaau

SEQ ID NO: 2719851 - RNA, 11 nt, Human
ugaacuccugg

SEQ ID NO: 2719852 - RNA, 13 nt, Human
ugaagacagagcu

SEQ ID NO: 2719853 - RNA, 23 nt, Human
ugaagacaaugacuuacuguaca

SEQ ID NO: 2719854 - RNA, 22 nt, Human
ugaagacaaugacuuacuguac

SEQ ID NO: 2719855 - RNA, 21 nt, Human
ugaagacaaugacuuacugua

SEQ ID NO: 2719856 - RNA, 21 nt, Human
ugaaccaccacacccagccca

SEQ ID NO: 2719857 - RNA, 22 nt, Human
ugaaccaccacacccagcccac

SEQ ID NO: 2719858 - RNA, 16 nt, Human
agagcugcccucuccu

SEQ ID NO: 2719859 - RNA, 17 nt, Human
agagcugcccucuccug

SEQ ID NO: 2719860 - RNA, 18 nt, Human
agagcugcccucuccugg

SEQ ID NO: 2719861 - RNA, 19 nt, Human
agagcugcccucuccuggg

SEQ ID NO: 2719862 - RNA, 20 nt, Human
agagcugcccucuccugggc

SEQ ID NO: 2719863 - RNA, 16 nt, Human
agagauugugguuuca

SEQ ID NO: 2719864 - RNA, 23 nt, Human
ugaaauaaacgucuuaaauauuc

SEQ ID NO: 2719865 - RNA, 22 nt, Human
ugaaauaaacgucuuaaauauu

SEQ ID NO: 2719866 - RNA, 18 nt, Human
ugaaauaaacgucuuaaa

SEQ ID NO: 2719867 - RNA, 13 nt, Human
ugaaauaaacguc

SEQ ID NO: 2719868 - RNA, 19 nt, Human
ugaaauuguaauuauaucu

SEQ ID NO: 2719869 - RNA, 16 nt, Human
ugaaauuguaauuaua

SEQ ID NO: 2719870 - RNA, 15 nt, Human
ugaaauuguaauuau

SEQ ID NO: 2719871 - RNA, 14 nt, Human
ugaaauuguaauua

SEQ ID NO: 2719872 - RNA, 13 nt, Human
ugaaauuguaauu

SEQ ID NO: 2719873 - RNA, 19 nt, Human
ugaaauuuuuauuaaauua

SEQ ID NO: 2719874 - RNA, 15 nt, Human
ugaaauuuccuggga

SEQ ID NO: 2719875 - RNA, 20 nt, Human
ugaaauuuuuauuaaauuau

SEQ ID NO: 2719876 - RNA, 21 nt, Human
ugaaauuuccugggagcuuuu

SEQ ID NO: 2719877 - RNA, 17 nt, Human
uguaagaaaauaucacu

SEQ ID NO: 2719878 - RNA, 18 nt, Human
uguaagaaaauaucacuu

SEQ ID NO: 2719879 - RNA, 22 nt, Human
uguaagcucuacugaggugcua

SEQ ID NO: 2719880 - RNA, 13 nt, Human
uguaaggaaugau

SEQ ID NO: 2719881 - RNA, 14 nt, Human
uguaaggaaugauu

SEQ ID NO: 2719882 - RNA, 15 nt, Human
uguaaggaaugauua

SEQ ID NO: 2719883 - RNA, 14 nt, Human
agguggggcagcuu

SEQ ID NO: 2719884 - RNA, 23 nt, Human
agguggggucacucuggcagcuc

SEQ ID NO: 2719885 - RNA, 13 nt, Human
agguggggcagcu

SEQ ID NO: 2719886 - RNA, 23 nt, Human
aggugugaaccaccacacccagc

SEQ ID NO: 2719887 - RNA, 18 nt, Human
aggugugacugaauuucu

SEQ ID NO: 2719888 - RNA, 22 nt, Human
aggugugaaccaccacacccag

SEQ ID NO: 2719889 - RNA, 20 nt, Human
aggugugacugaauuucuuu

SEQ ID NO: 2719890 - RNA, 14 nt, Human
aggugugagucacc

SEQ ID NO: 2719891 - RNA, 20 nt, Human
aggugugagucaccaagccc

SEQ ID NO: 2719892 - RNA, 15 nt, Human
uguacuuaacuauuc

SEQ ID NO: 2719893 - RNA, 20 nt, Human
uguacaugaaaacacauuuu

SEQ ID NO: 2719894 - RNA, 19 nt, Human
uguacaugaaaacacauuu

SEQ ID NO: 2719895 - RNA, 18 nt, Human
uguacaugaaaacacauu

SEQ ID NO: 2719896 - RNA, 17 nt, Human
uguacaugaaaacacau

SEQ ID NO: 2719897 - RNA, 21 nt, Human
uguagaagucacauuccugaa

SEQ ID NO: 2719898 - RNA, 13 nt, Human
uguacaaaguauu

SEQ ID NO: 2719899 - RNA, 14 nt, Human
uguacaaaguauua

SEQ ID NO: 2719900 - RNA, 23 nt, Human
uguacaaaguagaagucuuagau

SEQ ID NO: 2719901 - RNA, 19 nt, Human
uguacaaaguagaagucuu

SEQ ID NO: 2719902 - RNA, 21 nt, Human
uguaauuugugauacaaugcu

SEQ ID NO: 2719903 - RNA, 17 nt, Human
uguaauuugugauacaa

SEQ ID NO: 2719904 - RNA, 18 nt, Human
uguaaggaaugauuaauu

SEQ ID NO: 2719905 - RNA, 16 nt, Human
uguaauuugugauaca

SEQ ID NO: 2719906 - RNA, 15 nt, Human
ugguuucagaaaugu

SEQ ID NO: 2719907 - RNA, 14 nt, Human
ugguuucagaaaug

SEQ ID NO: 2719908 - RNA, 12 nt, Human
ugguuuucuguu

SEQ ID NO: 2719909 - RNA, 21 nt, Human
ugguuuguaaauuaacuuuua

SEQ ID NO: 2719910 - RNA, 10 nt, Human
uguaaauccc

SEQ ID NO: 2719911 - RNA, 21 nt, Human
aggugauccacccaccucagc

SEQ ID NO: 2719912 - RNA, 23 nt, Human
aggugauccacccaccucagccu

SEQ ID NO: 2719913 - RNA, 21 nt, Human
uguaaauacaauuuuguuucu

SEQ ID NO: 2719914 - RNA, 15 nt, Human
ugguuuucuguucuu

SEQ ID NO: 2719915 - RNA, 13 nt, Human
ugguuuucuguuc

SEQ ID NO: 2719916 - RNA, 19 nt, Human
uguaaauacaauuuuguuu

SEQ ID NO: 2719917 - RNA, 18 nt, Human
uguaaauacaauuuuguu

SEQ ID NO: 2719918 - RNA, 17 nt, Human
uguaaauacaauuuugu

SEQ ID NO: 2719919 - RNA, 16 nt, Human
uguaaauacaauuuug

SEQ ID NO: 2719920 - RNA, 12 nt, Human
ugguggcagcug

SEQ ID NO: 2719921 - RNA, 15 nt, Human
ugguggcagagugga

SEQ ID NO: 2719922 - RNA, 12 nt, Human
ugguggcagcuc

SEQ ID NO: 2719923 - RNA, 16 nt, Human
ugguggcagcucaccu

SEQ ID NO: 2719924 - RNA, 19 nt, Human
ugguggcagcucaccucuc

SEQ ID NO: 2719925 - RNA, 20 nt, Human
ugguggcagcucaccucucc

SEQ ID NO: 2719926 - RNA, 23 nt, Human
ugguggcagcucaccucucccuu

SEQ ID NO: 2719927 - RNA, 15 nt, Human
ugguguuuccuggca

SEQ ID NO: 2719928 - RNA, 17 nt, Human
ugguguuuccuggcacu

SEQ ID NO: 2719929 - RNA, 23 nt, Human
ugguucaggguuggccccugccc

SEQ ID NO: 2719930 - RNA, 20 nt, Human
ugguucaggguuggccccug

SEQ ID NO: 2719931 - RNA, 22 nt, Human
ugguucaggguuggccccugcc

SEQ ID NO: 2719932 - RNA, 22 nt, Human
agggugaugggaaagcauugua

SEQ ID NO: 2719933 - RNA, 21 nt, Human
agggugaugggaaagcauugu

SEQ ID NO: 2719934 - RNA, 15 nt, Human
agggugaaaauuauu

SEQ ID NO: 2719935 - RNA, 23 nt, Human
uggguggaugccugguggcagcu

SEQ ID NO: 2719936 - RNA, 14 nt, Human
uggguggaugccug

SEQ ID NO: 2719937 - RNA, 23 nt, Human
uggucaccaaaucagcugcuacu

SEQ ID NO: 2719938 - RNA, 21 nt, Human
uggucaccaaaucagcugcua

SEQ ID NO: 2719939 - RNA, 15 nt, Human
ugguccauagagagc

SEQ ID NO: 2719940 - RNA, 16 nt, Human
ugguccauagagagca

SEQ ID NO: 2719941 - RNA, 16 nt, Human
aggggaauugaggaca

SEQ ID NO: 2719942 - RNA, 16 nt, Human
aggggauagagagaga

SEQ ID NO: 2719943 - RNA, 13 nt, Human
agggggcugggac

SEQ ID NO: 2719944 - RNA, 19 nt, Human
aggguacuaaggaaucuuu

SEQ ID NO: 2719945 - RNA, 16 nt, Human
aggguaucaggugcug

SEQ ID NO: 2719946 - RNA, 22 nt, Human
ugguccaugggccauaugaaaa

SEQ ID NO: 2719947 - RNA, 19 nt, Human
ugguccauagagagcaaga

SEQ ID NO: 2719948 - RNA, 13 nt, Human
uggucccacccca

SEQ ID NO: 2719949 - RNA, 12 nt, Human
uggucuguguga

SEQ ID NO: 2719950 - RNA, 18 nt, Human
uggucugacccacugcuu

SEQ ID NO: 2719951 - RNA, 19 nt, Human
uggugaacagaacaaaagg

SEQ ID NO: 2719952 - RNA, 17 nt, Human
aggguggugaccucugc

SEQ ID NO: 2719953 - RNA, 18 nt, Human
aggguggugaccucugcc

SEQ ID NO: 2719954 - RNA, 19 nt, Human
aggguggugaccucugccu

SEQ ID NO: 2719955 - RNA, 17 nt, Human
aggguuaugauuaagua

SEQ ID NO: 2719956 - RNA, 13 nt, Human
aggguuggccccu

SEQ ID NO: 2719957 - RNA, 14 nt, Human
aggguuggccccug

SEQ ID NO: 2719958 - RNA, 13 nt, Human
aggguugggcugg

SEQ ID NO: 2719959 - RNA, 15 nt, Human
aggguugggcuggug

SEQ ID NO: 2719960 - RNA, 17 nt, Human
aggguugggcugguguc

SEQ ID NO: 2719961 - RNA, 17 nt, Human
agguaugcaaucaaauc

SEQ ID NO: 2719962 - RNA, 15 nt, Human
aggucagugcaaaua

SEQ ID NO: 2719963 - RNA, 21 nt, Human
aggucaaggcugcagugagcc

SEQ ID NO: 2719964 - RNA, 23 nt, Human
aggucauuuuuuuuaagaaaaag

SEQ ID NO: 2719965 - RNA, 22 nt, Human
aggucauuuuuuuuaagaaaaa

SEQ ID NO: 2719966 - RNA, 18 nt, Human
aggucuugaacuccuggc

SEQ ID NO: 2719967 - RNA, 22 nt, Human
aggucuugaacuccuggccuca

SEQ ID NO: 2719968 - RNA, 20 nt, Human
aggucuugaacuccuggccu

SEQ ID NO: 2719969 - RNA, 21 nt, Human
aggucuugaacuccuggccuc

SEQ ID NO: 2719970 - RNA, 16 nt, Human
aggucauauuaauaua

SEQ ID NO: 2719971 - RNA, 19 nt, Human
ugugagcacaaagguagcu

SEQ ID NO: 2719972 - RNA, 14 nt, Human
ugugaagcaaaauu

SEQ ID NO: 2719973 - RNA, 14 nt, Human
ugugaagagaacca

SEQ ID NO: 2719974 - RNA, 11 nt, Human
agugaaaaagg

SEQ ID NO: 2719975 - RNA, 17 nt, Human
agugaaaaaggaggaag

SEQ ID NO: 2719976 - RNA, 20 nt, Human
agugaaaaaggaggaagaga

SEQ ID NO: 2719977 - RNA, 23 nt, Human
agugaaaaaggaggaagagaaaa

SEQ ID NO: 2719978 - RNA, 17 nt, Human
agugaaagaaaauaaca

SEQ ID NO: 2719979 - RNA, 16 nt, Human
agugaaagaggcagcu

SEQ ID NO: 2719980 - RNA, 22 nt, Human
agugaaagaggcagcuugaaac

SEQ ID NO: 2719981 - RNA, 21 nt, Human
agugagacccugucucaaaaa

SEQ ID NO: 2719982 - RNA, 13 nt, Human
agugagacucugu

SEQ ID NO: 2719983 - RNA, 17 nt, Human
agugagacccugucuca

SEQ ID NO: 2719984 - RNA, 22 nt, Human
agugagacucugucucaaaaaa

SEQ ID NO: 2719985 - RNA, 16 nt, Human
agugagacucugucuc

SEQ ID NO: 2719986 - RNA, 17 nt, Human
agugagacucugucuca

SEQ ID NO: 2719987 - RNA, 21 nt, Human
agugagcagucaggaaagaga

SEQ ID NO: 2719988 - RNA, 14 nt, Human
agugagagcugggu

SEQ ID NO: 2719989 - RNA, 15 nt, Human
ugugauggggcccug

SEQ ID NO: 2719990 - RNA, 16 nt, Human
ugugauggggcccugc

SEQ ID NO: 2719991 - RNA, 17 nt, Human
ugugauggggcccugcc

SEQ ID NO: 2719992 - RNA, 16 nt, Human
ugugauguauucuagc

SEQ ID NO: 2719993 - RNA, 14 nt, Human
ugucuucacaacag

SEQ ID NO: 2719994 - RNA, 15 nt, Human
ugucuugcaauggca

SEQ ID NO: 2719995 - RNA, 17 nt, Human
ugucuugcaauggcagc

SEQ ID NO: 2719996 - RNA, 18 nt, Human
ugucuugcaauggcagcc

SEQ ID NO: 2719997 - RNA, 20 nt, Human
ugucuugcaauggcagccuu

SEQ ID NO: 2719998 - RNA, 21 nt, Human
ugucuugcaauggcagccuug

SEQ ID NO: 2719999 - RNA, 21 nt, Human
ugucuugccuuuuucauuauu

SEQ ID NO: 2720000 - RNA, 17 nt, Human
ugucuugccuuuuucau

SEQ ID NO: 2720001 - RNA, 16 nt, Human
ugucuugccuuuuuca

SEQ ID NO: 2720002 - RNA, 15 nt, Human
ugucuugccuuuuuc

SEQ ID NO: 2720003 - RNA, 22 nt, Human
ugugaacaguuguguuugaagc

SEQ ID NO: 2720004 - RNA, 15 nt, Human
ugugaaccaccacac

SEQ ID NO: 2720005 - RNA, 16 nt, Human
ugugaaccaccacacc

SEQ ID NO: 2720006 - RNA, 22 nt, Human
ugugaaccaccacacccagccc

SEQ ID NO: 2720007 - RNA, 23 nt, Human
ugugaaccaccacacccagccca

SEQ ID NO: 2720008 - RNA, 13 nt, Human
ugucucugagagu

SEQ ID NO: 2720009 - RNA, 23 nt, Human
aguccccuguuuguuucugaaag

SEQ ID NO: 2720010 - RNA, 13 nt, Human
agucccugccaau

SEQ ID NO: 2720011 - RNA, 14 nt, Human
agucccugccaaug

SEQ ID NO: 2720012 - RNA, 16 nt, Human
agucccugccaaugga

SEQ ID NO: 2720013 - RNA, 14 nt, Human
ugucuuaauuaaaa

SEQ ID NO: 2720014 - RNA, 22 nt, Human
ugucucuuuaaugucacaggca

SEQ ID NO: 2720015 - RNA, 21 nt, Human
ugucucuuuaaugucacaggc

SEQ ID NO: 2720016 - RNA, 22 nt, Human
ugucucuugguccugcugcagu

SEQ ID NO: 2720017 - RNA, 18 nt, Human
ugucucuugguccugcug

SEQ ID NO: 2720018 - RNA, 19 nt, Human
ugucucuugguccugcugc

SEQ ID NO: 2720019 - RNA, 20 nt, Human
ugucucuugguccugcugca

SEQ ID NO: 2720020 - RNA, 21 nt, Human
ugucucuugguccugcugcag

SEQ ID NO: 2720021 - RNA, 21 nt, Human
aguauuagaauaccacaggaa

SEQ ID NO: 2720022 - RNA, 18 nt, Human
aguauguuagugcaaauu

SEQ ID NO: 2720023 - RNA, 21 nt, Human
aguauguuagugcaaauuguc

SEQ ID NO: 2720024 - RNA, 14 nt, Human
aguauguguaaaau

SEQ ID NO: 2720025 - RNA, 22 nt, Human
aguagcugggacuacaggcacc

SEQ ID NO: 2720026 - RNA, 19 nt, Human
aguagcugggacuacaggc

SEQ ID NO: 2720027 - RNA, 21 nt, Human
aguagcugggacuacaggcac

SEQ ID NO: 2720028 - RNA, 15 nt, Human
aguauuauaccuuuu

SEQ ID NO: 2720029 - RNA, 14 nt, Human
aguauuauaccuuu

SEQ ID NO: 2720030 - RNA, 11 nt, Human
aguauuguaca

SEQ ID NO: 2720031 - RNA, 23 nt, Human
aguauuguacaaaguauuaagca

SEQ ID NO: 2720032 - RNA, 22 nt, Human
aguauuguacaaaguauuaagc

SEQ ID NO: 2720033 - RNA, 20 nt, Human
aguauuguacaaaguauuaa

SEQ ID NO: 2720034 - RNA, 15 nt, Human
aguauuguacaaagu

SEQ ID NO: 2720035 - RNA, 15 nt, Human
ugucagcauagaagu

SEQ ID NO: 2720036 - RNA, 17 nt, Human
agucacugagacagccc

SEQ ID NO: 2720037 - RNA, 15 nt, Human
agucacugagacagc

SEQ ID NO: 2720038 - RNA, 16 nt, Human
agucacugagacagcc

SEQ ID NO: 2720039 - RNA, 15 nt, Human
aguauuguccagguc

SEQ ID NO: 2720040 - RNA, 16 nt, Human
aguauuguccaggucu

SEQ ID NO: 2720041 - RNA, 14 nt, Human
ugucaaagugguga

SEQ ID NO: 2720042 - RNA, 15 nt, Human
ugucaaaguggugag

SEQ ID NO: 2720043 - RNA, 16 nt, Human
ugucaaaguggugaga

SEQ ID NO: 2720044 - RNA, 19 nt, Human
ugucaaaguggugagaggc

SEQ ID NO: 2720045 - RNA, 13 nt, Human
aguagcugggacu

SEQ ID NO: 2720046 - RNA, 14 nt, Human
aguagcugggacua

SEQ ID NO: 2720047 - RNA, 23 nt, Human
agguuuggacaaaauggaauacu

SEQ ID NO: 2720048 - RNA, 12 nt, Human
uguagagccagg

SEQ ID NO: 2720049 - RNA, 15 nt, Human
uguagagccaggguc

SEQ ID NO: 2720050 - RNA, 14 nt, Human
uguauguguaagua

SEQ ID NO: 2720051 - RNA, 15 nt, Human
uguaucccaugagcc

SEQ ID NO: 2720052 - RNA, 13 nt, Human
uguaugugugaag

SEQ ID NO: 2720053 - RNA, 12 nt, Human
uguaugugugaa

SEQ ID NO: 2720054 - RNA, 23 nt, Human
ugucagcuccccucggagaagag

SEQ ID NO: 2720055 - RNA, 21 nt, Human
ugucagcuccccucggagaag

SEQ ID NO: 2720056 - RNA, 20 nt, Human
ugucagcuccccucggagaa

SEQ ID NO: 2720057 - RNA, 16 nt, Human
ugucagccauuccugu

SEQ ID NO: 2720058 - RNA, 12 nt, Human
ugucccuuuucc

SEQ ID NO: 2720059 - RNA, 14 nt, Human
ugucccugcacuug

SEQ ID NO: 2720060 - RNA, 15 nt, Human
ugucuaagauaguaa

SEQ ID NO: 2720061 - RNA, 14 nt, Human
ugucuaagauagua

SEQ ID NO: 2720062 - RNA, 17 nt, Human
agucagaucugccuaag

SEQ ID NO: 2720063 - RNA, 20 nt, Human
agucagaucugccuaaggac

SEQ ID NO: 2720064 - RNA, 22 nt, Human
agucagaucugccuaaggacuu

SEQ ID NO: 2720065 - RNA, 21 nt, Human
agucagaucugccuaaggacu

SEQ ID NO: 2720066 - RNA, 18 nt, Human
ugucuaaauuugaauguu

SEQ ID NO: 2720067 - RNA, 19 nt, Human
agucagggguucccuuuuu

SEQ ID NO: 2720068 - RNA, 23 nt, Human
agucagaucugccuaaggacuuc

SEQ ID NO: 2720069 - RNA, 21 nt, Human
agucagucauucagauaugau

SEQ ID NO: 2720070 - RNA, 15 nt, Human
agucagucauucaga

SEQ ID NO: 2720071 - RNA, 14 nt, Human
aguccccuguuugu

SEQ ID NO: 2720072 - RNA, 19 nt, Human
aguccccuguuuguuucug

SEQ ID NO: 2720073 - RNA, 21 nt, Human
agucccaccuuggcugcaggg

SEQ ID NO: 2720074 - RNA, 23 nt, Human
agucccaccuuggcugcagggag

SEQ ID NO: 2720075 - RNA, 20 nt, Human
agucccaccuuggcugcagg

SEQ ID NO: 2720076 - RNA, 23 nt, Human
uuagaugcaguucugaagaagau

SEQ ID NO: 2720077 - RNA, 22 nt, Human
uuagaugcaguucugaagaaga

SEQ ID NO: 2720078 - RNA, 14 nt, Human
auaaugaauacuuu

SEQ ID NO: 2720079 - RNA, 19 nt, Human
auaauuauaugcuauuucu

SEQ ID NO: 2720080 - RNA, 17 nt, Human
auaauuauaugcuauuu

SEQ ID NO: 2720081 - RNA, 23 nt, Human
auaauuauaugcuauuucuauau

SEQ ID NO: 2720082 - RNA, 21 nt, Human
auaauuauaugcuauuucuau

SEQ ID NO: 2720083 - RNA, 14 nt, Human
auaauucuacuuug

SEQ ID NO: 2720084 - RNA, 21 nt, Human
auaaucuuucacaggggacag

SEQ ID NO: 2720085 - RNA, 20 nt, Human
auaaucagugugucuaaauu

SEQ ID NO: 2720086 - RNA, 19 nt, Human
auaauacaguaucucaggg

SEQ ID NO: 2720087 - RNA, 16 nt, Human
auaauaaggaaaaguu

SEQ ID NO: 2720088 - RNA, 21 nt, Human
auaauacaccacuacauucug

SEQ ID NO: 2720089 - RNA, 23 nt, Human
auaauacaccacuacauucuguu

SEQ ID NO: 2720090 - RNA, 22 nt, Human
auaauaaggaaaaguuuaauau

SEQ ID NO: 2720091 - RNA, 19 nt, Human
auaauaaggaaaaguuuaa

SEQ ID NO: 2720092 - RNA, 18 nt, Human
auaauaaggaaaaguuua

SEQ ID NO: 2720093 - RNA, 17 nt, Human
auaauaaggaaaaguuu

SEQ ID NO: 2720094 - RNA, 22 nt, Human
auaaguuaacuuccaauuuaca

SEQ ID NO: 2720095 - RNA, 21 nt, Human
auaaguucauacauuguacga

SEQ ID NO: 2720096 - RNA, 11 nt, Human
auaaguucaua

SEQ ID NO: 2720097 - RNA, 13 nt, Human
auaaguucauaca

SEQ ID NO: 2720098 - RNA, 14 nt, Human
auaaguucauacau

SEQ ID NO: 2720099 - RNA, 15 nt, Human
auaaguucauacauu

SEQ ID NO: 2720100 - RNA, 23 nt, Human
auaagaaccuuuugagugccuua

SEQ ID NO: 2720101 - RNA, 17 nt, Human
auaaguuaacuuccaau

SEQ ID NO: 2720102 - RNA, 22 nt, Human
auaagaaccuuuugagugccuu

SEQ ID NO: 2720103 - RNA, 12 nt, Human
auaacuggaaac

SEQ ID NO: 2720104 - RNA, 20 nt, Human
auaaccaguguuguggauuu

SEQ ID NO: 2720105 - RNA, 19 nt, Human
auaaaugugccuucauuuu

SEQ ID NO: 2720106 - RNA, 12 nt, Human
auaacugugaag

SEQ ID NO: 2720107 - RNA, 15 nt, Human
uuacaggaaguacug

SEQ ID NO: 2720108 - RNA, 16 nt, Human
uuacaggaaguacugg

SEQ ID NO: 2720109 - RNA, 18 nt, Human
uuacaggaaguacuggag

SEQ ID NO: 2720110 - RNA, 22 nt, Human
uuacaggaaguacuggagaaaa

SEQ ID NO: 2720111 - RNA, 23 nt, Human
uuaccauuuugggguacccacug

SEQ ID NO: 2720112 - RNA, 17 nt, Human
aguuuucugagaaagac

SEQ ID NO: 2720113 - RNA, 14 nt, Human
aguuuucugagaaa

SEQ ID NO: 2720114 - RNA, 13 nt, Human
aguuuucugagaa

SEQ ID NO: 2720115 - RNA, 12 nt, Human
aguuuucugaga

SEQ ID NO: 2720116 - RNA, 16 nt, Human
auaaaccgaacugaug

SEQ ID NO: 2720117 - RNA, 16 nt, Human
auaaaccucaaaaugu

SEQ ID NO: 2720118 - RNA, 18 nt, Human
auaaacgucuuaaauauu

SEQ ID NO: 2720119 - RNA, 16 nt, Human
auaaacgucuuaaaua

SEQ ID NO: 2720120 - RNA, 15 nt, Human
auaaacgucuuaaau

SEQ ID NO: 2720121 - RNA, 15 nt, Human
auaaacuuuaccuuu

SEQ ID NO: 2720122 - RNA, 13 nt, Human
auaaacuuuaccu

SEQ ID NO: 2720123 - RNA, 23 nt, Human
uuauacccagaaaguuauugaua

SEQ ID NO: 2720124 - RNA, 18 nt, Human
uuauacccagaaaguuau

SEQ ID NO: 2720125 - RNA, 19 nt, Human
uuauacccagaaaguuauu

SEQ ID NO: 2720126 - RNA, 23 nt, Human
uuauagaguguacuuaacuauuc

SEQ ID NO: 2720127 - RNA, 18 nt, Human
uuauauaagcuuguauuc

SEQ ID NO: 2720128 - RNA, 13 nt, Human
uuauauaaguauu

SEQ ID NO: 2720129 - RNA, 14 nt, Human
uuauauaaguauuc

SEQ ID NO: 2720130 - RNA, 16 nt, Human
uuauauaaguauucua

SEQ ID NO: 2720131 - RNA, 22 nt, Human
uuauauauauuuuuuucugaaa

SEQ ID NO: 2720132 - RNA, 14 nt, Human
auaauuuuaagaaa

SEQ ID NO: 2720133 - RNA, 15 nt, Human
auaauuuuaagaaau

SEQ ID NO: 2720134 - RNA, 21 nt, Human
auaauuuuaagaaaucaaaga

SEQ ID NO: 2720135 - RNA, 14 nt, Human
auaauuuuuauauu

SEQ ID NO: 2720136 - RNA, 16 nt, Human
auaauuuuuauauuug

SEQ ID NO: 2720137 - RNA, 19 nt, Human
auaauuuuuauauuugaaa

SEQ ID NO: 2720138 - RNA, 13 nt, Human
auaauuuugugaa

SEQ ID NO: 2720139 - RNA, 14 nt, Human
auaauuuugugaag

SEQ ID NO: 2720140 - RNA, 15 nt, Human
auaauuuugugaagc

SEQ ID NO: 2720141 - RNA, 20 nt, Human
auaauuuugugaagcaaaau

SEQ ID NO: 2720142 - RNA, 12 nt, Human
auacaaaagcau

SEQ ID NO: 2720143 - RNA, 15 nt, Human
auacaaaagcaugug

SEQ ID NO: 2720144 - RNA, 13 nt, Human
auacaaaagcaug

SEQ ID NO: 2720145 - RNA, 21 nt, Human
auaauuuuuauauuugaaaua

SEQ ID NO: 2720146 - RNA, 22 nt, Human
auaauuuuuauauuugaaauau

SEQ ID NO: 2720147 - RNA, 22 nt, Human
auaccacaggaaccacaagacu

SEQ ID NO: 2720148 - RNA, 19 nt, Human
auaccagccaguaaauggg

SEQ ID NO: 2720149 - RNA, 17 nt, Human
auaccagccaguaaaug

SEQ ID NO: 2720150 - RNA, 21 nt, Human
auacuaaccagcagaaaugcc

SEQ ID NO: 2720151 - RNA, 20 nt, Human
auacuacaguuuguuaguau

SEQ ID NO: 2720152 - RNA, 16 nt, Human
auacuacaguuuguua

SEQ ID NO: 2720153 - RNA, 15 nt, Human
auacuacaguuuguu

SEQ ID NO: 2720154 - RNA, 13 nt, Human
auacuacaguuug

SEQ ID NO: 2720155 - RNA, 22 nt, Human
uuaucaaagggugaaaauuauu

SEQ ID NO: 2720156 - RNA, 20 nt, Human
auacaucccuuaccugggaa

SEQ ID NO: 2720157 - RNA, 19 nt, Human
auacauauuuuuguagcac

SEQ ID NO: 2720158 - RNA, 14 nt, Human
auacauuguacgaa

SEQ ID NO: 2720159 - RNA, 21 nt, Human
auacauuguacgaagaguauu

SEQ ID NO: 2720160 - RNA, 22 nt, Human
auacauuguacgaagaguauuu

SEQ ID NO: 2720161 - RNA, 16 nt, Human
auacauuugauaaagu

SEQ ID NO: 2720162 - RNA, 21 nt, Human
auacaguucggugagcuacaa

SEQ ID NO: 2720163 - RNA, 21 nt, Human
auacaggucauauuaauauau

SEQ ID NO: 2720164 - RNA, 15 nt, Human
auacaggucauauua

SEQ ID NO: 2720165 - RNA, 14 nt, Human
auacaggaaaagcu

SEQ ID NO: 2720166 - RNA, 19 nt, Human
auacaggaaaagcugcuga

SEQ ID NO: 2720167 - RNA, 20 nt, Human
auacaggaaaagcugcugac

SEQ ID NO: 2720168 - RNA, 20 nt, Human
aguucggugagcuacaaaug

SEQ ID NO: 2720169 - RNA, 14 nt, Human
aguucagagcugcc

SEQ ID NO: 2720170 - RNA, 15 nt, Human
aguucagagcugccc

SEQ ID NO: 2720171 - RNA, 16 nt, Human
aguucagagcugcccu

SEQ ID NO: 2720172 - RNA, 17 nt, Human
aguucagagcugcccuc

SEQ ID NO: 2720173 - RNA, 18 nt, Human
aguucagagcugcccucu

SEQ ID NO: 2720174 - RNA, 21 nt, Human
aguuauuuuuauuuauuuaaa

SEQ ID NO: 2720175 - RNA, 15 nt, Human
aguucuaaauuuugu

SEQ ID NO: 2720176 - RNA, 16 nt, Human
uguugggccaggagcc

SEQ ID NO: 2720177 - RNA, 13 nt, Human
uguugggccagga

SEQ ID NO: 2720178 - RNA, 21 nt, Human
uguuguacucaauuuuaacaa

SEQ ID NO: 2720179 - RNA, 13 nt, Human
uguugucagcuga

SEQ ID NO: 2720180 - RNA, 19 nt, Human
aguuauggcuauaggugcu

SEQ ID NO: 2720181 - RNA, 20 nt, Human
aguuauuauauuuacaaaug

SEQ ID NO: 2720182 - RNA, 23 nt, Human
aguuauugauaaguucauacauu

SEQ ID NO: 2720183 - RNA, 17 nt, Human
aguuauugauaaguuca

SEQ ID NO: 2720184 - RNA, 19 nt, Human
aguuauugauaaguucaua

SEQ ID NO: 2720185 - RNA, 21 nt, Human
aguuauugauaaguucauaca

SEQ ID NO: 2720186 - RNA, 22 nt, Human
aguuauugauaaguucauacau

SEQ ID NO: 2720187 - RNA, 18 nt, Human
aguuacccaaauuaagag

SEQ ID NO: 2720188 - RNA, 17 nt, Human
aguuacccaaauuaaga

SEQ ID NO: 2720189 - RNA, 18 nt, Human
uguucuuuccaaaguaca

SEQ ID NO: 2720190 - RNA, 19 nt, Human
uguucuugguuuguaaauu

SEQ ID NO: 2720191 - RNA, 14 nt, Human
uguucuuuccaaag

SEQ ID NO: 2720192 - RNA, 13 nt, Human
uguucuuuccaaa

SEQ ID NO: 2720193 - RNA, 18 nt, Human
uguucuugguuuguaaau

SEQ ID NO: 2720194 - RNA, 17 nt, Human
uguucuugguuuguaaa

SEQ ID NO: 2720195 - RNA, 14 nt, Human
uguucugggacaca

SEQ ID NO: 2720196 - RNA, 15 nt, Human
uguucugggacacag

SEQ ID NO: 2720197 - RNA, 16 nt, Human
uguucuuaauucuuag

SEQ ID NO: 2720198 - RNA, 14 nt, Human
uguucuuaauucuu

SEQ ID NO: 2720199 - RNA, 12 nt, Human
uguucugggaca

SEQ ID NO: 2720200 - RNA, 13 nt, Human
uguucugggacac

SEQ ID NO: 2720201 - RNA, 23 nt, Human
aguguacauggaauaacauguaa

SEQ ID NO: 2720202 - RNA, 16 nt, Human
aguggugcgaucuggg

SEQ ID NO: 2720203 - RNA, 21 nt, Human
agugguuccuaauccucuagg

SEQ ID NO: 2720204 - RNA, 19 nt, Human
agugggugaauaauacagu

SEQ ID NO: 2720205 - RNA, 22 nt, Human
aguguacauggaauaacaugua

SEQ ID NO: 2720206 - RNA, 21 nt, Human
aguguacauggaauaacaugu

SEQ ID NO: 2720207 - RNA, 18 nt, Human
agugggggaucacagccu

SEQ ID NO: 2720208 - RNA, 13 nt, Human
agugggugaauaa

SEQ ID NO: 2720209 - RNA, 18 nt, Human
agugggugaauaauacag

SEQ ID NO: 2720210 - RNA, 19 nt, Human
agugggggaguggccacag

SEQ ID NO: 2720211 - RNA, 20 nt, Human
agugggggaguggccacaga

SEQ ID NO: 2720212 - RNA, 11 nt, Human
aguggcagcug

SEQ ID NO: 2720213 - RNA, 12 nt, Human
aguggcagcugc

SEQ ID NO: 2720214 - RNA, 13 nt, Human
aguggcagcugcu

SEQ ID NO: 2720215 - RNA, 14 nt, Human
aguggcagcugcuu

SEQ ID NO: 2720216 - RNA, 20 nt, Human
aguggcagcugcuuuugucu

SEQ ID NO: 2720217 - RNA, 15 nt, Human
uuaaaaaagaaacau

SEQ ID NO: 2720218 - RNA, 18 nt, Human
uuaaaaaagaaacauuug

SEQ ID NO: 2720219 - RNA, 20 nt, Human
aguugccagucaccccggcc

SEQ ID NO: 2720220 - RNA, 22 nt, Human
aguugcauagguuuaauaauuu

SEQ ID NO: 2720221 - RNA, 17 nt, Human
uuaaaacaacacucaca

SEQ ID NO: 2720222 - RNA, 18 nt, Human
uuaaaaaguggaaaaaua

SEQ ID NO: 2720223 - RNA, 15 nt, Human
uuaaauaaaucauaa

SEQ ID NO: 2720224 - RNA, 13 nt, Human
uuaaauaaaucau

SEQ ID NO: 2720225 - RNA, 19 nt, Human
uuaaauaaugugaaacugg

SEQ ID NO: 2720226 - RNA, 22 nt, Human
uuaaauaaugugaaacuggauu

SEQ ID NO: 2720227 - RNA, 21 nt, Human
uuaaauaaugugaaacuggau

SEQ ID NO: 2720228 - RNA, 20 nt, Human
uuaaauaaugugaaacugga

SEQ ID NO: 2720229 - RNA, 17 nt, Human
uuaaaccgccaaggcug

SEQ ID NO: 2720230 - RNA, 22 nt, Human
aguuuucacucuuauugcccac

SEQ ID NO: 2720231 - RNA, 13 nt, Human
uuaaauucuugca

SEQ ID NO: 2720232 - RNA, 16 nt, Human
uuaaauucuugcaaag

SEQ ID NO: 2720233 - RNA, 21 nt, Human
aguuucuccaagcaggacaug

SEQ ID NO: 2720234 - RNA, 13 nt, Human
aguuucuccaagc

SEQ ID NO: 2720235 - RNA, 15 nt, Human
aguuucuccaagcag

SEQ ID NO: 2720236 - RNA, 15 nt, Human
aguucugaagaagau

SEQ ID NO: 2720237 - RNA, 13 nt, Human
aguucugaagaag

SEQ ID NO: 2720238 - RNA, 14 nt, Human
aguucugaagaaga

SEQ ID NO: 2720239 - RNA, 14 nt, Human
aguugauagcacag

SEQ ID NO: 2720240 - RNA, 15 nt, Human
aguugauagcacaga

SEQ ID NO: 2720241 - RNA, 19 nt, Human
aguugauagcacagacccu

SEQ ID NO: 2720242 - RNA, 20 nt, Human
aguugauagcacagacccug

SEQ ID NO: 2720243 - RNA, 21 nt, Human
aguugauagcacagacccugc

SEQ ID NO: 2720244 - RNA, 21 nt, Human
aguugauaugccuuuucccaa

SEQ ID NO: 2720245 - RNA, 22 nt, Human
aguugauagcacagacccugcc

SEQ ID NO: 2720246 - RNA, 23 nt, Human
aguugauagcacagacccugccc

SEQ ID NO: 2720247 - RNA, 13 nt, Human
aguugauucagcu

SEQ ID NO: 2720248 - RNA, 23 nt, Human
aguugauucagcucugcaagaau

SEQ ID NO: 2720249 - RNA, 14 nt, Human
aguugauucagcuc

SEQ ID NO: 2720250 - RNA, 15 nt, Human
aguugauucagcucu

SEQ ID NO: 2720251 - RNA, 17 nt, Human
aguugauucagcucugc

SEQ ID NO: 2720252 - RNA, 18 nt, Human
aguugauucagcucugca

SEQ ID NO: 2720253 - RNA, 13 nt, Human
uguuuuauaauuu

SEQ ID NO: 2720254 - RNA, 20 nt, Human
uguuuuauaauuuugugaag

SEQ ID NO: 2720255 - RNA, 15 nt, Human
uguuuucaguguaca

SEQ ID NO: 2720256 - RNA, 17 nt, Human
uguuuucaguguacaug

SEQ ID NO: 2720257 - RNA, 15 nt, Human
uguuuucucuugaga

SEQ ID NO: 2720258 - RNA, 16 nt, Human
aguucucuccuucuuc

SEQ ID NO: 2720259 - RNA, 13 nt, Human
aguucucuccuuc

SEQ ID NO: 2720260 - RNA, 12 nt, Human
aguucucuccuu

SEQ ID NO: 2720261 - RNA, 15 nt, Human
uguuugcuaagcauu

SEQ ID NO: 2720262 - RNA, 16 nt, Human
uguuugccucugccuc

SEQ ID NO: 2720263 - RNA, 14 nt, Human
uguuugccucugcc

SEQ ID NO: 2720264 - RNA, 14 nt, Human
uguugucagcugaa

SEQ ID NO: 2720265 - RNA, 19 nt, Human
uguuugcuaagcauuccaa

SEQ ID NO: 2720266 - RNA, 19 nt, Human
uguuuggggaugagaaagg

SEQ ID NO: 2720267 - RNA, 15 nt, Human
uguuuggggaugaga

SEQ ID NO: 2720268 - RNA, 18 nt, Human
ugccucagaaaacaagga

SEQ ID NO: 2720269 - RNA, 22 nt, Human
ugccucccaucacccgcuaaga

SEQ ID NO: 2720270 - RNA, 16 nt, Human
ugccuccccuccucug

SEQ ID NO: 2720271 - RNA, 16 nt, Human
ugccucucucaggcca

SEQ ID NO: 2720272 - RNA, 17 nt, Human
ugccucucucaggccaa

SEQ ID NO: 2720273 - RNA, 12 nt, Human
ugccuccccucc

SEQ ID NO: 2720274 - RNA, 13 nt, Human
ugccuccccuccu

SEQ ID NO: 2720275 - RNA, 14 nt, Human
ugccuccccuccuc

SEQ ID NO: 2720276 - RNA, 15 nt, Human
ugccuccccuccucu

SEQ ID NO: 2720277 - RNA, 11 nt, Human
ugccuccccuc

SEQ ID NO: 2720278 - RNA, 19 nt, Human
ugcccuuaccugccaggaa

SEQ ID NO: 2720279 - RNA, 20 nt, Human
ugccgcagcccugcagaggg

SEQ ID NO: 2720280 - RNA, 22 nt, Human
ugcccuuaccugccaggaagcc

SEQ ID NO: 2720281 - RNA, 15 nt, Human
ugcccugugggcccc

SEQ ID NO: 2720282 - RNA, 18 nt, Human
ugcccugugggcccccaa

SEQ ID NO: 2720283 - RNA, 15 nt, Human
agcucuucuccaggc

SEQ ID NO: 2720284 - RNA, 16 nt, Human
agcucuucuccaggcu

SEQ ID NO: 2720285 - RNA, 23 nt, Human
ugcccugugaguacuacaguccu

SEQ ID NO: 2720286 - RNA, 21 nt, Human
agcugcccucuccugggcagc

SEQ ID NO: 2720287 - RNA, 10 nt, Human
agcugccugu

SEQ ID NO: 2720288 - RNA, 19 nt, Human
agcugcccucuccugggca

SEQ ID NO: 2720289 - RNA, 20 nt, Human
agcugcccucuccugggcag

SEQ ID NO: 2720290 - RNA, 17 nt, Human
agcugcccucuccuggg

SEQ ID NO: 2720291 - RNA, 18 nt, Human
agcugcccucuccugggc

SEQ ID NO: 2720292 - RNA, 13 nt, Human
agcugccuguuca

SEQ ID NO: 2720293 - RNA, 22 nt, Human
agcugcuuuugucuaugggacu

SEQ ID NO: 2720294 - RNA, 15 nt, Human
agcugggacuacagg

SEQ ID NO: 2720295 - RNA, 23 nt, Human
agcugcuuuugucuaugggacuc

SEQ ID NO: 2720296 - RNA, 24 nt, Human
agcugcuuuugucuaugggacuca

SEQ ID NO: 2720297 - RNA, 12 nt, Human
ugccucugccuc

SEQ ID NO: 2720298 - RNA, 17 nt, Human
ugccugcccaggccccu

SEQ ID NO: 2720299 - RNA, 18 nt, Human
ugccugcccaggccccug

SEQ ID NO: 2720300 - RNA, 19 nt, Human
ugccugcccaggccccugc

SEQ ID NO: 2720301 - RNA, 14 nt, Human
ugccucugacacac

SEQ ID NO: 2720302 - RNA, 16 nt, Human
ugccucugacacacag

SEQ ID NO: 2720303 - RNA, 11 nt, Human
ugccucugccu

SEQ ID NO: 2720304 - RNA, 22 nt, Human
agcuccuucuguccuacucugu

SEQ ID NO: 2720305 - RNA, 23 nt, Human
agcuccuucuguccuacucugug

SEQ ID NO: 2720306 - RNA, 21 nt, Human
agcuccagcucaccagcccca

SEQ ID NO: 2720307 - RNA, 18 nt, Human
agcuccagcucaccagcc

SEQ ID NO: 2720308 - RNA, 19 nt, Human
agcuccagcucaccagccc

SEQ ID NO: 2720309 - RNA, 22 nt, Human
ugcccucuccugggcagcugcc

SEQ ID NO: 2720310 - RNA, 23 nt, Human
ugcccucuccugggcagcugccu

SEQ ID NO: 2720311 - RNA, 16 nt, Human
ugcccucuccugggca

SEQ ID NO: 2720312 - RNA, 17 nt, Human
ugcccucuccugggcag

SEQ ID NO: 2720313 - RNA, 18 nt, Human
ugcccucuccugggcagc

SEQ ID NO: 2720314 - RNA, 20 nt, Human
ugcccucuccugggcagcug

SEQ ID NO: 2720315 - RNA, 13 nt, Human
ugcccucuccugg

SEQ ID NO: 2720316 - RNA, 14 nt, Human
ugcccucuccuggg

SEQ ID NO: 2720317 - RNA, 15 nt, Human
ugcccucuccugggc

SEQ ID NO: 2720318 - RNA, 12 nt, Human
ugcccucuccug

SEQ ID NO: 2720319 - RNA, 13 nt, Human
agcuccagcucac

SEQ ID NO: 2720320 - RNA, 17 nt, Human
agcuccagcucaccagc

SEQ ID NO: 2720321 - RNA, 17 nt, Human
agcuccaagcucccagg

SEQ ID NO: 2720322 - RNA, 18 nt, Human
agcuccaagcucccaggc

SEQ ID NO: 2720323 - RNA, 19 nt, Human
agcuccaagcucccaggca

SEQ ID NO: 2720324 - RNA, 22 nt, Human
ugccauuuaaagcuuauuaaaa

SEQ ID NO: 2720325 - RNA, 16 nt, Human
agcuccaagcucccag

SEQ ID NO: 2720326 - RNA, 18 nt, Human
agcuccaagaauuucuag

SEQ ID NO: 2720327 - RNA, 15 nt, Human
agcuccaagcuccca

SEQ ID NO: 2720328 - RNA, 17 nt, Human
agcucaggugucccugc

SEQ ID NO: 2720329 - RNA, 15 nt, Human
agcuccaagaauuuc

SEQ ID NO: 2720330 - RNA, 19 nt, Human
agcuauucaguaauaacuc

SEQ ID NO: 2720331 - RNA, 12 nt, Human
agcucagggccu

SEQ ID NO: 2720332 - RNA, 13 nt, Human
agcucagggccug

SEQ ID NO: 2720333 - RNA, 14 nt, Human
agcucagggccugg

SEQ ID NO: 2720334 - RNA, 19 nt, Human
agcucagggccuggcucag

SEQ ID NO: 2720335 - RNA, 20 nt, Human
agcucagggccuggcucagg

SEQ ID NO: 2720336 - RNA, 18 nt, Human
agcucagggccuggcuca

SEQ ID NO: 2720337 - RNA, 21 nt, Human
agcuaggccuggccagaugca

SEQ ID NO: 2720338 - RNA, 16 nt, Human
ugccccauucaacauc

SEQ ID NO: 2720339 - RNA, 23 nt, Human
ugccccgaacauguuuuucuucu

SEQ ID NO: 2720340 - RNA, 20 nt, Human
ugcccuaaaguguauuuuuu

SEQ ID NO: 2720341 - RNA, 17 nt, Human
ugcccaaagaugcagcc

SEQ ID NO: 2720342 - RNA, 20 nt, Human
ugcccaaagaugcagccggu

SEQ ID NO: 2720343 - RNA, 13 nt, Human
ugcccagccccuu

SEQ ID NO: 2720344 - RNA, 12 nt, Human
ugcccagccccu

SEQ ID NO: 2720345 - RNA, 16 nt, Human
ugcccagccccuucug

SEQ ID NO: 2720346 - RNA, 17 nt, Human
ugcccagccccuucuga

SEQ ID NO: 2720347 - RNA, 14 nt, Human
ugcccaggccccug

SEQ ID NO: 2720348 - RNA, 15 nt, Human
ugcccaggccccugc

SEQ ID NO: 2720349 - RNA, 17 nt, Human
ugcccaggccccugcca

SEQ ID NO: 2720350 - RNA, 18 nt, Human
ugcccaggccccugccac

SEQ ID NO: 2720351 - RNA, 18 nt, Human
agccuuccagggguggga

SEQ ID NO: 2720352 - RNA, 15 nt, Human
agccuugaacuuuga

SEQ ID NO: 2720353 - RNA, 23 nt, Human
agccuugaccauucuccaccugc

SEQ ID NO: 2720354 - RNA, 22 nt, Human
agcgauucuucugcuucagccu

SEQ ID NO: 2720355 - RNA, 22 nt, Human
agccuugaacuuugaccucugc

SEQ ID NO: 2720356 - RNA, 16 nt, Human
agccuugaacuuugac

SEQ ID NO: 2720357 - RNA, 22 nt, Human
agccuugaccauucuccaccug

SEQ ID NO: 2720358 - RNA, 18 nt, Human
ugcauuugaggucuguuc

SEQ ID NO: 2720359 - RNA, 19 nt, Human
ugcauuugaggucuguucu

SEQ ID NO: 2720360 - RNA, 20 nt, Human
ugcauuuaaaagauacaguu

SEQ ID NO: 2720361 - RNA, 21 nt, Human
ugcauuugaggucuguucuuu

SEQ ID NO: 2720362 - RNA, 20 nt, Human
ugcauuugaggucuguucuu

SEQ ID NO: 2720363 - RNA, 13 nt, Human
agcggcuggcagc

SEQ ID NO: 2720364 - RNA, 18 nt, Human
ugccagcuuaucucaggg

SEQ ID NO: 2720365 - RNA, 22 nt, Human
agcggggacagcuccuucuguc

SEQ ID NO: 2720366 - RNA, 23 nt, Human
agcggcuggcagcccaccccuca

SEQ ID NO: 2720367 - RNA, 19 nt, Human
agcggggacagcuccuucu

SEQ ID NO: 2720368 - RNA, 20 nt, Human
agcggggacagcuccuucug

SEQ ID NO: 2720369 - RNA, 16 nt, Human
agcccuuagcagggaa

SEQ ID NO: 2720370 - RNA, 16 nt, Human
ugcagacucuacagag

SEQ ID NO: 2720371 - RNA, 17 nt, Human
ugcagacucuacagagg

SEQ ID NO: 2720372 - RNA, 21 nt, Human
agcccuuagcagggaaacagc

SEQ ID NO: 2720373 - RNA, 17 nt, Human
agccgagaucacgccac

SEQ ID NO: 2720374 - RNA, 21 nt, Human
agccgagauagccaaggccaa

SEQ ID NO: 2720375 - RNA, 20 nt, Human
agccgagauagccaaggcca

SEQ ID NO: 2720376 - RNA, 22 nt, Human
ugcagacaggcaagcaccuccu

SEQ ID NO: 2720377 - RNA, 19 nt, Human
ugcacuccccugcugggug

SEQ ID NO: 2720378 - RNA, 16 nt, Human
ugcacuccccugcugg

SEQ ID NO: 2720379 - RNA, 17 nt, Human
ugcacuccccugcuggg

SEQ ID NO: 2720380 - RNA, 15 nt, Human
ugcacacauuuuuua

SEQ ID NO: 2720381 - RNA, 13 nt, Human
ugcacacauuuuu

SEQ ID NO: 2720382 - RNA, 12 nt, Human
ugcacacauuuu

SEQ ID NO: 2720383 - RNA, 11 nt, Human
ugcacacauuu

SEQ ID NO: 2720384 - RNA, 18 nt, Human
agccucacaguccuuacc

SEQ ID NO: 2720385 - RNA, 17 nt, Human
agccucacaguccuuac

SEQ ID NO: 2720386 - RNA, 20 nt, Human
agccucaaccuccugggcua

SEQ ID NO: 2720387 - RNA, 19 nt, Human
agccucaaccuccugggcu

SEQ ID NO: 2720388 - RNA, 18 nt, Human
agccgagaucacgccacu

SEQ ID NO: 2720389 - RNA, 22 nt, Human
ugcagccucaaccuccugggcu

SEQ ID NO: 2720390 - RNA, 20 nt, Human
ugcagccucaaccuccuggg

SEQ ID NO: 2720391 - RNA, 21 nt, Human
ugcagccucaaccuccugggc

SEQ ID NO: 2720392 - RNA, 23 nt, Human
agccucugaaaaccaauguucuc

SEQ ID NO: 2720393 - RNA, 14 nt, Human
agcccugguggcag

SEQ ID NO: 2720394 - RNA, 15 nt, Human
agcccugguggcagu

SEQ ID NO: 2720395 - RNA, 16 nt, Human
agcccugguggcagug

SEQ ID NO: 2720396 - RNA, 21 nt, Human
ugcacacaccagagcccaccu

SEQ ID NO: 2720397 - RNA, 17 nt, Human
ugcacacaccagagccc

SEQ ID NO: 2720398 - RNA, 18 nt, Human
ugcacacaccagagccca

SEQ ID NO: 2720399 - RNA, 21 nt, Human
agcccaggccuccuacagcuu

SEQ ID NO: 2720400 - RNA, 16 nt, Human
agccccaaaacucucc

SEQ ID NO: 2720401 - RNA, 17 nt, Human
agccccaaaacucuccu

SEQ ID NO: 2720402 - RNA, 20 nt, Human
agccccauucugccugccca

SEQ ID NO: 2720403 - RNA, 18 nt, Human
agccccaaaacucuccuc

SEQ ID NO: 2720404 - RNA, 21 nt, Human
agccccauucugccugcccag

SEQ ID NO: 2720405 - RNA, 22 nt, Human
agccccauucugccugcccagg

SEQ ID NO: 2720406 - RNA, 21 nt, Human
ugcaaaccaucauugaaaucu

SEQ ID NO: 2720407 - RNA, 18 nt, Human
ugauuuccguuaaaauac

SEQ ID NO: 2720408 - RNA, 22 nt, Human
ugauuuccguuaaaauaccagc

SEQ ID NO: 2720409 - RNA, 16 nt, Human
ugauuucuaugcugag

SEQ ID NO: 2720410 - RNA, 15 nt, Human
ugauuucuaugcuga

SEQ ID NO: 2720411 - RNA, 12 nt, Human
ugauuucuaugc

SEQ ID NO: 2720412 - RNA, 17 nt, Human
ugauuuggggauauuuu

SEQ ID NO: 2720413 - RNA, 22 nt, Human
ugauucccaagcucugcuccuc

SEQ ID NO: 2720414 - RNA, 23 nt, Human
ugauucccaagcucugcuccucu

SEQ ID NO: 2720415 - RNA, 13 nt, Human
ugauucuccugcc

SEQ ID NO: 2720416 - RNA, 21 nt, Human
ugauucauaaugacuuaagca

SEQ ID NO: 2720417 - RNA, 15 nt, Human
ugauucauaaugacu

SEQ ID NO: 2720418 - RNA, 16 nt, Human
ugauucauaaugacuu

SEQ ID NO: 2720419 - RNA, 14 nt, Human
agcccaggaaaggc

SEQ ID NO: 2720420 - RNA, 13 nt, Human
agcccacuucugc

SEQ ID NO: 2720421 - RNA, 14 nt, Human
agcccacuucugcc

SEQ ID NO: 2720422 - RNA, 15 nt, Human
agcccacuucugcca

SEQ ID NO: 2720423 - RNA, 13 nt, Human
agccaguaaaugg

SEQ ID NO: 2720424 - RNA, 21 nt, Human
agccaguaaaugggggugcau

SEQ ID NO: 2720425 - RNA, 19 nt, Human
ugaugggaaagcauuguaa

SEQ ID NO: 2720426 - RNA, 14 nt, Human
ugauggggcccugc

SEQ ID NO: 2720427 - RNA, 15 nt, Human
ugauggggcccugcc

SEQ ID NO: 2720428 - RNA, 16 nt, Human
ugauggggcccugccu

SEQ ID NO: 2720429 - RNA, 19 nt, Human
ugauggggcccugccuccu

SEQ ID NO: 2720430 - RNA, 14 nt, Human
ugaugggaaagcau

SEQ ID NO: 2720431 - RNA, 23 nt, Human
ugaugcuucuucagagacuccug

SEQ ID NO: 2720432 - RNA, 13 nt, Human
ugaugagaggaaa

SEQ ID NO: 2720433 - RNA, 14 nt, Human
ugaugagaggaaau

SEQ ID NO: 2720434 - RNA, 15 nt, Human
ugaugagaggaaauc

SEQ ID NO: 2720435 - RNA, 16 nt, Human
ugaugagaggaaauca

SEQ ID NO: 2720436 - RNA, 11 nt, Human
ugaugaagaag

SEQ ID NO: 2720437 - RNA, 12 nt, Human
ugaugaagaagu

SEQ ID NO: 2720438 - RNA, 22 nt, Human
ugauccucccaccucagccucc

SEQ ID NO: 2720439 - RNA, 16 nt, Human
ugauccucccaccuca

SEQ ID NO: 2720440 - RNA, 21 nt, Human
ugauccucccaccucagccuc

SEQ ID NO: 2720441 - RNA, 15 nt, Human
ugauccucccaccuc

SEQ ID NO: 2720442 - RNA, 16 nt, Human
ugauccuaguuccacc

SEQ ID NO: 2720443 - RNA, 23 nt, Human
ugauuaaguaaugauaacuggaa

SEQ ID NO: 2720444 - RNA, 16 nt, Human
agccacugcaccgggc

SEQ ID NO: 2720445 - RNA, 18 nt, Human
ugauuaaguaaugauaac

SEQ ID NO: 2720446 - RNA, 19 nt, Human
ugauuaaccacuucagcug

SEQ ID NO: 2720447 - RNA, 20 nt, Human
ugauuaaauucuugcaaagu

SEQ ID NO: 2720448 - RNA, 13 nt, Human
ugauggugcaaug

SEQ ID NO: 2720449 - RNA, 19 nt, Human
ugauuaaauucuugcaaag

SEQ ID NO: 2720450 - RNA, 15 nt, Human
ugauggugcaaugac

SEQ ID NO: 2720451 - RNA, 15 nt, Human
agccagcaguucaga

SEQ ID NO: 2720452 - RNA, 17 nt, Human
agccagcaguucagagc

SEQ ID NO: 2720453 - RNA, 19 nt, Human
agccagcaguucagagcug

SEQ ID NO: 2720454 - RNA, 10 nt, Human
agccagagga

SEQ ID NO: 2720455 - RNA, 11 nt, Human
agccagaggag

SEQ ID NO: 2720456 - RNA, 18 nt, Human
agccacugcaccgggcca

SEQ ID NO: 2720457 - RNA, 19 nt, Human
agccacugcaccgggccac

SEQ ID NO: 2720458 - RNA, 22 nt, Human
agccagcaguucagagcugccc

SEQ ID NO: 2720459 - RNA, 20 nt, Human
agccagcaguucagagcugc

SEQ ID NO: 2720460 - RNA, 21 nt, Human
agccagcaguucagagcugcc

SEQ ID NO: 2720461 - RNA, 18 nt, Human
uggaauuggagcucgugg

SEQ ID NO: 2720462 - RNA, 22 nt, Human
uggaauuucucccagucauuua

SEQ ID NO: 2720463 - RNA, 17 nt, Human
aggcaacucaucuuagg

SEQ ID NO: 2720464 - RNA, 19 nt, Human
aggauuuugauccaagcug

SEQ ID NO: 2720465 - RNA, 19 nt, Human
aggaugcccaaagaugcag

SEQ ID NO: 2720466 - RNA, 20 nt, Human
aggaugaucuaggaagacuu

SEQ ID NO: 2720467 - RNA, 14 nt, Human
aggaugcccaaaga

SEQ ID NO: 2720468 - RNA, 18 nt, Human
uggacacagcucuucucc

SEQ ID NO: 2720469 - RNA, 15 nt, Human
uggacacagcucuuc

SEQ ID NO: 2720470 - RNA, 16 nt, Human
uggacacagcucuucu

SEQ ID NO: 2720471 - RNA, 14 nt, Human
uggacccugaggcc

SEQ ID NO: 2720472 - RNA, 12 nt, Human
uggacccugagg

SEQ ID NO: 2720473 - RNA, 13 nt, Human
uggacccugaggc

SEQ ID NO: 2720474 - RNA, 21 nt, Human
aggaucucuugagccugggag

SEQ ID NO: 2720475 - RNA, 22 nt, Human
aggaucucuugagccugggagg

SEQ ID NO: 2720476 - RNA, 17 nt, Human
aggauccugagccagau

SEQ ID NO: 2720477 - RNA, 18 nt, Human
aggauccugagccagauu

SEQ ID NO: 2720478 - RNA, 16 nt, Human
aggaugaucuaggaag

SEQ ID NO: 2720479 - RNA, 17 nt, Human
aggaugaucuaggaaga

SEQ ID NO: 2720480 - RNA, 21 nt, Human
aggauacaaaagcaugugaga

SEQ ID NO: 2720481 - RNA, 15 nt, Human
aggauccugagccag

SEQ ID NO: 2720482 - RNA, 16 nt, Human
aggauccugagccaga

SEQ ID NO: 2720483 - RNA, 23 nt, Human
uggaaaugggcagagcagagacc

SEQ ID NO: 2720484 - RNA, 20 nt, Human
uggaaauauuaagaaagacu

SEQ ID NO: 2720485 - RNA, 16 nt, Human
ugcuugccaucccucc

SEQ ID NO: 2720486 - RNA, 15 nt, Human
ugcuugccaucccuc

SEQ ID NO: 2720487 - RNA, 21 nt, Human
ugcuuggaggaaggaaaccca

SEQ ID NO: 2720488 - RNA, 12 nt, Human
ugcuugggcuuc

SEQ ID NO: 2720489 - RNA, 16 nt, Human
ugcuugggcuucaucc

SEQ ID NO: 2720490 - RNA, 15 nt, Human
uggaaauauuaagaa

SEQ ID NO: 2720491 - RNA, 19 nt, Human
ugcuugggcuucauccucc

SEQ ID NO: 2720492 - RNA, 17 nt, Human
aggacuuguuagaucua

SEQ ID NO: 2720493 - RNA, 23 nt, Human
aggacuuuucuuuguggcuuccu

SEQ ID NO: 2720494 - RNA, 17 nt, Human
aggagauuggaaggaac

SEQ ID NO: 2720495 - RNA, 14 nt, Human
aggagcagccacau

SEQ ID NO: 2720496 - RNA, 22 nt, Human
aggagccccgaggccuucucug

SEQ ID NO: 2720497 - RNA, 16 nt, Human
aggacuuguuagaucu

SEQ ID NO: 2720498 - RNA, 14 nt, Human
aggacuuguuagau

SEQ ID NO: 2720499 - RNA, 20 nt, Human
aggacugaauuaugaaacuu

SEQ ID NO: 2720500 - RNA, 19 nt, Human
aggacugaauuaugaaacu

SEQ ID NO: 2720501 - RNA, 19 nt, Human
aggacauugcggacagcca

SEQ ID NO: 2720502 - RNA, 23 nt, Human
aggacauugcggacagccacggc

SEQ ID NO: 2720503 - RNA, 15 nt, Human
aggacauugcggaca

SEQ ID NO: 2720504 - RNA, 17 nt, Human
aggacauugcggacagc

SEQ ID NO: 2720505 - RNA, 18 nt, Human
aggacauugcggacagcc

SEQ ID NO: 2720506 - RNA, 14 nt, Human
aggacacugauaug

SEQ ID NO: 2720507 - RNA, 23 nt, Human
aggacacuaaccacgcuggaccu

SEQ ID NO: 2720508 - RNA, 19 nt, Human
aggacacuaaccacgcugg

SEQ ID NO: 2720509 - RNA, 23 nt, Human
aggacagcccuucuuuccacaga

SEQ ID NO: 2720510 - RNA, 22 nt, Human
aggacagggaggugaccccagg

SEQ ID NO: 2720511 - RNA, 13 nt, Human
ugcuuauacacuu

SEQ ID NO: 2720512 - RNA, 12 nt, Human
ugcuucaaggau

SEQ ID NO: 2720513 - RNA, 13 nt, Human
ugcuucagccucc

SEQ ID NO: 2720514 - RNA, 14 nt, Human
ugcuucagccuccc

SEQ ID NO: 2720515 - RNA, 16 nt, Human
ugcuucaaggauccug

SEQ ID NO: 2720516 - RNA, 18 nt, Human
ugcuucaaggauccugag

SEQ ID NO: 2720517 - RNA, 19 nt, Human
ugcuucaaggauccugagc

SEQ ID NO: 2720518 - RNA, 15 nt, Human
ugcugcccugugagu

SEQ ID NO: 2720519 - RNA, 12 nt, Human
ugcugcccugug

SEQ ID NO: 2720520 - RNA, 13 nt, Human
ugcugcccuguga

SEQ ID NO: 2720521 - RNA, 14 nt, Human
ugcugcccugugag

SEQ ID NO: 2720522 - RNA, 18 nt, Human
ugcuggcuguuggcuggg

SEQ ID NO: 2720523 - RNA, 16 nt, Human
ugcuggcugguuagag

SEQ ID NO: 2720524 - RNA, 23 nt, Human
ugcuguauuuuaaaagaaugauu

SEQ ID NO: 2720525 - RNA, 11 nt, Human
aggaauuuaaa

SEQ ID NO: 2720526 - RNA, 18 nt, Human
aggaaggaaacccagcuc

SEQ ID NO: 2720527 - RNA, 17 nt, Human
aggaagccagcaggcuc

SEQ ID NO: 2720528 - RNA, 13 nt, Human
aggaagccagcag

SEQ ID NO: 2720529 - RNA, 15 nt, Human
aggaaggagaggaga

SEQ ID NO: 2720530 - RNA, 19 nt, Human
aggaaggaaacccagcucu

SEQ ID NO: 2720531 - RNA, 22 nt, Human
aggaagcacaugccucucucag

SEQ ID NO: 2720532 - RNA, 14 nt, Human
aggaagccagcagg

SEQ ID NO: 2720533 - RNA, 15 nt, Human
aggaagccagcaggc

SEQ ID NO: 2720534 - RNA, 13 nt, Human
aggaagacuuugg

SEQ ID NO: 2720535 - RNA, 14 nt, Human
aggaagacuuugga

SEQ ID NO: 2720536 - RNA, 23 nt, Human
aggaagcacaugccucucucagg

SEQ ID NO: 2720537 - RNA, 24 nt, Human
aggaagcacaugccucucucaggc

SEQ ID NO: 2720538 - RNA, 16 nt, Human
ugcugagucugaaggc

SEQ ID NO: 2720539 - RNA, 17 nt, Human
ugcugagucugaaggcu

SEQ ID NO: 2720540 - RNA, 18 nt, Human
ugcugagucugaaggcug

SEQ ID NO: 2720541 - RNA, 21 nt, Human
ugcugagucugaaggcugggu

SEQ ID NO: 2720542 - RNA, 22 nt, Human
ugcugagucugaaggcuggguu

SEQ ID NO: 2720543 - RNA, 23 nt, Human
ugcugagucugaaggcuggguuc

SEQ ID NO: 2720544 - RNA, 13 nt, Human
aggaagacuucau

SEQ ID NO: 2720545 - RNA, 19 nt, Human
aggaagacuucaucccucu

SEQ ID NO: 2720546 - RNA, 13 nt, Human
ugcuauuucuaua

SEQ ID NO: 2720547 - RNA, 12 nt, Human
ugcuauuucuau

SEQ ID NO: 2720548 - RNA, 20 nt, Human
ugcuauuucuauauuuucau

SEQ ID NO: 2720549 - RNA, 14 nt, Human
ugcuauuucuauau

SEQ ID NO: 2720550 - RNA, 19 nt, Human
agcugggacuacaggcacc

SEQ ID NO: 2720551 - RNA, 16 nt, Human
agcugggacuacaggc

SEQ ID NO: 2720552 - RNA, 18 nt, Human
agcugggacuacaggcac

SEQ ID NO: 2720553 - RNA, 16 nt, Human
ugcuccagcuguucag

SEQ ID NO: 2720554 - RNA, 19 nt, Human
ugcuccagcuguucagcug

SEQ ID NO: 2720555 - RNA, 21 nt, Human
ugcucugcugacagacacagg

SEQ ID NO: 2720556 - RNA, 22 nt, Human
ugcucugcugacagacacaggc

SEQ ID NO: 2720557 - RNA, 16 nt, Human
ugcucugcugacagac

SEQ ID NO: 2720558 - RNA, 15 nt, Human
ugcugagucugaagg

SEQ ID NO: 2720559 - RNA, 14 nt, Human
ugcugagucugaag

SEQ ID NO: 2720560 - RNA, 21 nt, Human
ugggaaagcauuguaaaugug

SEQ ID NO: 2720561 - RNA, 16 nt, Human
ugggaaaggggaaguu

SEQ ID NO: 2720562 - RNA, 23 nt, Human
uggcuucacggaagagccuugcg

SEQ ID NO: 2720563 - RNA, 22 nt, Human
uggcuucacggaagagccuugc

SEQ ID NO: 2720564 - RNA, 13 nt, Human
uggcuguuggcug

SEQ ID NO: 2720565 - RNA, 14 nt, Human
uggcugugucuccc

SEQ ID NO: 2720566 - RNA, 15 nt, Human
uggcuguuggcuggg

SEQ ID NO: 2720567 - RNA, 17 nt, Human
uggcuuaaaacaacacu

SEQ ID NO: 2720568 - RNA, 12 nt, Human
uggcugcaaagg

SEQ ID NO: 2720569 - RNA, 18 nt, Human
uggcucaaguccucuuuu

SEQ ID NO: 2720570 - RNA, 19 nt, Human
uggcucuuccaggcuggga

SEQ ID NO: 2720571 - RNA, 20 nt, Human
uggcucuuccaggcugggag

SEQ ID NO: 2720572 - RNA, 21 nt, Human
uggcucuuccaggcugggaga

SEQ ID NO: 2720573 - RNA, 15 nt, Human
uggcugcagggaguc

SEQ ID NO: 2720574 - RNA, 13 nt, Human
uggcugcagggag

SEQ ID NO: 2720575 - RNA, 14 nt, Human
uggcugcagggagu

SEQ ID NO: 2720576 - RNA, 18 nt, Human
uggcugccaaugggagcu

SEQ ID NO: 2720577 - RNA, 20 nt, Human
uggcugccaaugggagcuca

SEQ ID NO: 2720578 - RNA, 14 nt, Human
uggcuaugcauuug

SEQ ID NO: 2720579 - RNA, 17 nt, Human
uggcuaugcauuugaaa

SEQ ID NO: 2720580 - RNA, 15 nt, Human
uggcuaugcauuuga

SEQ ID NO: 2720581 - RNA, 19 nt, Human
uggcuaugcauuugaaaau

SEQ ID NO: 2720582 - RNA, 22 nt, Human
uggcuauuagagaucaaccccu

SEQ ID NO: 2720583 - RNA, 22 nt, Human
uggcuagagguucaaagauauu

SEQ ID NO: 2720584 - RNA, 14 nt, Human
aggcugggagagcc

SEQ ID NO: 2720585 - RNA, 18 nt, Human
aggcuggcgugcaguggu

SEQ ID NO: 2720586 - RNA, 20 nt, Human
aggcuggcgugcaguggugc

SEQ ID NO: 2720587 - RNA, 13 nt, Human
aggcuggcgugca

SEQ ID NO: 2720588 - RNA, 17 nt, Human
aggcuggcgugcagugg

SEQ ID NO: 2720589 - RNA, 16 nt, Human
aggcucugcccuuggu

SEQ ID NO: 2720590 - RNA, 21 nt, Human
aggcucucaggccagcugcuu

SEQ ID NO: 2720591 - RNA, 12 nt, Human
aggcucugcccu

SEQ ID NO: 2720592 - RNA, 11 nt, Human
aggcucugccc

SEQ ID NO: 2720593 - RNA, 13 nt, Human
aggcucugcccuu

SEQ ID NO: 2720594 - RNA, 14 nt, Human
aggcucugcccuug

SEQ ID NO: 2720595 - RNA, 15 nt, Human
aggcucugcccuugg

SEQ ID NO: 2720596 - RNA, 11 nt, Human
aggcucucagg

SEQ ID NO: 2720597 - RNA, 12 nt, Human
aggcucucaggc

SEQ ID NO: 2720598 - RNA, 14 nt, Human
aggcucucaggcca

SEQ ID NO: 2720599 - RNA, 15 nt, Human
aggcucucaggccag

SEQ ID NO: 2720600 - RNA, 16 nt, Human
aggcucucaggccagc

SEQ ID NO: 2720601 - RNA, 18 nt, Human
aggcucucaggccagcug

SEQ ID NO: 2720602 - RNA, 19 nt, Human
aggcucucaggccagcugc

SEQ ID NO: 2720603 - RNA, 20 nt, Human
aggcucucaggccagcugcu

SEQ ID NO: 2720604 - RNA, 21 nt, Human
aggcucgagcaugccuggaug

SEQ ID NO: 2720605 - RNA, 15 nt, Human
aggcucgagcaugcc

SEQ ID NO: 2720606 - RNA, 17 nt, Human
aggcucgagcaugccug

SEQ ID NO: 2720607 - RNA, 18 nt, Human
aggcucgagcaugccugg

SEQ ID NO: 2720608 - RNA, 19 nt, Human
aggcucgagcaugccugga

SEQ ID NO: 2720609 - RNA, 19 nt, Human
aggcuccuuuagcgcccag

SEQ ID NO: 2720610 - RNA, 12 nt, Human
aggcucgagcau

SEQ ID NO: 2720611 - RNA, 18 nt, Human
uggacgagaaaacaauaa

SEQ ID NO: 2720612 - RNA, 18 nt, Human
aggcauuuguuugaacug

SEQ ID NO: 2720613 - RNA, 16 nt, Human
aggccaaacucaccug

SEQ ID NO: 2720614 - RNA, 18 nt, Human
aggccaaggugggaggau

SEQ ID NO: 2720615 - RNA, 20 nt, Human
aggccaaaggaagcacaugc

SEQ ID NO: 2720616 - RNA, 23 nt, Human
aggccaaaggaagcacaugccuc

SEQ ID NO: 2720617 - RNA, 20 nt, Human
aggccaaacucaccugcccc

SEQ ID NO: 2720618 - RNA, 14 nt, Human
aggccaaaggaagc

SEQ ID NO: 2720619 - RNA, 15 nt, Human
aggccacaagacccu

SEQ ID NO: 2720620 - RNA, 15 nt, Human
uggaugccugguggc

SEQ ID NO: 2720621 - RNA, 20 nt, Human
uggaguucaucuugaauugu

SEQ ID NO: 2720622 - RNA, 16 nt, Human
uggaguucaucuugaa

SEQ ID NO: 2720623 - RNA, 17 nt, Human
uggaguucaucuugaau

SEQ ID NO: 2720624 - RNA, 20 nt, Human
uggaugccugguggcagcug

SEQ ID NO: 2720625 - RNA, 18 nt, Human
uggaugccugguggcagc

SEQ ID NO: 2720626 - RNA, 19 nt, Human
uggaugccugguggcagcu

SEQ ID NO: 2720627 - RNA, 20 nt, Human
uggcacaguuuucugagaaa

SEQ ID NO: 2720628 - RNA, 22 nt, Human
uggauuaaacuuaaucuaaaug

SEQ ID NO: 2720629 - RNA, 12 nt, Human
uggauguucuga

SEQ ID NO: 2720630 - RNA, 22 nt, Human
uggcacaguuuucugagaaaga

SEQ ID NO: 2720631 - RNA, 18 nt, Human
uggcaccagcagccugga

SEQ ID NO: 2720632 - RNA, 20 nt, Human
uggcacaucagcacgauuuc

SEQ ID NO: 2720633 - RNA, 22 nt, Human
uggcagaguugaagacagagcu

SEQ ID NO: 2720634 - RNA, 15 nt, Human
uggcacccggccccu

SEQ ID NO: 2720635 - RNA, 16 nt, Human
uggcacccggccccug

SEQ ID NO: 2720636 - RNA, 21 nt, Human
uggcagaguugaagacagagc

SEQ ID NO: 2720637 - RNA, 12 nt, Human
uggcagccccug

SEQ ID NO: 2720638 - RNA, 20 nt, Human
aggccacaagacccuugugg

SEQ ID NO: 2720639 - RNA, 12 nt, Human
aggccagagaca

SEQ ID NO: 2720640 - RNA, 21 nt, Human
uggccccugcccggcugcgga

SEQ ID NO: 2720641 - RNA, 22 nt, Human
aggccuggccagaugcaccagc

SEQ ID NO: 2720642 - RNA, 23 nt, Human
aggccuggccagaugcaccagcc

SEQ ID NO: 2720643 - RNA, 23 nt, Human
aggccugggggcugggcagagga

SEQ ID NO: 2720644 - RNA, 15 nt, Human
aggccuggccagaug

SEQ ID NO: 2720645 - RNA, 16 nt, Human
aggccuggccagaugc

SEQ ID NO: 2720646 - RNA, 17 nt, Human
aggccuggccagaugca

SEQ ID NO: 2720647 - RNA, 21 nt, Human
aggccuggccagaugcaccag

SEQ ID NO: 2720648 - RNA, 14 nt, Human
uggccucugcacuc

SEQ ID NO: 2720649 - RNA, 15 nt, Human
uggccucugcacucc

SEQ ID NO: 2720650 - RNA, 17 nt, Human
uggccucugcacucccc

SEQ ID NO: 2720651 - RNA, 13 nt, Human
uggccucugcacu

SEQ ID NO: 2720652 - RNA, 15 nt, Human
uggccaggcuggucu

SEQ ID NO: 2720653 - RNA, 17 nt, Human
uggccaggcuggucuca

SEQ ID NO: 2720654 - RNA, 12 nt, Human
uggcaugggaau

SEQ ID NO: 2720655 - RNA, 15 nt, Human
uggcaugggaaugaa

SEQ ID NO: 2720656 - RNA, 15 nt, Human
aggcccucugcccac

SEQ ID NO: 2720657 - RNA, 13 nt, Human
aggcccucugccc

SEQ ID NO: 2720658 - RNA, 14 nt, Human
aggcccucugccca

SEQ ID NO: 2720659 - RNA, 14 nt, Human
auccugagccagau

SEQ ID NO: 2720660 - RNA, 15 nt, Human
auccugagccagauu

SEQ ID NO: 2720661 - RNA, 17 nt, Human
auccugagccagauuuc

SEQ ID NO: 2720662 - RNA, 21 nt, Human
auccugagccagauuucacuc

SEQ ID NO: 2720663 - RNA, 11 nt, Human
auccugagcca

SEQ ID NO: 2720664 - RNA, 12 nt, Human
auccugagccag

SEQ ID NO: 2720665 - RNA, 13 nt, Human
auccugagccaga

SEQ ID NO: 2720666 - RNA, 17 nt, Human
auccucuuugagugaag

SEQ ID NO: 2720667 - RNA, 20 nt, Human
uucuuuugccguuauuaaaa

SEQ ID NO: 2720668 - RNA, 18 nt, Human
auccucuguacagagccc

SEQ ID NO: 2720669 - RNA, 20 nt, Human
auccucuguacagagcccac

SEQ ID NO: 2720670 - RNA, 22 nt, Human
auccuggcacccggccccugcu

SEQ ID NO: 2720671 - RNA, 23 nt, Human
auccuggcacccggccccugcug

SEQ ID NO: 2720672 - RNA, 15 nt, Human
auccuggaguucugg

SEQ ID NO: 2720673 - RNA, 17 nt, Human
auccuggcacccggccc

SEQ ID NO: 2720674 - RNA, 19 nt, Human
auccuggcacccggccccu

SEQ ID NO: 2720675 - RNA, 20 nt, Human
auccuggcacccggccccug

SEQ ID NO: 2720676 - RNA, 21 nt, Human
auccuggcacccggccccugc

SEQ ID NO: 2720677 - RNA, 14 nt, Human
aucgugacaacacu

SEQ ID NO: 2720678 - RNA, 15 nt, Human
aucgugacaacacuu

SEQ ID NO: 2720679 - RNA, 18 nt, Human
aucgucacugcuuaacuu

SEQ ID NO: 2720680 - RNA, 14 nt, Human
aucgucacugcuua

SEQ ID NO: 2720681 - RNA, 19 nt, Human
aucuaaauggaaccacucu

SEQ ID NO: 2720682 - RNA, 15 nt, Human
aucuaaauguugaaa

SEQ ID NO: 2720683 - RNA, 17 nt, Human
uugaaggaaaaugauac

SEQ ID NO: 2720684 - RNA, 19 nt, Human
uugacagggcacaccgggc

SEQ ID NO: 2720685 - RNA, 14 nt, Human
uugacauagucugg

SEQ ID NO: 2720686 - RNA, 17 nt, Human
uugacauagucuggcug

SEQ ID NO: 2720687 - RNA, 18 nt, Human
uugaccauucuccaccug

SEQ ID NO: 2720688 - RNA, 19 nt, Human
uugaccauucuccaccugc

SEQ ID NO: 2720689 - RNA, 14 nt, Human
uugagaguucuaaa

SEQ ID NO: 2720690 - RNA, 24 nt, Human
uugaccauucuccaccugccaggg

SEQ ID NO: 2720691 - RNA, 16 nt, Human
uugauaaguucauaca

SEQ ID NO: 2720692 - RNA, 17 nt, Human
uugauaaguucauacau

SEQ ID NO: 2720693 - RNA, 12 nt, Human
uugauaaaguaa

SEQ ID NO: 2720694 - RNA, 16 nt, Human
uugaggucuguucuuu

SEQ ID NO: 2720695 - RNA, 15 nt, Human
uugaggucuguucuu

SEQ ID NO: 2720696 - RNA, 14 nt, Human
aucccucccuccac

SEQ ID NO: 2720697 - RNA, 16 nt, Human
aucccucccuccaccu

SEQ ID NO: 2720698 - RNA, 17 nt, Human
aucccucccuccaccuc

SEQ ID NO: 2720699 - RNA, 18 nt, Human
aucccucccuccaccucc

SEQ ID NO: 2720700 - RNA, 17 nt, Human
aucccaugagccucagc

SEQ ID NO: 2720701 - RNA, 18 nt, Human
aucccaugagccucagca

SEQ ID NO: 2720702 - RNA, 20 nt, Human
aucccucccuccaccucccu

SEQ ID NO: 2720703 - RNA, 21 nt, Human
aucccucccuccaccucccug

SEQ ID NO: 2720704 - RNA, 17 nt, Human
aucccugaaggccccgc

SEQ ID NO: 2720705 - RNA, 22 nt, Human
aucccugaaggccccgcccagg

SEQ ID NO: 2720706 - RNA, 11 nt, Human
aucccagcccc

SEQ ID NO: 2720707 - RNA, 13 nt, Human
aucccaugagccu

SEQ ID NO: 2720708 - RNA, 16 nt, Human
aucccaugagccucag

SEQ ID NO: 2720709 - RNA, 15 nt, Human
uucugccugcccagg

SEQ ID NO: 2720710 - RNA, 16 nt, Human
uucugccugcccaggc

SEQ ID NO: 2720711 - RNA, 17 nt, Human
auccagguucagcuugu

SEQ ID NO: 2720712 - RNA, 15 nt, Human
auccaguaucuugaa

SEQ ID NO: 2720713 - RNA, 14 nt, Human
auccaguaucuuga

SEQ ID NO: 2720714 - RNA, 16 nt, Human
uucuguuuuauaauuu

SEQ ID NO: 2720715 - RNA, 17 nt, Human
uucuguuuuauaauuuu

SEQ ID NO: 2720716 - RNA, 21 nt, Human
uucuguuggccagugugacaa

SEQ ID NO: 2720717 - RNA, 18 nt, Human
uucuguuuagauaauaca

SEQ ID NO: 2720718 - RNA, 13 nt, Human
uucuguuuagaua

SEQ ID NO: 2720719 - RNA, 13 nt, Human
uucuuaaaguuga

SEQ ID NO: 2720720 - RNA, 22 nt, Human
uucuucuccacuuucuagccag

SEQ ID NO: 2720721 - RNA, 12 nt, Human
uucuuucuggcu

SEQ ID NO: 2720722 - RNA, 20 nt, Human
uucuuucuggcuaugcauuu

SEQ ID NO: 2720723 - RNA, 17 nt, Human
uucuuucuggcuaugca

SEQ ID NO: 2720724 - RNA, 15 nt, Human
aucaggugcugccau

SEQ ID NO: 2720725 - RNA, 17 nt, Human
aucaggugcugccaucc

SEQ ID NO: 2720726 - RNA, 19 nt, Human
aucaggugcugccauccag

SEQ ID NO: 2720727 - RNA, 23 nt, Human
aucagugugucuaaauuugaaug

SEQ ID NO: 2720728 - RNA, 14 nt, Human
aucaggugcugcca

SEQ ID NO: 2720729 - RNA, 19 nt, Human
aucagucugauucccaagc

SEQ ID NO: 2720730 - RNA, 23 nt, Human
aucauaguggcuuaaaacaacac

SEQ ID NO: 2720731 - RNA, 15 nt, Human
aucauaaaacuugau

SEQ ID NO: 2720732 - RNA, 16 nt, Human
aucauuaggugugacu

SEQ ID NO: 2720733 - RNA, 21 nt, Human
aucauccacugugccaugugc

SEQ ID NO: 2720734 - RNA, 23 nt, Human
aucauccacugugccaugugcca

SEQ ID NO: 2720735 - RNA, 21 nt, Human
uucucuaguuugauuaaauuc

SEQ ID NO: 2720736 - RNA, 19 nt, Human
uucugcagccacuauuguu

SEQ ID NO: 2720737 - RNA, 13 nt, Human
aucauugaaaucu

SEQ ID NO: 2720738 - RNA, 12 nt, Human
aucauugaaauc

SEQ ID NO: 2720739 - RNA, 14 nt, Human
aucaauuuuucuua

SEQ ID NO: 2720740 - RNA, 15 nt, Human
aucacgccacugcac

SEQ ID NO: 2720741 - RNA, 17 nt, Human
aucacgccacugcacua

SEQ ID NO: 2720742 - RNA, 14 nt, Human
aucacgccacugca

SEQ ID NO: 2720743 - RNA, 21 nt, Human
aucaaggguacacugccuucu

SEQ ID NO: 2720744 - RNA, 18 nt, Human
aucaaauaugcaaagcac

SEQ ID NO: 2720745 - RNA, 17 nt, Human
aucaaauaugcaaagca

SEQ ID NO: 2720746 - RNA, 16 nt, Human
aucaaauaugcaaagc

SEQ ID NO: 2720747 - RNA, 16 nt, Human
aucaaggguacacugc

SEQ ID NO: 2720748 - RNA, 21 nt, Human
aucaacugcaucaagauguga

SEQ ID NO: 2720749 - RNA, 15 nt, Human
aucaaauaugcaaag

SEQ ID NO: 2720750 - RNA, 15 nt, Human
auauuuuuguagcac

SEQ ID NO: 2720751 - RNA, 16 nt, Human
auauuuuuguagcacu

SEQ ID NO: 2720752 - RNA, 23 nt, Human
auauuuuuguagcacugacagau

SEQ ID NO: 2720753 - RNA, 18 nt, Human
auauuuuucacauaucua

SEQ ID NO: 2720754 - RNA, 20 nt, Human
uuccuggcacugcuuccagu

SEQ ID NO: 2720755 - RNA, 22 nt, Human
uuccuggcacugcuuccaguga

SEQ ID NO: 2720756 - RNA, 22 nt, Human
uuccucuuuuuauuuaguuccu

SEQ ID NO: 2720757 - RNA, 12 nt, Human
uuccugaacagg

SEQ ID NO: 2720758 - RNA, 19 nt, Human
uuccuggcacugcuuccag

SEQ ID NO: 2720759 - RNA, 13 nt, Human
auauuuacaaaug

SEQ ID NO: 2720760 - RNA, 12 nt, Human
auauuuaaugau

SEQ ID NO: 2720761 - RNA, 13 nt, Human
auauuuaaugaua

SEQ ID NO: 2720762 - RNA, 23 nt, Human
auauuuaaugauaaguaaaugcu

SEQ ID NO: 2720763 - RNA, 14 nt, Human
auauuguuugcuaa

SEQ ID NO: 2720764 - RNA, 13 nt, Human
auauuguuuucag

SEQ ID NO: 2720765 - RNA, 15 nt, Human
auauugauaugcuua

SEQ ID NO: 2720766 - RNA, 18 nt, Human
auauucucacagcuccaa

SEQ ID NO: 2720767 - RNA, 22 nt, Human
auauugcugauggugcaaugac

SEQ ID NO: 2720768 - RNA, 13 nt, Human
auauguuucaaac

SEQ ID NO: 2720769 - RNA, 14 nt, Human
auauguuucaaacu

SEQ ID NO: 2720770 - RNA, 16 nt, Human
auauguuucaaacuuu

SEQ ID NO: 2720771 - RNA, 17 nt, Human
auauuaccacagacaua

SEQ ID NO: 2720772 - RNA, 12 nt, Human
auauuaaagcca

SEQ ID NO: 2720773 - RNA, 22 nt, Human
auauuaagaaagacuaucuaaa

SEQ ID NO: 2720774 - RNA, 17 nt, Human
auauuaagaaagacuau

SEQ ID NO: 2720775 - RNA, 15 nt, Human
auauuaagaaagacu

SEQ ID NO: 2720776 - RNA, 16 nt, Human
auauuaagaaagacua

SEQ ID NO: 2720777 - RNA, 17 nt, Human
uucccagugaauucuug

SEQ ID NO: 2720778 - RNA, 15 nt, Human
uuccagugaggcucu

SEQ ID NO: 2720779 - RNA, 16 nt, Human
uuccagugaggcucug

SEQ ID NO: 2720780 - RNA, 17 nt, Human
uucagcgguuuauauaa

SEQ ID NO: 2720781 - RNA, 19 nt, Human
uucagcaaaaauauuuuau

SEQ ID NO: 2720782 - RNA, 14 nt, Human
uucaggguuggccc

SEQ ID NO: 2720783 - RNA, 16 nt, Human
uucaggguuggccccu

SEQ ID NO: 2720784 - RNA, 17 nt, Human
uucaggguuggccccug

SEQ ID NO: 2720785 - RNA, 19 nt, Human
uucaggguuggccccugcc

SEQ ID NO: 2720786 - RNA, 22 nt, Human
uucaggguuggccccugcccgg

SEQ ID NO: 2720787 - RNA, 15 nt, Human
uucagguaacaggca

SEQ ID NO: 2720788 - RNA, 16 nt, Human
uucagguaacaggcag

SEQ ID NO: 2720789 - RNA, 16 nt, Human
uucagaaauguguuau

SEQ ID NO: 2720790 - RNA, 16 nt, Human
uucagauaugauucaa

SEQ ID NO: 2720791 - RNA, 18 nt, Human
uucagauaugauucaaau

SEQ ID NO: 2720792 - RNA, 17 nt, Human
uucagauaugauucaaa

SEQ ID NO: 2720793 - RNA, 19 nt, Human
uucagauaugauucaaaug

SEQ ID NO: 2720794 - RNA, 17 nt, Human
uucagcaaaaauauuuu

SEQ ID NO: 2720795 - RNA, 13 nt, Human
auauaugcuaagu

SEQ ID NO: 2720796 - RNA, 16 nt, Human
auauauuuaaugauaa

SEQ ID NO: 2720797 - RNA, 21 nt, Human
auauauguuuuaagaggcagg

SEQ ID NO: 2720798 - RNA, 22 nt, Human
auauauguuuuaagaggcaggg

SEQ ID NO: 2720799 - RNA, 17 nt, Human
uucagguaacaggcaga

SEQ ID NO: 2720800 - RNA, 14 nt, Human
uucaguaagccgug

SEQ ID NO: 2720801 - RNA, 20 nt, Human
auauguggaguucaucuuga

SEQ ID NO: 2720802 - RNA, 21 nt, Human
auauguggaguucaucuugaa

SEQ ID NO: 2720803 - RNA, 22 nt, Human
uucaugcuguucaugaaagauu

SEQ ID NO: 2720804 - RNA, 20 nt, Human
uucaugcuguucaugaaaga

SEQ ID NO: 2720805 - RNA, 20 nt, Human
uucauggaacgcguugaaau

SEQ ID NO: 2720806 - RNA, 19 nt, Human
uucauggaacgcguugaaa

SEQ ID NO: 2720807 - RNA, 22 nt, Human
uucauggaacgcguugaaauug

SEQ ID NO: 2720808 - RNA, 21 nt, Human
uucauggaacgcguugaaauu

SEQ ID NO: 2720809 - RNA, 14 nt, Human
auaugcaaagcacu

SEQ ID NO: 2720810 - RNA, 13 nt, Human
auaugcaaagcac

SEQ ID NO: 2720811 - RNA, 22 nt, Human
auaugagcuuccuucugugaaa

SEQ ID NO: 2720812 - RNA, 21 nt, Human
auaugagcuuccuucugugaa

SEQ ID NO: 2720813 - RNA, 13 nt, Human
auauauuuuuaua

SEQ ID NO: 2720814 - RNA, 14 nt, Human
uucauuaucucaaa

SEQ ID NO: 2720815 - RNA, 22 nt, Human
uucauuauuuuauuaugaaacu

SEQ ID NO: 2720816 - RNA, 22 nt, Human
uuccaauuuacauacucugcuu

SEQ ID NO: 2720817 - RNA, 21 nt, Human
uuccacaagagcccaggccuc

SEQ ID NO: 2720818 - RNA, 17 nt, Human
uuccaggcugggagagc

SEQ ID NO: 2720819 - RNA, 13 nt, Human
uuccaggcuggga

SEQ ID NO: 2720820 - RNA, 15 nt, Human
uuccaggcugggaga

SEQ ID NO: 2720821 - RNA, 18 nt, Human
uuccagguuuaagcuguu

SEQ ID NO: 2720822 - RNA, 17 nt, Human
uuccagguuuaagcugu

SEQ ID NO: 2720823 - RNA, 22 nt, Human
augggacauuugcucauggaau

SEQ ID NO: 2720824 - RNA, 21 nt, Human
augggacauuugcucauggaa

SEQ ID NO: 2720825 - RNA, 21 nt, Human
auggcuauaggugcuacaaaa

SEQ ID NO: 2720826 - RNA, 19 nt, Human
auggcuauaggugcuacaa

SEQ ID NO: 2720827 - RNA, 16 nt, Human
auggcuauaggugcua

SEQ ID NO: 2720828 - RNA, 18 nt, Human
auggccucuucagaucuc

SEQ ID NO: 2720829 - RNA, 17 nt, Human
auggaauuucucccagu

SEQ ID NO: 2720830 - RNA, 19 nt, Human
auggacaugaucuucuuua

SEQ ID NO: 2720831 - RNA, 21 nt, Human
auggacccaauauuuaccaga

SEQ ID NO: 2720832 - RNA, 13 nt, Human
augggagcucaug

SEQ ID NO: 2720833 - RNA, 18 nt, Human
augggcaacccccagccu

SEQ ID NO: 2720834 - RNA, 19 nt, Human
augggcaacccccagccug

SEQ ID NO: 2720835 - RNA, 21 nt, Human
augggcaacccccagccugcu

SEQ ID NO: 2720836 - RNA, 15 nt, Human
augggccuccugugu

SEQ ID NO: 2720837 - RNA, 15 nt, Human
augggcagagcagag

SEQ ID NO: 2720838 - RNA, 13 nt, Human
augggcagagcag

SEQ ID NO: 2720839 - RNA, 14 nt, Human
augggcagagcaga

SEQ ID NO: 2720840 - RNA, 17 nt, Human
augggccuccugugugu

SEQ ID NO: 2720841 - RNA, 12 nt, Human
uuuccugugucu

SEQ ID NO: 2720842 - RNA, 11 nt, Human
uuuccuucagu

SEQ ID NO: 2720843 - RNA, 12 nt, Human
uuuccuucagug

SEQ ID NO: 2720844 - RNA, 15 nt, Human
uuuccuucagugccu

SEQ ID NO: 2720845 - RNA, 23 nt, Human
uuuccuucauucaacccaccugc

SEQ ID NO: 2720846 - RNA, 21 nt, Human
uuuccuucauucaacccaccu

SEQ ID NO: 2720847 - RNA, 22 nt, Human
uuuccuucagugccuuauggaa

SEQ ID NO: 2720848 - RNA, 18 nt, Human
uuuccuucagugccuuau

SEQ ID NO: 2720849 - RNA, 21 nt, Human
uuuccuucagugccuuaugga

SEQ ID NO: 2720850 - RNA, 22 nt, Human
uuucgcaggauucuuccucccu

SEQ ID NO: 2720851 - RNA, 18 nt, Human
uuucgcaggauucuuccu

SEQ ID NO: 2720852 - RNA, 14 nt, Human
uuugaaauauugac

SEQ ID NO: 2720853 - RNA, 23 nt, Human
augggcuggguucuacccaggug

SEQ ID NO: 2720854 - RNA, 14 nt, Human
auggggcccugccu

SEQ ID NO: 2720855 - RNA, 13 nt, Human
auggggcccugcc

SEQ ID NO: 2720856 - RNA, 13 nt, Human
uuucuuuguggcu

SEQ ID NO: 2720857 - RNA, 14 nt, Human
uuucugcaucagcu

SEQ ID NO: 2720858 - RNA, 14 nt, Human
uuucugccgcagcc

SEQ ID NO: 2720859 - RNA, 16 nt, Human
uuucugccgcagcccu

SEQ ID NO: 2720860 - RNA, 14 nt, Human
uuucuaugaaauau

SEQ ID NO: 2720861 - RNA, 20 nt, Human
uuucuaugaaauauuauguu

SEQ ID NO: 2720862 - RNA, 13 nt, Human
uuucuaugaaaua

SEQ ID NO: 2720863 - RNA, 21 nt, Human
uuucuaugcugaguuugugcu

SEQ ID NO: 2720864 - RNA, 21 nt, Human
uuucuaugacacaugcaaggu

SEQ ID NO: 2720865 - RNA, 15 nt, Human
uuucuaugacacaug

SEQ ID NO: 2720866 - RNA, 17 nt, Human
uuucuaggacugaauua

SEQ ID NO: 2720867 - RNA, 21 nt, Human
uuucuaggacugaauuaugaa

SEQ ID NO: 2720868 - RNA, 22 nt, Human
uuucuaggacugaauuaugaaa

SEQ ID NO: 2720869 - RNA, 13 nt, Human
uuucuauauuuuc

SEQ ID NO: 2720870 - RNA, 18 nt, Human
uuucuauauuuucauucu

SEQ ID NO: 2720871 - RNA, 15 nt, Human
uuucuauauuuucau

SEQ ID NO: 2720872 - RNA, 24 nt, Human
uuuaaagcuuauuaaaacucauuu

SEQ ID NO: 2720873 - RNA, 16 nt, Human
uuuaaagcuuccauug

SEQ ID NO: 2720874 - RNA, 17 nt, Human
augcuacacacugcaug

SEQ ID NO: 2720875 - RNA, 18 nt, Human
augcuacacacugcaugu

SEQ ID NO: 2720876 - RNA, 14 nt, Human
uuuaccuuuuuuau

SEQ ID NO: 2720877 - RNA, 20 nt, Human
uuuaccuuuuuuauacauaa

SEQ ID NO: 2720878 - RNA, 19 nt, Human
uuuaccuuuuuuauacaua

SEQ ID NO: 2720879 - RNA, 15 nt, Human
uuuacuaaaauggac

SEQ ID NO: 2720880 - RNA, 17 nt, Human
uuuacuaaaauggacug

SEQ ID NO: 2720881 - RNA, 21 nt, Human
uuuaccuuuuuuauacauaaa

SEQ ID NO: 2720882 - RNA, 18 nt, Human
uuuacuaauagacaauuu

SEQ ID NO: 2720883 - RNA, 17 nt, Human
uuuacuaauagacaauu

SEQ ID NO: 2720884 - RNA, 14 nt, Human
uuuacuaauagaca

SEQ ID NO: 2720885 - RNA, 16 nt, Human
uuuauuacuguaagaa

SEQ ID NO: 2720886 - RNA, 19 nt, Human
uuuauuaaaugcccagccc

SEQ ID NO: 2720887 - RNA, 17 nt, Human
uuuauaugcuucuguuu

SEQ ID NO: 2720888 - RNA, 15 nt, Human
uuuagauaauacacc

SEQ ID NO: 2720889 - RNA, 13 nt, Human
uuuagauaauaca

SEQ ID NO: 2720890 - RNA, 18 nt, Human
uuuagaguugauacuaca

SEQ ID NO: 2720891 - RNA, 23 nt, Human
auggaauuggagcucgugggaca

SEQ ID NO: 2720892 - RNA, 19 nt, Human
uuuccagguuuaagcuguu

SEQ ID NO: 2720893 - RNA, 15 nt, Human
uuucauaugcuguau

SEQ ID NO: 2720894 - RNA, 14 nt, Human
uuucacucuccuug

SEQ ID NO: 2720895 - RNA, 22 nt, Human
uuucagaaaauauuauguguuu

SEQ ID NO: 2720896 - RNA, 24 nt, Human
uuucacucuuauugcccacgcugg

SEQ ID NO: 2720897 - RNA, 15 nt, Human
uuucacucuccuugg

SEQ ID NO: 2720898 - RNA, 14 nt, Human
augcuguauuuuaa

SEQ ID NO: 2720899 - RNA, 23 nt, Human
augcugucuacacuaagagagaa

SEQ ID NO: 2720900 - RNA, 19 nt, Human
augcugugcccuaaagugu

SEQ ID NO: 2720901 - RNA, 19 nt, Human
uuuauuacuguaagaaaau

SEQ ID NO: 2720902 - RNA, 13 nt, Human
uuuauuaugaaac

SEQ ID NO: 2720903 - RNA, 22 nt, Human
augcuggcuguuggcugggggc

SEQ ID NO: 2720904 - RNA, 21 nt, Human
uuuauuaugaaacuuguguaa

SEQ ID NO: 2720905 - RNA, 19 nt, Human
augcuguauauccuuucua

SEQ ID NO: 2720906 - RNA, 16 nt, Human
uuuauuuuaauaaugu

SEQ ID NO: 2720907 - RNA, 15 nt, Human
auggaauaacaugua

SEQ ID NO: 2720908 - RNA, 14 nt, Human
auggaauaacaugu

SEQ ID NO: 2720909 - RNA, 16 nt, Human
auggaacauaaaauac

SEQ ID NO: 2720910 - RNA, 21 nt, Human
auggaaguacuauaauuuacc

SEQ ID NO: 2720911 - RNA, 18 nt, Human
auggaacacucugagacu

SEQ ID NO: 2720912 - RNA, 17 nt, Human
auggaacacucugagac

SEQ ID NO: 2720913 - RNA, 14 nt, Human
augauaacuggaaa

SEQ ID NO: 2720914 - RNA, 18 nt, Human
uugucacacacuuuggcu

SEQ ID NO: 2720915 - RNA, 15 nt, Human
augauaaaacacaaa

SEQ ID NO: 2720916 - RNA, 17 nt, Human
augagccucagcauccu

SEQ ID NO: 2720917 - RNA, 18 nt, Human
augagccucagcauccug

SEQ ID NO: 2720918 - RNA, 15 nt, Human
augagcaucaggcca

SEQ ID NO: 2720919 - RNA, 16 nt, Human
augagcaucaggccag

SEQ ID NO: 2720920 - RNA, 17 nt, Human
augagcaucaggccagg

SEQ ID NO: 2720921 - RNA, 18 nt, Human
augagcaucaggccaggc

SEQ ID NO: 2720922 - RNA, 19 nt, Human
augagcaucaggccaggcc

SEQ ID NO: 2720923 - RNA, 20 nt, Human
augagcaucaggccaggccc

SEQ ID NO: 2720924 - RNA, 21 nt, Human
augagcaucaggccaggcccu

SEQ ID NO: 2720925 - RNA, 22 nt, Human
augagcaucaggccaggcccuc

SEQ ID NO: 2720926 - RNA, 12 nt, Human
augagccucagc

SEQ ID NO: 2720927 - RNA, 15 nt, Human
augagccucagcauc

SEQ ID NO: 2720928 - RNA, 16 nt, Human
augagccucagcaucc

SEQ ID NO: 2720929 - RNA, 16 nt, Human
augagaggaaaucacc

SEQ ID NO: 2720930 - RNA, 14 nt, Human
augagaggaaauca

SEQ ID NO: 2720931 - RNA, 15 nt, Human
augagaggaaaucac

SEQ ID NO: 2720932 - RNA, 12 nt, Human
augagaggaaau

SEQ ID NO: 2720933 - RNA, 13 nt, Human
augagaggaaauc

SEQ ID NO: 2720934 - RNA, 19 nt, Human
augacauaaaaacaacuuu

SEQ ID NO: 2720935 - RNA, 18 nt, Human
uugugaagcaaaauuuuu

SEQ ID NO: 2720936 - RNA, 18 nt, Human
augaucacggcucacugc

SEQ ID NO: 2720937 - RNA, 19 nt, Human
augaucacggcucacugca

SEQ ID NO: 2720938 - RNA, 15 nt, Human
augaucacggcucac

SEQ ID NO: 2720939 - RNA, 23 nt, Human
augaucacggcucacugcagccu

SEQ ID NO: 2720940 - RNA, 16 nt, Human
augauccuaggcauuu

SEQ ID NO: 2720941 - RNA, 14 nt, Human
augaucuucuuuau

SEQ ID NO: 2720942 - RNA, 20 nt, Human
uuuaaaaaagaaacauuugg

SEQ ID NO: 2720943 - RNA, 17 nt, Human
uuuaaaaaaaaaauugg

SEQ ID NO: 2720944 - RNA, 19 nt, Human
augcaccuggaauauauaa

SEQ ID NO: 2720945 - RNA, 18 nt, Human
augaucuucuuuauaauu

SEQ ID NO: 2720946 - RNA, 15 nt, Human
augaucuucuuuaua

SEQ ID NO: 2720947 - RNA, 16 nt, Human
augcaaaccaucauug

SEQ ID NO: 2720948 - RNA, 18 nt, Human
augcaaaccaucauugaa

SEQ ID NO: 2720949 - RNA, 19 nt, Human
augcaaaccaucauugaaa

SEQ ID NO: 2720950 - RNA, 20 nt, Human
augcaaaccaucauugaaau

SEQ ID NO: 2720951 - RNA, 21 nt, Human
augcaaaccaucauugaaauc

SEQ ID NO: 2720952 - RNA, 22 nt, Human
augcaaaccaucauugaaaucu

SEQ ID NO: 2720953 - RNA, 22 nt, Human
augcaaggucauuuuuuuuaag

SEQ ID NO: 2720954 - RNA, 14 nt, Human
augcaccuggaaua

SEQ ID NO: 2720955 - RNA, 16 nt, Human
augcaccuggaauaua

SEQ ID NO: 2720956 - RNA, 16 nt, Human
augcaaggucauuuuu

SEQ ID NO: 2720957 - RNA, 14 nt, Human
augcaaggucauuu

SEQ ID NO: 2720958 - RNA, 18 nt, Human
augaauuacauuuguaua

SEQ ID NO: 2720959 - RNA, 19 nt, Human
augaauuacauuuguauaa

SEQ ID NO: 2720960 - RNA, 17 nt, Human
augaauuacauuuguau

SEQ ID NO: 2720961 - RNA, 20 nt, Human
augaaccacaucuugcucug

SEQ ID NO: 2720962 - RNA, 13 nt, Human
augaaccacaucu

SEQ ID NO: 2720963 - RNA, 17 nt, Human
uugggguacccacugcu

SEQ ID NO: 2720964 - RNA, 19 nt, Human
uuggggaagaacgaagcca

SEQ ID NO: 2720965 - RNA, 22 nt, Human
uugggguacccacugcucuggu

SEQ ID NO: 2720966 - RNA, 19 nt, Human
uugguuaggcauuguggga

SEQ ID NO: 2720967 - RNA, 14 nt, Human
uuguaaggaaugau

SEQ ID NO: 2720968 - RNA, 19 nt, Human
uuguauaaaauaauuuuua

SEQ ID NO: 2720969 - RNA, 13 nt, Human
uuguauaaaauaa

SEQ ID NO: 2720970 - RNA, 23 nt, Human
uuguaguguuggagaagaacuga

SEQ ID NO: 2720971 - RNA, 15 nt, Human
uuguaauuauaucug

SEQ ID NO: 2720972 - RNA, 20 nt, Human
uuguaaggaaugauuaauua

SEQ ID NO: 2720973 - RNA, 22 nt, Human
augaauuacauuuguauaaaau

SEQ ID NO: 2720974 - RNA, 21 nt, Human
augaauuaguuuuauaugcuu

SEQ ID NO: 2720975 - RNA, 23 nt, Human
augaauuaguuuuauaugcuucu

SEQ ID NO: 2720976 - RNA, 20 nt, Human
augacacgaauauugcugau

SEQ ID NO: 2720977 - RNA, 19 nt, Human
augacacgaauauugcuga

SEQ ID NO: 2720978 - RNA, 12 nt, Human
uugcucauggaa

SEQ ID NO: 2720979 - RNA, 11 nt, Human
uugcucaugga

SEQ ID NO: 2720980 - RNA, 19 nt, Human
uugcugaauacagaggcaa

SEQ ID NO: 2720981 - RNA, 20 nt, Human
uugcuaagugaggaugaaaa

SEQ ID NO: 2720982 - RNA, 17 nt, Human
uuggaaagaguaggaag

SEQ ID NO: 2720983 - RNA, 17 nt, Human
uugcugauggugcaaug

SEQ ID NO: 2720984 - RNA, 18 nt, Human
uugcugauggugcaauga

SEQ ID NO: 2720985 - RNA, 21 nt, Human
augaaauauuauguuaaaacu

SEQ ID NO: 2720986 - RNA, 20 nt, Human
augaaauauuauguuaaaac

SEQ ID NO: 2720987 - RNA, 14 nt, Human
augaaaugagguca

SEQ ID NO: 2720988 - RNA, 20 nt, Human
augaaagacuguacaaagua

SEQ ID NO: 2720989 - RNA, 18 nt, Human
uuggaaagaguaggaaga

SEQ ID NO: 2720990 - RNA, 21 nt, Human
uuggcuagagguucaaagaua

SEQ ID NO: 2720991 - RNA, 22 nt, Human
uuggcuaggaccccuccaugug

SEQ ID NO: 2720992 - RNA, 22 nt, Human
uuggcuagagguucaaagauau

SEQ ID NO: 2720993 - RNA, 13 nt, Human
uuggcugcaggga

SEQ ID NO: 2720994 - RNA, 14 nt, Human
uuggcugcagggag

SEQ ID NO: 2720995 - RNA, 11 nt, Human
uuggcugcuga

SEQ ID NO: 2720996 - RNA, 15 nt, Human
uuggcugcugaaggc

SEQ ID NO: 2720997 - RNA, 13 nt, Human
auuuagauguaua

SEQ ID NO: 2720998 - RNA, 18 nt, Human
auuuaguauuuuguuuca

SEQ ID NO: 2720999 - RNA, 22 nt, Human
auuuauuaaaugcccagccccu

SEQ ID NO: 2721000 - RNA, 15 nt, Human
auuuagaaauauaau

SEQ ID NO: 2721001 - RNA, 17 nt, Human
auuuacuucuuauacau

SEQ ID NO: 2721002 - RNA, 16 nt, Human
auuuacuucuuauaca

SEQ ID NO: 2721003 - RNA, 14 nt, Human
auuuacuucuuaua

SEQ ID NO: 2721004 - RNA, 14 nt, Human
auuuaacagaaaug

SEQ ID NO: 2721005 - RNA, 12 nt, Human
auuuaacagaaa

SEQ ID NO: 2721006 - RNA, 14 nt, Human
auuuauucugcuca

SEQ ID NO: 2721007 - RNA, 17 nt, Human
auuuauuuuaauaaugu

SEQ ID NO: 2721008 - RNA, 13 nt, Human
auuuauucugcuc

SEQ ID NO: 2721009 - RNA, 12 nt, Human
auuucauuucuu

SEQ ID NO: 2721010 - RNA, 19 nt, Human
auuuauuuuaauaauguuu

SEQ ID NO: 2721011 - RNA, 20 nt, Human
auuuauuuuaauaauguuuc

SEQ ID NO: 2721012 - RNA, 17 nt, Human
auuuccagccaaagccu

SEQ ID NO: 2721013 - RNA, 14 nt, Human
auuugaaauauuga

SEQ ID NO: 2721014 - RNA, 14 nt, Human
auuugaaaauuuug

SEQ ID NO: 2721015 - RNA, 16 nt, Human
auuuccguuaaaauac

SEQ ID NO: 2721016 - RNA, 15 nt, Human
auuuccguuaaaaua

SEQ ID NO: 2721017 - RNA, 23 nt, Human
auucuucagcaaaaauauuuuau

SEQ ID NO: 2721018 - RNA, 15 nt, Human
auucuucagcaaaaa

SEQ ID NO: 2721019 - RNA, 18 nt, Human
auucuuauuuaaugaaag

SEQ ID NO: 2721020 - RNA, 14 nt, Human
auucuuauuuaaug

SEQ ID NO: 2721021 - RNA, 18 nt, Human
auucuuaaaguugaauuu

SEQ ID NO: 2721022 - RNA, 13 nt, Human
auucuuauuuaau

SEQ ID NO: 2721023 - RNA, 13 nt, Human
auucuucuccacu

SEQ ID NO: 2721024 - RNA, 13 nt, Human
auucuuccucccu

SEQ ID NO: 2721025 - RNA, 22 nt, Human
auucuuccucccucccucuuuc

SEQ ID NO: 2721026 - RNA, 16 nt, Human
auucuuaaaguugaau

SEQ ID NO: 2721027 - RNA, 15 nt, Human
auucuuaaaguugaa

SEQ ID NO: 2721028 - RNA, 14 nt, Human
auucuuaaaguuga

SEQ ID NO: 2721029 - RNA, 13 nt, Human
auucuuaaaguug

SEQ ID NO: 2721030 - RNA, 15 nt, Human
auucuguauagauua

SEQ ID NO: 2721031 - RNA, 21 nt, Human
auucuguauagauuagaauuc

SEQ ID NO: 2721032 - RNA, 15 nt, Human
auuguauuacaaauc

SEQ ID NO: 2721033 - RNA, 23 nt, Human
auugguguuguacucaauuuuaa

SEQ ID NO: 2721034 - RNA, 22 nt, Human
auugguguuguacucaauuuua

SEQ ID NO: 2721035 - RNA, 14 nt, Human
auugguguuguacu

SEQ ID NO: 2721036 - RNA, 17 nt, Human
auuguccccgacccuug

SEQ ID NO: 2721037 - RNA, 19 nt, Human
auuguccccgacccuugcc

SEQ ID NO: 2721038 - RNA, 20 nt, Human
auuguccccgacccuugccg

SEQ ID NO: 2721039 - RNA, 14 nt, Human
auugugucucuugg

SEQ ID NO: 2721040 - RNA, 18 nt, Human
auugugucucuugguccu

SEQ ID NO: 2721041 - RNA, 17 nt, Human
auuuuaaaagaaugauu

SEQ ID NO: 2721042 - RNA, 14 nt, Human
auuugugauacaau

SEQ ID NO: 2721043 - RNA, 19 nt, Human
auuuguauaaaauaauuuu

SEQ ID NO: 2721044 - RNA, 15 nt, Human
auuuguauaaaauaa

SEQ ID NO: 2721045 - RNA, 18 nt, Human
auuuguauaaaauaauuu

SEQ ID NO: 2721046 - RNA, 18 nt, Human
auuuuaaaagaaugauua

SEQ ID NO: 2721047 - RNA, 22 nt, Human
auuuuaaaagaaugauuaugaa

SEQ ID NO: 2721048 - RNA, 13 nt, Human
auuuuacauaaau

SEQ ID NO: 2721049 - RNA, 17 nt, Human
auuuuacauaaauuuag

SEQ ID NO: 2721050 - RNA, 16 nt, Human
auuuuacauaaauuua

SEQ ID NO: 2721051 - RNA, 15 nt, Human
auuuuaauucaguug

SEQ ID NO: 2721052 - RNA, 22 nt, Human
auuuucaguuauuauauuuaca

SEQ ID NO: 2721053 - RNA, 14 nt, Human
auuuucagaaaaua

SEQ ID NO: 2721054 - RNA, 17 nt, Human
auuuucagaaaauauua

SEQ ID NO: 2721055 - RNA, 17 nt, Human
auuuuccuccuuucucu

SEQ ID NO: 2721056 - RNA, 13 nt, Human
auuuuccuccuuu

SEQ ID NO: 2721057 - RNA, 15 nt, Human
auuuuauuauguaaa

SEQ ID NO: 2721058 - RNA, 19 nt, Human
auuuuauuauguaaauccc

SEQ ID NO: 2721059 - RNA, 18 nt, Human
auuuuauuauguaaaucc

SEQ ID NO: 2721060 - RNA, 17 nt, Human
auuuuauuauguaaauc

SEQ ID NO: 2721061 - RNA, 16 nt, Human
auuuuauuauguaaau

SEQ ID NO: 2721062 - RNA, 21 nt, Human
auuuuauuauguaaaucccau

SEQ ID NO: 2721063 - RNA, 20 nt, Human
auuuuauuauguaaauccca

SEQ ID NO: 2721064 - RNA, 14 nt, Human
uuuucucuaggaaa

SEQ ID NO: 2721065 - RNA, 18 nt, Human
uuuucugagaaagacuau

SEQ ID NO: 2721066 - RNA, 15 nt, Human
uuuucugagaaagac

SEQ ID NO: 2721067 - RNA, 15 nt, Human
uuuucugauccaguu

SEQ ID NO: 2721068 - RNA, 20 nt, Human
uuuucauuuaggugaggaag

SEQ ID NO: 2721069 - RNA, 15 nt, Human
uuuuccaaaauaauu

SEQ ID NO: 2721070 - RNA, 11 nt, Human
uuuuauuuuau

SEQ ID NO: 2721071 - RNA, 14 nt, Human
uuuucaguguacau

SEQ ID NO: 2721072 - RNA, 13 nt, Human
uuuuauuaugcau

SEQ ID NO: 2721073 - RNA, 22 nt, Human
uuuuauuaugaaacuuguguaa

SEQ ID NO: 2721074 - RNA, 21 nt, Human
uuuuauuaugaaacuugugua

SEQ ID NO: 2721075 - RNA, 12 nt, Human
uuuuauuaugaa

SEQ ID NO: 2721076 - RNA, 17 nt, Human
auguuuucaggcuagau

SEQ ID NO: 2721077 - RNA, 21 nt, Human
auguuuucaggcuagauguau

SEQ ID NO: 2721078 - RNA, 15 nt, Human
auguuuucaggcuag

SEQ ID NO: 2721079 - RNA, 19 nt, Human
auuaaaaaucucaaauuuc

SEQ ID NO: 2721080 - RNA, 15 nt, Human
auuaaaaaucucaaa

SEQ ID NO: 2721081 - RNA, 23 nt, Human
auuaaaacacaacaucuuuuucu

SEQ ID NO: 2721082 - RNA, 22 nt, Human
auuaaaaaucucaaauuucuaa

SEQ ID NO: 2721083 - RNA, 20 nt, Human
auuaaaaaucucaaauuucu

SEQ ID NO: 2721084 - RNA, 16 nt, Human
auguugcccaggcagg

SEQ ID NO: 2721085 - RNA, 17 nt, Human
auguugcccaggcaggu

SEQ ID NO: 2721086 - RNA, 12 nt, Human
auguugcccagg

SEQ ID NO: 2721087 - RNA, 20 nt, Human
auguugcccaggcaggucuu

SEQ ID NO: 2721088 - RNA, 20 nt, Human
auguuaaaccaugggauaaa

SEQ ID NO: 2721089 - RNA, 13 nt, Human
auguuaaaccaug

SEQ ID NO: 2721090 - RNA, 12 nt, Human
auguuaaaccau

SEQ ID NO: 2721091 - RNA, 19 nt, Human
augugcuaguaauuggaaa

SEQ ID NO: 2721092 - RNA, 16 nt, Human
uuuuaauaauguuuca

SEQ ID NO: 2721093 - RNA, 22 nt, Human
augugccagguuuuuggucuga

SEQ ID NO: 2721094 - RNA, 12 nt, Human
uuuuaauaaugu

SEQ ID NO: 2721095 - RNA, 13 nt, Human
uuuuaauaauguu

SEQ ID NO: 2721096 - RNA, 14 nt, Human
uuuuaauaauguuu

SEQ ID NO: 2721097 - RNA, 20 nt, Human
auggggcccugccuccuuug

SEQ ID NO: 2721098 - RNA, 24 nt, Human
auguggaguucaucuugaauugua

SEQ ID NO: 2721099 - RNA, 20 nt, Human
auguggaguucaucuugaau

SEQ ID NO: 2721100 - RNA, 19 nt, Human
uuuuuauauuugaaauauu

SEQ ID NO: 2721101 - RNA, 17 nt, Human
uuuuuauauuugaaaua

SEQ ID NO: 2721102 - RNA, 12 nt, Human
uuuuuauggcuu

SEQ ID NO: 2721103 - RNA, 20 nt, Human
uuuuuaucgucacugcuuaa

SEQ ID NO: 2721104 - RNA, 23 nt, Human
uuuuguuuggaccaaaaaccagu

SEQ ID NO: 2721105 - RNA, 11 nt, Human
uuuuuacuaau

SEQ ID NO: 2721106 - RNA, 22 nt, Human
uuuuuagacagagucucacugu

SEQ ID NO: 2721107 - RNA, 14 nt, Human
uuuuguucauacau

SEQ ID NO: 2721108 - RNA, 20 nt, Human
uuuugugcauuaucuagaua

SEQ ID NO: 2721109 - RNA, 17 nt, Human
uuuugugcauuaucuag

SEQ ID NO: 2721110 - RNA, 12 nt, Human
uuuuguuucugu

SEQ ID NO: 2721111 - RNA, 13 nt, Human
uuuuguuucugua

SEQ ID NO: 2721112 - RNA, 22 nt, Human
uuuuguuuggaccaaaaaccag

SEQ ID NO: 2721113 - RNA, 12 nt, Human
uuuuguuuggac

SEQ ID NO: 2721114 - RNA, 21 nt, Human
uuuuguuccacaaguuaaaua

SEQ ID NO: 2721115 - RNA, 18 nt, Human
uuuuguuguuuguuuagu

SEQ ID NO: 2721116 - RNA, 15 nt, Human
uuuuguuccacaagu

SEQ ID NO: 2721117 - RNA, 17 nt, Human
uuuuguucauacauauu

SEQ ID NO: 2721118 - RNA, 14 nt, Human
auuaagcauauauu

SEQ ID NO: 2721119 - RNA, 21 nt, Human
auuaagcauauauuuuuauau

SEQ ID NO: 2721120 - RNA, 15 nt, Human
auuaagcauauauuu

SEQ ID NO: 2721121 - RNA, 17 nt, Human
uuuugauccaagcuggu

SEQ ID NO: 2721122 - RNA, 14 nt, Human
uuuugaguucuaca

SEQ ID NO: 2721123 - RNA, 17 nt, Human
uuuugagugccuuacac

SEQ ID NO: 2721124 - RNA, 23 nt, Human
uuuugccauguuggccaggcugg

SEQ ID NO: 2721125 - RNA, 16 nt, Human
auuacauuuguauaaa

SEQ ID NO: 2721126 - RNA, 18 nt, Human
auuacauuuguauaaaau

SEQ ID NO: 2721127 - RNA, 17 nt, Human
auuacauuuguauaaaa

SEQ ID NO: 2721128 - RNA, 21 nt, Human
auuacaguggggaaugaagau

SEQ ID NO: 2721129 - RNA, 14 nt, Human
auuaaguacuaugu

SEQ ID NO: 2721130 - RNA, 19 nt, Human
uuuuugugaaaagcuccau

SEQ ID NO: 2721131 - RNA, 19 nt, Human
uuuuuguagagccaggguc

SEQ ID NO: 2721132 - RNA, 20 nt, Human
uuuuuguagagccagggucu

SEQ ID NO: 2721133 - RNA, 21 nt, Human
auuaaguaaugauaacuggaa

SEQ ID NO: 2721134 - RNA, 23 nt, Human
auuaaguaaugauaacuggaaac

SEQ ID NO: 2721135 - RNA, 22 nt, Human
uuuuuauggcuuuugugcauua

SEQ ID NO: 2721136 - RNA, 21 nt, Human
uuuuuauggcuuuugugcauu

SEQ ID NO: 2721137 - RNA, 20 nt, Human
uuuuuauggcuuuugugcau

SEQ ID NO: 2721138 - RNA, 20 nt, Human
auuauauaaguauucuaaau

SEQ ID NO: 2721139 - RNA, 14 nt, Human
auuauauaaguauu

SEQ ID NO: 2721140 - RNA, 17 nt, Human
auuauauaaguauucua

SEQ ID NO: 2721141 - RNA, 12 nt, Human
auuagaauucug

SEQ ID NO: 2721142 - RNA, 14 nt, Human
auuagaauucugua

SEQ ID NO: 2721143 - RNA, 13 nt, Human
auuagaauucugu

SEQ ID NO: 2721144 - RNA, 18 nt, Human
auuagaauucuguauaga

SEQ ID NO: 2721145 - RNA, 17 nt, Human
auuagaauucuguauag

SEQ ID NO: 2721146 - RNA, 16 nt, Human
auuagaauucuguaua

SEQ ID NO: 2721147 - RNA, 15 nt, Human
auuagaauucuguau

SEQ ID NO: 2721148 - RNA, 19 nt, Human
auucuccaccugccaggga

SEQ ID NO: 2721149 - RNA, 20 nt, Human
auucuccaccugccagggac

SEQ ID NO: 2721150 - RNA, 16 nt, Human
auucuccuuguguuac

SEQ ID NO: 2721151 - RNA, 20 nt, Human
auucuccugccucagccucc

SEQ ID NO: 2721152 - RNA, 19 nt, Human
auucuccugccucagccuc

SEQ ID NO: 2721153 - RNA, 15 nt, Human
auucuccugccucag

SEQ ID NO: 2721154 - RNA, 17 nt, Human
auucuccugccucagcc

SEQ ID NO: 2721155 - RNA, 21 nt, Human
auucuccuaucaccugucuug

SEQ ID NO: 2721156 - RNA, 21 nt, Human
auucuccaccugccagggaca

SEQ ID NO: 2721157 - RNA, 11 nt, Human
auucuccugcc

SEQ ID NO: 2721158 - RNA, 14 nt, Human
auucuccugccuca

SEQ ID NO: 2721159 - RNA, 13 nt, Human
auucuccugccuc

SEQ ID NO: 2721160 - RNA, 14 nt, Human
auucaggaagcuca

SEQ ID NO: 2721161 - RNA, 19 nt, Human
auucaguaauaacucuacc

SEQ ID NO: 2721162 - RNA, 15 nt, Human
auucaguaauaacuc

SEQ ID NO: 2721163 - RNA, 18 nt, Human
auucagauaugauucaaa

SEQ ID NO: 2721164 - RNA, 20 nt, Human
auucaggaagcucagggccu

SEQ ID NO: 2721165 - RNA, 17 nt, Human
auucaggaagcucaggg

SEQ ID NO: 2721166 - RNA, 19 nt, Human
auucaggaagcucagggcc

SEQ ID NO: 2721167 - RNA, 16 nt, Human
auucccaagcucugcu

SEQ ID NO: 2721168 - RNA, 14 nt, Human
auucccaagcucug

SEQ ID NO: 2721169 - RNA, 15 nt, Human
auucccaagcucugc

SEQ ID NO: 2721170 - RNA, 20 nt, Human
auucagauaugauucaaaug

SEQ ID NO: 2721171 - RNA, 12 nt, Human
aaaaacaacuuu

SEQ ID NO: 2721172 - RNA, 14 nt, Human
aaaaacacaaaagu

SEQ ID NO: 2721173 - RNA, 23 nt, Human
aaaaaauuggggauucuuaaagu

SEQ ID NO: 2721174 - RNA, 14 nt, Human
aaaacaaggaugaa

SEQ ID NO: 2721175 - RNA, 12 nt, Human
aaaacaacuuua

SEQ ID NO: 2721176 - RNA, 18 nt, Human
aaaacacagcaaggguga

SEQ ID NO: 2721177 - RNA, 12 nt, Human
aaaacacauuuu

SEQ ID NO: 2721178 - RNA, 13 nt, Human
aaaacacagcaag

SEQ ID NO: 2721179 - RNA, 12 nt, Human
aaaacacagcaa

SEQ ID NO: 2721180 - RNA, 17 nt, Human
aaaacaaggaugaauua

SEQ ID NO: 2721181 - RNA, 13 nt, Human
aaaaacugauuuu

SEQ ID NO: 2721182 - RNA, 18 nt, Human
aaaaaccaguauuguaca

SEQ ID NO: 2721183 - RNA, 16 nt, Human
aaaaaccaguauugua

SEQ ID NO: 2721184 - RNA, 15 nt, Human
aaaaacugauuuuuu

SEQ ID NO: 2721185 - RNA, 12 nt, Human
aaaaagaggcua

SEQ ID NO: 2721186 - RNA, 20 nt, Human
aaaaauuggggauucuuaaa

SEQ ID NO: 2721187 - RNA, 19 nt, Human
aaaaauuggggauucuuaa

SEQ ID NO: 2721188 - RNA, 18 nt, Human
aaaaauuggggauucuua

SEQ ID NO: 2721189 - RNA, 17 nt, Human
aaaaauuggggauucuu

SEQ ID NO: 2721190 - RNA, 16 nt, Human
aagauuuaccacuugu

SEQ ID NO: 2721191 - RNA, 13 nt, Human
aagccagauuuuc

SEQ ID NO: 2721192 - RNA, 14 nt, Human
aagcagaggaagga

SEQ ID NO: 2721193 - RNA, 18 nt, Human
aagccauaauuguucuua

SEQ ID NO: 2721194 - RNA, 13 nt, Human
aagccauguuuau

SEQ ID NO: 2721195 - RNA, 16 nt, Human
aaggcaaggcugucaa

SEQ ID NO: 2721196 - RNA, 17 nt, Human
aaggcaaggcugucaau

SEQ ID NO: 2721197 - RNA, 18 nt, Human
aaggcaaggcugucaauu

SEQ ID NO: 2721198 - RNA, 11 nt, Human
aagcugggcag

SEQ ID NO: 2721199 - RNA, 13 nt, Human
aagcugggcaggu

SEQ ID NO: 2721200 - RNA, 18 nt, Human
aaggacauugcggacagc

SEQ ID NO: 2721201 - RNA, 21 nt, Human
aagcugcacccucaggcaggu

SEQ ID NO: 2721202 - RNA, 20 nt, Human
aagcugcacccucaggcagg

SEQ ID NO: 2721203 - RNA, 22 nt, Human
aagcugcacccucaggcaggug

SEQ ID NO: 2721204 - RNA, 12 nt, Human
aagcguggugga

SEQ ID NO: 2721205 - RNA, 21 nt, Human
aauaauccuaaacauaugaau

SEQ ID NO: 2721206 - RNA, 16 nt, Human
aauaaugugaaacugg

SEQ ID NO: 2721207 - RNA, 14 nt, Human
aauaaaauggguuu

SEQ ID NO: 2721208 - RNA, 22 nt, Human
aaguuguaggcauaaagucagg

SEQ ID NO: 2721209 - RNA, 19 nt, Human
aauaaaauggguuuuacug

SEQ ID NO: 2721210 - RNA, 16 nt, Human
aauaaacgucuuaaau

SEQ ID NO: 2721211 - RNA, 17 nt, Human
aauaaacgucuuaaaua

SEQ ID NO: 2721212 - RNA, 22 nt, Human
aagugcugggauuacaggugug

SEQ ID NO: 2721213 - RNA, 11 nt, Human
aaggugggagg

SEQ ID NO: 2721214 - RNA, 16 nt, Human
aagguuaauaaaguaa

SEQ ID NO: 2721215 - RNA, 15 nt, Human
aagguuaauaaagua

SEQ ID NO: 2721216 - RNA, 20 nt, Human
aagguuaauguucaucaucc

SEQ ID NO: 2721217 - RNA, 11 nt, Human
aaguacuucuu

SEQ ID NO: 2721218 - RNA, 18 nt, Human
aaguauguguaaaaugug

SEQ ID NO: 2721219 - RNA, 16 nt, Human
aaguaucccuacugua

SEQ ID NO: 2721220 - RNA, 16 nt, Human
aagucuuagauguaua

SEQ ID NO: 2721221 - RNA, 20 nt, Human
aaugauaacuggaaacuuca

SEQ ID NO: 2721222 - RNA, 18 nt, Human
aaugauaaguaaaugcua

SEQ ID NO: 2721223 - RNA, 17 nt, Human
aaugaagauacugaaau

SEQ ID NO: 2721224 - RNA, 21 nt, Human
aaugaugauccuaggcauuug

SEQ ID NO: 2721225 - RNA, 21 nt, Human
aaugauaaguaaaugcuaggu

SEQ ID NO: 2721226 - RNA, 17 nt, Human
aaugauaacuggaaacu

SEQ ID NO: 2721227 - RNA, 12 nt, Human
aaugaagauacu

SEQ ID NO: 2721228 - RNA, 22 nt, Human
aaucugcuuuuuaaagaaugcu

SEQ ID NO: 2721229 - RNA, 16 nt, Human
aaugaaccacaucuug

SEQ ID NO: 2721230 - RNA, 17 nt, Human
aaugaaccacaucuugc

SEQ ID NO: 2721231 - RNA, 23 nt, Human
aaugaaccacaucuugcucugcu

SEQ ID NO: 2721232 - RNA, 13 nt, Human
aauccauacauuu

SEQ ID NO: 2721233 - RNA, 14 nt, Human
aauccauacauuug

SEQ ID NO: 2721234 - RNA, 15 nt, Human
aauccauuuggaaau

SEQ ID NO: 2721235 - RNA, 14 nt, Human
aauccauuuggaaa

SEQ ID NO: 2721236 - RNA, 22 nt, Human
aauccauuuggaaaucuuuaaa

SEQ ID NO: 2721237 - RNA, 18 nt, Human
aauccauuuggaaaucuu

SEQ ID NO: 2721238 - RNA, 17 nt, Human
aauccauuuggaaaucu

SEQ ID NO: 2721239 - RNA, 14 nt, Human
aaucuccaaaauaa

SEQ ID NO: 2721240 - RNA, 13 nt, Human
aaucuccaaaaua

SEQ ID NO: 2721241 - RNA, 18 nt, Human
aaucucauaauuuauaca

SEQ ID NO: 2721242 - RNA, 19 nt, Human
aaugaugccaugaggaaca

SEQ ID NO: 2721243 - RNA, 15 nt, Human
aaucaagaaacuuaa

SEQ ID NO: 2721244 - RNA, 13 nt, Human
aaucacaauacau

SEQ ID NO: 2721245 - RNA, 16 nt, Human
aauauuauguuaaaac

SEQ ID NO: 2721246 - RNA, 14 nt, Human
aauauuauguguuu

SEQ ID NO: 2721247 - RNA, 18 nt, Human
aauauaggaacuuaaaua

SEQ ID NO: 2721248 - RNA, 21 nt, Human
aauauaggaacuuaaauaaug

SEQ ID NO: 2721249 - RNA, 20 nt, Human
aauauaggaacuuaaauaau

SEQ ID NO: 2721250 - RNA, 14 nt, Human
aauuaguuuuauau

SEQ ID NO: 2721251 - RNA, 17 nt, Human
aauuaguuuuauaugcu

SEQ ID NO: 2721252 - RNA, 20 nt, Human
aauuaguuuuauaugcuucu

SEQ ID NO: 2721253 - RNA, 20 nt, Human
aaugucucuuuaaugucaca

SEQ ID NO: 2721254 - RNA, 22 nt, Human
aaugucuaguuguaacaccaug

SEQ ID NO: 2721255 - RNA, 17 nt, Human
aaugucagugugacuga

SEQ ID NO: 2721256 - RNA, 21 nt, Human
aaugucagugugacugaucuc

SEQ ID NO: 2721257 - RNA, 22 nt, Human
aaugguccgugcuaaggacuug

SEQ ID NO: 2721258 - RNA, 15 nt, Human
aaugucagugugacu

SEQ ID NO: 2721259 - RNA, 16 nt, Human
aaugucagugugacug

SEQ ID NO: 2721260 - RNA, 13 nt, Human
aaugucaguguga

SEQ ID NO: 2721261 - RNA, 15 nt, Human
aaugggcagagcaga

SEQ ID NO: 2721262 - RNA, 13 nt, Human
aaugggcagagca

SEQ ID NO: 2721263 - RNA, 13 nt, Human
aauggcuuuguau

SEQ ID NO: 2721264 - RNA, 18 nt, Human
aauggcuuuguauagaac

SEQ ID NO: 2721265 - RNA, 16 nt, Human
aauggcuuuguauaga

SEQ ID NO: 2721266 - RNA, 15 nt, Human
aauggcuuuguauag

SEQ ID NO: 2721267 - RNA, 14 nt, Human
aauuaaauuuugag

SEQ ID NO: 2721268 - RNA, 22 nt, Human
aauuaaauuuugaguucuacau

SEQ ID NO: 2721269 - RNA, 18 nt, Human
aauuaaaacacaacaucu

SEQ ID NO: 2721270 - RNA, 19 nt, Human
aauguuugccucugccucu

SEQ ID NO: 2721271 - RNA, 18 nt, Human
aauguuugccucugccuc

SEQ ID NO: 2721272 - RNA, 19 nt, Human
aaaucaaauaugcaaagca

SEQ ID NO: 2721273 - RNA, 18 nt, Human
aaaucaaauaugcaaagc

SEQ ID NO: 2721274 - RNA, 16 nt, Human
aaaucaaauaugcaaa

SEQ ID NO: 2721275 - RNA, 16 nt, Human
aaauggaaaugggcag

SEQ ID NO: 2721276 - RNA, 18 nt, Human
aaauggaagacagcucuu

SEQ ID NO: 2721277 - RNA, 20 nt, Human
aaauggacguguuaugacuc

SEQ ID NO: 2721278 - RNA, 21 nt, Human
aaauggacguguuaugacucc

SEQ ID NO: 2721279 - RNA, 22 nt, Human
aaauggacguguuaugacucca

SEQ ID NO: 2721280 - RNA, 18 nt, Human
aaauggcuuccuggcaau

SEQ ID NO: 2721281 - RNA, 19 nt, Human
aaauggacuguggugacuu

SEQ ID NO: 2721282 - RNA, 14 nt, Human
aaauaguauuugag

SEQ ID NO: 2721283 - RNA, 14 nt, Human
aaauauuuuaugau

SEQ ID NO: 2721284 - RNA, 19 nt, Human
aaauauuuuaugauccagc

SEQ ID NO: 2721285 - RNA, 18 nt, Human
aaauauuuuaugauccag

SEQ ID NO: 2721286 - RNA, 12 nt, Human
aaauaacaauga

SEQ ID NO: 2721287 - RNA, 17 nt, Human
aaauaaacgucuuaaau

SEQ ID NO: 2721288 - RNA, 14 nt, Human
aaagugcugggauu

SEQ ID NO: 2721289 - RNA, 11 nt, Human
aaagugcuggg

SEQ ID NO: 2721290 - RNA, 16 nt, Human
aaagaugaaaauauuu

SEQ ID NO: 2721291 - RNA, 13 nt, Human
aaagaugaaaaua

SEQ ID NO: 2721292 - RNA, 17 nt, Human
aaagaugaaaauauuug

SEQ ID NO: 2721293 - RNA, 19 nt, Human
aaacugccagcaacgcagg

SEQ ID NO: 2721294 - RNA, 17 nt, Human
aaacugacucuuaagaa

SEQ ID NO: 2721295 - RNA, 15 nt, Human
aaacugccagcaacg

SEQ ID NO: 2721296 - RNA, 14 nt, Human
aaacugccagcaac

SEQ ID NO: 2721297 - RNA, 16 nt, Human
aaacugacucuuaaga

SEQ ID NO: 2721298 - RNA, 11 nt, Human
aaagagguuuu

SEQ ID NO: 2721299 - RNA, 19 nt, Human
aaacacuguucucugcccu

SEQ ID NO: 2721300 - RNA, 22 nt, Human
aaacacuguucucugcccucca

SEQ ID NO: 2721301 - RNA, 17 nt, Human
aaaauuggggauucuua

SEQ ID NO: 2721302 - RNA, 19 nt, Human
aaaauuggggauucuuaaa

SEQ ID NO: 2721303 - RNA, 18 nt, Human
aaaauuggggauucuuaa

SEQ ID NO: 2721304 - RNA, 18 nt, Human
aaacacuguucucugccc

SEQ ID NO: 2721305 - RNA, 13 nt, Human
aaaauucagugga

SEQ ID NO: 2721306 - RNA, 21 nt, Human
aaaauuauuuuguucauacau

SEQ ID NO: 2721307 - RNA, 15 nt, Human
aaaacacauuuuucu

SEQ ID NO: 2721308 - RNA, 13 nt, Human
aaaacacauuuuu

SEQ ID NO: 2721309 - RNA, 14 nt, Human
aagaaauguaaggg

SEQ ID NO: 2721310 - RNA, 13 nt, Human
aagaaauguaagg

SEQ ID NO: 2721311 - RNA, 12 nt, Human
aacuuuucugau

SEQ ID NO: 2721312 - RNA, 19 nt, Human
aacuuuuauaaacuuuacc

SEQ ID NO: 2721313 - RNA, 16 nt, Human
aacuuuuauaaacuuu

SEQ ID NO: 2721314 - RNA, 14 nt, Human
aacuuuucugauag

SEQ ID NO: 2721315 - RNA, 13 nt, Human
aacuuuucugaua

SEQ ID NO: 2721316 - RNA, 15 nt, Human
aacuuuuauaaacuu

SEQ ID NO: 2721317 - RNA, 12 nt, Human
aacuuuuauaaa

SEQ ID NO: 2721318 - RNA, 16 nt, Human
aacuuuggaacaagau

SEQ ID NO: 2721319 - RNA, 20 nt, Human
aacuuugaccucugcagcaa

SEQ ID NO: 2721320 - RNA, 19 nt, Human
aacuuugaccucugcagca

SEQ ID NO: 2721321 - RNA, 17 nt, Human
aacuuugaccucugcag

SEQ ID NO: 2721322 - RNA, 14 nt, Human
aacuuugaccucug

SEQ ID NO: 2721323 - RNA, 13 nt, Human
aacuuugaccucu

SEQ ID NO: 2721324 - RNA, 19 nt, Human
aacugauuuuuuuuuccuu

SEQ ID NO: 2721325 - RNA, 17 nt, Human
aacugauuuuuuuuucc

SEQ ID NO: 2721326 - RNA, 17 nt, Human
aacuuaaauaaugugaa

SEQ ID NO: 2721327 - RNA, 15 nt, Human
aacucaccugccccu

SEQ ID NO: 2721328 - RNA, 16 nt, Human
aacucaccugccccuc

SEQ ID NO: 2721329 - RNA, 12 nt, Human
aacucaccccag

SEQ ID NO: 2721330 - RNA, 13 nt, Human
aacuucacauauu

SEQ ID NO: 2721331 - RNA, 15 nt, Human
aacacgagcaggcua

SEQ ID NO: 2721332 - RNA, 19 nt, Human
aacacauuuuucuuaggga

SEQ ID NO: 2721333 - RNA, 21 nt, Human
aaauugauguguuuauuuaua

SEQ ID NO: 2721334 - RNA, 16 nt, Human
aaauuggggauucuua

SEQ ID NO: 2721335 - RNA, 17 nt, Human
aacagcuggugcccugc

SEQ ID NO: 2721336 - RNA, 21 nt, Human
aacauguaauuaaguacuaug

SEQ ID NO: 2721337 - RNA, 14 nt, Human
aacauguaauuaag

SEQ ID NO: 2721338 - RNA, 23 nt, Human
aacauguaauuaaguacuaugua

SEQ ID NO: 2721339 - RNA, 22 nt, Human
aaccacucuaucaaguauuaua

SEQ ID NO: 2721340 - RNA, 15 nt, Human
aaccaguauuguaca

SEQ ID NO: 2721341 - RNA, 20 nt, Human
aaccaguauuguacaaagua

SEQ ID NO: 2721342 - RNA, 22 nt, Human
aaccaguauuguacaaaguauu

SEQ ID NO: 2721343 - RNA, 21 nt, Human
aaccaguauuguacaaaguau

SEQ ID NO: 2721344 - RNA, 14 nt, Human
aacccuggugacca

SEQ ID NO: 2721345 - RNA, 13 nt, Human
acaacuauauugu

SEQ ID NO: 2721346 - RNA, 13 nt, Human
acaaagacugagu

SEQ ID NO: 2721347 - RNA, 15 nt, Human
acaaacgggcucagc

SEQ ID NO: 2721348 - RNA, 21 nt, Human
acaaaccuguuucugcagcca

SEQ ID NO: 2721349 - RNA, 20 nt, Human
acaaaauguaggguuauaau

SEQ ID NO: 2721350 - RNA, 20 nt, Human
acaaaauggaauacucuuau

SEQ ID NO: 2721351 - RNA, 20 nt, Human
aauuuugaguucuacauaag

SEQ ID NO: 2721352 - RNA, 19 nt, Human
acaaaauggaauacucuua

SEQ ID NO: 2721353 - RNA, 15 nt, Human
acaaaauggaauacu

SEQ ID NO: 2721354 - RNA, 15 nt, Human
aauuuuauaucuugu

SEQ ID NO: 2721355 - RNA, 20 nt, Human
acaagucagucauucagaua

SEQ ID NO: 2721356 - RNA, 13 nt, Human
acaacuuuauacc

SEQ ID NO: 2721357 - RNA, 14 nt, Human
acaacuuuauaccc

SEQ ID NO: 2721358 - RNA, 18 nt, Human
acaacuucccagugaauu

SEQ ID NO: 2721359 - RNA, 17 nt, Human
acaacuucaauauccaa

SEQ ID NO: 2721360 - RNA, 16 nt, Human
acaacuauuuuuccaa

SEQ ID NO: 2721361 - RNA, 15 nt, Human
acacggacacucaaa

SEQ ID NO: 2721362 - RNA, 14 nt, Human
acacuaaccacgcu

SEQ ID NO: 2721363 - RNA, 15 nt, Human
acacuaaccacgcug

SEQ ID NO: 2721364 - RNA, 11 nt, Human
acacagcucug

SEQ ID NO: 2721365 - RNA, 12 nt, Human
acacagcucugu

SEQ ID NO: 2721366 - RNA, 21 nt, Human
acaccacuacauucuguuaau

SEQ ID NO: 2721367 - RNA, 12 nt, Human
acaccagagccc

SEQ ID NO: 2721368 - RNA, 14 nt, Human
acaauuuuguuucu

SEQ ID NO: 2721369 - RNA, 17 nt, Human
acaauuuuguuucugua

SEQ ID NO: 2721370 - RNA, 15 nt, Human
acaauuuuguuucug

SEQ ID NO: 2721371 - RNA, 18 nt, Human
acacaaacgggcucagca

SEQ ID NO: 2721372 - RNA, 16 nt, Human
acaauuuauuauggca

SEQ ID NO: 2721373 - RNA, 15 nt, Human
acaauuuauuauggc

SEQ ID NO: 2721374 - RNA, 14 nt, Human
acagcugccuggga

SEQ ID NO: 2721375 - RNA, 13 nt, Human
acagcugccuggg

SEQ ID NO: 2721376 - RNA, 23 nt, Human
acagcugccugggaucccucauc

SEQ ID NO: 2721377 - RNA, 12 nt, Human
acagcuccuucu

SEQ ID NO: 2721378 - RNA, 13 nt, Human
acagcuccuucug

SEQ ID NO: 2721379 - RNA, 14 nt, Human
acagcuccuucugu

SEQ ID NO: 2721380 - RNA, 18 nt, Human
acaggcaagcaccuccug

SEQ ID NO: 2721381 - RNA, 15 nt, Human
acaggcaagcaccuc

SEQ ID NO: 2721382 - RNA, 16 nt, Human
acaggcaagcaccucc

SEQ ID NO: 2721383 - RNA, 19 nt, Human
acaggucauauuaauauau

SEQ ID NO: 2721384 - RNA, 20 nt, Human
acaggugugaaccaccacac

SEQ ID NO: 2721385 - RNA, 23 nt, Human
acaggugugaaccaccacaccca

SEQ ID NO: 2721386 - RNA, 15 nt, Human
acagccagacuggca

SEQ ID NO: 2721387 - RNA, 13 nt, Human
acagccagacugg

SEQ ID NO: 2721388 - RNA, 16 nt, Human
acagccagacuggcac

SEQ ID NO: 2721389 - RNA, 19 nt, Human
acagccacggccaggccag

SEQ ID NO: 2721390 - RNA, 15 nt, Human
acagccaugauucuu

SEQ ID NO: 2721391 - RNA, 18 nt, Human
acagcaguugaaaagacu

SEQ ID NO: 2721392 - RNA, 15 nt, Human
acagcaguugaaaag

SEQ ID NO: 2721393 - RNA, 17 nt, Human
acagagucucacuguug

SEQ ID NO: 2721394 - RNA, 19 nt, Human
acagagucucacuguugcc

SEQ ID NO: 2721395 - RNA, 21 nt, Human
acagaggggguggccucccaa

SEQ ID NO: 2721396 - RNA, 19 nt, Human
acagaauauguuucaaacu

SEQ ID NO: 2721397 - RNA, 21 nt, Human
acagaauauguuucaaacuuu

SEQ ID NO: 2721398 - RNA, 16 nt, Human
acagaauauguuucaa

SEQ ID NO: 2721399 - RNA, 17 nt, Human
acagaauauguuucaaa

SEQ ID NO: 2721400 - RNA, 22 nt, Human
acagaggggguggccucccaac

SEQ ID NO: 2721401 - RNA, 12 nt, Human
acagagucucac

SEQ ID NO: 2721402 - RNA, 14 nt, Human
acagagucucacug

SEQ ID NO: 2721403 - RNA, 21 nt, Human
acauguuuuucuucucccuca

SEQ ID NO: 2721404 - RNA, 19 nt, Human
acaugcaaggucauuuuuu

SEQ ID NO: 2721405 - RNA, 20 nt, Human
acaugcacagcuaacaugga

SEQ ID NO: 2721406 - RNA, 23 nt, Human
acaugcacagcuaacauggaagu

SEQ ID NO: 2721407 - RNA, 23 nt, Human
acauaaacaagaccacguuucua

SEQ ID NO: 2721408 - RNA, 22 nt, Human
acaucagcacgauuucuguuua

SEQ ID NO: 2721409 - RNA, 21 nt, Human
acaucagcacgauuucuguuu

SEQ ID NO: 2721410 - RNA, 20 nt, Human
acaucagcacgauuucuguu

SEQ ID NO: 2721411 - RNA, 14 nt, Human
acauaaaucuguga

SEQ ID NO: 2721412 - RNA, 19 nt, Human
acaucagcacgauuucugu

SEQ ID NO: 2721413 - RNA, 18 nt, Human
acauaaaucugugaacuu

SEQ ID NO: 2721414 - RNA, 15 nt, Human
acauaaaucugugaa

SEQ ID NO: 2721415 - RNA, 18 nt, Human
acauuugcucauggaauu

SEQ ID NO: 2721416 - RNA, 16 nt, Human
acauuugcucauggaa

SEQ ID NO: 2721417 - RNA, 14 nt, Human
acauuuguauaaaa

SEQ ID NO: 2721418 - RNA, 14 nt, Human
accacuacauucug

SEQ ID NO: 2721419 - RNA, 19 nt, Human
accacguuucuaaaggcua

SEQ ID NO: 2721420 - RNA, 15 nt, Human
accacguuucuaaag

SEQ ID NO: 2721421 - RNA, 13 nt, Human
accagcagccugg

SEQ ID NO: 2721422 - RNA, 14 nt, Human
accagcagccugga

SEQ ID NO: 2721423 - RNA, 17 nt, Human
accagcagccuggaccc

SEQ ID NO: 2721424 - RNA, 16 nt, Human
acccaaguccaagcau

SEQ ID NO: 2721425 - RNA, 13 nt, Human
acccaagggccug

SEQ ID NO: 2721426 - RNA, 16 nt, Human
acccaagggccuggcc

SEQ ID NO: 2721427 - RNA, 16 nt, Human
acccaugcugcccugu

SEQ ID NO: 2721428 - RNA, 19 nt, Human
acccaugcugcccugugag

SEQ ID NO: 2721429 - RNA, 17 nt, Human
acccaugcugcccugug

SEQ ID NO: 2721430 - RNA, 18 nt, Human
acccaugcugcccuguga

SEQ ID NO: 2721431 - RNA, 15 nt, Human
accccggccaccugc

SEQ ID NO: 2721432 - RNA, 21 nt, Human
accaucccugaaggccccgcc

SEQ ID NO: 2721433 - RNA, 22 nt, Human
accaucccugaaggccccgccc

SEQ ID NO: 2721434 - RNA, 16 nt, Human
accaucaugucuggcu

SEQ ID NO: 2721435 - RNA, 17 nt, Human
accaucaugucuggcua

SEQ ID NO: 2721436 - RNA, 18 nt, Human
accaucccugaaggcccc

SEQ ID NO: 2721437 - RNA, 16 nt, Human
accaucccugaaggcc

SEQ ID NO: 2721438 - RNA, 14 nt, Human
accaucaugucugg

SEQ ID NO: 2721439 - RNA, 20 nt, Human
accccucaacaccucugcac

SEQ ID NO: 2721440 - RNA, 18 nt, Human
acuuguaaaggaauuuaa

SEQ ID NO: 2721441 - RNA, 20 nt, Human
acuuguaaaggaauuuaaaa

SEQ ID NO: 2721442 - RNA, 19 nt, Human
acuuguaaaggaauuuaaa

SEQ ID NO: 2721443 - RNA, 18 nt, Human
acuucugccauauucugu

SEQ ID NO: 2721444 - RNA, 19 nt, Human
acuucugccauauucuguu

SEQ ID NO: 2721445 - RNA, 21 nt, Human
acuucuuuaauuuuggaauuu

SEQ ID NO: 2721446 - RNA, 13 nt, Human
acuguuucaaacu

SEQ ID NO: 2721447 - RNA, 20 nt, Human
acuuauuguagcauccugga

SEQ ID NO: 2721448 - RNA, 23 nt, Human
acuuauuguagcauccuggaaua

SEQ ID NO: 2721449 - RNA, 12 nt, Human
acuguuuugaau

SEQ ID NO: 2721450 - RNA, 19 nt, Human
acuucacauauugauuucc

SEQ ID NO: 2721451 - RNA, 14 nt, Human
acuggaagcacagc

SEQ ID NO: 2721452 - RNA, 16 nt, Human
acuggaagcacagcuu

SEQ ID NO: 2721453 - RNA, 15 nt, Human
acuggaagcacagcu

SEQ ID NO: 2721454 - RNA, 14 nt, Human
acuggagaaaaugg

SEQ ID NO: 2721455 - RNA, 12 nt, Human
acugucuucagu

SEQ ID NO: 2721456 - RNA, 23 nt, Human
acuuuguucuggcucuuccaggc

SEQ ID NO: 2721457 - RNA, 23 nt, Human
acuuuccuucauucaacccaccu

SEQ ID NO: 2721458 - RNA, 19 nt, Human
acuuuauacccagaaaguu

SEQ ID NO: 2721459 - RNA, 22 nt, Human
acuuuuauaaacuuuaccuuuu

SEQ ID NO: 2721460 - RNA, 19 nt, Human
acuuuuauaaacuuuaccu

SEQ ID NO: 2721461 - RNA, 15 nt, Human
acuuuuauaaacuuu

SEQ ID NO: 2721462 - RNA, 12 nt, Human
acuuuucugaua

SEQ ID NO: 2721463 - RNA, 21 nt, Human
agaaaaguugaauuuuacaug

SEQ ID NO: 2721464 - RNA, 18 nt, Human
agaaaaguugaauuuuac

SEQ ID NO: 2721465 - RNA, 23 nt, Human
agaaaauggaagacagcucuuau

SEQ ID NO: 2721466 - RNA, 15 nt, Human
agaaaauggacgugu

SEQ ID NO: 2721467 - RNA, 20 nt, Human
agaaaauggacguguuauga

SEQ ID NO: 2721468 - RNA, 23 nt, Human
agaaaauauuauguguuuccaua

SEQ ID NO: 2721469 - RNA, 22 nt, Human
agaaaauggacguguuaugacu

SEQ ID NO: 2721470 - RNA, 23 nt, Human
agaaaauggacguguuaugacuc

SEQ ID NO: 2721471 - RNA, 18 nt, Human
agaaauaaaguuucuguu

SEQ ID NO: 2721472 - RNA, 15 nt, Human
agaaauaaaguuucu

SEQ ID NO: 2721473 - RNA, 20 nt, Human
agaaaggaggggauagagag

SEQ ID NO: 2721474 - RNA, 23 nt, Human
agaaaggaggggauagagagaga

SEQ ID NO: 2721475 - RNA, 18 nt, Human
acucaaaagcugggcagg

SEQ ID NO: 2721476 - RNA, 11 nt, Human
acuauaaugua

SEQ ID NO: 2721477 - RNA, 17 nt, Human
acucaaacucuuaaaac

SEQ ID NO: 2721478 - RNA, 16 nt, Human
acucaaacucuuaaaa

SEQ ID NO: 2721479 - RNA, 14 nt, Human
acucccccaggugg

SEQ ID NO: 2721480 - RNA, 21 nt, Human
acucauaaaaagccugcaauu

SEQ ID NO: 2721481 - RNA, 17 nt, Human
acuccccugcugggugu

SEQ ID NO: 2721482 - RNA, 13 nt, Human
acuccccugcugg

SEQ ID NO: 2721483 - RNA, 14 nt, Human
acuagcuauggugu

SEQ ID NO: 2721484 - RNA, 21 nt, Human
acucuacccucuuagaaaaac

SEQ ID NO: 2721485 - RNA, 13 nt, Human
acucuacccucuu

SEQ ID NO: 2721486 - RNA, 18 nt, Human
acucuacccucuuagaaa

SEQ ID NO: 2721487 - RNA, 11 nt, Human
acucuuaaaac

SEQ ID NO: 2721488 - RNA, 18 nt, Human
acucuuaaaacccaagug

SEQ ID NO: 2721489 - RNA, 16 nt, Human
acucugugucaggugg

SEQ ID NO: 2721490 - RNA, 16 nt, Human
acucuaucaaguauua

SEQ ID NO: 2721491 - RNA, 14 nt, Human
acucuaucaaguau

SEQ ID NO: 2721492 - RNA, 18 nt, Human
acgcugugcugcccugcc

SEQ ID NO: 2721493 - RNA, 15 nt, Human
acgcugugcugcccu

SEQ ID NO: 2721494 - RNA, 16 nt, Human
acgcugugcugcccug

SEQ ID NO: 2721495 - RNA, 17 nt, Human
acgcugugcugcccugc

SEQ ID NO: 2721496 - RNA, 15 nt, Human
acuaagagagaauga

SEQ ID NO: 2721497 - RNA, 16 nt, Human
acuaagagagaaugag

SEQ ID NO: 2721498 - RNA, 11 nt, Human
acguggcugcu

SEQ ID NO: 2721499 - RNA, 13 nt, Human
acguggcugcuuc

SEQ ID NO: 2721500 - RNA, 14 nt, Human
acguggcugcuuca

SEQ ID NO: 2721501 - RNA, 15 nt, Human
acguggcugcuucaa

SEQ ID NO: 2721502 - RNA, 22 nt, Human
acuaaguuuuuauggcuuuugu

SEQ ID NO: 2721503 - RNA, 15 nt, Human
acuaaguuuuuaugg

SEQ ID NO: 2721504 - RNA, 18 nt, Human
acgccacugcacuauagc

SEQ ID NO: 2721505 - RNA, 17 nt, Human
acgauuucuguuuagau

SEQ ID NO: 2721506 - RNA, 14 nt, Human
acgauuucuguuua

SEQ ID NO: 2721507 - RNA, 13 nt, Human
acgauuucuguuu

SEQ ID NO: 2721508 - RNA, 12 nt, Human
acgauuucuguu

SEQ ID NO: 2721509 - RNA, 20 nt, Human
accugccccucaacucuccu

SEQ ID NO: 2721510 - RNA, 23 nt, Human
accugccccucaacucuccucca

SEQ ID NO: 2721511 - RNA, 16 nt, Human
accucugcacaagcug

SEQ ID NO: 2721512 - RNA, 18 nt, Human
accucugcacaagcugca

SEQ ID NO: 2721513 - RNA, 21 nt, Human
accucugcacaagcugcaccc

SEQ ID NO: 2721514 - RNA, 23 nt, Human
accuuucaauaggaaaaacugau

SEQ ID NO: 2721515 - RNA, 17 nt, Human
accuuucaauaggaaaa

SEQ ID NO: 2721516 - RNA, 21 nt, Human
accuuucaauaggaaaaacug

SEQ ID NO: 2721517 - RNA, 14 nt, Human
accuuggcugcagg

SEQ ID NO: 2721518 - RNA, 16 nt, Human
accuuucaauaggaaa

SEQ ID NO: 2721519 - RNA, 12 nt, Human
accuuggcucaa

SEQ ID NO: 2721520 - RNA, 14 nt, Human
accuuggcucaagu

SEQ ID NO: 2721521 - RNA, 12 nt, Human
accuuggcugca

SEQ ID NO: 2721522 - RNA, 20 nt, Human
auacaauuuuguuucuguac

SEQ ID NO: 2721523 - RNA, 19 nt, Human
auacaauuuuguuucugua

SEQ ID NO: 2721524 - RNA, 12 nt, Human
auaccugucccc

SEQ ID NO: 2721525 - RNA, 18 nt, Human
auaaugugaaacuggauu

SEQ ID NO: 2721526 - RNA, 17 nt, Human
auaauuaacauguuaaa

SEQ ID NO: 2721527 - RNA, 22 nt, Human
auaauuaacauguuaaaccaug

SEQ ID NO: 2721528 - RNA, 21 nt, Human
auaauuaacauguuaaaccau

SEQ ID NO: 2721529 - RNA, 20 nt, Human
auaauuaacauguuaaacca

SEQ ID NO: 2721530 - RNA, 21 nt, Human
auaaugugaaacuggauuaaa

SEQ ID NO: 2721531 - RNA, 19 nt, Human
auaaugugaaacuggauua

SEQ ID NO: 2721532 - RNA, 18 nt, Human
auaucacuugucaauaaa

SEQ ID NO: 2721533 - RNA, 23 nt, Human
auaugcuucuguuuuauaauuuu

SEQ ID NO: 2721534 - RNA, 19 nt, Human
auaugcuuauacacuuaca

SEQ ID NO: 2721535 - RNA, 16 nt, Human
auaugcuuauacacuu

SEQ ID NO: 2721536 - RNA, 14 nt, Human
auaugcuuauacac

SEQ ID NO: 2721537 - RNA, 15 nt, Human
auauccuuucuaaca

SEQ ID NO: 2721538 - RNA, 16 nt, Human
auauccuuucuaacaa

SEQ ID NO: 2721539 - RNA, 14 nt, Human
auaugcuauuucua

SEQ ID NO: 2721540 - RNA, 22 nt, Human
auaugccugggcagaaggaaga

SEQ ID NO: 2721541 - RNA, 23 nt, Human
auauuucagauaaucacaauaca

SEQ ID NO: 2721542 - RNA, 18 nt, Human
auauuuauuuuaauaaug

SEQ ID NO: 2721543 - RNA, 14 nt, Human
auauuuauuacugu

SEQ ID NO: 2721544 - RNA, 19 nt, Human
auauuuauuacuguaagaa

SEQ ID NO: 2721545 - RNA, 13 nt, Human
auauucaggaagc

SEQ ID NO: 2721546 - RNA, 14 nt, Human
auauucaggaagcu

SEQ ID NO: 2721547 - RNA, 16 nt, Human
auauucaggaagcuca

SEQ ID NO: 2721548 - RNA, 16 nt, Human
auauaggaacuuaaau

SEQ ID NO: 2721549 - RNA, 15 nt, Human
auaguaugguggcug

SEQ ID NO: 2721550 - RNA, 16 nt, Human
auaguaugguggcugg

SEQ ID NO: 2721551 - RNA, 22 nt, Human
auauaaguauucuaaauuuuau

SEQ ID NO: 2721552 - RNA, 15 nt, Human
aguugaauuuuacau

SEQ ID NO: 2721553 - RNA, 20 nt, Human
aguugaauuuauuggcuuuu

SEQ ID NO: 2721554 - RNA, 19 nt, Human
aguugaauuuauuggcuuu

SEQ ID NO: 2721555 - RNA, 17 nt, Human
aguugaauuuauuggcu

SEQ ID NO: 2721556 - RNA, 13 nt, Human
aguugaauuuauu

SEQ ID NO: 2721557 - RNA, 11 nt, Human
aguugaauuua

SEQ ID NO: 2721558 - RNA, 18 nt, Human
aguuacagacaaagcgug

SEQ ID NO: 2721559 - RNA, 16 nt, Human
aguuguuacauuuuua

SEQ ID NO: 2721560 - RNA, 15 nt, Human
aguuguuacauuuuu

SEQ ID NO: 2721561 - RNA, 13 nt, Human
aguuguuacauuu

SEQ ID NO: 2721562 - RNA, 21 nt, Human
agugucuuaauuaaaagaaua

SEQ ID NO: 2721563 - RNA, 23 nt, Human
agugugacaaggauugcuacugu

SEQ ID NO: 2721564 - RNA, 13 nt, Human
agucaaauugugu

SEQ ID NO: 2721565 - RNA, 15 nt, Human
agucaaauuguguga

SEQ ID NO: 2721566 - RNA, 17 nt, Human
agucaaauugugugaaa

SEQ ID NO: 2721567 - RNA, 16 nt, Human
agucaagugaaaaagg

SEQ ID NO: 2721568 - RNA, 20 nt, Human
agucaagugaaaaaggagga

SEQ ID NO: 2721569 - RNA, 16 nt, Human
aguccaagcauuuaga

SEQ ID NO: 2721570 - RNA, 21 nt, Human
aguccaagcauuuagauguau

SEQ ID NO: 2721571 - RNA, 23 nt, Human
agucauucagauaugauucaaau

SEQ ID NO: 2721572 - RNA, 20 nt, Human
agucauucagauaugauuca

SEQ ID NO: 2721573 - RNA, 15 nt, Human
agucauucagauaug

SEQ ID NO: 2721574 - RNA, 13 nt, Human
agugauccuccca

SEQ ID NO: 2721575 - RNA, 17 nt, Human
aucagcugcugaaacaa

SEQ ID NO: 2721576 - RNA, 20 nt, Human
aucagccugcuccagcuguu

SEQ ID NO: 2721577 - RNA, 23 nt, Human
aucagcugcuacuacuccuguag

SEQ ID NO: 2721578 - RNA, 13 nt, Human
aucagcugcuacu

SEQ ID NO: 2721579 - RNA, 19 nt, Human
aucauggagguuugaagau

SEQ ID NO: 2721580 - RNA, 12 nt, Human
aucaccugucuu

SEQ ID NO: 2721581 - RNA, 21 nt, Human
aucaccugucuugccuuuuuc

SEQ ID NO: 2721582 - RNA, 11 nt, Human
aucagccuggg

SEQ ID NO: 2721583 - RNA, 20 nt, Human
aucagccugggcaaugugau

SEQ ID NO: 2721584 - RNA, 21 nt, Human
aucagccugggcaaugugaua

SEQ ID NO: 2721585 - RNA, 12 nt, Human
aucagcugcuac

SEQ ID NO: 2721586 - RNA, 13 nt, Human
aucgaugcagugc

SEQ ID NO: 2721587 - RNA, 14 nt, Human
auccuccucagauc

SEQ ID NO: 2721588 - RNA, 13 nt, Human
auccuuucuaaca

SEQ ID NO: 2721589 - RNA, 11 nt, Human
auccuccucag

SEQ ID NO: 2721590 - RNA, 13 nt, Human
auccuccaggugc

SEQ ID NO: 2721591 - RNA, 14 nt, Human
auccuccaggugca

SEQ ID NO: 2721592 - RNA, 19 nt, Human
auccuccaggugcacaagc

SEQ ID NO: 2721593 - RNA, 22 nt, Human
auccuccaggugcacaagcucc

SEQ ID NO: 2721594 - RNA, 15 nt, Human
aucccuacuguaauu

SEQ ID NO: 2721595 - RNA, 18 nt, Human
auccucauacccaccccc

SEQ ID NO: 2721596 - RNA, 19 nt, Human
auccucauacccaccccca

SEQ ID NO: 2721597 - RNA, 22 nt, Human
auccucauacccacccccaccc

SEQ ID NO: 2721598 - RNA, 18 nt, Human
auccacccaccucagccu

SEQ ID NO: 2721599 - RNA, 20 nt, Human
auccacccaccucagccucc

SEQ ID NO: 2721600 - RNA, 16 nt, Human
auccacccaccucagc

SEQ ID NO: 2721601 - RNA, 22 nt, Human
aucuuauaauuuaaaauaugcu

SEQ ID NO: 2721602 - RNA, 19 nt, Human
aucuuccaacucaaacucu

SEQ ID NO: 2721603 - RNA, 22 nt, Human
aucucucgugauugauaagaac

SEQ ID NO: 2721604 - RNA, 17 nt, Human
aucuucuuuauaauucu

SEQ ID NO: 2721605 - RNA, 17 nt, Human
aucuugaagacuuuucu

SEQ ID NO: 2721606 - RNA, 13 nt, Human
augagccuggcaa

SEQ ID NO: 2721607 - RNA, 14 nt, Human
augagccuggcaag

SEQ ID NO: 2721608 - RNA, 12 nt, Human
augagccuggca

SEQ ID NO: 2721609 - RNA, 17 nt, Human
augacuccagaauuucc

SEQ ID NO: 2721610 - RNA, 12 nt, Human
augacuccagaa

SEQ ID NO: 2721611 - RNA, 16 nt, Human
augacuccagaauuuc

SEQ ID NO: 2721612 - RNA, 14 nt, Human
augacucagaauau

SEQ ID NO: 2721613 - RNA, 12 nt, Human
augacccagugg

SEQ ID NO: 2721614 - RNA, 20 nt, Human
augaaacacucaguuguuca

SEQ ID NO: 2721615 - RNA, 20 nt, Human
auguaagggaaacugccagc

SEQ ID NO: 2721616 - RNA, 17 nt, Human
auguaagcucuacugag

SEQ ID NO: 2721617 - RNA, 22 nt, Human
auguaagggaaacugccagcaa

SEQ ID NO: 2721618 - RNA, 21 nt, Human
auguaagggaaacugccagca

SEQ ID NO: 2721619 - RNA, 16 nt, Human
auguaaguaaacgguc

SEQ ID NO: 2721620 - RNA, 17 nt, Human
auguaauaacugugaag

SEQ ID NO: 2721621 - RNA, 15 nt, Human
auggucggaaaacau

SEQ ID NO: 2721622 - RNA, 15 nt, Human
augucacaggcaggu

SEQ ID NO: 2721623 - RNA, 14 nt, Human
augucacaggcagg

SEQ ID NO: 2721624 - RNA, 16 nt, Human
augucacaggcagguc

SEQ ID NO: 2721625 - RNA, 17 nt, Human
augucacaggcaggucc

SEQ ID NO: 2721626 - RNA, 18 nt, Human
auguucucugaggacacu

SEQ ID NO: 2721627 - RNA, 20 nt, Human
auguucuuucacccuuuucu

SEQ ID NO: 2721628 - RNA, 14 nt, Human
auguucuuaauucu

SEQ ID NO: 2721629 - RNA, 22 nt, Human
auguucugacccugcuucaaau

SEQ ID NO: 2721630 - RNA, 20 nt, Human
auguucuuaguggauguucu

SEQ ID NO: 2721631 - RNA, 15 nt, Human
auguucuuaauucuu

SEQ ID NO: 2721632 - RNA, 16 nt, Human
auguuuuaagaggcag

SEQ ID NO: 2721633 - RNA, 18 nt, Human
auguuuuaagaggcaggg

SEQ ID NO: 2721634 - RNA, 14 nt, Human
auuaaaugcccagc

SEQ ID NO: 2721635 - RNA, 15 nt, Human
auuaaaugcccagcc

SEQ ID NO: 2721636 - RNA, 11 nt, Human
auuaaauuaug

SEQ ID NO: 2721637 - RNA, 16 nt, Human
auuaaaugcccagccc

SEQ ID NO: 2721638 - RNA, 13 nt, Human
auuaaauucuugc

SEQ ID NO: 2721639 - RNA, 14 nt, Human
auguguaaguauuc

SEQ ID NO: 2721640 - RNA, 20 nt, Human
augugggcuaguugggcuuc

SEQ ID NO: 2721641 - RNA, 20 nt, Human
augcaugaaguaauaugcac

SEQ ID NO: 2721642 - RNA, 23 nt, Human
augcaugaaguaauaugcacaca

SEQ ID NO: 2721643 - RNA, 18 nt, Human
augcauuugaaaauuuug

SEQ ID NO: 2721644 - RNA, 12 nt, Human
augcauuugaaa

SEQ ID NO: 2721645 - RNA, 10 nt, Human
augcauuuga

SEQ ID NO: 2721646 - RNA, 15 nt, Human
augccugguggcagc

SEQ ID NO: 2721647 - RNA, 16 nt, Human
augccugguggcagcu

SEQ ID NO: 2721648 - RNA, 17 nt, Human
augccugguggcagcug

SEQ ID NO: 2721649 - RNA, 21 nt, Human
augccuggauggggcugcacc

SEQ ID NO: 2721650 - RNA, 23 nt, Human
augccuggauggggcugcaccgg

SEQ ID NO: 2721651 - RNA, 17 nt, Human
augccugggcagaagga

SEQ ID NO: 2721652 - RNA, 21 nt, Human
augcacagcuaacauggaagu

SEQ ID NO: 2721653 - RNA, 23 nt, Human
augcacacauuuuuuaaaugcac

SEQ ID NO: 2721654 - RNA, 23 nt, Human
augcacagaguuguuacauuuuu

SEQ ID NO: 2721655 - RNA, 14 nt, Human
augcacagcuaaca

SEQ ID NO: 2721656 - RNA, 17 nt, Human
augcacacauuuuuuaa

SEQ ID NO: 2721657 - RNA, 22 nt, Human
augcacacauuuuuuaaaugca

SEQ ID NO: 2721658 - RNA, 19 nt, Human
augcacacauuuuuuaaau

SEQ ID NO: 2721659 - RNA, 22 nt, Human
augcuucuucagagacuccugc

SEQ ID NO: 2721660 - RNA, 19 nt, Human
auggaaaugggcagagcag

SEQ ID NO: 2721661 - RNA, 20 nt, Human
auggaaaugggcagagcaga

SEQ ID NO: 2721662 - RNA, 23 nt, Human
auggcugccaaugggagcucaug

SEQ ID NO: 2721663 - RNA, 15 nt, Human
augggaaugaauguc

SEQ ID NO: 2721664 - RNA, 22 nt, Human
auggagccugcacggugaaugg

SEQ ID NO: 2721665 - RNA, 18 nt, Human
auggagccugcacgguga

SEQ ID NO: 2721666 - RNA, 18 nt, Human
agcuucacuguaaaauaa

SEQ ID NO: 2721667 - RNA, 19 nt, Human
agcuuccuucugugaaagu

SEQ ID NO: 2721668 - RNA, 13 nt, Human
aggaaaaacugau

SEQ ID NO: 2721669 - RNA, 15 nt, Human
aggaaaaacugauuu

SEQ ID NO: 2721670 - RNA, 17 nt, Human
agcugggugucaagagg

SEQ ID NO: 2721671 - RNA, 22 nt, Human
agcugggugucaagagggucug

SEQ ID NO: 2721672 - RNA, 21 nt, Human
agcuggucccacucaguccau

SEQ ID NO: 2721673 - RNA, 19 nt, Human
agcuggucccacucagucc

SEQ ID NO: 2721674 - RNA, 20 nt, Human
aggauguucugggacacagu

SEQ ID NO: 2721675 - RNA, 17 nt, Human
aggaggggauagagaga

SEQ ID NO: 2721676 - RNA, 12 nt, Human
aggauucuuccu

SEQ ID NO: 2721677 - RNA, 20 nt, Human
aggaccccuccaugugggcu

SEQ ID NO: 2721678 - RNA, 15 nt, Human
aggagagcuagcagc

SEQ ID NO: 2721679 - RNA, 14 nt, Human
aggagaggggcaca

SEQ ID NO: 2721680 - RNA, 16 nt, Human
aggagaggggcacagg

SEQ ID NO: 2721681 - RNA, 18 nt, Human
aggagaggggcacagggu

SEQ ID NO: 2721682 - RNA, 14 nt, Human
aggaccucagguga

SEQ ID NO: 2721683 - RNA, 20 nt, Human
aggaccucaggugagaagca

SEQ ID NO: 2721684 - RNA, 17 nt, Human
agguaaggaauaccugu

SEQ ID NO: 2721685 - RNA, 13 nt, Human
agguucagcuugu

SEQ ID NO: 2721686 - RNA, 15 nt, Human
agguuaauaaaguaa

SEQ ID NO: 2721687 - RNA, 14 nt, Human
agguuaauguucau

SEQ ID NO: 2721688 - RNA, 15 nt, Human
agguuaauuccaauu

SEQ ID NO: 2721689 - RNA, 22 nt, Human
agguuaauuccaauuauaugag

SEQ ID NO: 2721690 - RNA, 17 nt, Human
agguucaaagauauuuu

SEQ ID NO: 2721691 - RNA, 15 nt, Human
agguucaaagauauu

SEQ ID NO: 2721692 - RNA, 17 nt, Human
aggugcugccauccagg

SEQ ID NO: 2721693 - RNA, 16 nt, Human
aggugcugccauccag

SEQ ID NO: 2721694 - RNA, 14 nt, Human
aggucgaggcagga

SEQ ID NO: 2721695 - RNA, 23 nt, Human
aggcuagugugguguuuccuggc

SEQ ID NO: 2721696 - RNA, 18 nt, Human
aggcugccucucccauca

SEQ ID NO: 2721697 - RNA, 17 nt, Human
agggacgcuacccggga

SEQ ID NO: 2721698 - RNA, 21 nt, Human
agggacgcuacccgggaaggg

SEQ ID NO: 2721699 - RNA, 12 nt, Human
agggacagaggg

SEQ ID NO: 2721700 - RNA, 13 nt, Human
agggacagagggg

SEQ ID NO: 2721701 - RNA, 20 nt, Human
agggacagaggggguggccu

SEQ ID NO: 2721702 - RNA, 18 nt, Human
agggccuggccugagcug

SEQ ID NO: 2721703 - RNA, 19 nt, Human
agggcgggaggauguucug

SEQ ID NO: 2721704 - RNA, 21 nt, Human
aggggauagagagagaccacu

SEQ ID NO: 2721705 - RNA, 15 nt, Human
aggggcacagggucu

SEQ ID NO: 2721706 - RNA, 17 nt, Human
agggcacaccgggcacu

SEQ ID NO: 2721707 - RNA, 15 nt, Human
agggccuggccugag

SEQ ID NO: 2721708 - RNA, 16 nt, Human
agggccuggccugagc

SEQ ID NO: 2721709 - RNA, 17 nt, Human
agggccuggccugagcu

SEQ ID NO: 2721710 - RNA, 20 nt, Human
agggcacaccgggcacucag

SEQ ID NO: 2721711 - RNA, 21 nt, Human
agggcacaccgggcacucaga

SEQ ID NO: 2721712 - RNA, 22 nt, Human
agggcacagaaaauggaagaca

SEQ ID NO: 2721713 - RNA, 17 nt, Human
agacugcauuauauuua

SEQ ID NO: 2721714 - RNA, 10 nt, Human
agagaagaga

SEQ ID NO: 2721715 - RNA, 21 nt, Human
agagaagagauugugguuuca

SEQ ID NO: 2721716 - RNA, 18 nt, Human
agagaaaguacuucucca

SEQ ID NO: 2721717 - RNA, 23 nt, Human
agagaggguggugaccucugccu

SEQ ID NO: 2721718 - RNA, 23 nt, Human
agacugaguacguugugcauuug

SEQ ID NO: 2721719 - RNA, 17 nt, Human
agacaaugacuuacugu

SEQ ID NO: 2721720 - RNA, 13 nt, Human
agacaaugacuua

SEQ ID NO: 2721721 - RNA, 21 nt, Human
agacaauuuauuauggcacau

SEQ ID NO: 2721722 - RNA, 15 nt, Human
agacaauuuauuaug

SEQ ID NO: 2721723 - RNA, 19 nt, Human
agacaaugacuuacuguac

SEQ ID NO: 2721724 - RNA, 13 nt, Human
agaccaucccuga

SEQ ID NO: 2721725 - RNA, 14 nt, Human
agaccaucccugaa

SEQ ID NO: 2721726 - RNA, 17 nt, Human
agaccaucccugaaggc

SEQ ID NO: 2721727 - RNA, 18 nt, Human
agaccaucccugaaggcc

SEQ ID NO: 2721728 - RNA, 21 nt, Human
agaccaucccugaaggccccg

SEQ ID NO: 2721729 - RNA, 18 nt, Human
agacagcccgggcucugc

SEQ ID NO: 2721730 - RNA, 20 nt, Human
agacagcccgggcucugccu

SEQ ID NO: 2721731 - RNA, 16 nt, Human
agacagcccgggcucu

SEQ ID NO: 2721732 - RNA, 14 nt, Human
agacacaacuauuu

SEQ ID NO: 2721733 - RNA, 17 nt, Human
agacagcccgggcucug

SEQ ID NO: 2721734 - RNA, 18 nt, Human
agacgggggcagagaggg

SEQ ID NO: 2721735 - RNA, 19 nt, Human
agacggagucccaccuugg

SEQ ID NO: 2721736 - RNA, 21 nt, Human
agauaggucagugcaaauacu

SEQ ID NO: 2721737 - RNA, 15 nt, Human
agauagccaaggcca

SEQ ID NO: 2721738 - RNA, 16 nt, Human
agauagccaaggccaa

SEQ ID NO: 2721739 - RNA, 13 nt, Human
agaggagaggggc

SEQ ID NO: 2721740 - RNA, 22 nt, Human
agaggggaacagacuggaagca

SEQ ID NO: 2721741 - RNA, 16 nt, Human
agaggggaagagacuu

SEQ ID NO: 2721742 - RNA, 22 nt, Human
agauacuuggggggcugaggug

SEQ ID NO: 2721743 - RNA, 13 nt, Human
agauagccaaggc

SEQ ID NO: 2721744 - RNA, 23 nt, Human
agaggguggugaccucugccuga

SEQ ID NO: 2721745 - RNA, 14 nt, Human
agaguguugaaacg

SEQ ID NO: 2721746 - RNA, 18 nt, Human
agccucccaaagugcugg

SEQ ID NO: 2721747 - RNA, 19 nt, Human
agccucccaaagugcuggg

SEQ ID NO: 2721748 - RNA, 19 nt, Human
agccgagauugcaccacug

SEQ ID NO: 2721749 - RNA, 21 nt, Human
agccgagaucacgccacugca

SEQ ID NO: 2721750 - RNA, 20 nt, Human
agccgagauugcaccacugc

SEQ ID NO: 2721751 - RNA, 22 nt, Human
agccgcuggggccaguuggucc

SEQ ID NO: 2721752 - RNA, 14 nt, Human
agccgcuggggcca

SEQ ID NO: 2721753 - RNA, 22 nt, Human
agccucccgaguagcugggacu

SEQ ID NO: 2721754 - RNA, 17 nt, Human
agccucccaaagugcug

SEQ ID NO: 2721755 - RNA, 20 nt, Human
agccucccaaagugcuggga

SEQ ID NO: 2721756 - RNA, 18 nt, Human
agccucccgaauagcugg

SEQ ID NO: 2721757 - RNA, 19 nt, Human
agccucccgaauagcuggg

SEQ ID NO: 2721758 - RNA, 20 nt, Human
agccucccgaauagcuggga

SEQ ID NO: 2721759 - RNA, 22 nt, Human
agccucccgaauagcugggacu

SEQ ID NO: 2721760 - RNA, 17 nt, Human
agccucccgaguagcug

SEQ ID NO: 2721761 - RNA, 16 nt, Human
agccccagugcccaca

SEQ ID NO: 2721762 - RNA, 20 nt, Human
agccccaucccaaacccuuc

SEQ ID NO: 2721763 - RNA, 11 nt, Human
agccccauccu

SEQ ID NO: 2721764 - RNA, 15 nt, Human
agcccugagcuuucu

SEQ ID NO: 2721765 - RNA, 19 nt, Human
agccgagaucacgccacug

SEQ ID NO: 2721766 - RNA, 20 nt, Human
agccgagaucacgccacugc

SEQ ID NO: 2721767 - RNA, 21 nt, Human
agcaguugaaaagacuccaaa

SEQ ID NO: 2721768 - RNA, 23 nt, Human
agcaguugaaaagacuccaaaga

SEQ ID NO: 2721769 - RNA, 16 nt, Human
agcaguucagagcugc

SEQ ID NO: 2721770 - RNA, 15 nt, Human
agcaguucagagcug

SEQ ID NO: 2721771 - RNA, 17 nt, Human
agcaguucagagcugcc

SEQ ID NO: 2721772 - RNA, 18 nt, Human
agcaguucagagcugccc

SEQ ID NO: 2721773 - RNA, 19 nt, Human
agcacuaaggugugcucug

SEQ ID NO: 2721774 - RNA, 21 nt, Human
agcagccacauuccugaugcu

SEQ ID NO: 2721775 - RNA, 19 nt, Human
agcaguucagagcugcccu

SEQ ID NO: 2721776 - RNA, 15 nt, Human
agccagauuuuccug

SEQ ID NO: 2721777 - RNA, 19 nt, Human
agccagauuuuccugaaaa

SEQ ID NO: 2721778 - RNA, 17 nt, Human
agccauguuuauuacag

SEQ ID NO: 2721779 - RNA, 22 nt, Human
agccauguuuauuacaguauaa

SEQ ID NO: 2721780 - RNA, 20 nt, Human
agccagaggagagaggaccc

SEQ ID NO: 2721781 - RNA, 23 nt, Human
agccaaggccaaaggaagcacau

SEQ ID NO: 2721782 - RNA, 22 nt, Human
agccaaggccaaaggaagcaca

SEQ ID NO: 2721783 - RNA, 20 nt, Human
agccaaggccaaaggaagca

SEQ ID NO: 2721784 - RNA, 12 nt, Human
agcaugccugga

SEQ ID NO: 2721785 - RNA, 19 nt, Human
agccaaagcuaggccuggc

SEQ ID NO: 2721786 - RNA, 20 nt, Human
agccaaagcuaggccuggcc

SEQ ID NO: 2721787 - RNA, 23 nt, Human
agccaaagcuaggccuggccaga

SEQ ID NO: 2721788 - RNA, 17 nt, Human
caagcuggucccacuca

SEQ ID NO: 2721789 - RNA, 19 nt, Human
caagcuggucccacucagu

SEQ ID NO: 2721790 - RNA, 21 nt, Human
caagccagauuuuccugaaaa

SEQ ID NO: 2721791 - RNA, 22 nt, Human
caagccaccaacauacucccau

SEQ ID NO: 2721792 - RNA, 14 nt, Human
caagcaggacaugg

SEQ ID NO: 2721793 - RNA, 18 nt, Human
caagcaggacauggacaa

SEQ ID NO: 2721794 - RNA, 20 nt, Human
caagcgauucuucugcuuca

SEQ ID NO: 2721795 - RNA, 22 nt, Human
caagcgauucuucugcuucagc

SEQ ID NO: 2721796 - RNA, 19 nt, Human
caagcgauucuucugcuuc

SEQ ID NO: 2721797 - RNA, 14 nt, Human
caaguuaaauaaau

SEQ ID NO: 2721798 - RNA, 18 nt, Human
caagugagagcugggugu

SEQ ID NO: 2721799 - RNA, 21 nt, Human
caaguccucuuuucugagagg

SEQ ID NO: 2721800 - RNA, 14 nt, Human
caagugagagcugg

SEQ ID NO: 2721801 - RNA, 15 nt, Human
caagugagagcuggg

SEQ ID NO: 2721802 - RNA, 17 nt, Human
caagugagagcugggug

SEQ ID NO: 2721803 - RNA, 12 nt, Human
caaggcugcagu

SEQ ID NO: 2721804 - RNA, 15 nt, Human
caaggcugcagugag

SEQ ID NO: 2721805 - RNA, 21 nt, Human
caaggcugucaauuacaggaa

SEQ ID NO: 2721806 - RNA, 23 nt, Human
caaggcugucaauuacaggaagu

SEQ ID NO: 2721807 - RNA, 17 nt, Human
caaggggcccaaauucu

SEQ ID NO: 2721808 - RNA, 18 nt, Human
caaggggcccaaauucuu

SEQ ID NO: 2721809 - RNA, 20 nt, Human
caaggucauuuuuuuuaaga

SEQ ID NO: 2721810 - RNA, 14 nt, Human
caaggucauuuuuu

SEQ ID NO: 2721811 - RNA, 14 nt, Human
caaguccucuuuuc

SEQ ID NO: 2721812 - RNA, 22 nt, Human
caaccccuucgcuccugugucu

SEQ ID NO: 2721813 - RNA, 22 nt, Human
caacacucacauuuauucugcu

SEQ ID NO: 2721814 - RNA, 18 nt, Human
caacacucauugaccuga

SEQ ID NO: 2721815 - RNA, 20 nt, Human
caacacucauugaccugagg

SEQ ID NO: 2721816 - RNA, 22 nt, Human
caacacucauugaccugaggcc

SEQ ID NO: 2721817 - RNA, 13 nt, Human
caacgucugugcc

SEQ ID NO: 2721818 - RNA, 14 nt, Human
caacgucugugcca

SEQ ID NO: 2721819 - RNA, 15 nt, Human
caaccuccugggcua

SEQ ID NO: 2721820 - RNA, 14 nt, Human
caaccuccugggcu

SEQ ID NO: 2721821 - RNA, 18 nt, Human
caagacucuuuggacacu

SEQ ID NO: 2721822 - RNA, 13 nt, Human
caagagcccaggc

SEQ ID NO: 2721823 - RNA, 14 nt, Human
caagagcccaggcc

SEQ ID NO: 2721824 - RNA, 15 nt, Human
caagagcccaggccu

SEQ ID NO: 2721825 - RNA, 18 nt, Human
caagacgcugugcugccc

SEQ ID NO: 2721826 - RNA, 23 nt, Human
caagacgcugugcugcccugccc

SEQ ID NO: 2721827 - RNA, 16 nt, Human
caagagcccaggccuc

SEQ ID NO: 2721828 - RNA, 15 nt, Human
caagcaccuccugcc

SEQ ID NO: 2721829 - RNA, 16 nt, Human
caagcaccuccugccu

SEQ ID NO: 2721830 - RNA, 17 nt, Human
caagcaccuccugccuc

SEQ ID NO: 2721831 - RNA, 20 nt, Human
caagaacuuuccaggaaggc

SEQ ID NO: 2721832 - RNA, 14 nt, Human
caagaccuucuccu

SEQ ID NO: 2721833 - RNA, 16 nt, Human
caagaccuucuccuuc

SEQ ID NO: 2721834 - RNA, 17 nt, Human
caagaccuucuccuuca

SEQ ID NO: 2721835 - RNA, 18 nt, Human
caagaccuucuccuucac

SEQ ID NO: 2721836 - RNA, 16 nt, Human
caagacgcugugcugc

SEQ ID NO: 2721837 - RNA, 17 nt, Human
caagacgcugugcugcc

SEQ ID NO: 2721838 - RNA, 15 nt, Human
caagaaaacaacuuc

SEQ ID NO: 2721839 - RNA, 17 nt, Human
caaugcacuuuguucug

SEQ ID NO: 2721840 - RNA, 22 nt, Human
caaugcacuuuguucuggcucu

SEQ ID NO: 2721841 - RNA, 20 nt, Human
caaugcacuuuguucuggcu

SEQ ID NO: 2721842 - RNA, 21 nt, Human
caaugcacuuuguucuggcuc

SEQ ID NO: 2721843 - RNA, 15 nt, Human
caaugugauaaaacc

SEQ ID NO: 2721844 - RNA, 17 nt, Human
caaugugauaaaacccc

SEQ ID NO: 2721845 - RNA, 23 nt, Human
caauucucauuugucacacacuu

SEQ ID NO: 2721846 - RNA, 16 nt, Human
caauuacaggaaguac

SEQ ID NO: 2721847 - RNA, 23 nt, Human
caauacaucccuuaccugggaaa

SEQ ID NO: 2721848 - RNA, 13 nt, Human
caauaggaaaaac

SEQ ID NO: 2721849 - RNA, 12 nt, Human
caauaggaaaaa

SEQ ID NO: 2721850 - RNA, 17 nt, Human
caauauucgcuguguca

SEQ ID NO: 2721851 - RNA, 23 nt, Human
caaugaccuuucaauaggaaaaa

SEQ ID NO: 2721852 - RNA, 21 nt, Human
caaugaccuuucaauaggaaa

SEQ ID NO: 2721853 - RNA, 15 nt, Human
caaugacuuacugua

SEQ ID NO: 2721854 - RNA, 18 nt, Human
caaugacuuacuguacau

SEQ ID NO: 2721855 - RNA, 17 nt, Human
caaugacuuacuguaca

SEQ ID NO: 2721856 - RNA, 14 nt, Human
caauaggaaaaacu

SEQ ID NO: 2721857 - RNA, 17 nt, Human
caaaauaaaaaugaggu

SEQ ID NO: 2721858 - RNA, 22 nt, Human
caaaacucuccucugcugcugg

SEQ ID NO: 2721859 - RNA, 20 nt, Human
caaaacucuccucugcugcu

SEQ ID NO: 2721860 - RNA, 21 nt, Human
caaaacucuccucugcugcug

SEQ ID NO: 2721861 - RNA, 19 nt, Human
caaaaaucucaauauuuca

SEQ ID NO: 2721862 - RNA, 23 nt, Human
caaaaauauuuuaugauccagca

SEQ ID NO: 2721863 - RNA, 22 nt, Human
caaaaauauuuuaugauccagc

SEQ ID NO: 2721864 - RNA, 21 nt, Human
caaaaauauuuuaugauccag

SEQ ID NO: 2721865 - RNA, 17 nt, Human
caaaaauauuuuaugau

SEQ ID NO: 2721866 - RNA, 15 nt, Human
caaaaauauuuuaug

SEQ ID NO: 2721867 - RNA, 14 nt, Human
caaaaauauuuuau

SEQ ID NO: 2721868 - RNA, 13 nt, Human
auuuuccugaaaa

SEQ ID NO: 2721869 - RNA, 21 nt, Human
auuuugggguacccacugcuc

SEQ ID NO: 2721870 - RNA, 22 nt, Human
auuuugggguacccacugcucu

SEQ ID NO: 2721871 - RNA, 23 nt, Human
auuuugggguacccacugcucug

SEQ ID NO: 2721872 - RNA, 16 nt, Human
caaaaaaugcuugcuu

SEQ ID NO: 2721873 - RNA, 17 nt, Human
caaaaacacagcaaggg

SEQ ID NO: 2721874 - RNA, 15 nt, Human
caaaaacacagcaag

SEQ ID NO: 2721875 - RNA, 14 nt, Human
caaaaacacagcaa

SEQ ID NO: 2721876 - RNA, 13 nt, Human
caaaaacacagca

SEQ ID NO: 2721877 - RNA, 13 nt, Human
caaaaaggcagga

SEQ ID NO: 2721878 - RNA, 18 nt, Human
caaaaaccaguauuguac

SEQ ID NO: 2721879 - RNA, 20 nt, Human
caaaaaccaguauuguacaa

SEQ ID NO: 2721880 - RNA, 19 nt, Human
caaaaaccaguauuguaca

SEQ ID NO: 2721881 - RNA, 21 nt, Human
caaauaugcaaagcacugacu

SEQ ID NO: 2721882 - RNA, 19 nt, Human
caaauaugcaaagcacuga

SEQ ID NO: 2721883 - RNA, 20 nt, Human
caaauacgugggcauucaaa

SEQ ID NO: 2721884 - RNA, 22 nt, Human
caaauacgugggcauucaaaug

SEQ ID NO: 2721885 - RNA, 21 nt, Human
caaauacgugggcauucaaau

SEQ ID NO: 2721886 - RNA, 23 nt, Human
caaagugcugggauuacaggugu

SEQ ID NO: 2721887 - RNA, 19 nt, Human
caaagugcugggauuacag

SEQ ID NO: 2721888 - RNA, 19 nt, Human
caaaggguaucaggugcug

SEQ ID NO: 2721889 - RNA, 15 nt, Human
caaauugugugaaag

SEQ ID NO: 2721890 - RNA, 11 nt, Human
caaauuucuaa

SEQ ID NO: 2721891 - RNA, 14 nt, Human
caaauuucuaaauc

SEQ ID NO: 2721892 - RNA, 12 nt, Human
caaauuucuaaa

SEQ ID NO: 2721893 - RNA, 15 nt, Human
caaaugucuauaaac

SEQ ID NO: 2721894 - RNA, 14 nt, Human
caaaugucuauaaa

SEQ ID NO: 2721895 - RNA, 16 nt, Human
caaaauuuuuucucua

SEQ ID NO: 2721896 - RNA, 21 nt, Human
caaaauuuuuucucuaggaaa

SEQ ID NO: 2721897 - RNA, 22 nt, Human
caaaauuuuuucucuaggaaau

SEQ ID NO: 2721898 - RNA, 15 nt, Human
caaacacauacagga

SEQ ID NO: 2721899 - RNA, 14 nt, Human
caaacccuucagug

SEQ ID NO: 2721900 - RNA, 20 nt, Human
caaacccuucagugccaaaa

SEQ ID NO: 2721901 - RNA, 22 nt, Human
caaaauugauguguuuauuuau

SEQ ID NO: 2721902 - RNA, 15 nt, Human
caaaauugauguguu

SEQ ID NO: 2721903 - RNA, 16 nt, Human
caaaauugauguguuu

SEQ ID NO: 2721904 - RNA, 12 nt, Human
caaaauaaaacu

SEQ ID NO: 2721905 - RNA, 15 nt, Human
caaaauguaggguua

SEQ ID NO: 2721906 - RNA, 17 nt, Human
caaagccuccuccagcc

SEQ ID NO: 2721907 - RNA, 18 nt, Human
caaagccuccuccagccg

SEQ ID NO: 2721908 - RNA, 22 nt, Human
caaagccaaagcuaggccuggc

SEQ ID NO: 2721909 - RNA, 17 nt, Human
caaacucaccugccccu

SEQ ID NO: 2721910 - RNA, 19 nt, Human
caaagcugaugacaacuuc

SEQ ID NO: 2721911 - RNA, 12 nt, Human
caaaggaagcac

SEQ ID NO: 2721912 - RNA, 13 nt, Human
caaaggaagcaca

SEQ ID NO: 2721913 - RNA, 13 nt, Human
caaagcuaggccu

SEQ ID NO: 2721914 - RNA, 14 nt, Human
caaagcuaggccug

SEQ ID NO: 2721915 - RNA, 19 nt, Human
caaagcuaggccuggccag

SEQ ID NO: 2721916 - RNA, 14 nt, Human
caaaggaagcacau

SEQ ID NO: 2721917 - RNA, 16 nt, Human
caaaggguaucaggug

SEQ ID NO: 2721918 - RNA, 18 nt, Human
caaaggguaucaggugcu

SEQ ID NO: 2721919 - RNA, 19 nt, Human
cacaguuuucugagaaaga

SEQ ID NO: 2721920 - RNA, 17 nt, Human
cacaguuuucugagaaa

SEQ ID NO: 2721921 - RNA, 16 nt, Human
cacaguuuucugagaa

SEQ ID NO: 2721922 - RNA, 14 nt, Human
cacauaucugucau

SEQ ID NO: 2721923 - RNA, 11 nt, Human
cacaggcaggu

SEQ ID NO: 2721924 - RNA, 14 nt, Human
cacaggcaggucca

SEQ ID NO: 2721925 - RNA, 15 nt, Human
cacaggcagguccag

SEQ ID NO: 2721926 - RNA, 22 nt, Human
cacagcugggguggggaccuca

SEQ ID NO: 2721927 - RNA, 23 nt, Human
cacagcugggguggggaccucag

SEQ ID NO: 2721928 - RNA, 21 nt, Human
cacagcuucauuuccuguguc

SEQ ID NO: 2721929 - RNA, 22 nt, Human
cacagcuucauuuccugugucu

SEQ ID NO: 2721930 - RNA, 14 nt, Human
cacaguucucuccu

SEQ ID NO: 2721931 - RNA, 15 nt, Human
cacaguucucuccuu

SEQ ID NO: 2721932 - RNA, 19 nt, Human
cacagugaucaaguuauuu

SEQ ID NO: 2721933 - RNA, 22 nt, Human
cacagugagucgaggacaggga

SEQ ID NO: 2721934 - RNA, 21 nt, Human
cacagugagucgaggacaggg

SEQ ID NO: 2721935 - RNA, 13 nt, Human
cacaguccuuacc

SEQ ID NO: 2721936 - RNA, 15 nt, Human
cacaguccuuaccag

SEQ ID NO: 2721937 - RNA, 21 nt, Human
cacaguccuuaccagcagagc

SEQ ID NO: 2721938 - RNA, 22 nt, Human
cacaguccuuaccagcagagca

SEQ ID NO: 2721939 - RNA, 16 nt, Human
cacuugacaucaacug

SEQ ID NO: 2721940 - RNA, 20 nt, Human
cacuugagaauuacccuuuu

SEQ ID NO: 2721941 - RNA, 17 nt, Human
cacuugagaauuacccu

SEQ ID NO: 2721942 - RNA, 19 nt, Human
cacuugacaucaacugcau

SEQ ID NO: 2721943 - RNA, 13 nt, Human
cacuugaguccag

SEQ ID NO: 2721944 - RNA, 13 nt, Human
cacuugcagacuc

SEQ ID NO: 2721945 - RNA, 18 nt, Human
cacuuucuagccagagga

SEQ ID NO: 2721946 - RNA, 19 nt, Human
cacuuucuagccagaggag

SEQ ID NO: 2721947 - RNA, 20 nt, Human
cacuuucuagccagaggaga

SEQ ID NO: 2721948 - RNA, 24 nt, Human
cacuugcagacucuacagaggcca

SEQ ID NO: 2721949 - RNA, 14 nt, Human
cacuugcagacucu

SEQ ID NO: 2721950 - RNA, 18 nt, Human
cacuugcagacucuacag

SEQ ID NO: 2721951 - RNA, 19 nt, Human
cacuugcagacucuacaga

SEQ ID NO: 2721952 - RNA, 22 nt, Human
cacuugcagacucuacagaggc

SEQ ID NO: 2721953 - RNA, 16 nt, Human
cacuucccuacaugga

SEQ ID NO: 2721954 - RNA, 21 nt, Human
cacuucgggaggucgaggcag

SEQ ID NO: 2721955 - RNA, 23 nt, Human
cacuucgggaggucgaggcagga

SEQ ID NO: 2721956 - RNA, 22 nt, Human
cacuucugccauauucuguugg

SEQ ID NO: 2721957 - RNA, 12 nt, Human
cacuucagcuga

SEQ ID NO: 2721958 - RNA, 21 nt, Human
cacuucagcugacuuuucugu

SEQ ID NO: 2721959 - RNA, 19 nt, Human
cacuguggguagacacaca

SEQ ID NO: 2721960 - RNA, 17 nt, Human
cacugugcugagucuga

SEQ ID NO: 2721961 - RNA, 20 nt, Human
cacugugcugagucugaagg

SEQ ID NO: 2721962 - RNA, 21 nt, Human
cacugugcugagucugaaggc

SEQ ID NO: 2721963 - RNA, 22 nt, Human
cacugugcugagucugaaggcu

SEQ ID NO: 2721964 - RNA, 13 nt, Human
cacugugcugagu

SEQ ID NO: 2721965 - RNA, 15 nt, Human
cacugugcugagucu

SEQ ID NO: 2721966 - RNA, 18 nt, Human
cacugugccaugugccag

SEQ ID NO: 2721967 - RNA, 15 nt, Human
cacugugccaugugc

SEQ ID NO: 2721968 - RNA, 16 nt, Human
cacugugccaugugcc

SEQ ID NO: 2721969 - RNA, 22 nt, Human
cacuguggguagacacacauga

SEQ ID NO: 2721970 - RNA, 24 nt, Human
cacuguggguagacacacaugaag

SEQ ID NO: 2721971 - RNA, 13 nt, Human
cacuguucucugc

SEQ ID NO: 2721972 - RNA, 14 nt, Human
cacuguucucugcc

SEQ ID NO: 2721973 - RNA, 15 nt, Human
cacuguucucugccc

SEQ ID NO: 2721974 - RNA, 16 nt, Human
cacuguucucugcccu

SEQ ID NO: 2721975 - RNA, 17 nt, Human
cacuguucucugcccuc

SEQ ID NO: 2721976 - RNA, 19 nt, Human
cacuguucucugcccucca

SEQ ID NO: 2721977 - RNA, 21 nt, Human
cacuguucucugcccuccaag

SEQ ID NO: 2721978 - RNA, 22 nt, Human
cacuguucucugcccuccaaga

SEQ ID NO: 2721979 - RNA, 14 nt, Human
cacugucaagauga

SEQ ID NO: 2721980 - RNA, 13 nt, Human
cacugugaagaga

SEQ ID NO: 2721981 - RNA, 14 nt, Human
cacugugccaugug

SEQ ID NO: 2721982 - RNA, 20 nt, Human
cacugacuucuaaguaaaac

SEQ ID NO: 2721983 - RNA, 16 nt, Human
cacugacuucuaagua

SEQ ID NO: 2721984 - RNA, 15 nt, Human
cacugacuucuaagu

SEQ ID NO: 2721985 - RNA, 14 nt, Human
cacugacuucuaag

SEQ ID NO: 2721986 - RNA, 21 nt, Human
cacugacuucuaaguaaaacc

SEQ ID NO: 2721987 - RNA, 12 nt, Human
cacugagacagc

SEQ ID NO: 2721988 - RNA, 13 nt, Human
cacugagacagcc

SEQ ID NO: 2721989 - RNA, 14 nt, Human
cacugagacagccc

SEQ ID NO: 2721990 - RNA, 17 nt, Human
cacugagacagcccggg

SEQ ID NO: 2721991 - RNA, 19 nt, Human
cacugagacagcccgggcu

SEQ ID NO: 2721992 - RNA, 22 nt, Human
cacugagacagcccgggcucug

SEQ ID NO: 2721993 - RNA, 23 nt, Human
cacucuggcagcucagagagggu

SEQ ID NO: 2721994 - RNA, 20 nt, Human
cacucuggcagcucagagag

SEQ ID NO: 2721995 - RNA, 21 nt, Human
cacucuggcagcucagagagg

SEQ ID NO: 2721996 - RNA, 15 nt, Human
cacucuggcagcuca

SEQ ID NO: 2721997 - RNA, 16 nt, Human
cacucuggcagcucag

SEQ ID NO: 2721998 - RNA, 17 nt, Human
cacucuggcagcucaga

SEQ ID NO: 2721999 - RNA, 19 nt, Human
cacucuggcagcucagaga

SEQ ID NO: 2722000 - RNA, 15 nt, Human
cacucugucgcccag

SEQ ID NO: 2722001 - RNA, 16 nt, Human
cacucugucgcccagu

SEQ ID NO: 2722002 - RNA, 19 nt, Human
cacucugucgcccagucug

SEQ ID NO: 2722003 - RNA, 23 nt, Human
cacugacauuguuggccaaagcc

SEQ ID NO: 2722004 - RNA, 13 nt, Human
cacugacagauuu

SEQ ID NO: 2722005 - RNA, 17 nt, Human
cacugacagauuuccau

SEQ ID NO: 2722006 - RNA, 22 nt, Human
cacugacagauuuccauccuag

SEQ ID NO: 2722007 - RNA, 14 nt, Human
cacugcaaccuccg

SEQ ID NO: 2722008 - RNA, 16 nt, Human
cacugcaaccuccgcc

SEQ ID NO: 2722009 - RNA, 23 nt, Human
cacugcaaccuccgccucuuggg

SEQ ID NO: 2722010 - RNA, 13 nt, Human
cacugcaaccucc

SEQ ID NO: 2722011 - RNA, 23 nt, Human
cacugauuugacauagucuggcu

SEQ ID NO: 2722012 - RNA, 21 nt, Human
cacugauuugacauagucugg

SEQ ID NO: 2722013 - RNA, 23 nt, Human
cacugagacagcccgggcucugc

SEQ ID NO: 2722014 - RNA, 14 nt, Human
cacugaugggcaac

SEQ ID NO: 2722015 - RNA, 18 nt, Human
cacugaugggcaaccccc

SEQ ID NO: 2722016 - RNA, 24 nt, Human
cacugaugggcaacccccagccug

SEQ ID NO: 2722017 - RNA, 20 nt, Human
cacugccuucucaacuccaa

SEQ ID NO: 2722018 - RNA, 12 nt, Human
cacugcucuggu

SEQ ID NO: 2722019 - RNA, 14 nt, Human
cacugcaccgggcc

SEQ ID NO: 2722020 - RNA, 15 nt, Human
cacugcaccgggcca

SEQ ID NO: 2722021 - RNA, 16 nt, Human
cacugcaccgggccac

SEQ ID NO: 2722022 - RNA, 18 nt, Human
cacugcaccgggccacag

SEQ ID NO: 2722023 - RNA, 19 nt, Human
cacugcaccgggccacaga

SEQ ID NO: 2722024 - RNA, 18 nt, Human
cacugcacuauagccuag

SEQ ID NO: 2722025 - RNA, 17 nt, Human
cacuggaacacuaauga

SEQ ID NO: 2722026 - RNA, 21 nt, Human
cacugcuuuuggucuguguga

SEQ ID NO: 2722027 - RNA, 13 nt, Human
cacugcuuaacuu

SEQ ID NO: 2722028 - RNA, 14 nt, Human
cacugcuuccagug

SEQ ID NO: 2722029 - RNA, 15 nt, Human
cacugcuuccaguga

SEQ ID NO: 2722030 - RNA, 16 nt, Human
cacugcuuccagugag

SEQ ID NO: 2722031 - RNA, 22 nt, Human
cacugcuuccagugaggcucug

SEQ ID NO: 2722032 - RNA, 20 nt, Human
cacugcuuuuggucugugug

SEQ ID NO: 2722033 - RNA, 18 nt, Human
cacugcuuccagugaggc

SEQ ID NO: 2722034 - RNA, 19 nt, Human
cacugcuuccagugaggcu

SEQ ID NO: 2722035 - RNA, 20 nt, Human
cacugcuuccagugaggcuc

SEQ ID NO: 2722036 - RNA, 21 nt, Human
cacugcuuccagugaggcucu

SEQ ID NO: 2722037 - RNA, 16 nt, Human
cacgugguccuaaucu

SEQ ID NO: 2722038 - RNA, 19 nt, Human
cacgugguccuaaucuucu

SEQ ID NO: 2722039 - RNA, 13 nt, Human
cacuaaacaaaga

SEQ ID NO: 2722040 - RNA, 23 nt, Human
cacguuucuaaaggcuaccuuug

SEQ ID NO: 2722041 - RNA, 14 nt, Human
cacguuucuaaagg

SEQ ID NO: 2722042 - RNA, 12 nt, Human
cacguuucuaaa

SEQ ID NO: 2722043 - RNA, 18 nt, Human
cacguacacacacauaca

SEQ ID NO: 2722044 - RNA, 19 nt, Human
cacguacacacacauacac

SEQ ID NO: 2722045 - RNA, 14 nt, Human
cacguacacacaca

SEQ ID NO: 2722046 - RNA, 19 nt, Human
cacgccuguaauccuagca

SEQ ID NO: 2722047 - RNA, 20 nt, Human
cacgccuguaauccuagcac

SEQ ID NO: 2722048 - RNA, 15 nt, Human
cacgcgugcacacac

SEQ ID NO: 2722049 - RNA, 16 nt, Human
cacgcgugcacacacc

SEQ ID NO: 2722050 - RNA, 21 nt, Human
cacgcgugcacacaccagagc

SEQ ID NO: 2722051 - RNA, 23 nt, Human
cacgcgugcacacaccagagccc

SEQ ID NO: 2722052 - RNA, 23 nt, Human
cacggugaauggcuuuguauaga

SEQ ID NO: 2722053 - RNA, 20 nt, Human
cacggugaauggcuuuguau

SEQ ID NO: 2722054 - RNA, 20 nt, Human
cacgcuggaccuugaacugg

SEQ ID NO: 2722055 - RNA, 17 nt, Human
cacgcuggaccuugaac

SEQ ID NO: 2722056 - RNA, 16 nt, Human
cacggcucacugcagc

SEQ ID NO: 2722057 - RNA, 17 nt, Human
cacggcucacugcagcc

SEQ ID NO: 2722058 - RNA, 19 nt, Human
cacggcucacugcagccuc

SEQ ID NO: 2722059 - RNA, 20 nt, Human
cacggcucacugcagccuca

SEQ ID NO: 2722060 - RNA, 20 nt, Human
cacgagcaggcuacugucag

SEQ ID NO: 2722061 - RNA, 19 nt, Human
cacgagcaggcuacuguca

SEQ ID NO: 2722062 - RNA, 17 nt, Human
cacgagcaggcuacugu

SEQ ID NO: 2722063 - RNA, 22 nt, Human
cacgagcaggcuacugucagcu

SEQ ID NO: 2722064 - RNA, 17 nt, Human
cacgcacuucgggaggu

SEQ ID NO: 2722065 - RNA, 16 nt, Human
cacgauuucuguuuag

SEQ ID NO: 2722066 - RNA, 14 nt, Human
cacgauuucuguuu

SEQ ID NO: 2722067 - RNA, 12 nt, Human
cacgauuucugu

SEQ ID NO: 2722068 - RNA, 17 nt, Human
cacgcccccacugguga

SEQ ID NO: 2722069 - RNA, 18 nt, Human
cacgcccccacuggugac

SEQ ID NO: 2722070 - RNA, 23 nt, Human
cacgccagauucuuuccugaggc

SEQ ID NO: 2722071 - RNA, 13 nt, Human
cacgcccccacug

SEQ ID NO: 2722072 - RNA, 15 nt, Human
cacgcccccacuggu

SEQ ID NO: 2722073 - RNA, 13 nt, Human
cacgccacugcac

SEQ ID NO: 2722074 - RNA, 15 nt, Human
cacgccacugcacua

SEQ ID NO: 2722075 - RNA, 19 nt, Human
cacgccagauucuuuccug

SEQ ID NO: 2722076 - RNA, 20 nt, Human
cacgccagauucuuuccuga

SEQ ID NO: 2722077 - RNA, 22 nt, Human
cacgccagauucuuuccugagg

SEQ ID NO: 2722078 - RNA, 18 nt, Human
caccuugacagggcacac

SEQ ID NO: 2722079 - RNA, 15 nt, Human
caccuugacagggca

SEQ ID NO: 2722080 - RNA, 16 nt, Human
caccuugacagggcac

SEQ ID NO: 2722081 - RNA, 13 nt, Human
caccuugacaggg

SEQ ID NO: 2722082 - RNA, 17 nt, Human
cacgacugcccggcagg

SEQ ID NO: 2722083 - RNA, 16 nt, Human
cacgacugcccggcag

SEQ ID NO: 2722084 - RNA, 16 nt, Human
cacgaauauugcugau

SEQ ID NO: 2722085 - RNA, 19 nt, Human
cacgaauauugcugauggu

SEQ ID NO: 2722086 - RNA, 22 nt, Human
cacgaauauugcugauggugca

SEQ ID NO: 2722087 - RNA, 21 nt, Human
caccuuagacagucccugcca

SEQ ID NO: 2722088 - RNA, 23 nt, Human
caccuuagacagucccugccaau

SEQ ID NO: 2722089 - RNA, 20 nt, Human
caccugucuugccuuuuuca

SEQ ID NO: 2722090 - RNA, 17 nt, Human
caccugucuugccuuuu

SEQ ID NO: 2722091 - RNA, 14 nt, Human
caccuuagacaguc

SEQ ID NO: 2722092 - RNA, 16 nt, Human
caccuuagacaguccc

SEQ ID NO: 2722093 - RNA, 18 nt, Human
caccuuagacagucccug

SEQ ID NO: 2722094 - RNA, 19 nt, Human
caccuuagacagucccugc

SEQ ID NO: 2722095 - RNA, 16 nt, Human
cacucaaaucaagaaa

SEQ ID NO: 2722096 - RNA, 20 nt, Human
cacucaaaagcugggcaggu

SEQ ID NO: 2722097 - RNA, 15 nt, Human
cacucaaaagcuggg

SEQ ID NO: 2722098 - RNA, 17 nt, Human
cacucaaaagcugggca

SEQ ID NO: 2722099 - RNA, 18 nt, Human
cacucaaaagcugggcag

SEQ ID NO: 2722100 - RNA, 19 nt, Human
cacucaaaagcugggcagg

SEQ ID NO: 2722101 - RNA, 20 nt, Human
cacuauguugcccaggcagg

SEQ ID NO: 2722102 - RNA, 21 nt, Human
cacuauguugcccaggcaggu

SEQ ID NO: 2722103 - RNA, 12 nt, Human
cacucagaagac

SEQ ID NO: 2722104 - RNA, 16 nt, Human
cacucagaagacacug

SEQ ID NO: 2722105 - RNA, 17 nt, Human
cacucagaagacacuga

SEQ ID NO: 2722106 - RNA, 19 nt, Human
cacucacauuuauucugcu

SEQ ID NO: 2722107 - RNA, 20 nt, Human
cacucacauuuauucugcuc

SEQ ID NO: 2722108 - RNA, 22 nt, Human
cacucagaagacacugaugggc

SEQ ID NO: 2722109 - RNA, 18 nt, Human
cacucagaagacacugau

SEQ ID NO: 2722110 - RNA, 19 nt, Human
cacucagaagacacugaug

SEQ ID NO: 2722111 - RNA, 14 nt, Human
cacuaaccacgcug

SEQ ID NO: 2722112 - RNA, 15 nt, Human
cacuaaccacgcugg

SEQ ID NO: 2722113 - RNA, 16 nt, Human
cacuaaccacgcugga

SEQ ID NO: 2722114 - RNA, 17 nt, Human
cacuaagagagaaugag

SEQ ID NO: 2722115 - RNA, 18 nt, Human
cacuaaccacgcuggacc

SEQ ID NO: 2722116 - RNA, 17 nt, Human
cacuaaggugugcucug

SEQ ID NO: 2722117 - RNA, 18 nt, Human
cacuaaggugugcucuga

SEQ ID NO: 2722118 - RNA, 14 nt, Human
cacuaguauuucua

SEQ ID NO: 2722119 - RNA, 19 nt, Human
cacuaguauuucuaugaaa

SEQ ID NO: 2722120 - RNA, 14 nt, Human
cacuauaauguaag

SEQ ID NO: 2722121 - RNA, 18 nt, Human
cacuauaauguaagcucu

SEQ ID NO: 2722122 - RNA, 14 nt, Human
cacuauagccuagg

SEQ ID NO: 2722123 - RNA, 21 nt, Human
cacuauagccuaggugacaga

SEQ ID NO: 2722124 - RNA, 15 nt, Human
cacuauguugcccag

SEQ ID NO: 2722125 - RNA, 16 nt, Human
cacuauguugcccagg

SEQ ID NO: 2722126 - RNA, 17 nt, Human
cacuauguugcccaggc

SEQ ID NO: 2722127 - RNA, 18 nt, Human
cacuauguugcccaggca

SEQ ID NO: 2722128 - RNA, 19 nt, Human
cacuauguugcccaggcag

SEQ ID NO: 2722129 - RNA, 12 nt, Human
cacucuggcagc

SEQ ID NO: 2722130 - RNA, 13 nt, Human
cacucuggcagcu

SEQ ID NO: 2722131 - RNA, 14 nt, Human
cacucuggcagcuc

SEQ ID NO: 2722132 - RNA, 12 nt, Human
cacucuccuugg

SEQ ID NO: 2722133 - RNA, 12 nt, Human
cacucugagacu

SEQ ID NO: 2722134 - RNA, 23 nt, Human
cacucugagacucgcgacaaugc

SEQ ID NO: 2722135 - RNA, 17 nt, Human
cacucuccauuuaauaa

SEQ ID NO: 2722136 - RNA, 15 nt, Human
cacucuccauuuaau

SEQ ID NO: 2722137 - RNA, 17 nt, Human
cacucccugcaaccuga

SEQ ID NO: 2722138 - RNA, 14 nt, Human
cacuccuucacaga

SEQ ID NO: 2722139 - RNA, 21 nt, Human
cacuccuucacagaugggugc

SEQ ID NO: 2722140 - RNA, 16 nt, Human
cacucaguccauagca

SEQ ID NO: 2722141 - RNA, 15 nt, Human
cacucauugaccuga

SEQ ID NO: 2722142 - RNA, 18 nt, Human
cacucauugaccugaggc

SEQ ID NO: 2722143 - RNA, 19 nt, Human
cacucauugaccugaggcc

SEQ ID NO: 2722144 - RNA, 20 nt, Human
cacucauugaccugaggccc

SEQ ID NO: 2722145 - RNA, 22 nt, Human
cacucauugaccugaggcccuu

SEQ ID NO: 2722146 - RNA, 15 nt, Human
cacuccccugcuggg

SEQ ID NO: 2722147 - RNA, 12 nt, Human
cacucccugcaa

SEQ ID NO: 2722148 - RNA, 13 nt, Human
cacucccugcaac

SEQ ID NO: 2722149 - RNA, 16 nt, Human
cacucccugcaaccug

SEQ ID NO: 2722150 - RNA, 13 nt, Human
caccucccugcaa

SEQ ID NO: 2722151 - RNA, 14 nt, Human
caccucccugcaau

SEQ ID NO: 2722152 - RNA, 14 nt, Human
caccuccugccucg

SEQ ID NO: 2722153 - RNA, 13 nt, Human
caccuccugccuc

SEQ ID NO: 2722154 - RNA, 11 nt, Human
caccuccugcc

SEQ ID NO: 2722155 - RNA, 13 nt, Human
caccucucccuug

SEQ ID NO: 2722156 - RNA, 14 nt, Human
caccucucccuugg

SEQ ID NO: 2722157 - RNA, 17 nt, Human
caccucucccuuggauu

SEQ ID NO: 2722158 - RNA, 10 nt, Human
caccucccug

SEQ ID NO: 2722159 - RNA, 11 nt, Human
caccucaugga

SEQ ID NO: 2722160 - RNA, 12 nt, Human
caccucauggaa

SEQ ID NO: 2722161 - RNA, 14 nt, Human
caccucauggaauu

SEQ ID NO: 2722162 - RNA, 21 nt, Human
caccgcagacaggaccaggga

SEQ ID NO: 2722163 - RNA, 14 nt, Human
caccgggcacucag

SEQ ID NO: 2722164 - RNA, 20 nt, Human
caccggcuggccuggccccu

SEQ ID NO: 2722165 - RNA, 17 nt, Human
caccggcuggccuggcc

SEQ ID NO: 2722166 - RNA, 18 nt, Human
caccggcuggccuggccc

SEQ ID NO: 2722167 - RNA, 14 nt, Human
caccggcuggccug

SEQ ID NO: 2722168 - RNA, 15 nt, Human
caccggcuggccugg

SEQ ID NO: 2722169 - RNA, 16 nt, Human
caccggcuggccuggc

SEQ ID NO: 2722170 - RNA, 15 nt, Human
caccgggcacucaga

SEQ ID NO: 2722171 - RNA, 22 nt, Human
caccgggcacucagaagacacu

SEQ ID NO: 2722172 - RNA, 15 nt, Human
caccgggccacagag

SEQ ID NO: 2722173 - RNA, 18 nt, Human
caccgggccacagagaaa

SEQ ID NO: 2722174 - RNA, 18 nt, Human
caccucugcacaagcugc

SEQ ID NO: 2722175 - RNA, 19 nt, Human
caccucugcacaagcugca

SEQ ID NO: 2722176 - RNA, 15 nt, Human
caccucucucacucc

SEQ ID NO: 2722177 - RNA, 17 nt, Human
caccucucucacuccuu

SEQ ID NO: 2722178 - RNA, 18 nt, Human
caccucucucacuccuug

SEQ ID NO: 2722179 - RNA, 19 nt, Human
caccucucucacuccuuga

SEQ ID NO: 2722180 - RNA, 23 nt, Human
caccugaagacucauucuucugu

SEQ ID NO: 2722181 - RNA, 14 nt, Human
caccugaagacuca

SEQ ID NO: 2722182 - RNA, 15 nt, Human
caccugaagacucau

SEQ ID NO: 2722183 - RNA, 20 nt, Human
caccugcggugcuaucuccc

SEQ ID NO: 2722184 - RNA, 23 nt, Human
caccugcggugcuaucuccccca

SEQ ID NO: 2722185 - RNA, 20 nt, Human
caccuggaauauauaaccag

SEQ ID NO: 2722186 - RNA, 23 nt, Human
caccuggccucugcacuccccug

SEQ ID NO: 2722187 - RNA, 17 nt, Human
caccuggccucugcacu

SEQ ID NO: 2722188 - RNA, 18 nt, Human
caccuggccucugcacuc

SEQ ID NO: 2722189 - RNA, 19 nt, Human
caccuggccucugcacucc

SEQ ID NO: 2722190 - RNA, 20 nt, Human
caccuggccucugcacuccc

SEQ ID NO: 2722191 - RNA, 12 nt, Human
caccuggccucu

SEQ ID NO: 2722192 - RNA, 13 nt, Human
caccuggccucug

SEQ ID NO: 2722193 - RNA, 14 nt, Human
caccuggccucugc

SEQ ID NO: 2722194 - RNA, 15 nt, Human
caccuggccucugca

SEQ ID NO: 2722195 - RNA, 12 nt, Human
cacccggccccu

SEQ ID NO: 2722196 - RNA, 19 nt, Human
cacccgcuaagagggaggg

SEQ ID NO: 2722197 - RNA, 13 nt, Human
cacccggccccug

SEQ ID NO: 2722198 - RNA, 14 nt, Human
cacccggccccugc

SEQ ID NO: 2722199 - RNA, 16 nt, Human
cacccggccccugcug

SEQ ID NO: 2722200 - RNA, 17 nt, Human
cacccggccccugcugg

SEQ ID NO: 2722201 - RNA, 18 nt, Human
cacccggccccugcuggu

SEQ ID NO: 2722202 - RNA, 21 nt, Human
cacccggccccugcugguuca

SEQ ID NO: 2722203 - RNA, 20 nt, Human
caccccucaacaccucugca

SEQ ID NO: 2722204 - RNA, 13 nt, Human
cacauauugauuu

SEQ ID NO: 2722205 - RNA, 12 nt, Human
caccgcagacag

SEQ ID NO: 2722206 - RNA, 13 nt, Human
caccgcagacagg

SEQ ID NO: 2722207 - RNA, 14 nt, Human
caccgcagacagga

SEQ ID NO: 2722208 - RNA, 15 nt, Human
caccgcagacaggac

SEQ ID NO: 2722209 - RNA, 17 nt, Human
caccgcagacaggacca

SEQ ID NO: 2722210 - RNA, 18 nt, Human
caccgcagacaggaccag

SEQ ID NO: 2722211 - RNA, 22 nt, Human
caccgaaaacguggcugcuuca

SEQ ID NO: 2722212 - RNA, 19 nt, Human
caccgaaaacguggcugcu

SEQ ID NO: 2722213 - RNA, 21 nt, Human
caccgaaaacguggcugcuuc

SEQ ID NO: 2722214 - RNA, 15 nt, Human
caccgaaaacguggc

SEQ ID NO: 2722215 - RNA, 18 nt, Human
caccgaaaacguggcugc

SEQ ID NO: 2722216 - RNA, 11 nt, Human
cacccugugau

SEQ ID NO: 2722217 - RNA, 12 nt, Human
cacccugugaug

SEQ ID NO: 2722218 - RNA, 15 nt, Human
cacccugugaugggg

SEQ ID NO: 2722219 - RNA, 18 nt, Human
cacccugugauggggccc

SEQ ID NO: 2722220 - RNA, 20 nt, Human
cacccugugauggggcccug

SEQ ID NO: 2722221 - RNA, 21 nt, Human
cacccugugauggggcccugc

SEQ ID NO: 2722222 - RNA, 22 nt, Human
cacccugugauggggcccugcc

SEQ ID NO: 2722223 - RNA, 23 nt, Human
cacccugugauggggcccugccu

SEQ ID NO: 2722224 - RNA, 20 nt, Human
cacauauugauuuccguuaa

SEQ ID NO: 2722225 - RNA, 16 nt, Human
cacgccagauucuuuc

SEQ ID NO: 2722226 - RNA, 19 nt, Human
cagacauacuaaccagcag

SEQ ID NO: 2722227 - RNA, 19 nt, Human
cagacaccuugacagggca

SEQ ID NO: 2722228 - RNA, 20 nt, Human
cagacaccuugacagggcac

SEQ ID NO: 2722229 - RNA, 22 nt, Human
cagacaccuugacagggcacac

SEQ ID NO: 2722230 - RNA, 20 nt, Human
cagacaguuaagagaaauga

SEQ ID NO: 2722231 - RNA, 14 nt, Human
cagacacaugucca

SEQ ID NO: 2722232 - RNA, 17 nt, Human
cagacacauguccaaga

SEQ ID NO: 2722233 - RNA, 21 nt, Human
cagacacauguccaagaagcc

SEQ ID NO: 2722234 - RNA, 22 nt, Human
cagacacauguccaagaagccc

SEQ ID NO: 2722235 - RNA, 23 nt, Human
cagacacauguccaagaagccca

SEQ ID NO: 2722236 - RNA, 13 nt, Human
cagacacaggccc

SEQ ID NO: 2722237 - RNA, 14 nt, Human
cagacacaggcccg

SEQ ID NO: 2722238 - RNA, 15 nt, Human
cagacacaggcccgg

SEQ ID NO: 2722239 - RNA, 17 nt, Human
cagacacaggcccggcu

SEQ ID NO: 2722240 - RNA, 18 nt, Human
cagacacaggcccggcuc

SEQ ID NO: 2722241 - RNA, 21 nt, Human
cagacacaggcccggcuccag

SEQ ID NO: 2722242 - RNA, 22 nt, Human
cagacacaggcccggcuccagg

SEQ ID NO: 2722243 - RNA, 23 nt, Human
cagacacaggcccggcuccaggc

SEQ ID NO: 2722244 - RNA, 22 nt, Human
cagacaaagcgugguggacaug

SEQ ID NO: 2722245 - RNA, 20 nt, Human
cagacaacaaaccuguuucu

SEQ ID NO: 2722246 - RNA, 12 nt, Human
cagacaaagcgu

SEQ ID NO: 2722247 - RNA, 24 nt, Human
cagaauuucccaaagcagugcaug

SEQ ID NO: 2722248 - RNA, 17 nt, Human
cagaauuucccaaagca

SEQ ID NO: 2722249 - RNA, 18 nt, Human
cagaauuucccaaagcag

SEQ ID NO: 2722250 - RNA, 19 nt, Human
cagaauuucccaaagcagu

SEQ ID NO: 2722251 - RNA, 20 nt, Human
cagaauuucccaaagcagug

SEQ ID NO: 2722252 - RNA, 11 nt, Human
cagaauucuca

SEQ ID NO: 2722253 - RNA, 18 nt, Human
cagaauucucuaguuuga

SEQ ID NO: 2722254 - RNA, 15 nt, Human
cagaauucucuaguu

SEQ ID NO: 2722255 - RNA, 14 nt, Human
cagaauuucccaaa

SEQ ID NO: 2722256 - RNA, 19 nt, Human
cagagaaaguacuucucca

SEQ ID NO: 2722257 - RNA, 23 nt, Human
cagagaaaguacuucuccacccu

SEQ ID NO: 2722258 - RNA, 22 nt, Human
cagacccugcccugugggcccc

SEQ ID NO: 2722259 - RNA, 15 nt, Human
cagacccugcccugu

SEQ ID NO: 2722260 - RNA, 16 nt, Human
cagacccugcccugug

SEQ ID NO: 2722261 - RNA, 17 nt, Human
cagacccugcccugugg

SEQ ID NO: 2722262 - RNA, 21 nt, Human
cagacccugcccugugggccc

SEQ ID NO: 2722263 - RNA, 16 nt, Human
cagacccggcugcgug

SEQ ID NO: 2722264 - RNA, 12 nt, Human
cagacccugccc

SEQ ID NO: 2722265 - RNA, 13 nt, Human
cagacccugcccu

SEQ ID NO: 2722266 - RNA, 14 nt, Human
cagacccugcccug

SEQ ID NO: 2722267 - RNA, 12 nt, Human
cagacccggcug

SEQ ID NO: 2722268 - RNA, 14 nt, Human
cagacccggcugcg

SEQ ID NO: 2722269 - RNA, 14 nt, Human
cagaccacaaaacu

SEQ ID NO: 2722270 - RNA, 20 nt, Human
cagaccacaaaacuuuucua

SEQ ID NO: 2722271 - RNA, 21 nt, Human
cagaagacacugaugggcaac

SEQ ID NO: 2722272 - RNA, 18 nt, Human
cagaaucucaaauaacua

SEQ ID NO: 2722273 - RNA, 17 nt, Human
cagaaucucaaauaacu

SEQ ID NO: 2722274 - RNA, 17 nt, Human
cagaaggaucuucaucu

SEQ ID NO: 2722275 - RNA, 19 nt, Human
cagaaggaagacuucaucc

SEQ ID NO: 2722276 - RNA, 16 nt, Human
cagaaggaagacuuca

SEQ ID NO: 2722277 - RNA, 17 nt, Human
cagaaggaagacuucau

SEQ ID NO: 2722278 - RNA, 18 nt, Human
cagaaggaagacuucauc

SEQ ID NO: 2722279 - RNA, 23 nt, Human
cagaaaauggaagacagcucuua

SEQ ID NO: 2722280 - RNA, 19 nt, Human
cagaaaauauuauguguuu

SEQ ID NO: 2722281 - RNA, 16 nt, Human
cagaaaauggaagaca

SEQ ID NO: 2722282 - RNA, 20 nt, Human
cagaaaauggaagacagcuc

SEQ ID NO: 2722283 - RNA, 21 nt, Human
cagaaaauggaagacagcucu

SEQ ID NO: 2722284 - RNA, 22 nt, Human
cagaaaauggaagacagcucuu

SEQ ID NO: 2722285 - RNA, 17 nt, Human
cagaaaaguugaauuuu

SEQ ID NO: 2722286 - RNA, 22 nt, Human
cagaaaaguugaauuuuacaug

SEQ ID NO: 2722287 - RNA, 20 nt, Human
cagaaaaguugaauuuuaca

SEQ ID NO: 2722288 - RNA, 22 nt, Human
cacuuuuguucuugguuuguaa

SEQ ID NO: 2722289 - RNA, 14 nt, Human
cacuuuuguucuug

SEQ ID NO: 2722290 - RNA, 12 nt, Human
cacuuugggagg

SEQ ID NO: 2722291 - RNA, 13 nt, Human
cacuuugggaggc

SEQ ID NO: 2722292 - RNA, 16 nt, Human
cacuuugggaggccaa

SEQ ID NO: 2722293 - RNA, 13 nt, Human
cacuuuguucugg

SEQ ID NO: 2722294 - RNA, 14 nt, Human
cacuuuguucuggc

SEQ ID NO: 2722295 - RNA, 16 nt, Human
cacuuuguucuggcuc

SEQ ID NO: 2722296 - RNA, 23 nt, Human
cacuuuguucuggcucuuccagg

SEQ ID NO: 2722297 - RNA, 22 nt, Human
cacuuucuagccagaggagaga

SEQ ID NO: 2722298 - RNA, 16 nt, Human
cagacaacaaaccugu

SEQ ID NO: 2722299 - RNA, 12 nt, Human
cagagccugcag

SEQ ID NO: 2722300 - RNA, 13 nt, Human
cagaggaaggaga

SEQ ID NO: 2722301 - RNA, 13 nt, Human
cagagccugcagu

SEQ ID NO: 2722302 - RNA, 20 nt, Human
cagaggaaagcaaaggagau

SEQ ID NO: 2722303 - RNA, 23 nt, Human
cagagcccacgcccccacuggug

SEQ ID NO: 2722304 - RNA, 17 nt, Human
cagagcccacgccccca

SEQ ID NO: 2722305 - RNA, 19 nt, Human
cagagcccacgcccccacu

SEQ ID NO: 2722306 - RNA, 20 nt, Human
cagagcccacgcccccacug

SEQ ID NO: 2722307 - RNA, 21 nt, Human
cagagcccacgcccccacugg

SEQ ID NO: 2722308 - RNA, 20 nt, Human
cagaggagagaggacccccu

SEQ ID NO: 2722309 - RNA, 11 nt, Human
cagaggcagcc

SEQ ID NO: 2722310 - RNA, 13 nt, Human
cagaggagagagg

SEQ ID NO: 2722311 - RNA, 15 nt, Human
cagaggagagaggac

SEQ ID NO: 2722312 - RNA, 19 nt, Human
cagaggagagaggaccccc

SEQ ID NO: 2722313 - RNA, 23 nt, Human
cagagcaccuuagacagucccug

SEQ ID NO: 2722314 - RNA, 11 nt, Human
cagagcagaga

SEQ ID NO: 2722315 - RNA, 12 nt, Human
cagagcagagac

SEQ ID NO: 2722316 - RNA, 18 nt, Human
cagagcaccuuagacagu

SEQ ID NO: 2722317 - RNA, 19 nt, Human
cagagcaccuuagacaguc

SEQ ID NO: 2722318 - RNA, 21 nt, Human
cagagcaccuuagacaguccc

SEQ ID NO: 2722319 - RNA, 22 nt, Human
cagagcaccuuagacagucccu

SEQ ID NO: 2722320 - RNA, 13 nt, Human
cagagcagagacc

SEQ ID NO: 2722321 - RNA, 14 nt, Human
cagagcagagacca

SEQ ID NO: 2722322 - RNA, 15 nt, Human
cagagcagagaccau

SEQ ID NO: 2722323 - RNA, 17 nt, Human
cagagcagagaccaucc

SEQ ID NO: 2722324 - RNA, 18 nt, Human
cagagcagagaccauccc

SEQ ID NO: 2722325 - RNA, 19 nt, Human
cagagcagagaccaucccu

SEQ ID NO: 2722326 - RNA, 21 nt, Human
cagagcagagaccaucccuga

SEQ ID NO: 2722327 - RNA, 15 nt, Human
cagagcccaccuugg

SEQ ID NO: 2722328 - RNA, 17 nt, Human
cagagcccaccuuggcu

SEQ ID NO: 2722329 - RNA, 19 nt, Human
cagagcccaccuuggcuca

SEQ ID NO: 2722330 - RNA, 20 nt, Human
cagagcccaccuuggcucaa

SEQ ID NO: 2722331 - RNA, 16 nt, Human
cagagcccacgccccc

SEQ ID NO: 2722332 - RNA, 13 nt, Human
cagagaccauccc

SEQ ID NO: 2722333 - RNA, 14 nt, Human
cagagaccaucccu

SEQ ID NO: 2722334 - RNA, 16 nt, Human
cagagaccaucccuga

SEQ ID NO: 2722335 - RNA, 14 nt, Human
cagagacacaagcc

SEQ ID NO: 2722336 - RNA, 15 nt, Human
cagagacacaagccu

SEQ ID NO: 2722337 - RNA, 16 nt, Human
cagagacacaagccuu

SEQ ID NO: 2722338 - RNA, 17 nt, Human
cagagacacaagccuuc

SEQ ID NO: 2722339 - RNA, 19 nt, Human
cagagaaugaaagggccca

SEQ ID NO: 2722340 - RNA, 15 nt, Human
cagagaauucucuua

SEQ ID NO: 2722341 - RNA, 20 nt, Human
cagagaaugaaagggcccag

SEQ ID NO: 2722342 - RNA, 21 nt, Human
cagagaaugaaagggcccaga

SEQ ID NO: 2722343 - RNA, 14 nt, Human
cagagcaagugaga

SEQ ID NO: 2722344 - RNA, 20 nt, Human
cagagcaagugagacccugu

SEQ ID NO: 2722345 - RNA, 16 nt, Human
cagagcaccuuagaca

SEQ ID NO: 2722346 - RNA, 13 nt, Human
cagagacuccugc

SEQ ID NO: 2722347 - RNA, 14 nt, Human
cagagacuccugca

SEQ ID NO: 2722348 - RNA, 15 nt, Human
cagagacuccugcag

SEQ ID NO: 2722349 - RNA, 16 nt, Human
cagagacuccugcagg

SEQ ID NO: 2722350 - RNA, 17 nt, Human
cagagacuccugcaggc

SEQ ID NO: 2722351 - RNA, 18 nt, Human
cagagacuccugcaggca

SEQ ID NO: 2722352 - RNA, 19 nt, Human
cagagacuccugcaggcag

SEQ ID NO: 2722353 - RNA, 21 nt, Human
cagagaccaucccugaaggcc

SEQ ID NO: 2722354 - RNA, 17 nt, Human
cagagaccaucccugaa

SEQ ID NO: 2722355 - RNA, 18 nt, Human
cagagaccaucccugaag

SEQ ID NO: 2722356 - RNA, 19 nt, Human
cagagaccaucccugaagg

SEQ ID NO: 2722357 - RNA, 20 nt, Human
cagagaccaucccugaaggc

SEQ ID NO: 2722358 - RNA, 14 nt, Human
cagauaaucacaau

SEQ ID NO: 2722359 - RNA, 14 nt, Human
cagauaaucagugu

SEQ ID NO: 2722360 - RNA, 19 nt, Human
cagaguuguuacauuuuua

SEQ ID NO: 2722361 - RNA, 18 nt, Human
cagaguuguuacauuuuu

SEQ ID NO: 2722362 - RNA, 15 nt, Human
cagaguuguuacauu

SEQ ID NO: 2722363 - RNA, 14 nt, Human
cagaguugaagaca

SEQ ID NO: 2722364 - RNA, 15 nt, Human
cagaguugaagacag

SEQ ID NO: 2722365 - RNA, 16 nt, Human
cagaguugaagacaga

SEQ ID NO: 2722366 - RNA, 22 nt, Human
cagaguugaagacagagcuaca

SEQ ID NO: 2722367 - RNA, 14 nt, Human
cagaguuguuacau

SEQ ID NO: 2722368 - RNA, 17 nt, Human
cagaguugaagacagag

SEQ ID NO: 2722369 - RNA, 18 nt, Human
cagaguugaagacagagc

SEQ ID NO: 2722370 - RNA, 19 nt, Human
cagaguugaagacagagcu

SEQ ID NO: 2722371 - RNA, 20 nt, Human
cagaguugaagacagagcua

SEQ ID NO: 2722372 - RNA, 14 nt, Human
cagauccuggaaau

SEQ ID NO: 2722373 - RNA, 20 nt, Human
cagaucucuaacuucaccau

SEQ ID NO: 2722374 - RNA, 13 nt, Human
cagauccuggaaa

SEQ ID NO: 2722375 - RNA, 22 nt, Human
cagauacaggaaaagcugcuga

SEQ ID NO: 2722376 - RNA, 20 nt, Human
cagauacaggaaaagcugcu

SEQ ID NO: 2722377 - RNA, 21 nt, Human
cagauacaggaaaagcugcug

SEQ ID NO: 2722378 - RNA, 14 nt, Human
cagaucugccuaag

SEQ ID NO: 2722379 - RNA, 17 nt, Human
cagaucugccuaaggac

SEQ ID NO: 2722380 - RNA, 16 nt, Human
cagaucugccuaagga

SEQ ID NO: 2722381 - RNA, 23 nt, Human
cagaucugccuaaggacuucuuu

SEQ ID NO: 2722382 - RNA, 21 nt, Human
cagaucugccuaaggacuucu

SEQ ID NO: 2722383 - RNA, 20 nt, Human
cagaucugccuaaggacuuc

SEQ ID NO: 2722384 - RNA, 19 nt, Human
cagaucugccuaaggacuu

SEQ ID NO: 2722385 - RNA, 13 nt, Human
cagaugcaccagc

SEQ ID NO: 2722386 - RNA, 14 nt, Human
cagaugcaccagcc

SEQ ID NO: 2722387 - RNA, 16 nt, Human
cagaugcaccagcccu

SEQ ID NO: 2722388 - RNA, 17 nt, Human
cagaugcaccagcccuu

SEQ ID NO: 2722389 - RNA, 22 nt, Human
cagaugcaccagcccuuagcag

SEQ ID NO: 2722390 - RNA, 20 nt, Human
cagaggccaugggccuccug

SEQ ID NO: 2722391 - RNA, 21 nt, Human
cagaggccaugggccuccugu

SEQ ID NO: 2722392 - RNA, 23 nt, Human
cagaggcagccccauucugccug

SEQ ID NO: 2722393 - RNA, 19 nt, Human
cagaggccaugggccuccu

SEQ ID NO: 2722394 - RNA, 16 nt, Human
cagaggccaugggccu

SEQ ID NO: 2722395 - RNA, 12 nt, Human
cagaggcagccc

SEQ ID NO: 2722396 - RNA, 13 nt, Human
cagaggcagcccc

SEQ ID NO: 2722397 - RNA, 14 nt, Human
cagaggcagcccca

SEQ ID NO: 2722398 - RNA, 15 nt, Human
cagaggcagccccau

SEQ ID NO: 2722399 - RNA, 18 nt, Human
cagaggcagccccauucu

SEQ ID NO: 2722400 - RNA, 19 nt, Human
cagaggcagccccauucug

SEQ ID NO: 2722401 - RNA, 20 nt, Human
cagaggcagccccauucugc

SEQ ID NO: 2722402 - RNA, 22 nt, Human
cagaggcagccccauucugccu

SEQ ID NO: 2722403 - RNA, 23 nt, Human
cagaggcugccucucccaucacu

SEQ ID NO: 2722404 - RNA, 14 nt, Human
cagagggagugaca

SEQ ID NO: 2722405 - RNA, 16 nt, Human
cagagggagugacaga

SEQ ID NO: 2722406 - RNA, 18 nt, Human
cagagggagugacagagg

SEQ ID NO: 2722407 - RNA, 19 nt, Human
cagagggagugacagaggc

SEQ ID NO: 2722408 - RNA, 13 nt, Human
cagaggcugccuc

SEQ ID NO: 2722409 - RNA, 13 nt, Human
cagagucucacug

SEQ ID NO: 2722410 - RNA, 17 nt, Human
cagagucucacuguugc

SEQ ID NO: 2722411 - RNA, 19 nt, Human
cagagucucacuguugccc

SEQ ID NO: 2722412 - RNA, 20 nt, Human
cagagucucacuguugccca

SEQ ID NO: 2722413 - RNA, 21 nt, Human
cagagucucacuguugcccag

SEQ ID NO: 2722414 - RNA, 15 nt, Human
cagagggccugcaag

SEQ ID NO: 2722415 - RNA, 19 nt, Human
cagagggccugcaagggag

SEQ ID NO: 2722416 - RNA, 20 nt, Human
cagagggagugacagaggca

SEQ ID NO: 2722417 - RNA, 21 nt, Human
cagagggagugacagaggcag

SEQ ID NO: 2722418 - RNA, 22 nt, Human
cagagggagugacagaggcagc

SEQ ID NO: 2722419 - RNA, 23 nt, Human
cagagggagugacagaggcagcc

SEQ ID NO: 2722420 - RNA, 19 nt, Human
cagagugagacucugucuc

SEQ ID NO: 2722421 - RNA, 20 nt, Human
cagagugagacucugucuca

SEQ ID NO: 2722422 - RNA, 22 nt, Human
cagagucucacuguugcccagg

SEQ ID NO: 2722423 - RNA, 23 nt, Human
cagagucucacuguugcccaggc

SEQ ID NO: 2722424 - RNA, 16 nt, Human
cagagugagacucugu

SEQ ID NO: 2722425 - RNA, 17 nt, Human
cagagugagacucuguc

SEQ ID NO: 2722426 - RNA, 18 nt, Human
cagagugagacucugucu

SEQ ID NO: 2722427 - RNA, 20 nt, Human
caggaaguacuggagaaaau

SEQ ID NO: 2722428 - RNA, 17 nt, Human
caggaaguacuggagaa

SEQ ID NO: 2722429 - RNA, 18 nt, Human
caggaaguacuggagaaa

SEQ ID NO: 2722430 - RNA, 12 nt, Human
caggaaguacug

SEQ ID NO: 2722431 - RNA, 14 nt, Human
caggaaguacugga

SEQ ID NO: 2722432 - RNA, 16 nt, Human
caggaaguacuggaga

SEQ ID NO: 2722433 - RNA, 15 nt, Human
caggaaggcuaaagg

SEQ ID NO: 2722434 - RNA, 23 nt, Human
caggaauggagccugcacgguga

SEQ ID NO: 2722435 - RNA, 17 nt, Human
caggaauggagccugca

SEQ ID NO: 2722436 - RNA, 23 nt, Human
caggaagcucagggccuggcuca

SEQ ID NO: 2722437 - RNA, 20 nt, Human
caggaagcucagggccuggc

SEQ ID NO: 2722438 - RNA, 21 nt, Human
caggaagcucagggccuggcu

SEQ ID NO: 2722439 - RNA, 13 nt, Human
caggaagcucagg

SEQ ID NO: 2722440 - RNA, 14 nt, Human
caggaagcucaggg

SEQ ID NO: 2722441 - RNA, 15 nt, Human
caggaagcucagggc

SEQ ID NO: 2722442 - RNA, 16 nt, Human
caggaagcucagggcc

SEQ ID NO: 2722443 - RNA, 17 nt, Human
caggaagcucagggccu

SEQ ID NO: 2722444 - RNA, 18 nt, Human
caggaagcucagggccug

SEQ ID NO: 2722445 - RNA, 19 nt, Human
caggaagcucagggccugg

SEQ ID NO: 2722446 - RNA, 22 nt, Human
caggaagccagcaggcucucag

SEQ ID NO: 2722447 - RNA, 19 nt, Human
caggaagccagcaggcucu

SEQ ID NO: 2722448 - RNA, 21 nt, Human
caggaagccagcaggcucuca

SEQ ID NO: 2722449 - RNA, 14 nt, Human
caggaagccagcag

SEQ ID NO: 2722450 - RNA, 16 nt, Human
caggaagccagcaggc

SEQ ID NO: 2722451 - RNA, 17 nt, Human
caggaagccagcaggcu

SEQ ID NO: 2722452 - RNA, 18 nt, Human
caggaagccagcaggcuc

SEQ ID NO: 2722453 - RNA, 18 nt, Human
cagcuugaaacugagaug

SEQ ID NO: 2722454 - RNA, 19 nt, Human
cagcuucauuuccuguguc

SEQ ID NO: 2722455 - RNA, 20 nt, Human
cagcuucauuuccugugucu

SEQ ID NO: 2722456 - RNA, 21 nt, Human
cagcuucauuuccugugucuu

SEQ ID NO: 2722457 - RNA, 14 nt, Human
cagcuugaggguug

SEQ ID NO: 2722458 - RNA, 15 nt, Human
cagcuugaggguugg

SEQ ID NO: 2722459 - RNA, 18 nt, Human
cagcuugaccgugaggcc

SEQ ID NO: 2722460 - RNA, 19 nt, Human
cagcuugaccgugaggcca

SEQ ID NO: 2722461 - RNA, 20 nt, Human
cagcuugaccgugaggccag

SEQ ID NO: 2722462 - RNA, 21 nt, Human
cagcuugaccgugaggccaga

SEQ ID NO: 2722463 - RNA, 18 nt, Human
cagcuugaggguugggcu

SEQ ID NO: 2722464 - RNA, 19 nt, Human
cagcuugaggguugggcug

SEQ ID NO: 2722465 - RNA, 20 nt, Human
cagcuugaggguugggcugg

SEQ ID NO: 2722466 - RNA, 21 nt, Human
cagcuugaggguugggcuggu

SEQ ID NO: 2722467 - RNA, 18 nt, Human
cagcuuguaaauagcuca

SEQ ID NO: 2722468 - RNA, 19 nt, Human
cagcuuguaaauagcucag

SEQ ID NO: 2722469 - RNA, 20 nt, Human
cagcuuguaaauagcucagg

SEQ ID NO: 2722470 - RNA, 21 nt, Human
cagcuuguaaauagcucaggu

SEQ ID NO: 2722471 - RNA, 22 nt, Human
cagcuuguaaauagcucaggug

SEQ ID NO: 2722472 - RNA, 18 nt, Human
caggaaccacaagacugc

SEQ ID NO: 2722473 - RNA, 12 nt, Human
cagcuuuguuug

SEQ ID NO: 2722474 - RNA, 21 nt, Human
cagcuuuguuuguugucagcu

SEQ ID NO: 2722475 - RNA, 22 nt, Human
cagcuuuguuuguugucagcug

SEQ ID NO: 2722476 - RNA, 23 nt, Human
cagcuuuguuuguugucagcuga

SEQ ID NO: 2722477 - RNA, 18 nt, Human
cagcuguaugauucccag

SEQ ID NO: 2722478 - RNA, 18 nt, Human
cagcugguugagguuuca

SEQ ID NO: 2722479 - RNA, 18 nt, Human
cagcuggugcccugcuuu

SEQ ID NO: 2722480 - RNA, 23 nt, Human
cagcuggugcccugcuuucagau

SEQ ID NO: 2722481 - RNA, 21 nt, Human
cagcuggugcccugcuuucag

SEQ ID NO: 2722482 - RNA, 20 nt, Human
cagcuggugcccugcuuuca

SEQ ID NO: 2722483 - RNA, 19 nt, Human
cagcuggugcccugcuuuc

SEQ ID NO: 2722484 - RNA, 21 nt, Human
cagcugggguggggaccucag

SEQ ID NO: 2722485 - RNA, 22 nt, Human
cagcugggguggggaccucagg

SEQ ID NO: 2722486 - RNA, 23 nt, Human
cagcugggguggggaccucaggc

SEQ ID NO: 2722487 - RNA, 23 nt, Human
cagcugcuuuugucuaugggacu

SEQ ID NO: 2722488 - RNA, 22 nt, Human
cagcugcuuuugucuaugggac

SEQ ID NO: 2722489 - RNA, 21 nt, Human
cagcugcugaaacaacaaaua

SEQ ID NO: 2722490 - RNA, 20 nt, Human
cagcugcugaaacaacaaau

SEQ ID NO: 2722491 - RNA, 17 nt, Human
cagcugcuacuacuccu

SEQ ID NO: 2722492 - RNA, 13 nt, Human
cagcugcuugggc

SEQ ID NO: 2722493 - RNA, 14 nt, Human
cagcugcuugggcu

SEQ ID NO: 2722494 - RNA, 15 nt, Human
cagcugcuugggcuu

SEQ ID NO: 2722495 - RNA, 16 nt, Human
cagcugcuugggcuuc

SEQ ID NO: 2722496 - RNA, 18 nt, Human
cagcugcuugggcuucau

SEQ ID NO: 2722497 - RNA, 19 nt, Human
cagcugcuugggcuucauc

SEQ ID NO: 2722498 - RNA, 21 nt, Human
cagcugcuugggcuucauccu

SEQ ID NO: 2722499 - RNA, 22 nt, Human
cagcugcuugggcuucauccuc

SEQ ID NO: 2722500 - RNA, 18 nt, Human
cagcugccugggaucccu

SEQ ID NO: 2722501 - RNA, 23 nt, Human
cagcugccugggaucccucaucc

SEQ ID NO: 2722502 - RNA, 18 nt, Human
cagcugcgguccacccag

SEQ ID NO: 2722503 - RNA, 15 nt, Human
cagcugccugggauc

SEQ ID NO: 2722504 - RNA, 19 nt, Human
cagcugcgguccacccagg

SEQ ID NO: 2722505 - RNA, 20 nt, Human
cagcugcgguccacccagga

SEQ ID NO: 2722506 - RNA, 21 nt, Human
cagcugcgguccacccaggag

SEQ ID NO: 2722507 - RNA, 22 nt, Human
cagcugcgguccacccaggagc

SEQ ID NO: 2722508 - RNA, 23 nt, Human
cagcugcgguccacccaggagcc

SEQ ID NO: 2722509 - RNA, 24 nt, Human
cagcugcgguccacccaggagccc

SEQ ID NO: 2722510 - RNA, 21 nt, Human
cagcucugcaagaauugaagc

SEQ ID NO: 2722511 - RNA, 15 nt, Human
cagcucugcaagaau

SEQ ID NO: 2722512 - RNA, 16 nt, Human
cagcucugcaagaauu

SEQ ID NO: 2722513 - RNA, 16 nt, Human
cagcuccuucuguccu

SEQ ID NO: 2722514 - RNA, 17 nt, Human
cagcuccuucuguccua

SEQ ID NO: 2722515 - RNA, 21 nt, Human
cagcuccuucuguccuacucu

SEQ ID NO: 2722516 - RNA, 23 nt, Human
cagcuccuucuguccuacucugu

SEQ ID NO: 2722517 - RNA, 13 nt, Human
cagcucagagagg

SEQ ID NO: 2722518 - RNA, 17 nt, Human
cagcucagagagggugg

SEQ ID NO: 2722519 - RNA, 19 nt, Human
cagcucagagaggguggga

SEQ ID NO: 2722520 - RNA, 20 nt, Human
cagcucagagagggugggag

SEQ ID NO: 2722521 - RNA, 10 nt, Human
cagcucuggu

SEQ ID NO: 2722522 - RNA, 13 nt, Human
cagcucuggucca

SEQ ID NO: 2722523 - RNA, 16 nt, Human
cagcucugguccauag

SEQ ID NO: 2722524 - RNA, 17 nt, Human
cagcucugguccauaga

SEQ ID NO: 2722525 - RNA, 18 nt, Human
cagcucugguccauagag

SEQ ID NO: 2722526 - RNA, 21 nt, Human
cagcucugguccauagagagc

SEQ ID NO: 2722527 - RNA, 12 nt, Human
cagcucuguccu

SEQ ID NO: 2722528 - RNA, 13 nt, Human
cagcucuguccug

SEQ ID NO: 2722529 - RNA, 22 nt, Human
cagcucugguccauagagagca

SEQ ID NO: 2722530 - RNA, 23 nt, Human
cagcucugguccauagagagcaa

SEQ ID NO: 2722531 - RNA, 14 nt, Human
cagcucuguccugg

SEQ ID NO: 2722532 - RNA, 16 nt, Human
cagcucuguccuggga

SEQ ID NO: 2722533 - RNA, 17 nt, Human
cagcucuguccugggag

SEQ ID NO: 2722534 - RNA, 18 nt, Human
cagcucuguccugggagu

SEQ ID NO: 2722535 - RNA, 23 nt, Human
cagcucuguccugggagugagcu

SEQ ID NO: 2722536 - RNA, 10 nt, Human
cagcucuuau

SEQ ID NO: 2722537 - RNA, 21 nt, Human
cagcucuuauauugccauuuc

SEQ ID NO: 2722538 - RNA, 13 nt, Human
cagcucuucucca

SEQ ID NO: 2722539 - RNA, 14 nt, Human
cagcucuucuccag

SEQ ID NO: 2722540 - RNA, 15 nt, Human
cagcucuucuccagg

SEQ ID NO: 2722541 - RNA, 16 nt, Human
cagcucuucuccaggc

SEQ ID NO: 2722542 - RNA, 17 nt, Human
cagcucuucuccaggcu

SEQ ID NO: 2722543 - RNA, 18 nt, Human
cagcucuucuccaggcug

SEQ ID NO: 2722544 - RNA, 19 nt, Human
cagcucuucuccaggcugu

SEQ ID NO: 2722545 - RNA, 23 nt, Human
cagcucuucuccaggcuguaucc

SEQ ID NO: 2722546 - RNA, 22 nt, Human
caggaagcucagggccuggcuc

SEQ ID NO: 2722547 - RNA, 21 nt, Human
cagcccgggcucugccuccca

SEQ ID NO: 2722548 - RNA, 22 nt, Human
cagcccgggcucugccucccau

SEQ ID NO: 2722549 - RNA, 17 nt, Human
cagcccgggcucugccu

SEQ ID NO: 2722550 - RNA, 18 nt, Human
cagcccgggcucugccuc

SEQ ID NO: 2722551 - RNA, 19 nt, Human
cagcccgggcucugccucc

SEQ ID NO: 2722552 - RNA, 20 nt, Human
cagcccgggcucugccuccc

SEQ ID NO: 2722553 - RNA, 13 nt, Human
cagcccgggcucu

SEQ ID NO: 2722554 - RNA, 14 nt, Human
cagcccgggcucug

SEQ ID NO: 2722555 - RNA, 15 nt, Human
cagcccgggcucugc

SEQ ID NO: 2722556 - RNA, 16 nt, Human
cagcccgggcucugcc

SEQ ID NO: 2722557 - RNA, 24 nt, Human
cagccccuucugacccaugcugcc

SEQ ID NO: 2722558 - RNA, 22 nt, Human
cagccccuucugacccaugcug

SEQ ID NO: 2722559 - RNA, 23 nt, Human
cagccccuucugacccaugcugc

SEQ ID NO: 2722560 - RNA, 16 nt, Human
cagccccuucugaccc

SEQ ID NO: 2722561 - RNA, 17 nt, Human
cagccccuucugaccca

SEQ ID NO: 2722562 - RNA, 19 nt, Human
cagccccuucugacccaug

SEQ ID NO: 2722563 - RNA, 21 nt, Human
cagccccuucugacccaugcu

SEQ ID NO: 2722564 - RNA, 13 nt, Human
cagccccagugcc

SEQ ID NO: 2722565 - RNA, 14 nt, Human
cagccccagugccc

SEQ ID NO: 2722566 - RNA, 15 nt, Human
cagccccagugccca

SEQ ID NO: 2722567 - RNA, 16 nt, Human
cagccccagugcccac

SEQ ID NO: 2722568 - RNA, 17 nt, Human
cagccccagugcccaca

SEQ ID NO: 2722569 - RNA, 18 nt, Human
cagccccagugcccacag

SEQ ID NO: 2722570 - RNA, 11 nt, Human
cagccccaucc

SEQ ID NO: 2722571 - RNA, 21 nt, Human
cagccccaucccaaacccuuc

SEQ ID NO: 2722572 - RNA, 21 nt, Human
cagccccuguucuggcagagu

SEQ ID NO: 2722573 - RNA, 20 nt, Human
cagccccuguucuggcagag

SEQ ID NO: 2722574 - RNA, 22 nt, Human
cagccccuggaugcagccucac

SEQ ID NO: 2722575 - RNA, 16 nt, Human
cagccccauucugccu

SEQ ID NO: 2722576 - RNA, 17 nt, Human
cagccccauucugccug

SEQ ID NO: 2722577 - RNA, 18 nt, Human
cagccccauucugccugc

SEQ ID NO: 2722578 - RNA, 23 nt, Human
cagccccuggaugcagccucaca

SEQ ID NO: 2722579 - RNA, 13 nt, Human
cagccccauucug

SEQ ID NO: 2722580 - RNA, 14 nt, Human
cagccccauucugc

SEQ ID NO: 2722581 - RNA, 16 nt, Human
cagccccauccucugu

SEQ ID NO: 2722582 - RNA, 22 nt, Human
cagccccauccucuguacagag

SEQ ID NO: 2722583 - RNA, 22 nt, Human
cagccccaucccaaacccuuca

SEQ ID NO: 2722584 - RNA, 12 nt, Human
cagccccauccu

SEQ ID NO: 2722585 - RNA, 13 nt, Human
cagccccauccuc

SEQ ID NO: 2722586 - RNA, 14 nt, Human
cagccccauccucu

SEQ ID NO: 2722587 - RNA, 16 nt, Human
cagccuaguugaucag

SEQ ID NO: 2722588 - RNA, 17 nt, Human
cagccucaaccuccugg

SEQ ID NO: 2722589 - RNA, 18 nt, Human
cagccucaaccuccuggg

SEQ ID NO: 2722590 - RNA, 19 nt, Human
cagccucaaccuccugggc

SEQ ID NO: 2722591 - RNA, 20 nt, Human
cagccucaaccuccugggcu

SEQ ID NO: 2722592 - RNA, 21 nt, Human
cagccucaaccuccugggcua

SEQ ID NO: 2722593 - RNA, 20 nt, Human
cagccucacaguccuuacca

SEQ ID NO: 2722594 - RNA, 14 nt, Human
cagccucacagucc

SEQ ID NO: 2722595 - RNA, 15 nt, Human
cagccucacaguccu

SEQ ID NO: 2722596 - RNA, 19 nt, Human
cagccucccaaagugcugg

SEQ ID NO: 2722597 - RNA, 20 nt, Human
cagccucccaaagugcuggg

SEQ ID NO: 2722598 - RNA, 21 nt, Human
cagccucccaaagugcuggga

SEQ ID NO: 2722599 - RNA, 23 nt, Human
cagccucccaaagugcugggauu

SEQ ID NO: 2722600 - RNA, 20 nt, Human
cagccucccgaauagcuggg

SEQ ID NO: 2722601 - RNA, 21 nt, Human
cagccucccgaauagcuggga

SEQ ID NO: 2722602 - RNA, 22 nt, Human
cagccucccgaauagcugggac

SEQ ID NO: 2722603 - RNA, 21 nt, Human
cagccguguaaccauggaccc

SEQ ID NO: 2722604 - RNA, 18 nt, Human
cagcccugcagagggcac

SEQ ID NO: 2722605 - RNA, 20 nt, Human
cagcccugcagagggcacag

SEQ ID NO: 2722606 - RNA, 13 nt, Human
cagcccugcagag

SEQ ID NO: 2722607 - RNA, 14 nt, Human
cagcccugcagagg

SEQ ID NO: 2722608 - RNA, 15 nt, Human
cagcccugcagaggg

SEQ ID NO: 2722609 - RNA, 16 nt, Human
cagcccugcagagggc

SEQ ID NO: 2722610 - RNA, 20 nt, Human
cagcuaacauggaaguacua

SEQ ID NO: 2722611 - RNA, 15 nt, Human
cagcuaaugggacac

SEQ ID NO: 2722612 - RNA, 16 nt, Human
cagcuaaugggacacu

SEQ ID NO: 2722613 - RNA, 21 nt, Human
cagcgagcccugguggcagug

SEQ ID NO: 2722614 - RNA, 19 nt, Human
cagcuaacauggaaguacu

SEQ ID NO: 2722615 - RNA, 18 nt, Human
cagcuaacauggaaguac

SEQ ID NO: 2722616 - RNA, 13 nt, Human
cagcgagcccugg

SEQ ID NO: 2722617 - RNA, 16 nt, Human
cagcgagcccuggugg

SEQ ID NO: 2722618 - RNA, 17 nt, Human
cagcgagcccugguggc

SEQ ID NO: 2722619 - RNA, 19 nt, Human
cagcgagcccugguggcag

SEQ ID NO: 2722620 - RNA, 20 nt, Human
cagcgagcccugguggcagu

SEQ ID NO: 2722621 - RNA, 12 nt, Human
cagcucagagag

SEQ ID NO: 2722622 - RNA, 19 nt, Human
cagcucaccucucccuugg

SEQ ID NO: 2722623 - RNA, 20 nt, Human
cagcucaccucucccuugga

SEQ ID NO: 2722624 - RNA, 22 nt, Human
cagcucaccagccccagugccc

SEQ ID NO: 2722625 - RNA, 20 nt, Human
cagcucaccagccccagugc

SEQ ID NO: 2722626 - RNA, 21 nt, Human
cagcucaccagccccagugcc

SEQ ID NO: 2722627 - RNA, 13 nt, Human
cagcucaccucuc

SEQ ID NO: 2722628 - RNA, 15 nt, Human
cagcucaccucuccc

SEQ ID NO: 2722629 - RNA, 16 nt, Human
cagcucaccucucccu

SEQ ID NO: 2722630 - RNA, 17 nt, Human
cagcucaccucucccuu

SEQ ID NO: 2722631 - RNA, 13 nt, Human
cagcucaccagcc

SEQ ID NO: 2722632 - RNA, 15 nt, Human
cagcucaccagcccc

SEQ ID NO: 2722633 - RNA, 16 nt, Human
cagcucaccagcccca

SEQ ID NO: 2722634 - RNA, 17 nt, Human
cagcucaccagccccag

SEQ ID NO: 2722635 - RNA, 19 nt, Human
cagcucaccagccccagug

SEQ ID NO: 2722636 - RNA, 24 nt, Human
cagccuugaccauucuccaccugc

SEQ ID NO: 2722637 - RNA, 22 nt, Human
cagccuugaccauucuccaccu

SEQ ID NO: 2722638 - RNA, 23 nt, Human
cagccuugaccauucuccaccug

SEQ ID NO: 2722639 - RNA, 17 nt, Human
cagccuugaccauucuc

SEQ ID NO: 2722640 - RNA, 20 nt, Human
cagccuugaccauucuccac

SEQ ID NO: 2722641 - RNA, 21 nt, Human
cagccuugaccauucuccacc

SEQ ID NO: 2722642 - RNA, 16 nt, Human
cagccugggcaaugug

SEQ ID NO: 2722643 - RNA, 19 nt, Human
cagccugggcaaugugaua

SEQ ID NO: 2722644 - RNA, 20 nt, Human
cagccugcuccagcuguuca

SEQ ID NO: 2722645 - RNA, 23 nt, Human
cagccucccgaauagcugggacu

SEQ ID NO: 2722646 - RNA, 19 nt, Human
cagccucccgaguagcugg

SEQ ID NO: 2722647 - RNA, 20 nt, Human
cagccucccgaguagcuggg

SEQ ID NO: 2722648 - RNA, 21 nt, Human
cagccucccgaguagcuggga

SEQ ID NO: 2722649 - RNA, 22 nt, Human
cagccucccgaguagcugggac

SEQ ID NO: 2722650 - RNA, 23 nt, Human
cagccucccgaguagcugggacu

SEQ ID NO: 2722651 - RNA, 15 nt, Human
cagccuggacccugu

SEQ ID NO: 2722652 - RNA, 19 nt, Human
cagccuggacccuguggau

SEQ ID NO: 2722653 - RNA, 23 nt, Human
cagcaacgcaggcccccaggugc

SEQ ID NO: 2722654 - RNA, 18 nt, Human
cagcaaaagaugcuucuc

SEQ ID NO: 2722655 - RNA, 14 nt, Human
cagauuuuccugaa

SEQ ID NO: 2722656 - RNA, 15 nt, Human
cagauuuuccugaaa

SEQ ID NO: 2722657 - RNA, 17 nt, Human
cagcaaaaauauuuuau

SEQ ID NO: 2722658 - RNA, 14 nt, Human
cagauucuuuccug

SEQ ID NO: 2722659 - RNA, 22 nt, Human
cagauuuuauuauguaaauccc

SEQ ID NO: 2722660 - RNA, 21 nt, Human
cagauuuuauuauguaaaucc

SEQ ID NO: 2722661 - RNA, 20 nt, Human
cagauuuuauuauguaaauc

SEQ ID NO: 2722662 - RNA, 18 nt, Human
cagauuuuauuauguaaa

SEQ ID NO: 2722663 - RNA, 16 nt, Human
cagauuuuauuaugua

SEQ ID NO: 2722664 - RNA, 15 nt, Human
cagauuuuauuaugu

SEQ ID NO: 2722665 - RNA, 13 nt, Human
cagauuuuauuau

SEQ ID NO: 2722666 - RNA, 16 nt, Human
cagauggaaugcugug

SEQ ID NO: 2722667 - RNA, 17 nt, Human
cagauggaaugcugugu

SEQ ID NO: 2722668 - RNA, 19 nt, Human
cagauggaaugcuguguua

SEQ ID NO: 2722669 - RNA, 21 nt, Human
cagauggaaugcuguguuaaa

SEQ ID NO: 2722670 - RNA, 18 nt, Human
cagaugggugcuuggagg

SEQ ID NO: 2722671 - RNA, 23 nt, Human
cagaugggugcuuggaggaagga

SEQ ID NO: 2722672 - RNA, 23 nt, Human
cagauuauucacugauuugacau

SEQ ID NO: 2722673 - RNA, 18 nt, Human
cagauuauucacugauuu

SEQ ID NO: 2722674 - RNA, 12 nt, Human
cagauuauucac

SEQ ID NO: 2722675 - RNA, 23 nt, Human
cagcaagggugaugggaaagcau

SEQ ID NO: 2722676 - RNA, 22 nt, Human
cagcaagggugaugggaaagca

SEQ ID NO: 2722677 - RNA, 12 nt, Human
cagcaagugaga

SEQ ID NO: 2722678 - RNA, 14 nt, Human
cagcaagugagagc

SEQ ID NO: 2722679 - RNA, 15 nt, Human
cagcaagugagagcu

SEQ ID NO: 2722680 - RNA, 16 nt, Human
cagcaagugagagcug

SEQ ID NO: 2722681 - RNA, 17 nt, Human
cagcaagugagagcugg

SEQ ID NO: 2722682 - RNA, 19 nt, Human
cagcaagggugaugggaaa

SEQ ID NO: 2722683 - RNA, 17 nt, Human
cagcaaggagauuuaca

SEQ ID NO: 2722684 - RNA, 18 nt, Human
cagcaaggagauuuacaa

SEQ ID NO: 2722685 - RNA, 22 nt, Human
cagcaauaaagcagcguuucua

SEQ ID NO: 2722686 - RNA, 19 nt, Human
cagcaagugagagcugggu

SEQ ID NO: 2722687 - RNA, 21 nt, Human
cagcaagugagagcugggugu

SEQ ID NO: 2722688 - RNA, 21 nt, Human
cagcaauaaagcagcguuucu

SEQ ID NO: 2722689 - RNA, 13 nt, Human
cagcaauaaagca

SEQ ID NO: 2722690 - RNA, 14 nt, Human
cagcagauuauuca

SEQ ID NO: 2722691 - RNA, 19 nt, Human
cagcagauuauucacugau

SEQ ID NO: 2722692 - RNA, 15 nt, Human
cagcagauuauucac

SEQ ID NO: 2722693 - RNA, 17 nt, Human
cagcagaaaugccuuac

SEQ ID NO: 2722694 - RNA, 15 nt, Human
cagcagaaaugccuu

SEQ ID NO: 2722695 - RNA, 11 nt, Human
cagcagagcac

SEQ ID NO: 2722696 - RNA, 13 nt, Human
cagcagagcaccu

SEQ ID NO: 2722697 - RNA, 22 nt, Human
cagcagaaaugccuuacccuca

SEQ ID NO: 2722698 - RNA, 19 nt, Human
cagcagaaaugccuuaccc

SEQ ID NO: 2722699 - RNA, 12 nt, Human
cagcaggcucuc

SEQ ID NO: 2722700 - RNA, 14 nt, Human
cagcaggcucucag

SEQ ID NO: 2722701 - RNA, 15 nt, Human
cagcaggcucucagg

SEQ ID NO: 2722702 - RNA, 19 nt, Human
cagcagccuggacccugug

SEQ ID NO: 2722703 - RNA, 22 nt, Human
cagcagccuggacccuguggau

SEQ ID NO: 2722704 - RNA, 12 nt, Human
cagcagccugga

SEQ ID NO: 2722705 - RNA, 14 nt, Human
cagcagccuggacc

SEQ ID NO: 2722706 - RNA, 15 nt, Human
cagcagccuggaccc

SEQ ID NO: 2722707 - RNA, 18 nt, Human
cagcagccuggacccugu

SEQ ID NO: 2722708 - RNA, 20 nt, Human
cagcagggagggcuucugcc

SEQ ID NO: 2722709 - RNA, 14 nt, Human
cagcauccuggcac

SEQ ID NO: 2722710 - RNA, 15 nt, Human
cagcauccuggcacc

SEQ ID NO: 2722711 - RNA, 16 nt, Human
cagcauccuggcaccc

SEQ ID NO: 2722712 - RNA, 17 nt, Human
cagcauccuggcacccg

SEQ ID NO: 2722713 - RNA, 18 nt, Human
cagcagggagggcuucug

SEQ ID NO: 2722714 - RNA, 20 nt, Human
cagcaggcucucaggccagc

SEQ ID NO: 2722715 - RNA, 22 nt, Human
cagcaggcucucaggccagcug

SEQ ID NO: 2722716 - RNA, 16 nt, Human
cagcaggcucucaggc

SEQ ID NO: 2722717 - RNA, 17 nt, Human
cagcaggcucucaggcc

SEQ ID NO: 2722718 - RNA, 18 nt, Human
cagcaggcucucaggcca

SEQ ID NO: 2722719 - RNA, 19 nt, Human
cagcaggcucucaggccag

SEQ ID NO: 2722720 - RNA, 21 nt, Human
cagcauccuggcacccggccc

SEQ ID NO: 2722721 - RNA, 19 nt, Human
cagcauccuggcacccggc

SEQ ID NO: 2722722 - RNA, 20 nt, Human
cagcauccuggcacccggcc

SEQ ID NO: 2722723 - RNA, 15 nt, Human
cagccaaagccuccu

SEQ ID NO: 2722724 - RNA, 16 nt, Human
cagccaaagccuccuc

SEQ ID NO: 2722725 - RNA, 18 nt, Human
cagccaaagccuccucca

SEQ ID NO: 2722726 - RNA, 21 nt, Human
cagccaaagccuccuccagcc

SEQ ID NO: 2722727 - RNA, 15 nt, Human
cagcccacuucugcc

SEQ ID NO: 2722728 - RNA, 15 nt, Human
cagcccaccccucaa

SEQ ID NO: 2722729 - RNA, 18 nt, Human
cagcccacuucugccaua

SEQ ID NO: 2722730 - RNA, 22 nt, Human
cagccccaaaacucuccucugc

SEQ ID NO: 2722731 - RNA, 20 nt, Human
cagccccaaaacucuccucu

SEQ ID NO: 2722732 - RNA, 21 nt, Human
cagccccaaaacucuccucug

SEQ ID NO: 2722733 - RNA, 23 nt, Human
cagccacggccaggccagaggga

SEQ ID NO: 2722734 - RNA, 13 nt, Human
cagccaguaaaug

SEQ ID NO: 2722735 - RNA, 22 nt, Human
cagccaguaaaugggggugcau

SEQ ID NO: 2722736 - RNA, 14 nt, Human
cagccacggccagg

SEQ ID NO: 2722737 - RNA, 15 nt, Human
cagccacggccaggc

SEQ ID NO: 2722738 - RNA, 16 nt, Human
cagccacggccaggcc

SEQ ID NO: 2722739 - RNA, 17 nt, Human
cagccacggccaggcca

SEQ ID NO: 2722740 - RNA, 18 nt, Human
cagccacggccaggccag

SEQ ID NO: 2722741 - RNA, 19 nt, Human
cagccacggccaggccaga

SEQ ID NO: 2722742 - RNA, 21 nt, Human
cagccacggccaggccagagg

SEQ ID NO: 2722743 - RNA, 22 nt, Human
cagccacggccaggccagaggg

SEQ ID NO: 2722744 - RNA, 14 nt, Human
cagccacauuccug

SEQ ID NO: 2722745 - RNA, 19 nt, Human
cagccacauuccugaugcu

SEQ ID NO: 2722746 - RNA, 15 nt, Human
cagccacauuccuga

SEQ ID NO: 2722747 - RNA, 17 nt, Human
cagccacauuccugaug

SEQ ID NO: 2722748 - RNA, 14 nt, Human
cagcucaccagccc

SEQ ID NO: 2722749 - RNA, 13 nt, Human
caggcuagaugua

SEQ ID NO: 2722750 - RNA, 19 nt, Human
caggcuagauguauguacu

SEQ ID NO: 2722751 - RNA, 14 nt, Human
caggcuacugucag

SEQ ID NO: 2722752 - RNA, 14 nt, Human
caggcuccuuuagc

SEQ ID NO: 2722753 - RNA, 19 nt, Human
caggcuccuuuagcgccca

SEQ ID NO: 2722754 - RNA, 20 nt, Human
caggcuccuuuagcgcccag

SEQ ID NO: 2722755 - RNA, 21 nt, Human
caggcucucaggccagcugcu

SEQ ID NO: 2722756 - RNA, 23 nt, Human
caggcucucaggccagcugcuug

SEQ ID NO: 2722757 - RNA, 17 nt, Human
caggcucucaggccagc

SEQ ID NO: 2722758 - RNA, 18 nt, Human
caggcucucaggccagcu

SEQ ID NO: 2722759 - RNA, 19 nt, Human
caggcucucaggccagcug

SEQ ID NO: 2722760 - RNA, 20 nt, Human
caggcucucaggccagcugc

SEQ ID NO: 2722761 - RNA, 21 nt, Human
caggcuccuuuagcgcccagu

SEQ ID NO: 2722762 - RNA, 20 nt, Human
caggcucgggcuccccagcc

SEQ ID NO: 2722763 - RNA, 12 nt, Human
caggcucucagg

SEQ ID NO: 2722764 - RNA, 13 nt, Human
caggcucucaggc

SEQ ID NO: 2722765 - RNA, 14 nt, Human
caggcucucaggcc

SEQ ID NO: 2722766 - RNA, 15 nt, Human
caggcucucaggcca

SEQ ID NO: 2722767 - RNA, 16 nt, Human
caggcucucaggccag

SEQ ID NO: 2722768 - RNA, 21 nt, Human
caggcccucugcccacucccu

SEQ ID NO: 2722769 - RNA, 22 nt, Human
caggcccucugcccacucccug

SEQ ID NO: 2722770 - RNA, 16 nt, Human
caggcccucugcccac

SEQ ID NO: 2722771 - RNA, 17 nt, Human
caggcccucugcccacu

SEQ ID NO: 2722772 - RNA, 19 nt, Human
caggcccucugcccacucc

SEQ ID NO: 2722773 - RNA, 20 nt, Human
caggcccucugcccacuccc

SEQ ID NO: 2722774 - RNA, 13 nt, Human
caggcccucugcc

SEQ ID NO: 2722775 - RNA, 14 nt, Human
caggcccucugccc

SEQ ID NO: 2722776 - RNA, 15 nt, Human
caggcccucugccca

SEQ ID NO: 2722777 - RNA, 22 nt, Human
caggcccggcuccaggcuccuu

SEQ ID NO: 2722778 - RNA, 20 nt, Human
caggcccggcuccaggcucc

SEQ ID NO: 2722779 - RNA, 21 nt, Human
caggcccggcuccaggcuccu

SEQ ID NO: 2722780 - RNA, 17 nt, Human
caggcccggcuccaggc

SEQ ID NO: 2722781 - RNA, 16 nt, Human
caggcccggcuccagg

SEQ ID NO: 2722782 - RNA, 18 nt, Human
caggcccggcuccaggcu

SEQ ID NO: 2722783 - RNA, 19 nt, Human
caggcccggcuccaggcuc

SEQ ID NO: 2722784 - RNA, 23 nt, Human
caggcugggcuucaguggcagcu

SEQ ID NO: 2722785 - RNA, 22 nt, Human
caggcuuagucacugagacagc

SEQ ID NO: 2722786 - RNA, 23 nt, Human
caggcuuagucacugagacagcc

SEQ ID NO: 2722787 - RNA, 12 nt, Human
caggcuggucuc

SEQ ID NO: 2722788 - RNA, 19 nt, Human
caggcuggucucaaacucu

SEQ ID NO: 2722789 - RNA, 14 nt, Human
caggcuguauccca

SEQ ID NO: 2722790 - RNA, 20 nt, Human
caggcuguaucccaugagcc

SEQ ID NO: 2722791 - RNA, 21 nt, Human
caggcuguaucccaugagccu

SEQ ID NO: 2722792 - RNA, 22 nt, Human
caggcuguaucccaugagccuc

SEQ ID NO: 2722793 - RNA, 23 nt, Human
caggcuguaucccaugagccuca

SEQ ID NO: 2722794 - RNA, 16 nt, Human
caggcuuagucacuga

SEQ ID NO: 2722795 - RNA, 17 nt, Human
caggcuuagucacugag

SEQ ID NO: 2722796 - RNA, 20 nt, Human
caggcuuagucacugagaca

SEQ ID NO: 2722797 - RNA, 21 nt, Human
caggcuuagucacugagacag

SEQ ID NO: 2722798 - RNA, 11 nt, Human
caggggacagg

SEQ ID NO: 2722799 - RNA, 16 nt, Human
caggggacaggauggu

SEQ ID NO: 2722800 - RNA, 16 nt, Human
cagggccuggcucagg

SEQ ID NO: 2722801 - RNA, 19 nt, Human
cagggccuggcucaggugg

SEQ ID NO: 2722802 - RNA, 13 nt, Human
cagggccuggcuc

SEQ ID NO: 2722803 - RNA, 14 nt, Human
cagggccuggcuca

SEQ ID NO: 2722804 - RNA, 15 nt, Human
cagggccuggcucag

SEQ ID NO: 2722805 - RNA, 19 nt, Human
caggggaggguagagcgga

SEQ ID NO: 2722806 - RNA, 17 nt, Human
cagggcauggcugggaa

SEQ ID NO: 2722807 - RNA, 18 nt, Human
cagggacaggauaagagg

SEQ ID NO: 2722808 - RNA, 23 nt, Human
cagggacagaggggguggccucc

SEQ ID NO: 2722809 - RNA, 14 nt, Human
cagggcacaccggg

SEQ ID NO: 2722810 - RNA, 22 nt, Human
cagggcacaccgggcacucaga

SEQ ID NO: 2722811 - RNA, 23 nt, Human
cagggcacaccgggcacucagaa

SEQ ID NO: 2722812 - RNA, 15 nt, Human
cagggcacaccgggc

SEQ ID NO: 2722813 - RNA, 17 nt, Human
cagggcacaccgggcac

SEQ ID NO: 2722814 - RNA, 19 nt, Human
cagggcacaccgggcacuc

SEQ ID NO: 2722815 - RNA, 21 nt, Human
cagggcacaccgggcacucag

SEQ ID NO: 2722816 - RNA, 16 nt, Human
cagggaaacagcuaau

SEQ ID NO: 2722817 - RNA, 22 nt, Human
cagggaaacagcuaaugggaca

SEQ ID NO: 2722818 - RNA, 13 nt, Human
cagggacagaggg

SEQ ID NO: 2722819 - RNA, 14 nt, Human
cagggacagagggg

SEQ ID NO: 2722820 - RNA, 20 nt, Human
cagggacagaggggguggcc

SEQ ID NO: 2722821 - RNA, 19 nt, Human
caggcccccaggugccagu

SEQ ID NO: 2722822 - RNA, 14 nt, Human
caggcccccaggug

SEQ ID NO: 2722823 - RNA, 20 nt, Human
caggcccccaggugccaguu

SEQ ID NO: 2722824 - RNA, 13 nt, Human
caggccccugcca

SEQ ID NO: 2722825 - RNA, 23 nt, Human
caggccaaacucaccugccccuc

SEQ ID NO: 2722826 - RNA, 18 nt, Human
caggccaaacucaccugc

SEQ ID NO: 2722827 - RNA, 13 nt, Human
caggccacaagac

SEQ ID NO: 2722828 - RNA, 17 nt, Human
caggccacaagacccuu

SEQ ID NO: 2722829 - RNA, 18 nt, Human
caggccacaagacccuug

SEQ ID NO: 2722830 - RNA, 20 nt, Human
caggccacaagacccuugug

SEQ ID NO: 2722831 - RNA, 21 nt, Human
caggccaggcccucugcccac

SEQ ID NO: 2722832 - RNA, 22 nt, Human
caggccaggcccucugcccacu

SEQ ID NO: 2722833 - RNA, 13 nt, Human
caggcccggcucc

SEQ ID NO: 2722834 - RNA, 14 nt, Human
caggcccggcucca

SEQ ID NO: 2722835 - RNA, 15 nt, Human
caggcccggcuccag

SEQ ID NO: 2722836 - RNA, 15 nt, Human
caggccccugccacc

SEQ ID NO: 2722837 - RNA, 17 nt, Human
caggccccugccacccu

SEQ ID NO: 2722838 - RNA, 19 nt, Human
caggccccugccacccugg

SEQ ID NO: 2722839 - RNA, 20 nt, Human
caggccccugccacccuggg

SEQ ID NO: 2722840 - RNA, 16 nt, Human
caggauuuuaaucuuu

SEQ ID NO: 2722841 - RNA, 20 nt, Human
caggauucuuccucccuccc

SEQ ID NO: 2722842 - RNA, 14 nt, Human
caggcagccaggcc

SEQ ID NO: 2722843 - RNA, 15 nt, Human
caggcagccaggcca

SEQ ID NO: 2722844 - RNA, 14 nt, Human
caggcaagcaccuc

SEQ ID NO: 2722845 - RNA, 15 nt, Human
caggcaagcaccucc

SEQ ID NO: 2722846 - RNA, 16 nt, Human
caggcaagcaccuccu

SEQ ID NO: 2722847 - RNA, 21 nt, Human
caggcaagcaccuccugccuc

SEQ ID NO: 2722848 - RNA, 16 nt, Human
caggcagccaggccac

SEQ ID NO: 2722849 - RNA, 17 nt, Human
caggcagccaggccaca

SEQ ID NO: 2722850 - RNA, 13 nt, Human
caggcagguccag

SEQ ID NO: 2722851 - RNA, 17 nt, Human
caggcaugguggcccac

SEQ ID NO: 2722852 - RNA, 15 nt, Human
caggcaggugggaug

SEQ ID NO: 2722853 - RNA, 23 nt, Human
caggcaggucuugaacuccuggc

SEQ ID NO: 2722854 - RNA, 13 nt, Human
caggcaggucuug

SEQ ID NO: 2722855 - RNA, 22 nt, Human
caggcaggucuugaacuccugg

SEQ ID NO: 2722856 - RNA, 14 nt, Human
caggcagguccagg

SEQ ID NO: 2722857 - RNA, 15 nt, Human
caggcagguccaggg

SEQ ID NO: 2722858 - RNA, 19 nt, Human
caggcagguccaggguuug

SEQ ID NO: 2722859 - RNA, 12 nt, Human
caggcaggucuu

SEQ ID NO: 2722860 - RNA, 24 nt, Human
caggcauuccccaggaggccagcc

SEQ ID NO: 2722861 - RNA, 22 nt, Human
caggcauuccccaggaggccag

SEQ ID NO: 2722862 - RNA, 23 nt, Human
caggcauuccccaggaggccagc

SEQ ID NO: 2722863 - RNA, 18 nt, Human
caggcauuccccaggagg

SEQ ID NO: 2722864 - RNA, 19 nt, Human
caggcauuccccaggaggc

SEQ ID NO: 2722865 - RNA, 20 nt, Human
caggcauuccccaggaggcc

SEQ ID NO: 2722866 - RNA, 21 nt, Human
caggcauuccccaggaggcca

SEQ ID NO: 2722867 - RNA, 15 nt, Human
caggcauguucucug

SEQ ID NO: 2722868 - RNA, 18 nt, Human
caggcauguucucugagg

SEQ ID NO: 2722869 - RNA, 19 nt, Human
caggcauguucucugagga

SEQ ID NO: 2722870 - RNA, 20 nt, Human
caggcauguucucugaggac

SEQ ID NO: 2722871 - RNA, 13 nt, Human
caggcauucccca

SEQ ID NO: 2722872 - RNA, 15 nt, Human
caggcauuccccagg

SEQ ID NO: 2722873 - RNA, 16 nt, Human
caggcauuccccagga

SEQ ID NO: 2722874 - RNA, 17 nt, Human
caggcauuccccaggag

SEQ ID NO: 2722875 - RNA, 21 nt, Human
caggaugguucccuugaugaa

SEQ ID NO: 2722876 - RNA, 23 nt, Human
caggaugguucccuugaugaaga

SEQ ID NO: 2722877 - RNA, 18 nt, Human
caggauucuuccucccuc

SEQ ID NO: 2722878 - RNA, 17 nt, Human
caggauucuuccucccu

SEQ ID NO: 2722879 - RNA, 23 nt, Human
caggauggccgggcgcgguggcu

SEQ ID NO: 2722880 - RNA, 14 nt, Human
caggaucagucuga

SEQ ID NO: 2722881 - RNA, 13 nt, Human
caggaucagucug

SEQ ID NO: 2722882 - RNA, 21 nt, Human
caggauauucucacagcucca

SEQ ID NO: 2722883 - RNA, 22 nt, Human
caggaguuugagaccaaccugg

SEQ ID NO: 2722884 - RNA, 23 nt, Human
caggaguuugagaccaaccuggg

SEQ ID NO: 2722885 - RNA, 21 nt, Human
caggaguuugagaccaaccug

SEQ ID NO: 2722886 - RNA, 12 nt, Human
caggagugagca

SEQ ID NO: 2722887 - RNA, 14 nt, Human
caggagccuccugc

SEQ ID NO: 2722888 - RNA, 17 nt, Human
caggagccuccugcccu

SEQ ID NO: 2722889 - RNA, 20 nt, Human
caggagccuccugcccuuac

SEQ ID NO: 2722890 - RNA, 23 nt, Human
caggagccccgaggccuucucug

SEQ ID NO: 2722891 - RNA, 20 nt, Human
caggagccccgaggccuucu

SEQ ID NO: 2722892 - RNA, 22 nt, Human
caggagccccgaggccuucucu

SEQ ID NO: 2722893 - RNA, 15 nt, Human
caggagccccgaggc

SEQ ID NO: 2722894 - RNA, 16 nt, Human
caggagccccgaggcc

SEQ ID NO: 2722895 - RNA, 18 nt, Human
caggagccccgaggccuu

SEQ ID NO: 2722896 - RNA, 12 nt, Human
caggagcagcca

SEQ ID NO: 2722897 - RNA, 13 nt, Human
caggagcagccac

SEQ ID NO: 2722898 - RNA, 14 nt, Human
caggagcagccaca

SEQ ID NO: 2722899 - RNA, 19 nt, Human
caggagcagccacauuccu

SEQ ID NO: 2722900 - RNA, 12 nt, Human
caggagaguaga

SEQ ID NO: 2722901 - RNA, 19 nt, Human
cagugagucgaggacaggg

SEQ ID NO: 2722902 - RNA, 20 nt, Human
cagugagucgaggacaggga

SEQ ID NO: 2722903 - RNA, 22 nt, Human
cagugagucgaggacagggagg

SEQ ID NO: 2722904 - RNA, 23 nt, Human
cagugagucgaggacagggaggu

SEQ ID NO: 2722905 - RNA, 15 nt, Human
cagugccgagaagga

SEQ ID NO: 2722906 - RNA, 18 nt, Human
cagugccgagaaggaagc

SEQ ID NO: 2722907 - RNA, 11 nt, Human
cagugccuuau

SEQ ID NO: 2722908 - RNA, 13 nt, Human
cagugccuuaugg

SEQ ID NO: 2722909 - RNA, 15 nt, Human
cagugccuuauggaa

SEQ ID NO: 2722910 - RNA, 16 nt, Human
cagugccuuauggaac

SEQ ID NO: 2722911 - RNA, 17 nt, Human
cagugccuuauggaaca

SEQ ID NO: 2722912 - RNA, 18 nt, Human
cagugccuuauggaacac

SEQ ID NO: 2722913 - RNA, 19 nt, Human
cagugccuuauggaacacu

SEQ ID NO: 2722914 - RNA, 20 nt, Human
cagugccuuauggaacacuc

SEQ ID NO: 2722915 - RNA, 21 nt, Human
cagugccuuauggaacacucu

SEQ ID NO: 2722916 - RNA, 22 nt, Human
cagugccuuauggaacacucug

SEQ ID NO: 2722917 - RNA, 20 nt, Human
cagugaaagaaaauaacaau

SEQ ID NO: 2722918 - RNA, 16 nt, Human
cagugaaagaaaauaa

SEQ ID NO: 2722919 - RNA, 19 nt, Human
cagucuggaaugcaguggu

SEQ ID NO: 2722920 - RNA, 18 nt, Human
cagucuggaaugcagugg

SEQ ID NO: 2722921 - RNA, 21 nt, Human
caguccuuaccagcagagcac

SEQ ID NO: 2722922 - RNA, 19 nt, Human
caguccuuaccagcagagc

SEQ ID NO: 2722923 - RNA, 20 nt, Human
caguccuuaccagcagagca

SEQ ID NO: 2722924 - RNA, 15 nt, Human
caguccuuaccagca

SEQ ID NO: 2722925 - RNA, 18 nt, Human
caguccuuaccagcagag

SEQ ID NO: 2722926 - RNA, 16 nt, Human
caguccucccaucuca

SEQ ID NO: 2722927 - RNA, 17 nt, Human
caguccucccaucucac

SEQ ID NO: 2722928 - RNA, 12 nt, Human
cagugaauucuu

SEQ ID NO: 2722929 - RNA, 24 nt, Human
cagugagccgagauugcaccacug

SEQ ID NO: 2722930 - RNA, 12 nt, Human
cagugaggcucu

SEQ ID NO: 2722931 - RNA, 13 nt, Human
cagugaggcucug

SEQ ID NO: 2722932 - RNA, 14 nt, Human
cagugaggcucugc

SEQ ID NO: 2722933 - RNA, 15 nt, Human
cagugaggcucugcc

SEQ ID NO: 2722934 - RNA, 16 nt, Human
cagugaggcucugccc

SEQ ID NO: 2722935 - RNA, 21 nt, Human
cagugaggcucugcccuuggu

SEQ ID NO: 2722936 - RNA, 17 nt, Human
cagugagucgaggacag

SEQ ID NO: 2722937 - RNA, 18 nt, Human
cagugagucgaggacagg

SEQ ID NO: 2722938 - RNA, 17 nt, Human
cagugaggcucugcccu

SEQ ID NO: 2722939 - RNA, 18 nt, Human
cagugaggcucugcccuu

SEQ ID NO: 2722940 - RNA, 19 nt, Human
cagugaggcucugcccuug

SEQ ID NO: 2722941 - RNA, 20 nt, Human
cagugaggcucugcccuugg

SEQ ID NO: 2722942 - RNA, 23 nt, Human
cagugccuuauggaacacucuga

SEQ ID NO: 2722943 - RNA, 21 nt, Human
caguaucuugaagacuuuucu

SEQ ID NO: 2722944 - RNA, 15 nt, Human
caguaucucagggcc

SEQ ID NO: 2722945 - RNA, 12 nt, Human
caguaucuugaa

SEQ ID NO: 2722946 - RNA, 18 nt, Human
caguaucuugaagacuuu

SEQ ID NO: 2722947 - RNA, 13 nt, Human
caguaucucaggg

SEQ ID NO: 2722948 - RNA, 21 nt, Human
caguauaauuaacauguuaaa

SEQ ID NO: 2722949 - RNA, 17 nt, Human
caguauaauuaacaugu

SEQ ID NO: 2722950 - RNA, 15 nt, Human
caguauaauuaacau

SEQ ID NO: 2722951 - RNA, 14 nt, Human
caguauaauuaaca

SEQ ID NO: 2722952 - RNA, 22 nt, Human
cagucaggaaagagaacuucca

SEQ ID NO: 2722953 - RNA, 15 nt, Human
cagucaggaaagaga

SEQ ID NO: 2722954 - RNA, 18 nt, Human
cagucaggaaagagaacu

SEQ ID NO: 2722955 - RNA, 18 nt, Human
caguauuacuucugcuac

SEQ ID NO: 2722956 - RNA, 16 nt, Human
caguauuacuucugcu

SEQ ID NO: 2722957 - RNA, 16 nt, Human
caguccauagcagaga

SEQ ID NO: 2722958 - RNA, 17 nt, Human
cagucauucagauauga

SEQ ID NO: 2722959 - RNA, 20 nt, Human
cagucauucagauaugauuc

SEQ ID NO: 2722960 - RNA, 17 nt, Human
cagucccugccaaugga

SEQ ID NO: 2722961 - RNA, 12 nt, Human
caguccucccau

SEQ ID NO: 2722962 - RNA, 13 nt, Human
caguccucccauc

SEQ ID NO: 2722963 - RNA, 14 nt, Human
caguccucccaucu

SEQ ID NO: 2722964 - RNA, 15 nt, Human
caguccucccaucuc

SEQ ID NO: 2722965 - RNA, 12 nt, Human
cagucccugcca

SEQ ID NO: 2722966 - RNA, 13 nt, Human
cagucccugccaa

SEQ ID NO: 2722967 - RNA, 14 nt, Human
cagucccugccaau

SEQ ID NO: 2722968 - RNA, 15 nt, Human
cagucccugccaaug

SEQ ID NO: 2722969 - RNA, 16 nt, Human
cagucccugccaaugg

SEQ ID NO: 2722970 - RNA, 14 nt, Human
caggggugggacac

SEQ ID NO: 2722971 - RNA, 15 nt, Human
caggggugggacacc

SEQ ID NO: 2722972 - RNA, 20 nt, Human
caggggugggacacccugug

SEQ ID NO: 2722973 - RNA, 21 nt, Human
caggggugggacacccuguga

SEQ ID NO: 2722974 - RNA, 23 nt, Human
cagggucccugguggcagcucac

SEQ ID NO: 2722975 - RNA, 18 nt, Human
caggguccuguagcccua

SEQ ID NO: 2722976 - RNA, 21 nt, Human
cagggucucacuauguugccc

SEQ ID NO: 2722977 - RNA, 22 nt, Human
cagggucucacuauguugccca

SEQ ID NO: 2722978 - RNA, 23 nt, Human
cagggucucacuauguugcccag

SEQ ID NO: 2722979 - RNA, 15 nt, Human
cagggucucacucug

SEQ ID NO: 2722980 - RNA, 16 nt, Human
caggguuuugccaugu

SEQ ID NO: 2722981 - RNA, 16 nt, Human
cagggucucacucugu

SEQ ID NO: 2722982 - RNA, 14 nt, Human
cagguaacaggcag

SEQ ID NO: 2722983 - RNA, 15 nt, Human
cagguaacaggcaga

SEQ ID NO: 2722984 - RNA, 16 nt, Human
cagguaacaggcagau

SEQ ID NO: 2722985 - RNA, 17 nt, Human
cagguaacaggcagaua

SEQ ID NO: 2722986 - RNA, 20 nt, Human
caggguauuccagagugggg

SEQ ID NO: 2722987 - RNA, 21 nt, Human
caggguauuccagagugggga

SEQ ID NO: 2722988 - RNA, 12 nt, Human
cagggucccugg

SEQ ID NO: 2722989 - RNA, 14 nt, Human
cagggucccuggug

SEQ ID NO: 2722990 - RNA, 15 nt, Human
cagggucccuggugg

SEQ ID NO: 2722991 - RNA, 18 nt, Human
cagggucccugguggcag

SEQ ID NO: 2722992 - RNA, 19 nt, Human
cagggucccugguggcagc

SEQ ID NO: 2722993 - RNA, 22 nt, Human
cagggucccugguggcagcuca

SEQ ID NO: 2722994 - RNA, 20 nt, Human
cagguaacaggcagauacag

SEQ ID NO: 2722995 - RNA, 21 nt, Human
cagguaacaggcagauacagg

SEQ ID NO: 2722996 - RNA, 20 nt, Human
caggucauauuaauauauuu

SEQ ID NO: 2722997 - RNA, 21 nt, Human
caggucauauuaauauauuuc

SEQ ID NO: 2722998 - RNA, 21 nt, Human
caggugagaagcagaggaagg

SEQ ID NO: 2722999 - RNA, 13 nt, Human
caggugagaagca

SEQ ID NO: 2723000 - RNA, 20 nt, Human
caggugagaagcagaggaag

SEQ ID NO: 2723001 - RNA, 18 nt, Human
caggucuugaacuccugg

SEQ ID NO: 2723002 - RNA, 19 nt, Human
caggucuugaacuccuggc

SEQ ID NO: 2723003 - RNA, 20 nt, Human
caggucuugaacuccuggcc

SEQ ID NO: 2723004 - RNA, 21 nt, Human
caggucuugaacuccuggccu

SEQ ID NO: 2723005 - RNA, 22 nt, Human
caggucuugaacuccuggccuc

SEQ ID NO: 2723006 - RNA, 23 nt, Human
caggucuugaacuccuggccuca

SEQ ID NO: 2723007 - RNA, 20 nt, Human
caggugguuauggagagggu

SEQ ID NO: 2723008 - RNA, 11 nt, Human
caggugucccu

SEQ ID NO: 2723009 - RNA, 14 nt, Human
caggugucccugca

SEQ ID NO: 2723010 - RNA, 18 nt, Human
caggugguuauggagagg

SEQ ID NO: 2723011 - RNA, 23 nt, Human
cagguggggucacucuggcagcu

SEQ ID NO: 2723012 - RNA, 19 nt, Human
cagguggggucacucuggc

SEQ ID NO: 2723013 - RNA, 20 nt, Human
cagguggggucacucuggca

SEQ ID NO: 2723014 - RNA, 21 nt, Human
cagguggggucacucuggcag

SEQ ID NO: 2723015 - RNA, 22 nt, Human
cagguggggucacucuggcagc

SEQ ID NO: 2723016 - RNA, 13 nt, Human
cagguggggcagc

SEQ ID NO: 2723017 - RNA, 14 nt, Human
cagguggggcagcu

SEQ ID NO: 2723018 - RNA, 15 nt, Human
cagguggggcagcuu

SEQ ID NO: 2723019 - RNA, 16 nt, Human
cagguggggcagcuug

SEQ ID NO: 2723020 - RNA, 17 nt, Human
cagguggggcagcuuga

SEQ ID NO: 2723021 - RNA, 18 nt, Human
cagguggggucacucugg

SEQ ID NO: 2723022 - RNA, 13 nt, Human
caguaauaacucu

SEQ ID NO: 2723023 - RNA, 12 nt, Human
caguaauaacuc

SEQ ID NO: 2723024 - RNA, 22 nt, Human
caguaaaugggggugcauuuga

SEQ ID NO: 2723025 - RNA, 20 nt, Human
caguaaaugggggugcauuu

SEQ ID NO: 2723026 - RNA, 21 nt, Human
caguaaaugggggugcauuug

SEQ ID NO: 2723027 - RNA, 13 nt, Human
cagguucagcuug

SEQ ID NO: 2723028 - RNA, 12 nt, Human
cagguucagcuu

SEQ ID NO: 2723029 - RNA, 15 nt, Human
caggugucccugcac

SEQ ID NO: 2723030 - RNA, 16 nt, Human
caggugucccugcacu

SEQ ID NO: 2723031 - RNA, 18 nt, Human
caggugucccugcacuug

SEQ ID NO: 2723032 - RNA, 19 nt, Human
caggugucccugcacuugc

SEQ ID NO: 2723033 - RNA, 12 nt, Human
caggugugaacc

SEQ ID NO: 2723034 - RNA, 22 nt, Human
caggugugagucaccaagccca

SEQ ID NO: 2723035 - RNA, 23 nt, Human
caggugugagucaccaagcccag

SEQ ID NO: 2723036 - RNA, 16 nt, Human
caggugugaaccacca

SEQ ID NO: 2723037 - RNA, 19 nt, Human
caggugugaaccaccacac

SEQ ID NO: 2723038 - RNA, 22 nt, Human
caggugugaaccaccacaccca

SEQ ID NO: 2723039 - RNA, 23 nt, Human
caggugugaaccaccacacccag

SEQ ID NO: 2723040 - RNA, 20 nt, Human
caggugugagucaccaagcc

SEQ ID NO: 2723041 - RNA, 21 nt, Human
caggugugagucaccaagccc

SEQ ID NO: 2723042 - RNA, 16 nt, Human
caggugugagucacca

SEQ ID NO: 2723043 - RNA, 22 nt, Human
cauuccaacuaucucauuucca

SEQ ID NO: 2723044 - RNA, 21 nt, Human
cauucagauaugauucaaaug

SEQ ID NO: 2723045 - RNA, 13 nt, Human
cauuccccaggag

SEQ ID NO: 2723046 - RNA, 15 nt, Human
cauuccccaggaggc

SEQ ID NO: 2723047 - RNA, 17 nt, Human
cauuccccaggaggcca

SEQ ID NO: 2723048 - RNA, 20 nt, Human
cauuccccaggaggccagcc

SEQ ID NO: 2723049 - RNA, 18 nt, Human
cauuccccaggaggccag

SEQ ID NO: 2723050 - RNA, 19 nt, Human
cauuccccaggaggccagc

SEQ ID NO: 2723051 - RNA, 17 nt, Human
cauuauuuuauuaugaa

SEQ ID NO: 2723052 - RNA, 16 nt, Human
cauuauucaaaguugc

SEQ ID NO: 2723053 - RNA, 22 nt, Human
cauuauucaaaguugccuaaau

SEQ ID NO: 2723054 - RNA, 21 nt, Human
cauuauucaaaguugccuaaa

SEQ ID NO: 2723055 - RNA, 18 nt, Human
cauuauucaaaguugccu

SEQ ID NO: 2723056 - RNA, 20 nt, Human
cauucaaauguauuacagug

SEQ ID NO: 2723057 - RNA, 13 nt, Human
cauucuggaauaa

SEQ ID NO: 2723058 - RNA, 17 nt, Human
cauucuguuaaucauua

SEQ ID NO: 2723059 - RNA, 12 nt, Human
cauucugccugc

SEQ ID NO: 2723060 - RNA, 13 nt, Human
cauucugccugcc

SEQ ID NO: 2723061 - RNA, 15 nt, Human
cauucugccugccca

SEQ ID NO: 2723062 - RNA, 16 nt, Human
cauucugccugcccag

SEQ ID NO: 2723063 - RNA, 17 nt, Human
cauucugccugcccagg

SEQ ID NO: 2723064 - RNA, 18 nt, Human
cauucugccugcccaggc

SEQ ID NO: 2723065 - RNA, 19 nt, Human
cauucugccugcccaggcc

SEQ ID NO: 2723066 - RNA, 20 nt, Human
cauucugccugcccaggccc

SEQ ID NO: 2723067 - RNA, 23 nt, Human
cauuccugaugcuucuucagaga

SEQ ID NO: 2723068 - RNA, 14 nt, Human
cauuccugaacagg

SEQ ID NO: 2723069 - RNA, 14 nt, Human
cauuccugaugcuu

SEQ ID NO: 2723070 - RNA, 16 nt, Human
cauuccugaugcuucu

SEQ ID NO: 2723071 - RNA, 19 nt, Human
cauuccugaugcuucuuca

SEQ ID NO: 2723072 - RNA, 22 nt, Human
cauuccugaugcuucuucagag

SEQ ID NO: 2723073 - RNA, 23 nt, Human
cauucuucuguacgucugacagg

SEQ ID NO: 2723074 - RNA, 21 nt, Human
cauuguaaaugugcuuuuaaa

SEQ ID NO: 2723075 - RNA, 20 nt, Human
cauuguacgaagaguauuuu

SEQ ID NO: 2723076 - RNA, 15 nt, Human
cauugugggaagggg

SEQ ID NO: 2723077 - RNA, 13 nt, Human
cauugugggaagg

SEQ ID NO: 2723078 - RNA, 19 nt, Human
cauuguacgaagaguauuu

SEQ ID NO: 2723079 - RNA, 15 nt, Human
cauuuaaaaaaaauc

SEQ ID NO: 2723080 - RNA, 18 nt, Human
cauugaccugaggcccuu

SEQ ID NO: 2723081 - RNA, 14 nt, Human
cauugaccugaggc

SEQ ID NO: 2723082 - RNA, 15 nt, Human
cauugaccugaggcc

SEQ ID NO: 2723083 - RNA, 17 nt, Human
cauugaccugaggcccu

SEQ ID NO: 2723084 - RNA, 19 nt, Human
cauuugaaaauuuugaugu

SEQ ID NO: 2723085 - RNA, 17 nt, Human
cauuugaaaauuuugau

SEQ ID NO: 2723086 - RNA, 13 nt, Human
cauuugcugaaua

SEQ ID NO: 2723087 - RNA, 22 nt, Human
cauuuuauuuuauuaugcauga

SEQ ID NO: 2723088 - RNA, 23 nt, Human
cauuuuauuuuauuaugcaugaa

SEQ ID NO: 2723089 - RNA, 11 nt, Human
cauuuggaaau

SEQ ID NO: 2723090 - RNA, 18 nt, Human
cauuuggaaaucuuuaaa

SEQ ID NO: 2723091 - RNA, 17 nt, Human
cauuuggaaaucuuuaa

SEQ ID NO: 2723092 - RNA, 17 nt, Human
cauuuuuaguagagaca

SEQ ID NO: 2723093 - RNA, 21 nt, Human
cauuuuuaagugcugcauuua

SEQ ID NO: 2723094 - RNA, 16 nt, Human
ccaaacccuucagugc

SEQ ID NO: 2723095 - RNA, 20 nt, Human
caugugcuaguaauuggaaa

SEQ ID NO: 2723096 - RNA, 22 nt, Human
caugugccagguuuuuggucug

SEQ ID NO: 2723097 - RNA, 14 nt, Human
caugugcacaugca

SEQ ID NO: 2723098 - RNA, 23 nt, Human
cauguuuauuacaguauaauuaa

SEQ ID NO: 2723099 - RNA, 22 nt, Human
cauguuaaaccaugggauaaau

SEQ ID NO: 2723100 - RNA, 13 nt, Human
cauguuaaaccau

SEQ ID NO: 2723101 - RNA, 21 nt, Human
caugugaugagaggaaaucac

SEQ ID NO: 2723102 - RNA, 18 nt, Human
caugugaugagaggaaau

SEQ ID NO: 2723103 - RNA, 20 nt, Human
caugugaugagaggaaauca

SEQ ID NO: 2723104 - RNA, 15 nt, Human
caugugaugagagga

SEQ ID NO: 2723105 - RNA, 16 nt, Human
caugugaugagaggaa

SEQ ID NO: 2723106 - RNA, 17 nt, Human
caugugaugagaggaaa

SEQ ID NO: 2723107 - RNA, 12 nt, Human
caugucuggcua

SEQ ID NO: 2723108 - RNA, 23 nt, Human
cauggucggaaaacaugcuacac

SEQ ID NO: 2723109 - RNA, 19 nt, Human
cauggucggaaaacaugcu

SEQ ID NO: 2723110 - RNA, 17 nt, Human
cauggucggaaaacaug

SEQ ID NO: 2723111 - RNA, 14 nt, Human
cauguuugugauug

SEQ ID NO: 2723112 - RNA, 12 nt, Human
cauguuugugau

SEQ ID NO: 2723113 - RNA, 21 nt, Human
cauuaaaaaaucaguuguaca

SEQ ID NO: 2723114 - RNA, 20 nt, Human
cauguuuuucuucucccuca

SEQ ID NO: 2723115 - RNA, 19 nt, Human
cauguuuuucuucucccuc

SEQ ID NO: 2723116 - RNA, 20 nt, Human
cauggaauuggagcucgugg

SEQ ID NO: 2723117 - RNA, 18 nt, Human
caugcuguucaugaaaga

SEQ ID NO: 2723118 - RNA, 16 nt, Human
caugcuguucaugaaa

SEQ ID NO: 2723119 - RNA, 15 nt, Human
cauggacuuccacug

SEQ ID NO: 2723120 - RNA, 15 nt, Human
caugcuguucaugaa

SEQ ID NO: 2723121 - RNA, 13 nt, Human
caugcugucccuu

SEQ ID NO: 2723122 - RNA, 15 nt, Human
caugcugucccuuac

SEQ ID NO: 2723123 - RNA, 15 nt, Human
cauggcauauuuuuc

SEQ ID NO: 2723124 - RNA, 19 nt, Human
cauggcauauuuuucacau

SEQ ID NO: 2723125 - RNA, 23 nt, Human
cauggcauauuuuucacauaucu

SEQ ID NO: 2723126 - RNA, 13 nt, Human
cauggcauauuuu

SEQ ID NO: 2723127 - RNA, 18 nt, Human
caugggccuccugugugu

SEQ ID NO: 2723128 - RNA, 17 nt, Human
caugggauaaaugccau

SEQ ID NO: 2723129 - RNA, 16 nt, Human
caugggauaaaugcca

SEQ ID NO: 2723130 - RNA, 23 nt, Human
caugggauaaaugccaucaauaa

SEQ ID NO: 2723131 - RNA, 18 nt, Human
caugggauaaaugccauc

SEQ ID NO: 2723132 - RNA, 20 nt, Human
caucccucccuccaccuccc

SEQ ID NO: 2723133 - RNA, 17 nt, Human
cauccagguucagcuug

SEQ ID NO: 2723134 - RNA, 14 nt, Human
cauccacugugcca

SEQ ID NO: 2723135 - RNA, 17 nt, Human
cauccacugugccaugu

SEQ ID NO: 2723136 - RNA, 23 nt, Human
cauccacugugccaugugccagg

SEQ ID NO: 2723137 - RNA, 18 nt, Human
caucccuuaccugggaaa

SEQ ID NO: 2723138 - RNA, 22 nt, Human
caucccucccuccaccucccug

SEQ ID NO: 2723139 - RNA, 23 nt, Human
caucccucccuccaccucccugc

SEQ ID NO: 2723140 - RNA, 22 nt, Human
caucccugaaggccccgcccag

SEQ ID NO: 2723141 - RNA, 15 nt, Human
caucccucuggggcu

SEQ ID NO: 2723142 - RNA, 13 nt, Human
caucaugucuggc

SEQ ID NO: 2723143 - RNA, 14 nt, Human
caucaugucuggcu

SEQ ID NO: 2723144 - RNA, 15 nt, Human
caucaugucuggcua

SEQ ID NO: 2723145 - RNA, 16 nt, Human
caucauccuaagcuau

SEQ ID NO: 2723146 - RNA, 12 nt, Human
caucacccgcua

SEQ ID NO: 2723147 - RNA, 20 nt, Human
caucaccaacgucugugcca

SEQ ID NO: 2723148 - RNA, 13 nt, Human
cauauauaacaau

SEQ ID NO: 2723149 - RNA, 23 nt, Human
cauauaagauucauauuuacuuc

SEQ ID NO: 2723150 - RNA, 19 nt, Human
cauagucuggcuguaccca

SEQ ID NO: 2723151 - RNA, 15 nt, Human
cauauauaacaaugc

SEQ ID NO: 2723152 - RNA, 23 nt, Human
cauauauauguuuuaagaggcag

SEQ ID NO: 2723153 - RNA, 18 nt, Human
cauauauuuuuauauuua

SEQ ID NO: 2723154 - RNA, 21 nt, Human
cauauauuuuuauauuuacua

SEQ ID NO: 2723155 - RNA, 20 nt, Human
cauauauuuuuauauuuacu

SEQ ID NO: 2723156 - RNA, 15 nt, Human
cauaucuaguaugaa

SEQ ID NO: 2723157 - RNA, 17 nt, Human
cauaucuaguaugaaau

SEQ ID NO: 2723158 - RNA, 18 nt, Human
cauaucuaguaugaaauu

SEQ ID NO: 2723159 - RNA, 16 nt, Human
cauaguaugguggcug

SEQ ID NO: 2723160 - RNA, 17 nt, Human
cauaguaugguggcugg

SEQ ID NO: 2723161 - RNA, 15 nt, Human
cauaguaugguggcu

SEQ ID NO: 2723162 - RNA, 21 nt, Human
cauaucuaguaugaaauuaua

SEQ ID NO: 2723163 - RNA, 22 nt, Human
cauauucuguuggccaguguga

SEQ ID NO: 2723164 - RNA, 17 nt, Human
cauauugauuuccguua

SEQ ID NO: 2723165 - RNA, 21 nt, Human
cauauugauuuccguuaaaau

SEQ ID NO: 2723166 - RNA, 14 nt, Human
caucaacaucuugg

SEQ ID NO: 2723167 - RNA, 13 nt, Human
caugagcaucagg

SEQ ID NO: 2723168 - RNA, 12 nt, Human
caugagccucag

SEQ ID NO: 2723169 - RNA, 15 nt, Human
caugagccucagcau

SEQ ID NO: 2723170 - RNA, 17 nt, Human
caugagccucagcaucc

SEQ ID NO: 2723171 - RNA, 18 nt, Human
caugagccucagcauccu

SEQ ID NO: 2723172 - RNA, 19 nt, Human
caugagccucagcauccug

SEQ ID NO: 2723173 - RNA, 20 nt, Human
caugagccucagcauccugg

SEQ ID NO: 2723174 - RNA, 21 nt, Human
caugagccucagcauccuggc

SEQ ID NO: 2723175 - RNA, 15 nt, Human
caugagcaucaggcc

SEQ ID NO: 2723176 - RNA, 16 nt, Human
caugagcaucaggcca

SEQ ID NO: 2723177 - RNA, 17 nt, Human
caugagcaucaggccag

SEQ ID NO: 2723178 - RNA, 18 nt, Human
caugagcaucaggccagg

SEQ ID NO: 2723179 - RNA, 20 nt, Human
caugagcaucaggccaggcc

SEQ ID NO: 2723180 - RNA, 21 nt, Human
caugagcaucaggccaggccc

SEQ ID NO: 2723181 - RNA, 22 nt, Human
caugagcaucaggccaggcccu

SEQ ID NO: 2723182 - RNA, 23 nt, Human
caugagcaucaggccaggcccuc

SEQ ID NO: 2723183 - RNA, 23 nt, Human
caugaggaacaaggcaaggcugu

SEQ ID NO: 2723184 - RNA, 22 nt, Human
caugagccucagcauccuggca

SEQ ID NO: 2723185 - RNA, 23 nt, Human
caugagccucagcauccuggcac

SEQ ID NO: 2723186 - RNA, 16 nt, Human
caugaggaacaaggca

SEQ ID NO: 2723187 - RNA, 17 nt, Human
caugaggaacaaggcaa

SEQ ID NO: 2723188 - RNA, 20 nt, Human
caugaggaacaaggcaaggc

SEQ ID NO: 2723189 - RNA, 21 nt, Human
caugaggaacaaggcaaggcu

SEQ ID NO: 2723190 - RNA, 13 nt, Human
caugaguccccug

SEQ ID NO: 2723191 - RNA, 23 nt, Human
caugaguccccuguuuguuucug

SEQ ID NO: 2723192 - RNA, 14 nt, Human
caugaguccccugu

SEQ ID NO: 2723193 - RNA, 15 nt, Human
caugaguccccuguu

SEQ ID NO: 2723194 - RNA, 13 nt, Human
caugaaaacacau

SEQ ID NO: 2723195 - RNA, 17 nt, Human
caugaaaacacauuuuu

SEQ ID NO: 2723196 - RNA, 16 nt, Human
caugaaaacacauuuu

SEQ ID NO: 2723197 - RNA, 15 nt, Human
caugaaaacacauuu

SEQ ID NO: 2723198 - RNA, 14 nt, Human
caugaaaacacauu

SEQ ID NO: 2723199 - RNA, 21 nt, Human
caugaaaacacauuuuucuua

SEQ ID NO: 2723200 - RNA, 19 nt, Human
caugaaaacacauuuuucu

SEQ ID NO: 2723201 - RNA, 14 nt, Human
caugaaagauucaa

SEQ ID NO: 2723202 - RNA, 16 nt, Human
caucuugaauuguaag

SEQ ID NO: 2723203 - RNA, 21 nt, Human
caucuugaauuguaaggaaug

SEQ ID NO: 2723204 - RNA, 15 nt, Human
caucuugcucugcug

SEQ ID NO: 2723205 - RNA, 19 nt, Human
caucuugcucugcugacag

SEQ ID NO: 2723206 - RNA, 16 nt, Human
caucuugcucugcuga

SEQ ID NO: 2723207 - RNA, 17 nt, Human
caucuugcucugcugac

SEQ ID NO: 2723208 - RNA, 16 nt, Human
caucucuacaaaaagc

SEQ ID NO: 2723209 - RNA, 17 nt, Human
caucugacuaugacaua

SEQ ID NO: 2723210 - RNA, 15 nt, Human
caucucuccuccuuu

SEQ ID NO: 2723211 - RNA, 14 nt, Human
ccaccucccugcaa

SEQ ID NO: 2723212 - RNA, 17 nt, Human
ccaccucccacaaagga

SEQ ID NO: 2723213 - RNA, 16 nt, Human
ccaccugccagggaca

SEQ ID NO: 2723214 - RNA, 17 nt, Human
ccaccugccuguugggc

SEQ ID NO: 2723215 - RNA, 20 nt, Human
ccaccugccuguugggccag

SEQ ID NO: 2723216 - RNA, 17 nt, Human
ccaccuggccucugcac

SEQ ID NO: 2723217 - RNA, 14 nt, Human
ccaccuggccucug

SEQ ID NO: 2723218 - RNA, 22 nt, Human
ccaccugcggugcuaucucccc

SEQ ID NO: 2723219 - RNA, 15 nt, Human
ccaccuggccucugc

SEQ ID NO: 2723220 - RNA, 16 nt, Human
ccaccuggccucugca

SEQ ID NO: 2723221 - RNA, 15 nt, Human
ccacggccaggccag

SEQ ID NO: 2723222 - RNA, 12 nt, Human
ccacggccaggc

SEQ ID NO: 2723223 - RNA, 13 nt, Human
ccacggccaggcc

SEQ ID NO: 2723224 - RNA, 14 nt, Human
ccacggccaggcca

SEQ ID NO: 2723225 - RNA, 18 nt, Human
ccacccugaaagcccuga

SEQ ID NO: 2723226 - RNA, 12 nt, Human
ccaccucagccu

SEQ ID NO: 2723227 - RNA, 16 nt, Human
ccacccugaaagcccu

SEQ ID NO: 2723228 - RNA, 17 nt, Human
ccacccugaaagcccug

SEQ ID NO: 2723229 - RNA, 13 nt, Human
ccaccucagccuc

SEQ ID NO: 2723230 - RNA, 14 nt, Human
ccaccucagccucc

SEQ ID NO: 2723231 - RNA, 15 nt, Human
ccaccucagccuccc

SEQ ID NO: 2723232 - RNA, 12 nt, Human
ccacccaggagc

SEQ ID NO: 2723233 - RNA, 14 nt, Human
ccacccaggagccc

SEQ ID NO: 2723234 - RNA, 13 nt, Human
ccacguuucuaaa

SEQ ID NO: 2723235 - RNA, 18 nt, Human
ccacugcacuccagccug

SEQ ID NO: 2723236 - RNA, 15 nt, Human
ccacucccugcaacc

SEQ ID NO: 2723237 - RNA, 19 nt, Human
ccacugcacuccagccugg

SEQ ID NO: 2723238 - RNA, 20 nt, Human
ccacugcacuccagccuggg

SEQ ID NO: 2723239 - RNA, 16 nt, Human
ccacugcgaccacaag

SEQ ID NO: 2723240 - RNA, 18 nt, Human
ccacucaguccauagcag

SEQ ID NO: 2723241 - RNA, 12 nt, Human
ccacucccugca

SEQ ID NO: 2723242 - RNA, 13 nt, Human
ccacucccugcaa

SEQ ID NO: 2723243 - RNA, 23 nt, Human
ccacuacggaauaguuggcuagg

SEQ ID NO: 2723244 - RNA, 22 nt, Human
ccacuacggaauaguuggcuag

SEQ ID NO: 2723245 - RNA, 18 nt, Human
ccacuacauucuguuaau

SEQ ID NO: 2723246 - RNA, 13 nt, Human
ccacacccagccc

SEQ ID NO: 2723247 - RNA, 14 nt, Human
ccacacccagccca

SEQ ID NO: 2723248 - RNA, 12 nt, Human
ccacacccagcc

SEQ ID NO: 2723249 - RNA, 14 nt, Human
ccaccaacauacuc

SEQ ID NO: 2723250 - RNA, 18 nt, Human
ccaccaacauacucccau

SEQ ID NO: 2723251 - RNA, 16 nt, Human
ccacaucuugcucugc

SEQ ID NO: 2723252 - RNA, 20 nt, Human
ccacaucuugcucugcugac

SEQ ID NO: 2723253 - RNA, 22 nt, Human
ccacaucuugcucugcugacag

SEQ ID NO: 2723254 - RNA, 23 nt, Human
ccacaucuugcucugcugacaga

SEQ ID NO: 2723255 - RNA, 14 nt, Human
ccacaucuugcucu

SEQ ID NO: 2723256 - RNA, 14 nt, Human
ccaccacacccagc

SEQ ID NO: 2723257 - RNA, 16 nt, Human
ccaccacacccagccc

SEQ ID NO: 2723258 - RNA, 20 nt, Human
ccaccaacauacucccaucu

SEQ ID NO: 2723259 - RNA, 16 nt, Human
ccacccaagggccugg

SEQ ID NO: 2723260 - RNA, 17 nt, Human
ccacccaagggccuggc

SEQ ID NO: 2723261 - RNA, 19 nt, Human
ccacccaagggccuggccu

SEQ ID NO: 2723262 - RNA, 16 nt, Human
ccacccaccucagccu

SEQ ID NO: 2723263 - RNA, 14 nt, Human
ccacccaccucagc

SEQ ID NO: 2723264 - RNA, 15 nt, Human
ccacccaccucagcc

SEQ ID NO: 2723265 - RNA, 13 nt, Human
ccacccaccucag

SEQ ID NO: 2723266 - RNA, 22 nt, Human
ccacccaagggccuggccugag

SEQ ID NO: 2723267 - RNA, 20 nt, Human
ccacccaagggccuggccug

SEQ ID NO: 2723268 - RNA, 21 nt, Human
ccacccaagggccuggccuga

SEQ ID NO: 2723269 - RNA, 13 nt, Human
ccagcaguucaga

SEQ ID NO: 2723270 - RNA, 18 nt, Human
ccagcaguucagagcugc

SEQ ID NO: 2723271 - RNA, 19 nt, Human
ccagcaguucagagcugcc

SEQ ID NO: 2723272 - RNA, 20 nt, Human
ccagcaguucagagcugccc

SEQ ID NO: 2723273 - RNA, 21 nt, Human
ccagcaguucagagcugcccu

SEQ ID NO: 2723274 - RNA, 22 nt, Human
ccagcaguucagagcugcccuc

SEQ ID NO: 2723275 - RNA, 23 nt, Human
ccagcaguucagagcugcccucu

SEQ ID NO: 2723276 - RNA, 22 nt, Human
ccagccagcaguucagagcugc

SEQ ID NO: 2723277 - RNA, 15 nt, Human
ccagccaaagccucc

SEQ ID NO: 2723278 - RNA, 18 nt, Human
ccagccaaagccuccucc

SEQ ID NO: 2723279 - RNA, 19 nt, Human
ccagccaaagccuccucca

SEQ ID NO: 2723280 - RNA, 13 nt, Human
ccagccccagugc

SEQ ID NO: 2723281 - RNA, 15 nt, Human
ccagccccagugccc

SEQ ID NO: 2723282 - RNA, 23 nt, Human
ccagccccaaaacucuccucugc

SEQ ID NO: 2723283 - RNA, 16 nt, Human
ccagccccagugccca

SEQ ID NO: 2723284 - RNA, 16 nt, Human
ccagcccuuagcaggg

SEQ ID NO: 2723285 - RNA, 17 nt, Human
ccagcccuuagcaggga

SEQ ID NO: 2723286 - RNA, 14 nt, Human
ccagccgccaugcu

SEQ ID NO: 2723287 - RNA, 23 nt, Human
ccagccgagauagccaaggccaa

SEQ ID NO: 2723288 - RNA, 18 nt, Human
ccagccgccaugcuccug

SEQ ID NO: 2723289 - RNA, 19 nt, Human
ccagccgccaugcuccugg

SEQ ID NO: 2723290 - RNA, 15 nt, Human
ccagcaagugagagc

SEQ ID NO: 2723291 - RNA, 14 nt, Human
ccagauuucacucu

SEQ ID NO: 2723292 - RNA, 16 nt, Human
ccagcaagugagagcu

SEQ ID NO: 2723293 - RNA, 20 nt, Human
ccagcaagugagagcugggu

SEQ ID NO: 2723294 - RNA, 21 nt, Human
ccagcaagugagagcugggug

SEQ ID NO: 2723295 - RNA, 22 nt, Human
ccagcaagugagagcugggugu

SEQ ID NO: 2723296 - RNA, 18 nt, Human
ccagauucuuuccugagg

SEQ ID NO: 2723297 - RNA, 19 nt, Human
ccagauucuuuccugaggc

SEQ ID NO: 2723298 - RNA, 20 nt, Human
ccagauucuuuccugaggcu

SEQ ID NO: 2723299 - RNA, 21 nt, Human
ccagauucuuuccugaggcug

SEQ ID NO: 2723300 - RNA, 22 nt, Human
ccagauucuuuccugaggcugg

SEQ ID NO: 2723301 - RNA, 13 nt, Human
ccagagggccugc

SEQ ID NO: 2723302 - RNA, 22 nt, Human
ccagagggagugacagaggcag

SEQ ID NO: 2723303 - RNA, 23 nt, Human
ccagagggagugacagaggcagc

SEQ ID NO: 2723304 - RNA, 23 nt, Human
ccagaugcaccagcccuuagcag

SEQ ID NO: 2723305 - RNA, 15 nt, Human
ccagagggccugcaa

SEQ ID NO: 2723306 - RNA, 16 nt, Human
ccagagggccugcaag

SEQ ID NO: 2723307 - RNA, 23 nt, Human
ccagauucuuuccugaggcuggg

SEQ ID NO: 2723308 - RNA, 19 nt, Human
ccagauugcaacaggcugg

SEQ ID NO: 2723309 - RNA, 20 nt, Human
ccagauugcaacaggcuggg

SEQ ID NO: 2723310 - RNA, 21 nt, Human
ccagauugcaacaggcugggc

SEQ ID NO: 2723311 - RNA, 12 nt, Human
ccagauuucacu

SEQ ID NO: 2723312 - RNA, 17 nt, Human
ccagacaccuugacagg

SEQ ID NO: 2723313 - RNA, 19 nt, Human
ccagacaccuugacagggc

SEQ ID NO: 2723314 - RNA, 20 nt, Human
ccagacaccuugacagggca

SEQ ID NO: 2723315 - RNA, 21 nt, Human
ccagagaggguggugaccucu

SEQ ID NO: 2723316 - RNA, 23 nt, Human
ccagagaggguggugaccucugc

SEQ ID NO: 2723317 - RNA, 14 nt, Human
ccagagaggguggu

SEQ ID NO: 2723318 - RNA, 16 nt, Human
ccagagggagugacag

SEQ ID NO: 2723319 - RNA, 17 nt, Human
ccagagggagugacaga

SEQ ID NO: 2723320 - RNA, 18 nt, Human
ccagagggagugacagag

SEQ ID NO: 2723321 - RNA, 19 nt, Human
ccagagggagugacagagg

SEQ ID NO: 2723322 - RNA, 20 nt, Human
ccagagggagugacagaggc

SEQ ID NO: 2723323 - RNA, 21 nt, Human
ccagagggagugacagaggca

SEQ ID NO: 2723324 - RNA, 21 nt, Human
ccagaggagagaggacccccu

SEQ ID NO: 2723325 - RNA, 22 nt, Human
ccagaggagagaggacccccug

SEQ ID NO: 2723326 - RNA, 11 nt, Human
ccagagcugcc

SEQ ID NO: 2723327 - RNA, 12 nt, Human
ccagagcugcca

SEQ ID NO: 2723328 - RNA, 13 nt, Human
ccagagcugccac

SEQ ID NO: 2723329 - RNA, 14 nt, Human
ccagagcugccacc

SEQ ID NO: 2723330 - RNA, 15 nt, Human
ccagagcugccaccu

SEQ ID NO: 2723331 - RNA, 16 nt, Human
ccagagcugccaccug

SEQ ID NO: 2723332 - RNA, 19 nt, Human
ccagagcugccaccugccu

SEQ ID NO: 2723333 - RNA, 13 nt, Human
ccaugggauaaau

SEQ ID NO: 2723334 - RNA, 17 nt, Human
ccauguuggccaggcug

SEQ ID NO: 2723335 - RNA, 16 nt, Human
ccauguuggccaggcu

SEQ ID NO: 2723336 - RNA, 18 nt, Human
ccauucuccaccugccag

SEQ ID NO: 2723337 - RNA, 22 nt, Human
ccauuauucaaaguugccuaaa

SEQ ID NO: 2723338 - RNA, 17 nt, Human
ccauuauucaaaguugc

SEQ ID NO: 2723339 - RNA, 14 nt, Human
ccauuauucaaagu

SEQ ID NO: 2723340 - RNA, 20 nt, Human
ccauguuuauuacaguauaa

SEQ ID NO: 2723341 - RNA, 13 nt, Human
ccauguuuauuac

SEQ ID NO: 2723342 - RNA, 19 nt, Human
ccauauucuguuggccagu

SEQ ID NO: 2723343 - RNA, 16 nt, Human
cccaaaacucuccucu

SEQ ID NO: 2723344 - RNA, 18 nt, Human
cccaaaacucuccucugc

SEQ ID NO: 2723345 - RNA, 13 nt, Human
cccaaagugcugg

SEQ ID NO: 2723346 - RNA, 15 nt, Human
cccaaagugcuggga

SEQ ID NO: 2723347 - RNA, 14 nt, Human
ccauuuguguuuau

SEQ ID NO: 2723348 - RNA, 19 nt, Human
ccauucuccaccugccagg

SEQ ID NO: 2723349 - RNA, 20 nt, Human
ccauucuccaccugccaggg

SEQ ID NO: 2723350 - RNA, 18 nt, Human
cccaaauggaaaugggca

SEQ ID NO: 2723351 - RNA, 22 nt, Human
cccaaauggaaaugggcagagc

SEQ ID NO: 2723352 - RNA, 16 nt, Human
cccaaagugcugggau

SEQ ID NO: 2723353 - RNA, 21 nt, Human
ccaguuauggcuauaggugcu

SEQ ID NO: 2723354 - RNA, 14 nt, Human
ccaguuauggcuau

SEQ ID NO: 2723355 - RNA, 23 nt, Human
ccauauucuguuggccaguguga

SEQ ID NO: 2723356 - RNA, 22 nt, Human
ccaguguuguggauuuaacaga

SEQ ID NO: 2723357 - RNA, 23 nt, Human
ccagugcccacaggaucagucug

SEQ ID NO: 2723358 - RNA, 16 nt, Human
ccagugaggcucugcc

SEQ ID NO: 2723359 - RNA, 14 nt, Human
ccagugaggcucug

SEQ ID NO: 2723360 - RNA, 15 nt, Human
ccagugaggcucugc

SEQ ID NO: 2723361 - RNA, 20 nt, Human
ccagugccgagaaggaagcc

SEQ ID NO: 2723362 - RNA, 22 nt, Human
ccagugguuccuaauccucuag

SEQ ID NO: 2723363 - RNA, 13 nt, Human
ccaucuacccucc

SEQ ID NO: 2723364 - RNA, 22 nt, Human
ccaggcccucugcccacucccu

SEQ ID NO: 2723365 - RNA, 23 nt, Human
ccaggcccucugcccacucccug

SEQ ID NO: 2723366 - RNA, 20 nt, Human
ccaggcccucugcccacucc

SEQ ID NO: 2723367 - RNA, 21 nt, Human
ccaggcccucugcccacuccc

SEQ ID NO: 2723368 - RNA, 24 nt, Human
ccaggcuguaucccaugagccuca

SEQ ID NO: 2723369 - RNA, 17 nt, Human
ccaggcuuagucacuga

SEQ ID NO: 2723370 - RNA, 19 nt, Human
ccaggagccuccugcccuu

SEQ ID NO: 2723371 - RNA, 12 nt, Human
ccaggagccucc

SEQ ID NO: 2723372 - RNA, 20 nt, Human
ccaggagccccgaggccuuc

SEQ ID NO: 2723373 - RNA, 16 nt, Human
ccaggagccccgaggc

SEQ ID NO: 2723374 - RNA, 19 nt, Human
ccaggagccccgaggccuu

SEQ ID NO: 2723375 - RNA, 19 nt, Human
ccaggcauuccccaggagg

SEQ ID NO: 2723376 - RNA, 21 nt, Human
ccaggcauuccccaggaggcc

SEQ ID NO: 2723377 - RNA, 17 nt, Human
ccaggcauuccccagga

SEQ ID NO: 2723378 - RNA, 18 nt, Human
ccaggcauuccccaggag

SEQ ID NO: 2723379 - RNA, 18 nt, Human
ccaggugcacaagcucca

SEQ ID NO: 2723380 - RNA, 19 nt, Human
ccaggugcacaagcuccaa

SEQ ID NO: 2723381 - RNA, 20 nt, Human
ccaggugcacaagcuccaag

SEQ ID NO: 2723382 - RNA, 13 nt, Human
ccagugaggcucu

SEQ ID NO: 2723383 - RNA, 19 nt, Human
ccagucuggaaugcagugg

SEQ ID NO: 2723384 - RNA, 20 nt, Human
ccagucuggaaugcaguggu

SEQ ID NO: 2723385 - RNA, 18 nt, Human
ccagucuggaaugcagug

SEQ ID NO: 2723386 - RNA, 15 nt, Human
ccagguucagcuugu

SEQ ID NO: 2723387 - RNA, 24 nt, Human
ccaggugcacaagcuccaagcucc

SEQ ID NO: 2723388 - RNA, 17 nt, Human
ccagguuuuuggucuga

SEQ ID NO: 2723389 - RNA, 20 nt, Human
ccaggcuuagucacugagac

SEQ ID NO: 2723390 - RNA, 14 nt, Human
ccagggacagaggg

SEQ ID NO: 2723391 - RNA, 15 nt, Human
ccagggacagagggg

SEQ ID NO: 2723392 - RNA, 21 nt, Human
ccagggacagaggggguggcc

SEQ ID NO: 2723393 - RNA, 22 nt, Human
ccagggacagaggggguggccu

SEQ ID NO: 2723394 - RNA, 19 nt, Human
ccuuggggcugaugcaguu

SEQ ID NO: 2723395 - RNA, 21 nt, Human
ccuuggugucgggcaugacac

SEQ ID NO: 2723396 - RNA, 22 nt, Human
ccuuggugucgggcaugacacg

SEQ ID NO: 2723397 - RNA, 21 nt, Human
ccuugguuaggcauuguggga

SEQ ID NO: 2723398 - RNA, 22 nt, Human
ccuugguuaggcauugugggaa

SEQ ID NO: 2723399 - RNA, 14 nt, Human
ccuugaugaagaag

SEQ ID NO: 2723400 - RNA, 16 nt, Human
ccuuugacgccauccc

SEQ ID NO: 2723401 - RNA, 17 nt, Human
ccuuugacgccauccca

SEQ ID NO: 2723402 - RNA, 18 nt, Human
ccuuugacgccaucccag

SEQ ID NO: 2723403 - RNA, 19 nt, Human
ccuugaacuuugaccucug

SEQ ID NO: 2723404 - RNA, 20 nt, Human
ccuugaguugauucagcucu

SEQ ID NO: 2723405 - RNA, 23 nt, Human
ccuugaccauucuccaccugcca

SEQ ID NO: 2723406 - RNA, 13 nt, Human
ccuugacucuuuc

SEQ ID NO: 2723407 - RNA, 22 nt, Human
ccuugaccauucuccaccugcc

SEQ ID NO: 2723408 - RNA, 15 nt, Human
ccuucuccuucaccu

SEQ ID NO: 2723409 - RNA, 19 nt, Human
ccuucuccuucaccuuugu

SEQ ID NO: 2723410 - RNA, 15 nt, Human
ccuucggcgccuuaa

SEQ ID NO: 2723411 - RNA, 15 nt, Human
ccuucugugaaagua

SEQ ID NO: 2723412 - RNA, 22 nt, Human
ccuucauuuggcauuccccacu

SEQ ID NO: 2723413 - RNA, 19 nt, Human
ccuucauuuggcauucccc

SEQ ID NO: 2723414 - RNA, 14 nt, Human
ccuucagugccaaa

SEQ ID NO: 2723415 - RNA, 11 nt, Human
ccuucagugcc

SEQ ID NO: 2723416 - RNA, 10 nt, Human
ccuucagugc

SEQ ID NO: 2723417 - RNA, 21 nt, Human
ccuucaccuuuguccccaccg

SEQ ID NO: 2723418 - RNA, 14 nt, Human
ccuuagacaguccc

SEQ ID NO: 2723419 - RNA, 17 nt, Human
ccuucacagaugggugc

SEQ ID NO: 2723420 - RNA, 19 nt, Human
ccuucaccuuuguccccac

SEQ ID NO: 2723421 - RNA, 20 nt, Human
ccuucaccuuuguccccacc

SEQ ID NO: 2723422 - RNA, 21 nt, Human
ccuguuaaaagaugaaaauau

SEQ ID NO: 2723423 - RNA, 20 nt, Human
ccuguuaaaagaugaaaaua

SEQ ID NO: 2723424 - RNA, 23 nt, Human
ccuguugggccaggagccuccug

SEQ ID NO: 2723425 - RNA, 16 nt, Human
ccuguuucugcagcca

SEQ ID NO: 2723426 - RNA, 18 nt, Human
ccuguuuguuucugaaag

SEQ ID NO: 2723427 - RNA, 14 nt, Human
ccuguuuguuucug

SEQ ID NO: 2723428 - RNA, 17 nt, Human
ccugugucuugcaaugg

SEQ ID NO: 2723429 - RNA, 19 nt, Human
ccugugucuugcaauggca

SEQ ID NO: 2723430 - RNA, 21 nt, Human
ccugugucuugcaauggcagc

SEQ ID NO: 2723431 - RNA, 22 nt, Human
ccugugucuugcaauggcagcc

SEQ ID NO: 2723432 - RNA, 20 nt, Human
ccugugugugcgccuacagg

SEQ ID NO: 2723433 - RNA, 21 nt, Human
ccugugugugcgccuacagga

SEQ ID NO: 2723434 - RNA, 17 nt, Human
ccuuagaagucacacag

SEQ ID NO: 2723435 - RNA, 18 nt, Human
ccuuagaagucacacagu

SEQ ID NO: 2723436 - RNA, 19 nt, Human
ccuuacccucauguucuua

SEQ ID NO: 2723437 - RNA, 19 nt, Human
ccuuaccugccaggaagcc

SEQ ID NO: 2723438 - RNA, 15 nt, Human
ccuuacccucauguu

SEQ ID NO: 2723439 - RNA, 20 nt, Human
ccuuaccagcagagcaccuu

SEQ ID NO: 2723440 - RNA, 13 nt, Human
ccuuaccagcaga

SEQ ID NO: 2723441 - RNA, 14 nt, Human
ccuuacacaauggu

SEQ ID NO: 2723442 - RNA, 20 nt, Human
ccuuacacaaugguuuucuu

SEQ ID NO: 2723443 - RNA, 12 nt, Human
ccuucagugccu

SEQ ID NO: 2723444 - RNA, 18 nt, Human
cgagcaggcuacugucag

SEQ ID NO: 2723445 - RNA, 20 nt, Human
cgagcaggcuucuucccccc

SEQ ID NO: 2723446 - RNA, 14 nt, Human
cgagcaugccugga

SEQ ID NO: 2723447 - RNA, 13 nt, Human
cgagcaugccugg

SEQ ID NO: 2723448 - RNA, 16 nt, Human
cgagcaugccuggaug

SEQ ID NO: 2723449 - RNA, 17 nt, Human
cgagcaugccuggaugg

SEQ ID NO: 2723450 - RNA, 20 nt, Human
cgagauugcaccacugcacu

SEQ ID NO: 2723451 - RNA, 18 nt, Human
cgagaucacgccacugca

SEQ ID NO: 2723452 - RNA, 20 nt, Human
cgagaucacgccacugcacu

SEQ ID NO: 2723453 - RNA, 13 nt, Human
cgaauagcuggga

SEQ ID NO: 2723454 - RNA, 14 nt, Human
cgaauagcugggac

SEQ ID NO: 2723455 - RNA, 17 nt, Human
cgagaucacgccacugc

SEQ ID NO: 2723456 - RNA, 18 nt, Human
cgagauagccaaggccaa

SEQ ID NO: 2723457 - RNA, 20 nt, Human
cgaaaacguggcugcuucaa

SEQ ID NO: 2723458 - RNA, 15 nt, Human
cgaaaacguggcugc

SEQ ID NO: 2723459 - RNA, 18 nt, Human
cgaaaacguggcugcuuc

SEQ ID NO: 2723460 - RNA, 19 nt, Human
cgaaaacguggcugcuuca

SEQ ID NO: 2723461 - RNA, 22 nt, Human
ccuuugacgccaucccagcccc

SEQ ID NO: 2723462 - RNA, 20 nt, Human
ccuuugacgccaucccagcc

SEQ ID NO: 2723463 - RNA, 21 nt, Human
ccuuugacgccaucccagccc

SEQ ID NO: 2723464 - RNA, 20 nt, Human
cgaaaggaugaaagugacca

SEQ ID NO: 2723465 - RNA, 19 nt, Human
cgaaagggacuuggaagcu

SEQ ID NO: 2723466 - RNA, 22 nt, Human
cgaaagggacuuggaagcuccg

SEQ ID NO: 2723467 - RNA, 12 nt, Human
cgaacuggcugc

SEQ ID NO: 2723468 - RNA, 14 nt, Human
cgaacuggcugcaa

SEQ ID NO: 2723469 - RNA, 21 nt, Human
cgaagaguauuuuugacagaa

SEQ ID NO: 2723470 - RNA, 17 nt, Human
cgccaugcuccuggccc

SEQ ID NO: 2723471 - RNA, 18 nt, Human
cgagcaugccuggauggg

SEQ ID NO: 2723472 - RNA, 15 nt, Human
cgagcccugguggca

SEQ ID NO: 2723473 - RNA, 16 nt, Human
cgagcccugguggcag

SEQ ID NO: 2723474 - RNA, 20 nt, Human
cgauuucuguuuagauaaua

SEQ ID NO: 2723475 - RNA, 14 nt, Human
cgcagcccugcaga

SEQ ID NO: 2723476 - RNA, 15 nt, Human
cgcagacaggaccag

SEQ ID NO: 2723477 - RNA, 16 nt, Human
cgcagacaggaccagg

SEQ ID NO: 2723478 - RNA, 22 nt, Human
cgccaggggaaaaucagccugc

SEQ ID NO: 2723479 - RNA, 17 nt, Human
cgccagauucuuuccug

SEQ ID NO: 2723480 - RNA, 19 nt, Human
cgccagauucuuuccugag

SEQ ID NO: 2723481 - RNA, 20 nt, Human
cgccagauucuuuccugagg

SEQ ID NO: 2723482 - RNA, 21 nt, Human
cgccagauucuuuccugaggc

SEQ ID NO: 2723483 - RNA, 16 nt, Human
ccugcaauaaaauggg

SEQ ID NO: 2723484 - RNA, 14 nt, Human
ccugcaagaacaag

SEQ ID NO: 2723485 - RNA, 19 nt, Human
ccugcaauuucauaugcug

SEQ ID NO: 2723486 - RNA, 20 nt, Human
ccugcacggugaauggcuuu

SEQ ID NO: 2723487 - RNA, 21 nt, Human
ccugcacggugaauggcuuug

SEQ ID NO: 2723488 - RNA, 14 nt, Human
ccugaggcccuucu

SEQ ID NO: 2723489 - RNA, 15 nt, Human
ccugauugugucucu

SEQ ID NO: 2723490 - RNA, 21 nt, Human
ccugaugcuucuucagagacu

SEQ ID NO: 2723491 - RNA, 22 nt, Human
ccugaugcuucuucagagacuc

SEQ ID NO: 2723492 - RNA, 11 nt, Human
ccugaggcccu

SEQ ID NO: 2723493 - RNA, 12 nt, Human
ccugaggcccuu

SEQ ID NO: 2723494 - RNA, 19 nt, Human
ccugaugcuucuucagaga

SEQ ID NO: 2723495 - RNA, 20 nt, Human
ccugaugcuucuucagagac

SEQ ID NO: 2723496 - RNA, 17 nt, Human
ccugauugugucucuug

SEQ ID NO: 2723497 - RNA, 19 nt, Human
ccugauugugucucuuggu

SEQ ID NO: 2723498 - RNA, 22 nt, Human
ccugcaaccugauugugucucu

SEQ ID NO: 2723499 - RNA, 21 nt, Human
ccugcaaccugauugugucuc

SEQ ID NO: 2723500 - RNA, 16 nt, Human
ccugccagggacagag

SEQ ID NO: 2723501 - RNA, 12 nt, Human
ccugccagggac

SEQ ID NO: 2723502 - RNA, 13 nt, Human
ccugccagggaca

SEQ ID NO: 2723503 - RNA, 14 nt, Human
ccugccagggacag

SEQ ID NO: 2723504 - RNA, 15 nt, Human
ccugccagggacaga

SEQ ID NO: 2723505 - RNA, 15 nt, Human
ccugccaggcauggu

SEQ ID NO: 2723506 - RNA, 23 nt, Human
ccugccaggaagccagcaggcuc

SEQ ID NO: 2723507 - RNA, 16 nt, Human
ccugccaggcauggug

SEQ ID NO: 2723508 - RNA, 11 nt, Human
ccugccaggga

SEQ ID NO: 2723509 - RNA, 18 nt, Human
ccugccaggaagccagca

SEQ ID NO: 2723510 - RNA, 19 nt, Human
ccugccaggaagccagcag

SEQ ID NO: 2723511 - RNA, 21 nt, Human
ccugccaggaagccagcaggc

SEQ ID NO: 2723512 - RNA, 22 nt, Human
ccugccaggaagccagcaggcu

SEQ ID NO: 2723513 - RNA, 13 nt, Human
ccugccaggaagc

SEQ ID NO: 2723514 - RNA, 14 nt, Human
ccugccaggaagcc

SEQ ID NO: 2723515 - RNA, 15 nt, Human
ccugccaggaagcca

SEQ ID NO: 2723516 - RNA, 17 nt, Human
ccugccaggaagccagc

SEQ ID NO: 2723517 - RNA, 14 nt, Human
ccugagcuuucugc

SEQ ID NO: 2723518 - RNA, 20 nt, Human
ccugagccagauuucacucu

SEQ ID NO: 2723519 - RNA, 16 nt, Human
ccugagcuuucugcua

SEQ ID NO: 2723520 - RNA, 21 nt, Human
ccugaggcccagagggccugc

SEQ ID NO: 2723521 - RNA, 23 nt, Human
ccugacaacacucauugaccuga

SEQ ID NO: 2723522 - RNA, 23 nt, Human
ccuggaaaucaggguuaguauug

SEQ ID NO: 2723523 - RNA, 14 nt, Human
ccugcuucaaauau

SEQ ID NO: 2723524 - RNA, 22 nt, Human
ccugcggugcuaucucccccag

SEQ ID NO: 2723525 - RNA, 21 nt, Human
ccugcucuccgaccagacacc

SEQ ID NO: 2723526 - RNA, 22 nt, Human
ccugcucuccgaccagacaccu

SEQ ID NO: 2723527 - RNA, 22 nt, Human
ccugccccucaacucuccucca

SEQ ID NO: 2723528 - RNA, 23 nt, Human
ccugccuguugggccaggagccu

SEQ ID NO: 2723529 - RNA, 11 nt, Human
ccugccucagc

SEQ ID NO: 2723530 - RNA, 16 nt, Human
ccugcggugcuaucuc

SEQ ID NO: 2723531 - RNA, 17 nt, Human
ccugcggugcuaucucc

SEQ ID NO: 2723532 - RNA, 22 nt, Human
ccugggcagcugccuccccucc

SEQ ID NO: 2723533 - RNA, 22 nt, Human
ccuggcacccggccccugcugg

SEQ ID NO: 2723534 - RNA, 23 nt, Human
ccuggcacccggccccugcuggu

SEQ ID NO: 2723535 - RNA, 13 nt, Human
ccuggcagccccu

SEQ ID NO: 2723536 - RNA, 12 nt, Human
ccuggcagcccc

SEQ ID NO: 2723537 - RNA, 18 nt, Human
ccuggaauauauaaccag

SEQ ID NO: 2723538 - RNA, 15 nt, Human
ccuggccagaugcac

SEQ ID NO: 2723539 - RNA, 16 nt, Human
cccgggcucugccucc

SEQ ID NO: 2723540 - RNA, 20 nt, Human
cccuacaguugaaaaacagc

SEQ ID NO: 2723541 - RNA, 12 nt, Human
cccgggcucugc

SEQ ID NO: 2723542 - RNA, 14 nt, Human
cccgggcucugccu

SEQ ID NO: 2723543 - RNA, 15 nt, Human
cccgggcucugccuc

SEQ ID NO: 2723544 - RNA, 22 nt, Human
cccgaguagcugggacuacagg

SEQ ID NO: 2723545 - RNA, 19 nt, Human
cccgcugucagccauuccu

SEQ ID NO: 2723546 - RNA, 20 nt, Human
cccgcugucagccauuccug

SEQ ID NO: 2723547 - RNA, 14 nt, Human
cccagagggccugc

SEQ ID NO: 2723548 - RNA, 21 nt, Human
cccgaggccuucucugaagga

SEQ ID NO: 2723549 - RNA, 15 nt, Human
cccagagggccugca

SEQ ID NO: 2723550 - RNA, 13 nt, Human
cccgaguagcugg

SEQ ID NO: 2723551 - RNA, 14 nt, Human
cccgaguagcuggg

SEQ ID NO: 2723552 - RNA, 15 nt, Human
cccgaguagcuggga

SEQ ID NO: 2723553 - RNA, 16 nt, Human
cccgaguagcugggac

SEQ ID NO: 2723554 - RNA, 17 nt, Human
cccgaguagcugggacu

SEQ ID NO: 2723555 - RNA, 18 nt, Human
cccgaguagcugggacua

SEQ ID NO: 2723556 - RNA, 21 nt, Human
cccgaguagcugggacuacag

SEQ ID NO: 2723557 - RNA, 11 nt, Human
cccucuccugg

SEQ ID NO: 2723558 - RNA, 12 nt, Human
cccucuccuggg

SEQ ID NO: 2723559 - RNA, 13 nt, Human
cccucuccugggc

SEQ ID NO: 2723560 - RNA, 14 nt, Human
cccucuccugggca

SEQ ID NO: 2723561 - RNA, 15 nt, Human
cccucuccugggcag

SEQ ID NO: 2723562 - RNA, 12 nt, Human
cccucuggggcu

SEQ ID NO: 2723563 - RNA, 19 nt, Human
cccuccaccucccugcaau

SEQ ID NO: 2723564 - RNA, 15 nt, Human
cccuccaccucccug

SEQ ID NO: 2723565 - RNA, 17 nt, Human
cccuccaccucccugca

SEQ ID NO: 2723566 - RNA, 14 nt, Human
cccuccaccucccu

SEQ ID NO: 2723567 - RNA, 12 nt, Human
cccuccaccucc

SEQ ID NO: 2723568 - RNA, 12 nt, Human
cccugcacuugc

SEQ ID NO: 2723569 - RNA, 19 nt, Human
cccugcacuugcagacucu

SEQ ID NO: 2723570 - RNA, 15 nt, Human
cccugaaagcccuga

SEQ ID NO: 2723571 - RNA, 13 nt, Human
cccugaggcccag

SEQ ID NO: 2723572 - RNA, 16 nt, Human
cccucuggggcuguuc

SEQ ID NO: 2723573 - RNA, 14 nt, Human
cccugaggcccaga

SEQ ID NO: 2723574 - RNA, 15 nt, Human
cccugaggcccagag

SEQ ID NO: 2723575 - RNA, 16 nt, Human
cccugaggcccagagg

SEQ ID NO: 2723576 - RNA, 17 nt, Human
cccugaggcccagaggg

SEQ ID NO: 2723577 - RNA, 18 nt, Human
cccugaggcccagagggc

SEQ ID NO: 2723578 - RNA, 19 nt, Human
cccugaggcccagagggcc

SEQ ID NO: 2723579 - RNA, 20 nt, Human
cccugaggcccagagggccu

SEQ ID NO: 2723580 - RNA, 23 nt, Human
cccugaggcccagagggccugca

SEQ ID NO: 2723581 - RNA, 18 nt, Human
cccugcccaccuggccuc

SEQ ID NO: 2723582 - RNA, 16 nt, Human
cccugcuggguguggc

SEQ ID NO: 2723583 - RNA, 21 nt, Human
cccugcuggguguggcgcagc

SEQ ID NO: 2723584 - RNA, 13 nt, Human
cccugcccaccug

SEQ ID NO: 2723585 - RNA, 14 nt, Human
cccugcccaccugg

SEQ ID NO: 2723586 - RNA, 17 nt, Human
cccugcccaccuggccu

SEQ ID NO: 2723587 - RNA, 17 nt, Human
cccugcuuucagauacu

SEQ ID NO: 2723588 - RNA, 14 nt, Human
cccugcuuucagau

SEQ ID NO: 2723589 - RNA, 22 nt, Human
cccugcuggguguggcgcagca

SEQ ID NO: 2723590 - RNA, 15 nt, Human
cccugguggcagcuc

SEQ ID NO: 2723591 - RNA, 16 nt, Human
cccugguggcagcuca

SEQ ID NO: 2723592 - RNA, 17 nt, Human
cccugguggcagcucac

SEQ ID NO: 2723593 - RNA, 21 nt, Human
cccacaaaggagagcuagcag

SEQ ID NO: 2723594 - RNA, 16 nt, Human
cccaaugcacuuuguu

SEQ ID NO: 2723595 - RNA, 20 nt, Human
cccaaugcacuuuguucugg

SEQ ID NO: 2723596 - RNA, 17 nt, Human
cccaccuggccucugca

SEQ ID NO: 2723597 - RNA, 19 nt, Human
cccaccuggccucugcacu

SEQ ID NO: 2723598 - RNA, 21 nt, Human
cccaccuggccucugcacucc

SEQ ID NO: 2723599 - RNA, 20 nt, Human
cccacgacugcccggcaggg

SEQ ID NO: 2723600 - RNA, 21 nt, Human
cccacgacugcccggcagggu

SEQ ID NO: 2723601 - RNA, 16 nt, Human
cccaccuggccucugc

SEQ ID NO: 2723602 - RNA, 23 nt, Human
cccacuugagaauuacccuuuug

SEQ ID NO: 2723603 - RNA, 12 nt, Human
cccacuucugcc

SEQ ID NO: 2723604 - RNA, 14 nt, Human
cccacgcuggagug

SEQ ID NO: 2723605 - RNA, 19 nt, Human
cccacgcuggagugcagug

SEQ ID NO: 2723606 - RNA, 20 nt, Human
cccacgcuggagugcaguga

SEQ ID NO: 2723607 - RNA, 21 nt, Human
cccacgcuggagugcagugag

SEQ ID NO: 2723608 - RNA, 17 nt, Human
cccaccucagccucccg

SEQ ID NO: 2723609 - RNA, 22 nt, Human
cccaccucucucacuccuugaa

SEQ ID NO: 2723610 - RNA, 19 nt, Human
cccaccgcagacaggacca

SEQ ID NO: 2723611 - RNA, 20 nt, Human
cccaccgcagacaggaccag

SEQ ID NO: 2723612 - RNA, 20 nt, Human
ccgggcgcgguggcucacgc

SEQ ID NO: 2723613 - RNA, 22 nt, Human
ccgggcucugccucccaucacc

SEQ ID NO: 2723614 - RNA, 14 nt, Human
ccgugcuaaggacu

SEQ ID NO: 2723615 - RNA, 16 nt, Human
ccgugcuaaggacuug

SEQ ID NO: 2723616 - RNA, 15 nt, Human
ccgugcuaaggacuu

SEQ ID NO: 2723617 - RNA, 12 nt, Human
ccgcuuucuacc

SEQ ID NO: 2723618 - RNA, 20 nt, Human
ccgggaagggggcugggaca

SEQ ID NO: 2723619 - RNA, 19 nt, Human
ccgcuuucuacccagcgag

SEQ ID NO: 2723620 - RNA, 15 nt, Human
ccggcuggccuggcc

SEQ ID NO: 2723621 - RNA, 17 nt, Human
ccggcuggccuggcccc

SEQ ID NO: 2723622 - RNA, 18 nt, Human
ccggcuggccuggccccu

SEQ ID NO: 2723623 - RNA, 19 nt, Human
ccgcacugggcuuggggac

SEQ ID NO: 2723624 - RNA, 14 nt, Human
ccgcacugggcuug

SEQ ID NO: 2723625 - RNA, 21 nt, Human
ccgcuaagagggagggagggc

SEQ ID NO: 2723626 - RNA, 23 nt, Human
ccgcuaagagggagggagggcuc

SEQ ID NO: 2723627 - RNA, 20 nt, Human
ccgaguagcugggacuacag

SEQ ID NO: 2723628 - RNA, 17 nt, Human
ccgaguagcugggacua

SEQ ID NO: 2723629 - RNA, 20 nt, Human
cccugguggcagcucaccuc

SEQ ID NO: 2723630 - RNA, 14 nt, Human
ccgaggccuucucu

SEQ ID NO: 2723631 - RNA, 17 nt, Human
ccuaaauccauuuggaa

SEQ ID NO: 2723632 - RNA, 15 nt, Human
ccuaaaauucagugg

SEQ ID NO: 2723633 - RNA, 14 nt, Human
ccuaaaguguauuu

SEQ ID NO: 2723634 - RNA, 12 nt, Human
ccuaaauccauu

SEQ ID NO: 2723635 - RNA, 13 nt, Human
ccuaguuccacca

SEQ ID NO: 2723636 - RNA, 21 nt, Human
ccuaguuccaccaucaagcca

SEQ ID NO: 2723637 - RNA, 23 nt, Human
ccuaguuccaccaucaagccacc

SEQ ID NO: 2723638 - RNA, 18 nt, Human
ccuauauuguuuucagug

SEQ ID NO: 2723639 - RNA, 22 nt, Human
ccuauauuguuuucaguguaca

SEQ ID NO: 2723640 - RNA, 13 nt, Human
ccuccaccucccu

SEQ ID NO: 2723641 - RNA, 14 nt, Human
ccuccaccucccug

SEQ ID NO: 2723642 - RNA, 15 nt, Human
ccuccaccucccugc

SEQ ID NO: 2723643 - RNA, 17 nt, Human
ccuccaccucccugcaa

SEQ ID NO: 2723644 - RNA, 22 nt, Human
ccuccaccucccugcaauaaaa

SEQ ID NO: 2723645 - RNA, 22 nt, Human
ccuccaggugcacaagcuccaa

SEQ ID NO: 2723646 - RNA, 19 nt, Human
ccuccaggugcacaagcuc

SEQ ID NO: 2723647 - RNA, 21 nt, Human
ccuccaggugcacaagcucca

SEQ ID NO: 2723648 - RNA, 16 nt, Human
ccucccaaagugcugg

SEQ ID NO: 2723649 - RNA, 23 nt, Human
ccuccaugugggcuaguugggcu

SEQ ID NO: 2723650 - RNA, 15 nt, Human
ccucccaaagugcug

SEQ ID NO: 2723651 - RNA, 13 nt, Human
ccucauccucaua

SEQ ID NO: 2723652 - RNA, 20 nt, Human
ccucauccucauacccaccc

SEQ ID NO: 2723653 - RNA, 20 nt, Human
ccucauaguaugguggcugg

SEQ ID NO: 2723654 - RNA, 13 nt, Human
ccucauacccacc

SEQ ID NO: 2723655 - RNA, 21 nt, Human
ccucauaguaugguggcuggg

SEQ ID NO: 2723656 - RNA, 22 nt, Human
ccucauaguaugguggcugggu

SEQ ID NO: 2723657 - RNA, 13 nt, Human
ccucaucaccaac

SEQ ID NO: 2723658 - RNA, 14 nt, Human
ccucaucaccaacg

SEQ ID NO: 2723659 - RNA, 20 nt, Human
ccucagucuggcccuuccuu

SEQ ID NO: 2723660 - RNA, 11 nt, Human
ccucagugcca

SEQ ID NO: 2723661 - RNA, 12 nt, Human
ccucauacccac

SEQ ID NO: 2723662 - RNA, 19 nt, Human
ccucagucuggcccuuccu

SEQ ID NO: 2723663 - RNA, 16 nt, Human
ccuccucugcuugcca

SEQ ID NO: 2723664 - RNA, 13 nt, Human
ccuccucugcuug

SEQ ID NO: 2723665 - RNA, 18 nt, Human
ccuccucugcuugccauc

SEQ ID NO: 2723666 - RNA, 23 nt, Human
ccuccugccucgaacuggcugca

SEQ ID NO: 2723667 - RNA, 14 nt, Human
ccuccugggcuaag

SEQ ID NO: 2723668 - RNA, 20 nt, Human
ccucccuccaccucccugca

SEQ ID NO: 2723669 - RNA, 17 nt, Human
ccucccuccaccucccu

SEQ ID NO: 2723670 - RNA, 10 nt, Human
ccucccuccc

SEQ ID NO: 2723671 - RNA, 14 nt, Human
ccuccucagaucuu

SEQ ID NO: 2723672 - RNA, 19 nt, Human
ccucccgaguagcugggac

SEQ ID NO: 2723673 - RNA, 20 nt, Human
ccucccgaguagcugggacu

SEQ ID NO: 2723674 - RNA, 21 nt, Human
ccucccgaguagcugggacua

SEQ ID NO: 2723675 - RNA, 16 nt, Human
ccucuaggaggucucu

SEQ ID NO: 2723676 - RNA, 16 nt, Human
ccucggugccuuccuc

SEQ ID NO: 2723677 - RNA, 14 nt, Human
ccucgguguggaga

SEQ ID NO: 2723678 - RNA, 18 nt, Human
ccucgguguggagaagcg

SEQ ID NO: 2723679 - RNA, 17 nt, Human
ccucccgaauagcuggg

SEQ ID NO: 2723680 - RNA, 19 nt, Human
cuucgggaggucgaggcag

SEQ ID NO: 2723681 - RNA, 16 nt, Human
cuucucacugccaugc

SEQ ID NO: 2723682 - RNA, 21 nt, Human
cuucucacugccaugccagcu

SEQ ID NO: 2723683 - RNA, 20 nt, Human
cuuccuuggacucauuuuaa

SEQ ID NO: 2723684 - RNA, 16 nt, Human
cuucgcuccugugucu

SEQ ID NO: 2723685 - RNA, 17 nt, Human
cuucgcuccugugucuu

SEQ ID NO: 2723686 - RNA, 16 nt, Human
cuucagccucccgagu

SEQ ID NO: 2723687 - RNA, 20 nt, Human
cuucagccucccgaguagcu

SEQ ID NO: 2723688 - RNA, 14 nt, Human
cuucagccucccga

SEQ ID NO: 2723689 - RNA, 23 nt, Human
cuucagcaaaaauauuuuaugau

SEQ ID NO: 2723690 - RNA, 20 nt, Human
cuucagcaaaaauauuuuau

SEQ ID NO: 2723691 - RNA, 16 nt, Human
cuucagcgguuuauau

SEQ ID NO: 2723692 - RNA, 15 nt, Human
cuucagcugacuuuu

SEQ ID NO: 2723693 - RNA, 19 nt, Human
cuucagcugacuuuucugu

SEQ ID NO: 2723694 - RNA, 14 nt, Human
cuucaguaagccgu

SEQ ID NO: 2723695 - RNA, 13 nt, Human
cuuccacaagagc

SEQ ID NO: 2723696 - RNA, 14 nt, Human
cuuccacaagagcc

SEQ ID NO: 2723697 - RNA, 15 nt, Human
cuuccacaagagccc

SEQ ID NO: 2723698 - RNA, 14 nt, Human
cuucagugccaaaa

SEQ ID NO: 2723699 - RNA, 17 nt, Human
cuucaaauccuugaaga

SEQ ID NO: 2723700 - RNA, 15 nt, Human
cuucaaauauuuccc

SEQ ID NO: 2723701 - RNA, 21 nt, Human
cuuagucacugagacagcccg

SEQ ID NO: 2723702 - RNA, 20 nt, Human
cuuagucacugagacagccc

SEQ ID NO: 2723703 - RNA, 22 nt, Human
cuuagucacugagacagcccgg

SEQ ID NO: 2723704 - RNA, 17 nt, Human
cuucaaggauccugagc

SEQ ID NO: 2723705 - RNA, 18 nt, Human
cuucaaggauccugagcc

SEQ ID NO: 2723706 - RNA, 19 nt, Human
cuucaaggauccugagcca

SEQ ID NO: 2723707 - RNA, 20 nt, Human
cuucaaggauccugagccag

SEQ ID NO: 2723708 - RNA, 14 nt, Human
cuucacaacagauu

SEQ ID NO: 2723709 - RNA, 12 nt, Human
cuucacaacaga

SEQ ID NO: 2723710 - RNA, 23 nt, Human
cuucaaggauccugagccagauu

SEQ ID NO: 2723711 - RNA, 21 nt, Human
cuucaaggauccugagccaga

SEQ ID NO: 2723712 - RNA, 22 nt, Human
cuucaaggauccugagccagau

SEQ ID NO: 2723713 - RNA, 17 nt, Human
cuucagcaaaaauauuu

SEQ ID NO: 2723714 - RNA, 24 nt, Human
cuucagagacuccugcaggcagcc

SEQ ID NO: 2723715 - RNA, 23 nt, Human
cuucacauauugauuuccguuaa

SEQ ID NO: 2723716 - RNA, 14 nt, Human
cuucacauauugau

SEQ ID NO: 2723717 - RNA, 15 nt, Human
cuguuuuauaauuuu

SEQ ID NO: 2723718 - RNA, 14 nt, Human
cuguuuuauaauuu

SEQ ID NO: 2723719 - RNA, 16 nt, Human
cuuaaaaaguggaaaa

SEQ ID NO: 2723720 - RNA, 17 nt, Human
cuuaaaaaguggaaaaa

SEQ ID NO: 2723721 - RNA, 18 nt, Human
cuguuuagauaauacacc

SEQ ID NO: 2723722 - RNA, 17 nt, Human
cuguuucaaacuuuacu

SEQ ID NO: 2723723 - RNA, 15 nt, Human
cuguuucaaacuuua

SEQ ID NO: 2723724 - RNA, 17 nt, Human
cuguugcccaggcuggc

SEQ ID NO: 2723725 - RNA, 17 nt, Human
cuguuuagauaauacac

SEQ ID NO: 2723726 - RNA, 14 nt, Human
cuguuuagauaaua

SEQ ID NO: 2723727 - RNA, 17 nt, Human
cuguuugcuaagugagg

SEQ ID NO: 2723728 - RNA, 19 nt, Human
cuguuugcuaagugaggau

SEQ ID NO: 2723729 - RNA, 23 nt, Human
cuguucuuucuggcuaugcauuu

SEQ ID NO: 2723730 - RNA, 12 nt, Human
cuguugcccagg

SEQ ID NO: 2723731 - RNA, 13 nt, Human
cuguugcccaggc

SEQ ID NO: 2723732 - RNA, 14 nt, Human
cuguugcccaggcu

SEQ ID NO: 2723733 - RNA, 15 nt, Human
cuguugcccaggcug

SEQ ID NO: 2723734 - RNA, 16 nt, Human
cuguugcccaggcugg

SEQ ID NO: 2723735 - RNA, 16 nt, Human
cuguuaauaguucagg

SEQ ID NO: 2723736 - RNA, 21 nt, Human
cuguucuuucuggcuaugcau

SEQ ID NO: 2723737 - RNA, 14 nt, Human
cuguucuuucuggc

SEQ ID NO: 2723738 - RNA, 13 nt, Human
cuguucuuucugg

SEQ ID NO: 2723739 - RNA, 21 nt, Human
cuguucuuuccaaaguacacu

SEQ ID NO: 2723740 - RNA, 19 nt, Human
cuguucuuuccaaaguaca

SEQ ID NO: 2723741 - RNA, 16 nt, Human
cuguucuuuccaaagu

SEQ ID NO: 2723742 - RNA, 15 nt, Human
cuguucuuuccaaag

SEQ ID NO: 2723743 - RNA, 17 nt, Human
cuuaauuaaaagaauau

SEQ ID NO: 2723744 - RNA, 16 nt, Human
cuuaauuaaaagaaua

SEQ ID NO: 2723745 - RNA, 20 nt, Human
cuuaauuaaaagaauauuuu

SEQ ID NO: 2723746 - RNA, 19 nt, Human
cuuaauuaaaagaauauuu

SEQ ID NO: 2723747 - RNA, 20 nt, Human
cuuaauucuuagcucauucu

SEQ ID NO: 2723748 - RNA, 21 nt, Human
cuuaagaagacugcauuauau

SEQ ID NO: 2723749 - RNA, 23 nt, Human
cuuaagaagacugcauuauauuu

SEQ ID NO: 2723750 - RNA, 23 nt, Human
cuuagguuggcaaaaaggcagga

SEQ ID NO: 2723751 - RNA, 21 nt, Human
cuuagguuggcaaaaaggcag

SEQ ID NO: 2723752 - RNA, 13 nt, Human
cuuaccugccagg

SEQ ID NO: 2723753 - RNA, 20 nt, Human
cuuaccugccaggaagccag

SEQ ID NO: 2723754 - RNA, 20 nt, Human
cuuagaaaaaccaccaccau

SEQ ID NO: 2723755 - RNA, 17 nt, Human
cuuagaagucacacagu

SEQ ID NO: 2723756 - RNA, 20 nt, Human
cuuagaagucacacaguauu

SEQ ID NO: 2723757 - RNA, 16 nt, Human
cuguuaaaagaugaaa

SEQ ID NO: 2723758 - RNA, 15 nt, Human
cuguuaaaagaugaa

SEQ ID NO: 2723759 - RNA, 19 nt, Human
cuguuaaaagaugaaaaua

SEQ ID NO: 2723760 - RNA, 20 nt, Human
cugugucuuuuuucacuaca

SEQ ID NO: 2723761 - RNA, 12 nt, Human
cuguggugacuu

SEQ ID NO: 2723762 - RNA, 14 nt, Human
cuguggugacuuug

SEQ ID NO: 2723763 - RNA, 13 nt, Human
cuguggugacuuu

SEQ ID NO: 2723764 - RNA, 22 nt, Human
cuguggguuucuaaagcugcca

SEQ ID NO: 2723765 - RNA, 23 nt, Human
cuguggugacuuuggauaauaag

SEQ ID NO: 2723766 - RNA, 20 nt, Human
cuguggugacuuuggauaau

SEQ ID NO: 2723767 - RNA, 18 nt, Human
cuguggugacuuuggaua

SEQ ID NO: 2723768 - RNA, 17 nt, Human
cuguggugacuuuggau

SEQ ID NO: 2723769 - RNA, 15 nt, Human
cuguggugacuuugg

SEQ ID NO: 2723770 - RNA, 21 nt, Human
cuguggguuucuaaagcugcc

SEQ ID NO: 2723771 - RNA, 18 nt, Human
cugucuucacaacagauu

SEQ ID NO: 2723772 - RNA, 18 nt, Human
cugucuucaguaagccgu

SEQ ID NO: 2723773 - RNA, 15 nt, Human
cugugaaaggaaaga

SEQ ID NO: 2723774 - RNA, 23 nt, Human
cugucuugccuuuuucauuauuu

SEQ ID NO: 2723775 - RNA, 21 nt, Human
cugucuugccuuuuucauuau

SEQ ID NO: 2723776 - RNA, 23 nt, Human
cugucauuugagcagggcucagc

SEQ ID NO: 2723777 - RNA, 21 nt, Human
cugucauuugagcagggcuca

SEQ ID NO: 2723778 - RNA, 22 nt, Human
cugucauuugagcagggcucag

SEQ ID NO: 2723779 - RNA, 18 nt, Human
cugucaauuacaggaagu

SEQ ID NO: 2723780 - RNA, 20 nt, Human
cugucauuugagcagggcuc

SEQ ID NO: 2723781 - RNA, 15 nt, Human
cugugccaugugcca

SEQ ID NO: 2723782 - RNA, 22 nt, Human
cugugccauuuuguauuuuacu

SEQ ID NO: 2723783 - RNA, 19 nt, Human
cugugcccuaaaguguauu

SEQ ID NO: 2723784 - RNA, 14 nt, Human
cugugccaugugcc

SEQ ID NO: 2723785 - RNA, 18 nt, Human
cugugaaaguacauuugg

SEQ ID NO: 2723786 - RNA, 16 nt, Human
cugugaaaggaaagag

SEQ ID NO: 2723787 - RNA, 22 nt, Human
cugugaaaggaaagagggaggu

SEQ ID NO: 2723788 - RNA, 23 nt, Human
cugugauggggcccugccuccuu

SEQ ID NO: 2723789 - RNA, 16 nt, Human
cugugauggggcccug

SEQ ID NO: 2723790 - RNA, 21 nt, Human
cugugauggggcccugccucc

SEQ ID NO: 2723791 - RNA, 15 nt, Human
cugugauggggcccu

SEQ ID NO: 2723792 - RNA, 15 nt, Human
cuguaauuugugaua

SEQ ID NO: 2723793 - RNA, 14 nt, Human
cuguaauuugugau

SEQ ID NO: 2723794 - RNA, 14 nt, Human
cuguacagagccca

SEQ ID NO: 2723795 - RNA, 15 nt, Human
cuguacagagcccac

SEQ ID NO: 2723796 - RNA, 18 nt, Human
cuguacagagcccacgcc

SEQ ID NO: 2723797 - RNA, 22 nt, Human
cuguacagagcccacgccccca

SEQ ID NO: 2723798 - RNA, 19 nt, Human
cuguaauccuagcacuuug

SEQ ID NO: 2723799 - RNA, 22 nt, Human
cugguuagagguucccuuugac

SEQ ID NO: 2723800 - RNA, 21 nt, Human
cugguuagagguucccuuuga

SEQ ID NO: 2723801 - RNA, 15 nt, Human
cugguguauguguga

SEQ ID NO: 2723802 - RNA, 16 nt, Human
cugguggcagcucacc

SEQ ID NO: 2723803 - RNA, 17 nt, Human
cugguggcagcucaccu

SEQ ID NO: 2723804 - RNA, 18 nt, Human
cugguggcagcucaccuc

SEQ ID NO: 2723805 - RNA, 15 nt, Human
cugguggcagcugcg

SEQ ID NO: 2723806 - RNA, 20 nt, Human
cugguggcagcucaccucuc

SEQ ID NO: 2723807 - RNA, 14 nt, Human
cugguggcaguggg

SEQ ID NO: 2723808 - RNA, 18 nt, Human
cugguggcagugggagcu

SEQ ID NO: 2723809 - RNA, 13 nt, Human
cugucaauuacag

SEQ ID NO: 2723810 - RNA, 15 nt, Human
cugucaauuacagga

SEQ ID NO: 2723811 - RNA, 16 nt, Human
cugucaauuacaggaa

SEQ ID NO: 2723812 - RNA, 20 nt, Human
cuguauuuuguuuuugucuu

SEQ ID NO: 2723813 - RNA, 21 nt, Human
cuguaucccaugagccucagc

SEQ ID NO: 2723814 - RNA, 22 nt, Human
cuguaucccaugagccucagca

SEQ ID NO: 2723815 - RNA, 20 nt, Human
cuguaucccaugagccucag

SEQ ID NO: 2723816 - RNA, 19 nt, Human
cuguaucccaugagccuca

SEQ ID NO: 2723817 - RNA, 19 nt, Human
cuguacgucugacaggcaa

SEQ ID NO: 2723818 - RNA, 20 nt, Human
cuguacgucugacaggcaau

SEQ ID NO: 2723819 - RNA, 17 nt, Human
cuguacaugaaaacaca

SEQ ID NO: 2723820 - RNA, 21 nt, Human
cuguacaugaaaacacauuuu

SEQ ID NO: 2723821 - RNA, 20 nt, Human
cuguacaugaaaacacauuu

SEQ ID NO: 2723822 - RNA, 14 nt, Human
cuguacgucugaca

SEQ ID NO: 2723823 - RNA, 15 nt, Human
cuguacgucugacag

SEQ ID NO: 2723824 - RNA, 16 nt, Human
cuguacgucugacagg

SEQ ID NO: 2723825 - RNA, 18 nt, Human
cuguacgucugacaggca

SEQ ID NO: 2723826 - RNA, 21 nt, Human
cugggauuacaagcgugagcc

SEQ ID NO: 2723827 - RNA, 14 nt, Human
cugggguuaucuga

SEQ ID NO: 2723828 - RNA, 18 nt, Human
cugggggcugggcagagg

SEQ ID NO: 2723829 - RNA, 14 nt, Human
cugggggcugggca

SEQ ID NO: 2723830 - RNA, 18 nt, Human
cugggcuugucuguagau

SEQ ID NO: 2723831 - RNA, 22 nt, Human
cugggcuuggggaccagagcug

SEQ ID NO: 2723832 - RNA, 15 nt, Human
cugggcuucaguggc

SEQ ID NO: 2723833 - RNA, 21 nt, Human
gaacuagaguuuagcuggaaa

SEQ ID NO: 2723834 - RNA, 22 nt, Human
gaacuagaguuuagcuggaaaa

SEQ ID NO: 2723835 - RNA, 15 nt, Human
gaacgcguugaaauu

SEQ ID NO: 2723836 - RNA, 16 nt, Human
gaacgcguugaaauug

SEQ ID NO: 2723837 - RNA, 16 nt, Human
gaaccaccacacccag

SEQ ID NO: 2723838 - RNA, 17 nt, Human
gaaccaccacacccagc

SEQ ID NO: 2723839 - RNA, 15 nt, Human
gaacagacuggaagc

SEQ ID NO: 2723840 - RNA, 16 nt, Human
gaacagacuggaagca

SEQ ID NO: 2723841 - RNA, 21 nt, Human
gaaccacaucuugcucugcug

SEQ ID NO: 2723842 - RNA, 22 nt, Human
gaacuggguacuuguggacaca

SEQ ID NO: 2723843 - RNA, 22 nt, Human
gaacuuccagauccuggaaauc

SEQ ID NO: 2723844 - RNA, 21 nt, Human
gaacuuguaaaggaauuuaaa

SEQ ID NO: 2723845 - RNA, 23 nt, Human
gaacuugguucccauuugcuccu

SEQ ID NO: 2723846 - RNA, 12 nt, Human
gaacuugguucc

SEQ ID NO: 2723847 - RNA, 13 nt, Human
gaacuuggcgcug

SEQ ID NO: 2723848 - RNA, 15 nt, Human
gaacuuggcgcugcc

SEQ ID NO: 2723849 - RNA, 16 nt, Human
gaacuuggcgcugccc

SEQ ID NO: 2723850 - RNA, 21 nt, Human
gaagaagcaccaaucaugaau

SEQ ID NO: 2723851 - RNA, 13 nt, Human
gaaauauuauguu

SEQ ID NO: 2723852 - RNA, 16 nt, Human
gaaauauuauguuaaa

SEQ ID NO: 2723853 - RNA, 14 nt, Human
gaaaugggcagagc

SEQ ID NO: 2723854 - RNA, 20 nt, Human
gaaaugggcagagcagagac

SEQ ID NO: 2723855 - RNA, 18 nt, Human
gaaauuguauuacaaauc

SEQ ID NO: 2723856 - RNA, 17 nt, Human
gaaauuuguuauaauga

SEQ ID NO: 2723857 - RNA, 20 nt, Human
gaaauaucugaaaauguaug

SEQ ID NO: 2723858 - RNA, 13 nt, Human
gaaauauaauuga

SEQ ID NO: 2723859 - RNA, 21 nt, Human
gaaauaucugaaaauguaugu

SEQ ID NO: 2723860 - RNA, 21 nt, Human
gaagccuuggggcugaugcag

SEQ ID NO: 2723861 - RNA, 21 nt, Human
gaagccgcuggggccaguugg

SEQ ID NO: 2723862 - RNA, 20 nt, Human
gaagcccaggaaaggcucca

SEQ ID NO: 2723863 - RNA, 21 nt, Human
gaagcccaggaaaggcuccag

SEQ ID NO: 2723864 - RNA, 22 nt, Human
gaagcccaggaaaggcuccagg

SEQ ID NO: 2723865 - RNA, 19 nt, Human
gaagacucauucuucugua

SEQ ID NO: 2723866 - RNA, 21 nt, Human
gaagacucauucuucuguacg

SEQ ID NO: 2723867 - RNA, 15 nt, Human
gaagccagcaggcuc

SEQ ID NO: 2723868 - RNA, 16 nt, Human
gaagccagcaggcucu

SEQ ID NO: 2723869 - RNA, 23 nt, Human
gaagccagcaggcucucaggcca

SEQ ID NO: 2723870 - RNA, 16 nt, Human
gaaggccccgcccagg

SEQ ID NO: 2723871 - RNA, 14 nt, Human
gaaggccccgccca

SEQ ID NO: 2723872 - RNA, 15 nt, Human
gaaggccccgcccag

SEQ ID NO: 2723873 - RNA, 14 nt, Human
gaaggaaaaugaua

SEQ ID NO: 2723874 - RNA, 18 nt, Human
gaaggaaacccagcucug

SEQ ID NO: 2723875 - RNA, 14 nt, Human
gaaggaaacccagc

SEQ ID NO: 2723876 - RNA, 17 nt, Human
gaaggaaacccagcucu

SEQ ID NO: 2723877 - RNA, 21 nt, Human
gaaggauacaaaagcauguga

SEQ ID NO: 2723878 - RNA, 19 nt, Human
gaaggauacaaaagcaugu

SEQ ID NO: 2723879 - RNA, 12 nt, Human
gaaggauacaaa

SEQ ID NO: 2723880 - RNA, 14 nt, Human
gaauacuuuauaaa

SEQ ID NO: 2723881 - RNA, 20 nt, Human
gaauaauccuaaacauauga

SEQ ID NO: 2723882 - RNA, 14 nt, Human
gaauaacauguaau

SEQ ID NO: 2723883 - RNA, 16 nt, Human
gaaguuuacauuguaa

SEQ ID NO: 2723884 - RNA, 17 nt, Human
gaaguuuacauuguaaa

SEQ ID NO: 2723885 - RNA, 12 nt, Human
gaaguuucugcc

SEQ ID NO: 2723886 - RNA, 19 nt, Human
gaaugaaagggcccagaga

SEQ ID NO: 2723887 - RNA, 14 nt, Human
gaaugaaagggccc

SEQ ID NO: 2723888 - RNA, 16 nt, Human
gaaucucaaauaacua

SEQ ID NO: 2723889 - RNA, 15 nt, Human
gaauagcugggacua

SEQ ID NO: 2723890 - RNA, 14 nt, Human
gaauagcugggacu

SEQ ID NO: 2723891 - RNA, 20 nt, Human
gaaaaucuuauaauuuaaaa

SEQ ID NO: 2723892 - RNA, 18 nt, Human
gaaacagcuaaugggaca

SEQ ID NO: 2723893 - RNA, 19 nt, Human
gaaaauaacgauaaaagac

SEQ ID NO: 2723894 - RNA, 13 nt, Human
gaaaagcugcuga

SEQ ID NO: 2723895 - RNA, 17 nt, Human
gaaaagcugcugacagu

SEQ ID NO: 2723896 - RNA, 19 nt, Human
gaaaaucuuauaauuuaaa

SEQ ID NO: 2723897 - RNA, 16 nt, Human
gaaaaucagccugcuc

SEQ ID NO: 2723898 - RNA, 18 nt, Human
gaaaaucagccugcucca

SEQ ID NO: 2723899 - RNA, 12 nt, Human
gaaaauaucacu

SEQ ID NO: 2723900 - RNA, 14 nt, Human
gaaaaucagccugc

SEQ ID NO: 2723901 - RNA, 17 nt, Human
gaaaauauuauguguuu

SEQ ID NO: 2723902 - RNA, 22 nt, Human
gaaaacaauaacgauaaaagac

SEQ ID NO: 2723903 - RNA, 13 nt, Human
gaaaacacauuuu

SEQ ID NO: 2723904 - RNA, 12 nt, Human
gaaaacaugcua

SEQ ID NO: 2723905 - RNA, 15 nt, Human
gaaaacaugcuacac

SEQ ID NO: 2723906 - RNA, 14 nt, Human
gaaaacaugcuaca

SEQ ID NO: 2723907 - RNA, 14 nt, Human
gaaaacguggcugc

SEQ ID NO: 2723908 - RNA, 18 nt, Human
gaaaacguggcugcuuca

SEQ ID NO: 2723909 - RNA, 15 nt, Human
gaaaacguggcugcu

SEQ ID NO: 2723910 - RNA, 16 nt, Human
gaaaacguggcugcuu

SEQ ID NO: 2723911 - RNA, 17 nt, Human
gaaaaaggaugcacaga

SEQ ID NO: 2723912 - RNA, 23 nt, Human
gaaaaaggaugcacagaguuguu

SEQ ID NO: 2723913 - RNA, 22 nt, Human
cuuuuuucucugauacagaaaa

SEQ ID NO: 2723914 - RNA, 14 nt, Human
cuuuuuuggcugcu

SEQ ID NO: 2723915 - RNA, 15 nt, Human
cuuuuuuggcugcug

SEQ ID NO: 2723916 - RNA, 15 nt, Human
cuuuuuucacuacau

SEQ ID NO: 2723917 - RNA, 20 nt, Human
cuuuuuucucugauacagaa

SEQ ID NO: 2723918 - RNA, 16 nt, Human
cuuuugagcauuuaga

SEQ ID NO: 2723919 - RNA, 21 nt, Human
cuuuugagugccuuacacaau

SEQ ID NO: 2723920 - RNA, 19 nt, Human
cuuuggacccugaggccca

SEQ ID NO: 2723921 - RNA, 17 nt, Human
cuuuggacccugaggcc

SEQ ID NO: 2723922 - RNA, 18 nt, Human
cuuuggacccugaggccc

SEQ ID NO: 2723923 - RNA, 15 nt, Human
cuuuggacccugagg

SEQ ID NO: 2723924 - RNA, 16 nt, Human
cuuuggacccugaggc

SEQ ID NO: 2723925 - RNA, 16 nt, Human
cuuucccaucuuccaa

SEQ ID NO: 2723926 - RNA, 14 nt, Human
cuuuguucuggcuc

SEQ ID NO: 2723927 - RNA, 15 nt, Human
cuuuguucuggcucu

SEQ ID NO: 2723928 - RNA, 19 nt, Human
cuuugugauuuuuguaauu

SEQ ID NO: 2723929 - RNA, 18 nt, Human
cuuugugauuuuuguaau

SEQ ID NO: 2723930 - RNA, 17 nt, Human
cuuugugauuuuuguaa

SEQ ID NO: 2723931 - RNA, 13 nt, Human
cuuugggaggcca

SEQ ID NO: 2723932 - RNA, 18 nt, Human
cuuuguccccaccgcaga

SEQ ID NO: 2723933 - RNA, 14 nt, Human
cuuugugauuuuug

SEQ ID NO: 2723934 - RNA, 22 nt, Human
cuuuguccccaccgcagacagg

SEQ ID NO: 2723935 - RNA, 18 nt, Human
cuuuguuuguugucagcu

SEQ ID NO: 2723936 - RNA, 20 nt, Human
cuuuguuuguugucagcuga

SEQ ID NO: 2723937 - RNA, 22 nt, Human
cuuuucauaaccuagccuuaga

SEQ ID NO: 2723938 - RNA, 20 nt, Human
cuuuucauaaccuagccuua

SEQ ID NO: 2723939 - RNA, 16 nt, Human
cuuuucuuucagccaa

SEQ ID NO: 2723940 - RNA, 18 nt, Human
cuuuucuugcaugaggcu

SEQ ID NO: 2723941 - RNA, 23 nt, Human
cuuuucuugcaugaggcuagugu

SEQ ID NO: 2723942 - RNA, 14 nt, Human
cuuuucugauagag

SEQ ID NO: 2723943 - RNA, 18 nt, Human
cuuuucuguccgagcuuu

SEQ ID NO: 2723944 - RNA, 23 nt, Human
cuuuucuguccgagcuuugaaaa

SEQ ID NO: 2723945 - RNA, 11 nt, Human
cuuuucugaua

SEQ ID NO: 2723946 - RNA, 18 nt, Human
cuuuaaagggauggcaag

SEQ ID NO: 2723947 - RNA, 21 nt, Human
cuuguguguuuauugucaaag

SEQ ID NO: 2723948 - RNA, 19 nt, Human
cuuguguuaaguaugugua

SEQ ID NO: 2723949 - RNA, 20 nt, Human
cuuguguguuuauugucaaa

SEQ ID NO: 2723950 - RNA, 21 nt, Human
cuuuauuuucuauaauuuaaa

SEQ ID NO: 2723951 - RNA, 13 nt, Human
cuuuccacagaag

SEQ ID NO: 2723952 - RNA, 22 nt, Human
cuuuccaaaugcccagcuuaaa

SEQ ID NO: 2723953 - RNA, 18 nt, Human
cuuuccaaaugcccagcu

SEQ ID NO: 2723954 - RNA, 19 nt, Human
cuuuccaaaugcccagcuu

SEQ ID NO: 2723955 - RNA, 19 nt, Human
cuuguaaaggaauuuaaaa

SEQ ID NO: 2723956 - RNA, 16 nt, Human
cuuggggggcugaggu

SEQ ID NO: 2723957 - RNA, 15 nt, Human
cuuggggggcugagg

SEQ ID NO: 2723958 - RNA, 22 nt, Human
cuuggggaccagagcugccacc

SEQ ID NO: 2723959 - RNA, 13 nt, Human
cuugggcuucauc

SEQ ID NO: 2723960 - RNA, 14 nt, Human
cuugggccacugug

SEQ ID NO: 2723961 - RNA, 22 nt, Human
cuugggcuucauccuccucaga

SEQ ID NO: 2723962 - RNA, 20 nt, Human
cuuggggaccagagcugcca

SEQ ID NO: 2723963 - RNA, 21 nt, Human
cuuggggaccagagcugccac

SEQ ID NO: 2723964 - RNA, 16 nt, Human
cuuggcugcagggagu

SEQ ID NO: 2723965 - RNA, 22 nt, Human
cuuggaggaaggaaacccagcu

SEQ ID NO: 2723966 - RNA, 14 nt, Human
cuuggcugcaggga

SEQ ID NO: 2723967 - RNA, 17 nt, Human
cuuggcugcagggaguc

SEQ ID NO: 2723968 - RNA, 22 nt, Human
cuugccaucccucccuccaccu

SEQ ID NO: 2723969 - RNA, 13 nt, Human
cuugcucugcuga

SEQ ID NO: 2723970 - RNA, 14 nt, Human
cuugcucugcugac

SEQ ID NO: 2723971 - RNA, 21 nt, Human
cuugccaucccucccuccacc

SEQ ID NO: 2723972 - RNA, 17 nt, Human
cuucuccacccugcucu

SEQ ID NO: 2723973 - RNA, 18 nt, Human
cuucuccacccugcucuc

SEQ ID NO: 2723974 - RNA, 21 nt, Human
cuucuccacccugcucuccga

SEQ ID NO: 2723975 - RNA, 20 nt, Human
cuugcuucaaccccaugaga

SEQ ID NO: 2723976 - RNA, 16 nt, Human
cuugcucugcugacag

SEQ ID NO: 2723977 - RNA, 17 nt, Human
cuugcucugcugacaga

SEQ ID NO: 2723978 - RNA, 13 nt, Human
cuuggaagcuccg

SEQ ID NO: 2723979 - RNA, 13 nt, Human
cuuggaggaagga

SEQ ID NO: 2723980 - RNA, 16 nt, Human
cuuggaaaugggagac

SEQ ID NO: 2723981 - RNA, 20 nt, Human
cuccccuccucugcuugcca

SEQ ID NO: 2723982 - RNA, 22 nt, Human
cuccccagcaagugagagcugg

SEQ ID NO: 2723983 - RNA, 23 nt, Human
cuccccagcaagugagagcuggg

SEQ ID NO: 2723984 - RNA, 11 nt, Human
cuccccuccuc

SEQ ID NO: 2723985 - RNA, 21 nt, Human
cuccccagcaagugagagcug

SEQ ID NO: 2723986 - RNA, 13 nt, Human
cuccccuccucug

SEQ ID NO: 2723987 - RNA, 18 nt, Human
cucccgaguagcugggac

SEQ ID NO: 2723988 - RNA, 19 nt, Human
cucccgaguagcugggacu

SEQ ID NO: 2723989 - RNA, 20 nt, Human
cucccgaguagcugggacua

SEQ ID NO: 2723990 - RNA, 20 nt, Human
cucccuuggauuguccccga

SEQ ID NO: 2723991 - RNA, 18 nt, Human
cuccucagaucuucugug

SEQ ID NO: 2723992 - RNA, 15 nt, Human
cuccuccagccgcca

SEQ ID NO: 2723993 - RNA, 13 nt, Human
cuccuccagaguc

SEQ ID NO: 2723994 - RNA, 15 nt, Human
cuccuccagagucag

SEQ ID NO: 2723995 - RNA, 22 nt, Human
cuccugccucgaacuggcugca

SEQ ID NO: 2723996 - RNA, 18 nt, Human
cuccugccucgaacuggc

SEQ ID NO: 2723997 - RNA, 20 nt, Human
cuccugccucgaacuggcug

SEQ ID NO: 2723998 - RNA, 21 nt, Human
cuccugccucgaacuggcugc

SEQ ID NO: 2723999 - RNA, 17 nt, Human
cuccugccucagccucc

SEQ ID NO: 2724000 - RNA, 16 nt, Human
cuccugccucagccuc

SEQ ID NO: 2724001 - RNA, 12 nt, Human
cuccugccucag

SEQ ID NO: 2724002 - RNA, 11 nt, Human
cuccugccuca

SEQ ID NO: 2724003 - RNA, 13 nt, Human
cuccucuccccag

SEQ ID NO: 2724004 - RNA, 15 nt, Human
cuccucuccccagca

SEQ ID NO: 2724005 - RNA, 14 nt, Human
cuccuggaaauauu

SEQ ID NO: 2724006 - RNA, 21 nt, Human
cuccugugugugcgccuacag

SEQ ID NO: 2724007 - RNA, 23 nt, Human
cuccugugugugcgccuacagga

SEQ ID NO: 2724008 - RNA, 24 nt, Human
cuccugugugugcgccuacaggag

SEQ ID NO: 2724009 - RNA, 22 nt, Human
cucgagcaugccuggauggggc

SEQ ID NO: 2724010 - RNA, 13 nt, Human
cucgagcaugccu

SEQ ID NO: 2724011 - RNA, 15 nt, Human
cucgagcaugccugg

SEQ ID NO: 2724012 - RNA, 16 nt, Human
cucgagcaugccugga

SEQ ID NO: 2724013 - RNA, 19 nt, Human
cucgagcaugccuggaugg

SEQ ID NO: 2724014 - RNA, 23 nt, Human
cuccuuggugucgggcaugacac

SEQ ID NO: 2724015 - RNA, 18 nt, Human
cuccaggagcagccacau

SEQ ID NO: 2724016 - RNA, 23 nt, Human
cuccaggagcagccacauuccug

SEQ ID NO: 2724017 - RNA, 11 nt, Human
cuccaggagca

SEQ ID NO: 2724018 - RNA, 13 nt, Human
cuccaggagcagc

SEQ ID NO: 2724019 - RNA, 14 nt, Human
cuccaggagcagcc

SEQ ID NO: 2724020 - RNA, 15 nt, Human
cuccaggagcagcca

SEQ ID NO: 2724021 - RNA, 16 nt, Human
cuccaggagcagccac

SEQ ID NO: 2724022 - RNA, 17 nt, Human
cuccaggagcagccaca

SEQ ID NO: 2724023 - RNA, 15 nt, Human
cuccagccccuggau

SEQ ID NO: 2724024 - RNA, 14 nt, Human
cuccaccugccagg

SEQ ID NO: 2724025 - RNA, 12 nt, Human
cuccaccugcca

SEQ ID NO: 2724026 - RNA, 13 nt, Human
cuccaccugccag

SEQ ID NO: 2724027 - RNA, 14 nt, Human
cuccagcucaccag

SEQ ID NO: 2724028 - RNA, 12 nt, Human
cuccagccuggg

SEQ ID NO: 2724029 - RNA, 20 nt, Human
cuccagccccuggaugcagc

SEQ ID NO: 2724030 - RNA, 16 nt, Human
cuccagccccuggaug

SEQ ID NO: 2724031 - RNA, 17 nt, Human
cuccagccccuggaugc

SEQ ID NO: 2724032 - RNA, 23 nt, Human
cuccaccucccugcaauaaaaug

SEQ ID NO: 2724033 - RNA, 15 nt, Human
cuccacccugcucuc

SEQ ID NO: 2724034 - RNA, 13 nt, Human
cuccacccugcuc

SEQ ID NO: 2724035 - RNA, 21 nt, Human
cuccaaacugacucuuaagaa

SEQ ID NO: 2724036 - RNA, 12 nt, Human
cuccaaagaaau

SEQ ID NO: 2724037 - RNA, 13 nt, Human
cuccaaagaaaug

SEQ ID NO: 2724038 - RNA, 16 nt, Human
cuccaaaauaaaacuu

SEQ ID NO: 2724039 - RNA, 15 nt, Human
cuccaaaauaaaacu

SEQ ID NO: 2724040 - RNA, 17 nt, Human
cucauuugucacacacu

SEQ ID NO: 2724041 - RNA, 21 nt, Human
cucauuuccaagcaaguauua

SEQ ID NO: 2724042 - RNA, 16 nt, Human
cucaggugagaagcag

SEQ ID NO: 2724043 - RNA, 14 nt, Human
cucaggugagaagc

SEQ ID NO: 2724044 - RNA, 19 nt, Human
cucaggugagaagcagagg

SEQ ID NO: 2724045 - RNA, 20 nt, Human
cucaggugagaagcagagga

SEQ ID NO: 2724046 - RNA, 15 nt, Human
cucagggucccuggu

SEQ ID NO: 2724047 - RNA, 16 nt, Human
cucagggucccuggug

SEQ ID NO: 2724048 - RNA, 17 nt, Human
cucagggucccuggugg

SEQ ID NO: 2724049 - RNA, 13 nt, Human
cucagggccuggc

SEQ ID NO: 2724050 - RNA, 14 nt, Human
cucagggccuggcu

SEQ ID NO: 2724051 - RNA, 15 nt, Human
cucagggccuggcuc

SEQ ID NO: 2724052 - RNA, 15 nt, Human
cucagggccuggucg

SEQ ID NO: 2724053 - RNA, 16 nt, Human
cucagggccuggcuca

SEQ ID NO: 2724054 - RNA, 18 nt, Human
cucaggaguuugagacca

SEQ ID NO: 2724055 - RNA, 23 nt, Human
cucaggaguuugagaccaaccug

SEQ ID NO: 2724056 - RNA, 18 nt, Human
cucagcauccuggcaccc

SEQ ID NO: 2724057 - RNA, 22 nt, Human
cucaucaccaacgucugugcca

SEQ ID NO: 2724058 - RNA, 23 nt, Human
cucauaguaugguggcuggguug

SEQ ID NO: 2724059 - RNA, 21 nt, Human
cucaucaccaacgucugugcc

SEQ ID NO: 2724060 - RNA, 15 nt, Human
cucauccucauaccc

SEQ ID NO: 2724061 - RNA, 14 nt, Human
cucauacucaccuc

SEQ ID NO: 2724062 - RNA, 15 nt, Human
cucauacccaccccc

SEQ ID NO: 2724063 - RNA, 22 nt, Human
cucauacucaccucaccccacu

SEQ ID NO: 2724064 - RNA, 21 nt, Human
cucauaguaugguggcugggu

SEQ ID NO: 2724065 - RNA, 20 nt, Human
cucaggugauccacccaccu

SEQ ID NO: 2724066 - RNA, 18 nt, Human
cucaggugauccacccac

SEQ ID NO: 2724067 - RNA, 19 nt, Human
cucaggugauccacccacc

SEQ ID NO: 2724068 - RNA, 16 nt, Human
cucauacccaccccca

SEQ ID NO: 2724069 - RNA, 18 nt, Human
cucauacccacccccacc

SEQ ID NO: 2724070 - RNA, 19 nt, Human
cucauacccacccccaccc

SEQ ID NO: 2724071 - RNA, 21 nt, Human
cucauacccacccccacccaa

SEQ ID NO: 2724072 - RNA, 15 nt, Human
cuauaggugcuacaa

SEQ ID NO: 2724073 - RNA, 18 nt, Human
cuauauuguuugcuaagc

SEQ ID NO: 2724074 - RNA, 20 nt, Human
cuauaggugcuacaaaaaca

SEQ ID NO: 2724075 - RNA, 17 nt, Human
cuauagccuaggugaca

SEQ ID NO: 2724076 - RNA, 22 nt, Human
cuauaggugcuacaaaaacaca

SEQ ID NO: 2724077 - RNA, 21 nt, Human
cuauaggugcuacaaaaacac

SEQ ID NO: 2724078 - RNA, 17 nt, Human
cuauauuuuacauaaau

SEQ ID NO: 2724079 - RNA, 15 nt, Human
cuauauuuucauucu

SEQ ID NO: 2724080 - RNA, 19 nt, Human
cuauauuuucauucuccua

SEQ ID NO: 2724081 - RNA, 21 nt, Human
cuauaauguaagcucuacuga

SEQ ID NO: 2724082 - RNA, 22 nt, Human
cuauaauuuaccugaagucuuu

SEQ ID NO: 2724083 - RNA, 16 nt, Human
cuauaauguaagcucu

SEQ ID NO: 2724084 - RNA, 16 nt, Human
cuauucaaacagucuc

SEQ ID NO: 2724085 - RNA, 18 nt, Human
cuauucaaacagucucag

SEQ ID NO: 2724086 - RNA, 23 nt, Human
cuauucaaacagucucaggaaau

SEQ ID NO: 2724087 - RNA, 15 nt, Human
cuauuagagaagaga

SEQ ID NO: 2724088 - RNA, 18 nt, Human
cuaugggacucaaugcac

SEQ ID NO: 2724089 - RNA, 22 nt, Human
cuaugggacucaaugcacugac

SEQ ID NO: 2724090 - RNA, 23 nt, Human
cuaugggacucaaugcacugaca

SEQ ID NO: 2724091 - RNA, 18 nt, Human
cuaugcugaguuugugcu

SEQ ID NO: 2724092 - RNA, 21 nt, Human
cuagugagcagucaggaaaga

SEQ ID NO: 2724093 - RNA, 19 nt, Human
cuagugaaagaggcagcuu

SEQ ID NO: 2724094 - RNA, 18 nt, Human
cuagugaaagaggcagcu

SEQ ID NO: 2724095 - RNA, 20 nt, Human
cuagugaaacucguuaauuu

SEQ ID NO: 2724096 - RNA, 16 nt, Human
cuaguaauuggaaagg

SEQ ID NO: 2724097 - RNA, 23 nt, Human
cgcccaguuggguggaugccugg

SEQ ID NO: 2724098 - RNA, 15 nt, Human
cgccaugcuccuggc

SEQ ID NO: 2724099 - RNA, 20 nt, Human
cgccaucccagccccaauga

SEQ ID NO: 2724100 - RNA, 17 nt, Human
cgccaucccagccccaa

SEQ ID NO: 2724101 - RNA, 22 nt, Human
cgcccaguuggguggaugccug

SEQ ID NO: 2724102 - RNA, 24 nt, Human
cuaggugacagagugagacucugu

SEQ ID NO: 2724103 - RNA, 14 nt, Human
cuaggugacagagu

SEQ ID NO: 2724104 - RNA, 18 nt, Human
cuaggugacagagugaga

SEQ ID NO: 2724105 - RNA, 13 nt, Human
cucaccagcccca

SEQ ID NO: 2724106 - RNA, 14 nt, Human
cucaccagccccag

SEQ ID NO: 2724107 - RNA, 15 nt, Human
cucaccagccccagu

SEQ ID NO: 2724108 - RNA, 17 nt, Human
cucaccagccccagugc

SEQ ID NO: 2724109 - RNA, 18 nt, Human
cucaccagccccagugcc

SEQ ID NO: 2724110 - RNA, 15 nt, Human
cucacauuuauucug

SEQ ID NO: 2724111 - RNA, 19 nt, Human
cucacauuuauucugcuca

SEQ ID NO: 2724112 - RNA, 22 nt, Human
cucacauuuauucugcucacau

SEQ ID NO: 2724113 - RNA, 17 nt, Human
cucacaguccuuaccag

SEQ ID NO: 2724114 - RNA, 19 nt, Human
cucacaguccuuaccagca

SEQ ID NO: 2724115 - RNA, 22 nt, Human
cucacaguccuuaccagcagag

SEQ ID NO: 2724116 - RNA, 21 nt, Human
cucaaguccucuuuucugaga

SEQ ID NO: 2724117 - RNA, 14 nt, Human
cucaaguccucuuu

SEQ ID NO: 2724118 - RNA, 17 nt, Human
cucaagugauucuccug

SEQ ID NO: 2724119 - RNA, 15 nt, Human
cucacaguccuuacc

SEQ ID NO: 2724120 - RNA, 22 nt, Human
cucacacaugagcaucaggcca

SEQ ID NO: 2724121 - RNA, 24 nt, Human
cucacacaugagcaucaggccagg

SEQ ID NO: 2724122 - RNA, 14 nt, Human
cuauuucuauauuu

SEQ ID NO: 2724123 - RNA, 18 nt, Human
cuauuucuauauuuucau

SEQ ID NO: 2724124 - RNA, 16 nt, Human
cuauuucuauauuuuc

SEQ ID NO: 2724125 - RNA, 23 nt, Human
cucaaauacgugggcauucaaau

SEQ ID NO: 2724126 - RNA, 21 nt, Human
cucaacaccucugcacaagcu

SEQ ID NO: 2724127 - RNA, 13 nt, Human
cucaaccuccugg

SEQ ID NO: 2724128 - RNA, 15 nt, Human
cucaaccuccugggc

SEQ ID NO: 2724129 - RNA, 17 nt, Human
cucaaccuccugggcua

SEQ ID NO: 2724130 - RNA, 13 nt, Human
cucagauuuuauu

SEQ ID NO: 2724131 - RNA, 15 nt, Human
cucagaucuucugug

SEQ ID NO: 2724132 - RNA, 18 nt, Human
cucagauuuuauuaugua

SEQ ID NO: 2724133 - RNA, 21 nt, Human
cucagcaaaagaugcuucuca

SEQ ID NO: 2724134 - RNA, 17 nt, Human
cucagauuuuauuaugu

SEQ ID NO: 2724135 - RNA, 15 nt, Human
cucagauuuuauuau

SEQ ID NO: 2724136 - RNA, 16 nt, Human
cucagcauccuggcac

SEQ ID NO: 2724137 - RNA, 17 nt, Human
cucagcauccuggcacc

SEQ ID NO: 2724138 - RNA, 20 nt, Human
cucacuguugcccaggcugg

SEQ ID NO: 2724139 - RNA, 19 nt, Human
cucacugccaugccagcuu

SEQ ID NO: 2724140 - RNA, 22 nt, Human
cucacugccaugccagcuuauc

SEQ ID NO: 2724141 - RNA, 21 nt, Human
cucacuguugcccaggcuggc

SEQ ID NO: 2724142 - RNA, 22 nt, Human
cucacuguugcccaggcuggcg

SEQ ID NO: 2724143 - RNA, 14 nt, Human
cucagagagggugg

SEQ ID NO: 2724144 - RNA, 23 nt, Human
cucacuauguugcccaggcaggu

SEQ ID NO: 2724145 - RNA, 21 nt, Human
cucacuauguugcccaggcag

SEQ ID NO: 2724146 - RNA, 22 nt, Human
cucacuauguugcccaggcagg

SEQ ID NO: 2724147 - RNA, 15 nt, Human
cucaccccagcccca

SEQ ID NO: 2724148 - RNA, 19 nt, Human
cucacuauguugcccaggc

SEQ ID NO: 2724149 - RNA, 20 nt, Human
cucacuauguugcccaggca

SEQ ID NO: 2724150 - RNA, 11 nt, Human
cucacucuguc

SEQ ID NO: 2724151 - RNA, 12 nt, Human
cucacucugucg

SEQ ID NO: 2724152 - RNA, 13 nt, Human
cucacuccuugaa

SEQ ID NO: 2724153 - RNA, 13 nt, Human
cucacugcagccu

SEQ ID NO: 2724154 - RNA, 12 nt, Human
cucacugcagcc

SEQ ID NO: 2724155 - RNA, 22 nt, Human
cucacucugucgcccagucugg

SEQ ID NO: 2724156 - RNA, 13 nt, Human
cucacucugucgc

SEQ ID NO: 2724157 - RNA, 21 nt, Human
cucacucugucgcccagucug

SEQ ID NO: 2724158 - RNA, 15 nt, Human
cugcaauaaaauggg

SEQ ID NO: 2724159 - RNA, 22 nt, Human
cugcaauaaaauggguuuuacu

SEQ ID NO: 2724160 - RNA, 18 nt, Human
cugcaauaaggggagagu

SEQ ID NO: 2724161 - RNA, 22 nt, Human
cugcacaagcugcacccucagg

SEQ ID NO: 2724162 - RNA, 18 nt, Human
cugcacaagcugcacccu

SEQ ID NO: 2724163 - RNA, 13 nt, Human
cugcacccucagg

SEQ ID NO: 2724164 - RNA, 14 nt, Human
cugcacccucaggc

SEQ ID NO: 2724165 - RNA, 20 nt, Human
cugcaccggcuggccuggcc

SEQ ID NO: 2724166 - RNA, 22 nt, Human
cugcaccggcuggccuggcccc

SEQ ID NO: 2724167 - RNA, 12 nt, Human
cugcaccgggcc

SEQ ID NO: 2724168 - RNA, 23 nt, Human
cugcaccggcuggccuggccccu

SEQ ID NO: 2724169 - RNA, 14 nt, Human
cugcacuccccugc

SEQ ID NO: 2724170 - RNA, 15 nt, Human
cugcacuccccugcu

SEQ ID NO: 2724171 - RNA, 18 nt, Human
cugcacuugcagacucua

SEQ ID NO: 2724172 - RNA, 16 nt, Human
cugcacuccccugcug

SEQ ID NO: 2724173 - RNA, 17 nt, Human
cugcacuccccugcugg

SEQ ID NO: 2724174 - RNA, 23 nt, Human
cugauuugacauagucuggcugu

SEQ ID NO: 2724175 - RNA, 22 nt, Human
cugauuugacauagucuggcug

SEQ ID NO: 2724176 - RNA, 21 nt, Human
cugauuugacauagucuggcu

SEQ ID NO: 2724177 - RNA, 21 nt, Human
cugauugugucucuugguccu

SEQ ID NO: 2724178 - RNA, 17 nt, Human
cugauugugucucuugg

SEQ ID NO: 2724179 - RNA, 17 nt, Human
cugauggugcaaugacc

SEQ ID NO: 2724180 - RNA, 19 nt, Human
cugauggugcaaugaccuu

SEQ ID NO: 2724181 - RNA, 20 nt, Human
cugauggugcaaugaccuuu

SEQ ID NO: 2724182 - RNA, 21 nt, Human
cugauggugcaaugaccuuuc

SEQ ID NO: 2724183 - RNA, 23 nt, Human
cugauuuuuuuuuccuucagugc

SEQ ID NO: 2724184 - RNA, 21 nt, Human
cugauuuuuuuuuccuucagu

SEQ ID NO: 2724185 - RNA, 22 nt, Human
cugauuuuuuuuuccuucagug

SEQ ID NO: 2724186 - RNA, 16 nt, Human
cugauuuuuuuuuccu

SEQ ID NO: 2724187 - RNA, 18 nt, Human
cugauuuuuuuuuccuuc

SEQ ID NO: 2724188 - RNA, 19 nt, Human
cugauuuuuuuuuccuuca

SEQ ID NO: 2724189 - RNA, 20 nt, Human
cugauuuuuuuuuccuucag

SEQ ID NO: 2724190 - RNA, 24 nt, Human
cugaggcccuucucuccagccccu

SEQ ID NO: 2724191 - RNA, 13 nt, Human
cugaggcugggcu

SEQ ID NO: 2724192 - RNA, 15 nt, Human
cugaggcugggcucc

SEQ ID NO: 2724193 - RNA, 16 nt, Human
cugaggcugggcuccc

SEQ ID NO: 2724194 - RNA, 17 nt, Human
cugaggcugggcucccu

SEQ ID NO: 2724195 - RNA, 22 nt, Human
cugaggcugggcucccuuccca

SEQ ID NO: 2724196 - RNA, 17 nt, Human
cugagucugaaggcugg

SEQ ID NO: 2724197 - RNA, 18 nt, Human
cugagucugaaggcuggg

SEQ ID NO: 2724198 - RNA, 19 nt, Human
cugagucugaaggcugggu

SEQ ID NO: 2724199 - RNA, 18 nt, Human
cugaguuugugcuggugu

SEQ ID NO: 2724200 - RNA, 13 nt, Human
cugaguuugugcu

SEQ ID NO: 2724201 - RNA, 20 nt, Human
cugauccuaguuccaccauc

SEQ ID NO: 2724202 - RNA, 21 nt, Human
cugauccuaguuccaccauca

SEQ ID NO: 2724203 - RNA, 14 nt, Human
cugauggugcaaug

SEQ ID NO: 2724204 - RNA, 15 nt, Human
cugauggugcaauga

SEQ ID NO: 2724205 - RNA, 16 nt, Human
cugauggugcaaugac

SEQ ID NO: 2724206 - RNA, 22 nt, Human
cugauacagaaaaguugaauuu

SEQ ID NO: 2724207 - RNA, 20 nt, Human
cugcaucagcugcugaaaca

SEQ ID NO: 2724208 - RNA, 17 nt, Human
cugcaguugccagucac

SEQ ID NO: 2724209 - RNA, 21 nt, Human
cugcaguugccagucaccccg

SEQ ID NO: 2724210 - RNA, 22 nt, Human
cugcaguugccagucaccccgg

SEQ ID NO: 2724211 - RNA, 23 nt, Human
cugcacuugcagacucuacagag

SEQ ID NO: 2724212 - RNA, 19 nt, Human
cugcaguugccagucaccc

SEQ ID NO: 2724213 - RNA, 22 nt, Human
cugcaucguuucaucuuccaac

SEQ ID NO: 2724214 - RNA, 16 nt, Human
cugcaucguuucaucu

SEQ ID NO: 2724215 - RNA, 18 nt, Human
cugcaugcgggcuuccuc

SEQ ID NO: 2724216 - RNA, 22 nt, Human
cugcaugcgggcuuccuccugg

SEQ ID NO: 2724217 - RNA, 18 nt, Human
cugccaaugggagcucau

SEQ ID NO: 2724218 - RNA, 19 nt, Human
cugccaaugggagcucaug

SEQ ID NO: 2724219 - RNA, 11 nt, Human
cugccaggcau

SEQ ID NO: 2724220 - RNA, 13 nt, Human
cugccaggcaugg

SEQ ID NO: 2724221 - RNA, 14 nt, Human
cugccaugccagcu

SEQ ID NO: 2724222 - RNA, 13 nt, Human
cugcccaccuggc

SEQ ID NO: 2724223 - RNA, 14 nt, Human
cugcccaccuggcc

SEQ ID NO: 2724224 - RNA, 15 nt, Human
cugcccaccuggccu

SEQ ID NO: 2724225 - RNA, 18 nt, Human
cugcccacucccugcaac

SEQ ID NO: 2724226 - RNA, 17 nt, Human
cugcccaccuggccucu

SEQ ID NO: 2724227 - RNA, 18 nt, Human
cugcccaccuggccucug

SEQ ID NO: 2724228 - RNA, 19 nt, Human
cugcccaccuggccucugc

SEQ ID NO: 2724229 - RNA, 20 nt, Human
cugcccaccuggccucugca

SEQ ID NO: 2724230 - RNA, 22 nt, Human
cugcccaccuggccucugcacu

SEQ ID NO: 2724231 - RNA, 14 nt, Human
cugcccacucccug

SEQ ID NO: 2724232 - RNA, 15 nt, Human
cugcccacucccugc

SEQ ID NO: 2724233 - RNA, 16 nt, Human
cugcccacucccugca

SEQ ID NO: 2724234 - RNA, 12 nt, Human
cugccgcagccc

SEQ ID NO: 2724235 - RNA, 13 nt, Human
cugccgcagcccu

SEQ ID NO: 2724236 - RNA, 23 nt, Human
cugccgcagcccugcagagggca

SEQ ID NO: 2724237 - RNA, 19 nt, Human
cugccgcagcccugcagag

SEQ ID NO: 2724238 - RNA, 20 nt, Human
cugccgcagcccugcagagg

SEQ ID NO: 2724239 - RNA, 21 nt, Human
cugccgcagcccugcagaggg

SEQ ID NO: 2724240 - RNA, 22 nt, Human
cugccgcagcccugcagagggc

SEQ ID NO: 2724241 - RNA, 15 nt, Human
cugccucagccuccc

SEQ ID NO: 2724242 - RNA, 19 nt, Human
cugccucagccucccaaag

SEQ ID NO: 2724243 - RNA, 19 nt, Human
cugcgguccacccaggagc

SEQ ID NO: 2724244 - RNA, 20 nt, Human
cugcgguccacccaggagcc

SEQ ID NO: 2724245 - RNA, 17 nt, Human
cugcgguccacccagga

SEQ ID NO: 2724246 - RNA, 18 nt, Human
cugcgguccacccaggag

SEQ ID NO: 2724247 - RNA, 21 nt, Human
cugccugcccaggccccugcc

SEQ ID NO: 2724248 - RNA, 22 nt, Human
cugccugcccaggccccugcca

SEQ ID NO: 2724249 - RNA, 17 nt, Human
cugccucugacacacag

SEQ ID NO: 2724250 - RNA, 18 nt, Human
cugccucugacacacagc

SEQ ID NO: 2724251 - RNA, 21 nt, Human
cugccucugacacacagcucu

SEQ ID NO: 2724252 - RNA, 14 nt, Human
cugaagaagauggu

SEQ ID NO: 2724253 - RNA, 17 nt, Human
cugaagucacacaguga

SEQ ID NO: 2724254 - RNA, 18 nt, Human
cugaagucacacagugag

SEQ ID NO: 2724255 - RNA, 19 nt, Human
cugaagucacacagugagu

SEQ ID NO: 2724256 - RNA, 16 nt, Human
cugaagucacacagug

SEQ ID NO: 2724257 - RNA, 21 nt, Human
cugaagucacacagugagucg

SEQ ID NO: 2724258 - RNA, 22 nt, Human
cugaagucccagauacuugggg

SEQ ID NO: 2724259 - RNA, 17 nt, Human
cugaagucuuuguacag

SEQ ID NO: 2724260 - RNA, 20 nt, Human
cugaagucuuuguacagaca

SEQ ID NO: 2724261 - RNA, 20 nt, Human
cugaaugguuuucaaaauaa

SEQ ID NO: 2724262 - RNA, 19 nt, Human
cugaaugguuuucaaaaua

SEQ ID NO: 2724263 - RNA, 13 nt, Human
cugaauuaugaaa

SEQ ID NO: 2724264 - RNA, 15 nt, Human
cugaauuaugaaacu

SEQ ID NO: 2724265 - RNA, 14 nt, Human
cugaauuaugaaac

SEQ ID NO: 2724266 - RNA, 12 nt, Human
cugaauuucuuu

SEQ ID NO: 2724267 - RNA, 16 nt, Human
cucuucuccaggcugu

SEQ ID NO: 2724268 - RNA, 22 nt, Human
cucuuuggucuacacugugcug

SEQ ID NO: 2724269 - RNA, 23 nt, Human
cucuuuggucuacacugugcuga

SEQ ID NO: 2724270 - RNA, 14 nt, Human
cucuuuucaaaaca

SEQ ID NO: 2724271 - RNA, 23 nt, Human
cugaaagggacgcuacccgggaa

SEQ ID NO: 2724272 - RNA, 23 nt, Human
cucuuugucuacaccauuaugug

SEQ ID NO: 2724273 - RNA, 20 nt, Human
cugaaauaaacgucuuaaau

SEQ ID NO: 2724274 - RNA, 16 nt, Human
cugacagacacaggcc

SEQ ID NO: 2724275 - RNA, 14 nt, Human
cugaauuucuuuug

SEQ ID NO: 2724276 - RNA, 16 nt, Human
cugaauuaugaaacuu

SEQ ID NO: 2724277 - RNA, 17 nt, Human
cugacagacacaggccc

SEQ ID NO: 2724278 - RNA, 18 nt, Human
cugacagacacaggcccg

SEQ ID NO: 2724279 - RNA, 18 nt, Human
cugagaaagacuauucaa

SEQ ID NO: 2724280 - RNA, 15 nt, Human
cugagaaagacuauu

SEQ ID NO: 2724281 - RNA, 13 nt, Human
cugagaaagacua

SEQ ID NO: 2724282 - RNA, 12 nt, Human
cugagaaagacu

SEQ ID NO: 2724283 - RNA, 21 nt, Human
cugagaugugaacacaucagc

SEQ ID NO: 2724284 - RNA, 20 nt, Human
cugagaaagacuauucaaac

SEQ ID NO: 2724285 - RNA, 19 nt, Human
cugagaaagacuauucaaa

SEQ ID NO: 2724286 - RNA, 20 nt, Human
cugagacagcccgggcucug

SEQ ID NO: 2724287 - RNA, 19 nt, Human
cugagacagcccgggcucu

SEQ ID NO: 2724288 - RNA, 20 nt, Human
cugagaugugaacacaucag

SEQ ID NO: 2724289 - RNA, 16 nt, Human
cugagaugugaacaca

SEQ ID NO: 2724290 - RNA, 21 nt, Human
cugagacagcccgggcucugc

SEQ ID NO: 2724291 - RNA, 22 nt, Human
cugagacagcccgggcucugcc

SEQ ID NO: 2724292 - RNA, 16 nt, Human
cugagcaggauuuuaa

SEQ ID NO: 2724293 - RNA, 13 nt, Human
cugagccagauuu

SEQ ID NO: 2724294 - RNA, 14 nt, Human
cugagccagauuuc

SEQ ID NO: 2724295 - RNA, 20 nt, Human
cucuggcagcucagagaggg

SEQ ID NO: 2724296 - RNA, 23 nt, Human
cucuggcagcucagagagggugg

SEQ ID NO: 2724297 - RNA, 16 nt, Human
cucugccucugacaca

SEQ ID NO: 2724298 - RNA, 21 nt, Human
cucugccucccaucacccgcu

SEQ ID NO: 2724299 - RNA, 19 nt, Human
cucugccucugacacacag

SEQ ID NO: 2724300 - RNA, 20 nt, Human
cucugccucugacacacagc

SEQ ID NO: 2724301 - RNA, 10 nt, Human
cucugccuga

SEQ ID NO: 2724302 - RNA, 14 nt, Human
cucuguccugggag

SEQ ID NO: 2724303 - RNA, 13 nt, Human
cucuguccuggga

SEQ ID NO: 2724304 - RNA, 15 nt, Human
cucuguccugggagu

SEQ ID NO: 2724305 - RNA, 22 nt, Human
cucuguccugggagugagcugg

SEQ ID NO: 2724306 - RNA, 18 nt, Human
cucugucgcccagucugg

SEQ ID NO: 2724307 - RNA, 19 nt, Human
cucugucgcccagucugga

SEQ ID NO: 2724308 - RNA, 17 nt, Human
cucugucgcccagucug

SEQ ID NO: 2724309 - RNA, 13 nt, Human
cucugucgcccag

SEQ ID NO: 2724310 - RNA, 19 nt, Human
cucuuaagaagacugcauu

SEQ ID NO: 2724311 - RNA, 19 nt, Human
cucugugucagguggggca

SEQ ID NO: 2724312 - RNA, 20 nt, Human
cucugugucagguggggcag

SEQ ID NO: 2724313 - RNA, 21 nt, Human
cucugugucagguggggcagc

SEQ ID NO: 2724314 - RNA, 22 nt, Human
cucugugucagguggggcagcu

SEQ ID NO: 2724315 - RNA, 23 nt, Human
cucugugucagguggggcagcuu

SEQ ID NO: 2724316 - RNA, 15 nt, Human
cucuucuccaggcug

SEQ ID NO: 2724317 - RNA, 13 nt, Human
cucuucuccaggc

SEQ ID NO: 2724318 - RNA, 10 nt, Human
cucugcacaa

SEQ ID NO: 2724319 - RNA, 13 nt, Human
cucugcacaagcu

SEQ ID NO: 2724320 - RNA, 15 nt, Human
cucugauacagaaaa

SEQ ID NO: 2724321 - RNA, 14 nt, Human
cucugcacaagcug

SEQ ID NO: 2724322 - RNA, 15 nt, Human
cucugcacaagcugc

SEQ ID NO: 2724323 - RNA, 12 nt, Human
cucugcccuugg

SEQ ID NO: 2724324 - RNA, 13 nt, Human
cucugccucccau

SEQ ID NO: 2724325 - RNA, 14 nt, Human
cucugccucccauc

SEQ ID NO: 2724326 - RNA, 16 nt, Human
cucugccucccaucac

SEQ ID NO: 2724327 - RNA, 17 nt, Human
cucugccucccaucacc

SEQ ID NO: 2724328 - RNA, 18 nt, Human
cucugcccacucccugca

SEQ ID NO: 2724329 - RNA, 20 nt, Human
cucugcccacucccugcaac

SEQ ID NO: 2724330 - RNA, 13 nt, Human
cucugcccacucc

SEQ ID NO: 2724331 - RNA, 15 nt, Human
cucugcccacucccu

SEQ ID NO: 2724332 - RNA, 16 nt, Human
cucugcccacucccug

SEQ ID NO: 2724333 - RNA, 17 nt, Human
cucugcccacucccugc

SEQ ID NO: 2724334 - RNA, 21 nt, Human
cucugagacucgcgacaaugc

SEQ ID NO: 2724335 - RNA, 20 nt, Human
cucugagacucgcgacaaug

SEQ ID NO: 2724336 - RNA, 23 nt, Human
cucugagacucgcgacaaugcaa

SEQ ID NO: 2724337 - RNA, 16 nt, Human
cucugaggacacuaac

SEQ ID NO: 2724338 - RNA, 12 nt, Human
cucugaggacac

SEQ ID NO: 2724339 - RNA, 14 nt, Human
cucugaggacacua

SEQ ID NO: 2724340 - RNA, 19 nt, Human
cucugaaggguaauuauau

SEQ ID NO: 2724341 - RNA, 22 nt, Human
cucugaaggacauugcggacag

SEQ ID NO: 2724342 - RNA, 14 nt, Human
cucugacacacagc

SEQ ID NO: 2724343 - RNA, 15 nt, Human
cucugacacacagcu

SEQ ID NO: 2724344 - RNA, 16 nt, Human
cucugacacacagcuc

SEQ ID NO: 2724345 - RNA, 17 nt, Human
cucugacacacagcucu

SEQ ID NO: 2724346 - RNA, 18 nt, Human
cucugacacacagcucug

SEQ ID NO: 2724347 - RNA, 23 nt, Human
cucugacagaagaaccccagggu

SEQ ID NO: 2724348 - RNA, 19 nt, Human
cucugacacacagcucugu

SEQ ID NO: 2724349 - RNA, 14 nt, Human
gagcugcccucucc

SEQ ID NO: 2724350 - RNA, 15 nt, Human
gagcugccaccugcc

SEQ ID NO: 2724351 - RNA, 16 nt, Human
gagcugccaccugccu

SEQ ID NO: 2724352 - RNA, 13 nt, Human
gagcugccaccug

SEQ ID NO: 2724353 - RNA, 15 nt, Human
gagcugcccucuccu

SEQ ID NO: 2724354 - RNA, 16 nt, Human
gagcugcccucuccug

SEQ ID NO: 2724355 - RNA, 14 nt, Human
gagcuacaaaugca

SEQ ID NO: 2724356 - RNA, 23 nt, Human
gagcuacacaggggaaaagagga

SEQ ID NO: 2724357 - RNA, 13 nt, Human
gagcuacaaaugc

SEQ ID NO: 2724358 - RNA, 12 nt, Human
gagcuacaaaug

SEQ ID NO: 2724359 - RNA, 15 nt, Human
gagccuggcaagaau

SEQ ID NO: 2724360 - RNA, 10 nt, Human
gagccuggca

SEQ ID NO: 2724361 - RNA, 13 nt, Human
gagccugggaggu

SEQ ID NO: 2724362 - RNA, 21 nt, Human
gagccugggaggucaaggcug

SEQ ID NO: 2724363 - RNA, 23 nt, Human
gagccugcacggugaauggcuuu

SEQ ID NO: 2724364 - RNA, 20 nt, Human
gagccuccugcccuuaccug

SEQ ID NO: 2724365 - RNA, 22 nt, Human
gagccuccugcccuuaccugcc

SEQ ID NO: 2724366 - RNA, 22 nt, Human
gagccugcacggugaauggcuu

SEQ ID NO: 2724367 - RNA, 17 nt, Human
gagccugcacggugaau

SEQ ID NO: 2724368 - RNA, 20 nt, Human
gagccucagcauccuggcac

SEQ ID NO: 2724369 - RNA, 21 nt, Human
gagccucagcauccuggcacc

SEQ ID NO: 2724370 - RNA, 14 nt, Human
gagccuccugcccu

SEQ ID NO: 2724371 - RNA, 15 nt, Human
gagcccugguggcag

SEQ ID NO: 2724372 - RNA, 16 nt, Human
gagcccugguggcagu

SEQ ID NO: 2724373 - RNA, 19 nt, Human
gagccucagcauccuggca

SEQ ID NO: 2724374 - RNA, 17 nt, Human
gagcccugguggcagug

SEQ ID NO: 2724375 - RNA, 21 nt, Human
gagcaggcuacugucagcucc

SEQ ID NO: 2724376 - RNA, 18 nt, Human
gagcagccacauuccuga

SEQ ID NO: 2724377 - RNA, 22 nt, Human
gagccacugcaccgggccacag

SEQ ID NO: 2724378 - RNA, 11 nt, Human
gagcccacgcc

SEQ ID NO: 2724379 - RNA, 13 nt, Human
gagcccaggccuc

SEQ ID NO: 2724380 - RNA, 14 nt, Human
gagcccaggccucc

SEQ ID NO: 2724381 - RNA, 12 nt, Human
gagcccacgccc

SEQ ID NO: 2724382 - RNA, 15 nt, Human
gagcccacgccccca

SEQ ID NO: 2724383 - RNA, 16 nt, Human
gagcccacgcccccac

SEQ ID NO: 2724384 - RNA, 12 nt, Human
gagcccaggccu

SEQ ID NO: 2724385 - RNA, 14 nt, Human
gagaucagccuggg

SEQ ID NO: 2724386 - RNA, 16 nt, Human
gagaucagccugggca

SEQ ID NO: 2724387 - RNA, 13 nt, Human
gagaucagccugg

SEQ ID NO: 2724388 - RNA, 20 nt, Human
gagaucaaccccuucgcucc

SEQ ID NO: 2724389 - RNA, 19 nt, Human
gagcaccuuagacaguccc

SEQ ID NO: 2724390 - RNA, 17 nt, Human
gagcaccuuagacaguc

SEQ ID NO: 2724391 - RNA, 19 nt, Human
gagcaaaaucgaugcagug

SEQ ID NO: 2724392 - RNA, 13 nt, Human
gagcaaagcugau

SEQ ID NO: 2724393 - RNA, 21 nt, Human
gagcaagacgcugugcugccc

SEQ ID NO: 2724394 - RNA, 18 nt, Human
gagcaagacgcugugcug

SEQ ID NO: 2724395 - RNA, 22 nt, Human
gagcaagacgcugugcugcccu

SEQ ID NO: 2724396 - RNA, 23 nt, Human
gagcaagacgcugugcugcccug

SEQ ID NO: 2724397 - RNA, 13 nt, Human
gaggcagccccau

SEQ ID NO: 2724398 - RNA, 12 nt, Human
gaggccagccuu

SEQ ID NO: 2724399 - RNA, 13 nt, Human
gaggccagccuug

SEQ ID NO: 2724400 - RNA, 23 nt, Human
gaggcagccccauucugccugcc

SEQ ID NO: 2724401 - RNA, 22 nt, Human
gaggcagccccauucugccugc

SEQ ID NO: 2724402 - RNA, 16 nt, Human
gaggauugcuugagcu

SEQ ID NO: 2724403 - RNA, 17 nt, Human
gaggauguucugggaca

SEQ ID NO: 2724404 - RNA, 20 nt, Human
gaggauguucugggacacag

SEQ ID NO: 2724405 - RNA, 12 nt, Human
gaggauguucug

SEQ ID NO: 2724406 - RNA, 23 nt, Human
gaggaguuugggguaugggagag

SEQ ID NO: 2724407 - RNA, 13 nt, Human
gaggacagggagg

SEQ ID NO: 2724408 - RNA, 22 nt, Human
gaggacagggaggugaccccag

SEQ ID NO: 2724409 - RNA, 23 nt, Human
gaggacagggaggugaccccagg

SEQ ID NO: 2724410 - RNA, 14 nt, Human
gaggaauccagacc

SEQ ID NO: 2724411 - RNA, 22 nt, Human
gaggaaggaaacccagcucugg

SEQ ID NO: 2724412 - RNA, 15 nt, Human
gaggaauccagaccc

SEQ ID NO: 2724413 - RNA, 14 nt, Human
gaggaauucuguau

SEQ ID NO: 2724414 - RNA, 17 nt, Human
gaggaauucuguauaga

SEQ ID NO: 2724415 - RNA, 16 nt, Human
gaggaauucuguauag

SEQ ID NO: 2724416 - RNA, 12 nt, Human
gaggggccucuu

SEQ ID NO: 2724417 - RNA, 22 nt, Human
gaggggccucuuaugggcuggg

SEQ ID NO: 2724418 - RNA, 23 nt, Human
gagggcacagaaaauggaagaca

SEQ ID NO: 2724419 - RNA, 14 nt, Human
gagggcacagaaaa

SEQ ID NO: 2724420 - RNA, 22 nt, Human
gagggcacagaaaauggaagac

SEQ ID NO: 2724421 - RNA, 13 nt, Human
gagggagugacag

SEQ ID NO: 2724422 - RNA, 14 nt, Human
gagggagguaagga

SEQ ID NO: 2724423 - RNA, 14 nt, Human
gagggagugacaga

SEQ ID NO: 2724424 - RNA, 14 nt, Human
gagggagggagggc

SEQ ID NO: 2724425 - RNA, 15 nt, Human
gagggagggagggcu

SEQ ID NO: 2724426 - RNA, 15 nt, Human
gagggagggcuccag

SEQ ID NO: 2724427 - RNA, 15 nt, Human
gaggcugggcucccu

SEQ ID NO: 2724428 - RNA, 13 nt, Human
gaggcugggcucc

SEQ ID NO: 2724429 - RNA, 14 nt, Human
gaggcugggcuccc

SEQ ID NO: 2724430 - RNA, 14 nt, Human
gaggccuucucuga

SEQ ID NO: 2724431 - RNA, 22 nt, Human
gaggcccuucucuccagccccu

SEQ ID NO: 2724432 - RNA, 24 nt, Human
gaggcccuucucuccagccccugg

SEQ ID NO: 2724433 - RNA, 14 nt, Human
gaggcccuucucuc

SEQ ID NO: 2724434 - RNA, 23 nt, Human
gaggcccuucucuccagccccug

SEQ ID NO: 2724435 - RNA, 14 nt, Human
gaucuuuaaaauac

SEQ ID NO: 2724436 - RNA, 23 nt, Human
gaucuucaucugacuaugacaua

SEQ ID NO: 2724437 - RNA, 16 nt, Human
gaucuuugcagacagg

SEQ ID NO: 2724438 - RNA, 15 nt, Human
gaugaaaaaauaaca

SEQ ID NO: 2724439 - RNA, 18 nt, Human
gauccucccaccucagcc

SEQ ID NO: 2724440 - RNA, 16 nt, Human
gaucuucaucugacua

SEQ ID NO: 2724441 - RNA, 23 nt, Human
gaucaaccccuucgcuccugugu

SEQ ID NO: 2724442 - RNA, 13 nt, Human
gaucacgccacug

SEQ ID NO: 2724443 - RNA, 14 nt, Human
gaucacgccacugc

SEQ ID NO: 2724444 - RNA, 15 nt, Human
gaucacgccacugca

SEQ ID NO: 2724445 - RNA, 18 nt, Human
gauccuaguuccaccauc

SEQ ID NO: 2724446 - RNA, 11 nt, Human
gauccuccagg

SEQ ID NO: 2724447 - RNA, 19 nt, Human
gauccucccaccucagccu

SEQ ID NO: 2724448 - RNA, 12 nt, Human
gauccuccaggu

SEQ ID NO: 2724449 - RNA, 20 nt, Human
gauccucccaccucagccuc

SEQ ID NO: 2724450 - RNA, 21 nt, Human
gauccucccaccucagccucc

SEQ ID NO: 2724451 - RNA, 13 nt, Human
gauccugagccag

SEQ ID NO: 2724452 - RNA, 14 nt, Human
gauccugagccaga

SEQ ID NO: 2724453 - RNA, 15 nt, Human
gauccugagccagau

SEQ ID NO: 2724454 - RNA, 19 nt, Human
gauccugagccagauuuca

SEQ ID NO: 2724455 - RNA, 16 nt, Human
gaugggaaagcauugu

SEQ ID NO: 2724456 - RNA, 22 nt, Human
gaugggcaacccccagccugcu

SEQ ID NO: 2724457 - RNA, 18 nt, Human
gaugcaguucugaagaag

SEQ ID NO: 2724458 - RNA, 22 nt, Human
gaugagaaagguugaagcacca

SEQ ID NO: 2724459 - RNA, 11 nt, Human
gaugagaaagg

SEQ ID NO: 2724460 - RNA, 21 nt, Human
gauguucuuucacccuuuucu

SEQ ID NO: 2724461 - RNA, 14 nt, Human
gauguuuuccauga

SEQ ID NO: 2724462 - RNA, 21 nt, Human
gauguuuuaaggaugcuugua

SEQ ID NO: 2724463 - RNA, 19 nt, Human
gauuaaauucuugcaaagu

SEQ ID NO: 2724464 - RNA, 12 nt, Human
gauuaaauucuu

SEQ ID NO: 2724465 - RNA, 15 nt, Human
gauguuuuccaugag

SEQ ID NO: 2724466 - RNA, 23 nt, Human
gauguuuuccaugaguccccugu

SEQ ID NO: 2724467 - RNA, 19 nt, Human
gauucaacagguuuuccug

SEQ ID NO: 2724468 - RNA, 18 nt, Human
gauuaaccacuucagcug

SEQ ID NO: 2724469 - RNA, 19 nt, Human
gauuaaccacuucagcuga

SEQ ID NO: 2724470 - RNA, 21 nt, Human
gauuaaccacuucagcugacu

SEQ ID NO: 2724471 - RNA, 14 nt, Human
gauguucugggaca

SEQ ID NO: 2724472 - RNA, 16 nt, Human
gauguucugggacaca

SEQ ID NO: 2724473 - RNA, 20 nt, Human
gauggugcaaugaccuuuca

SEQ ID NO: 2724474 - RNA, 23 nt, Human
gauggugcaaugaccuuucaaua

SEQ ID NO: 2724475 - RNA, 20 nt, Human
gauuguccccgacccuugcc

SEQ ID NO: 2724476 - RNA, 15 nt, Human
gauuguccccgaccc

SEQ ID NO: 2724477 - RNA, 18 nt, Human
gauugcuugagcucagga

SEQ ID NO: 2724478 - RNA, 23 nt, Human
gauugacgggacuguugguauug

SEQ ID NO: 2724479 - RNA, 22 nt, Human
gauucccaagcucugcuccucu

SEQ ID NO: 2724480 - RNA, 12 nt, Human
gauucagacagc

SEQ ID NO: 2724481 - RNA, 21 nt, Human
gaguugaaaaucuuauaauuu

SEQ ID NO: 2724482 - RNA, 14 nt, Human
gaguugaagacaga

SEQ ID NO: 2724483 - RNA, 13 nt, Human
gaguucugguucc

SEQ ID NO: 2724484 - RNA, 17 nt, Human
gagugugccugaagucc

SEQ ID NO: 2724485 - RNA, 23 nt, Human
gaguucaucuugaauuguaagga

SEQ ID NO: 2724486 - RNA, 19 nt, Human
gagugucuuaauuaaaaga

SEQ ID NO: 2724487 - RNA, 23 nt, Human
gagugggggaucacagccucuga

SEQ ID NO: 2724488 - RNA, 12 nt, Human
gagugggcccaa

SEQ ID NO: 2724489 - RNA, 13 nt, Human
gauagcagggcau

SEQ ID NO: 2724490 - RNA, 19 nt, Human
gauagcacagacccugccc

SEQ ID NO: 2724491 - RNA, 12 nt, Human
gauagccaaggc

SEQ ID NO: 2724492 - RNA, 13 nt, Human
gauagccaaggcc

SEQ ID NO: 2724493 - RNA, 23 nt, Human
gauauaugcucugcauguuacau

SEQ ID NO: 2724494 - RNA, 21 nt, Human
gaucaaccccuucgcuccugu

SEQ ID NO: 2724495 - RNA, 22 nt, Human
gaucaaccccuucgcuccugug

SEQ ID NO: 2724496 - RNA, 14 nt, Human
gauagaggaagccu

SEQ ID NO: 2724497 - RNA, 18 nt, Human
gauacaaugcugugcccu

SEQ ID NO: 2724498 - RNA, 13 nt, Human
gauacaaugcugu

SEQ ID NO: 2724499 - RNA, 22 nt, Human
gauagaggaagccugauuaaag

SEQ ID NO: 2724500 - RNA, 21 nt, Human
gauagaggaagccugauuaaa

SEQ ID NO: 2724501 - RNA, 15 nt, Human
gauagaggaagccug

SEQ ID NO: 2724502 - RNA, 17 nt, Human
gauagcacagacccugc

SEQ ID NO: 2724503 - RNA, 18 nt, Human
gauagcacagacccugcc

SEQ ID NO: 2724504 - RNA, 21 nt, Human
gauaaucagugugucuaaauu

SEQ ID NO: 2724505 - RNA, 17 nt, Human
gauacaaaagcauguga

SEQ ID NO: 2724506 - RNA, 14 nt, Human
gaguauuuuugaca

SEQ ID NO: 2724507 - RNA, 16 nt, Human
gaguauuuuugacaga

SEQ ID NO: 2724508 - RNA, 17 nt, Human
gaguauuuuugacagaa

SEQ ID NO: 2724509 - RNA, 12 nt, Human
gaguagcuggga

SEQ ID NO: 2724510 - RNA, 14 nt, Human
gaguagcugggacu

SEQ ID NO: 2724511 - RNA, 18 nt, Human
gaguauuuuugacagaau

SEQ ID NO: 2724512 - RNA, 14 nt, Human
gaguccccuguuug

SEQ ID NO: 2724513 - RNA, 23 nt, Human
gaguccccuguuuguuucugaaa

SEQ ID NO: 2724514 - RNA, 12 nt, Human
gaguccccuguu

SEQ ID NO: 2724515 - RNA, 17 nt, Human
gagucgaggacagggag

SEQ ID NO: 2724516 - RNA, 19 nt, Human
gagucucacuguugcccag

SEQ ID NO: 2724517 - RNA, 20 nt, Human
gagucucacuguugcccagg

SEQ ID NO: 2724518 - RNA, 21 nt, Human
gagucucacuguugcccaggc

SEQ ID NO: 2724519 - RNA, 21 nt, Human
gagucugaaggcuggguucug

SEQ ID NO: 2724520 - RNA, 22 nt, Human
gagucucacuguugcccaggcu

SEQ ID NO: 2724521 - RNA, 23 nt, Human
gagucucacuguugcccaggcug

SEQ ID NO: 2724522 - RNA, 22 nt, Human
gaggggggaggugggauccucc

SEQ ID NO: 2724523 - RNA, 15 nt, Human
gaggggguggccucc

SEQ ID NO: 2724524 - RNA, 15 nt, Human
gaggggggagguggg

SEQ ID NO: 2724525 - RNA, 21 nt, Human
gaggugggauccuccaggugc

SEQ ID NO: 2724526 - RNA, 22 nt, Human
gaggugggauccuccaggugca

SEQ ID NO: 2724527 - RNA, 18 nt, Human
gaggugggauccuccagg

SEQ ID NO: 2724528 - RNA, 18 nt, Human
gaguacuacaguccuccc

SEQ ID NO: 2724529 - RNA, 19 nt, Human
gaguacuacaguccuccca

SEQ ID NO: 2724530 - RNA, 20 nt, Human
gaguacguugugcauuuggu

SEQ ID NO: 2724531 - RNA, 15 nt, Human
gaguacuacaguccu

SEQ ID NO: 2724532 - RNA, 18 nt, Human
gaguacguugugcauuug

SEQ ID NO: 2724533 - RNA, 17 nt, Human
gaguacguugugcauuu

SEQ ID NO: 2724534 - RNA, 19 nt, Human
gagguuuuaaaaaaauccc

SEQ ID NO: 2724535 - RNA, 16 nt, Human
gaguacguugugcauu

SEQ ID NO: 2724536 - RNA, 14 nt, Human
gagguucccuuuga

SEQ ID NO: 2724537 - RNA, 19 nt, Human
gagguucaaagauauuuug

SEQ ID NO: 2724538 - RNA, 16 nt, Human
gccauuuguguuuaua

SEQ ID NO: 2724539 - RNA, 19 nt, Human
gccaugccagcuuaucuca

SEQ ID NO: 2724540 - RNA, 13 nt, Human
gccaugccagcuu

SEQ ID NO: 2724541 - RNA, 18 nt, Human
gccaugccagcuuaucuc

SEQ ID NO: 2724542 - RNA, 18 nt, Human
gccaugaggaacaaggca

SEQ ID NO: 2724543 - RNA, 16 nt, Human
gccagauuucacucuc

SEQ ID NO: 2724544 - RNA, 18 nt, Human
gccagauuucacucuccu

SEQ ID NO: 2724545 - RNA, 21 nt, Human
gccagauuucacucuccuugg

SEQ ID NO: 2724546 - RNA, 23 nt, Human
gccagggacagaggggguggccu

SEQ ID NO: 2724547 - RNA, 13 nt, Human
gccagggacagag

SEQ ID NO: 2724548 - RNA, 16 nt, Human
gccagggacagagggg

SEQ ID NO: 2724549 - RNA, 18 nt, Human
gccagggacagagggggu

SEQ ID NO: 2724550 - RNA, 17 nt, Human
gccagguuuuuggucug

SEQ ID NO: 2724551 - RNA, 20 nt, Human
gccagucaccccggccaccu

SEQ ID NO: 2724552 - RNA, 17 nt, Human
gccagucaccccggcca

SEQ ID NO: 2724553 - RNA, 18 nt, Human
gccagucaccccggccac

SEQ ID NO: 2724554 - RNA, 20 nt, Human
gcccagccccuucugaccca

SEQ ID NO: 2724555 - RNA, 24 nt, Human
gcccagccccuucugacccaugcu

SEQ ID NO: 2724556 - RNA, 13 nt, Human
gcccagccccuuc

SEQ ID NO: 2724557 - RNA, 14 nt, Human
gcccagccccuucu

SEQ ID NO: 2724558 - RNA, 16 nt, Human
gcccagccccuucuga

SEQ ID NO: 2724559 - RNA, 17 nt, Human
gcccagccccuucugac

SEQ ID NO: 2724560 - RNA, 15 nt, Human
gcccaguugggugga

SEQ ID NO: 2724561 - RNA, 19 nt, Human
gcccagucuggaaugcagu

SEQ ID NO: 2724562 - RNA, 23 nt, Human
gcccaggcuuagucacugagaca

SEQ ID NO: 2724563 - RNA, 19 nt, Human
gcccaggcuuagucacuga

SEQ ID NO: 2724564 - RNA, 21 nt, Human
gcccaggcuuagucacugaga

SEQ ID NO: 2724565 - RNA, 22 nt, Human
gcccaggcuggcgugcaguggu

SEQ ID NO: 2724566 - RNA, 19 nt, Human
gcccaggcuggcgugcagu

SEQ ID NO: 2724567 - RNA, 20 nt, Human
gcccaggcuggcgugcagug

SEQ ID NO: 2724568 - RNA, 18 nt, Human
gcccaggaaaggcuccag

SEQ ID NO: 2724569 - RNA, 19 nt, Human
gcccaggaaaggcuccagg

SEQ ID NO: 2724570 - RNA, 20 nt, Human
gcccaggaaaggcuccagga

SEQ ID NO: 2724571 - RNA, 21 nt, Human
gcccaggaaaggcuccaggag

SEQ ID NO: 2724572 - RNA, 21 nt, Human
gcccaaugcacuuuguucugg

SEQ ID NO: 2724573 - RNA, 12 nt, Human
gcccagagggcc

SEQ ID NO: 2724574 - RNA, 14 nt, Human
gcccagagggccug

SEQ ID NO: 2724575 - RNA, 15 nt, Human
gcccagagggccugc

SEQ ID NO: 2724576 - RNA, 18 nt, Human
gcccagagggccugcaag

SEQ ID NO: 2724577 - RNA, 19 nt, Human
gcccagagggccugcaagg

SEQ ID NO: 2724578 - RNA, 9 nt, Human
gcccagccc

SEQ ID NO: 2724579 - RNA, 11 nt, Human
gcccagccccu

SEQ ID NO: 2724580 - RNA, 12 nt, Human
gcccagccccuu

SEQ ID NO: 2724581 - RNA, 22 nt, Human
gcccagagggccugcaagggag

SEQ ID NO: 2724582 - RNA, 20 nt, Human
gcccagagggccugcaaggg

SEQ ID NO: 2724583 - RNA, 21 nt, Human
gcccagagggccugcaaggga

SEQ ID NO: 2724584 - RNA, 18 nt, Human
gccagacuggcacaguuu

SEQ ID NO: 2724585 - RNA, 15 nt, Human
gccagacuggcacag

SEQ ID NO: 2724586 - RNA, 19 nt, Human
gccagacuggcacaguuuu

SEQ ID NO: 2724587 - RNA, 16 nt, Human
gccagagacacaagcc

SEQ ID NO: 2724588 - RNA, 17 nt, Human
gccagagacacaagccu

SEQ ID NO: 2724589 - RNA, 19 nt, Human
gccagagacacaagccuuc

SEQ ID NO: 2724590 - RNA, 10 nt, Human
gccagaggag

SEQ ID NO: 2724591 - RNA, 20 nt, Human
gccagagacacaagccuucg

SEQ ID NO: 2724592 - RNA, 21 nt, Human
gccagagggagugacagaggc

SEQ ID NO: 2724593 - RNA, 22 nt, Human
gccagagggagugacagaggca

SEQ ID NO: 2724594 - RNA, 19 nt, Human
gccagaggagagaggaccc

SEQ ID NO: 2724595 - RNA, 22 nt, Human
gccagaggagagaggacccccu

SEQ ID NO: 2724596 - RNA, 12 nt, Human
gccagaggagag

SEQ ID NO: 2724597 - RNA, 13 nt, Human
gccagaggagaga

SEQ ID NO: 2724598 - RNA, 15 nt, Human
gccagaggagagagg

SEQ ID NO: 2724599 - RNA, 17 nt, Human
gccagaggagagaggac

SEQ ID NO: 2724600 - RNA, 23 nt, Human
gccagagggagugacagaggcag

SEQ ID NO: 2724601 - RNA, 16 nt, Human
gccagaugcaccagcc

SEQ ID NO: 2724602 - RNA, 17 nt, Human
gccagaugcaccagccc

SEQ ID NO: 2724603 - RNA, 18 nt, Human
gccagaugcaccagcccu

SEQ ID NO: 2724604 - RNA, 18 nt, Human
gccacggccaggccagag

SEQ ID NO: 2724605 - RNA, 17 nt, Human
gccacggccaggccaga

SEQ ID NO: 2724606 - RNA, 19 nt, Human
gccacggccaggccagagg

SEQ ID NO: 2724607 - RNA, 22 nt, Human
gccaccugcggugcuaucuccc

SEQ ID NO: 2724608 - RNA, 14 nt, Human
gccaccugcggugc

SEQ ID NO: 2724609 - RNA, 20 nt, Human
gccaccugcggugcuaucuc

SEQ ID NO: 2724610 - RNA, 17 nt, Human
gccaccugccuguuggg

SEQ ID NO: 2724611 - RNA, 14 nt, Human
gccaaggugggagg

SEQ ID NO: 2724612 - RNA, 15 nt, Human
gccaaggugggagga

SEQ ID NO: 2724613 - RNA, 23 nt, Human
gccaaggugggaggauugcuuga

SEQ ID NO: 2724614 - RNA, 21 nt, Human
gccaaggcugggggaagaagc

SEQ ID NO: 2724615 - RNA, 23 nt, Human
gcauuuggugguuucagaaaugu

SEQ ID NO: 2724616 - RNA, 22 nt, Human
gcauuuggugguuucagaaaug

SEQ ID NO: 2724617 - RNA, 20 nt, Human
gcauuugaggucuguucuuu

SEQ ID NO: 2724618 - RNA, 19 nt, Human
gcauuugaggucuguucuu

SEQ ID NO: 2724619 - RNA, 22 nt, Human
gccacaagacccuugugguccc

SEQ ID NO: 2724620 - RNA, 16 nt, Human
gccacaagacccuugu

SEQ ID NO: 2724621 - RNA, 23 nt, Human
gccacagagaaaguacuucucca

SEQ ID NO: 2724622 - RNA, 13 nt, Human
gccacagagaaag

SEQ ID NO: 2724623 - RNA, 14 nt, Human
gccacagagaaagu

SEQ ID NO: 2724624 - RNA, 20 nt, Human
gccacagagaaaguacuucu

SEQ ID NO: 2724625 - RNA, 18 nt, Human
gcagcucagagagggugg

SEQ ID NO: 2724626 - RNA, 19 nt, Human
gcagcucagagaggguggg

SEQ ID NO: 2724627 - RNA, 16 nt, Human
gcagcucaccucuccc

SEQ ID NO: 2724628 - RNA, 17 nt, Human
gcagcucaccucucccu

SEQ ID NO: 2724629 - RNA, 20 nt, Human
gcagcucaccucucccuugg

SEQ ID NO: 2724630 - RNA, 21 nt, Human
gcagcucaccucucccuugga

SEQ ID NO: 2724631 - RNA, 14 nt, Human
gcagcucagagagg

SEQ ID NO: 2724632 - RNA, 15 nt, Human
gcagccucacagucc

SEQ ID NO: 2724633 - RNA, 17 nt, Human
gcagccucacaguccuu

SEQ ID NO: 2724634 - RNA, 19 nt, Human
gcagccucacaguccuuac

SEQ ID NO: 2724635 - RNA, 18 nt, Human
gcagcagggagggcuucu

SEQ ID NO: 2724636 - RNA, 19 nt, Human
gcagcagggagggcuucug

SEQ ID NO: 2724637 - RNA, 16 nt, Human
gcagauuauucacuga

SEQ ID NO: 2724638 - RNA, 13 nt, Human
gcagauuauucac

SEQ ID NO: 2724639 - RNA, 18 nt, Human
gcagauggagaccccuug

SEQ ID NO: 2724640 - RNA, 22 nt, Human
gcacuucgggaggucgaggcag

SEQ ID NO: 2724641 - RNA, 14 nt, Human
gcacuugcagacuc

SEQ ID NO: 2724642 - RNA, 16 nt, Human
gcacuugcagacucua

SEQ ID NO: 2724643 - RNA, 17 nt, Human
gcagacucuacagaggc

SEQ ID NO: 2724644 - RNA, 18 nt, Human
gcagacucuacagaggcc

SEQ ID NO: 2724645 - RNA, 19 nt, Human
gcagacucuacagaggcca

SEQ ID NO: 2724646 - RNA, 22 nt, Human
gcagacucuacagaggccaugg

SEQ ID NO: 2724647 - RNA, 19 nt, Human
gcagagaccaucccugaag

SEQ ID NO: 2724648 - RNA, 22 nt, Human
gcagagaccaucccugaaggcc

SEQ ID NO: 2724649 - RNA, 20 nt, Human
gcagagaccaucccugaagg

SEQ ID NO: 2724650 - RNA, 21 nt, Human
gcagagaccaucccugaaggc

SEQ ID NO: 2724651 - RNA, 15 nt, Human
gcacagccucuuaga

SEQ ID NO: 2724652 - RNA, 20 nt, Human
gauugugucucuugguccug

SEQ ID NO: 2724653 - RNA, 18 nt, Human
gcacagccucuuagaugc

SEQ ID NO: 2724654 - RNA, 21 nt, Human
gcacagcuucauuuccugugu

SEQ ID NO: 2724655 - RNA, 23 nt, Human
gcacagcuucauuuccugugucu

SEQ ID NO: 2724656 - RNA, 13 nt, Human
gcaccagcagccu

SEQ ID NO: 2724657 - RNA, 14 nt, Human
gcaccaucucuccu

SEQ ID NO: 2724658 - RNA, 15 nt, Human
gcaccaucucuccuc

SEQ ID NO: 2724659 - RNA, 17 nt, Human
gcaccaucucuccuccu

SEQ ID NO: 2724660 - RNA, 19 nt, Human
gcacuguggguagacacac

SEQ ID NO: 2724661 - RNA, 19 nt, Human
gcacuguuuuauuuuaauu

SEQ ID NO: 2724662 - RNA, 12 nt, Human
gcacugggcuug

SEQ ID NO: 2724663 - RNA, 15 nt, Human
gcacuauaauguaag

SEQ ID NO: 2724664 - RNA, 14 nt, Human
gcacuauaauguaa

SEQ ID NO: 2724665 - RNA, 20 nt, Human
gcacuauaauguaagcucua

SEQ ID NO: 2724666 - RNA, 22 nt, Human
gcacuauaauguaagcucuacu

SEQ ID NO: 2724667 - RNA, 12 nt, Human
gcacugcuucca

SEQ ID NO: 2724668 - RNA, 13 nt, Human
gcacugcuuccag

SEQ ID NO: 2724669 - RNA, 14 nt, Human
gcacugcuuccagu

SEQ ID NO: 2724670 - RNA, 15 nt, Human
gcacugcuuccagug

SEQ ID NO: 2724671 - RNA, 16 nt, Human
gcacccucaggcaggu

SEQ ID NO: 2724672 - RNA, 19 nt, Human
gcacccucaggcagguggg

SEQ ID NO: 2724673 - RNA, 19 nt, Human
gcacuaaggugugcucuga

SEQ ID NO: 2724674 - RNA, 20 nt, Human
gcacuaaggugugcucugau

SEQ ID NO: 2724675 - RNA, 14 nt, Human
gcacgugugugcac

SEQ ID NO: 2724676 - RNA, 23 nt, Human
gcaucagcugcugaaacaacaaa

SEQ ID NO: 2724677 - RNA, 12 nt, Human
gcaucaggccag

SEQ ID NO: 2724678 - RNA, 22 nt, Human
gcaucagcugcugaaacaacaa

SEQ ID NO: 2724679 - RNA, 23 nt, Human
gcaucaggccaggcccucugccc

SEQ ID NO: 2724680 - RNA, 18 nt, Human
gcaucaggccaggcccuc

SEQ ID NO: 2724681 - RNA, 20 nt, Human
gcaucuagcaugucgucaaa

SEQ ID NO: 2724682 - RNA, 20 nt, Human
gcaugaaguaauaugcacac

SEQ ID NO: 2724683 - RNA, 22 nt, Human
gcaugaaguaauaugcacacau

SEQ ID NO: 2724684 - RNA, 21 nt, Human
gcaugaaguaauaugcacaca

SEQ ID NO: 2724685 - RNA, 20 nt, Human
gcaugacacgaauauugcug

SEQ ID NO: 2724686 - RNA, 21 nt, Human
gcaugacacgaauauugcuga

SEQ ID NO: 2724687 - RNA, 22 nt, Human
gcaugacacgaauauugcugau

SEQ ID NO: 2724688 - RNA, 14 nt, Human
gcaugccuggaugg

SEQ ID NO: 2724689 - RNA, 13 nt, Human
gcauguuacauaa

SEQ ID NO: 2724690 - RNA, 15 nt, Human
gcaugccuggauggg

SEQ ID NO: 2724691 - RNA, 24 nt, Human
gcauuaucuagauacuguaucaug

SEQ ID NO: 2724692 - RNA, 22 nt, Human
gcauuaucuagauacuguauca

SEQ ID NO: 2724693 - RNA, 19 nt, Human
gcauuaucuagauacugua

SEQ ID NO: 2724694 - RNA, 18 nt, Human
gcauuugaggucuguucu

SEQ ID NO: 2724695 - RNA, 22 nt, Human
gcauuccccaggaggccagccu

SEQ ID NO: 2724696 - RNA, 14 nt, Human
gcauuccccaggag

SEQ ID NO: 2724697 - RNA, 15 nt, Human
gcauuccccaggagg

SEQ ID NO: 2724698 - RNA, 16 nt, Human
gcauuccccaggaggc

SEQ ID NO: 2724699 - RNA, 17 nt, Human
gcauuccccaggaggcc

SEQ ID NO: 2724700 - RNA, 18 nt, Human
gcauuccccaggaggcca

SEQ ID NO: 2724701 - RNA, 19 nt, Human
gcauuccccaggaggccag

SEQ ID NO: 2724702 - RNA, 20 nt, Human
gcauuccccaggaggccagc

SEQ ID NO: 2724703 - RNA, 21 nt, Human
gcauuccccaggaggccagcc

SEQ ID NO: 2724704 - RNA, 15 nt, Human
gcaguugaaaagacu

SEQ ID NO: 2724705 - RNA, 19 nt, Human
gcaguugaaaagacuccaa

SEQ ID NO: 2724706 - RNA, 16 nt, Human
gcaguugaaaagacuc

SEQ ID NO: 2724707 - RNA, 21 nt, Human
gcaguugaaaagacuccaaag

SEQ ID NO: 2724708 - RNA, 19 nt, Human
gcauacguacacauuuuau

SEQ ID NO: 2724709 - RNA, 19 nt, Human
gcaguucagagcugcccuc

SEQ ID NO: 2724710 - RNA, 20 nt, Human
gcaguucagagcugcccucu

SEQ ID NO: 2724711 - RNA, 22 nt, Human
gcaguucagagcugcccucucc

SEQ ID NO: 2724712 - RNA, 23 nt, Human
gcaguucagagcugcccucuccu

SEQ ID NO: 2724713 - RNA, 21 nt, Human
gcaguggugguuuucuguucu

SEQ ID NO: 2724714 - RNA, 20 nt, Human
gcaguggugguuuucuguuc

SEQ ID NO: 2724715 - RNA, 22 nt, Human
gcaguggugcgaucuggguuca

SEQ ID NO: 2724716 - RNA, 19 nt, Human
gcaguggugguuuucuguu

SEQ ID NO: 2724717 - RNA, 20 nt, Human
gcaguggugcgaucuggguu

SEQ ID NO: 2724718 - RNA, 21 nt, Human
gcaguggugcgaucuggguuc

SEQ ID NO: 2724719 - RNA, 11 nt, Human
gcagugggagc

SEQ ID NO: 2724720 - RNA, 18 nt, Human
gcaguggugcgaucuggg

SEQ ID NO: 2724721 - RNA, 19 nt, Human
gcaguggugcgaucugggu

SEQ ID NO: 2724722 - RNA, 19 nt, Human
gcaggguccuagaaauucc

SEQ ID NO: 2724723 - RNA, 16 nt, Human
gcagggucucacucug

SEQ ID NO: 2724724 - RNA, 22 nt, Human
gcaggggaggguagagcggaga

SEQ ID NO: 2724725 - RNA, 18 nt, Human
gcaggcagccaggccaca

SEQ ID NO: 2724726 - RNA, 17 nt, Human
gcaggcagccaggccac

SEQ ID NO: 2724727 - RNA, 18 nt, Human
gcuugcccuguuaaaaga

SEQ ID NO: 2724728 - RNA, 12 nt, Human
gcuuguguuaag

SEQ ID NO: 2724729 - RNA, 14 nt, Human
gcuuuguauagaac

SEQ ID NO: 2724730 - RNA, 13 nt, Human
gcuuuguauagaa

SEQ ID NO: 2724731 - RNA, 12 nt, Human
gcuuuguauaga

SEQ ID NO: 2724732 - RNA, 19 nt, Human
gcuucuguuuuauaauuuu

SEQ ID NO: 2724733 - RNA, 22 nt, Human
gcuucucacugccaugccagcu

SEQ ID NO: 2724734 - RNA, 17 nt, Human
gcuucucacugccaugc

SEQ ID NO: 2724735 - RNA, 18 nt, Human
gcuucauuuccugugucu

SEQ ID NO: 2724736 - RNA, 21 nt, Human
gcuucauccuccucagaucuu

SEQ ID NO: 2724737 - RNA, 19 nt, Human
gcuucaguggcagcugcuu

SEQ ID NO: 2724738 - RNA, 20 nt, Human
gcuucaguggcagcugcuuu

SEQ ID NO: 2724739 - RNA, 20 nt, Human
gcuuauacacuuacacuuua

SEQ ID NO: 2724740 - RNA, 23 nt, Human
gcuggucccagccagcaguucag

SEQ ID NO: 2724741 - RNA, 14 nt, Human
gcugggggccucag

SEQ ID NO: 2724742 - RNA, 15 nt, Human
gcugggggccucagu

SEQ ID NO: 2724743 - RNA, 18 nt, Human
gcugggggccucagugcc

SEQ ID NO: 2724744 - RNA, 13 nt, Human
gcugggggccuca

SEQ ID NO: 2724745 - RNA, 19 nt, Human
gcugggaugauuggagggg

SEQ ID NO: 2724746 - RNA, 21 nt, Human
gcugggcucccuucccaccuc

SEQ ID NO: 2724747 - RNA, 13 nt, Human
gcuggccuggccc

SEQ ID NO: 2724748 - RNA, 12 nt, Human
gcuggccuggcc

SEQ ID NO: 2724749 - RNA, 14 nt, Human
gcuggccuggcccc

SEQ ID NO: 2724750 - RNA, 15 nt, Human
gcuggccuggccccu

SEQ ID NO: 2724751 - RNA, 21 nt, Human
gcugggcuucaguggcagcug

SEQ ID NO: 2724752 - RNA, 22 nt, Human
gcugggcuucaguggcagcugc

SEQ ID NO: 2724753 - RNA, 20 nt, Human
gcugggcuucaguggcagcu

SEQ ID NO: 2724754 - RNA, 16 nt, Human
gcugucccuuuuccuu

SEQ ID NO: 2724755 - RNA, 23 nt, Human
gcugucccuuacgugaguccugg

SEQ ID NO: 2724756 - RNA, 17 nt, Human
gcugucagccauuccug

SEQ ID NO: 2724757 - RNA, 21 nt, Human
gcugguguaugugugaaguga

SEQ ID NO: 2724758 - RNA, 14 nt, Human
gcuggugucaccug

SEQ ID NO: 2724759 - RNA, 15 nt, Human
gcuggugucaccuga

SEQ ID NO: 2724760 - RNA, 15 nt, Human
gcugugucucccuuc

SEQ ID NO: 2724761 - RNA, 18 nt, Human
gcuguguuaaauaaaccu

SEQ ID NO: 2724762 - RNA, 12 nt, Human
gcugcccucucc

SEQ ID NO: 2724763 - RNA, 13 nt, Human
gcugccaccugcc

SEQ ID NO: 2724764 - RNA, 12 nt, Human
gcugccaccugc

SEQ ID NO: 2724765 - RNA, 20 nt, Human
gcugccaaugggagcucaug

SEQ ID NO: 2724766 - RNA, 13 nt, Human
gcugcaguugcca

SEQ ID NO: 2724767 - RNA, 14 nt, Human
gcugcaguugccag

SEQ ID NO: 2724768 - RNA, 19 nt, Human
gcugcauuuaaaagauaca

SEQ ID NO: 2724769 - RNA, 18 nt, Human
gcugcauuuaaaagauac

SEQ ID NO: 2724770 - RNA, 17 nt, Human
gcugcauuuaaaagaua

SEQ ID NO: 2724771 - RNA, 17 nt, Human
gcugcaguugccaguca

SEQ ID NO: 2724772 - RNA, 22 nt, Human
gcugcaaaggguaucaggugcu

SEQ ID NO: 2724773 - RNA, 23 nt, Human
gcugcaaaggguaucaggugcug

SEQ ID NO: 2724774 - RNA, 17 nt, Human
gcugacagacacaggcc

SEQ ID NO: 2724775 - RNA, 18 nt, Human
gcugacagacacaggccc

SEQ ID NO: 2724776 - RNA, 19 nt, Human
gcugacagacacaggcccg

SEQ ID NO: 2724777 - RNA, 22 nt, Human
gcugacuguuuucucuugagag

SEQ ID NO: 2724778 - RNA, 21 nt, Human
gcucucaggccagcugcuugg

SEQ ID NO: 2724779 - RNA, 13 nt, Human
gcugcccucuccu

SEQ ID NO: 2724780 - RNA, 14 nt, Human
gcugcccucuccug

SEQ ID NO: 2724781 - RNA, 15 nt, Human
gcugcccucuccugg

SEQ ID NO: 2724782 - RNA, 16 nt, Human
gcugcccucuccuggg

SEQ ID NO: 2724783 - RNA, 17 nt, Human
gcugcccucuccugggc

SEQ ID NO: 2724784 - RNA, 18 nt, Human
gcugcccucuccugggca

SEQ ID NO: 2724785 - RNA, 20 nt, Human
gcugcccucuccugggcagc

SEQ ID NO: 2724786 - RNA, 22 nt, Human
gcugcccucuccugggcagcug

SEQ ID NO: 2724787 - RNA, 23 nt, Human
gcugcccucuccugggcagcugc

SEQ ID NO: 2724788 - RNA, 12 nt, Human
gcugcccugccc

SEQ ID NO: 2724789 - RNA, 13 nt, Human
gcugcccugccca

SEQ ID NO: 2724790 - RNA, 14 nt, Human
gcugcccugcccac

SEQ ID NO: 2724791 - RNA, 24 nt, Human
gcugcccugcccaccuggccucug

SEQ ID NO: 2724792 - RNA, 22 nt, Human
gcugcccugcccaccuggccuc

SEQ ID NO: 2724793 - RNA, 23 nt, Human
gcugcccugcccaccuggccucu

SEQ ID NO: 2724794 - RNA, 16 nt, Human
gcugcccugcccaccu

SEQ ID NO: 2724795 - RNA, 18 nt, Human
gcugcccugcccaccugg

SEQ ID NO: 2724796 - RNA, 20 nt, Human
gcugcccugcccaccuggcc

SEQ ID NO: 2724797 - RNA, 21 nt, Human
gcugcccugcccaccuggccu

SEQ ID NO: 2724798 - RNA, 22 nt, Human
gcugcgguccacccaggagccc

SEQ ID NO: 2724799 - RNA, 21 nt, Human
gcugcgguccacccaggagcc

SEQ ID NO: 2724800 - RNA, 14 nt, Human
gcugcgguccaccc

SEQ ID NO: 2724801 - RNA, 15 nt, Human
gcugcgguccaccca

SEQ ID NO: 2724802 - RNA, 20 nt, Human
gcugccuguucagcuccagc

SEQ ID NO: 2724803 - RNA, 22 nt, Human
gcugccuguucagcuccagcuc

SEQ ID NO: 2724804 - RNA, 18 nt, Human
gcugccuguucagcucca

SEQ ID NO: 2724805 - RNA, 19 nt, Human
gcugccuguucagcuccag

SEQ ID NO: 2724806 - RNA, 23 nt, Human
gcuggaaaaguauguuagugcaa

SEQ ID NO: 2724807 - RNA, 21 nt, Human
gcuggaaaaguauguuagugc

SEQ ID NO: 2724808 - RNA, 22 nt, Human
gcugcuuuugucuaugggacuc

SEQ ID NO: 2724809 - RNA, 15 nt, Human
gcuggaccuugaacu

SEQ ID NO: 2724810 - RNA, 20 nt, Human
gcuccauuuuuagugaaaua

SEQ ID NO: 2724811 - RNA, 20 nt, Human
gcucccuucccaccucucuc

SEQ ID NO: 2724812 - RNA, 18 nt, Human
gcuccgcuuucuacccag

SEQ ID NO: 2724813 - RNA, 21 nt, Human
gcuccgcuuucuacccagcga

SEQ ID NO: 2724814 - RNA, 22 nt, Human
gcuccgcuuucuacccagcgag

SEQ ID NO: 2724815 - RNA, 23 nt, Human
gcuccgcuuucuacccagcgagc

SEQ ID NO: 2724816 - RNA, 21 nt, Human
gcuccagcuguucagcugguu

SEQ ID NO: 2724817 - RNA, 20 nt, Human
gcuccagcuguucagcuggu

SEQ ID NO: 2724818 - RNA, 11 nt, Human
gcuccaggagc

SEQ ID NO: 2724819 - RNA, 12 nt, Human
gcuccaggagca

SEQ ID NO: 2724820 - RNA, 14 nt, Human
gcuccaggagcagc

SEQ ID NO: 2724821 - RNA, 12 nt, Human
gcuccaggcucc

SEQ ID NO: 2724822 - RNA, 24 nt, Human
gcuccaggcuccuuuagcgcccag

SEQ ID NO: 2724823 - RNA, 15 nt, Human
gcuccaggagcagcc

SEQ ID NO: 2724824 - RNA, 16 nt, Human
gcuccaggagcagcca

SEQ ID NO: 2724825 - RNA, 17 nt, Human
gcuccaggagcagccac

SEQ ID NO: 2724826 - RNA, 18 nt, Human
gcuccaggagcagccaca

SEQ ID NO: 2724827 - RNA, 24 nt, Human
gcuccgcuuucuacccagcgagcc

SEQ ID NO: 2724828 - RNA, 12 nt, Human
gcuccugugucu

SEQ ID NO: 2724829 - RNA, 13 nt, Human
gcuccugugucuu

SEQ ID NO: 2724830 - RNA, 13 nt, Human
gcuccuucugucc

SEQ ID NO: 2724831 - RNA, 17 nt, Human
gcuccuuuagcgcccag

SEQ ID NO: 2724832 - RNA, 17 nt, Human
gcucgagcaugccugga

SEQ ID NO: 2724833 - RNA, 21 nt, Human
gcucgagcaugccuggauggg

SEQ ID NO: 2724834 - RNA, 19 nt, Human
gcucgagcaugccuggaug

SEQ ID NO: 2724835 - RNA, 19 nt, Human
gcuauaggugcuacaaaaa

SEQ ID NO: 2724836 - RNA, 21 nt, Human
gcuauaggugcuacaaaaaca

SEQ ID NO: 2724837 - RNA, 13 nt, Human
gcuagauguaugu

SEQ ID NO: 2724838 - RNA, 19 nt, Human
gcggugcuaucucccccag

SEQ ID NO: 2724839 - RNA, 22 nt, Human
gcggugcuaucucccccagccc

SEQ ID NO: 2724840 - RNA, 14 nt, Human
gcuagauguaugua

SEQ ID NO: 2724841 - RNA, 21 nt, Human
gcuaguugggcuuccucauag

SEQ ID NO: 2724842 - RNA, 15 nt, Human
gcuaucucccccagc

SEQ ID NO: 2724843 - RNA, 14 nt, Human
gcuaucucccccag

SEQ ID NO: 2724844 - RNA, 18 nt, Human
gcucaaguccucuuuucu

SEQ ID NO: 2724845 - RNA, 13 nt, Human
gcuaucuccccca

SEQ ID NO: 2724846 - RNA, 19 nt, Human
gcucaaguccucuuuucug

SEQ ID NO: 2724847 - RNA, 22 nt, Human
gcucaaguccucuuuucugaga

SEQ ID NO: 2724848 - RNA, 16 nt, Human
gcucagcggggacagc

SEQ ID NO: 2724849 - RNA, 17 nt, Human
gcucagcggggacagcu

SEQ ID NO: 2724850 - RNA, 18 nt, Human
gcucagcggggacagcuc

SEQ ID NO: 2724851 - RNA, 19 nt, Human
gcucagcggggacagcucc

SEQ ID NO: 2724852 - RNA, 23 nt, Human
gcucagcggggacagcuccuucu

SEQ ID NO: 2724853 - RNA, 14 nt, Human
gcucaccucucccu

SEQ ID NO: 2724854 - RNA, 16 nt, Human
gcucaccucucccuug

SEQ ID NO: 2724855 - RNA, 17 nt, Human
gcucaccucucccuugg

SEQ ID NO: 2724856 - RNA, 18 nt, Human
gcucaccucucccuugga

SEQ ID NO: 2724857 - RNA, 16 nt, Human
gcucacauaucuguca

SEQ ID NO: 2724858 - RNA, 12 nt, Human
gcucaccagccc

SEQ ID NO: 2724859 - RNA, 13 nt, Human
gcucaccagcccc

SEQ ID NO: 2724860 - RNA, 14 nt, Human
gcucaccagcccca

SEQ ID NO: 2724861 - RNA, 15 nt, Human
gcucaccagccccag

SEQ ID NO: 2724862 - RNA, 17 nt, Human
gccugaagucacacagu

SEQ ID NO: 2724863 - RNA, 18 nt, Human
gccugaagucacacagug

SEQ ID NO: 2724864 - RNA, 19 nt, Human
gcccaguuggguggaugcc

SEQ ID NO: 2724865 - RNA, 21 nt, Human
gcccaguuggguggaugccug

SEQ ID NO: 2724866 - RNA, 15 nt, Human
gccugaagucacaca

SEQ ID NO: 2724867 - RNA, 16 nt, Human
gccugaagucacacag

SEQ ID NO: 2724868 - RNA, 12 nt, Human
gccugagcuggg

SEQ ID NO: 2724869 - RNA, 16 nt, Human
gccuggauggggcugc

SEQ ID NO: 2724870 - RNA, 18 nt, Human
gccuggauggggcugcac

SEQ ID NO: 2724871 - RNA, 20 nt, Human
gccuggauggggcugcaccg

SEQ ID NO: 2724872 - RNA, 13 nt, Human
gccuggccccuca

SEQ ID NO: 2724873 - RNA, 14 nt, Human
gccuggccccucag

SEQ ID NO: 2724874 - RNA, 20 nt, Human
gccuggccagaugcaccagc

SEQ ID NO: 2724875 - RNA, 16 nt, Human
gccuggccagaugcac

SEQ ID NO: 2724876 - RNA, 21 nt, Human
gccuggccagaugcaccagcc

SEQ ID NO: 2724877 - RNA, 22 nt, Human
gccuggccagaugcaccagccc

SEQ ID NO: 2724878 - RNA, 20 nt, Human
gccuguaauccuagcacuuu

SEQ ID NO: 2724879 - RNA, 15 nt, Human
gccuguaauccuagc

SEQ ID NO: 2724880 - RNA, 18 nt, Human
gccuuggggcugaugcag

SEQ ID NO: 2724881 - RNA, 15 nt, Human
gccuuacacaauggu

SEQ ID NO: 2724882 - RNA, 16 nt, Human
gccuuacacaaugguu

SEQ ID NO: 2724883 - RNA, 12 nt, Human
gcgacaaugcaa

SEQ ID NO: 2724884 - RNA, 13 nt, Human
gcgacaaugcaaa

SEQ ID NO: 2724885 - RNA, 20 nt, Human
gcgacaaugcaaaccaucau

SEQ ID NO: 2724886 - RNA, 21 nt, Human
gcgacaaugcaaaccaucauu

SEQ ID NO: 2724887 - RNA, 15 nt, Human
gcggggacagcuccu

SEQ ID NO: 2724888 - RNA, 17 nt, Human
gcggggacagcuccuuc

SEQ ID NO: 2724889 - RNA, 19 nt, Human
gcggugagaggggaacaga

SEQ ID NO: 2724890 - RNA, 13 nt, Human
gcgguccacccag

SEQ ID NO: 2724891 - RNA, 14 nt, Human
gcgguccacccagg

SEQ ID NO: 2724892 - RNA, 18 nt, Human
gcgcugccccuggcagcc

SEQ ID NO: 2724893 - RNA, 21 nt, Human
gcgcugccccuggcagccccu

SEQ ID NO: 2724894 - RNA, 16 nt, Human
gcggagaaaggaaggg

SEQ ID NO: 2724895 - RNA, 19 nt, Human
gcggagacggagucccacc

SEQ ID NO: 2724896 - RNA, 14 nt, Human
gcggggacagcucc

SEQ ID NO: 2724897 - RNA, 21 nt, Human
gcgccuuaaggauguucuagc

SEQ ID NO: 2724898 - RNA, 23 nt, Human
gcgcccaguuggguggaugccug

SEQ ID NO: 2724899 - RNA, 9 nt, Human
ggcuccaga

SEQ ID NO: 2724900 - RNA, 14 nt, Human
ggcuaugcauuuga

SEQ ID NO: 2724901 - RNA, 13 nt, Human
ggcuaugcauuug

SEQ ID NO: 2724902 - RNA, 12 nt, Human
ggcuaugcauuu

SEQ ID NO: 2724903 - RNA, 10 nt, Human
ggcuccagac

SEQ ID NO: 2724904 - RNA, 14 nt, Human
ggcuccaggagcag

SEQ ID NO: 2724905 - RNA, 16 nt, Human
ggcuccaggagcagcc

SEQ ID NO: 2724906 - RNA, 12 nt, Human
ggcuccaggcuc

SEQ ID NO: 2724907 - RNA, 13 nt, Human
ggcuccaggcucc

SEQ ID NO: 2724908 - RNA, 18 nt, Human
ggcuccaggagcagccac

SEQ ID NO: 2724909 - RNA, 17 nt, Human
ggcuccaggagcagcca

SEQ ID NO: 2724910 - RNA, 23 nt, Human
ggcuauaggugcuacaaaaacac

SEQ ID NO: 2724911 - RNA, 15 nt, Human
ggcgcgguggcucac

SEQ ID NO: 2724912 - RNA, 17 nt, Human
ggcgcugccccuggcag

SEQ ID NO: 2724913 - RNA, 11 nt, Human
ggcgcugcccc

SEQ ID NO: 2724914 - RNA, 12 nt, Human
ggcucugcccuu

SEQ ID NO: 2724915 - RNA, 16 nt, Human
ggcucugccucccauc

SEQ ID NO: 2724916 - RNA, 14 nt, Human
ggcucugcccuugg

SEQ ID NO: 2724917 - RNA, 15 nt, Human
ggcucugcccuuggu

SEQ ID NO: 2724918 - RNA, 13 nt, Human
ggcucugccuccc

SEQ ID NO: 2724919 - RNA, 15 nt, Human
ggcucugccucccau

SEQ ID NO: 2724920 - RNA, 14 nt, Human
ggcucucaggccag

SEQ ID NO: 2724921 - RNA, 17 nt, Human
ggcucucaggccagcug

SEQ ID NO: 2724922 - RNA, 18 nt, Human
ggcucucaggccagcugc

SEQ ID NO: 2724923 - RNA, 19 nt, Human
ggcucucaggccagcugcu

SEQ ID NO: 2724924 - RNA, 20 nt, Human
ggcucucaggccagcugcuu

SEQ ID NO: 2724925 - RNA, 14 nt, Human
ggcuccaggcuccu

SEQ ID NO: 2724926 - RNA, 15 nt, Human
ggcucucaggccagc

SEQ ID NO: 2724927 - RNA, 16 nt, Human
ggcucucaggccagcu

SEQ ID NO: 2724928 - RNA, 23 nt, Human
ggccugggggcugggcagaggaa

SEQ ID NO: 2724929 - RNA, 15 nt, Human
ggccuggccugagcu

SEQ ID NO: 2724930 - RNA, 16 nt, Human
ggccuggccugagcug

SEQ ID NO: 2724931 - RNA, 23 nt, Human
ggcgcagcauauucaggaagcuc

SEQ ID NO: 2724932 - RNA, 24 nt, Human
ggcgcagcauauucaggaagcuca

SEQ ID NO: 2724933 - RNA, 22 nt, Human
ggccucugcacuccccugcugg

SEQ ID NO: 2724934 - RNA, 18 nt, Human
ggccucugcacuccccug

SEQ ID NO: 2724935 - RNA, 19 nt, Human
ggccucugcacuccccugc

SEQ ID NO: 2724936 - RNA, 13 nt, Human
ggccuggccccuc

SEQ ID NO: 2724937 - RNA, 14 nt, Human
ggccuggccccuca

SEQ ID NO: 2724938 - RNA, 15 nt, Human
ggccuggccccucag

SEQ ID NO: 2724939 - RNA, 17 nt, Human
ggccuggccccucaggg

SEQ ID NO: 2724940 - RNA, 18 nt, Human
ggccuggccccucagggu

SEQ ID NO: 2724941 - RNA, 23 nt, Human
ggccuggccccucagggucccug

SEQ ID NO: 2724942 - RNA, 10 nt, Human
ggccuggccu

SEQ ID NO: 2724943 - RNA, 13 nt, Human
ggccuggccugag

SEQ ID NO: 2724944 - RNA, 14 nt, Human
ggccuggccugagc

SEQ ID NO: 2724945 - RNA, 20 nt, Human
ggcccagagggccugcaagg

SEQ ID NO: 2724946 - RNA, 17 nt, Human
ggcccagagggccugca

SEQ ID NO: 2724947 - RNA, 19 nt, Human
ggcccagagggccugcaag

SEQ ID NO: 2724948 - RNA, 14 nt, Human
ggcccagagggccu

SEQ ID NO: 2724949 - RNA, 20 nt, Human
ggccucgguguggagaagcg

SEQ ID NO: 2724950 - RNA, 14 nt, Human
ggccuccugugugu

SEQ ID NO: 2724951 - RNA, 22 nt, Human
ggccuagcauacguacacauuu

SEQ ID NO: 2724952 - RNA, 20 nt, Human
ggccuagcauacguacacau

SEQ ID NO: 2724953 - RNA, 14 nt, Human
ggccucaagugauu

SEQ ID NO: 2724954 - RNA, 22 nt, Human
ggccucaagugauucuccugcc

SEQ ID NO: 2724955 - RNA, 14 nt, Human
gggaauugaggaca

SEQ ID NO: 2724956 - RNA, 19 nt, Human
gggaauguuugccucugcc

SEQ ID NO: 2724957 - RNA, 21 nt, Human
gggaauguuugccucugccuc

SEQ ID NO: 2724958 - RNA, 14 nt, Human
gggacacccuguga

SEQ ID NO: 2724959 - RNA, 15 nt, Human
ggcuuuguauagaac

SEQ ID NO: 2724960 - RNA, 23 nt, Human
gggacucaaugcacugacauugu

SEQ ID NO: 2724961 - RNA, 17 nt, Human
gggacucaaugcacuga

SEQ ID NO: 2724962 - RNA, 19 nt, Human
gggacucaaugcacugaca

SEQ ID NO: 2724963 - RNA, 21 nt, Human
gggaggauugcuugagcucag

SEQ ID NO: 2724964 - RNA, 22 nt, Human
gggaggauguucugggacacag

SEQ ID NO: 2724965 - RNA, 23 nt, Human
gggaggaucucuugagccuggga

SEQ ID NO: 2724966 - RNA, 20 nt, Human
gggaggugggauccuccagg

SEQ ID NO: 2724967 - RNA, 23 nt, Human
gggaggauugcuugagcucagga

SEQ ID NO: 2724968 - RNA, 21 nt, Human
gggagugaguugauagcacag

SEQ ID NO: 2724969 - RNA, 17 nt, Human
gggagugacagaggcag

SEQ ID NO: 2724970 - RNA, 13 nt, Human
gggagcugccugu

SEQ ID NO: 2724971 - RNA, 21 nt, Human
gggagcugccuguucagcucc

SEQ ID NO: 2724972 - RNA, 22 nt, Human
gggagcugccuguucagcucca

SEQ ID NO: 2724973 - RNA, 16 nt, Human
ggcugggggaagaagc

SEQ ID NO: 2724974 - RNA, 14 nt, Human
ggcugggggccuca

SEQ ID NO: 2724975 - RNA, 11 nt, Human
ggcugggcuuc

SEQ ID NO: 2724976 - RNA, 21 nt, Human
ggcugggcuucaguggcagcu

SEQ ID NO: 2724977 - RNA, 22 nt, Human
ggcugggcuucaguggcagcug

SEQ ID NO: 2724978 - RNA, 18 nt, Human
ggcugggcuucaguggca

SEQ ID NO: 2724979 - RNA, 18 nt, Human
ggcugggcucccuuccca

SEQ ID NO: 2724980 - RNA, 20 nt, Human
ggcugggcucccuucccacc

SEQ ID NO: 2724981 - RNA, 21 nt, Human
ggcugggcucccuucccaccu

SEQ ID NO: 2724982 - RNA, 15 nt, Human
ggcugcuucaaggau

SEQ ID NO: 2724983 - RNA, 19 nt, Human
ggcugcuucaaggauccug

SEQ ID NO: 2724984 - RNA, 21 nt, Human
ggcugcuucaaggauccugag

SEQ ID NO: 2724985 - RNA, 20 nt, Human
ggcugcuucaaggauccuga

SEQ ID NO: 2724986 - RNA, 18 nt, Human
ggcuggagcuagaauuug

SEQ ID NO: 2724987 - RNA, 20 nt, Human
ggcuucacggaagagccuug

SEQ ID NO: 2724988 - RNA, 15 nt, Human
ggcuuagucacugag

SEQ ID NO: 2724989 - RNA, 14 nt, Human
ggcuuagucacuga

SEQ ID NO: 2724990 - RNA, 21 nt, Human
ggcuucacggaagagccuugc

SEQ ID NO: 2724991 - RNA, 17 nt, Human
ggcuuggggaccagagc

SEQ ID NO: 2724992 - RNA, 18 nt, Human
ggcuuggggaccagagcu

SEQ ID NO: 2724993 - RNA, 14 nt, Human
ggcuguuggcuggg

SEQ ID NO: 2724994 - RNA, 15 nt, Human
ggcuguuggcugggg

SEQ ID NO: 2724995 - RNA, 16 nt, Human
ggcuguuggcuggggg

SEQ ID NO: 2724996 - RNA, 20 nt, Human
ggcuguuggcugggggccuc

SEQ ID NO: 2724997 - RNA, 17 nt, Human
ggcaagcaccuccugcc

SEQ ID NO: 2724998 - RNA, 13 nt, Human
ggauucuuaaagu

SEQ ID NO: 2724999 - RNA, 16 nt, Human
ggauucuuccucccuc

SEQ ID NO: 2725000 - RNA, 21 nt, Human
ggauucuuccucccucccucu

SEQ ID NO: 2725001 - RNA, 18 nt, Human
ggcaagcaccuccugccu

SEQ ID NO: 2725002 - RNA, 19 nt, Human
ggcaagcaccuccugccuc

SEQ ID NO: 2725003 - RNA, 17 nt, Human
ggcaccagcagccugga

SEQ ID NO: 2725004 - RNA, 22 nt, Human
ggcagagcagagaccaucccug

SEQ ID NO: 2725005 - RNA, 20 nt, Human
ggcacccaccaucaugucug

SEQ ID NO: 2725006 - RNA, 18 nt, Human
ggcacccggccccugcug

SEQ ID NO: 2725007 - RNA, 19 nt, Human
ggcacccggccccugcugg

SEQ ID NO: 2725008 - RNA, 20 nt, Human
ggcacccggccccugcuggu

SEQ ID NO: 2725009 - RNA, 17 nt, Human
ggcacccggccccugcu

SEQ ID NO: 2725010 - RNA, 18 nt, Human
ggcacucagaagacacug

SEQ ID NO: 2725011 - RNA, 19 nt, Human
ggcacucagaagacacuga

SEQ ID NO: 2725012 - RNA, 17 nt, Human
ggauuagggagagaaga

SEQ ID NO: 2725013 - RNA, 18 nt, Human
ggaugccugguggcagcu

SEQ ID NO: 2725014 - RNA, 19 nt, Human
ggaugccugguggcagcug

SEQ ID NO: 2725015 - RNA, 20 nt, Human
ggaugccugguggcagcugc

SEQ ID NO: 2725016 - RNA, 21 nt, Human
ggaugccugguggcagcugcg

SEQ ID NO: 2725017 - RNA, 18 nt, Human
ggaugcccaaagaugcag

SEQ ID NO: 2725018 - RNA, 19 nt, Human
ggaugcccaaagaugcagc

SEQ ID NO: 2725019 - RNA, 13 nt, Human
ggaugccuggugg

SEQ ID NO: 2725020 - RNA, 17 nt, Human
ggaugccugguggcagc

SEQ ID NO: 2725021 - RNA, 16 nt, Human
ggaugaucuaggaaga

SEQ ID NO: 2725022 - RNA, 18 nt, Human
ggaugaucuaggaagacu

SEQ ID NO: 2725023 - RNA, 22 nt, Human
ggaugaucuaggaagacuuugg

SEQ ID NO: 2725024 - RNA, 23 nt, Human
ggagucccaccuuggcugcaggg

SEQ ID NO: 2725025 - RNA, 11 nt, Human
ggcagcugccu

SEQ ID NO: 2725026 - RNA, 12 nt, Human
ggcagcugccuc

SEQ ID NO: 2725027 - RNA, 13 nt, Human
ggcagcugccucc

SEQ ID NO: 2725028 - RNA, 21 nt, Human
ggcagcugcgguccacccagg

SEQ ID NO: 2725029 - RNA, 17 nt, Human
ggcagaguugaagacag

SEQ ID NO: 2725030 - RNA, 19 nt, Human
ggcagaguugaagacagag

SEQ ID NO: 2725031 - RNA, 21 nt, Human
ggcagaguugaagacagagcu

SEQ ID NO: 2725032 - RNA, 16 nt, Human
ggcagcugccuccccu

SEQ ID NO: 2725033 - RNA, 12 nt, Human
ggcaggguccua

SEQ ID NO: 2725034 - RNA, 23 nt, Human
ggcagcugcgguccacccaggag

SEQ ID NO: 2725035 - RNA, 24 nt, Human
ggcagcugcgguccacccaggagc

SEQ ID NO: 2725036 - RNA, 17 nt, Human
ggcagguuggugggggc

SEQ ID NO: 2725037 - RNA, 17 nt, Human
ggcagggucucacucug

SEQ ID NO: 2725038 - RNA, 18 nt, Human
ggcagggucucacucugu

SEQ ID NO: 2725039 - RNA, 22 nt, Human
ggcaugacacgaauauugcuga

SEQ ID NO: 2725040 - RNA, 18 nt, Human
ggcaugugaugagaggaa

SEQ ID NO: 2725041 - RNA, 23 nt, Human
ggcaugugaugagaggaaaucac

SEQ ID NO: 2725042 - RNA, 11 nt, Human
ggccaggagcc

SEQ ID NO: 2725043 - RNA, 13 nt, Human
ggccaggagccuc

SEQ ID NO: 2725044 - RNA, 14 nt, Human
ggccaggcccucug

SEQ ID NO: 2725045 - RNA, 17 nt, Human
ggccaggcccucugccc

SEQ ID NO: 2725046 - RNA, 15 nt, Human
ggccaggcccucugc

SEQ ID NO: 2725047 - RNA, 16 nt, Human
ggccaggcccucugcc

SEQ ID NO: 2725048 - RNA, 20 nt, Human
ggcauguucucugaggacac

SEQ ID NO: 2725049 - RNA, 22 nt, Human
ggccacagaaaauucuucucca

SEQ ID NO: 2725050 - RNA, 20 nt, Human
ggccacugugaagagaacca

SEQ ID NO: 2725051 - RNA, 16 nt, Human
ggacauuugcucaugg

SEQ ID NO: 2725052 - RNA, 17 nt, Human
ggacauuugcucaugga

SEQ ID NO: 2725053 - RNA, 20 nt, Human
ggacauuugcucauggaauu

SEQ ID NO: 2725054 - RNA, 14 nt, Human
ggaccagagcugcc

SEQ ID NO: 2725055 - RNA, 19 nt, Human
ggaccagagcugccaccug

SEQ ID NO: 2725056 - RNA, 22 nt, Human
ggacagccacggccaggccaga

SEQ ID NO: 2725057 - RNA, 20 nt, Human
ggacagaggggguggccucc

SEQ ID NO: 2725058 - RNA, 11 nt, Human
ggacagcuccu

SEQ ID NO: 2725059 - RNA, 15 nt, Human
ggacagcuccuucug

SEQ ID NO: 2725060 - RNA, 16 nt, Human
ggacagcuccuucugu

SEQ ID NO: 2725061 - RNA, 17 nt, Human
ggacagcuccuucuguc

SEQ ID NO: 2725062 - RNA, 16 nt, Human
ggacagaggggguggc

SEQ ID NO: 2725063 - RNA, 15 nt, Human
ggagaagagcuguuc

SEQ ID NO: 2725064 - RNA, 11 nt, Human
ggagaagaacu

SEQ ID NO: 2725065 - RNA, 14 nt, Human
ggagaagaacugaa

SEQ ID NO: 2725066 - RNA, 23 nt, Human
ggagaagagcuguucacagccag

SEQ ID NO: 2725067 - RNA, 19 nt, Human
ggacugaauuaugaaacuu

SEQ ID NO: 2725068 - RNA, 17 nt, Human
ggacugaauuaugaaac

SEQ ID NO: 2725069 - RNA, 18 nt, Human
ggaccuugaacuggguac

SEQ ID NO: 2725070 - RNA, 22 nt, Human
ggagucccaccuuggcugcagg

SEQ ID NO: 2725071 - RNA, 18 nt, Human
ggaggauguucugggaca

SEQ ID NO: 2725072 - RNA, 21 nt, Human
ggaggauguucugggacacag

SEQ ID NO: 2725073 - RNA, 17 nt, Human
ggagggagggcuccaga

SEQ ID NO: 2725074 - RNA, 13 nt, Human
ggagggagggcuc

SEQ ID NO: 2725075 - RNA, 16 nt, Human
ggagggagggcuccag

SEQ ID NO: 2725076 - RNA, 14 nt, Human
ggagccuccugccc

SEQ ID NO: 2725077 - RNA, 15 nt, Human
ggagccuccugcccu

SEQ ID NO: 2725078 - RNA, 14 nt, Human
ggagcuagaauuug

SEQ ID NO: 2725079 - RNA, 18 nt, Human
ucagagcugcccucuccu

SEQ ID NO: 2725080 - RNA, 19 nt, Human
ucagagcugcccucuccug

SEQ ID NO: 2725081 - RNA, 20 nt, Human
ucagagcugcccucuccugg

SEQ ID NO: 2725082 - RNA, 21 nt, Human
ucagagcugcccucuccuggg

SEQ ID NO: 2725083 - RNA, 22 nt, Human
ucagagcugcccucuccugggc

SEQ ID NO: 2725084 - RNA, 23 nt, Human
ucagagcugcccucuccugggca

SEQ ID NO: 2725085 - RNA, 13 nt, Human
ucagacagcugcc

SEQ ID NO: 2725086 - RNA, 14 nt, Human
ucagacagcugccu

SEQ ID NO: 2725087 - RNA, 16 nt, Human
ucagaauucucuaguu

SEQ ID NO: 2725088 - RNA, 15 nt, Human
ucagaaauguguuau

SEQ ID NO: 2725089 - RNA, 23 nt, Human
ucagaauucucuaguuugauuaa

SEQ ID NO: 2725090 - RNA, 10 nt, Human
ucagaaaugu

SEQ ID NO: 2725091 - RNA, 20 nt, Human
ucacuuguuuuauuuaaccu

SEQ ID NO: 2725092 - RNA, 14 nt, Human
ucacugcuuaacuu

SEQ ID NO: 2725093 - RNA, 13 nt, Human
ucaccagccccag

SEQ ID NO: 2725094 - RNA, 22 nt, Human
ucaccccggccaccugcggugc

SEQ ID NO: 2725095 - RNA, 17 nt, Human
ucacucuuauugcccac

SEQ ID NO: 2725096 - RNA, 22 nt, Human
ucacucugucgcccagucugga

SEQ ID NO: 2725097 - RNA, 18 nt, Human
ucacugccaugccagcuu

SEQ ID NO: 2725098 - RNA, 20 nt, Human
ucacucuuauugcccacgcu

SEQ ID NO: 2725099 - RNA, 17 nt, Human
ucagcuccccucggaga

SEQ ID NO: 2725100 - RNA, 18 nt, Human
ucagcuccccucggagaa

SEQ ID NO: 2725101 - RNA, 15 nt, Human
ucagcugaaccuggg

SEQ ID NO: 2725102 - RNA, 16 nt, Human
ucagcugaaccugggu

SEQ ID NO: 2725103 - RNA, 18 nt, Human
ucagccugcuccagcugu

SEQ ID NO: 2725104 - RNA, 19 nt, Human
ucagccugcuccagcuguu

SEQ ID NO: 2725105 - RNA, 21 nt, Human
ucagccucccgaguagcuggg

SEQ ID NO: 2725106 - RNA, 22 nt, Human
ucagccucccgaguagcuggga

SEQ ID NO: 2725107 - RNA, 15 nt, Human
ucagauaugauucaa

SEQ ID NO: 2725108 - RNA, 20 nt, Human
ucagccucccgaguagcugg

SEQ ID NO: 2725109 - RNA, 18 nt, Human
ucagccucccgaguagcu

SEQ ID NO: 2725110 - RNA, 21 nt, Human
ucagccucccgaauagcuggg

SEQ ID NO: 2725111 - RNA, 22 nt, Human
ucagccucccgaauagcuggga

SEQ ID NO: 2725112 - RNA, 14 nt, Human
ucagccucccaaag

SEQ ID NO: 2725113 - RNA, 19 nt, Human
ucagccucccaaagugcug

SEQ ID NO: 2725114 - RNA, 21 nt, Human
ucagccucccaaagugcuggg

SEQ ID NO: 2725115 - RNA, 13 nt, Human
ucaggcuagaugu

SEQ ID NO: 2725116 - RNA, 17 nt, Human
ucaggcuagauguaugu

SEQ ID NO: 2725117 - RNA, 14 nt, Human
ucagggccuggcuc

SEQ ID NO: 2725118 - RNA, 16 nt, Human
ucagggccuggcucag

SEQ ID NO: 2725119 - RNA, 15 nt, Human
ucaggugagaagcag

SEQ ID NO: 2725120 - RNA, 16 nt, Human
ucaggugagaagcaga

SEQ ID NO: 2725121 - RNA, 19 nt, Human
uccacagaagcuccaggua

SEQ ID NO: 2725122 - RNA, 13 nt, Human
uccaccucccugc

SEQ ID NO: 2725123 - RNA, 14 nt, Human
uccaccucccugca

SEQ ID NO: 2725124 - RNA, 12 nt, Human
uccacccugcuc

SEQ ID NO: 2725125 - RNA, 15 nt, Human
uccaccucccugcaa

SEQ ID NO: 2725126 - RNA, 16 nt, Human
uccaccucccugcaau

SEQ ID NO: 2725127 - RNA, 17 nt, Human
uccaccucccugcaaua

SEQ ID NO: 2725128 - RNA, 17 nt, Human
uccaccugccagggaca

SEQ ID NO: 2725129 - RNA, 15 nt, Human
uccaccugccaggga

SEQ ID NO: 2725130 - RNA, 18 nt, Human
uccaccugccagggacag

SEQ ID NO: 2725131 - RNA, 21 nt, Human
uccaccugccagggacagagg

SEQ ID NO: 2725132 - RNA, 18 nt, Human
uccacaaguuaaauaaau

SEQ ID NO: 2725133 - RNA, 17 nt, Human
uccacaaguuaaauaaa

SEQ ID NO: 2725134 - RNA, 16 nt, Human
uccacaagagcccagg

SEQ ID NO: 2725135 - RNA, 17 nt, Human
uccacaagagcccaggc

SEQ ID NO: 2725136 - RNA, 15 nt, Human
uccacaagagcccag

SEQ ID NO: 2725137 - RNA, 18 nt, Human
uccacaagagcccaggcc

SEQ ID NO: 2725138 - RNA, 18 nt, Human
uccaauuuacauacucug

SEQ ID NO: 2725139 - RNA, 17 nt, Human
uccaauuuacauacucu

SEQ ID NO: 2725140 - RNA, 18 nt, Human
uccaaaauaaaacuuuuu

SEQ ID NO: 2725141 - RNA, 20 nt, Human
uccaaaauaaaacuuuuuaa

SEQ ID NO: 2725142 - RNA, 15 nt, Human
uccaaaauaauuuua

SEQ ID NO: 2725143 - RNA, 19 nt, Human
uccaaaauaauuuuaagaa

SEQ ID NO: 2725144 - RNA, 23 nt, Human
uccagccaaagccuccuccagcc

SEQ ID NO: 2725145 - RNA, 17 nt, Human
uccagcuguucagcugg

SEQ ID NO: 2725146 - RNA, 16 nt, Human
uccaggagcagccaca

SEQ ID NO: 2725147 - RNA, 15 nt, Human
uccagcucaccagcc

SEQ ID NO: 2725148 - RNA, 18 nt, Human
uccagcucaccagcccca

SEQ ID NO: 2725149 - RNA, 16 nt, Human
uccagcucaccagccc

SEQ ID NO: 2725150 - RNA, 17 nt, Human
uccagcucaccagcccc

SEQ ID NO: 2725151 - RNA, 23 nt, Human
uccaggggugggacacccuguga

SEQ ID NO: 2725152 - RNA, 15 nt, Human
uccaggugcacaagc

SEQ ID NO: 2725153 - RNA, 22 nt, Human
uccaggagcagccacauuccug

SEQ ID NO: 2725154 - RNA, 22 nt, Human
uccaggggugggacacccugug

SEQ ID NO: 2725155 - RNA, 17 nt, Human
uccaggagcagccacau

SEQ ID NO: 2725156 - RNA, 18 nt, Human
uccaggagcagccacauu

SEQ ID NO: 2725157 - RNA, 15 nt, Human
uccagguucagcuug

SEQ ID NO: 2725158 - RNA, 16 nt, Human
uccagguucagcuugu

SEQ ID NO: 2725159 - RNA, 18 nt, Human
uccaggugcacaagcucc

SEQ ID NO: 2725160 - RNA, 20 nt, Human
uccaggugcacaagcuccaa

SEQ ID NO: 2725161 - RNA, 21 nt, Human
uccaggugcacaagcuccaag

SEQ ID NO: 2725162 - RNA, 22 nt, Human
uccaggugcacaagcuccaagc

SEQ ID NO: 2725163 - RNA, 18 nt, Human
ucauaccuaucaucuuaa

SEQ ID NO: 2725164 - RNA, 15 nt, Human
ucaggugcugccauc

SEQ ID NO: 2725165 - RNA, 21 nt, Human
ucauacccacccccacccaag

SEQ ID NO: 2725166 - RNA, 21 nt, Human
ucaggugagaagcagaggaag

SEQ ID NO: 2725167 - RNA, 23 nt, Human
ucaggugccucaagagaaggcaa

SEQ ID NO: 2725168 - RNA, 13 nt, Human
ucaggugcugcca

SEQ ID NO: 2725169 - RNA, 14 nt, Human
ucaggugcugccau

SEQ ID NO: 2725170 - RNA, 19 nt, Human
ucaucaccaacgucugugc

SEQ ID NO: 2725171 - RNA, 20 nt, Human
ucaucaccaacgucugugcc

SEQ ID NO: 2725172 - RNA, 21 nt, Human
ucaucaccaacgucugugcca

SEQ ID NO: 2725173 - RNA, 23 nt, Human
ucaucuuagguuggcaaaaaggc

SEQ ID NO: 2725174 - RNA, 17 nt, Human
ucaucugacuaugacau

SEQ ID NO: 2725175 - RNA, 18 nt, Human
ucaucugacuaugacaua

SEQ ID NO: 2725176 - RNA, 13 nt, Human
ucauuaucucaaa

SEQ ID NO: 2725177 - RNA, 20 nt, Human
ucauuaucucaaaacugcac

SEQ ID NO: 2725178 - RNA, 19 nt, Human
ucauuaucucaaaacugca

SEQ ID NO: 2725179 - RNA, 21 nt, Human
ucauucaacccaccugcgucu

SEQ ID NO: 2725180 - RNA, 22 nt, Human
ucauuauuuuauuaugaaacuu

SEQ ID NO: 2725181 - RNA, 23 nt, Human
ucauuauuuuauuaugaaacuug

SEQ ID NO: 2725182 - RNA, 13 nt, Human
ucauuuccaagca

SEQ ID NO: 2725183 - RNA, 16 nt, Human
ucauuuccaagcaagu

SEQ ID NO: 2725184 - RNA, 13 nt, Human
ucauuuccugugu

SEQ ID NO: 2725185 - RNA, 16 nt, Human
ucauuuccugugucuu

SEQ ID NO: 2725186 - RNA, 13 nt, Human
uauguacuucaug

SEQ ID NO: 2725187 - RNA, 17 nt, Human
uauguacuucaugcugu

SEQ ID NO: 2725188 - RNA, 12 nt, Human
uauguaaauccc

SEQ ID NO: 2725189 - RNA, 23 nt, Human
uauguaaaucccauuauucaaag

SEQ ID NO: 2725190 - RNA, 21 nt, Human
uauguaaaucccauuauucaa

SEQ ID NO: 2725191 - RNA, 20 nt, Human
uauguaaaucccauuauuca

SEQ ID NO: 2725192 - RNA, 19 nt, Human
uauguaaaucccauuauuc

SEQ ID NO: 2725193 - RNA, 15 nt, Human
uauguaaaucccauu

SEQ ID NO: 2725194 - RNA, 13 nt, Human
gggaguggccaca

SEQ ID NO: 2725195 - RNA, 15 nt, Human
gggaguggccacaga

SEQ ID NO: 2725196 - RNA, 20 nt, Human
uauguugcccaggcaggucu

SEQ ID NO: 2725197 - RNA, 16 nt, Human
uauguuucaaacuuug

SEQ ID NO: 2725198 - RNA, 13 nt, Human
uauguuucaaacu

SEQ ID NO: 2725199 - RNA, 15 nt, Human
uauguuucaaacuuu

SEQ ID NO: 2725200 - RNA, 13 nt, Human
uauguugcccagg

SEQ ID NO: 2725201 - RNA, 16 nt, Human
uauguugcccaggcag

SEQ ID NO: 2725202 - RNA, 19 nt, Human
uauguugcccaggcagguc

SEQ ID NO: 2725203 - RNA, 24 nt, Human
uauuaagaaagacuaucuaaaugu

SEQ ID NO: 2725204 - RNA, 12 nt, Human
uauuaaauuaug

SEQ ID NO: 2725205 - RNA, 12 nt, Human
uauuaauauauu

SEQ ID NO: 2725206 - RNA, 16 nt, Human
uauuauucccauucua

SEQ ID NO: 2725207 - RNA, 13 nt, Human
uauuacaguauaa

SEQ ID NO: 2725208 - RNA, 12 nt, Human
uauuacaguaua

SEQ ID NO: 2725209 - RNA, 19 nt, Human
uauucuagcuaauguaaua

SEQ ID NO: 2725210 - RNA, 20 nt, Human
uauucuaaauuuuauaucuu

SEQ ID NO: 2725211 - RNA, 15 nt, Human
uauucuaaauuuuau

SEQ ID NO: 2725212 - RNA, 19 nt, Human
uauucuaaauuuuauaucu

SEQ ID NO: 2725213 - RNA, 14 nt, Human
uauucuaaauuuua

SEQ ID NO: 2725214 - RNA, 21 nt, Human
uauugauaugcuuauacacuu

SEQ ID NO: 2725215 - RNA, 17 nt, Human
uauucucuccuguaccu

SEQ ID NO: 2725216 - RNA, 22 nt, Human
uauuggaaauuuguuauaauga

SEQ ID NO: 2725217 - RNA, 17 nt, Human
uauugcugauggugcaa

SEQ ID NO: 2725218 - RNA, 14 nt, Human
uauuguguugugaa

SEQ ID NO: 2725219 - RNA, 22 nt, Human
uauuguuuucaguguacaugga

SEQ ID NO: 2725220 - RNA, 20 nt, Human
uauuguuuucaguguacaug

SEQ ID NO: 2725221 - RNA, 18 nt, Human
uauuguuuucaguguaca

SEQ ID NO: 2725222 - RNA, 12 nt, Human
uauuguuuucag

SEQ ID NO: 2725223 - RNA, 14 nt, Human
ucaaauugugugaa

SEQ ID NO: 2725224 - RNA, 23 nt, Human
ucaaccccuucgcuccugugucu

SEQ ID NO: 2725225 - RNA, 20 nt, Human
ucaaaucaagaaacuuaagg

SEQ ID NO: 2725226 - RNA, 14 nt, Human
ucaaauaugcaaag

SEQ ID NO: 2725227 - RNA, 17 nt, Human
uauuuuuuucuuuucuu

SEQ ID NO: 2725228 - RNA, 14 nt, Human
uauuuuuuuacuaa

SEQ ID NO: 2725229 - RNA, 14 nt, Human
ucaaaaaaagaaaa

SEQ ID NO: 2725230 - RNA, 15 nt, Human
ucaaaaaaagaaaaa

SEQ ID NO: 2725231 - RNA, 22 nt, Human
uauuuucccuauuagagaagag

SEQ ID NO: 2725232 - RNA, 17 nt, Human
uauuuuauuaugcauga

SEQ ID NO: 2725233 - RNA, 14 nt, Human
uauuuuauuaugca

SEQ ID NO: 2725234 - RNA, 15 nt, Human
uauuuucauucuccu

SEQ ID NO: 2725235 - RNA, 13 nt, Human
uauuuuauuauga

SEQ ID NO: 2725236 - RNA, 23 nt, Human
uauuuuauuaugaaacuugugua

SEQ ID NO: 2725237 - RNA, 18 nt, Human
uauuuuauuaugaaacuu

SEQ ID NO: 2725238 - RNA, 21 nt, Human
ucaauaaaauccauacauuug

SEQ ID NO: 2725239 - RNA, 21 nt, Human
ucaagugauucuccugccuca

SEQ ID NO: 2725240 - RNA, 18 nt, Human
ucaagugauucuccugcc

SEQ ID NO: 2725241 - RNA, 20 nt, Human
ucaagugauucuccugccuc

SEQ ID NO: 2725242 - RNA, 21 nt, Human
ucaauuacaggaaguacugga

SEQ ID NO: 2725243 - RNA, 23 nt, Human
ucaauuacaggaaguacuggaga

SEQ ID NO: 2725244 - RNA, 20 nt, Human
ucaaugccccugaauuuaaa

SEQ ID NO: 2725245 - RNA, 18 nt, Human
ucaaugccccugaauuua

SEQ ID NO: 2725246 - RNA, 17 nt, Human
ucaaugccccugaauuu

SEQ ID NO: 2725247 - RNA, 20 nt, Human
ucaauuacaggaaguacugg

SEQ ID NO: 2725248 - RNA, 19 nt, Human
ucacaguccuuaccagcag

SEQ ID NO: 2725249 - RNA, 22 nt, Human
ucacaguccuuaccagcagagc

SEQ ID NO: 2725250 - RNA, 23 nt, Human
ucacaguccuuaccagcagagca

SEQ ID NO: 2725251 - RNA, 16 nt, Human
ucacaggcagguccag

SEQ ID NO: 2725252 - RNA, 17 nt, Human
ucacaggcagguccagg

SEQ ID NO: 2725253 - RNA, 18 nt, Human
ucacaggcagguccaggg

SEQ ID NO: 2725254 - RNA, 20 nt, Human
ucaccaaaucagcugcuacu

SEQ ID NO: 2725255 - RNA, 19 nt, Human
ucaccaaaucagcugcuac

SEQ ID NO: 2725256 - RNA, 17 nt, Human
ucacauuuauucugcuc

SEQ ID NO: 2725257 - RNA, 18 nt, Human
ucacauuuauucugcuca

SEQ ID NO: 2725258 - RNA, 19 nt, Human
ucacauuuauucugcucac

SEQ ID NO: 2725259 - RNA, 16 nt, Human
uccuuggacucauuuu

SEQ ID NO: 2725260 - RNA, 23 nt, Human
uccuuuucacaguucucuccuuc

SEQ ID NO: 2725261 - RNA, 21 nt, Human
uccuucaccuuuguccccacc

SEQ ID NO: 2725262 - RNA, 22 nt, Human
uccuucaccuuuguccccaccg

SEQ ID NO: 2725263 - RNA, 19 nt, Human
uccuucacagaugggugcu

SEQ ID NO: 2725264 - RNA, 18 nt, Human
uccuucaccuuugucccc

SEQ ID NO: 2725265 - RNA, 20 nt, Human
uccuucaccuuuguccccac

SEQ ID NO: 2725266 - RNA, 16 nt, Human
uccuuaccagcagagc

SEQ ID NO: 2725267 - RNA, 17 nt, Human
uccuuaccagcagagca

SEQ ID NO: 2725268 - RNA, 18 nt, Human
uccuuaccagcagagcac

SEQ ID NO: 2725269 - RNA, 18 nt, Human
uccuucacagaugggugc

SEQ ID NO: 2725270 - RNA, 14 nt, Human
uccuuaccagcaga

SEQ ID NO: 2725271 - RNA, 20 nt, Human
uccuguaccucuugagccuu

SEQ ID NO: 2725272 - RNA, 18 nt, Human
uccuggcacugcuuccag

SEQ ID NO: 2725273 - RNA, 22 nt, Human
uccuggcacugcuuccagugag

SEQ ID NO: 2725274 - RNA, 20 nt, Human
uccuggcacccggccccugc

SEQ ID NO: 2725275 - RNA, 21 nt, Human
uccuggcacccggccccugcu

SEQ ID NO: 2725276 - RNA, 22 nt, Human
uccuggcacccggccccugcug

SEQ ID NO: 2725277 - RNA, 17 nt, Human
uccuggcacugcuucca

SEQ ID NO: 2725278 - RNA, 14 nt, Human
uccugagccagauu

SEQ ID NO: 2725279 - RNA, 14 nt, Human
uccugccucagccu

SEQ ID NO: 2725280 - RNA, 13 nt, Human
uccugagccagau

SEQ ID NO: 2725281 - RNA, 17 nt, Human
uccuggcaauagucaaa

SEQ ID NO: 2725282 - RNA, 14 nt, Human
uccuggcacccggc

SEQ ID NO: 2725283 - RNA, 16 nt, Human
uccuggcacccggccc

SEQ ID NO: 2725284 - RNA, 19 nt, Human
uccuggcacccggccccug

SEQ ID NO: 2725285 - RNA, 17 nt, Human
uccugccucagccuccc

SEQ ID NO: 2725286 - RNA, 16 nt, Human
uccugccucagccucc

SEQ ID NO: 2725287 - RNA, 13 nt, Human
uccugccucagcc

SEQ ID NO: 2725288 - RNA, 15 nt, Human
uccugccucagccuc

SEQ ID NO: 2725289 - RNA, 13 nt, Human
ucguuaauuugua

SEQ ID NO: 2725290 - RNA, 21 nt, Human
ucuaaaucuccaaaauaaaac

SEQ ID NO: 2725291 - RNA, 16 nt, Human
ucgugauugauaagaa

SEQ ID NO: 2725292 - RNA, 21 nt, Human
ucguggaacaguuaccucugc

SEQ ID NO: 2725293 - RNA, 22 nt, Human
ucgugggacagucaccucaugg

SEQ ID NO: 2725294 - RNA, 13 nt, Human
ucuaugaaauauu

SEQ ID NO: 2725295 - RNA, 14 nt, Human
ucuaugaaauauua

SEQ ID NO: 2725296 - RNA, 17 nt, Human
ucuaugaaauauuaugu

SEQ ID NO: 2725297 - RNA, 15 nt, Human
ucuaucaaguauuau

SEQ ID NO: 2725298 - RNA, 22 nt, Human
ucuaucaaguauuauaccuuuu

SEQ ID NO: 2725299 - RNA, 21 nt, Human
ucuaucaaguauuauaccuuu

SEQ ID NO: 2725300 - RNA, 15 nt, Human
ucucaacuccaaacu

SEQ ID NO: 2725301 - RNA, 17 nt, Human
ucucaaauaacuaaaag

SEQ ID NO: 2725302 - RNA, 20 nt, Human
ucuaugcugaguuugugcug

SEQ ID NO: 2725303 - RNA, 16 nt, Human
ucuaugcugaguuugu

SEQ ID NO: 2725304 - RNA, 19 nt, Human
ucuagugagcagucaggaa

SEQ ID NO: 2725305 - RNA, 22 nt, Human
ucuagugagcagucaggaaaga

SEQ ID NO: 2725306 - RNA, 16 nt, Human
ucuaggacugaauuau

SEQ ID NO: 2725307 - RNA, 23 nt, Human
ucuaggacugaauuaugaaacuu

SEQ ID NO: 2725308 - RNA, 14 nt, Human
ucuaauauguaaca

SEQ ID NO: 2725309 - RNA, 20 nt, Human
uccucugcuugccaucccuc

SEQ ID NO: 2725310 - RNA, 19 nt, Human
uccucugcuugccaucccu

SEQ ID NO: 2725311 - RNA, 21 nt, Human
uccucugcuugccaucccucc

SEQ ID NO: 2725312 - RNA, 22 nt, Human
uccucugcuugccaucccuccc

SEQ ID NO: 2725313 - RNA, 12 nt, Human
uccucugcugcu

SEQ ID NO: 2725314 - RNA, 14 nt, Human
uccucugcugcugg

SEQ ID NO: 2725315 - RNA, 15 nt, Human
uccucugcugcuggc

SEQ ID NO: 2725316 - RNA, 16 nt, Human
uccucugcugcuggcu

SEQ ID NO: 2725317 - RNA, 16 nt, Human
uccucuguacagagcc

SEQ ID NO: 2725318 - RNA, 17 nt, Human
uccucuguacagagccc

SEQ ID NO: 2725319 - RNA, 18 nt, Human
uccucuguacagagccca

SEQ ID NO: 2725320 - RNA, 15 nt, Human
uccucuguacagagc

SEQ ID NO: 2725321 - RNA, 19 nt, Human
uccuccuuuucacaguucu

SEQ ID NO: 2725322 - RNA, 14 nt, Human
uccucuaggagguc

SEQ ID NO: 2725323 - RNA, 18 nt, Human
uccuacccacccuccuuu

SEQ ID NO: 2725324 - RNA, 13 nt, Human
uccgaccagacac

SEQ ID NO: 2725325 - RNA, 17 nt, Human
uccgaccagacaccuug

SEQ ID NO: 2725326 - RNA, 16 nt, Human
uccuaaucuucugaac

SEQ ID NO: 2725327 - RNA, 17 nt, Human
uccucauuagcauuuug

SEQ ID NO: 2725328 - RNA, 22 nt, Human
uccuaguuccaccaucaagcca

SEQ ID NO: 2725329 - RNA, 18 nt, Human
uccuauauuguuuucagu

SEQ ID NO: 2725330 - RNA, 15 nt, Human
ucccuugaugaagaa

SEQ ID NO: 2725331 - RNA, 16 nt, Human
ucccuugaugaagaag

SEQ ID NO: 2725332 - RNA, 13 nt, Human
ucccuucccaccu

SEQ ID NO: 2725333 - RNA, 16 nt, Human
ucccugcaauaaaaug

SEQ ID NO: 2725334 - RNA, 13 nt, Human
ucccugcacuugc

SEQ ID NO: 2725335 - RNA, 14 nt, Human
ucccugcacuugca

SEQ ID NO: 2725336 - RNA, 16 nt, Human
ucccuauuagagaaga

SEQ ID NO: 2725337 - RNA, 21 nt, Human
uccccuguuuguuucugaaag

SEQ ID NO: 2725338 - RNA, 17 nt, Human
uccagguuuaagcuguu

SEQ ID NO: 2725339 - RNA, 18 nt, Human
uccagguuuaagcuguua

SEQ ID NO: 2725340 - RNA, 18 nt, Human
uccccuguuuguuucuga

SEQ ID NO: 2725341 - RNA, 20 nt, Human
uccccuguuuguuucugaaa

SEQ ID NO: 2725342 - RNA, 14 nt, Human
ucucugaggacacu

SEQ ID NO: 2725343 - RNA, 17 nt, Human
ucucugaggacacuaac

SEQ ID NO: 2725344 - RNA, 15 nt, Human
ucucugauacagaaa

SEQ ID NO: 2725345 - RNA, 16 nt, Human
ucucuaguuugauuaa

SEQ ID NO: 2725346 - RNA, 15 nt, Human
ucucuaguuugauua

SEQ ID NO: 2725347 - RNA, 17 nt, Human
ucuccugccucagccuc

SEQ ID NO: 2725348 - RNA, 15 nt, Human
ucuccugccucagcc

SEQ ID NO: 2725349 - RNA, 15 nt, Human
ucuccuguaccucuu

SEQ ID NO: 2725350 - RNA, 21 nt, Human
ucuccuggaaauauuaagaaa

SEQ ID NO: 2725351 - RNA, 19 nt, Human
ucucuaacuucaccauauu

SEQ ID NO: 2725352 - RNA, 12 nt, Human
ucucuaacuuca

SEQ ID NO: 2725353 - RNA, 14 nt, Human
ucucgugauugaua

SEQ ID NO: 2725354 - RNA, 22 nt, Human
ucucgugauugauaagaaccuu

SEQ ID NO: 2725355 - RNA, 17 nt, Human
ucuccuguaccucuuga

SEQ ID NO: 2725356 - RNA, 16 nt, Human
ucuccuguaccucuug

SEQ ID NO: 2725357 - RNA, 14 nt, Human
ucugcaucagcugc

SEQ ID NO: 2725358 - RNA, 21 nt, Human
ucugcaucagcugcugaaaca

SEQ ID NO: 2725359 - RNA, 19 nt, Human
ucugcaucagcugcugaaa

SEQ ID NO: 2725360 - RNA, 20 nt, Human
ucugcaagaauugaagcagg

SEQ ID NO: 2725361 - RNA, 21 nt, Human
ucugcaagaauugaagcagga

SEQ ID NO: 2725362 - RNA, 15 nt, Human
ucugcaacucugaag

SEQ ID NO: 2725363 - RNA, 14 nt, Human
ucugcaacucugaa

SEQ ID NO: 2725364 - RNA, 14 nt, Human
ucugacccacugcu

SEQ ID NO: 2725365 - RNA, 15 nt, Human
ucugacccacugcuu

SEQ ID NO: 2725366 - RNA, 23 nt, Human
ucugaggaauccagacccggcug

SEQ ID NO: 2725367 - RNA, 14 nt, Human
ucugaggaauucug

SEQ ID NO: 2725368 - RNA, 18 nt, Human
ucugaggaauucuguaua

SEQ ID NO: 2725369 - RNA, 17 nt, Human
ucugaggaauucuguau

SEQ ID NO: 2725370 - RNA, 16 nt, Human
ucugaggaauucugua

SEQ ID NO: 2725371 - RNA, 15 nt, Human
ucugaggaauucugu

SEQ ID NO: 2725372 - RNA, 13 nt, Human
ucugaaaauguau

SEQ ID NO: 2725373 - RNA, 20 nt, Human
ucugaaauuuccugggagcu

SEQ ID NO: 2725374 - RNA, 18 nt, Human
ucugaaauuuccugggag

SEQ ID NO: 2725375 - RNA, 17 nt, Human
ucugaaauuuccuggga

SEQ ID NO: 2725376 - RNA, 16 nt, Human
ucugacacacagcucu

SEQ ID NO: 2725377 - RNA, 17 nt, Human
ucugacacacagcucug

SEQ ID NO: 2725378 - RNA, 18 nt, Human
ucugacacacagcucugu

SEQ ID NO: 2725379 - RNA, 19 nt, Human
ucugacacacagcucuguc

SEQ ID NO: 2725380 - RNA, 12 nt, Human
ucugacaggcaa

SEQ ID NO: 2725381 - RNA, 21 nt, Human
ucugacaggcaaugcuggcug

SEQ ID NO: 2725382 - RNA, 22 nt, Human
ucugacaggcaaugcuggcugu

SEQ ID NO: 2725383 - RNA, 13 nt, Human
ucugacccacugc

SEQ ID NO: 2725384 - RNA, 15 nt, Human
ucugucuucacaaca

SEQ ID NO: 2725385 - RNA, 12 nt, Human
ucuuaaaguuga

SEQ ID NO: 2725386 - RNA, 14 nt, Human
ucuuaaaguugaau

SEQ ID NO: 2725387 - RNA, 13 nt, Human
ucuuaaaguugaa

SEQ ID NO: 2725388 - RNA, 18 nt, Human
ucuuaagaagacugcauu

SEQ ID NO: 2725389 - RNA, 12 nt, Human
ucuuaagaagac

SEQ ID NO: 2725390 - RNA, 22 nt, Human
ucuuaaaguugaauuuauuggc

SEQ ID NO: 2725391 - RNA, 21 nt, Human
ucuuaaaguugaauuuauugg

SEQ ID NO: 2725392 - RNA, 20 nt, Human
ucuuaaaguugaauuuauug

SEQ ID NO: 2725393 - RNA, 19 nt, Human
ucuuaaaguugaauuuauu

SEQ ID NO: 2725394 - RNA, 16 nt, Human
ucuuaaaguugaauuu

SEQ ID NO: 2725395 - RNA, 22 nt, Human
ucuuaaauauguggaguucauc

SEQ ID NO: 2725396 - RNA, 19 nt, Human
ucuucaucugacuaugaca

SEQ ID NO: 2725397 - RNA, 22 nt, Human
ucuucagcaaaaauauuuuaug

SEQ ID NO: 2725398 - RNA, 21 nt, Human
ucuucagcaaaaauauuuuau

SEQ ID NO: 2725399 - RNA, 23 nt, Human
ucuucagcaaaaauauuuuauga

SEQ ID NO: 2725400 - RNA, 15 nt, Human
ucuucagaucucuaa

SEQ ID NO: 2725401 - RNA, 23 nt, Human
ucuucagaucucuaacuucacca

SEQ ID NO: 2725402 - RNA, 18 nt, Human
ucuucagaucucuaacuu

SEQ ID NO: 2725403 - RNA, 12 nt, Human
ucuugaacuccu

SEQ ID NO: 2725404 - RNA, 17 nt, Human
ucuggcuaugcauuuga

SEQ ID NO: 2725405 - RNA, 22 nt, Human
ucuggcuaugcauuugaaaauu

SEQ ID NO: 2725406 - RNA, 19 nt, Human
ucuggcuaugcauuugaaa

SEQ ID NO: 2725407 - RNA, 23 nt, Human
ucuggugacuuuccucuuugguc

SEQ ID NO: 2725408 - RNA, 14 nt, Human
ucugggacacaguu

SEQ ID NO: 2725409 - RNA, 18 nt, Human
ucuggcucuuccaggcug

SEQ ID NO: 2725410 - RNA, 23 nt, Human
ucuggcucuuccaggcugggaga

SEQ ID NO: 2725411 - RNA, 14 nt, Human
ucuguccuacucug

SEQ ID NO: 2725412 - RNA, 16 nt, Human
ucugucgcccagucug

SEQ ID NO: 2725413 - RNA, 14 nt, Human
ucugucgcccaguc

SEQ ID NO: 2725414 - RNA, 21 nt, Human
ucuguccugggagugagcugg

SEQ ID NO: 2725415 - RNA, 15 nt, Human
ucuguccuacucugu

SEQ ID NO: 2725416 - RNA, 19 nt, Human
ucuguccuacucuguguca

SEQ ID NO: 2725417 - RNA, 15 nt, Human
ucugccugcccaggc

SEQ ID NO: 2725418 - RNA, 16 nt, Human
ucugccugcccaggcc

SEQ ID NO: 2725419 - RNA, 18 nt, Human
ucugcuccucuccccagc

SEQ ID NO: 2725420 - RNA, 21 nt, Human
ucugcuccucuccccagcaag

SEQ ID NO: 2725421 - RNA, 18 nt, Human
ucugcugacagacacagg

SEQ ID NO: 2725422 - RNA, 17 nt, Human
ucugcugacagacacag

SEQ ID NO: 2725423 - RNA, 14 nt, Human
ucugccugcccagg

SEQ ID NO: 2725424 - RNA, 13 nt, Human
ucugccugcccag

SEQ ID NO: 2725425 - RNA, 21 nt, Human
ucuggacaggcauguucucug

SEQ ID NO: 2725426 - RNA, 16 nt, Human
ucuggaaugcaguggu

SEQ ID NO: 2725427 - RNA, 14 nt, Human
ucuggacaggcaug

SEQ ID NO: 2725428 - RNA, 15 nt, Human
ucuggaaugcagugg

SEQ ID NO: 2725429 - RNA, 19 nt, Human
ucuggaauaaggagaauga

SEQ ID NO: 2725430 - RNA, 19 nt, Human
ucugcugacagacacaggc

SEQ ID NO: 2725431 - RNA, 20 nt, Human
ucugcugacagacacaggcc

SEQ ID NO: 2725432 - RNA, 21 nt, Human
ucugcugacagacacaggccc

SEQ ID NO: 2725433 - RNA, 22 nt, Human
ucugcugacagacacaggcccg

SEQ ID NO: 2725434 - RNA, 16 nt, Human
ugguuuucuguucuuu

SEQ ID NO: 2725435 - RNA, 19 nt, Human
ugguuuucuuguguguuua

SEQ ID NO: 2725436 - RNA, 21 nt, Human
ugguuuuuaaaaaacugcuga

SEQ ID NO: 2725437 - RNA, 23 nt, Human
ugguuuuuaaaaaacugcugacu

SEQ ID NO: 2725438 - RNA, 17 nt, Human
uguaacaagccacccca

SEQ ID NO: 2725439 - RNA, 14 nt, Human
uguaacaagccacc

SEQ ID NO: 2725440 - RNA, 14 nt, Human
uguaauaacuguga

SEQ ID NO: 2725441 - RNA, 22 nt, Human
uguaauaacugugaaguuuaca

SEQ ID NO: 2725442 - RNA, 15 nt, Human
uguacaaaguauuaa

SEQ ID NO: 2725443 - RNA, 20 nt, Human
uguacaaaguauuaagcaua

SEQ ID NO: 2725444 - RNA, 19 nt, Human
uguacaaaguauuaagcau

SEQ ID NO: 2725445 - RNA, 18 nt, Human
uguacaaaguauuaagca

SEQ ID NO: 2725446 - RNA, 17 nt, Human
uguacaaaguauuaagc

SEQ ID NO: 2725447 - RNA, 14 nt, Human
uguacagacaacaa

SEQ ID NO: 2725448 - RNA, 11 nt, Human
uguacagagcc

SEQ ID NO: 2725449 - RNA, 21 nt, Human
uguacaaaguauuaagcauau

SEQ ID NO: 2725450 - RNA, 16 nt, Human
ugguucccuugaugaa

SEQ ID NO: 2725451 - RNA, 17 nt, Human
ugguucccuugaugaag

SEQ ID NO: 2725452 - RNA, 20 nt, Human
ugguucccuugaugaagaag

SEQ ID NO: 2725453 - RNA, 18 nt, Human
ugguugaugaucuuugca

SEQ ID NO: 2725454 - RNA, 16 nt, Human
uggugucaccugaaga

SEQ ID NO: 2725455 - RNA, 15 nt, Human
uggugucgggcauga

SEQ ID NO: 2725456 - RNA, 18 nt, Human
uggugucgggcaugacac

SEQ ID NO: 2725457 - RNA, 19 nt, Human
uggugucgggcaugacacg

SEQ ID NO: 2725458 - RNA, 14 nt, Human
uggguagacacaca

SEQ ID NO: 2725459 - RNA, 15 nt, Human
uggugacuuuggaua

SEQ ID NO: 2725460 - RNA, 20 nt, Human
uggguacuuguggacacagc

SEQ ID NO: 2725461 - RNA, 23 nt, Human
uggguacuuguggacacagcucu

SEQ ID NO: 2725462 - RNA, 14 nt, Human
uggugagaggcauc

SEQ ID NO: 2725463 - RNA, 23 nt, Human
uggugacuuuggauaauaaggaa

SEQ ID NO: 2725464 - RNA, 19 nt, Human
uggugacuuuggauaauaa

SEQ ID NO: 2725465 - RNA, 18 nt, Human
uggugacuuuggauaaua

SEQ ID NO: 2725466 - RNA, 16 nt, Human
uggugacuuuggauaa

SEQ ID NO: 2725467 - RNA, 14 nt, Human
uggugcaaugaccu

SEQ ID NO: 2725468 - RNA, 19 nt, Human
uggugcaaugaccuuucaa

SEQ ID NO: 2725469 - RNA, 12 nt, Human
ugguggcagugg

SEQ ID NO: 2725470 - RNA, 20 nt, Human
ugguggcagugggagcugcc

SEQ ID NO: 2725471 - RNA, 13 nt, Human
ugguggcaguggg

SEQ ID NO: 2725472 - RNA, 18 nt, Human
ugguggcagugggagcug

SEQ ID NO: 2725473 - RNA, 19 nt, Human
uggugguuuucuguucuuu

SEQ ID NO: 2725474 - RNA, 18 nt, Human
uggugguuucagaaaugu

SEQ ID NO: 2725475 - RNA, 17 nt, Human
uggugguuucagaaaug

SEQ ID NO: 2725476 - RNA, 16 nt, Human
uggugggggccucggu

SEQ ID NO: 2725477 - RNA, 18 nt, Human
uggugggggccucggugu

SEQ ID NO: 2725478 - RNA, 13 nt, Human
ugguggcuggguu

SEQ ID NO: 2725479 - RNA, 22 nt, Human
ugucuacacuaagagagaauga

SEQ ID NO: 2725480 - RNA, 18 nt, Human
ugucuacaccauuaugug

SEQ ID NO: 2725481 - RNA, 17 nt, Human
ugucuacacuaagagag

SEQ ID NO: 2725482 - RNA, 17 nt, Human
ugucuacaccauuaugu

SEQ ID NO: 2725483 - RNA, 14 nt, Human
ugucuaaugaaacc

SEQ ID NO: 2725484 - RNA, 12 nt, Human
uguccugggagu

SEQ ID NO: 2725485 - RNA, 19 nt, Human
uguccugggagugagcugg

SEQ ID NO: 2725486 - RNA, 20 nt, Human
uguccugggagugagcuggu

SEQ ID NO: 2725487 - RNA, 17 nt, Human
uguccccgcacugggcu

SEQ ID NO: 2725488 - RNA, 19 nt, Human
uguccccgcacugggcuug

SEQ ID NO: 2725489 - RNA, 12 nt, Human
ugucuuaauuaa

SEQ ID NO: 2725490 - RNA, 23 nt, Human
ugucuuuggacccugaggcccag

SEQ ID NO: 2725491 - RNA, 16 nt, Human
ugucuuuucuugcaug

SEQ ID NO: 2725492 - RNA, 21 nt, Human
ugucucaaaaaaagaaaaaga

SEQ ID NO: 2725493 - RNA, 20 nt, Human
ugucucagauuuuauuaugu

SEQ ID NO: 2725494 - RNA, 16 nt, Human
ugucucagauuuuauu

SEQ ID NO: 2725495 - RNA, 22 nt, Human
ugucucagauuuuauuauguaa

SEQ ID NO: 2725496 - RNA, 14 nt, Human
ugucuaugggacuc

SEQ ID NO: 2725497 - RNA, 15 nt, Human
ugucuaugggacuca

SEQ ID NO: 2725498 - RNA, 16 nt, Human
ugucuaugggacucaa

SEQ ID NO: 2725499 - RNA, 15 nt, Human
ugucuaguuguuuga

SEQ ID NO: 2725500 - RNA, 23 nt, Human
ugucuaguuguuugauucagaca

SEQ ID NO: 2725501 - RNA, 19 nt, Human
uguaguguuggagaagaac

SEQ ID NO: 2725502 - RNA, 20 nt, Human
uguaguguuggagaagaacu

SEQ ID NO: 2725503 - RNA, 21 nt, Human
uguaguguuggagaagaacug

SEQ ID NO: 2725504 - RNA, 13 nt, Human
uguauaaaauaau

SEQ ID NO: 2725505 - RNA, 14 nt, Human
uguauaaaauaauu

SEQ ID NO: 2725506 - RNA, 23 nt, Human
uguacagcaaggagauuuacaac

SEQ ID NO: 2725507 - RNA, 14 nt, Human
uguagcuuuaucaa

SEQ ID NO: 2725508 - RNA, 15 nt, Human
uguagcuuuaucaaa

SEQ ID NO: 2725509 - RNA, 22 nt, Human
uguacagcaaggagauuuacaa

SEQ ID NO: 2725510 - RNA, 21 nt, Human
uguacagagcccacgccccca

SEQ ID NO: 2725511 - RNA, 12 nt, Human
uguacagagccc

SEQ ID NO: 2725512 - RNA, 23 nt, Human
uguauagauuagagaguguugaa

SEQ ID NO: 2725513 - RNA, 23 nt, Human
uguauagaaccucuuugucuaca

SEQ ID NO: 2725514 - RNA, 21 nt, Human
uguauagauuagaauucugua

SEQ ID NO: 2725515 - RNA, 15 nt, Human
uguauagauuagaau

SEQ ID NO: 2725516 - RNA, 13 nt, Human
uguaucugagcag

SEQ ID NO: 2725517 - RNA, 18 nt, Human
uguauuuuaaaagaauga

SEQ ID NO: 2725518 - RNA, 19 nt, Human
uguauuuuaaaagaaugau

SEQ ID NO: 2725519 - RNA, 21 nt, Human
ugucaauuacaggaaguacug

SEQ ID NO: 2725520 - RNA, 13 nt, Human
ugucacacacuuu

SEQ ID NO: 2725521 - RNA, 14 nt, Human
ugucacaggcaggu

SEQ ID NO: 2725522 - RNA, 13 nt, Human
ugucacaggcagg

SEQ ID NO: 2725523 - RNA, 15 nt, Human
ugucacaggcagguc

SEQ ID NO: 2725524 - RNA, 16 nt, Human
ugucacaggcaggucc

SEQ ID NO: 2725525 - RNA, 17 nt, Human
ugucacaggcaggucca

SEQ ID NO: 2725526 - RNA, 21 nt, Human
ugucacaggcagguccagggu

SEQ ID NO: 2725527 - RNA, 15 nt, Human
ugucagugugacuga

SEQ ID NO: 2725528 - RNA, 14 nt, Human
ugucagugugacug

SEQ ID NO: 2725529 - RNA, 16 nt, Human
ugucagugugacugau

SEQ ID NO: 2725530 - RNA, 19 nt, Human
ugucagugugacugaucuc

SEQ ID NO: 2725531 - RNA, 17 nt, Human
ugcuucuguuuuauaau

SEQ ID NO: 2725532 - RNA, 12 nt, Human
ugcuucucacug

SEQ ID NO: 2725533 - RNA, 23 nt, Human
ugcuuccagugaggcucugcccu

SEQ ID NO: 2725534 - RNA, 21 nt, Human
ugcuuccagugaggcucugcc

SEQ ID NO: 2725535 - RNA, 22 nt, Human
ugcuuccagugaggcucugccc

SEQ ID NO: 2725536 - RNA, 19 nt, Human
ugcuuaacuucacauauug

SEQ ID NO: 2725537 - RNA, 18 nt, Human
ugcuuaacuucacauauu

SEQ ID NO: 2725538 - RNA, 17 nt, Human
ugcuuaacuucacauau

SEQ ID NO: 2725539 - RNA, 14 nt, Human
ugcuuaacuucaca

SEQ ID NO: 2725540 - RNA, 13 nt, Human
ugcuuaacuucac

SEQ ID NO: 2725541 - RNA, 15 nt, Human
uggaacacucugaga

SEQ ID NO: 2725542 - RNA, 17 nt, Human
uggaacacucugagacu

SEQ ID NO: 2725543 - RNA, 17 nt, Human
uggaacgcguugaaauu

SEQ ID NO: 2725544 - RNA, 16 nt, Human
uggaacgcguugaaau

SEQ ID NO: 2725545 - RNA, 15 nt, Human
uggaacgcguugaaa

SEQ ID NO: 2725546 - RNA, 14 nt, Human
uggaacgcguugaa

SEQ ID NO: 2725547 - RNA, 22 nt, Human
ugcuucuguuuuauaauuuugu

SEQ ID NO: 2725548 - RNA, 13 nt, Human
ugcuucuucagag

SEQ ID NO: 2725549 - RNA, 12 nt, Human
ugcuuguguuaa

SEQ ID NO: 2725550 - RNA, 18 nt, Human
ugcuugugaaaggaaaga

SEQ ID NO: 2725551 - RNA, 15 nt, Human
ugcuuguguuaagua

SEQ ID NO: 2725552 - RNA, 17 nt, Human
uggagacacaacuauuu

SEQ ID NO: 2725553 - RNA, 19 nt, Human
uggacguguuaugacucca

SEQ ID NO: 2725554 - RNA, 23 nt, Human
uggacguguuaugacuccagaau

SEQ ID NO: 2725555 - RNA, 19 nt, Human
uggacuaacuugucuuugg

SEQ ID NO: 2725556 - RNA, 20 nt, Human
uggacuaacuugucuuugga

SEQ ID NO: 2725557 - RNA, 18 nt, Human
uggacaggcauguucucu

SEQ ID NO: 2725558 - RNA, 22 nt, Human
uggacaggcauguucucugagg

SEQ ID NO: 2725559 - RNA, 17 nt, Human
uggacaggcauguucuc

SEQ ID NO: 2725560 - RNA, 23 nt, Human
uggacaggcauguucucugagga

SEQ ID NO: 2725561 - RNA, 15 nt, Human
uggaccaaaaaccag

SEQ ID NO: 2725562 - RNA, 19 nt, Human
uggcacugcuuccagugag

SEQ ID NO: 2725563 - RNA, 22 nt, Human
uggcacuauaauguaagcucua

SEQ ID NO: 2725564 - RNA, 22 nt, Human
uggcacugcuuccagugaggcu

SEQ ID NO: 2725565 - RNA, 17 nt, Human
uggauuuaacagaaaug

SEQ ID NO: 2725566 - RNA, 15 nt, Human
uggauuuaacagaaa

SEQ ID NO: 2725567 - RNA, 21 nt, Human
uggcacuauaauguaagcucu

SEQ ID NO: 2725568 - RNA, 23 nt, Human
uggaggggggaggugggauccuc

SEQ ID NO: 2725569 - RNA, 21 nt, Human
uggauuguccccgacccuugc

SEQ ID NO: 2725570 - RNA, 22 nt, Human
uggaugcagccucacaguccuu

SEQ ID NO: 2725571 - RNA, 13 nt, Human
uggaugcagccuc

SEQ ID NO: 2725572 - RNA, 21 nt, Human
uggaugcagccucacaguccu

SEQ ID NO: 2725573 - RNA, 11 nt, Human
uggcugcugaa

SEQ ID NO: 2725574 - RNA, 13 nt, Human
uggcugcugaagg

SEQ ID NO: 2725575 - RNA, 14 nt, Human
uggcugcugaaggc

SEQ ID NO: 2725576 - RNA, 16 nt, Human
uggcugcugaaggcuc

SEQ ID NO: 2725577 - RNA, 19 nt, Human
uggccucccaacucacccc

SEQ ID NO: 2725578 - RNA, 20 nt, Human
uggccucccaacucacccca

SEQ ID NO: 2725579 - RNA, 21 nt, Human
uggccucccaacucaccccag

SEQ ID NO: 2725580 - RNA, 22 nt, Human
uggccucccaacucaccccagc

SEQ ID NO: 2725581 - RNA, 11 nt, Human
uggccucccaa

SEQ ID NO: 2725582 - RNA, 14 nt, Human
uggccucccaacuc

SEQ ID NO: 2725583 - RNA, 18 nt, Human
uggccucaagugauucuc

SEQ ID NO: 2725584 - RNA, 23 nt, Human
uggccucaagugauucuccugcc

SEQ ID NO: 2725585 - RNA, 23 nt, Human
uggccuagcauacguacacauuu

SEQ ID NO: 2725586 - RNA, 19 nt, Human
uggcagcugcgguccaccc

SEQ ID NO: 2725587 - RNA, 17 nt, Human
uggcagcugcgguccac

SEQ ID NO: 2725588 - RNA, 13 nt, Human
uggccccucaggg

SEQ ID NO: 2725589 - RNA, 20 nt, Human
uggccccucagggucccugg

SEQ ID NO: 2725590 - RNA, 21 nt, Human
uggccccucagggucccuggu

SEQ ID NO: 2725591 - RNA, 22 nt, Human
uggccccucagggucccuggug

SEQ ID NO: 2725592 - RNA, 20 nt, Human
uggccuagcauacguacaca

SEQ ID NO: 2725593 - RNA, 16 nt, Human
ugggaggaucucuuga

SEQ ID NO: 2725594 - RNA, 16 nt, Human
ugggaaugaaugucag

SEQ ID NO: 2725595 - RNA, 21 nt, Human
ugggaaugaaugucaguguga

SEQ ID NO: 2725596 - RNA, 14 nt, Human
ugggacacccugug

SEQ ID NO: 2725597 - RNA, 15 nt, Human
ugggacacccuguga

SEQ ID NO: 2725598 - RNA, 18 nt, Human
ugggaugauuggaggggg

SEQ ID NO: 2725599 - RNA, 12 nt, Human
ugggauaaaugc

SEQ ID NO: 2725600 - RNA, 14 nt, Human
ugggauaaaugcca

SEQ ID NO: 2725601 - RNA, 13 nt, Human
ugggauaaaugcc

SEQ ID NO: 2725602 - RNA, 20 nt, Human
ugggcagcugccuccccucc

SEQ ID NO: 2725603 - RNA, 22 nt, Human
ugggcagcugccuccccuccuc

SEQ ID NO: 2725604 - RNA, 23 nt, Human
ugggcagcugccuccccuccucu

SEQ ID NO: 2725605 - RNA, 13 nt, Human
ugggcagagcaga

SEQ ID NO: 2725606 - RNA, 14 nt, Human
ugggcagagcagag

SEQ ID NO: 2725607 - RNA, 15 nt, Human
ugggcagagcagaga

SEQ ID NO: 2725608 - RNA, 17 nt, Human
ugggcagagcagagacc

SEQ ID NO: 2725609 - RNA, 23 nt, Human
ugggguuaucugaagucagaucu

SEQ ID NO: 2725610 - RNA, 19 nt, Human
uggggggcugaggugggag

SEQ ID NO: 2725611 - RNA, 16 nt, Human
ugggggccucagugcc

SEQ ID NO: 2725612 - RNA, 22 nt, Human
ugggcuucaguggcagcugcuu

SEQ ID NO: 2725613 - RNA, 21 nt, Human
ugggcuucaguggcagcugcu

SEQ ID NO: 2725614 - RNA, 22 nt, Human
ugggcuucauccuccucagauc

SEQ ID NO: 2725615 - RNA, 15 nt, Human
ugggcuucauccucc

SEQ ID NO: 2725616 - RNA, 17 nt, Human
ugggcuugucuguagau

SEQ ID NO: 2725617 - RNA, 23 nt, Human
ugggcuuggggaccagagcugcc

SEQ ID NO: 2725618 - RNA, 21 nt, Human
ugggcuugucuguagauuuua

SEQ ID NO: 2725619 - RNA, 22 nt, Human
ugggcuuggggaccagagcugc

SEQ ID NO: 2725620 - RNA, 13 nt, Human
uggggcagcuuga

SEQ ID NO: 2725621 - RNA, 12 nt, Human
ugacucuuaaga

SEQ ID NO: 2725622 - RNA, 13 nt, Human
ugacugaauuucu

SEQ ID NO: 2725623 - RNA, 15 nt, Human
ugacugaauuucuuu

SEQ ID NO: 2725624 - RNA, 14 nt, Human
ugacugaauuucuu

SEQ ID NO: 2725625 - RNA, 17 nt, Human
ugacugauucuucagca

SEQ ID NO: 2725626 - RNA, 16 nt, Human
ugacugauucuucagc

SEQ ID NO: 2725627 - RNA, 15 nt, Human
ugacugauucuucag

SEQ ID NO: 2725628 - RNA, 14 nt, Human
ugacugauucuuca

SEQ ID NO: 2725629 - RNA, 13 nt, Human
ugacugauucuuc

SEQ ID NO: 2725630 - RNA, 17 nt, Human
ugacgccaucccagccc

SEQ ID NO: 2725631 - RNA, 18 nt, Human
ugacgccaucccagcccc

SEQ ID NO: 2725632 - RNA, 19 nt, Human
ugacgccaucccagcccca

SEQ ID NO: 2725633 - RNA, 20 nt, Human
ugacgccaucccagccccaa

SEQ ID NO: 2725634 - RNA, 18 nt, Human
ugaccuuucaauaggaaa

SEQ ID NO: 2725635 - RNA, 22 nt, Human
ugaccuuucaauaggaaaaacu

SEQ ID NO: 2725636 - RNA, 13 nt, Human
ugacgccauccca

SEQ ID NO: 2725637 - RNA, 14 nt, Human
ugacgccaucccag

SEQ ID NO: 2725638 - RNA, 15 nt, Human
ugacgccaucccagc

SEQ ID NO: 2725639 - RNA, 16 nt, Human
ugacgccaucccagcc

SEQ ID NO: 2725640 - RNA, 15 nt, Human
ucuugaacuccuggc

SEQ ID NO: 2725641 - RNA, 17 nt, Human
ucuugaauuguaaggaa

SEQ ID NO: 2725642 - RNA, 20 nt, Human
ugaccauucuccaccugcca

SEQ ID NO: 2725643 - RNA, 21 nt, Human
ugaccauucuccaccugccag

SEQ ID NO: 2725644 - RNA, 22 nt, Human
ugaccauucuccaccugccagg

SEQ ID NO: 2725645 - RNA, 16 nt, Human
ugaccucugcagcaau

SEQ ID NO: 2725646 - RNA, 13 nt, Human
ugaccucugcagc

SEQ ID NO: 2725647 - RNA, 22 nt, Human
ugaccucaggugauccacccac

SEQ ID NO: 2725648 - RNA, 14 nt, Human
ugaccuuucaauag

SEQ ID NO: 2725649 - RNA, 15 nt, Human
ugaccuuucaauagg

SEQ ID NO: 2725650 - RNA, 16 nt, Human
ugaccuuucaauagga

SEQ ID NO: 2725651 - RNA, 12 nt, Human
ugaccucugccu

SEQ ID NO: 2725652 - RNA, 23 nt, Human
ugaccucugcagcaauaaagcag

SEQ ID NO: 2725653 - RNA, 21 nt, Human
ugaccucugcagcaauaaagc

SEQ ID NO: 2725654 - RNA, 18 nt, Human
ugaccucugcagcaauaa

SEQ ID NO: 2725655 - RNA, 17 nt, Human
ugagaaagacuauucaa

SEQ ID NO: 2725656 - RNA, 16 nt, Human
ugagaaagacuauuca

SEQ ID NO: 2725657 - RNA, 20 nt, Human
ugagaaagacuauucaaaca

SEQ ID NO: 2725658 - RNA, 18 nt, Human
ugagaaagacuauucaaa

SEQ ID NO: 2725659 - RNA, 12 nt, Human
ugagacccuguc

SEQ ID NO: 2725660 - RNA, 12 nt, Human
ugagacucuguc

SEQ ID NO: 2725661 - RNA, 13 nt, Human
ugagacucugucu

SEQ ID NO: 2725662 - RNA, 14 nt, Human
ugagacucugucuc

SEQ ID NO: 2725663 - RNA, 23 nt, Human
ugagaggcauccaguaucuugaa

SEQ ID NO: 2725664 - RNA, 22 nt, Human
ugagaggcauccaguaucuuga

SEQ ID NO: 2725665 - RNA, 19 nt, Human
ugagaggggaacagacugg

SEQ ID NO: 2725666 - RNA, 17 nt, Human
ugagaguagagucacug

SEQ ID NO: 2725667 - RNA, 20 nt, Human
ugagcagucaggaaagagaa

SEQ ID NO: 2725668 - RNA, 13 nt, Human
ugagcaucaggcc

SEQ ID NO: 2725669 - RNA, 17 nt, Human
ugagcagucaggaaaga

SEQ ID NO: 2725670 - RNA, 15 nt, Human
ugagcagucaggaaa

SEQ ID NO: 2725671 - RNA, 14 nt, Human
ugagcaucaggcca

SEQ ID NO: 2725672 - RNA, 15 nt, Human
ugagcaucaggccag

SEQ ID NO: 2725673 - RNA, 13 nt, Human
ugagccucagcau

SEQ ID NO: 2725674 - RNA, 15 nt, Human
ugagccucagcaucc

SEQ ID NO: 2725675 - RNA, 22 nt, Human
ugaucacggcucacugcagccu

SEQ ID NO: 2725676 - RNA, 21 nt, Human
ugauccacccaccucagccuc

SEQ ID NO: 2725677 - RNA, 22 nt, Human
ugauccacccaccucagccucc

SEQ ID NO: 2725678 - RNA, 19 nt, Human
ugaucuaggaagacuuugg

SEQ ID NO: 2725679 - RNA, 21 nt, Human
ugaucuaggaagacuuuggaa

SEQ ID NO: 2725680 - RNA, 13 nt, Human
ugaucauccacug

SEQ ID NO: 2725681 - RNA, 24 nt, Human
ugaucauccacugugccaugugcc

SEQ ID NO: 2725682 - RNA, 17 nt, Human
ugauccaagcugguccc

SEQ ID NO: 2725683 - RNA, 21 nt, Human
ugauccaagcuggucccacuc

SEQ ID NO: 2725684 - RNA, 15 nt, Human
ugauccacccaccuc

SEQ ID NO: 2725685 - RNA, 20 nt, Human
ugauccacccaccucagccu

SEQ ID NO: 2725686 - RNA, 14 nt, Human
ugaugccaugagga

SEQ ID NO: 2725687 - RNA, 22 nt, Human
ugaugaucuuugcagacaggca

SEQ ID NO: 2725688 - RNA, 23 nt, Human
ugaugaucuuugcagacaggcaa

SEQ ID NO: 2725689 - RNA, 20 nt, Human
ugaugaugaaaugaggucag

SEQ ID NO: 2725690 - RNA, 18 nt, Human
ugaucuuugcagacaggc

SEQ ID NO: 2725691 - RNA, 21 nt, Human
ugaucuuugcagacaggcaag

SEQ ID NO: 2725692 - RNA, 23 nt, Human
ugaucuuugcagacaggcaagca

SEQ ID NO: 2725693 - RNA, 19 nt, Human
ugaucuuugcagacaggca

SEQ ID NO: 2725694 - RNA, 20 nt, Human
ugaucuuugcagacaggcaa

SEQ ID NO: 2725695 - RNA, 13 nt, Human
ugauguauucuag

SEQ ID NO: 2725696 - RNA, 21 nt, Human
ugauguauucuagcuaaugua

SEQ ID NO: 2725697 - RNA, 14 nt, Human
ugauguauucuagc

SEQ ID NO: 2725698 - RNA, 20 nt, Human
ugauguauucuagcuaaugu

SEQ ID NO: 2725699 - RNA, 18 nt, Human
ugaugcuucuucagagac

SEQ ID NO: 2725700 - RNA, 19 nt, Human
ugaugcuucuucagagacu

SEQ ID NO: 2725701 - RNA, 21 nt, Human
ugaugcuucuucagagacucc

SEQ ID NO: 2725702 - RNA, 22 nt, Human
ugaugcuucuucagagacuccu

SEQ ID NO: 2725703 - RNA, 15 nt, Human
ugauagcacagaccc

SEQ ID NO: 2725704 - RNA, 16 nt, Human
ugauagcacagacccu

SEQ ID NO: 2725705 - RNA, 17 nt, Human
ugauagcacagacccug

SEQ ID NO: 2725706 - RNA, 18 nt, Human
ugauagcacagacccugc

SEQ ID NO: 2725707 - RNA, 20 nt, Human
ugauagcacagacccugccc

SEQ ID NO: 2725708 - RNA, 21 nt, Human
ugauagcacagacccugcccu

SEQ ID NO: 2725709 - RNA, 22 nt, Human
ugauagcacagacccugcccug

SEQ ID NO: 2725710 - RNA, 23 nt, Human
ugauagcacagacccugcccugu

SEQ ID NO: 2725711 - RNA, 16 nt, Human
ugaguugauucagcuc

SEQ ID NO: 2725712 - RNA, 19 nt, Human
ugaguugauucagcucugc

SEQ ID NO: 2725713 - RNA, 18 nt, Human
ugagucgaggacagggag

SEQ ID NO: 2725714 - RNA, 15 nt, Human
ugagucgaggacagg

SEQ ID NO: 2725715 - RNA, 16 nt, Human
ugagucgaggacaggg

SEQ ID NO: 2725716 - RNA, 21 nt, Human
ugaguugauagcacagacccu

SEQ ID NO: 2725717 - RNA, 23 nt, Human
ugaguugauagcacagacccugc

SEQ ID NO: 2725718 - RNA, 19 nt, Human
ugagguuucaaaccucccu

SEQ ID NO: 2725719 - RNA, 21 nt, Human
ugaguccccuguuuguuucug

SEQ ID NO: 2725720 - RNA, 15 nt, Human
ugaggugcuauguuc

SEQ ID NO: 2725721 - RNA, 16 nt, Human
ugaggugcuauguucu

SEQ ID NO: 2725722 - RNA, 11 nt, Human
ugaguccuggc

SEQ ID NO: 2725723 - RNA, 18 nt, Human
ugaguccuggcaugggaa

SEQ ID NO: 2725724 - RNA, 14 nt, Human
ugagucgaggacag

SEQ ID NO: 2725725 - RNA, 19 nt, Human
ugaguccuggcaugggaau

SEQ ID NO: 2725726 - RNA, 22 nt, Human
ugaguccuggcaugggaaugaa

SEQ ID NO: 2725727 - RNA, 20 nt, Human
ugaggucuguucuuuccaaa

SEQ ID NO: 2725728 - RNA, 15 nt, Human
ugaggucuguucuuu

SEQ ID NO: 2725729 - RNA, 14 nt, Human
ugaggucuguucuu

SEQ ID NO: 2725730 - RNA, 11 nt, Human
ugaggcugggc

SEQ ID NO: 2725731 - RNA, 21 nt, Human
ugcauuauauuuauuacugua

SEQ ID NO: 2725732 - RNA, 12 nt, Human
ugcauuaucuag

SEQ ID NO: 2725733 - RNA, 17 nt, Human
ugcauuaucuagauacu

SEQ ID NO: 2725734 - RNA, 15 nt, Human
ugcauguuugugauu

SEQ ID NO: 2725735 - RNA, 12 nt, Human
ugccaggaagcc

SEQ ID NO: 2725736 - RNA, 16 nt, Human
ugccaggaagccagca

SEQ ID NO: 2725737 - RNA, 18 nt, Human
ugccaggaagccagcagg

SEQ ID NO: 2725738 - RNA, 19 nt, Human
ugccaggaagccagcaggc

SEQ ID NO: 2725739 - RNA, 17 nt, Human
ugccagguuuuuggucu

SEQ ID NO: 2725740 - RNA, 15 nt, Human
ugccauccagguuca

SEQ ID NO: 2725741 - RNA, 12 nt, Human
ugccauccaggu

SEQ ID NO: 2725742 - RNA, 15 nt, Human
ugccauguuggccag

SEQ ID NO: 2725743 - RNA, 12 nt, Human
ugccauguuggc

SEQ ID NO: 2725744 - RNA, 16 nt, Human
ugccauguuggccagg

SEQ ID NO: 2725745 - RNA, 20 nt, Human
ugcccaccuggccucugcac

SEQ ID NO: 2725746 - RNA, 19 nt, Human
ugcccaccuggccucugca

SEQ ID NO: 2725747 - RNA, 18 nt, Human
ugcccacgcuggagugca

SEQ ID NO: 2725748 - RNA, 21 nt, Human
ugcccacucccugcaaccuga

SEQ ID NO: 2725749 - RNA, 13 nt, Human
ugcccacucccug

SEQ ID NO: 2725750 - RNA, 15 nt, Human
ugccaugugccaggu

SEQ ID NO: 2725751 - RNA, 14 nt, Human
ugccaugugccagg

SEQ ID NO: 2725752 - RNA, 20 nt, Human
ugccaugaggaacaaggcaa

SEQ ID NO: 2725753 - RNA, 23 nt, Human
ugccaugaggaacaaggcaaggc

SEQ ID NO: 2725754 - RNA, 17 nt, Human
ugccgucuaccugaggg

SEQ ID NO: 2725755 - RNA, 19 nt, Human
ugccgucuaccugaggggc

SEQ ID NO: 2725756 - RNA, 15 nt, Human
ugccgucuaccugag

SEQ ID NO: 2725757 - RNA, 16 nt, Human
ugccgucuaccugagg

SEQ ID NO: 2725758 - RNA, 17 nt, Human
ugcccugcuuucagaua

SEQ ID NO: 2725759 - RNA, 16 nt, Human
ugcccugcuuucagau

SEQ ID NO: 2725760 - RNA, 12 nt, Human
ugcccugcuuuc

SEQ ID NO: 2725761 - RNA, 21 nt, Human
ugcccugcccaccuggccucu

SEQ ID NO: 2725762 - RNA, 19 nt, Human
ugcccuaaaguguauuuuu

SEQ ID NO: 2725763 - RNA, 17 nt, Human
ugcccuaaaguguauuu

SEQ ID NO: 2725764 - RNA, 22 nt, Human
ugcccugcccaccuggccucug

SEQ ID NO: 2725765 - RNA, 23 nt, Human
ugcccugcccaccuggccucugc

SEQ ID NO: 2725766 - RNA, 17 nt, Human
ugccugguggcagcugc

SEQ ID NO: 2725767 - RNA, 18 nt, Human
ugccugguggcagcugcg

SEQ ID NO: 2725768 - RNA, 19 nt, Human
ugccugguggcagcugcgg

SEQ ID NO: 2725769 - RNA, 21 nt, Human
ugccucuucucuacucuaggg

SEQ ID NO: 2725770 - RNA, 13 nt, Human
ugccucugggacu

SEQ ID NO: 2725771 - RNA, 22 nt, Human
ugccuccuuugugaggaagccg

SEQ ID NO: 2725772 - RNA, 21 nt, Human
ugccuccuuugugaggaagcc

SEQ ID NO: 2725773 - RNA, 20 nt, Human
ugccuccuuugugaggaagc

SEQ ID NO: 2725774 - RNA, 21 nt, Human
ugccuaaggacuucuuuaauu

SEQ ID NO: 2725775 - RNA, 13 nt, Human
ugccuaaggacuu

SEQ ID NO: 2725776 - RNA, 12 nt, Human
ugccuaaggacu

SEQ ID NO: 2725777 - RNA, 20 nt, Human
ugccuaaggacuucuuuaau

SEQ ID NO: 2725778 - RNA, 16 nt, Human
ugccuaaggacuucuu

SEQ ID NO: 2725779 - RNA, 15 nt, Human
ugccuaaggacuucu

SEQ ID NO: 2725780 - RNA, 14 nt, Human
ugccuaaggacuuc

SEQ ID NO: 2725781 - RNA, 22 nt, Human
ugcaccuggaauauauaaccag

SEQ ID NO: 2725782 - RNA, 20 nt, Human
ugcaccuggaauauauaacc

SEQ ID NO: 2725783 - RNA, 17 nt, Human
ugcaccuggaauauaua

SEQ ID NO: 2725784 - RNA, 21 nt, Human
ugcaccggcuggccuggcccc

SEQ ID NO: 2725785 - RNA, 20 nt, Human
ugcacagaguuguuacauuu

SEQ ID NO: 2725786 - RNA, 18 nt, Human
ugcaccggcuggccuggc

SEQ ID NO: 2725787 - RNA, 19 nt, Human
ugcaccggcuggccuggcc

SEQ ID NO: 2725788 - RNA, 20 nt, Human
ugcaccggcuggccuggccc

SEQ ID NO: 2725789 - RNA, 18 nt, Human
ugcacugacauuguuggc

SEQ ID NO: 2725790 - RNA, 21 nt, Human
ugcacugacauuguuggccaa

SEQ ID NO: 2725791 - RNA, 16 nt, Human
ugcacugucaagauga

SEQ ID NO: 2725792 - RNA, 13 nt, Human
ugcaauggcagcc

SEQ ID NO: 2725793 - RNA, 14 nt, Human
ugcaauggcagccu

SEQ ID NO: 2725794 - RNA, 15 nt, Human
ugcaauggcagccuu

SEQ ID NO: 2725795 - RNA, 16 nt, Human
ugcaauggcagccuug

SEQ ID NO: 2725796 - RNA, 13 nt, Human
ugcaaugaccuuu

SEQ ID NO: 2725797 - RNA, 16 nt, Human
ugcaaugaccuuucaa

SEQ ID NO: 2725798 - RNA, 17 nt, Human
ugcaaugaccuuucaau

SEQ ID NO: 2725799 - RNA, 19 nt, Human
ugcaaugaccuuucaauag

SEQ ID NO: 2725800 - RNA, 22 nt, Human
ugcaaugaccuuucaauaggaa

SEQ ID NO: 2725801 - RNA, 23 nt, Human
ugcaaugaccuuucaauaggaaa

SEQ ID NO: 2725802 - RNA, 17 nt, Human
ugcacagaguuguuaca

SEQ ID NO: 2725803 - RNA, 19 nt, Human
ugcacagaguuguuacauu

SEQ ID NO: 2725804 - RNA, 18 nt, Human
ugcacagaguuguuacau

SEQ ID NO: 2725805 - RNA, 20 nt, Human
ugcacaaacagaggccgcca

SEQ ID NO: 2725806 - RNA, 17 nt, Human
ugcacaaacagaggccg

SEQ ID NO: 2725807 - RNA, 19 nt, Human
ugcacaaacagaggccgcc

SEQ ID NO: 2725808 - RNA, 14 nt, Human
ugcaauuucauaug

SEQ ID NO: 2725809 - RNA, 20 nt, Human
ugcaauuucauaugcuguau

SEQ ID NO: 2725810 - RNA, 15 nt, Human
ugcacaaacagaggc

SEQ ID NO: 2725811 - RNA, 16 nt, Human
ugcacaaacagaggcc

SEQ ID NO: 2725812 - RNA, 19 nt, Human
ugcaaccugauugugucuc

SEQ ID NO: 2725813 - RNA, 20 nt, Human
ugcaaccugauugugucucu

SEQ ID NO: 2725814 - RNA, 18 nt, Human
ugcaaccuccgccucuug

SEQ ID NO: 2725815 - RNA, 20 nt, Human
ugcaaccuccgccucuuggg

SEQ ID NO: 2725816 - RNA, 21 nt, Human
ugcaaccuccgccucuugggu

SEQ ID NO: 2725817 - RNA, 22 nt, Human
ugcaacucugaaggguaauuau

SEQ ID NO: 2725818 - RNA, 22 nt, Human
ugcaaccugauugugucucuug

SEQ ID NO: 2725819 - RNA, 14 nt, Human
ugcaacaggcuggg

SEQ ID NO: 2725820 - RNA, 15 nt, Human
ugcaacaggcugggc

SEQ ID NO: 2725821 - RNA, 16 nt, Human
ugcaacaggcugggcu

SEQ ID NO: 2725822 - RNA, 17 nt, Human
ugcaacaggcugggcuu

SEQ ID NO: 2725823 - RNA, 19 nt, Human
ugcaacaggcugggcuuca

SEQ ID NO: 2725824 - RNA, 20 nt, Human
ugcaacaggcugggcuucag

SEQ ID NO: 2725825 - RNA, 13 nt, Human
ugcaaccuccgcc

SEQ ID NO: 2725826 - RNA, 14 nt, Human
ugcaaccuccgccu

SEQ ID NO: 2725827 - RNA, 15 nt, Human
ugauuuucauugcug

SEQ ID NO: 2725828 - RNA, 13 nt, Human
ugauuuucauugc

SEQ ID NO: 2725829 - RNA, 22 nt, Human
ugauuuuuuuuuccuucagugc

SEQ ID NO: 2725830 - RNA, 23 nt, Human
ugauuuuuuuuuccuucagugcc

SEQ ID NO: 2725831 - RNA, 16 nt, Human
ugauuuuuuuuuccuu

SEQ ID NO: 2725832 - RNA, 17 nt, Human
ugauuuuuuuuuccuuc

SEQ ID NO: 2725833 - RNA, 19 nt, Human
ugauuuuuuuuuccuucag

SEQ ID NO: 2725834 - RNA, 20 nt, Human
ugauuuuuuuuuccuucagu

SEQ ID NO: 2725835 - RNA, 13 nt, Human
uuuucuuauuuca

SEQ ID NO: 2725836 - RNA, 23 nt, Human
uuuucuacucgaguuacagacaa

SEQ ID NO: 2725837 - RNA, 20 nt, Human
uuuucuacucgaguuacaga

SEQ ID NO: 2725838 - RNA, 22 nt, Human
uuuucuacucgaguuacagaca

SEQ ID NO: 2725839 - RNA, 13 nt, Human
uuuucuacucgag

SEQ ID NO: 2725840 - RNA, 16 nt, Human
uuuucuuucagccaag

SEQ ID NO: 2725841 - RNA, 13 nt, Human
uuuucuucucccu

SEQ ID NO: 2725842 - RNA, 22 nt, Human
uuuucuuguguguuuauuguca

SEQ ID NO: 2725843 - RNA, 16 nt, Human
uuuucacauuggaaac

SEQ ID NO: 2725844 - RNA, 22 nt, Human
uuuucagaaaauauuauguguu

SEQ ID NO: 2725845 - RNA, 18 nt, Human
uuuucccuauuagagaag

SEQ ID NO: 2725846 - RNA, 22 nt, Human
uuuucccuauuagagaagagau

SEQ ID NO: 2725847 - RNA, 23 nt, Human
uuuucagaaaauauuauguguuu

SEQ ID NO: 2725848 - RNA, 13 nt, Human
uuuuauauuugaa

SEQ ID NO: 2725849 - RNA, 18 nt, Human
uuuuauauuugaaauauu

SEQ ID NO: 2725850 - RNA, 13 nt, Human
uuuuauauuuacu

SEQ ID NO: 2725851 - RNA, 21 nt, Human
uuuuauacauaaacaagacca

SEQ ID NO: 2725852 - RNA, 13 nt, Human
uuuuauacauaaa

SEQ ID NO: 2725853 - RNA, 19 nt, Human
uuuuaucgucacugcuuaa

SEQ ID NO: 2725854 - RNA, 17 nt, Human
uuuucaaaauaaaaaug

SEQ ID NO: 2725855 - RNA, 18 nt, Human
uuuuauuuuuagacagag

SEQ ID NO: 2725856 - RNA, 21 nt, Human
uuuuaaaguaacccuacaaaa

SEQ ID NO: 2725857 - RNA, 21 nt, Human
uuuuauaauuuugugaagcaa

SEQ ID NO: 2725858 - RNA, 15 nt, Human
uuuuacuaauagaca

SEQ ID NO: 2725859 - RNA, 23 nt, Human
uuuuauaauuuugugaagcaaaa

SEQ ID NO: 2725860 - RNA, 15 nt, Human
uuuccacagaagcuc

SEQ ID NO: 2725861 - RNA, 15 nt, Human
uuuccguuaaaauac

SEQ ID NO: 2725862 - RNA, 13 nt, Human
uuugagugccuua

SEQ ID NO: 2725863 - RNA, 17 nt, Human
uuuccguuaaaauacca

SEQ ID NO: 2725864 - RNA, 12 nt, Human
uuugaguucuac

SEQ ID NO: 2725865 - RNA, 21 nt, Human
uuugagugccuuacacaaugg

SEQ ID NO: 2725866 - RNA, 13 nt, Human
uuuggacccugag

SEQ ID NO: 2725867 - RNA, 22 nt, Human
uuuggaccaaaaaccaguauug

SEQ ID NO: 2725868 - RNA, 21 nt, Human
uuuggaccaaaaaccaguauu

SEQ ID NO: 2725869 - RNA, 18 nt, Human
uuuggaccaaaaaccagu

SEQ ID NO: 2725870 - RNA, 19 nt, Human
uuuggacaaaauggaauac

SEQ ID NO: 2725871 - RNA, 15 nt, Human
uuuggaaaucuuuaa

SEQ ID NO: 2725872 - RNA, 12 nt, Human
uuuggaaaauaa

SEQ ID NO: 2725873 - RNA, 17 nt, Human
uuuguauaaaauaauuu

SEQ ID NO: 2725874 - RNA, 17 nt, Human
uuuggucuacacugugc

SEQ ID NO: 2725875 - RNA, 18 nt, Human
uuuguauaaaauaauuuu

SEQ ID NO: 2725876 - RNA, 19 nt, Human
uuuguauaaaauaauuuuu

SEQ ID NO: 2725877 - RNA, 24 nt, Human
uuuggaccaaaaaccaguauugua

SEQ ID NO: 2725878 - RNA, 15 nt, Human
uuuguauucucuccu

SEQ ID NO: 2725879 - RNA, 15 nt, Human
uuuguugucagcuga

SEQ ID NO: 2725880 - RNA, 22 nt, Human
uuuguuaguaugaggcauuugu

SEQ ID NO: 2725881 - RNA, 22 nt, Human
uuuuucauuauuuuauuaugaa

SEQ ID NO: 2725882 - RNA, 13 nt, Human
uuuuucauuauuu

SEQ ID NO: 2725883 - RNA, 22 nt, Human
uuuugacagaauauguuucaaa

SEQ ID NO: 2725884 - RNA, 23 nt, Human
uuuugacagaauauguuucaaac

SEQ ID NO: 2725885 - RNA, 11 nt, Human
uuuuuaaaugc

SEQ ID NO: 2725886 - RNA, 23 nt, Human
uuuuuaagaaaaaggaugcacag

SEQ ID NO: 2725887 - RNA, 12 nt, Human
uuuuuaagaaaa

SEQ ID NO: 2725888 - RNA, 17 nt, Human
uuuuuaagugcugcauu

SEQ ID NO: 2725889 - RNA, 16 nt, Human
uuuuuaagugcugcau

SEQ ID NO: 2725890 - RNA, 23 nt, Human
uuuuuaagugcugcauuuaaaag

SEQ ID NO: 2725891 - RNA, 22 nt, Human
uuuuuaagugcugcauuuaaaa

SEQ ID NO: 2725892 - RNA, 19 nt, Human
uuuuuaagugcugcauuua

SEQ ID NO: 2725893 - RNA, 18 nt, Human
uuuuuaagugcugcauuu

SEQ ID NO: 2725894 - RNA, 12 nt, Human
uuuuuuuuaaga

SEQ ID NO: 2725895 - RNA, 11 nt, Human
uuuuuuuacua

SEQ ID NO: 2725896 - RNA, 13 nt, Human
uuuuuuuugacaa

SEQ ID NO: 2725897 - RNA, 19 nt, Human
uuuaacucuauaauguguu

SEQ ID NO: 2725898 - RNA, 18 nt, Human
uuuaacagaaauguacag

SEQ ID NO: 2725899 - RNA, 21 nt, Human
uuguuuggaccaaaaaccagu

SEQ ID NO: 2725900 - RNA, 16 nt, Human
uuuaacaacagcuggu

SEQ ID NO: 2725901 - RNA, 13 nt, Human
uuuaauaauguuu

SEQ ID NO: 2725902 - RNA, 18 nt, Human
uuuaagaaaaaggaugca

SEQ ID NO: 2725903 - RNA, 22 nt, Human
uuuaagaaaaaggaugcacaga

SEQ ID NO: 2725904 - RNA, 13 nt, Human
uuuaccacuugug

SEQ ID NO: 2725905 - RNA, 21 nt, Human
uuuaauagguuuggacaaaau

SEQ ID NO: 2725906 - RNA, 21 nt, Human
uuuaauaauuauaugcuauuu

SEQ ID NO: 2725907 - RNA, 18 nt, Human
uuuaauaauuauaugcua

SEQ ID NO: 2725908 - RNA, 22 nt, Human
uuuacuucuuauacauuugaua

SEQ ID NO: 2725909 - RNA, 19 nt, Human
uuuacuucuuauacauuug

SEQ ID NO: 2725910 - RNA, 14 nt, Human
uuuagaaauauaau

SEQ ID NO: 2725911 - RNA, 12 nt, Human
uuuagacagagu

SEQ ID NO: 2725912 - RNA, 17 nt, Human
uuuauggcacuaguauu

SEQ ID NO: 2725913 - RNA, 16 nt, Human
uuuauggcuuuugugc

SEQ ID NO: 2725914 - RNA, 14 nt, Human
uuuauggcuuuugu

SEQ ID NO: 2725915 - RNA, 14 nt, Human
uuuauuauguaaau

SEQ ID NO: 2725916 - RNA, 17 nt, Human
uuuauuauguaaauccc

SEQ ID NO: 2725917 - RNA, 16 nt, Human
uuuauuauguaaaucc

SEQ ID NO: 2725918 - RNA, 13 nt, Human
uuuauuauggcac

SEQ ID NO: 2725919 - RNA, 13 nt, Human
uuuauuaugcaug

SEQ ID NO: 2725920 - RNA, 22 nt, Human
uuuauaauuuugugaagcaaaa

SEQ ID NO: 2725921 - RNA, 22 nt, Human
uuuauuguuuaaaaucauuucu

SEQ ID NO: 2725922 - RNA, 17 nt, Human
uuucaauaggaaaaacu

SEQ ID NO: 2725923 - RNA, 12 nt, Human
uuucaauaggaa

SEQ ID NO: 2725924 - RNA, 14 nt, Human
uuucaauaggaaaa

SEQ ID NO: 2725925 - RNA, 21 nt, Human
uuucagauacuggauuguacu

SEQ ID NO: 2725926 - RNA, 13 nt, Human
uuucagauacugg

SEQ ID NO: 2725927 - RNA, 14 nt, Human
uuucauuuagguga

SEQ ID NO: 2725928 - RNA, 18 nt, Human
uuucauuuaggugaggaa

SEQ ID NO: 2725929 - RNA, 14 nt, Human
uuucaguguacaug

SEQ ID NO: 2725930 - RNA, 13 nt, Human
uuucaguguacau

SEQ ID NO: 2725931 - RNA, 14 nt, Human
uuguuuaaaaucau

SEQ ID NO: 2725932 - RNA, 22 nt, Human
uuguuaguaugaggcauuuguu

SEQ ID NO: 2725933 - RNA, 20 nt, Human
uuguuagugugucuuagugu

SEQ ID NO: 2725934 - RNA, 17 nt, Human
uuguuguuuguuuaguc

SEQ ID NO: 2725935 - RNA, 18 nt, Human
uuguguuuugcaagccag

SEQ ID NO: 2725936 - RNA, 17 nt, Human
uuguuagaucuaguuca

SEQ ID NO: 2725937 - RNA, 21 nt, Human
uuguuaguaugaggcauuugu

SEQ ID NO: 2725938 - RNA, 19 nt, Human
uuguuaguaugaggcauuu

SEQ ID NO: 2725939 - RNA, 14 nt, Human
uuguuacauuuuua

SEQ ID NO: 2725940 - RNA, 23 nt, Human
uugugcgcuaaacuuuucugaua

SEQ ID NO: 2725941 - RNA, 22 nt, Human
uugugcgcuaaacuuuucugau

SEQ ID NO: 2725942 - RNA, 19 nt, Human
uugugcugggguuaucuga

SEQ ID NO: 2725943 - RNA, 17 nt, Human
uugugcauuaucuagau

SEQ ID NO: 2725944 - RNA, 12 nt, Human
uugugcauuugg

SEQ ID NO: 2725945 - RNA, 23 nt, Human
uugugcauuaucuagauacugua

SEQ ID NO: 2725946 - RNA, 22 nt, Human
uugugcauuaucuagauacugu

SEQ ID NO: 2725947 - RNA, 13 nt, Human
uuguguucaccuu

SEQ ID NO: 2725948 - RNA, 23 nt, Human
uuguggauuuaacagaaauguac

SEQ ID NO: 2725949 - RNA, 22 nt, Human
uuguggauuuaacagaaaugua

SEQ ID NO: 2725950 - RNA, 13 nt, Human
uuguguugugaau

SEQ ID NO: 2725951 - RNA, 20 nt, Human
uuguguugaagagguuuuaa

SEQ ID NO: 2725952 - RNA, 21 nt, Human
uuguguuuauauauaagccaa

SEQ ID NO: 2725953 - RNA, 21 nt, Human
uuguggauuuaacagaaaugu

SEQ ID NO: 2725954 - RNA, 20 nt, Human
uuguggauuuaacagaaaug

SEQ ID NO: 2725955 - RNA, 17 nt, Human
uuguggacacagcucuu

SEQ ID NO: 2725956 - RNA, 16 nt, Human
uuguggacacagcucu

SEQ ID NO: 2725957 - RNA, 15 nt, Human
uugucuagugaaacu

SEQ ID NO: 2725958 - RNA, 20 nt, Human
uugucuacaccauuaugugc

SEQ ID NO: 2725959 - RNA, 13 nt, Human
uugucucagauuu

SEQ ID NO: 2725960 - RNA, 20 nt, Human
uugucucagauuuuauuaug

SEQ ID NO: 2725961 - RNA, 16 nt, Human
uugucucagauuuuau

SEQ ID NO: 2725962 - RNA, 15 nt, Human
uugucuuaaaaagug

SEQ ID NO: 2725963 - RNA, 22 nt, Human
uugucucagauuuuauuaugua

SEQ ID NO: 2725964 - RNA, 12 nt, Human
uugugauuuuug

SEQ ID NO: 2725965 - RNA, 17 nt, Human
uugugauuuuuguaauu

SEQ ID NO: 2725966 - RNA, 16 nt, Human
uugugauuuuuguaau

SEQ ID NO: 2725967 - RNA, 20 nt, Human
uugugaaaggaaagaggcuc

SEQ ID NO: 2725968 - RNA, 23 nt, Human
uuguacgaagaguauuuuugaca

SEQ ID NO: 2725969 - RNA, 21 nt, Human
uuguacgaagaguauuuuuga

SEQ ID NO: 2725970 - RNA, 15 nt, Human
uuguacucaauuuua

SEQ ID NO: 2725971 - RNA, 14 nt, Human
uuguacucaauuuu

SEQ ID NO: 2725972 - RNA, 16 nt, Human
uuguauucucuccugu

SEQ ID NO: 2725973 - RNA, 15 nt, Human
uuguauucucuccug

SEQ ID NO: 2725974 - RNA, 19 nt, Human
uugucuacaccauuaugug

SEQ ID NO: 2725975 - RNA, 19 nt, Human
uuguauucucuccuguacc

SEQ ID NO: 2725976 - RNA, 13 nt, Human
uuggucuguguga

SEQ ID NO: 2725977 - RNA, 16 nt, Human
uuggguguauugugcg

SEQ ID NO: 2725978 - RNA, 15 nt, Human
uuggguguauugugc

SEQ ID NO: 2725979 - RNA, 13 nt, Human
uuggguguauugu

SEQ ID NO: 2725980 - RNA, 22 nt, Human
uuggguucaagcgauucuucug

SEQ ID NO: 2725981 - RNA, 14 nt, Human
uuguacauaaugcg

SEQ ID NO: 2725982 - RNA, 18 nt, Human
uuguacauaaugcgugca

SEQ ID NO: 2725983 - RNA, 23 nt, Human
uuguaaauuaacuuuuauaaacu

SEQ ID NO: 2725984 - RNA, 18 nt, Human
uuguaaauuaacuuuuau

SEQ ID NO: 2725985 - RNA, 16 nt, Human
uuguaaauuaacuuuu

SEQ ID NO: 2725986 - RNA, 15 nt, Human
uuguaaauuaacuuu

SEQ ID NO: 2725987 - RNA, 17 nt, Human
uuguaaauaguauuuga

SEQ ID NO: 2725988 - RNA, 17 nt, Human
uuguaaauagcucaggu

SEQ ID NO: 2725989 - RNA, 18 nt, Human
uuauggcuauaggugcua

SEQ ID NO: 2725990 - RNA, 16 nt, Human
uuauggcuuuugugca

SEQ ID NO: 2725991 - RNA, 14 nt, Human
uuauggcacaucag

SEQ ID NO: 2725992 - RNA, 18 nt, Human
uuauggcuuuugugcauu

SEQ ID NO: 2725993 - RNA, 17 nt, Human
uuauggcuuuugugcau

SEQ ID NO: 2725994 - RNA, 17 nt, Human
uuauggaacacucugag

SEQ ID NO: 2725995 - RNA, 21 nt, Human
uuauggacaaugacccagugg

SEQ ID NO: 2725996 - RNA, 18 nt, Human
uuauggaacacucugaga

SEQ ID NO: 2725997 - RNA, 20 nt, Human
uuauggaacacucugagacu

SEQ ID NO: 2725998 - RNA, 23 nt, Human
uuauuaaaaaucucaaauuucua

SEQ ID NO: 2725999 - RNA, 19 nt, Human
uuauuaaaugcccagcccc

SEQ ID NO: 2726000 - RNA, 21 nt, Human
uuauuaaaugcccagccccuu

SEQ ID NO: 2726001 - RNA, 16 nt, Human
uuauuacaguauaauu

SEQ ID NO: 2726002 - RNA, 22 nt, Human
uuaugauuaaguaaugauaacu

SEQ ID NO: 2726003 - RNA, 11 nt, Human
uuaucucaaaa

SEQ ID NO: 2726004 - RNA, 16 nt, Human
uuauauuuacaaaugg

SEQ ID NO: 2726005 - RNA, 20 nt, Human
uuauauuuauuacuguaaga

SEQ ID NO: 2726006 - RNA, 12 nt, Human
uuauauuugaaa

SEQ ID NO: 2726007 - RNA, 13 nt, Human
uuauauuugaaau

SEQ ID NO: 2726008 - RNA, 11 nt, Human
uuauaaucuuu

SEQ ID NO: 2726009 - RNA, 15 nt, Human
uuauaaugaaugaaa

SEQ ID NO: 2726010 - RNA, 18 nt, Human
uuauaauaauguuaacau

SEQ ID NO: 2726011 - RNA, 15 nt, Human
uuauaauaauguuaa

SEQ ID NO: 2726012 - RNA, 14 nt, Human
uuauaauuuuguga

SEQ ID NO: 2726013 - RNA, 15 nt, Human
uuauaauuuugugaa

SEQ ID NO: 2726014 - RNA, 12 nt, Human
uuauaauuuaaa

SEQ ID NO: 2726015 - RNA, 17 nt, Human
ugugaaaagaaaaauga

SEQ ID NO: 2726016 - RNA, 13 nt, Human
ugugaaaagaaaa

SEQ ID NO: 2726017 - RNA, 15 nt, Human
ugugaaaagaaaaau

SEQ ID NO: 2726018 - RNA, 16 nt, Human
uuauaauuuugugaag

SEQ ID NO: 2726019 - RNA, 17 nt, Human
uuauaauuuugugaagc

SEQ ID NO: 2726020 - RNA, 18 nt, Human
uuauaauuuugugaagca

SEQ ID NO: 2726021 - RNA, 14 nt, Human
uuauacaggucaua

SEQ ID NO: 2726022 - RNA, 23 nt, Human
uuauaucuauauuuuacauaaau

SEQ ID NO: 2726023 - RNA, 19 nt, Human
uuauaucuauauuuuacau

SEQ ID NO: 2726024 - RNA, 11 nt, Human
uuauacauaaa

SEQ ID NO: 2726025 - RNA, 22 nt, Human
uuauacaggucauauuaauaua

SEQ ID NO: 2726026 - RNA, 13 nt, Human
uuauacauaaaca

SEQ ID NO: 2726027 - RNA, 18 nt, Human
uuauaugcuauuucuaua

SEQ ID NO: 2726028 - RNA, 22 nt, Human
uuauaucuuguagcuuuaucaa

SEQ ID NO: 2726029 - RNA, 16 nt, Human
uuauaugcuauuucua

SEQ ID NO: 2726030 - RNA, 15 nt, Human
uuauaucuuguagcu

SEQ ID NO: 2726031 - RNA, 23 nt, Human
uuauaucugaggaauucuguaua

SEQ ID NO: 2726032 - RNA, 22 nt, Human
uuauaucugaggaauucuguau

SEQ ID NO: 2726033 - RNA, 14 nt, Human
uuauaucugaggaa

SEQ ID NO: 2726034 - RNA, 21 nt, Human
uuauaucugaggaauucugua

SEQ ID NO: 2726035 - RNA, 20 nt, Human
uuauaucugaggaauucugu

SEQ ID NO: 2726036 - RNA, 15 nt, Human
uucagagcugcccuc

SEQ ID NO: 2726037 - RNA, 17 nt, Human
uucagagcugcccucuc

SEQ ID NO: 2726038 - RNA, 17 nt, Human
uucagacagcugccugg

SEQ ID NO: 2726039 - RNA, 18 nt, Human
uucagagcugcccucucc

SEQ ID NO: 2726040 - RNA, 19 nt, Human
uucagagcugcccucuccu

SEQ ID NO: 2726041 - RNA, 20 nt, Human
uucagagcugcccucuccug

SEQ ID NO: 2726042 - RNA, 20 nt, Human
uucagauaaucacaauacau

SEQ ID NO: 2726043 - RNA, 20 nt, Human
uucagauacuggauuguacu

SEQ ID NO: 2726044 - RNA, 16 nt, Human
uucagauacuggauug

SEQ ID NO: 2726045 - RNA, 13 nt, Human
uucacggaagagc

SEQ ID NO: 2726046 - RNA, 22 nt, Human
uucaccuuuguccccaccgcag

SEQ ID NO: 2726047 - RNA, 17 nt, Human
uucacggaagagccuug

SEQ ID NO: 2726048 - RNA, 14 nt, Human
uucagacagcugcc

SEQ ID NO: 2726049 - RNA, 15 nt, Human
uucagacagcugccu

SEQ ID NO: 2726050 - RNA, 16 nt, Human
uucagacagcugccug

SEQ ID NO: 2726051 - RNA, 13 nt, Human
uucacccuuuucu

SEQ ID NO: 2726052 - RNA, 14 nt, Human
uucaccuuuguccc

SEQ ID NO: 2726053 - RNA, 19 nt, Human
uucaccuuuguccccaccg

SEQ ID NO: 2726054 - RNA, 20 nt, Human
uucaccuuuguccccaccgc

SEQ ID NO: 2726055 - RNA, 22 nt, Human
uucaauaggaaaaacugauuuu

SEQ ID NO: 2726056 - RNA, 21 nt, Human
uucaauaggaaaaacugauuu

SEQ ID NO: 2726057 - RNA, 20 nt, Human
uuauuuuaauaauguuucaa

SEQ ID NO: 2726058 - RNA, 14 nt, Human
uuauuuuauuauga

SEQ ID NO: 2726059 - RNA, 18 nt, Human
uuauuuuauuaugcauga

SEQ ID NO: 2726060 - RNA, 16 nt, Human
uuauuuuauuaugaaa

SEQ ID NO: 2726061 - RNA, 15 nt, Human
uuauuuuauuaugaa

SEQ ID NO: 2726062 - RNA, 17 nt, Human
uuauuuuaauaauguuu

SEQ ID NO: 2726063 - RNA, 19 nt, Human
uuauuuuaauaauguuuca

SEQ ID NO: 2726064 - RNA, 22 nt, Human
uuauuuuggaaaauaaauuauu

SEQ ID NO: 2726065 - RNA, 20 nt, Human
uuauuuuauuaugaaacuug

SEQ ID NO: 2726066 - RNA, 14 nt, Human
uuauuuuguucaua

SEQ ID NO: 2726067 - RNA, 16 nt, Human
uuauuuuguucauaca

SEQ ID NO: 2726068 - RNA, 16 nt, Human
uucaauaauaaauauu

SEQ ID NO: 2726069 - RNA, 21 nt, Human
uucaacagguuuuccugaaga

SEQ ID NO: 2726070 - RNA, 18 nt, Human
uucaaauguauuacagug

SEQ ID NO: 2726071 - RNA, 18 nt, Human
uuccagauccuggaaauc

SEQ ID NO: 2726072 - RNA, 19 nt, Human
uuccaacccucaucaccaa

SEQ ID NO: 2726073 - RNA, 14 nt, Human
uuccauggacuuug

SEQ ID NO: 2726074 - RNA, 15 nt, Human
uuccauggacuuugu

SEQ ID NO: 2726075 - RNA, 16 nt, Human
uuccaaaguacacugu

SEQ ID NO: 2726076 - RNA, 13 nt, Human
uuccaaaguacac

SEQ ID NO: 2726077 - RNA, 21 nt, Human
uuccaaaaagauuuucagaaa

SEQ ID NO: 2726078 - RNA, 23 nt, Human
uucaguuauuauauuuacaaaug

SEQ ID NO: 2726079 - RNA, 15 nt, Human
uucauaaccuagccu

SEQ ID NO: 2726080 - RNA, 15 nt, Human
uucauccuccucaga

SEQ ID NO: 2726081 - RNA, 19 nt, Human
uucauccuccucagaucuu

SEQ ID NO: 2726082 - RNA, 21 nt, Human
uucagcugguugagguuucaa

SEQ ID NO: 2726083 - RNA, 22 nt, Human
uucagcuccagcucaccagccc

SEQ ID NO: 2726084 - RNA, 12 nt, Human
uucagcuccagc

SEQ ID NO: 2726085 - RNA, 15 nt, Human
uucagcuccagcuca

SEQ ID NO: 2726086 - RNA, 22 nt, Human
uucagcuuguaaauagcucagg

SEQ ID NO: 2726087 - RNA, 14 nt, Human
uucaguggcagcug

SEQ ID NO: 2726088 - RNA, 13 nt, Human
uucaguggcagcu

SEQ ID NO: 2726089 - RNA, 13 nt, Human
uucaguguacaug

SEQ ID NO: 2726090 - RNA, 12 nt, Human
uucaguguacau

SEQ ID NO: 2726091 - RNA, 17 nt, Human
uucaguggcagcugcuu

SEQ ID NO: 2726092 - RNA, 15 nt, Human
uucaguggcagcugc

SEQ ID NO: 2726093 - RNA, 16 nt, Human
uucaguggcagcugcu

SEQ ID NO: 2726094 - RNA, 18 nt, Human
uucggugagcuacaaaug

SEQ ID NO: 2726095 - RNA, 21 nt, Human
uuccuugaguugauucagcuc

SEQ ID NO: 2726096 - RNA, 16 nt, Human
uuccauggccucuuca

SEQ ID NO: 2726097 - RNA, 12 nt, Human
uuccauggccuc

SEQ ID NO: 2726098 - RNA, 20 nt, Human
uuccugaggcugggcucccu

SEQ ID NO: 2726099 - RNA, 15 nt, Human
uuccugaggcugggc

SEQ ID NO: 2726100 - RNA, 23 nt, Human
uuccugaugcuucuucagagacu

SEQ ID NO: 2726101 - RNA, 15 nt, Human
uucuacauacuaugg

SEQ ID NO: 2726102 - RNA, 22 nt, Human
uucuacauaaguaauucaagaa

SEQ ID NO: 2726103 - RNA, 12 nt, Human
uucuacccagcg

SEQ ID NO: 2726104 - RNA, 19 nt, Human
uucuacccagcgagcccug

SEQ ID NO: 2726105 - RNA, 13 nt, Human
uucuacgccaggg

SEQ ID NO: 2726106 - RNA, 20 nt, Human
uucuacccagcgagcccugg

SEQ ID NO: 2726107 - RNA, 21 nt, Human
uucuacccagcgagcccuggu

SEQ ID NO: 2726108 - RNA, 14 nt, Human
uucuacccaggugc

SEQ ID NO: 2726109 - RNA, 22 nt, Human
uucuacucgaguuacagacaaa

SEQ ID NO: 2726110 - RNA, 21 nt, Human
uucugagaaagacuauucaaa

SEQ ID NO: 2726111 - RNA, 16 nt, Human
uucugagaaagacuau

SEQ ID NO: 2726112 - RNA, 21 nt, Human
uucugacccugcuucaaauau

SEQ ID NO: 2726113 - RNA, 18 nt, Human
uucugacccugcuucaaa

SEQ ID NO: 2726114 - RNA, 16 nt, Human
uucucugcccuccaag

SEQ ID NO: 2726115 - RNA, 17 nt, Human
uucucugcccuccaaga

SEQ ID NO: 2726116 - RNA, 23 nt, Human
uucugacccaugcugcccuguga

SEQ ID NO: 2726117 - RNA, 22 nt, Human
uucugacccaugcugcccugug

SEQ ID NO: 2726118 - RNA, 21 nt, Human
uucugauagaggaagccugau

SEQ ID NO: 2726119 - RNA, 13 nt, Human
uucugauagagga

SEQ ID NO: 2726120 - RNA, 19 nt, Human
uucugauccuaguuccacc

SEQ ID NO: 2726121 - RNA, 19 nt, Human
uucugcucacauaucuguc

SEQ ID NO: 2726122 - RNA, 21 nt, Human
uucuaugaaauauuauguuaa

SEQ ID NO: 2726123 - RNA, 14 nt, Human
uucuaugaaauauu

SEQ ID NO: 2726124 - RNA, 16 nt, Human
uucuccacccugcucu

SEQ ID NO: 2726125 - RNA, 20 nt, Human
uucuccaccugccagggaca

SEQ ID NO: 2726126 - RNA, 16 nt, Human
uucuccaccugccagg

SEQ ID NO: 2726127 - RNA, 18 nt, Human
uucuccaccugccaggga

SEQ ID NO: 2726128 - RNA, 21 nt, Human
uucuccaccucccacaaagga

SEQ ID NO: 2726129 - RNA, 12 nt, Human
uucuccaccugc

SEQ ID NO: 2726130 - RNA, 14 nt, Human
uucuccaccugcca

SEQ ID NO: 2726131 - RNA, 15 nt, Human
uucuccaccugccag

SEQ ID NO: 2726132 - RNA, 19 nt, Human
uucucuccuguaccucuug

SEQ ID NO: 2726133 - RNA, 14 nt, Human
uucucugaggacac

SEQ ID NO: 2726134 - RNA, 20 nt, Human
uucucugaggacacuaacca

SEQ ID NO: 2726135 - RNA, 11 nt, Human
uucucugcccu

SEQ ID NO: 2726136 - RNA, 12 nt, Human
uucucugcccuc

SEQ ID NO: 2726137 - RNA, 13 nt, Human
uucucuccagccc

SEQ ID NO: 2726138 - RNA, 14 nt, Human
uucucuccagcccc

SEQ ID NO: 2726139 - RNA, 18 nt, Human
uucucuccuguaccucuu

SEQ ID NO: 2726140 - RNA, 14 nt, Human
uucucuccuguacc

SEQ ID NO: 2726141 - RNA, 15 nt, Human
uucucuccagccccu

SEQ ID NO: 2726142 - RNA, 16 nt, Human
uucucuccagccccug

SEQ ID NO: 2726143 - RNA, 17 nt, Human
uugaccgugaggccaga

SEQ ID NO: 2726144 - RNA, 21 nt, Human
uugaccucaggugauccaccc

SEQ ID NO: 2726145 - RNA, 15 nt, Human
uugaccucugcagca

SEQ ID NO: 2726146 - RNA, 14 nt, Human
uugaccucugcagc

SEQ ID NO: 2726147 - RNA, 16 nt, Human
uugaccucugcagcaa

SEQ ID NO: 2726148 - RNA, 17 nt, Human
uugacgccaucccagcc

SEQ ID NO: 2726149 - RNA, 18 nt, Human
uugacgccaucccagccc

SEQ ID NO: 2726150 - RNA, 19 nt, Human
uugacgccaucccagcccc

SEQ ID NO: 2726151 - RNA, 12 nt, Human
uugaauuuuaca

SEQ ID NO: 2726152 - RNA, 21 nt, Human
uugaauuuuguguuagagauu

SEQ ID NO: 2726153 - RNA, 17 nt, Human
uugaauuuuguguuaga

SEQ ID NO: 2726154 - RNA, 13 nt, Human
uugaacuuugacc

SEQ ID NO: 2726155 - RNA, 18 nt, Human
uugaacuggguacuugug

SEQ ID NO: 2726156 - RNA, 14 nt, Human
uugaauuguaagga

SEQ ID NO: 2726157 - RNA, 22 nt, Human
uugaauuuauuggcuuuucuga

SEQ ID NO: 2726158 - RNA, 18 nt, Human
uugaauuuauuggcuuuu

SEQ ID NO: 2726159 - RNA, 15 nt, Human
uugaauuuauuggcu

SEQ ID NO: 2726160 - RNA, 23 nt, Human
uugaugaagaaguugauaugccu

SEQ ID NO: 2726161 - RNA, 13 nt, Human
uugaugaagaagu

SEQ ID NO: 2726162 - RNA, 14 nt, Human
uugaugaagaaguu

SEQ ID NO: 2726163 - RNA, 23 nt, Human
uugauagcacagacccugcccug

SEQ ID NO: 2726164 - RNA, 23 nt, Human
uugauauccucuuugagugaagc

SEQ ID NO: 2726165 - RNA, 11 nt, Human
uugagccuggg

SEQ ID NO: 2726166 - RNA, 13 nt, Human
uugaggguugggc

SEQ ID NO: 2726167 - RNA, 16 nt, Human
uugaggguugggcugg

SEQ ID NO: 2726168 - RNA, 21 nt, Human
uugcaaaguaucccuacugua

SEQ ID NO: 2726169 - RNA, 16 nt, Human
uugaugaucuuugcag

SEQ ID NO: 2726170 - RNA, 17 nt, Human
uucugucuucacaacag

SEQ ID NO: 2726171 - RNA, 19 nt, Human
uucuguccuacucuguguc

SEQ ID NO: 2726172 - RNA, 18 nt, Human
uucuguauuuuguuuuug

SEQ ID NO: 2726173 - RNA, 18 nt, Human
uucugcuuguguuaagua

SEQ ID NO: 2726174 - RNA, 19 nt, Human
uucugcuucagccucccga

SEQ ID NO: 2726175 - RNA, 15 nt, Human
uucugcuucagccuc

SEQ ID NO: 2726176 - RNA, 16 nt, Human
uucugcuucagccucc

SEQ ID NO: 2726177 - RNA, 14 nt, Human
uucugcuucagccu

SEQ ID NO: 2726178 - RNA, 15 nt, Human
uugaacuccuggccu

SEQ ID NO: 2726179 - RNA, 16 nt, Human
uugaacuccuggccuc

SEQ ID NO: 2726180 - RNA, 21 nt, Human
uucuuuccaaaguacacuguu

SEQ ID NO: 2726181 - RNA, 20 nt, Human
uugaaaaaccauuuugcugu

SEQ ID NO: 2726182 - RNA, 23 nt, Human
uugaaaacacuguucucugcccu

SEQ ID NO: 2726183 - RNA, 22 nt, Human
uugaaaacacuguucucugccc

SEQ ID NO: 2726184 - RNA, 12 nt, Human
uucuuucagcca

SEQ ID NO: 2726185 - RNA, 14 nt, Human
uucuuuccaaagua

SEQ ID NO: 2726186 - RNA, 14 nt, Human
uucuuguguguuua

SEQ ID NO: 2726187 - RNA, 13 nt, Human
uucuuccucccuc

SEQ ID NO: 2726188 - RNA, 21 nt, Human
uucuuguguguuuauugucaa

SEQ ID NO: 2726189 - RNA, 21 nt, Human
uucuuauacauuugauaaagu

SEQ ID NO: 2726190 - RNA, 17 nt, Human
uucuuccaaaaagauuu

SEQ ID NO: 2726191 - RNA, 21 nt, Human
uucuuccacaagagcccaggc

SEQ ID NO: 2726192 - RNA, 17 nt, Human
aaaacacauuuuucuua

SEQ ID NO: 2726193 - RNA, 19 nt, Human
aaaacacuguucucugccc

SEQ ID NO: 2726194 - RNA, 11 nt, Human
aaaagaaaaag

SEQ ID NO: 2726195 - RNA, 12 nt, Human
aaaagaauauuu

SEQ ID NO: 2726196 - RNA, 20 nt, Human
aaaagacaaggaaaaaauaa

SEQ ID NO: 2726197 - RNA, 13 nt, Human
aaaagaauauuuu

SEQ ID NO: 2726198 - RNA, 11 nt, Human
aaaagaaugau

SEQ ID NO: 2726199 - RNA, 13 nt, Human
aaaagacuccaaa

SEQ ID NO: 2726200 - RNA, 10 nt, Human
aaaaucauuu

SEQ ID NO: 2726201 - RNA, 12 nt, Human
aaaaucauuucu

SEQ ID NO: 2726202 - RNA, 11 nt, Human
aaaaucauuuc

SEQ ID NO: 2726203 - RNA, 13 nt, Human
aaaaucagccugc

SEQ ID NO: 2726204 - RNA, 16 nt, Human
aaaauaaaacuuuuua

SEQ ID NO: 2726205 - RNA, 17 nt, Human
aaaaucagccugcucca

SEQ ID NO: 2726206 - RNA, 21 nt, Human
aaaaucagccugcuccagcug

SEQ ID NO: 2726207 - RNA, 14 nt, Human
aaaauaaaacuuuu

SEQ ID NO: 2726208 - RNA, 18 nt, Human
aaaaguuuaauauuaaag

SEQ ID NO: 2726209 - RNA, 18 nt, Human
aaaaguugaauuuuacau

SEQ ID NO: 2726210 - RNA, 16 nt, Human
aaaaguuuaauauuaa

SEQ ID NO: 2726211 - RNA, 14 nt, Human
aaaaguuuaauauu

SEQ ID NO: 2726212 - RNA, 17 nt, Human
aaagcauuguaaaugug

SEQ ID NO: 2726213 - RNA, 15 nt, Human
aaagcauuguaaaug

SEQ ID NO: 2726214 - RNA, 18 nt, Human
aaagccugcaauuucaua

SEQ ID NO: 2726215 - RNA, 13 nt, Human
aaagccugcaauu

SEQ ID NO: 2726216 - RNA, 23 nt, Human
aaagccauguuuauuacaguaua

SEQ ID NO: 2726217 - RNA, 18 nt, Human
aaagccauguuuauuaca

SEQ ID NO: 2726218 - RNA, 17 nt, Human
aaagccauguuuauuac

SEQ ID NO: 2726219 - RNA, 16 nt, Human
aaagccauguuuauua

SEQ ID NO: 2726220 - RNA, 14 nt, Human
aaagccauguuuau

SEQ ID NO: 2726221 - RNA, 20 nt, Human
aaagauauuuugcuuuguga

SEQ ID NO: 2726222 - RNA, 21 nt, Human
aaaaucauuucugcaucagcu

SEQ ID NO: 2726223 - RNA, 16 nt, Human
aaaaucucaaauuucu

SEQ ID NO: 2726224 - RNA, 15 nt, Human
aaaaucucaaauuuc

SEQ ID NO: 2726225 - RNA, 18 nt, Human
aaaaucucaaauuucuaa

SEQ ID NO: 2726226 - RNA, 15 nt, Human
aaacugcacugucaa

SEQ ID NO: 2726227 - RNA, 12 nt, Human
aaacucuuaaaa

SEQ ID NO: 2726228 - RNA, 23 nt, Human
aaacucuuaaaacccaagugccu

SEQ ID NO: 2726229 - RNA, 22 nt, Human
aaacugauuuuuuuuuccuuca

SEQ ID NO: 2726230 - RNA, 23 nt, Human
aaacugauuuuuuuuuccuucag

SEQ ID NO: 2726231 - RNA, 15 nt, Human
aaaccgccaaggcug

SEQ ID NO: 2726232 - RNA, 16 nt, Human
aaaccgccaaggcugg

SEQ ID NO: 2726233 - RNA, 22 nt, Human
aaaccgaacugauguaaguaaa

SEQ ID NO: 2726234 - RNA, 12 nt, Human
aaacccagcucu

SEQ ID NO: 2726235 - RNA, 16 nt, Human
aaacccagcucugguc

SEQ ID NO: 2726236 - RNA, 22 nt, Human
aaaccaguauuguacaaaguau

SEQ ID NO: 2726237 - RNA, 18 nt, Human
aaaccaguauuguacaaa

SEQ ID NO: 2726238 - RNA, 17 nt, Human
aaaccaguauuguacaa

SEQ ID NO: 2726239 - RNA, 16 nt, Human
aaaccaguauuguaca

SEQ ID NO: 2726240 - RNA, 14 nt, Human
aaaccaguauugua

SEQ ID NO: 2726241 - RNA, 21 nt, Human
aaauauuuauuuuaauaaugu

SEQ ID NO: 2726242 - RNA, 18 nt, Human
aaaucucaauauuucaga

SEQ ID NO: 2726243 - RNA, 23 nt, Human
aaaucucaaauuuggauugcuaa

SEQ ID NO: 2726244 - RNA, 13 nt, Human
aaaucuuuuugcu

SEQ ID NO: 2726245 - RNA, 14 nt, Human
aaaucuuuuugcuu

SEQ ID NO: 2726246 - RNA, 23 nt, Human
aaauggacuguggugacuuugga

SEQ ID NO: 2726247 - RNA, 20 nt, Human
aaauggacuguggugacuuu

SEQ ID NO: 2726248 - RNA, 21 nt, Human
aaauggacuguggugacuuug

SEQ ID NO: 2726249 - RNA, 20 nt, Human
aaaggaugcccaaagaugca

SEQ ID NO: 2726250 - RNA, 14 nt, Human
aaaggaugcacaga

SEQ ID NO: 2726251 - RNA, 22 nt, Human
aaauguugacaugggacauuug

SEQ ID NO: 2726252 - RNA, 23 nt, Human
aaauguugacaugggacauuugc

SEQ ID NO: 2726253 - RNA, 23 nt, Human
aaccuuuugagugccuuacacaa

SEQ ID NO: 2726254 - RNA, 16 nt, Human
aaccuuuugagugccu

SEQ ID NO: 2726255 - RNA, 15 nt, Human
aaauucuugcaaagu

SEQ ID NO: 2726256 - RNA, 23 nt, Human
aaauucuucuccacuuucuagcc

SEQ ID NO: 2726257 - RNA, 11 nt, Human
aacaggcagau

SEQ ID NO: 2726258 - RNA, 20 nt, Human
aaugaauacuuuauaaagga

SEQ ID NO: 2726259 - RNA, 20 nt, Human
aaugaugccaugaggaacaa

SEQ ID NO: 2726260 - RNA, 20 nt, Human
aaugaaagacuguacaaagu

SEQ ID NO: 2726261 - RNA, 18 nt, Human
aaugaaagacuguacaaa

SEQ ID NO: 2726262 - RNA, 21 nt, Human
aaugaaagacuguacaaagua

SEQ ID NO: 2726263 - RNA, 20 nt, Human
aaugaagauacugaaauaaa

SEQ ID NO: 2726264 - RNA, 16 nt, Human
aaucucaauauuucag

SEQ ID NO: 2726265 - RNA, 16 nt, Human
aaucucauaauuuaua

SEQ ID NO: 2726266 - RNA, 22 nt, Human
aauauuaaagccauguuuauua

SEQ ID NO: 2726267 - RNA, 13 nt, Human
aauauuaagaaag

SEQ ID NO: 2726268 - RNA, 23 nt, Human
aauauguggaguucaucuugaau

SEQ ID NO: 2726269 - RNA, 21 nt, Human
aaucaccgaaaacguggcugc

SEQ ID NO: 2726270 - RNA, 23 nt, Human
aaucaccgaaaacguggcugcuu

SEQ ID NO: 2726271 - RNA, 19 nt, Human
aauaauguuaacauggaca

SEQ ID NO: 2726272 - RNA, 14 nt, Human
aauaaagcagcguu

SEQ ID NO: 2726273 - RNA, 22 nt, Human
aauaaugugaaacuggauuaaa

SEQ ID NO: 2726274 - RNA, 17 nt, Human
aauaaugugaaacugga

SEQ ID NO: 2726275 - RNA, 17 nt, Human
aaguuuaauauuaaagc

SEQ ID NO: 2726276 - RNA, 15 nt, Human
aaguuuaauauuaaa

SEQ ID NO: 2726277 - RNA, 24 nt, Human
aaguugaauuuauuggcuuuucug

SEQ ID NO: 2726278 - RNA, 23 nt, Human
aaguugaauuuauuggcuuuucu

SEQ ID NO: 2726279 - RNA, 12 nt, Human
aagugcugggau

SEQ ID NO: 2726280 - RNA, 14 nt, Human
aaguugaauuuauu

SEQ ID NO: 2726281 - RNA, 17 nt, Human
aaguugaauuuauuggc

SEQ ID NO: 2726282 - RNA, 15 nt, Human
aaguugaauuuauug

SEQ ID NO: 2726283 - RNA, 22 nt, Human
aagugcugcauuuaaaagauac

SEQ ID NO: 2726284 - RNA, 21 nt, Human
aagacaaggaaaaaauaacaa

SEQ ID NO: 2726285 - RNA, 20 nt, Human
aagaagacugcauuauauuu

SEQ ID NO: 2726286 - RNA, 15 nt, Human
aagaagacugcauua

SEQ ID NO: 2726287 - RNA, 19 nt, Human
aagacaaugugaaaagaaa

SEQ ID NO: 2726288 - RNA, 22 nt, Human
aagacaaugacuuacuguacau

SEQ ID NO: 2726289 - RNA, 20 nt, Human
aagacaaugugaaaagaaaa

SEQ ID NO: 2726290 - RNA, 20 nt, Human
aacgcaggcccccaggugcc

SEQ ID NO: 2726291 - RNA, 12 nt, Human
aagaacugaaau

SEQ ID NO: 2726292 - RNA, 13 nt, Human
aagaacugaaauc

SEQ ID NO: 2726293 - RNA, 11 nt, Human
aagaacugaaa

SEQ ID NO: 2726294 - RNA, 15 nt, Human
aagaacugaaaucau

SEQ ID NO: 2726295 - RNA, 17 nt, Human
aagaccacguuucuaaa

SEQ ID NO: 2726296 - RNA, 15 nt, Human
aagaccacguuucua

SEQ ID NO: 2726297 - RNA, 13 nt, Human
aagagaaaaaaua

SEQ ID NO: 2726298 - RNA, 19 nt, Human
aagacuuuucuuucagcca

SEQ ID NO: 2726299 - RNA, 21 nt, Human
aagacuuuuccaacccucauc

SEQ ID NO: 2726300 - RNA, 12 nt, Human
aagacuuuucuu

SEQ ID NO: 2726301 - RNA, 17 nt, Human
aagacuuuuccaacccu

SEQ ID NO: 2726302 - RNA, 14 nt, Human
aagagagaaaauaa

SEQ ID NO: 2726303 - RNA, 19 nt, Human
aagaguauuuuugacagaa

SEQ ID NO: 2726304 - RNA, 16 nt, Human
aagaguaguaauagag

SEQ ID NO: 2726305 - RNA, 20 nt, Human
aagaguaggaagacuuugga

SEQ ID NO: 2726306 - RNA, 19 nt, Human
aagauaauauuaaggaaga

SEQ ID NO: 2726307 - RNA, 21 nt, Human
aagauaauauuaaggaagaca

SEQ ID NO: 2726308 - RNA, 14 nt, Human
aagauaaaugugcu

SEQ ID NO: 2726309 - RNA, 17 nt, Human
aagauacaguuacucag

SEQ ID NO: 2726310 - RNA, 14 nt, Human
aagcggcuggcagc

SEQ ID NO: 2726311 - RNA, 15 nt, Human
aagcgugagccacug

SEQ ID NO: 2726312 - RNA, 13 nt, Human
aagcuacuuauug

SEQ ID NO: 2726313 - RNA, 15 nt, Human
aaggcaaggcuguca

SEQ ID NO: 2726314 - RNA, 23 nt, Human
aaggacuuguuagaucuaguuca

SEQ ID NO: 2726315 - RNA, 13 nt, Human
aaggcaaggcugu

SEQ ID NO: 2726316 - RNA, 13 nt, Human
aagcugcacccuc

SEQ ID NO: 2726317 - RNA, 19 nt, Human
aagcugcacccucaggcag

SEQ ID NO: 2726318 - RNA, 23 nt, Human
aaggacuucuuuaauuuuggaau

SEQ ID NO: 2726319 - RNA, 21 nt, Human
aaggacuuguuagaucuaguu

SEQ ID NO: 2726320 - RNA, 15 nt, Human
aaggacuuguuagau

SEQ ID NO: 2726321 - RNA, 15 nt, Human
aauuggagcucgugg

SEQ ID NO: 2726322 - RNA, 14 nt, Human
aauucuguuuuucu

SEQ ID NO: 2726323 - RNA, 18 nt, Human
aauucuguuuuucuaggc

SEQ ID NO: 2726324 - RNA, 22 nt, Human
aauuguaaggaaugauuaauua

SEQ ID NO: 2726325 - RNA, 20 nt, Human
aauucuguauagauuagaga

SEQ ID NO: 2726326 - RNA, 14 nt, Human
aauucuguauagau

SEQ ID NO: 2726327 - RNA, 13 nt, Human
aauucuguauaga

SEQ ID NO: 2726328 - RNA, 12 nt, Human
aauucuguauag

SEQ ID NO: 2726329 - RNA, 21 nt, Human
aauucucauuugucacacacu

SEQ ID NO: 2726330 - RNA, 15 nt, Human
aauucucuuauccaa

SEQ ID NO: 2726331 - RNA, 17 nt, Human
aauucucuaguuugauu

SEQ ID NO: 2726332 - RNA, 15 nt, Human
aauucucuaguuuga

SEQ ID NO: 2726333 - RNA, 14 nt, Human
aauucuacuuugag

SEQ ID NO: 2726334 - RNA, 19 nt, Human
aauucucagaaucucaaau

SEQ ID NO: 2726335 - RNA, 17 nt, Human
aauuauauaaguauucu

SEQ ID NO: 2726336 - RNA, 15 nt, Human
aauuauauaaguauu

SEQ ID NO: 2726337 - RNA, 16 nt, Human
aauuauauaaguauuc

SEQ ID NO: 2726338 - RNA, 21 nt, Human
aauuauaugcuauuucuauau

SEQ ID NO: 2726339 - RNA, 20 nt, Human
aauuauaugcuauuucuaua

SEQ ID NO: 2726340 - RNA, 19 nt, Human
aauuauaugcuauuucuau

SEQ ID NO: 2726341 - RNA, 23 nt, Human
aauuauaucugaggaauucugua

SEQ ID NO: 2726342 - RNA, 22 nt, Human
aauuauaucugaggaauucugu

SEQ ID NO: 2726343 - RNA, 20 nt, Human
aauuauaucugaggaauucu

SEQ ID NO: 2726344 - RNA, 12 nt, Human
aauuaugaaacu

SEQ ID NO: 2726345 - RNA, 15 nt, Human
aauuaugaaacuuuu

SEQ ID NO: 2726346 - RNA, 13 nt, Human
aauuaugaaacuu

SEQ ID NO: 2726347 - RNA, 19 nt, Human
aauuaugaguuauuuuuau

SEQ ID NO: 2726348 - RNA, 18 nt, Human
aauuaugaaacuuuugga

SEQ ID NO: 2726349 - RNA, 11 nt, Human
aauuguaauag

SEQ ID NO: 2726350 - RNA, 14 nt, Human
aauuguaauuauau

SEQ ID NO: 2726351 - RNA, 16 nt, Human
aauuguaauuauaucu

SEQ ID NO: 2726352 - RNA, 15 nt, Human
aauuguaauuauauc

SEQ ID NO: 2726353 - RNA, 22 nt, Human
aauuucauaccuaucaucuuaa

SEQ ID NO: 2726354 - RNA, 17 nt, Human
aauuguaauuauaucug

SEQ ID NO: 2726355 - RNA, 16 nt, Human
aauuucauaugcugua

SEQ ID NO: 2726356 - RNA, 18 nt, Human
aauuucauaugcuguaua

SEQ ID NO: 2726357 - RNA, 15 nt, Human
aauuucccaaagcag

SEQ ID NO: 2726358 - RNA, 17 nt, Human
aauuucccaaagcagug

SEQ ID NO: 2726359 - RNA, 15 nt, Human
aauuuccugggagcu

SEQ ID NO: 2726360 - RNA, 12 nt, Human
aauuuccuggga

SEQ ID NO: 2726361 - RNA, 13 nt, Human
acaccagagccca

SEQ ID NO: 2726362 - RNA, 18 nt, Human
acaccagagcccaccuug

SEQ ID NO: 2726363 - RNA, 23 nt, Human
acaccagagcccaccuuggcuca

SEQ ID NO: 2726364 - RNA, 18 nt, Human
acacagcucuucuccagg

SEQ ID NO: 2726365 - RNA, 14 nt, Human
acacagcucuucuc

SEQ ID NO: 2726366 - RNA, 16 nt, Human
acacagcucuucucca

SEQ ID NO: 2726367 - RNA, 15 nt, Human
acaaguuaaauaaau

SEQ ID NO: 2726368 - RNA, 16 nt, Human
acaaggcaaggcuguc

SEQ ID NO: 2726369 - RNA, 17 nt, Human
acaaggcaaggcuguca

SEQ ID NO: 2726370 - RNA, 19 nt, Human
acaaggcaaggcugucaau

SEQ ID NO: 2726371 - RNA, 15 nt, Human
acaaggcaaggcugu

SEQ ID NO: 2726372 - RNA, 24 nt, Human
acaggaugguucccuugaugaaga

SEQ ID NO: 2726373 - RNA, 22 nt, Human
acaggaugguucccuugaugaa

SEQ ID NO: 2726374 - RNA, 15 nt, Human
acaggcaaugcuggc

SEQ ID NO: 2726375 - RNA, 16 nt, Human
acaggcaaugcuggcu

SEQ ID NO: 2726376 - RNA, 14 nt, Human
acaggcacccacca

SEQ ID NO: 2726377 - RNA, 17 nt, Human
acaggcaaugcuggcug

SEQ ID NO: 2726378 - RNA, 19 nt, Human
acagcucuucuccaggcug

SEQ ID NO: 2726379 - RNA, 20 nt, Human
acagcucuucuccaggcugu

SEQ ID NO: 2726380 - RNA, 18 nt, Human
acagcucuucuccaggcu

SEQ ID NO: 2726381 - RNA, 23 nt, Human
acagugaucaaguuauuuuuaau

SEQ ID NO: 2726382 - RNA, 23 nt, Human
acaggcacccaccaucaugucug

SEQ ID NO: 2726383 - RNA, 15 nt, Human
acauuugcucaugga

SEQ ID NO: 2726384 - RNA, 16 nt, Human
acauuuguauaaaaua

SEQ ID NO: 2726385 - RNA, 19 nt, Human
acauuuguauaaaauaauu

SEQ ID NO: 2726386 - RNA, 21 nt, Human
acauuuguauaaaauaauuuu

SEQ ID NO: 2726387 - RNA, 14 nt, Human
accaacgucugugc

SEQ ID NO: 2726388 - RNA, 17 nt, Human
accaacgucugugccau

SEQ ID NO: 2726389 - RNA, 14 nt, Human
accacguuucuaaa

SEQ ID NO: 2726390 - RNA, 13 nt, Human
accacguuucuaa

SEQ ID NO: 2726391 - RNA, 18 nt, Human
accacgcuggaccuugaa

SEQ ID NO: 2726392 - RNA, 14 nt, Human
accacgcuggaccu

SEQ ID NO: 2726393 - RNA, 16 nt, Human
accacgcuggaccuug

SEQ ID NO: 2726394 - RNA, 21 nt, Human
accaacgucugugccauuuug

SEQ ID NO: 2726395 - RNA, 12 nt, Human
accagagcugcc

SEQ ID NO: 2726396 - RNA, 13 nt, Human
accagagcugcca

SEQ ID NO: 2726397 - RNA, 14 nt, Human
accagagcugccac

SEQ ID NO: 2726398 - RNA, 16 nt, Human
accagagcugccaccu

SEQ ID NO: 2726399 - RNA, 19 nt, Human
acauguuuuucuucucccu

SEQ ID NO: 2726400 - RNA, 14 nt, Human
acauguuaaaccau

SEQ ID NO: 2726401 - RNA, 23 nt, Human
acauguuaaaccaugggauaaau

SEQ ID NO: 2726402 - RNA, 21 nt, Human
acauguuaaaccaugggauaa

SEQ ID NO: 2726403 - RNA, 16 nt, Human
acauguuaaaccaugg

SEQ ID NO: 2726404 - RNA, 16 nt, Human
acauacaauuccaaac

SEQ ID NO: 2726405 - RNA, 20 nt, Human
acauacaggaagguagaaau

SEQ ID NO: 2726406 - RNA, 20 nt, Human
acauaaauuuaguauuuugu

SEQ ID NO: 2726407 - RNA, 20 nt, Human
acauaaguaauucaagaaaa

SEQ ID NO: 2726408 - RNA, 21 nt, Human
acauaaguaauucaagaaaac

SEQ ID NO: 2726409 - RNA, 13 nt, Human
acaugcacgugug

SEQ ID NO: 2726410 - RNA, 20 nt, Human
acaugccucucucaggccaa

SEQ ID NO: 2726411 - RNA, 19 nt, Human
acgauuucuguuuagauaa

SEQ ID NO: 2726412 - RNA, 23 nt, Human
acgauuucuguuuagauaauaca

SEQ ID NO: 2726413 - RNA, 20 nt, Human
acgauuucuguuuagauaau

SEQ ID NO: 2726414 - RNA, 17 nt, Human
acggacacucaaaagcu

SEQ ID NO: 2726415 - RNA, 19 nt, Human
acggaauaguuggcuagga

SEQ ID NO: 2726416 - RNA, 12 nt, Human
acgucugugcca

SEQ ID NO: 2726417 - RNA, 13 nt, Human
acgucugugccau

SEQ ID NO: 2726418 - RNA, 14 nt, Human
acgucuuaaauauu

SEQ ID NO: 2726419 - RNA, 13 nt, Human
acgucuuaaauau

SEQ ID NO: 2726420 - RNA, 22 nt, Human
acgcugugcugcccugcccacc

SEQ ID NO: 2726421 - RNA, 19 nt, Human
acgcugugcugcccugccc

SEQ ID NO: 2726422 - RNA, 20 nt, Human
acuaauguguaagacaaaaa

SEQ ID NO: 2726423 - RNA, 18 nt, Human
acuaauggggcggugaga

SEQ ID NO: 2726424 - RNA, 20 nt, Human
accucugccucagaaaacaa

SEQ ID NO: 2726425 - RNA, 12 nt, Human
accucugccuga

SEQ ID NO: 2726426 - RNA, 20 nt, Human
accucugccugaagucacac

SEQ ID NO: 2726427 - RNA, 23 nt, Human
accucugccugaagucacacagu

SEQ ID NO: 2726428 - RNA, 19 nt, Human
accugccaggaagccagca

SEQ ID NO: 2726429 - RNA, 23 nt, Human
accugccaggaagccagcaggcu

SEQ ID NO: 2726430 - RNA, 21 nt, Human
accugccaggaagccagcagg

SEQ ID NO: 2726431 - RNA, 22 nt, Human
accugccaggaagccagcaggc

SEQ ID NO: 2726432 - RNA, 12 nt, Human
accugccccuca

SEQ ID NO: 2726433 - RNA, 15 nt, Human
accugccccucaacu

SEQ ID NO: 2726434 - RNA, 13 nt, Human
acccucaggcagg

SEQ ID NO: 2726435 - RNA, 14 nt, Human
acccucaggcaggu

SEQ ID NO: 2726436 - RNA, 13 nt, Human
acccucaucacca

SEQ ID NO: 2726437 - RNA, 15 nt, Human
acccucaggcaggug

SEQ ID NO: 2726438 - RNA, 16 nt, Human
acccucaggcaggugg

SEQ ID NO: 2726439 - RNA, 23 nt, Human
acccuggcacuauaauguaagcu

SEQ ID NO: 2726440 - RNA, 23 nt, Human
acccucaucaccaacgucugugc

SEQ ID NO: 2726441 - RNA, 16 nt, Human
acccugugauggggcc

SEQ ID NO: 2726442 - RNA, 16 nt, Human
acccuggggagaaagu

SEQ ID NO: 2726443 - RNA, 13 nt, Human
acccuauugcugc

SEQ ID NO: 2726444 - RNA, 14 nt, Human
acccuauugcugcu

SEQ ID NO: 2726445 - RNA, 19 nt, Human
acccuauugcugcuugagg

SEQ ID NO: 2726446 - RNA, 11 nt, Human
accucaggccu

SEQ ID NO: 2726447 - RNA, 20 nt, Human
accucaggugauccacccac

SEQ ID NO: 2726448 - RNA, 21 nt, Human
accucaggugauccacccacc

SEQ ID NO: 2726449 - RNA, 18 nt, Human
accgugaggccagagaca

SEQ ID NO: 2726450 - RNA, 23 nt, Human
accgugaggccagagacacaagc

SEQ ID NO: 2726451 - RNA, 12 nt, Human
accucagccucc

SEQ ID NO: 2726452 - RNA, 11 nt, Human
accucagccuc

SEQ ID NO: 2726453 - RNA, 12 nt, Human
accgggcacuca

SEQ ID NO: 2726454 - RNA, 14 nt, Human
accgggcacucaga

SEQ ID NO: 2726455 - RNA, 20 nt, Human
accgggccacagagaaagua

SEQ ID NO: 2726456 - RNA, 16 nt, Human
accgggcacucagaag

SEQ ID NO: 2726457 - RNA, 17 nt, Human
acccugugauggggccc

SEQ ID NO: 2726458 - RNA, 19 nt, Human
acccugugauggggcccug

SEQ ID NO: 2726459 - RNA, 20 nt, Human
acccugugauggggcccugc

SEQ ID NO: 2726460 - RNA, 21 nt, Human
acccugugauggggcccugcc

SEQ ID NO: 2726461 - RNA, 17 nt, Human
acuguaaaauaauaacu

SEQ ID NO: 2726462 - RNA, 20 nt, Human
acuggugacugauucuucag

SEQ ID NO: 2726463 - RNA, 16 nt, Human
acuggugacugauucu

SEQ ID NO: 2726464 - RNA, 19 nt, Human
acuggugacugauucuuca

SEQ ID NO: 2726465 - RNA, 18 nt, Human
acuggugacugauucuuc

SEQ ID NO: 2726466 - RNA, 14 nt, Human
acugccaugccagc

SEQ ID NO: 2726467 - RNA, 17 nt, Human
acugugccaugugccag

SEQ ID NO: 2726468 - RNA, 18 nt, Human
acugugccaugugccagg

SEQ ID NO: 2726469 - RNA, 16 nt, Human
acugugaagagaacca

SEQ ID NO: 2726470 - RNA, 16 nt, Human
acugugccaugugcca

SEQ ID NO: 2726471 - RNA, 18 nt, Human
acuucaaauccuugaaga

SEQ ID NO: 2726472 - RNA, 17 nt, Human
acuucaaauccuugaag

SEQ ID NO: 2726473 - RNA, 19 nt, Human
acuguuucaaacuuuacua

SEQ ID NO: 2726474 - RNA, 18 nt, Human
acuguuucaaacuuuacu

SEQ ID NO: 2726475 - RNA, 15 nt, Human
acuguuucaaacuuu

SEQ ID NO: 2726476 - RNA, 18 nt, Human
acuucuuuaauuuuggaa

SEQ ID NO: 2726477 - RNA, 20 nt, Human
acuucuuuaauuuuggaauu

SEQ ID NO: 2726478 - RNA, 19 nt, Human
acuucuuuaauuuuggaau

SEQ ID NO: 2726479 - RNA, 23 nt, Human
acuuggggggcugaggugggagg

SEQ ID NO: 2726480 - RNA, 22 nt, Human
acucccaucugugaaaggaaag

SEQ ID NO: 2726481 - RNA, 14 nt, Human
acucguuaauuugu

SEQ ID NO: 2726482 - RNA, 19 nt, Human
acucguuaauuuguagugu

SEQ ID NO: 2726483 - RNA, 15 nt, Human
acucuacagaggcca

SEQ ID NO: 2726484 - RNA, 23 nt, Human
acugaauuucuuuugccguuauu

SEQ ID NO: 2726485 - RNA, 16 nt, Human
acugacagauuuccau

SEQ ID NO: 2726486 - RNA, 17 nt, Human
acugacauuguuggcca

SEQ ID NO: 2726487 - RNA, 18 nt, Human
acugacauuguuggccaa

SEQ ID NO: 2726488 - RNA, 13 nt, Human
acugaauuaugaa

SEQ ID NO: 2726489 - RNA, 15 nt, Human
acugaauuaugaaac

SEQ ID NO: 2726490 - RNA, 14 nt, Human
acugaauuaugaaa

SEQ ID NO: 2726491 - RNA, 12 nt, Human
acugaauuucuu

SEQ ID NO: 2726492 - RNA, 20 nt, Human
acugaauuaugaaacuuuug

SEQ ID NO: 2726493 - RNA, 19 nt, Human
acugauaugggucuugaua

SEQ ID NO: 2726494 - RNA, 23 nt, Human
acugaugggcaacccccagccug

SEQ ID NO: 2726495 - RNA, 16 nt, Human
acugauuuuuuuuucc

SEQ ID NO: 2726496 - RNA, 22 nt, Human
acugauuugacauagucuggcu

SEQ ID NO: 2726497 - RNA, 17 nt, Human
acugauuuuuuuuuccu

SEQ ID NO: 2726498 - RNA, 18 nt, Human
acugauuuuuuuuuccuu

SEQ ID NO: 2726499 - RNA, 19 nt, Human
acugauuuuuuuuuccuuc

SEQ ID NO: 2726500 - RNA, 20 nt, Human
acugauuuuuuuuuccuuca

SEQ ID NO: 2726501 - RNA, 15 nt, Human
auaaaagacagugaa

SEQ ID NO: 2726502 - RNA, 16 nt, Human
auaaaagacagugaaa

SEQ ID NO: 2726503 - RNA, 23 nt, Human
auaaaaauauuguguugugaaug

SEQ ID NO: 2726504 - RNA, 14 nt, Human
auaaaaacaacuuu

SEQ ID NO: 2726505 - RNA, 16 nt, Human
auaaaaaauuaugaca

SEQ ID NO: 2726506 - RNA, 20 nt, Human
auaaaaagacauucuuccaa

SEQ ID NO: 2726507 - RNA, 14 nt, Human
aguuugauuaaauu

SEQ ID NO: 2726508 - RNA, 11 nt, Human
aguuugcaguu

SEQ ID NO: 2726509 - RNA, 18 nt, Human
aguugaaaaacagcugag

SEQ ID NO: 2726510 - RNA, 16 nt, Human
aguugaagacagagcu

SEQ ID NO: 2726511 - RNA, 17 nt, Human
aguugaagacagagcua

SEQ ID NO: 2726512 - RNA, 17 nt, Human
aguugaaaaacagcuga

SEQ ID NO: 2726513 - RNA, 18 nt, Human
aguuccaccaucaagcca

SEQ ID NO: 2726514 - RNA, 21 nt, Human
aguuccaccaucaagccacca

SEQ ID NO: 2726515 - RNA, 14 nt, Human
aguucauacccugu

SEQ ID NO: 2726516 - RNA, 17 nt, Human
aguuguuagugugucuu

SEQ ID NO: 2726517 - RNA, 22 nt, Human
aguuguuagugugucuuagugu

SEQ ID NO: 2726518 - RNA, 20 nt, Human
aguuguucaauaauaaauau

SEQ ID NO: 2726519 - RNA, 17 nt, Human
auacaccacuacauucu

SEQ ID NO: 2726520 - RNA, 21 nt, Human
auaaagaugagugagcaugcc

SEQ ID NO: 2726521 - RNA, 15 nt, Human
auaaguaaaugcuag

SEQ ID NO: 2726522 - RNA, 17 nt, Human
auaaguaauucaagaaa

SEQ ID NO: 2726523 - RNA, 12 nt, Human
auaauguuaaca

SEQ ID NO: 2726524 - RNA, 23 nt, Human
auacaaugcugugcccuaaagug

SEQ ID NO: 2726525 - RNA, 15 nt, Human
auacaccacuacauu

SEQ ID NO: 2726526 - RNA, 20 nt, Human
auacacacucaaaucaagaa

SEQ ID NO: 2726527 - RNA, 18 nt, Human
auacaauuuuguuucugu

SEQ ID NO: 2726528 - RNA, 17 nt, Human
auacaauuuuguuucug

SEQ ID NO: 2726529 - RNA, 16 nt, Human
auacaauuuuguuucu

SEQ ID NO: 2726530 - RNA, 14 nt, Human
auacaauuuuguuu

SEQ ID NO: 2726531 - RNA, 15 nt, Human
aguacuggagaaaau

SEQ ID NO: 2726532 - RNA, 20 nt, Human
aguacuucuccacccugcuc

SEQ ID NO: 2726533 - RNA, 19 nt, Human
aguacuucuccacccugcu

SEQ ID NO: 2726534 - RNA, 21 nt, Human
aguacuucuccacccugcucu

SEQ ID NO: 2726535 - RNA, 21 nt, Human
aguaaaugggggugcauuuga

SEQ ID NO: 2726536 - RNA, 20 nt, Human
aguaaaugggggugcauuug

SEQ ID NO: 2726537 - RNA, 19 nt, Human
aguaaaugggggugcauuu

SEQ ID NO: 2726538 - RNA, 18 nt, Human
aguaaaugggggugcauu

SEQ ID NO: 2726539 - RNA, 17 nt, Human
aguaacuuacuuaggug

SEQ ID NO: 2726540 - RNA, 19 nt, Human
agugaugucacuagggcag

SEQ ID NO: 2726541 - RNA, 19 nt, Human
agugauccucccaccucag

SEQ ID NO: 2726542 - RNA, 20 nt, Human
agugauccucccaccucagc

SEQ ID NO: 2726543 - RNA, 22 nt, Human
agugauccucccaccucagccu

SEQ ID NO: 2726544 - RNA, 19 nt, Human
agugauucuccugccucag

SEQ ID NO: 2726545 - RNA, 18 nt, Human
agugauucuccugccuca

SEQ ID NO: 2726546 - RNA, 20 nt, Human
agugauucuccugccucagc

SEQ ID NO: 2726547 - RNA, 18 nt, Human
agugccuuauggaacacu

SEQ ID NO: 2726548 - RNA, 19 nt, Human
agugccuuauggaacacuc

SEQ ID NO: 2726549 - RNA, 20 nt, Human
agugccuuauggaacacucu

SEQ ID NO: 2726550 - RNA, 21 nt, Human
agugccuuauggaacacucug

SEQ ID NO: 2726551 - RNA, 22 nt, Human
agugccuuauggaacacucuga

SEQ ID NO: 2726552 - RNA, 16 nt, Human
agugacagaggcagcc

SEQ ID NO: 2726553 - RNA, 19 nt, Human
agugacagaggcagcccca

SEQ ID NO: 2726554 - RNA, 13 nt, Human
agugaaugaaaca

SEQ ID NO: 2726555 - RNA, 14 nt, Human
agugacagaggcag

SEQ ID NO: 2726556 - RNA, 13 nt, Human
agucauuuaauaa

SEQ ID NO: 2726557 - RNA, 14 nt, Human
aguccucuuuucug

SEQ ID NO: 2726558 - RNA, 16 nt, Human
aguccuuaccagcaga

SEQ ID NO: 2726559 - RNA, 18 nt, Human
aguccuuaccagcagagc

SEQ ID NO: 2726560 - RNA, 18 nt, Human
agucuggcccuuccuuuu

SEQ ID NO: 2726561 - RNA, 21 nt, Human
agucuggcuguacccaggaau

SEQ ID NO: 2726562 - RNA, 19 nt, Human
agucuggcuguacccagga

SEQ ID NO: 2726563 - RNA, 21 nt, Human
agucugauucccaagcucugc

SEQ ID NO: 2726564 - RNA, 22 nt, Human
agucugauucccaagcucugcu

SEQ ID NO: 2726565 - RNA, 20 nt, Human
agucugauucccaagcucug

SEQ ID NO: 2726566 - RNA, 18 nt, Human
agucuggaaugcaguggu

SEQ ID NO: 2726567 - RNA, 16 nt, Human
agucgaggacagggag

SEQ ID NO: 2726568 - RNA, 21 nt, Human
aucaugaauuaguuuuauaug

SEQ ID NO: 2726569 - RNA, 20 nt, Human
aucaugacaaagacugagua

SEQ ID NO: 2726570 - RNA, 15 nt, Human
aucauccuaagcuau

SEQ ID NO: 2726571 - RNA, 18 nt, Human
auccagcagauuauucac

SEQ ID NO: 2726572 - RNA, 21 nt, Human
auccacugugccaugugccag

SEQ ID NO: 2726573 - RNA, 12 nt, Human
auccuugaagau

SEQ ID NO: 2726574 - RNA, 22 nt, Human
aucuaggaagacuuuggaaaga

SEQ ID NO: 2726575 - RNA, 19 nt, Human
auauuuuuuucugaaauuu

SEQ ID NO: 2726576 - RNA, 18 nt, Human
auauuuuuuucuuuucuu

SEQ ID NO: 2726577 - RNA, 18 nt, Human
auauuuuuuucugaaauu

SEQ ID NO: 2726578 - RNA, 16 nt, Human
auauuuuuuucugaaa

SEQ ID NO: 2726579 - RNA, 14 nt, Human
auauuuuuuucuga

SEQ ID NO: 2726580 - RNA, 20 nt, Human
aucaaagggugaaaauuauu

SEQ ID NO: 2726581 - RNA, 18 nt, Human
aucaaagagagaaaauaa

SEQ ID NO: 2726582 - RNA, 19 nt, Human
aucaaagagguuuuaaaaa

SEQ ID NO: 2726583 - RNA, 20 nt, Human
aucaaaagguuaauaaagua

SEQ ID NO: 2726584 - RNA, 24 nt, Human
aucaaaagguuaauaaaguaauua

SEQ ID NO: 2726585 - RNA, 14 nt, Human
auagcacagacccu

SEQ ID NO: 2726586 - RNA, 23 nt, Human
auggcuuccuggcaauagucaaa

SEQ ID NO: 2726587 - RNA, 16 nt, Human
auggcuuuguauagaa

SEQ ID NO: 2726588 - RNA, 15 nt, Human
auggcuuuguauaga

SEQ ID NO: 2726589 - RNA, 20 nt, Human
augggaaagcauuguaaaug

SEQ ID NO: 2726590 - RNA, 14 nt, Human
augggaaagcauug

SEQ ID NO: 2726591 - RNA, 21 nt, Human
augggaaugaaugucagugug

SEQ ID NO: 2726592 - RNA, 20 nt, Human
augggacauuugcucaugga

SEQ ID NO: 2726593 - RNA, 16 nt, Human
augcuuugaucccuuc

SEQ ID NO: 2726594 - RNA, 19 nt, Human
augcucugcauguuacaua

SEQ ID NO: 2726595 - RNA, 18 nt, Human
augcucugcauguuacau

SEQ ID NO: 2726596 - RNA, 14 nt, Human
augcuucuucagag

SEQ ID NO: 2726597 - RNA, 17 nt, Human
augcuucuucagagacu

SEQ ID NO: 2726598 - RNA, 20 nt, Human
augcuucuucagagacuccu

SEQ ID NO: 2726599 - RNA, 21 nt, Human
augccugguggcagcugcggu

SEQ ID NO: 2726600 - RNA, 11 nt, Human
augccuggugg

SEQ ID NO: 2726601 - RNA, 12 nt, Human
augccugguggc

SEQ ID NO: 2726602 - RNA, 13 nt, Human
augccugguggca

SEQ ID NO: 2726603 - RNA, 14 nt, Human
augccugguggcag

SEQ ID NO: 2726604 - RNA, 19 nt, Human
augccugguggcagcugcg

SEQ ID NO: 2726605 - RNA, 18 nt, Human
augccugguggcagcugc

SEQ ID NO: 2726606 - RNA, 23 nt, Human
augaaguaauaugcacacauuuu

SEQ ID NO: 2726607 - RNA, 21 nt, Human
augaaguaauaugcacacauu

SEQ ID NO: 2726608 - RNA, 14 nt, Human
augaaguaauaugc

SEQ ID NO: 2726609 - RNA, 23 nt, Human
augaagcauuuacuuuguguuca

SEQ ID NO: 2726610 - RNA, 12 nt, Human
augaaagacugu

SEQ ID NO: 2726611 - RNA, 16 nt, Human
augaaacuuuuggaag

SEQ ID NO: 2726612 - RNA, 18 nt, Human
augaaacuuguguaaaua

SEQ ID NO: 2726613 - RNA, 11 nt, Human
augagccuggc

SEQ ID NO: 2726614 - RNA, 21 nt, Human
augagccucagcauccuggca

SEQ ID NO: 2726615 - RNA, 19 nt, Human
augagccucagcauccugg

SEQ ID NO: 2726616 - RNA, 13 nt, Human
augaccuuucaau

SEQ ID NO: 2726617 - RNA, 15 nt, Human
augaccuuucaauag

SEQ ID NO: 2726618 - RNA, 18 nt, Human
augaccuuucaauaggaa

SEQ ID NO: 2726619 - RNA, 23 nt, Human
aucuaggaagacuuuggaaagag

SEQ ID NO: 2726620 - RNA, 20 nt, Human
agggauuagggagagaagau

SEQ ID NO: 2726621 - RNA, 13 nt, Human
agggccuggcuca

SEQ ID NO: 2726622 - RNA, 14 nt, Human
agggccuggcucag

SEQ ID NO: 2726623 - RNA, 18 nt, Human
agggccuggcucaggugg

SEQ ID NO: 2726624 - RNA, 17 nt, Human
agggacaggauaagagg

SEQ ID NO: 2726625 - RNA, 17 nt, Human
aggcugcagugagccga

SEQ ID NO: 2726626 - RNA, 19 nt, Human
aggcugcagugagccgaga

SEQ ID NO: 2726627 - RNA, 23 nt, Human
aggcuguaucccaugagccucag

SEQ ID NO: 2726628 - RNA, 12 nt, Human
aggcugucaauu

SEQ ID NO: 2726629 - RNA, 24 nt, Human
aggcuguaucccaugagccucagc

SEQ ID NO: 2726630 - RNA, 19 nt, Human
aggcccucugcccacuccc

SEQ ID NO: 2726631 - RNA, 20 nt, Human
aggcccucugcccacucccu

SEQ ID NO: 2726632 - RNA, 23 nt, Human
aggccaugggcacuguggguaga

SEQ ID NO: 2726633 - RNA, 14 nt, Human
aggccaugggccuc

SEQ ID NO: 2726634 - RNA, 16 nt, Human
aggccaugggccuccu

SEQ ID NO: 2726635 - RNA, 17 nt, Human
aggccaugggccuccug

SEQ ID NO: 2726636 - RNA, 17 nt, Human
aggcccucugcccacuc

SEQ ID NO: 2726637 - RNA, 13 nt, Human
aggccagcugcuu

SEQ ID NO: 2726638 - RNA, 14 nt, Human
aggccagcugcuug

SEQ ID NO: 2726639 - RNA, 16 nt, Human
aggccagcugcuuggg

SEQ ID NO: 2726640 - RNA, 16 nt, Human
aggccaggcccucugc

SEQ ID NO: 2726641 - RNA, 17 nt, Human
aggccaggcccucugcc

SEQ ID NO: 2726642 - RNA, 18 nt, Human
aggccaggcccucugccc

SEQ ID NO: 2726643 - RNA, 19 nt, Human
aggccaggcccucugccca

SEQ ID NO: 2726644 - RNA, 23 nt, Human
aggccaggcccucugcccacucc

SEQ ID NO: 2726645 - RNA, 12 nt, Human
aggcauguucuc

SEQ ID NO: 2726646 - RNA, 23 nt, Human
aggcaugugaugagaggaaauca

SEQ ID NO: 2726647 - RNA, 24 nt, Human
aggcaugugaugagaggaaaucac

SEQ ID NO: 2726648 - RNA, 12 nt, Human
aggccagcugcu

SEQ ID NO: 2726649 - RNA, 22 nt, Human
aggcauuccccaggaggccagc

SEQ ID NO: 2726650 - RNA, 23 nt, Human
aggcauuccccaggaggccagcc

SEQ ID NO: 2726651 - RNA, 21 nt, Human
aggcauuccccaggaggccag

SEQ ID NO: 2726652 - RNA, 20 nt, Human
aggcauguucucugaggaca

SEQ ID NO: 2726653 - RNA, 22 nt, Human
aggcauguucucugaggacacu

SEQ ID NO: 2726654 - RNA, 13 nt, Human
aggcagauacagg

SEQ ID NO: 2726655 - RNA, 14 nt, Human
aggcagccaggcca

SEQ ID NO: 2726656 - RNA, 15 nt, Human
aggcagccaggccac

SEQ ID NO: 2726657 - RNA, 16 nt, Human
aggcagccaggccaca

SEQ ID NO: 2726658 - RNA, 15 nt, Human
aggaggucucuaaga

SEQ ID NO: 2726659 - RNA, 12 nt, Human
aggagugagcac

SEQ ID NO: 2726660 - RNA, 14 nt, Human
aggagugagcacua

SEQ ID NO: 2726661 - RNA, 14 nt, Human
aggaggucucuaag

SEQ ID NO: 2726662 - RNA, 19 nt, Human
aggaaguacuggagaaaau

SEQ ID NO: 2726663 - RNA, 13 nt, Human
agcuacaaaugca

SEQ ID NO: 2726664 - RNA, 13 nt, Human
agcucaccagccc

SEQ ID NO: 2726665 - RNA, 14 nt, Human
agcucaccagcccc

SEQ ID NO: 2726666 - RNA, 21 nt, Human
agcucaccagccccagugccc

SEQ ID NO: 2726667 - RNA, 12 nt, Human
agcuacaaaugc

SEQ ID NO: 2726668 - RNA, 15 nt, Human
agcuaaugggacacu

SEQ ID NO: 2726669 - RNA, 13 nt, Human
agcuaaugggaca

SEQ ID NO: 2726670 - RNA, 14 nt, Human
agcuaaugggacac

SEQ ID NO: 2726671 - RNA, 17 nt, Human
agcgauucuucugcuuc

SEQ ID NO: 2726672 - RNA, 19 nt, Human
agcgauucuucugcuucag

SEQ ID NO: 2726673 - RNA, 15 nt, Human
agcgauucuucugcu

SEQ ID NO: 2726674 - RNA, 20 nt, Human
agcuaacauggaaguacuau

SEQ ID NO: 2726675 - RNA, 19 nt, Human
agcuaacauggaaguacua

SEQ ID NO: 2726676 - RNA, 14 nt, Human
agccuggacccugu

SEQ ID NO: 2726677 - RNA, 20 nt, Human
agccugggaggucaaggcug

SEQ ID NO: 2726678 - RNA, 18 nt, Human
agccugggcaaugugaua

SEQ ID NO: 2726679 - RNA, 20 nt, Human
agcugcugaaacaacaaaua

SEQ ID NO: 2726680 - RNA, 16 nt, Human
agcugcugaaacaaca

SEQ ID NO: 2726681 - RNA, 15 nt, Human
agcugcugaaacaac

SEQ ID NO: 2726682 - RNA, 14 nt, Human
agcugcugaaacaa

SEQ ID NO: 2726683 - RNA, 14 nt, Human
agcuggugcccugc

SEQ ID NO: 2726684 - RNA, 15 nt, Human
agcuggucccacuca

SEQ ID NO: 2726685 - RNA, 14 nt, Human
agcuguaugauucc

SEQ ID NO: 2726686 - RNA, 15 nt, Human
agcugacuuuucugu

SEQ ID NO: 2726687 - RNA, 21 nt, Human
agcugacuuuucuguccgagc

SEQ ID NO: 2726688 - RNA, 22 nt, Human
agcucaccagccccagugccca

SEQ ID NO: 2726689 - RNA, 23 nt, Human
agcucaccagccccagugcccac

SEQ ID NO: 2726690 - RNA, 17 nt, Human
agcuguaugauucccag

SEQ ID NO: 2726691 - RNA, 18 nt, Human
agcuguaugauucccagc

SEQ ID NO: 2726692 - RNA, 18 nt, Human
aggaaaaaauaacaauga

SEQ ID NO: 2726693 - RNA, 23 nt, Human
agcuuuuuucucugauacagaaa

SEQ ID NO: 2726694 - RNA, 19 nt, Human
agcuuuuuucucugauaca

SEQ ID NO: 2726695 - RNA, 22 nt, Human
agcuuuuuucucugauacagaa

SEQ ID NO: 2726696 - RNA, 20 nt, Human
agcuuuuuucucugauacag

SEQ ID NO: 2726697 - RNA, 21 nt, Human
agcuuuguuuguugucagcug

SEQ ID NO: 2726698 - RNA, 11 nt, Human
aggaaguacug

SEQ ID NO: 2726699 - RNA, 15 nt, Human
aggaaguacuggaga

SEQ ID NO: 2726700 - RNA, 14 nt, Human
aggaagguagaaau

SEQ ID NO: 2726701 - RNA, 23 nt, Human
aggaacaaggcaaggcugucaau

SEQ ID NO: 2726702 - RNA, 12 nt, Human
aggaacacuccu

SEQ ID NO: 2726703 - RNA, 23 nt, Human
aggaacuuaaauaaugugaaacu

SEQ ID NO: 2726704 - RNA, 15 nt, Human
aggaacacuccuuca

SEQ ID NO: 2726705 - RNA, 19 nt, Human
agacaaggaaaaaauaaca

SEQ ID NO: 2726706 - RNA, 20 nt, Human
agacaaugugaaaagaaaaa

SEQ ID NO: 2726707 - RNA, 23 nt, Human
agacaaugacuuacuguacauga

SEQ ID NO: 2726708 - RNA, 20 nt, Human
agacgcugugcugcccugcc

SEQ ID NO: 2726709 - RNA, 17 nt, Human
agacgcugugcugcccu

SEQ ID NO: 2726710 - RNA, 18 nt, Human
agacgcugugcugcccug

SEQ ID NO: 2726711 - RNA, 19 nt, Human
agacgcugugcugcccugc

SEQ ID NO: 2726712 - RNA, 21 nt, Human
agacagcccgggcucugccuc

SEQ ID NO: 2726713 - RNA, 14 nt, Human
agacaauuuauuau

SEQ ID NO: 2726714 - RNA, 22 nt, Human
agacagcccgggcucugccucc

SEQ ID NO: 2726715 - RNA, 23 nt, Human
agacagcccgggcucugccuccc

SEQ ID NO: 2726716 - RNA, 14 nt, Human
agaccacguuucua

SEQ ID NO: 2726717 - RNA, 23 nt, Human
agaccaucccugaaggccccgcc

SEQ ID NO: 2726718 - RNA, 16 nt, Human
agacucuuuggacacu

SEQ ID NO: 2726719 - RNA, 17 nt, Human
agagcccacgcccccac

SEQ ID NO: 2726720 - RNA, 18 nt, Human
agagcccacgcccccacu

SEQ ID NO: 2726721 - RNA, 23 nt, Human
agagagcaagacgcugugcugcc

SEQ ID NO: 2726722 - RNA, 11 nt, Human
agagagcaaga

SEQ ID NO: 2726723 - RNA, 19 nt, Human
agagagcaagacgcugugc

SEQ ID NO: 2726724 - RNA, 17 nt, Human
agaaccaaaaagaggcu

SEQ ID NO: 2726725 - RNA, 18 nt, Human
agaaccaaaaagaggcua

SEQ ID NO: 2726726 - RNA, 19 nt, Human
agaacagauaaucagugug

SEQ ID NO: 2726727 - RNA, 13 nt, Human
agaagagcuguuc

SEQ ID NO: 2726728 - RNA, 15 nt, Human
agaagagaaugcaca

SEQ ID NO: 2726729 - RNA, 23 nt, Human
agaagagaaugcacaaacagagg

SEQ ID NO: 2726730 - RNA, 13 nt, Human
agaagauagcagg

SEQ ID NO: 2726731 - RNA, 20 nt, Human
agaagagcuguucacagcca

SEQ ID NO: 2726732 - RNA, 21 nt, Human
agaagacugcauuauauuuau

SEQ ID NO: 2726733 - RNA, 21 nt, Human
agaaccaaaaagaggcuaugu

SEQ ID NO: 2726734 - RNA, 19 nt, Human
agaagucuuagauguauau

SEQ ID NO: 2726735 - RNA, 17 nt, Human
agaagucuuagauguau

SEQ ID NO: 2726736 - RNA, 14 nt, Human
agaagucacacagu

SEQ ID NO: 2726737 - RNA, 23 nt, Human
agaaugcacaaacagaggccgcc

SEQ ID NO: 2726738 - RNA, 18 nt, Human
agaaugcucuuuacuuca

SEQ ID NO: 2726739 - RNA, 16 nt, Human
agaaugaaagggccca

SEQ ID NO: 2726740 - RNA, 17 nt, Human
agaaucucaaauaacua

SEQ ID NO: 2726741 - RNA, 23 nt, Human
agcaaaauuuuuucucuaggaaa

SEQ ID NO: 2726742 - RNA, 23 nt, Human
agcaaaauugauguguuuauuua

SEQ ID NO: 2726743 - RNA, 19 nt, Human
agcaaauucuguuuuucua

SEQ ID NO: 2726744 - RNA, 13 nt, Human
agcaaaauugaug

SEQ ID NO: 2726745 - RNA, 19 nt, Human
agcaaaauugauguguuua

SEQ ID NO: 2726746 - RNA, 16 nt, Human
agauugcaccacugca

SEQ ID NO: 2726747 - RNA, 17 nt, Human
agauugcaacaggcugg

SEQ ID NO: 2726748 - RNA, 19 nt, Human
agauugcaacaggcugggc

SEQ ID NO: 2726749 - RNA, 18 nt, Human
agauucuuuccugaggcu

SEQ ID NO: 2726750 - RNA, 15 nt, Human
agauucuuuccugag

SEQ ID NO: 2726751 - RNA, 16 nt, Human
agauucuuuccugagg

SEQ ID NO: 2726752 - RNA, 16 nt, Human
agauugcaacaggcug

SEQ ID NO: 2726753 - RNA, 18 nt, Human
agaugacaucugucuagg

SEQ ID NO: 2726754 - RNA, 20 nt, Human
agaugggugcuuggaggaag

SEQ ID NO: 2726755 - RNA, 22 nt, Human
agaugggugcuuggaggaagga

SEQ ID NO: 2726756 - RNA, 14 nt, Human
agauucuuuccuga

SEQ ID NO: 2726757 - RNA, 18 nt, Human
agaucugccuaaggacuu

SEQ ID NO: 2726758 - RNA, 13 nt, Human
agaucugccuaag

SEQ ID NO: 2726759 - RNA, 20 nt, Human
agauagauaggucagugcaa

SEQ ID NO: 2726760 - RNA, 20 nt, Human
agauagccaaggccaaagga

SEQ ID NO: 2726761 - RNA, 14 nt, Human
agaguugaagacag

SEQ ID NO: 2726762 - RNA, 15 nt, Human
agaguugaagacaga

SEQ ID NO: 2726763 - RNA, 13 nt, Human
agaguugaagaca

SEQ ID NO: 2726764 - RNA, 20 nt, Human
agagggucugaggaauccag

SEQ ID NO: 2726765 - RNA, 23 nt, Human
agaggggguggccucccaacuca

SEQ ID NO: 2726766 - RNA, 14 nt, Human
agauaugauucaaa

SEQ ID NO: 2726767 - RNA, 16 nt, Human
agauaugauucaaaug

SEQ ID NO: 2726768 - RNA, 15 nt, Human
agauaugauucaaau

SEQ ID NO: 2726769 - RNA, 19 nt, Human
agcacugacuucuaaguaa

SEQ ID NO: 2726770 - RNA, 16 nt, Human
agcagccuggacccug

SEQ ID NO: 2726771 - RNA, 17 nt, Human
agcacugacuucuaagu

SEQ ID NO: 2726772 - RNA, 20 nt, Human
agcagccuggacccugugga

SEQ ID NO: 2726773 - RNA, 18 nt, Human
agcagcguuucuaugaca

SEQ ID NO: 2726774 - RNA, 19 nt, Human
agcagcguuucuaugacac

SEQ ID NO: 2726775 - RNA, 13 nt, Human
agcagugcaugcu

SEQ ID NO: 2726776 - RNA, 16 nt, Human
agcagugcaugcuguc

SEQ ID NO: 2726777 - RNA, 17 nt, Human
agcagugcaugcugucc

SEQ ID NO: 2726778 - RNA, 20 nt, Human
agcacuaaggugugcucuga

SEQ ID NO: 2726779 - RNA, 21 nt, Human
agcacagacccugcccugugg

SEQ ID NO: 2726780 - RNA, 14 nt, Human
agccagcaguucag

SEQ ID NO: 2726781 - RNA, 23 nt, Human
agccagcaggcucucaggccagc

SEQ ID NO: 2726782 - RNA, 22 nt, Human
agccagcaggcucucaggccag

SEQ ID NO: 2726783 - RNA, 21 nt, Human
agccagcaggcucucaggcca

SEQ ID NO: 2726784 - RNA, 13 nt, Human
agcccaccuuggc

SEQ ID NO: 2726785 - RNA, 23 nt, Human
agcccaccccucaacaccucugc

SEQ ID NO: 2726786 - RNA, 17 nt, Human
agcccacgcccccacug

SEQ ID NO: 2726787 - RNA, 18 nt, Human
agcccacgcccccacugg

SEQ ID NO: 2726788 - RNA, 19 nt, Human
agcccacgcccccacuggu

SEQ ID NO: 2726789 - RNA, 14 nt, Human
agccagauuucacu

SEQ ID NO: 2726790 - RNA, 17 nt, Human
agccagauuucacucuc

SEQ ID NO: 2726791 - RNA, 20 nt, Human
agccagauuucacucuccuu

SEQ ID NO: 2726792 - RNA, 22 nt, Human
agccagauuucacucuccuugg

SEQ ID NO: 2726793 - RNA, 16 nt, Human
agcaucuaugugagac

SEQ ID NO: 2726794 - RNA, 16 nt, Human
gccugccucuucucua

SEQ ID NO: 2726795 - RNA, 15 nt, Human
gccuggccccucagg

SEQ ID NO: 2726796 - RNA, 16 nt, Human
gccuggccccucaggg

SEQ ID NO: 2726797 - RNA, 17 nt, Human
gccuggccccucagggu

SEQ ID NO: 2726798 - RNA, 10 nt, Human
gccuggccug

SEQ ID NO: 2726799 - RNA, 20 nt, Human
gccuggccccucaggguccc

SEQ ID NO: 2726800 - RNA, 22 nt, Human
gccuggccccucagggucccug

SEQ ID NO: 2726801 - RNA, 21 nt, Human
gccugggaggucaaggcugca

SEQ ID NO: 2726802 - RNA, 22 nt, Human
gccugggaggucaaggcugcag

SEQ ID NO: 2726803 - RNA, 14 nt, Human
gccugggaucccuc

SEQ ID NO: 2726804 - RNA, 21 nt, Human
gccugggaucccucauccuca

SEQ ID NO: 2726805 - RNA, 18 nt, Human
gccugggaucccucaucc

SEQ ID NO: 2726806 - RNA, 13 nt, Human
gccuccuccagcc

SEQ ID NO: 2726807 - RNA, 18 nt, Human
gccuccugcccuuaccug

SEQ ID NO: 2726808 - RNA, 12 nt, Human
gccucugggacu

SEQ ID NO: 2726809 - RNA, 13 nt, Human
gccuccugugugu

SEQ ID NO: 2726810 - RNA, 17 nt, Human
gccugcccaggccccug

SEQ ID NO: 2726811 - RNA, 18 nt, Human
gccugcccaggccccugc

SEQ ID NO: 2726812 - RNA, 19 nt, Human
gccugcccaggccccugcc

SEQ ID NO: 2726813 - RNA, 12 nt, Human
gccucuucucua

SEQ ID NO: 2726814 - RNA, 23 nt, Human
gccucuucucuacucuagggaaa

SEQ ID NO: 2726815 - RNA, 14 nt, Human
gcccugccuccuuu

SEQ ID NO: 2726816 - RNA, 16 nt, Human
gcccugccuccuuugu

SEQ ID NO: 2726817 - RNA, 22 nt, Human
gcccugccuccuuugugaggaa

SEQ ID NO: 2726818 - RNA, 13 nt, Human
gcccuguuaaaag

SEQ ID NO: 2726819 - RNA, 17 nt, Human
gcccuguuaaaagauga

SEQ ID NO: 2726820 - RNA, 14 nt, Human
gcccuguuaaaaga

SEQ ID NO: 2726821 - RNA, 21 nt, Human
gcccugugggcccccaaaugg

SEQ ID NO: 2726822 - RNA, 15 nt, Human
gccgccaugcuccug

SEQ ID NO: 2726823 - RNA, 16 nt, Human
gcccuuaccugccagg

SEQ ID NO: 2726824 - RNA, 20 nt, Human
gcccuuaccugccaggaagc

SEQ ID NO: 2726825 - RNA, 16 nt, Human
gccgccaugcuccugg

SEQ ID NO: 2726826 - RNA, 13 nt, Human
gcccacucccugc

SEQ ID NO: 2726827 - RNA, 19 nt, Human
gcccacucccugcaaccug

SEQ ID NO: 2726828 - RNA, 14 nt, Human
gcccacucccugca

SEQ ID NO: 2726829 - RNA, 15 nt, Human
gcccacucccugcaa

SEQ ID NO: 2726830 - RNA, 22 nt, Human
gcccuaaaguguauuuuuuuac

SEQ ID NO: 2726831 - RNA, 16 nt, Human
gccccuggaugcagcc

SEQ ID NO: 2726832 - RNA, 18 nt, Human
gccccuggaugcagccuc

SEQ ID NO: 2726833 - RNA, 22 nt, Human
gccccuggaugcagccucacag

SEQ ID NO: 2726834 - RNA, 16 nt, Human
gcccccaggugccagu

SEQ ID NO: 2726835 - RNA, 19 nt, Human
gccccaaaacucuccucug

SEQ ID NO: 2726836 - RNA, 18 nt, Human
gccccaaaacucuccucu

SEQ ID NO: 2726837 - RNA, 13 nt, Human
gccccugcccggc

SEQ ID NO: 2726838 - RNA, 14 nt, Human
gccccugcccggcu

SEQ ID NO: 2726839 - RNA, 16 nt, Human
gccacauuccugaugc

SEQ ID NO: 2726840 - RNA, 20 nt, Human
gccacauuccugaugcuucu

SEQ ID NO: 2726841 - RNA, 19 nt, Human
gccaccaacauacucccau

SEQ ID NO: 2726842 - RNA, 20 nt, Human
gccaccaacauacucccauc

SEQ ID NO: 2726843 - RNA, 21 nt, Human
gccaccaacauacucccaucu

SEQ ID NO: 2726844 - RNA, 22 nt, Human
gccaccaacauacucccaucug

SEQ ID NO: 2726845 - RNA, 21 nt, Human
gccacugcacuauagccuagg

SEQ ID NO: 2726846 - RNA, 13 nt, Human
gccacccugggga

SEQ ID NO: 2726847 - RNA, 19 nt, Human
gccacccuggggagaaagu

SEQ ID NO: 2726848 - RNA, 23 nt, Human
gccacugcaccgggccacagaga

SEQ ID NO: 2726849 - RNA, 18 nt, Human
gccacugugaagagaacc

SEQ ID NO: 2726850 - RNA, 19 nt, Human
gccacugugaagagaacca

SEQ ID NO: 2726851 - RNA, 21 nt, Human
gccacuguuuugaaucucaua

SEQ ID NO: 2726852 - RNA, 16 nt, Human
gccauaugaaaaggcu

SEQ ID NO: 2726853 - RNA, 19 nt, Human
gccauauucuguuggccag

SEQ ID NO: 2726854 - RNA, 20 nt, Human
gccauauucuguuggccagu

SEQ ID NO: 2726855 - RNA, 14 nt, Human
gccauguuggccag

SEQ ID NO: 2726856 - RNA, 15 nt, Human
gccauguuggccagg

SEQ ID NO: 2726857 - RNA, 16 nt, Human
gccauguuggccaggc

SEQ ID NO: 2726858 - RNA, 17 nt, Human
gccauguuggccaggcu

SEQ ID NO: 2726859 - RNA, 18 nt, Human
gccauguuggccaggcug

SEQ ID NO: 2726860 - RNA, 15 nt, Human
gcccacgcuggagug

SEQ ID NO: 2726861 - RNA, 16 nt, Human
gcccacgcuggagugc

SEQ ID NO: 2726862 - RNA, 17 nt, Human
gcccacgcuggagugca

SEQ ID NO: 2726863 - RNA, 18 nt, Human
gcccaccuuggcucaagu

SEQ ID NO: 2726864 - RNA, 13 nt, Human
gcccacgccccca

SEQ ID NO: 2726865 - RNA, 14 nt, Human
gcccacgcccccac

SEQ ID NO: 2726866 - RNA, 19 nt, Human
gccauguuggccaggcugg

SEQ ID NO: 2726867 - RNA, 20 nt, Human
gccauguuggccaggcuggu

SEQ ID NO: 2726868 - RNA, 22 nt, Human
gccauguuggccaggcuggucu

SEQ ID NO: 2726869 - RNA, 24 nt, Human
gccauguuggccaggcuggucuca

SEQ ID NO: 2726870 - RNA, 23 nt, Human
gccaggccacaagacccuugugg

SEQ ID NO: 2726871 - RNA, 12 nt, Human
gccaggccagag

SEQ ID NO: 2726872 - RNA, 13 nt, Human
gccaggccagagg

SEQ ID NO: 2726873 - RNA, 15 nt, Human
gccaggcccucugcc

SEQ ID NO: 2726874 - RNA, 16 nt, Human
gccaggcccucugccc

SEQ ID NO: 2726875 - RNA, 17 nt, Human
gccaggcccucugccca

SEQ ID NO: 2726876 - RNA, 21 nt, Human
gccaggcccucugcccacucc

SEQ ID NO: 2726877 - RNA, 19 nt, Human
gccaggcccucugcccacu

SEQ ID NO: 2726878 - RNA, 20 nt, Human
gccaggcccucugcccacuc

SEQ ID NO: 2726879 - RNA, 19 nt, Human
gccagauuuuccugaaaac

SEQ ID NO: 2726880 - RNA, 22 nt, Human
gccagcaguucagagcugcccu

SEQ ID NO: 2726881 - RNA, 23 nt, Human
gccagcaguucagagcugcccuc

SEQ ID NO: 2726882 - RNA, 21 nt, Human
gccagcaggcucucaggccag

SEQ ID NO: 2726883 - RNA, 23 nt, Human
gccagcaggcucucaggccagcu

SEQ ID NO: 2726884 - RNA, 17 nt, Human
gccagcaggcucucagg

SEQ ID NO: 2726885 - RNA, 18 nt, Human
gccagcaggcucucaggc

SEQ ID NO: 2726886 - RNA, 19 nt, Human
gccagcaggcucucaggcc

SEQ ID NO: 2726887 - RNA, 20 nt, Human
gccagcaggcucucaggcca

SEQ ID NO: 2726888 - RNA, 13 nt, Human
gccagcaggcucu

SEQ ID NO: 2726889 - RNA, 16 nt, Human
gccagcaggcucucag

SEQ ID NO: 2726890 - RNA, 22 nt, Human
gcugaauacagaggcaacugca

SEQ ID NO: 2726891 - RNA, 17 nt, Human
gcugaaugguuuucaaa

SEQ ID NO: 2726892 - RNA, 12 nt, Human
gcugaaggcucg

SEQ ID NO: 2726893 - RNA, 20 nt, Human
gcugaaggcucgagcaugcc

SEQ ID NO: 2726894 - RNA, 14 nt, Human
gcugacagacacag

SEQ ID NO: 2726895 - RNA, 15 nt, Human
gcugacagacacagg

SEQ ID NO: 2726896 - RNA, 16 nt, Human
gcugacagacacaggc

SEQ ID NO: 2726897 - RNA, 12 nt, Human
gcucuuccaggc

SEQ ID NO: 2726898 - RNA, 15 nt, Human
gcucuuccaggcugg

SEQ ID NO: 2726899 - RNA, 16 nt, Human
gcucuuccaggcuggg

SEQ ID NO: 2726900 - RNA, 15 nt, Human
gcucuguccugggag

SEQ ID NO: 2726901 - RNA, 14 nt, Human
gcucuguccuggga

SEQ ID NO: 2726902 - RNA, 16 nt, Human
gcucuguccugggagu

SEQ ID NO: 2726903 - RNA, 13 nt, Human
gcucucaggccag

SEQ ID NO: 2726904 - RNA, 14 nt, Human
gcucucaggccagc

SEQ ID NO: 2726905 - RNA, 15 nt, Human
gcucucaggccagcu

SEQ ID NO: 2726906 - RNA, 16 nt, Human
gcucucaggccagcug

SEQ ID NO: 2726907 - RNA, 20 nt, Human
gcucccaggcauuccccagg

SEQ ID NO: 2726908 - RNA, 21 nt, Human
gcucccaggcauuccccagga

SEQ ID NO: 2726909 - RNA, 22 nt, Human
gcucccaggcauuccccaggag

SEQ ID NO: 2726910 - RNA, 14 nt, Human
gcuccccagcccca

SEQ ID NO: 2726911 - RNA, 18 nt, Human
gcuccccucggagaagag

SEQ ID NO: 2726912 - RNA, 15 nt, Human
gcuccccucggagaa

SEQ ID NO: 2726913 - RNA, 21 nt, Human
gcucagguggggucacucugg

SEQ ID NO: 2726914 - RNA, 22 nt, Human
gcucagguggggucacucuggc

SEQ ID NO: 2726915 - RNA, 12 nt, Human
gcucagggccug

SEQ ID NO: 2726916 - RNA, 17 nt, Human
gcucagggccuggcuca

SEQ ID NO: 2726917 - RNA, 13 nt, Human
gcucagggccugg

SEQ ID NO: 2726918 - RNA, 16 nt, Human
gcucagggccuggcuc

SEQ ID NO: 2726919 - RNA, 15 nt, Human
gcucagagagggugg

SEQ ID NO: 2726920 - RNA, 22 nt, Human
gcucagagagggugggaguggg

SEQ ID NO: 2726921 - RNA, 18 nt, Human
gcucagagagggugggag

SEQ ID NO: 2726922 - RNA, 20 nt, Human
gcucagagagggugggagug

SEQ ID NO: 2726923 - RNA, 20 nt, Human
gccuguucagcuccagcuca

SEQ ID NO: 2726924 - RNA, 19 nt, Human
gccuguucagcuccagcuc

SEQ ID NO: 2726925 - RNA, 21 nt, Human
gcuaguaauuggaaaggcagc

SEQ ID NO: 2726926 - RNA, 14 nt, Human
gcuaggccuggcca

SEQ ID NO: 2726927 - RNA, 15 nt, Human
gcuaggccuggccag

SEQ ID NO: 2726928 - RNA, 16 nt, Human
gcuaggaacacuccuu

SEQ ID NO: 2726929 - RNA, 18 nt, Human
gcuaggaacacuccuuca

SEQ ID NO: 2726930 - RNA, 19 nt, Human
gcuaggaacacuccuucac

SEQ ID NO: 2726931 - RNA, 21 nt, Human
gcuaggaacacuccuucacag

SEQ ID NO: 2726932 - RNA, 14 nt, Human
gcuggguuggaggg

SEQ ID NO: 2726933 - RNA, 21 nt, Human
gcuggguuggaggguguccca

SEQ ID NO: 2726934 - RNA, 15 nt, Human
gcuggguucuaccca

SEQ ID NO: 2726935 - RNA, 15 nt, Human
gcuggguucugaucc

SEQ ID NO: 2726936 - RNA, 20 nt, Human
gcuguaucccaugagccuca

SEQ ID NO: 2726937 - RNA, 23 nt, Human
gcuguaucccaugagccucagca

SEQ ID NO: 2726938 - RNA, 13 nt, Human
gcugugcugcccu

SEQ ID NO: 2726939 - RNA, 21 nt, Human
gcugugcucuggacaggcaug

SEQ ID NO: 2726940 - RNA, 12 nt, Human
gcugugcugccc

SEQ ID NO: 2726941 - RNA, 21 nt, Human
gcuguuggcugggggccucag

SEQ ID NO: 2726942 - RNA, 22 nt, Human
gcuguuggcugggggccucagu

SEQ ID NO: 2726943 - RNA, 19 nt, Human
gcugugcugcccugcccac

SEQ ID NO: 2726944 - RNA, 22 nt, Human
gcugugcugcccugcccaccug

SEQ ID NO: 2726945 - RNA, 14 nt, Human
gcuuaacuucacau

SEQ ID NO: 2726946 - RNA, 22 nt, Human
gcuucaaggauccugagccaga

SEQ ID NO: 2726947 - RNA, 20 nt, Human
gcuucacggaagagccuugc

SEQ ID NO: 2726948 - RNA, 22 nt, Human
gcuuccuucugugaaaguacau

SEQ ID NO: 2726949 - RNA, 19 nt, Human
gcuugggcuucauccuccu

SEQ ID NO: 2726950 - RNA, 16 nt, Human
gcuuguacauaaugcg

SEQ ID NO: 2726951 - RNA, 14 nt, Human
gcuuguacauaaug

SEQ ID NO: 2726952 - RNA, 12 nt, Human
gcuggagugcag

SEQ ID NO: 2726953 - RNA, 15 nt, Human
gcuggguguggcgca

SEQ ID NO: 2726954 - RNA, 19 nt, Human
gcugggcagaggaaagcaa

SEQ ID NO: 2726955 - RNA, 16 nt, Human
gcugggcagaggaaag

SEQ ID NO: 2726956 - RNA, 17 nt, Human
gcugggcagaggaaagc

SEQ ID NO: 2726957 - RNA, 12 nt, Human
gcugggcucccu

SEQ ID NO: 2726958 - RNA, 16 nt, Human
gcugggcucccuuccc

SEQ ID NO: 2726959 - RNA, 17 nt, Human
gcugggcucccuuccca

SEQ ID NO: 2726960 - RNA, 20 nt, Human
gcugggcucccuucccaccu

SEQ ID NO: 2726961 - RNA, 19 nt, Human
gcugggauuacagguguga

SEQ ID NO: 2726962 - RNA, 18 nt, Human
gcugggauuacaggugug

SEQ ID NO: 2726963 - RNA, 13 nt, Human
gcugggcagagga

SEQ ID NO: 2726964 - RNA, 14 nt, Human
gcugggcagaggaa

SEQ ID NO: 2726965 - RNA, 15 nt, Human
gcugggcagaggaaa

SEQ ID NO: 2726966 - RNA, 14 nt, Human
gcuggagugcagug

SEQ ID NO: 2726967 - RNA, 15 nt, Human
gcuggagugcaguga

SEQ ID NO: 2726968 - RNA, 16 nt, Human
gcuggccuggccccuc

SEQ ID NO: 2726969 - RNA, 17 nt, Human
gcuggccuggccccuca

SEQ ID NO: 2726970 - RNA, 16 nt, Human
gcugggauuacaggug

SEQ ID NO: 2726971 - RNA, 18 nt, Human
gcuggccuggccccucag

SEQ ID NO: 2726972 - RNA, 19 nt, Human
gcuggccuggccccucagg

SEQ ID NO: 2726973 - RNA, 14 nt, Human
gcugcaccggcugg

SEQ ID NO: 2726974 - RNA, 16 nt, Human
gcugcaccggcuggcc

SEQ ID NO: 2726975 - RNA, 17 nt, Human
gcugcaccggcuggccu

SEQ ID NO: 2726976 - RNA, 22 nt, Human
gcugcaccggcuggccuggccc

SEQ ID NO: 2726977 - RNA, 18 nt, Human
gcugcaccggcuggccug

SEQ ID NO: 2726978 - RNA, 19 nt, Human
gcugcaccggcuggccugg

SEQ ID NO: 2726979 - RNA, 21 nt, Human
gcugccauccagguucagcuu

SEQ ID NO: 2726980 - RNA, 23 nt, Human
gcugccauccagguucagcuugu

SEQ ID NO: 2726981 - RNA, 19 nt, Human
gcugccagccgagauagcc

SEQ ID NO: 2726982 - RNA, 21 nt, Human
gcugccagccgagauagccaa

SEQ ID NO: 2726983 - RNA, 21 nt, Human
gcugccuccccuccucugcuu

SEQ ID NO: 2726984 - RNA, 22 nt, Human
gcugccuccccuccucugcuug

SEQ ID NO: 2726985 - RNA, 16 nt, Human
gcugccuccccuccuc

SEQ ID NO: 2726986 - RNA, 17 nt, Human
gcugccuccccuccucu

SEQ ID NO: 2726987 - RNA, 20 nt, Human
gcugccuccccuccucugcu

SEQ ID NO: 2726988 - RNA, 13 nt, Human
gcugccugggauc

SEQ ID NO: 2726989 - RNA, 19 nt, Human
gcugccugggaucccucau

SEQ ID NO: 2726990 - RNA, 16 nt, Human
gcugccugggaucccu

SEQ ID NO: 2726991 - RNA, 18 nt, Human
gcugccugggaucccuca

SEQ ID NO: 2726992 - RNA, 15 nt, Human
ggagagcuagcagca

SEQ ID NO: 2726993 - RNA, 13 nt, Human
ggagagccuucca

SEQ ID NO: 2726994 - RNA, 16 nt, Human
ggagagccuuccaggg

SEQ ID NO: 2726995 - RNA, 22 nt, Human
ggagagccuuccagggguggga

SEQ ID NO: 2726996 - RNA, 17 nt, Human
ggagagccuuccagggg

SEQ ID NO: 2726997 - RNA, 18 nt, Human
ggagagccuuccaggggu

SEQ ID NO: 2726998 - RNA, 9 nt, Human
ggacuuugu

SEQ ID NO: 2726999 - RNA, 19 nt, Human
ggagaaaauggacguguua

SEQ ID NO: 2727000 - RNA, 15 nt, Human
ggacuuggaagcucc

SEQ ID NO: 2727001 - RNA, 17 nt, Human
ggacuuggaagcuccgc

SEQ ID NO: 2727002 - RNA, 22 nt, Human
ggagaaccaaaaagaggcuaug

SEQ ID NO: 2727003 - RNA, 22 nt, Human
ggacucaaugcacugacauugu

SEQ ID NO: 2727004 - RNA, 12 nt, Human
ggaccucaggcc

SEQ ID NO: 2727005 - RNA, 20 nt, Human
ggacuacaggugugagucac

SEQ ID NO: 2727006 - RNA, 19 nt, Human
ggacccugaggcccagagg

SEQ ID NO: 2727007 - RNA, 14 nt, Human
ggacccugaggccc

SEQ ID NO: 2727008 - RNA, 15 nt, Human
ggacccugaggccca

SEQ ID NO: 2727009 - RNA, 18 nt, Human
ggacccugaggcccagag

SEQ ID NO: 2727010 - RNA, 19 nt, Human
gcuuguacauaaugcgugc

SEQ ID NO: 2727011 - RNA, 13 nt, Human
ggagcagccacau

SEQ ID NO: 2727012 - RNA, 21 nt, Human
ggagcagccacauuccugaug

SEQ ID NO: 2727013 - RNA, 15 nt, Human
ggaggucgaggcagg

SEQ ID NO: 2727014 - RNA, 16 nt, Human
ggaggucgaggcagga

SEQ ID NO: 2727015 - RNA, 14 nt, Human
ggaggucgaggcag

SEQ ID NO: 2727016 - RNA, 18 nt, Human
ggaggucgaggcaggagg

SEQ ID NO: 2727017 - RNA, 12 nt, Human
ggaggaagagaa

SEQ ID NO: 2727018 - RNA, 21 nt, Human
ggaggcaugugaugagaggaa

SEQ ID NO: 2727019 - RNA, 18 nt, Human
ggaggccaaggugggagg

SEQ ID NO: 2727020 - RNA, 13 nt, Human
ggaggccagccuu

SEQ ID NO: 2727021 - RNA, 22 nt, Human
ggagcugccuguucagcuccag

SEQ ID NO: 2727022 - RNA, 16 nt, Human
ggagcugaguggggga

SEQ ID NO: 2727023 - RNA, 12 nt, Human
ggcagaaggaag

SEQ ID NO: 2727024 - RNA, 14 nt, Human
ggcagccaggccac

SEQ ID NO: 2727025 - RNA, 10 nt, Human
ggcagagcag

SEQ ID NO: 2727026 - RNA, 15 nt, Human
ggcagccaggccaca

SEQ ID NO: 2727027 - RNA, 17 nt, Human
ggcagccaggccacaag

SEQ ID NO: 2727028 - RNA, 22 nt, Human
ggaugguucccuugaugaagaa

SEQ ID NO: 2727029 - RNA, 23 nt, Human
ggaugguucccuugaugaagaag

SEQ ID NO: 2727030 - RNA, 21 nt, Human
ggaugaauuccaaauucugcu

SEQ ID NO: 2727031 - RNA, 12 nt, Human
ggaugagaaagg

SEQ ID NO: 2727032 - RNA, 22 nt, Human
ggaugagaaagguugaagcacc

SEQ ID NO: 2727033 - RNA, 21 nt, Human
ggauuuugauccaagcugguc

SEQ ID NO: 2727034 - RNA, 23 nt, Human
ggauuaaacuuaaucuaaaugga

SEQ ID NO: 2727035 - RNA, 21 nt, Human
ggccaaaggaagcacaugccu

SEQ ID NO: 2727036 - RNA, 15 nt, Human
ggccaaagccaaagc

SEQ ID NO: 2727037 - RNA, 12 nt, Human
ggccaaaggaag

SEQ ID NO: 2727038 - RNA, 12 nt, Human
ggcauuguggga

SEQ ID NO: 2727039 - RNA, 13 nt, Human
ggccaagguggga

SEQ ID NO: 2727040 - RNA, 22 nt, Human
ggccagagggagugacagaggc

SEQ ID NO: 2727041 - RNA, 23 nt, Human
ggccagagggagugacagaggca

SEQ ID NO: 2727042 - RNA, 17 nt, Human
ggccagaugcaccagcc

SEQ ID NO: 2727043 - RNA, 19 nt, Human
ggccagaugcaccagcccu

SEQ ID NO: 2727044 - RNA, 20 nt, Human
ggccagaugcaccagcccuu

SEQ ID NO: 2727045 - RNA, 13 nt, Human
ggccucccaacuc

SEQ ID NO: 2727046 - RNA, 14 nt, Human
ggccucccaacuca

SEQ ID NO: 2727047 - RNA, 13 nt, Human
aaaaaaacacaaa

SEQ ID NO: 2727048 - RNA, 15 nt, Human
ggcuucaguggcagc

SEQ ID NO: 2727049 - RNA, 20 nt, Human
ggcuguaucccaugagccuc

SEQ ID NO: 2727050 - RNA, 22 nt, Human
ggcuguaucccaugagccucag

SEQ ID NO: 2727051 - RNA, 23 nt, Human
ggcuguaucccaugagccucagc

SEQ ID NO: 2727052 - RNA, 15 nt, Human
ggcugucaauuacag

SEQ ID NO: 2727053 - RNA, 19 nt, Human
ggcuguaucccaugagccu

SEQ ID NO: 2727054 - RNA, 16 nt, Human
ggcuggugucaccuga

SEQ ID NO: 2727055 - RNA, 16 nt, Human
ggcuucaguggcagcu

SEQ ID NO: 2727056 - RNA, 13 nt, Human
gggaaaaucagcc

SEQ ID NO: 2727057 - RNA, 23 nt, Human
gggaaaaucagccugcuccagcu

SEQ ID NO: 2727058 - RNA, 16 nt, Human
ggcucccuucccaccu

SEQ ID NO: 2727059 - RNA, 17 nt, Human
ggcucccuucccaccuc

SEQ ID NO: 2727060 - RNA, 18 nt, Human
ggcucccuucccaccucu

SEQ ID NO: 2727061 - RNA, 20 nt, Human
ggcucccuucccaccucucu

SEQ ID NO: 2727062 - RNA, 22 nt, Human
ggcucccuucccaccucucuca

SEQ ID NO: 2727063 - RNA, 20 nt, Human
ggcugcaugcgggcuuccuc

SEQ ID NO: 2727064 - RNA, 17 nt, Human
ggcugcagggaguccga

SEQ ID NO: 2727065 - RNA, 18 nt, Human
ggcucgagcaugccugga

SEQ ID NO: 2727066 - RNA, 20 nt, Human
ggcucuuccaggcugggaga

SEQ ID NO: 2727067 - RNA, 23 nt, Human
ggcucuuccaggcugggagagcc

SEQ ID NO: 2727068 - RNA, 24 nt, Human
ggcucuuccaggcugggagagccu

SEQ ID NO: 2727069 - RNA, 14 nt, Human
ggcuggcgugcagu

SEQ ID NO: 2727070 - RNA, 16 nt, Human
ggcuggcgugcagugg

SEQ ID NO: 2727071 - RNA, 20 nt, Human
ggcuggcgugcaguggugcg

SEQ ID NO: 2727072 - RNA, 17 nt, Human
ggcuggccuggccccuc

SEQ ID NO: 2727073 - RNA, 22 nt, Human
ggcuggccuggccccucagggu

SEQ ID NO: 2727074 - RNA, 22 nt, Human
aaaacuugauguguuaucucuu

SEQ ID NO: 2727075 - RNA, 19 nt, Human
aaaagccugcaauuucaua

SEQ ID NO: 2727076 - RNA, 22 nt, Human
aaaagcuccauuuuuagugaaa

SEQ ID NO: 2727077 - RNA, 14 nt, Human
aaaagcugggcagg

SEQ ID NO: 2727078 - RNA, 11 nt, Human
gggagggcucc

SEQ ID NO: 2727079 - RNA, 13 nt, Human
gggagggcuccag

SEQ ID NO: 2727080 - RNA, 18 nt, Human
aaaacugauuuuuuuuuc

SEQ ID NO: 2727081 - RNA, 22 nt, Human
aaaacugauuuuuuuuuccuuc

SEQ ID NO: 2727082 - RNA, 21 nt, Human
aaaacguggcugcuucaagga

SEQ ID NO: 2727083 - RNA, 15 nt, Human
aaaaccaauguucuc

SEQ ID NO: 2727084 - RNA, 14 nt, Human
aaaacguggcugcu

SEQ ID NO: 2727085 - RNA, 16 nt, Human
aaaacguggcugcuuc

SEQ ID NO: 2727086 - RNA, 17 nt, Human
aaaacguggcugcuuca

SEQ ID NO: 2727087 - RNA, 18 nt, Human
aaaacguggcugcuucaa

SEQ ID NO: 2727088 - RNA, 14 nt, Human
gggaacagacugga

SEQ ID NO: 2727089 - RNA, 17 nt, Human
aaaaaucucaaauuucu

SEQ ID NO: 2727090 - RNA, 22 nt, Human
gggaacagacuggaagcacagc

SEQ ID NO: 2727091 - RNA, 20 nt, Human
aaaaaucucaaauuucuaaa

SEQ ID NO: 2727092 - RNA, 19 nt, Human
aaaaaucucaaauuucuaa

SEQ ID NO: 2727093 - RNA, 12 nt, Human
gggcagcugccu

SEQ ID NO: 2727094 - RNA, 13 nt, Human
gggcagcugccuc

SEQ ID NO: 2727095 - RNA, 14 nt, Human
gggcagcugccucc

SEQ ID NO: 2727096 - RNA, 19 nt, Human
gggcagcugccuccccucc

SEQ ID NO: 2727097 - RNA, 20 nt, Human
gggcagcugccuccccuccu

SEQ ID NO: 2727098 - RNA, 23 nt, Human
gggcagcugccuccccuccucug

SEQ ID NO: 2727099 - RNA, 20 nt, Human
gggauucuuaaaguugaauu

SEQ ID NO: 2727100 - RNA, 15 nt, Human
gggauucuuaaaguu

SEQ ID NO: 2727101 - RNA, 23 nt, Human
gggcagagcagagaccaucccug

SEQ ID NO: 2727102 - RNA, 15 nt, Human
gggauuuccaugaug

SEQ ID NO: 2727103 - RNA, 20 nt, Human
aaaauaauuuuuauauuuga

SEQ ID NO: 2727104 - RNA, 12 nt, Human
aaaauaaauuau

SEQ ID NO: 2727105 - RNA, 21 nt, Human
aaaauaauuuuuauauuugaa

SEQ ID NO: 2727106 - RNA, 23 nt, Human
aaaauaauuuuuauauuugaaau

SEQ ID NO: 2727107 - RNA, 14 nt, Human
aaaauaccagccag

SEQ ID NO: 2727108 - RNA, 15 nt, Human
aaaauaccagccagu

SEQ ID NO: 2727109 - RNA, 14 nt, Human
aaaauauauuuaau

SEQ ID NO: 2727110 - RNA, 18 nt, Human
aaaauaguggugugauuu

SEQ ID NO: 2727111 - RNA, 12 nt, Human
aaaauagccugc

SEQ ID NO: 2727112 - RNA, 21 nt, Human
aaacauauauaacaaugcugu

SEQ ID NO: 2727113 - RNA, 16 nt, Human
aaacaugcuacacacu

SEQ ID NO: 2727114 - RNA, 22 nt, Human
aaacaugcuacacacugcaugu

SEQ ID NO: 2727115 - RNA, 16 nt, Human
aaacauauauaacaau

SEQ ID NO: 2727116 - RNA, 19 nt, Human
aaacauauauaacaaugcu

SEQ ID NO: 2727117 - RNA, 13 nt, Human
aaacauauauaac

SEQ ID NO: 2727118 - RNA, 14 nt, Human
aaacacaacuauau

SEQ ID NO: 2727119 - RNA, 19 nt, Human
aaacaagucagucauucag

SEQ ID NO: 2727120 - RNA, 24 nt, Human
ggggaaaaucagccugcuccagcu

SEQ ID NO: 2727121 - RNA, 13 nt, Human
ggggaccucaggc

SEQ ID NO: 2727122 - RNA, 15 nt, Human
ggggaccucaggccu

SEQ ID NO: 2727123 - RNA, 16 nt, Human
ggggaccucaggccug

SEQ ID NO: 2727124 - RNA, 17 nt, Human
ggggaccucaggccugg

SEQ ID NO: 2727125 - RNA, 17 nt, Human
ggggccaguuggucccc

SEQ ID NO: 2727126 - RNA, 16 nt, Human
ggggcccugccuccuu

SEQ ID NO: 2727127 - RNA, 15 nt, Human
ggggcccugccuccu

SEQ ID NO: 2727128 - RNA, 19 nt, Human
ggggcccugccuccuuugu

SEQ ID NO: 2727129 - RNA, 23 nt, Human
ggggcccugccuccuuugugagg

SEQ ID NO: 2727130 - RNA, 17 nt, Human
aaacaaggaugaauuaa

SEQ ID NO: 2727131 - RNA, 19 nt, Human
aaacaacuucaauauccaa

SEQ ID NO: 2727132 - RNA, 19 nt, Human
aaaauuuuuucucuaggaa

SEQ ID NO: 2727133 - RNA, 21 nt, Human
aaaauauuauguguuuccaua

SEQ ID NO: 2727134 - RNA, 14 nt, Human
aaaauauuaugugu

SEQ ID NO: 2727135 - RNA, 15 nt, Human
aaaauauuauguguu

SEQ ID NO: 2727136 - RNA, 23 nt, Human
aaaauuggggauucuuaaaguug

SEQ ID NO: 2727137 - RNA, 21 nt, Human
aaaauuggggauucuuaaagu

SEQ ID NO: 2727138 - RNA, 21 nt, Human
aaaauguaggguuauaauaau

SEQ ID NO: 2727139 - RNA, 21 nt, Human
aaaauggacguguuaugacuc

SEQ ID NO: 2727140 - RNA, 12 nt, Human
aaaauggaauac

SEQ ID NO: 2727141 - RNA, 22 nt, Human
aaaauggacuguggugacuuug

SEQ ID NO: 2727142 - RNA, 16 nt, Human
aaacuggauuaaacuu

SEQ ID NO: 2727143 - RNA, 15 nt, Human
aaaccacagcaguug

SEQ ID NO: 2727144 - RNA, 16 nt, Human
aaaccacagcaguuga

SEQ ID NO: 2727145 - RNA, 18 nt, Human
aaacggaugauuucuaug

SEQ ID NO: 2727146 - RNA, 16 nt, Human
aaacggaugauuucua

SEQ ID NO: 2727147 - RNA, 17 nt, Human
aaacguggcugcuucaa

SEQ ID NO: 2727148 - RNA, 15 nt, Human
aaacgucuuaaauau

SEQ ID NO: 2727149 - RNA, 16 nt, Human
aaacguggcugcuuca

SEQ ID NO: 2727150 - RNA, 22 nt, Human
gggucucacuauguugcccagg

SEQ ID NO: 2727151 - RNA, 23 nt, Human
gggucucacuauguugcccaggc

SEQ ID NO: 2727152 - RNA, 20 nt, Human
ggguaucaggugcugccauc

SEQ ID NO: 2727153 - RNA, 22 nt, Human
gggucacucuggcagcucagag

SEQ ID NO: 2727154 - RNA, 12 nt, Human
ggucuguucuuu

SEQ ID NO: 2727155 - RNA, 21 nt, Human
ggucuugaacuccuggccuca

SEQ ID NO: 2727156 - RNA, 22 nt, Human
ggucuugaacuccuggccucaa

SEQ ID NO: 2727157 - RNA, 19 nt, Human
ggucuguucuuuccaaagu

SEQ ID NO: 2727158 - RNA, 17 nt, Human
ggucuguucuuuccaaa

SEQ ID NO: 2727159 - RNA, 21 nt, Human
aaagauuuucagaaaauauua

SEQ ID NO: 2727160 - RNA, 16 nt, Human
ggugcacaagcuccaa

SEQ ID NO: 2727161 - RNA, 22 nt, Human
ggugcacaagcuccaagcuccc

SEQ ID NO: 2727162 - RNA, 15 nt, Human
ggugccaguuauggc

SEQ ID NO: 2727163 - RNA, 13 nt, Human
aaaggaauuuaaa

SEQ ID NO: 2727164 - RNA, 11 nt, Human
aaaggaaagag

SEQ ID NO: 2727165 - RNA, 13 nt, Human
aaagcuuauuaaa

SEQ ID NO: 2727166 - RNA, 17 nt, Human
aaagcagugcaugcugu

SEQ ID NO: 2727167 - RNA, 16 nt, Human
aaagcagugcaugcug

SEQ ID NO: 2727168 - RNA, 21 nt, Human
aaagcagugcaugcugucccu

SEQ ID NO: 2727169 - RNA, 22 nt, Human
aaagcagugcaugcugucccuu

SEQ ID NO: 2727170 - RNA, 17 nt, Human
aaagcuaggccuggcca

SEQ ID NO: 2727171 - RNA, 18 nt, Human
aaagcuaggccuggccag

SEQ ID NO: 2727172 - RNA, 17 nt, Human
aaagcuacuuauuguag

SEQ ID NO: 2727173 - RNA, 16 nt, Human
aaagcuacuuauugua

SEQ ID NO: 2727174 - RNA, 16 nt, Human
aaagaaugauuaugaa

SEQ ID NO: 2727175 - RNA, 17 nt, Human
aaacuuuucugauagag

SEQ ID NO: 2727176 - RNA, 16 nt, Human
aaacuuuucugauaga

SEQ ID NO: 2727177 - RNA, 12 nt, Human
aaacuuuucuga

SEQ ID NO: 2727178 - RNA, 14 nt, Human
aaacuuuucugaua

SEQ ID NO: 2727179 - RNA, 13 nt, Human
aaacuuuucugau

SEQ ID NO: 2727180 - RNA, 14 nt, Human
aaacuuuaccuuuu

SEQ ID NO: 2727181 - RNA, 20 nt, Human
gguccacccaggagccccga

SEQ ID NO: 2727182 - RNA, 22 nt, Human
gguccacccaggagccccgagg

SEQ ID NO: 2727183 - RNA, 12 nt, Human
ggucccacccca

SEQ ID NO: 2727184 - RNA, 15 nt, Human
aaacuuguguaaaua

SEQ ID NO: 2727185 - RNA, 17 nt, Human
aaacuuguguaaauaca

SEQ ID NO: 2727186 - RNA, 19 nt, Human
gguccacccaggagccccg

SEQ ID NO: 2727187 - RNA, 21 nt, Human
ggucauauuaauauauuucca

SEQ ID NO: 2727188 - RNA, 18 nt, Human
ggucauauuaauauauuu

SEQ ID NO: 2727189 - RNA, 23 nt, Human
gguauuggcuagagguucaaaga

SEQ ID NO: 2727190 - RNA, 23 nt, Human
aaagacuauucaaacagucucag

SEQ ID NO: 2727191 - RNA, 13 nt, Human
aaagacuccaaag

SEQ ID NO: 2727192 - RNA, 15 nt, Human
aaagacuguacaaag

SEQ ID NO: 2727193 - RNA, 22 nt, Human
aaagacuauucaaacagucuca

SEQ ID NO: 2727194 - RNA, 18 nt, Human
aaagagaacuuccagauc

SEQ ID NO: 2727195 - RNA, 19 nt, Human
aaagacuuuuccaacccuc

SEQ ID NO: 2727196 - RNA, 20 nt, Human
aaagaggcagcuugaaacug

SEQ ID NO: 2727197 - RNA, 15 nt, Human
aaagaugagugagca

SEQ ID NO: 2727198 - RNA, 13 nt, Human
aaagaggcuaugu

SEQ ID NO: 2727199 - RNA, 18 nt, Human
aaagaggcuaugugagca

SEQ ID NO: 2727200 - RNA, 14 nt, Human
aaagauuuucagaa

SEQ ID NO: 2727201 - RNA, 15 nt, Human
aaagauuuucagaaa

SEQ ID NO: 2727202 - RNA, 17 nt, Human
gacagcccgggcucugc

SEQ ID NO: 2727203 - RNA, 15 nt, Human
gacacacugaagaag

SEQ ID NO: 2727204 - RNA, 16 nt, Human
gacacacugaagaagc

SEQ ID NO: 2727205 - RNA, 14 nt, Human
gacacacugaagaa

SEQ ID NO: 2727206 - RNA, 13 nt, Human
gacacagcucuuc

SEQ ID NO: 2727207 - RNA, 14 nt, Human
gacacagcucuucu

SEQ ID NO: 2727208 - RNA, 16 nt, Human
gacacagcucuucucc

SEQ ID NO: 2727209 - RNA, 17 nt, Human
gacacagcucuucucca

SEQ ID NO: 2727210 - RNA, 22 nt, Human
gacacagcucuucuccaggcug

SEQ ID NO: 2727211 - RNA, 23 nt, Human
gacacagcucuucuccaggcugu

SEQ ID NO: 2727212 - RNA, 20 nt, Human
gaccagggauuuccaugaug

SEQ ID NO: 2727213 - RNA, 12 nt, Human
gaccaucccuga

SEQ ID NO: 2727214 - RNA, 13 nt, Human
gaccaucccugaa

SEQ ID NO: 2727215 - RNA, 18 nt, Human
gaccaucccugaaggccc

SEQ ID NO: 2727216 - RNA, 19 nt, Human
gaccaucccugaaggcccc

SEQ ID NO: 2727217 - RNA, 18 nt, Human
gaccagggauuuccauga

SEQ ID NO: 2727218 - RNA, 16 nt, Human
gacauuugcucaugga

SEQ ID NO: 2727219 - RNA, 17 nt, Human
gacauuugcucauggaa

SEQ ID NO: 2727220 - RNA, 19 nt, Human
gacauuguuggccaaagcc

SEQ ID NO: 2727221 - RNA, 20 nt, Human
gacagcccgggcucugccuc

SEQ ID NO: 2727222 - RNA, 18 nt, Human
gacagcccgggcucugcc

SEQ ID NO: 2727223 - RNA, 19 nt, Human
gacagcccgggcucugccu

SEQ ID NO: 2727224 - RNA, 14 nt, Human
gacauugcggacag

SEQ ID NO: 2727225 - RNA, 15 nt, Human
gacauugcggacagc

SEQ ID NO: 2727226 - RNA, 14 nt, Human
gacucuuaagaaga

SEQ ID NO: 2727227 - RNA, 18 nt, Human
gacucuuaagaagacugc

SEQ ID NO: 2727228 - RNA, 19 nt, Human
gacucugucucaaaaaaac

SEQ ID NO: 2727229 - RNA, 21 nt, Human
gacucuuaagaagacugcauu

SEQ ID NO: 2727230 - RNA, 14 nt, Human
gacugaauuaugaa

SEQ ID NO: 2727231 - RNA, 14 nt, Human
gacugaauuucuuu

SEQ ID NO: 2727232 - RNA, 20 nt, Human
gacugaauuaugaaacuuuu

SEQ ID NO: 2727233 - RNA, 14 nt, Human
gacuguggugacuu

SEQ ID NO: 2727234 - RNA, 13 nt, Human
gacuguggugacu

SEQ ID NO: 2727235 - RNA, 19 nt, Human
gacgcuacccgggaagggg

SEQ ID NO: 2727236 - RNA, 16 nt, Human
gacgcuacccgggaag

SEQ ID NO: 2727237 - RNA, 18 nt, Human
gacgcuacccgggaaggg

SEQ ID NO: 2727238 - RNA, 15 nt, Human
gacgccaucccagcc

SEQ ID NO: 2727239 - RNA, 17 nt, Human
gacgccaucccagcccc

SEQ ID NO: 2727240 - RNA, 18 nt, Human
gacgccaucccagcccca

SEQ ID NO: 2727241 - RNA, 11 nt, Human
gaccugaggcc

SEQ ID NO: 2727242 - RNA, 13 nt, Human
gaccugaggcccu

SEQ ID NO: 2727243 - RNA, 14 nt, Human
gaccugaggcccuu

SEQ ID NO: 2727244 - RNA, 16 nt, Human
gacgccaucccagccc

SEQ ID NO: 2727245 - RNA, 20 nt, Human
gaccaucccugaaggccccg

SEQ ID NO: 2727246 - RNA, 14 nt, Human
gaccucugcagcaa

SEQ ID NO: 2727247 - RNA, 22 nt, Human
gaaggggagauaaggguaucug

SEQ ID NO: 2727248 - RNA, 14 nt, Human
gaauauguuucaaa

SEQ ID NO: 2727249 - RNA, 15 nt, Human
gaauauguuucaaac

SEQ ID NO: 2727250 - RNA, 20 nt, Human
gaauauguuucaaacuuugg

SEQ ID NO: 2727251 - RNA, 14 nt, Human
gaauauugcugaug

SEQ ID NO: 2727252 - RNA, 15 nt, Human
gaauauugcugaugg

SEQ ID NO: 2727253 - RNA, 19 nt, Human
gaauauugcugauggugca

SEQ ID NO: 2727254 - RNA, 20 nt, Human
gaauauugcugauggugcaa

SEQ ID NO: 2727255 - RNA, 19 nt, Human
gaagcuccgcuuucuaccc

SEQ ID NO: 2727256 - RNA, 22 nt, Human
gaagcuccgcuuucuacccagc

SEQ ID NO: 2727257 - RNA, 17 nt, Human
gaaggccccgcccaggc

SEQ ID NO: 2727258 - RNA, 21 nt, Human
gaaggcucgagcaugccugga

SEQ ID NO: 2727259 - RNA, 18 nt, Human
gaaggccccgcccaggcu

SEQ ID NO: 2727260 - RNA, 19 nt, Human
gaaggccccgcccaggcuu

SEQ ID NO: 2727261 - RNA, 19 nt, Human
gaaggcucgagcaugccug

SEQ ID NO: 2727262 - RNA, 15 nt, Human
gaaggcuggguucug

SEQ ID NO: 2727263 - RNA, 19 nt, Human
gaaggcuggguucugaucc

SEQ ID NO: 2727264 - RNA, 20 nt, Human
gaaggcuggguucugauccu

SEQ ID NO: 2727265 - RNA, 22 nt, Human
gaaggcuggguucugauccuag

SEQ ID NO: 2727266 - RNA, 15 nt, Human
gaagcagaggaagga

SEQ ID NO: 2727267 - RNA, 14 nt, Human
gaagcaaaauuuuu

SEQ ID NO: 2727268 - RNA, 23 nt, Human
gaagauuuugaaauuuuuauuaa

SEQ ID NO: 2727269 - RNA, 23 nt, Human
gaagacaaugugaaaagaaaaau

SEQ ID NO: 2727270 - RNA, 22 nt, Human
gaagacaaugacuuacuguaca

SEQ ID NO: 2727271 - RNA, 16 nt, Human
gaagacaaugacuuac

SEQ ID NO: 2727272 - RNA, 15 nt, Human
gaagcacaugccucu

SEQ ID NO: 2727273 - RNA, 17 nt, Human
gaagcacaugccucucu

SEQ ID NO: 2727274 - RNA, 20 nt, Human
gaagcacaugccucucucag

SEQ ID NO: 2727275 - RNA, 14 nt, Human
gaacugaaaucaua

SEQ ID NO: 2727276 - RNA, 13 nt, Human
gaacugaaaucau

SEQ ID NO: 2727277 - RNA, 15 nt, Human
gaacuccuggccuca

SEQ ID NO: 2727278 - RNA, 11 nt, Human
gaacuggcugc

SEQ ID NO: 2727279 - RNA, 12 nt, Human
gaacuggcugca

SEQ ID NO: 2727280 - RNA, 14 nt, Human
gcaccgggccacag

SEQ ID NO: 2727281 - RNA, 23 nt, Human
gcacaucagcacgauuucuguuu

SEQ ID NO: 2727282 - RNA, 22 nt, Human
gcacaucagcacgauuucuguu

SEQ ID NO: 2727283 - RNA, 23 nt, Human
gcaccgggccacagagaaaguac

SEQ ID NO: 2727284 - RNA, 16 nt, Human
gcacuccccugcuggg

SEQ ID NO: 2727285 - RNA, 22 nt, Human
gcacuccccugcuggguguggc

SEQ ID NO: 2727286 - RNA, 13 nt, Human
gcacucagaagac

SEQ ID NO: 2727287 - RNA, 16 nt, Human
gcacucagaagacacu

SEQ ID NO: 2727288 - RNA, 17 nt, Human
gcacuccccugcugggu

SEQ ID NO: 2727289 - RNA, 21 nt, Human
gauuuuuuuguuguuuguuua

SEQ ID NO: 2727290 - RNA, 18 nt, Human
gauuuuuuuguuguuugu

SEQ ID NO: 2727291 - RNA, 20 nt, Human
gcaaguauuagaauaccaca

SEQ ID NO: 2727292 - RNA, 22 nt, Human
gcaauagucaaauugugugaaa

SEQ ID NO: 2727293 - RNA, 22 nt, Human
gcacaguuuucugagaaagacu

SEQ ID NO: 2727294 - RNA, 20 nt, Human
gcacaguuuucugagaaaga

SEQ ID NO: 2727295 - RNA, 23 nt, Human
gcacaguuuucugagaaagacua

SEQ ID NO: 2727296 - RNA, 14 nt, Human
gcacacauuuuuua

SEQ ID NO: 2727297 - RNA, 14 nt, Human
gcacaccgggcacu

SEQ ID NO: 2727298 - RNA, 22 nt, Human
gcacaagcugcacccucaggca

SEQ ID NO: 2727299 - RNA, 17 nt, Human
gaucugccuaaggacuu

SEQ ID NO: 2727300 - RNA, 23 nt, Human
gaucugccuaaggacuucuuuaa

SEQ ID NO: 2727301 - RNA, 21 nt, Human
gaucugccuaaggacuucuuu

SEQ ID NO: 2727302 - RNA, 20 nt, Human
gaucugccuaaggacuucuu

SEQ ID NO: 2727303 - RNA, 18 nt, Human
gaucugccuaaggacuuc

SEQ ID NO: 2727304 - RNA, 16 nt, Human
gaugaucuuuaaaaua

SEQ ID NO: 2727305 - RNA, 21 nt, Human
gaugaucuaggaagacuuugg

SEQ ID NO: 2727306 - RNA, 15 nt, Human
gaugaucuaggaaga

SEQ ID NO: 2727307 - RNA, 16 nt, Human
gaugagugagcaugcc

SEQ ID NO: 2727308 - RNA, 22 nt, Human
gaugguucccuugaugaagaag

SEQ ID NO: 2727309 - RNA, 14 nt, Human
gaugguucuagcau

SEQ ID NO: 2727310 - RNA, 12 nt, Human
gauuauuggaaa

SEQ ID NO: 2727311 - RNA, 22 nt, Human
gauuauucacugauuugacaua

SEQ ID NO: 2727312 - RNA, 21 nt, Human
gauuauucacugauuugacau

SEQ ID NO: 2727313 - RNA, 18 nt, Human
gauucuccugccucagcc

SEQ ID NO: 2727314 - RNA, 15 nt, Human
gauucuccugccuca

SEQ ID NO: 2727315 - RNA, 17 nt, Human
gauucuccugccucagc

SEQ ID NO: 2727316 - RNA, 15 nt, Human
gauuuaccacuugug

SEQ ID NO: 2727317 - RNA, 18 nt, Human
gauucuuccucccucccu

SEQ ID NO: 2727318 - RNA, 17 nt, Human
gauucuuccucccuccc

SEQ ID NO: 2727319 - RNA, 23 nt, Human
gauucuucagcaaaaauauuuua

SEQ ID NO: 2727320 - RNA, 16 nt, Human
gauuuaccacuugugu

SEQ ID NO: 2727321 - RNA, 13 nt, Human
gagccuugaacuu

SEQ ID NO: 2727322 - RNA, 23 nt, Human
gagccuuccaggggugggacacc

SEQ ID NO: 2727323 - RNA, 20 nt, Human
gagccuuccaggggugggac

SEQ ID NO: 2727324 - RNA, 13 nt, Human
gaggccagagaca

SEQ ID NO: 2727325 - RNA, 14 nt, Human
gaggccagagacac

SEQ ID NO: 2727326 - RNA, 19 nt, Human
gaggccagagacacaagcc

SEQ ID NO: 2727327 - RNA, 22 nt, Human
gaggcuagugugguguuuccug

SEQ ID NO: 2727328 - RNA, 14 nt, Human
gaggcagggucuca

SEQ ID NO: 2727329 - RNA, 17 nt, Human
gaggccaaggugggagg

SEQ ID NO: 2727330 - RNA, 22 nt, Human
gaggccaaggugggaggauugc

SEQ ID NO: 2727331 - RNA, 15 nt, Human
gaggcagggucucac

SEQ ID NO: 2727332 - RNA, 22 nt, Human
gaggcagggucucacucugucg

SEQ ID NO: 2727333 - RNA, 15 nt, Human
gaggucgaggcagga

SEQ ID NO: 2727334 - RNA, 23 nt, Human
gaggugaccccagguuucuaugu

SEQ ID NO: 2727335 - RNA, 12 nt, Human
gagucccaccuu

SEQ ID NO: 2727336 - RNA, 18 nt, Human
gagugacagaggcagccc

SEQ ID NO: 2727337 - RNA, 22 nt, Human
gagucagaaguuucugccgcag

SEQ ID NO: 2727338 - RNA, 15 nt, Human
gagucaccaagccca

SEQ ID NO: 2727339 - RNA, 16 nt, Human
gagucaccaagcccag

SEQ ID NO: 2727340 - RNA, 17 nt, Human
gagucaccaagcccagu

SEQ ID NO: 2727341 - RNA, 15 nt, Human
gaguugauucagcuc

SEQ ID NO: 2727342 - RNA, 16 nt, Human
gaguugauucagcucu

SEQ ID NO: 2727343 - RNA, 17 nt, Human
gaguugauucagcucug

SEQ ID NO: 2727344 - RNA, 22 nt, Human
gaguugauagcacagacccugc

SEQ ID NO: 2727345 - RNA, 20 nt, Human
gagugacagaggcagcccca

SEQ ID NO: 2727346 - RNA, 21 nt, Human
gagugaguuggguguauugug

SEQ ID NO: 2727347 - RNA, 16 nt, Human
gaguuuaaauuguaau

SEQ ID NO: 2727348 - RNA, 18 nt, Human
gaguugauucagcucugc

SEQ ID NO: 2727349 - RNA, 22 nt, Human
gaguuguuacauuuuuaagugc

SEQ ID NO: 2727350 - RNA, 13 nt, Human
cuguucagcucca

SEQ ID NO: 2727351 - RNA, 14 nt, Human
cuguucagcuccag

SEQ ID NO: 2727352 - RNA, 16 nt, Human
cugugucuugcaaugg

SEQ ID NO: 2727353 - RNA, 19 nt, Human
cugugucuugcaauggcag

SEQ ID NO: 2727354 - RNA, 11 nt, Human
cugugcugccc

SEQ ID NO: 2727355 - RNA, 20 nt, Human
cugugcugagucugaaggcu

SEQ ID NO: 2727356 - RNA, 22 nt, Human
cugugcugagucugaaggcugg

SEQ ID NO: 2727357 - RNA, 20 nt, Human
cugugucagcauagaaguaa

SEQ ID NO: 2727358 - RNA, 19 nt, Human
cugugucagguggggcagc

SEQ ID NO: 2727359 - RNA, 21 nt, Human
cugugucagguggggcagcuu

SEQ ID NO: 2727360 - RNA, 14 nt, Human
cugugucuugcaau

SEQ ID NO: 2727361 - RNA, 14 nt, Human
cugugucucccuuc

SEQ ID NO: 2727362 - RNA, 19 nt, Human
cugugucucccuucauccu

SEQ ID NO: 2727363 - RNA, 19 nt, Human
cuuaccucggugccuuccu

SEQ ID NO: 2727364 - RNA, 21 nt, Human
cuuaccucggugccuuccucu

SEQ ID NO: 2727365 - RNA, 19 nt, Human
cuuagauguauauauuucc

SEQ ID NO: 2727366 - RNA, 13 nt, Human
cuuaccucggugc

SEQ ID NO: 2727367 - RNA, 17 nt, Human
cuuacccucauguucuu

SEQ ID NO: 2727368 - RNA, 19 nt, Human
cuuacccucauguucuuaa

SEQ ID NO: 2727369 - RNA, 18 nt, Human
cuuacccucauguucuua

SEQ ID NO: 2727370 - RNA, 13 nt, Human
cuuacacaauggu

SEQ ID NO: 2727371 - RNA, 13 nt, Human
cuuaaaguugaau

SEQ ID NO: 2727372 - RNA, 11 nt, Human
cuuaaaguuga

SEQ ID NO: 2727373 - RNA, 16 nt, Human
cuguugggccaggagc

SEQ ID NO: 2727374 - RNA, 17 nt, Human
cuguugggccaggagcc

SEQ ID NO: 2727375 - RNA, 20 nt, Human
cuguugggccaggagccucc

SEQ ID NO: 2727376 - RNA, 21 nt, Human
cuuauggaacacucugagacu

SEQ ID NO: 2727377 - RNA, 14 nt, Human
cuuaugggcugggu

SEQ ID NO: 2727378 - RNA, 21 nt, Human
cuuaugggcuggguucuaccc

SEQ ID NO: 2727379 - RNA, 22 nt, Human
cuuaugggcuggguucuaccca

SEQ ID NO: 2727380 - RNA, 23 nt, Human
cuuaugggcuggguucuacccag

SEQ ID NO: 2727381 - RNA, 12 nt, Human
cuuauugcccac

SEQ ID NO: 2727382 - RNA, 13 nt, Human
cuuauugcccacg

SEQ ID NO: 2727383 - RNA, 21 nt, Human
cuuagcagggaaacagcuaau

SEQ ID NO: 2727384 - RNA, 18 nt, Human
cuuagcagggaaacagcu

SEQ ID NO: 2727385 - RNA, 16 nt, Human
cuuccauggacuuugu

SEQ ID NO: 2727386 - RNA, 17 nt, Human
cuuccauggacuuuguu

SEQ ID NO: 2727387 - RNA, 18 nt, Human
cuuccagugaggcucugc

SEQ ID NO: 2727388 - RNA, 17 nt, Human
cuuccagugaggcucug

SEQ ID NO: 2727389 - RNA, 19 nt, Human
cuuccagugaggcucugcc

SEQ ID NO: 2727390 - RNA, 20 nt, Human
cuuccagugaggcucugccc

SEQ ID NO: 2727391 - RNA, 23 nt, Human
cuucaugcugucuacacuaagag

SEQ ID NO: 2727392 - RNA, 18 nt, Human
cuucaucugacuaugaca

SEQ ID NO: 2727393 - RNA, 16 nt, Human
cuucauccuccucaga

SEQ ID NO: 2727394 - RNA, 12 nt, Human
cuucaucugacu

SEQ ID NO: 2727395 - RNA, 15 nt, Human
cuucauccuccucag

SEQ ID NO: 2727396 - RNA, 13 nt, Human
cuucaucccucug

SEQ ID NO: 2727397 - RNA, 18 nt, Human
cuucaguggcagcugcuu

SEQ ID NO: 2727398 - RNA, 23 nt, Human
cuucagagacuccugcaggcagc

SEQ ID NO: 2727399 - RNA, 16 nt, Human
cuucagagacuccugc

SEQ ID NO: 2727400 - RNA, 21 nt, Human
cuucagagacuccugcaggca

SEQ ID NO: 2727401 - RNA, 22 nt, Human
cuucagagacuccugcaggcag

SEQ ID NO: 2727402 - RNA, 14 nt, Human
cuucaccuuugucc

SEQ ID NO: 2727403 - RNA, 18 nt, Human
cuuauugcccacgcugga

SEQ ID NO: 2727404 - RNA, 17 nt, Human
cuucaccuuugucccca

SEQ ID NO: 2727405 - RNA, 20 nt, Human
cuucaccuuuguccccaccg

SEQ ID NO: 2727406 - RNA, 12 nt, Human
cuugcucugcug

SEQ ID NO: 2727407 - RNA, 23 nt, Human
cuugaaugaugccaugaggaaca

SEQ ID NO: 2727408 - RNA, 23 nt, Human
cuugccgucuaccugaggggccu

SEQ ID NO: 2727409 - RNA, 12 nt, Human
cuugacagggca

SEQ ID NO: 2727410 - RNA, 20 nt, Human
cuugccgucuaccugagggg

SEQ ID NO: 2727411 - RNA, 20 nt, Human
cuugaaugaugccaugagga

SEQ ID NO: 2727412 - RNA, 18 nt, Human
cuucuucagagacuccug

SEQ ID NO: 2727413 - RNA, 22 nt, Human
cuucuucagagacuccugcagg

SEQ ID NO: 2727414 - RNA, 15 nt, Human
cuucuguuuuauaau

SEQ ID NO: 2727415 - RNA, 20 nt, Human
cuucuguuuuauaauuuugu

SEQ ID NO: 2727416 - RNA, 20 nt, Human
cuucuucagagacuccugca

SEQ ID NO: 2727417 - RNA, 21 nt, Human
cuucuucagagacuccugcag

SEQ ID NO: 2727418 - RNA, 13 nt, Human
cuuucagauacug

SEQ ID NO: 2727419 - RNA, 20 nt, Human
cuuuaaagggauggcaagau

SEQ ID NO: 2727420 - RNA, 13 nt, Human
cuuguggacacag

SEQ ID NO: 2727421 - RNA, 14 nt, Human
cuuguggacacagc

SEQ ID NO: 2727422 - RNA, 15 nt, Human
cuuguggacacagcu

SEQ ID NO: 2727423 - RNA, 18 nt, Human
cuuucaauaggaaaaacu

SEQ ID NO: 2727424 - RNA, 20 nt, Human
cuuucaauaggaaaaacuga

SEQ ID NO: 2727425 - RNA, 21 nt, Human
cuuucaauaggaaaaacugau

SEQ ID NO: 2727426 - RNA, 22 nt, Human
cuuucaauaggaaaaacugauu

SEQ ID NO: 2727427 - RNA, 16 nt, Human
cuuuaauuuuggaauu

SEQ ID NO: 2727428 - RNA, 13 nt, Human
cuuuaauuuugga

SEQ ID NO: 2727429 - RNA, 15 nt, Human
cuuuaauuuuggaau

SEQ ID NO: 2727430 - RNA, 14 nt, Human
cuuuaauuuuggaa

SEQ ID NO: 2727431 - RNA, 15 nt, Human
cuuuucaaaacauuu

SEQ ID NO: 2727432 - RNA, 20 nt, Human
cuuuggucuacacugugcug

SEQ ID NO: 2727433 - RNA, 16 nt, Human
cuuuggucuacacugu

SEQ ID NO: 2727434 - RNA, 14 nt, Human
cuuuuauaaacuuu

SEQ ID NO: 2727435 - RNA, 18 nt, Human
cuuuuauaaacuuuaccu

SEQ ID NO: 2727436 - RNA, 16 nt, Human
cuuuuauaaacuuuac

SEQ ID NO: 2727437 - RNA, 15 nt, Human
cuuuuauaaacuuua

SEQ ID NO: 2727438 - RNA, 21 nt, Human
cuuugagugucuuaauuaaaa

SEQ ID NO: 2727439 - RNA, 18 nt, Human
cuuugacgccaucccagc

SEQ ID NO: 2727440 - RNA, 19 nt, Human
cuuugacgccaucccagcc

SEQ ID NO: 2727441 - RNA, 21 nt, Human
cuuugacgccaucccagcccc

SEQ ID NO: 2727442 - RNA, 22 nt, Human
cuuugacgccaucccagcccca

SEQ ID NO: 2727443 - RNA, 14 nt, Human
cugcucacauaucu

SEQ ID NO: 2727444 - RNA, 12 nt, Human
cugcugaaggcu

SEQ ID NO: 2727445 - RNA, 16 nt, Human
cugcucacauaucugu

SEQ ID NO: 2727446 - RNA, 19 nt, Human
cugcucacauaucugucau

SEQ ID NO: 2727447 - RNA, 13 nt, Human
cugcugacagugu

SEQ ID NO: 2727448 - RNA, 15 nt, Human
cugcugacaguguug

SEQ ID NO: 2727449 - RNA, 11 nt, Human
cugcugacagu

SEQ ID NO: 2727450 - RNA, 12 nt, Human
cugcugacagug

SEQ ID NO: 2727451 - RNA, 15 nt, Human
cugcugaaggcucga

SEQ ID NO: 2727452 - RNA, 13 nt, Human
cugcugaaggcuc

SEQ ID NO: 2727453 - RNA, 14 nt, Human
cugcugaaggcucg

SEQ ID NO: 2727454 - RNA, 20 nt, Human
cugcuuaacuucacauauug

SEQ ID NO: 2727455 - RNA, 22 nt, Human
cuggaugcagccucacaguccu

SEQ ID NO: 2727456 - RNA, 15 nt, Human
cuggaguucugguuc

SEQ ID NO: 2727457 - RNA, 16 nt, Human
cuggaguucugguucc

SEQ ID NO: 2727458 - RNA, 17 nt, Human
cuggaguucugguuccu

SEQ ID NO: 2727459 - RNA, 12 nt, Human
cuggcccuuccu

SEQ ID NO: 2727460 - RNA, 22 nt, Human
cuggcuaugcauuugaaaauuu

SEQ ID NO: 2727461 - RNA, 16 nt, Human
cuggcuaugcauuuga

SEQ ID NO: 2727462 - RNA, 15 nt, Human
cuggcuaugcauuug

SEQ ID NO: 2727463 - RNA, 14 nt, Human
cuggcuaugcauuu

SEQ ID NO: 2727464 - RNA, 13 nt, Human
cuggcuaugcauu

SEQ ID NO: 2727465 - RNA, 14 nt, Human
cugggacaugggaa

SEQ ID NO: 2727466 - RNA, 18 nt, Human
cugggacaugggaaaggg

SEQ ID NO: 2727467 - RNA, 22 nt, Human
cugggacaugggaaaggggaag

SEQ ID NO: 2727468 - RNA, 13 nt, Human
cugggacuacagg

SEQ ID NO: 2727469 - RNA, 15 nt, Human
cugggacuacaggca

SEQ ID NO: 2727470 - RNA, 16 nt, Human
cugggacuacaggcac

SEQ ID NO: 2727471 - RNA, 22 nt, Human
cugggagaaccaaaaagaggcu

SEQ ID NO: 2727472 - RNA, 15 nt, Human
cuggguguggcgcag

SEQ ID NO: 2727473 - RNA, 21 nt, Human
cuggguggcaccagcagccug

SEQ ID NO: 2727474 - RNA, 14 nt, Human
cuggguguggcgca

SEQ ID NO: 2727475 - RNA, 13 nt, Human
cugggcagcugcc

SEQ ID NO: 2727476 - RNA, 20 nt, Human
cugggcagaggaaagcaaag

SEQ ID NO: 2727477 - RNA, 12 nt, Human
cugggcagagga

SEQ ID NO: 2727478 - RNA, 13 nt, Human
cugggcagaggaa

SEQ ID NO: 2727479 - RNA, 16 nt, Human
cugggcagaggaaagc

SEQ ID NO: 2727480 - RNA, 14 nt, Human
cugggcagcugccu

SEQ ID NO: 2727481 - RNA, 15 nt, Human
cugggcagcugccuc

SEQ ID NO: 2727482 - RNA, 20 nt, Human
cugggcagguuggugggggc

SEQ ID NO: 2727483 - RNA, 13 nt, Human
cuggggagaaagu

SEQ ID NO: 2727484 - RNA, 18 nt, Human
cuggguggcaccagcagc

SEQ ID NO: 2727485 - RNA, 20 nt, Human
cuggguggcaccagcagccu

SEQ ID NO: 2727486 - RNA, 19 nt, Human
cugcccugugggcccccaa

SEQ ID NO: 2727487 - RNA, 12 nt, Human
cugcccuuaccu

SEQ ID NO: 2727488 - RNA, 16 nt, Human
cugcccuuaccugcca

SEQ ID NO: 2727489 - RNA, 17 nt, Human
cugcccuuaccugccag

SEQ ID NO: 2727490 - RNA, 16 nt, Human
cugccauauucuguug

SEQ ID NO: 2727491 - RNA, 16 nt, Human
cugccauccagguuca

SEQ ID NO: 2727492 - RNA, 18 nt, Human
cugccauccagguucagc

SEQ ID NO: 2727493 - RNA, 19 nt, Human
cugccauccagguucagcu

SEQ ID NO: 2727494 - RNA, 23 nt, Human
cugccagggacagaggggguggc

SEQ ID NO: 2727495 - RNA, 18 nt, Human
cugcauuuaaaagauaca

SEQ ID NO: 2727496 - RNA, 17 nt, Human
cugcauuuaaaagauac

SEQ ID NO: 2727497 - RNA, 20 nt, Human
cugccagggacagagggggu

SEQ ID NO: 2727498 - RNA, 22 nt, Human
cugccagggacagagggggugg

SEQ ID NO: 2727499 - RNA, 14 nt, Human
cugcauuuaaaaga

SEQ ID NO: 2727500 - RNA, 13 nt, Human
cugcauuggcuuu

SEQ ID NO: 2727501 - RNA, 15 nt, Human
cugcacuccagccug

SEQ ID NO: 2727502 - RNA, 13 nt, Human
cugcacuccagcc

SEQ ID NO: 2727503 - RNA, 22 nt, Human
cugcacuauagccuaggugaca

SEQ ID NO: 2727504 - RNA, 23 nt, Human
cugcacuauagccuaggugacag

SEQ ID NO: 2727505 - RNA, 20 nt, Human
cugcacggugaauggcuuug

SEQ ID NO: 2727506 - RNA, 17 nt, Human
cugcacggugaauggcu

SEQ ID NO: 2727507 - RNA, 15 nt, Human
cugcacggugaaugg

SEQ ID NO: 2727508 - RNA, 14 nt, Human
cugcacggugaaug

SEQ ID NO: 2727509 - RNA, 16 nt, Human
cugcacuauagccuag

SEQ ID NO: 2727510 - RNA, 17 nt, Human
cugcacuauagccuagg

SEQ ID NO: 2727511 - RNA, 18 nt, Human
cugcacuauagccuaggu

SEQ ID NO: 2727512 - RNA, 20 nt, Human
cugcacuauagccuagguga

SEQ ID NO: 2727513 - RNA, 19 nt, Human
cugcacuccagccugggug

SEQ ID NO: 2727514 - RNA, 23 nt, Human
cugcagccucaaccuccugggcu

SEQ ID NO: 2727515 - RNA, 24 nt, Human
cugcagccucaaccuccugggcua

SEQ ID NO: 2727516 - RNA, 18 nt, Human
cugcacuccagccugggu

SEQ ID NO: 2727517 - RNA, 16 nt, Human
cugcacuccagccugg

SEQ ID NO: 2727518 - RNA, 17 nt, Human
cugcacuccagccuggg

SEQ ID NO: 2727519 - RNA, 12 nt, Human
cugcagcuuugu

SEQ ID NO: 2727520 - RNA, 13 nt, Human
cugcaggcagcca

SEQ ID NO: 2727521 - RNA, 14 nt, Human
cugcaggcagccag

SEQ ID NO: 2727522 - RNA, 15 nt, Human
cugcaggcagccagg

SEQ ID NO: 2727523 - RNA, 16 nt, Human
cugcaggcagccaggc

SEQ ID NO: 2727524 - RNA, 17 nt, Human
cugcaggcagccaggcc

SEQ ID NO: 2727525 - RNA, 18 nt, Human
cugcaggcagccaggcca

SEQ ID NO: 2727526 - RNA, 19 nt, Human
cugcaggcagccaggccac

SEQ ID NO: 2727527 - RNA, 20 nt, Human
cugcaggcagccaggccaca

SEQ ID NO: 2727528 - RNA, 24 nt, Human
cugaugggcaacccccagccugcu

SEQ ID NO: 2727529 - RNA, 22 nt, Human
cugaugggcaacccccagccug

SEQ ID NO: 2727530 - RNA, 23 nt, Human
cugaugggcaacccccagccugc

SEQ ID NO: 2727531 - RNA, 21 nt, Human
cugcaaaggguaucaggugcu

SEQ ID NO: 2727532 - RNA, 22 nt, Human
cugcaaaggguaucaggugcug

SEQ ID NO: 2727533 - RNA, 20 nt, Human
cugaugcuucuucagagacu

SEQ ID NO: 2727534 - RNA, 18 nt, Human
cugaugcuucuucagaga

SEQ ID NO: 2727535 - RNA, 19 nt, Human
cugaugcuucuucagagac

SEQ ID NO: 2727536 - RNA, 18 nt, Human
cugaugggcaacccccag

SEQ ID NO: 2727537 - RNA, 21 nt, Human
cugaugggcaacccccagccu

SEQ ID NO: 2727538 - RNA, 15 nt, Human
cucuuaugggcuggg

SEQ ID NO: 2727539 - RNA, 18 nt, Human
cucuuauaucuauauuuu

SEQ ID NO: 2727540 - RNA, 15 nt, Human
cucuuauaucuauau

SEQ ID NO: 2727541 - RNA, 14 nt, Human
cucuuaugggcugg

SEQ ID NO: 2727542 - RNA, 16 nt, Human
cugaugcuucuucaga

SEQ ID NO: 2727543 - RNA, 17 nt, Human
cugaugcuucuucagag

SEQ ID NO: 2727544 - RNA, 20 nt, Human
cugcaagaauugaagcagga

SEQ ID NO: 2727545 - RNA, 12 nt, Human
cugcaagggagu

SEQ ID NO: 2727546 - RNA, 20 nt, Human
cugcaccgggccacagagaa

SEQ ID NO: 2727547 - RNA, 23 nt, Human
cugcaccgggccacagagaaagu

SEQ ID NO: 2727548 - RNA, 18 nt, Human
cugcaagaauugaagcag

SEQ ID NO: 2727549 - RNA, 22 nt, Human
cugcaaccugauugugucucuu

SEQ ID NO: 2727550 - RNA, 20 nt, Human
cugcaaccuccgccucuugg

SEQ ID NO: 2727551 - RNA, 22 nt, Human
cugcaaccuccgccucuugggu

SEQ ID NO: 2727552 - RNA, 14 nt, Human
cugcaaccugauug

SEQ ID NO: 2727553 - RNA, 19 nt, Human
cugcaaccugauugugucu

SEQ ID NO: 2727554 - RNA, 21 nt, Human
cugcaaccugauugugucucu

SEQ ID NO: 2727555 - RNA, 14 nt, Human
cauuuguauaaaau

SEQ ID NO: 2727556 - RNA, 16 nt, Human
cauuuguauaaaauaa

SEQ ID NO: 2727557 - RNA, 23 nt, Human
cauuuuuuuuaagaaaaaggaug

SEQ ID NO: 2727558 - RNA, 18 nt, Human
cauuuaggugaggaagca

SEQ ID NO: 2727559 - RNA, 16 nt, Human
cauuuaggugaggaag

SEQ ID NO: 2727560 - RNA, 17 nt, Human
cauugguguuguacuca

SEQ ID NO: 2727561 - RNA, 21 nt, Human
ccaacuccagaaagugacaag

SEQ ID NO: 2727562 - RNA, 21 nt, Human
ccaacucaccccagccccaaa

SEQ ID NO: 2727563 - RNA, 16 nt, Human
ccaagcucugcuccuc

SEQ ID NO: 2727564 - RNA, 14 nt, Human
ccaagcucugcucc

SEQ ID NO: 2727565 - RNA, 15 nt, Human
ccaagcucugcuccu

SEQ ID NO: 2727566 - RNA, 15 nt, Human
ccaaaucagcugcua

SEQ ID NO: 2727567 - RNA, 23 nt, Human
ccaaaucagcugcuacuacuccu

SEQ ID NO: 2727568 - RNA, 16 nt, Human
ccaaaucauaguggcu

SEQ ID NO: 2727569 - RNA, 13 nt, Human
ccaacucacccca

SEQ ID NO: 2727570 - RNA, 19 nt, Human
ccaauucgaacuuuuucca

SEQ ID NO: 2727571 - RNA, 23 nt, Human
ccaauggacuaacuugucuuugg

SEQ ID NO: 2727572 - RNA, 22 nt, Human
ccaauuauaugagacguuuuug

SEQ ID NO: 2727573 - RNA, 14 nt, Human
ccaaagugcuggga

SEQ ID NO: 2727574 - RNA, 22 nt, Human
ccaaaguacacuguuucaaacu

SEQ ID NO: 2727575 - RNA, 19 nt, Human
cauuauauuuauuacugua

SEQ ID NO: 2727576 - RNA, 19 nt, Human
cauguuggccaggcugguc

SEQ ID NO: 2727577 - RNA, 18 nt, Human
cauguucuuaauucuuag

SEQ ID NO: 2727578 - RNA, 18 nt, Human
cauguuggccaggcuggu

SEQ ID NO: 2727579 - RNA, 17 nt, Human
cauguuggccaggcugg

SEQ ID NO: 2727580 - RNA, 21 nt, Human
cauguuacauaagauaaaugu

SEQ ID NO: 2727581 - RNA, 16 nt, Human
cauguucuuaauucuu

SEQ ID NO: 2727582 - RNA, 13 nt, Human
cauguucuuaauu

SEQ ID NO: 2727583 - RNA, 17 nt, Human
cauguuacauaagauaa

SEQ ID NO: 2727584 - RNA, 16 nt, Human
cauguuacauaagaua

SEQ ID NO: 2727585 - RNA, 15 nt, Human
cauguccaagaagcc

SEQ ID NO: 2727586 - RNA, 16 nt, Human
cauguccaagaagccc

SEQ ID NO: 2727587 - RNA, 20 nt, Human
cauucuccuuguguuacuaa

SEQ ID NO: 2727588 - RNA, 15 nt, Human
cauuauucaaaguug

SEQ ID NO: 2727589 - RNA, 14 nt, Human
cauuauucaaaguu

SEQ ID NO: 2727590 - RNA, 17 nt, Human
cauucuccaccugccag

SEQ ID NO: 2727591 - RNA, 18 nt, Human
cauucuccaccugccagg

SEQ ID NO: 2727592 - RNA, 19 nt, Human
cauucuccaccugccaggg

SEQ ID NO: 2727593 - RNA, 21 nt, Human
cauucuccaccugccagggac

SEQ ID NO: 2727594 - RNA, 13 nt, Human
caugacaaagacu

SEQ ID NO: 2727595 - RNA, 15 nt, Human
caugcaaggucauuu

SEQ ID NO: 2727596 - RNA, 12 nt, Human
caugcaagguca

SEQ ID NO: 2727597 - RNA, 17 nt, Human
caugcuccuggcccacu

SEQ ID NO: 2727598 - RNA, 14 nt, Human
caugcuccuggccc

SEQ ID NO: 2727599 - RNA, 16 nt, Human
caugcuccuggcccac

SEQ ID NO: 2727600 - RNA, 18 nt, Human
caugggaaaggggaaguu

SEQ ID NO: 2727601 - RNA, 21 nt, Human
cauggccucuucagaucucua

SEQ ID NO: 2727602 - RNA, 19 nt, Human
caucccaaacccuucagug

SEQ ID NO: 2727603 - RNA, 19 nt, Human
caucagcacgauuucuguu

SEQ ID NO: 2727604 - RNA, 21 nt, Human
caucagcacgauuucuguuua

SEQ ID NO: 2727605 - RNA, 12 nt, Human
caucccagcccc

SEQ ID NO: 2727606 - RNA, 21 nt, Human
cauccucuguacagagcccac

SEQ ID NO: 2727607 - RNA, 22 nt, Human
cauccucuguacagagcccacg

SEQ ID NO: 2727608 - RNA, 20 nt, Human
caucccaaacccuucagugc

SEQ ID NO: 2727609 - RNA, 11 nt, Human
caucccagccc

SEQ ID NO: 2727610 - RNA, 23 nt, Human
cauagcagagaaugaaagggccc

SEQ ID NO: 2727611 - RNA, 16 nt, Human
cauagguuuaauaauu

SEQ ID NO: 2727612 - RNA, 22 nt, Human
cauauuaccacagacauacuaa

SEQ ID NO: 2727613 - RNA, 23 nt, Human
cauaaugcgugcauaccacuuuu

SEQ ID NO: 2727614 - RNA, 23 nt, Human
cauacaggaagguagaaauaucu

SEQ ID NO: 2727615 - RNA, 23 nt, Human
caguuguucaauaauaaauauuu

SEQ ID NO: 2727616 - RNA, 18 nt, Human
caguuguuagugugucuu

SEQ ID NO: 2727617 - RNA, 22 nt, Human
caguuguuagugugucuuagug

SEQ ID NO: 2727618 - RNA, 23 nt, Human
caguuuguuaguaugaggcauuu

SEQ ID NO: 2727619 - RNA, 21 nt, Human
caguuuguuaguaugaggcau

SEQ ID NO: 2727620 - RNA, 21 nt, Human
caguuauuauauuuacaaaug

SEQ ID NO: 2727621 - RNA, 17 nt, Human
caguuauuauauuuaca

SEQ ID NO: 2727622 - RNA, 20 nt, Human
caguuauggcuauaggugcu

SEQ ID NO: 2727623 - RNA, 19 nt, Human
caguuauggcuauaggugc

SEQ ID NO: 2727624 - RNA, 13 nt, Human
caguuauggcuau

SEQ ID NO: 2727625 - RNA, 20 nt, Human
caguuacucagaauucucua

SEQ ID NO: 2727626 - RNA, 21 nt, Human
cagugguaugaucacggcuca

SEQ ID NO: 2727627 - RNA, 19 nt, Human
caguggugcgaucuggguu

SEQ ID NO: 2727628 - RNA, 23 nt, Human
cagucugauucccaagcucugcu

SEQ ID NO: 2727629 - RNA, 21 nt, Human
cagugcccacaggaucagucu

SEQ ID NO: 2727630 - RNA, 18 nt, Human
cagugcccacaggaucag

SEQ ID NO: 2727631 - RNA, 22 nt, Human
cagugcccacaggaucagucug

SEQ ID NO: 2727632 - RNA, 20 nt, Human
cagugguaugaucacggcuc

SEQ ID NO: 2727633 - RNA, 16 nt, Human
cagugggagcugccug

SEQ ID NO: 2727634 - RNA, 15 nt, Human
cagugggagcugccu

SEQ ID NO: 2727635 - RNA, 17 nt, Human
cagugggagcugccugu

SEQ ID NO: 2727636 - RNA, 18 nt, Human
cagugggagcugccuguu

SEQ ID NO: 2727637 - RNA, 21 nt, Human
cagucugauucccaagcucug

SEQ ID NO: 2727638 - RNA, 22 nt, Human
cagucugauucccaagcucugc

SEQ ID NO: 2727639 - RNA, 15 nt, Human
caguucagagcugcc

SEQ ID NO: 2727640 - RNA, 16 nt, Human
caguucagagcugccc

SEQ ID NO: 2727641 - RNA, 17 nt, Human
caguucagagcugcccu

SEQ ID NO: 2727642 - RNA, 22 nt, Human
caguuauuauauuuacaaaugg

SEQ ID NO: 2727643 - RNA, 23 nt, Human
caguucagagcugcccucuccug

SEQ ID NO: 2727644 - RNA, 24 nt, Human
caguucagagcugcccucuccugg

SEQ ID NO: 2727645 - RNA, 18 nt, Human
caguucagagcugcccuc

SEQ ID NO: 2727646 - RNA, 19 nt, Human
caguucagagcugcccucu

SEQ ID NO: 2727647 - RNA, 21 nt, Human
caguucagagcugcccucucc

SEQ ID NO: 2727648 - RNA, 22 nt, Human
caguucagagcugcccucuccu

SEQ ID NO: 2727649 - RNA, 18 nt, Human
cagacuggcacaguuuuc

SEQ ID NO: 2727650 - RNA, 17 nt, Human
cagacuggcacaguuuu

SEQ ID NO: 2727651 - RNA, 20 nt, Human
cagacuggaagcacagcuuc

SEQ ID NO: 2727652 - RNA, 21 nt, Human
cagacuggaagcacagcuuca

SEQ ID NO: 2727653 - RNA, 23 nt, Human
cagacuggcacaguuuucugaga

SEQ ID NO: 2727654 - RNA, 22 nt, Human
cagacuggcacaguuuucugag

SEQ ID NO: 2727655 - RNA, 13 nt, Human
cagacuggaagca

SEQ ID NO: 2727656 - RNA, 14 nt, Human
cagacuggaagcac

SEQ ID NO: 2727657 - RNA, 16 nt, Human
cagacuggaagcacag

SEQ ID NO: 2727658 - RNA, 17 nt, Human
cagacuggaagcacagc

SEQ ID NO: 2727659 - RNA, 18 nt, Human
cagacuggaagcacagcu

SEQ ID NO: 2727660 - RNA, 17 nt, Human
cagacucuacagaggcc

SEQ ID NO: 2727661 - RNA, 22 nt, Human
cagacaggcaagcaccuccugc

SEQ ID NO: 2727662 - RNA, 23 nt, Human
cagacaggcaagcaccuccugcc

SEQ ID NO: 2727663 - RNA, 23 nt, Human
cagacucuacagaggccaugggc

SEQ ID NO: 2727664 - RNA, 18 nt, Human
cagacucuacagaggcca

SEQ ID NO: 2727665 - RNA, 19 nt, Human
cagacucuacagaggccau

SEQ ID NO: 2727666 - RNA, 20 nt, Human
cagacucuacagaggccaug

SEQ ID NO: 2727667 - RNA, 21 nt, Human
cagacucuacagaggccaugg

SEQ ID NO: 2727668 - RNA, 13 nt, Human
cagacagcugccu

SEQ ID NO: 2727669 - RNA, 14 nt, Human
cagacagcugccug

SEQ ID NO: 2727670 - RNA, 13 nt, Human
cagacaggaccag

SEQ ID NO: 2727671 - RNA, 15 nt, Human
cagacaggaccaggg

SEQ ID NO: 2727672 - RNA, 16 nt, Human
cagacaggaccaggga

SEQ ID NO: 2727673 - RNA, 15 nt, Human
cagacagcugccugg

SEQ ID NO: 2727674 - RNA, 16 nt, Human
cagacagcugccuggg

SEQ ID NO: 2727675 - RNA, 17 nt, Human
cagacagcugccuggga

SEQ ID NO: 2727676 - RNA, 18 nt, Human
cagacagcugccugggau

SEQ ID NO: 2727677 - RNA, 11 nt, Human
cagacaggcaa

SEQ ID NO: 2727678 - RNA, 17 nt, Human
cagacaggaccagggau

SEQ ID NO: 2727679 - RNA, 24 nt, Human
cagacaggaccagggauuuccaug

SEQ ID NO: 2727680 - RNA, 13 nt, Human
cagacaggcaagc

SEQ ID NO: 2727681 - RNA, 18 nt, Human
cagacaggcaagcaccuc

SEQ ID NO: 2727682 - RNA, 20 nt, Human
cagacaggcaagcaccuccu

SEQ ID NO: 2727683 - RNA, 21 nt, Human
cagacaggcaagcaccuccug

SEQ ID NO: 2727684 - RNA, 23 nt, Human
cagccagcaguucagagcugccc

SEQ ID NO: 2727685 - RNA, 18 nt, Human
cagccagacuggcacagu

SEQ ID NO: 2727686 - RNA, 15 nt, Human
cagccagacuggcac

SEQ ID NO: 2727687 - RNA, 14 nt, Human
cagccagacuggca

SEQ ID NO: 2727688 - RNA, 15 nt, Human
cagcacgauuucugu

SEQ ID NO: 2727689 - RNA, 14 nt, Human
cagcacgauuucug

SEQ ID NO: 2727690 - RNA, 19 nt, Human
cagauuucacucuccuugg

SEQ ID NO: 2727691 - RNA, 17 nt, Human
cagcaccaucucuccuc

SEQ ID NO: 2727692 - RNA, 19 nt, Human
cagcaccaucucuccuccu

SEQ ID NO: 2727693 - RNA, 20 nt, Human
cagauuucacucuccuuggu

SEQ ID NO: 2727694 - RNA, 19 nt, Human
cagauugcaacaggcuggg

SEQ ID NO: 2727695 - RNA, 20 nt, Human
cagauugcaacaggcugggc

SEQ ID NO: 2727696 - RNA, 18 nt, Human
cagauugcaacaggcugg

SEQ ID NO: 2727697 - RNA, 18 nt, Human
cagagcugcccucuccug

SEQ ID NO: 2727698 - RNA, 19 nt, Human
cagagcugcccucuccugg

SEQ ID NO: 2727699 - RNA, 20 nt, Human
cagagcugcccucuccuggg

SEQ ID NO: 2727700 - RNA, 21 nt, Human
cagagcugcccucuccugggc

SEQ ID NO: 2727701 - RNA, 23 nt, Human
cagagcugcccucuccugggcag

SEQ ID NO: 2727702 - RNA, 13 nt, Human
cagaggggguggc

SEQ ID NO: 2727703 - RNA, 17 nt, Human
cagaggaaagcaaagga

SEQ ID NO: 2727704 - RNA, 19 nt, Human
cagaggaaagcaaaggaga

SEQ ID NO: 2727705 - RNA, 13 nt, Human
cagagcugccacc

SEQ ID NO: 2727706 - RNA, 20 nt, Human
cagagagguuaaggugggua

SEQ ID NO: 2727707 - RNA, 23 nt, Human
cagagagggugggagugggccca

SEQ ID NO: 2727708 - RNA, 23 nt, Human
cagagaggguggugaccucugcc

SEQ ID NO: 2727709 - RNA, 23 nt, Human
cagagacuccugcaggcagccag

SEQ ID NO: 2727710 - RNA, 12 nt, Human
cagagagggugg

SEQ ID NO: 2727711 - RNA, 17 nt, Human
cagagaggguggugacc

SEQ ID NO: 2727712 - RNA, 20 nt, Human
cagagaggguggugaccucu

SEQ ID NO: 2727713 - RNA, 22 nt, Human
cagagaggguggugaccucugc

SEQ ID NO: 2727714 - RNA, 19 nt, Human
cagauacuuggggggcuga

SEQ ID NO: 2727715 - RNA, 14 nt, Human
cagauacuggauug

SEQ ID NO: 2727716 - RNA, 14 nt, Human
cagaggggguggcc

SEQ ID NO: 2727717 - RNA, 16 nt, Human
cagaggggguggccuc

SEQ ID NO: 2727718 - RNA, 18 nt, Human
cagauacuggauuguacu

SEQ ID NO: 2727719 - RNA, 19 nt, Human
cagauagauauaugcucug

SEQ ID NO: 2727720 - RNA, 14 nt, Human
cagauaugauucaa

SEQ ID NO: 2727721 - RNA, 11 nt, Human
caggcuacugu

SEQ ID NO: 2727722 - RNA, 21 nt, Human
caggcugggagagccuuccag

SEQ ID NO: 2727723 - RNA, 20 nt, Human
caggcugggagagccuucca

SEQ ID NO: 2727724 - RNA, 14 nt, Human
caggccuccuacag

SEQ ID NO: 2727725 - RNA, 12 nt, Human
caggccuccuac

SEQ ID NO: 2727726 - RNA, 17 nt, Human
caggggaaaaucagccu

SEQ ID NO: 2727727 - RNA, 14 nt, Human
caggggaaaagagg

SEQ ID NO: 2727728 - RNA, 16 nt, Human
caggggaaaagaggag

SEQ ID NO: 2727729 - RNA, 22 nt, Human
caggcugggagagccuuccagg

SEQ ID NO: 2727730 - RNA, 23 nt, Human
caggcugggagagccuuccaggg

SEQ ID NO: 2727731 - RNA, 11 nt, Human
caggccaggcc

SEQ ID NO: 2727732 - RNA, 12 nt, Human
caggccaggccc

SEQ ID NO: 2727733 - RNA, 19 nt, Human
caggaggaucacuugaguc

SEQ ID NO: 2727734 - RNA, 22 nt, Human
caggaggccagccuugaccauu

SEQ ID NO: 2727735 - RNA, 18 nt, Human
caggaggccagccuugac

SEQ ID NO: 2727736 - RNA, 19 nt, Human
caggaggccagccuugacc

SEQ ID NO: 2727737 - RNA, 14 nt, Human
caggcaaugcuggc

SEQ ID NO: 2727738 - RNA, 15 nt, Human
caggcaaugcuggcu

SEQ ID NO: 2727739 - RNA, 16 nt, Human
caggcaaugcuggcug

SEQ ID NO: 2727740 - RNA, 17 nt, Human
caggcaaugcuggcugu

SEQ ID NO: 2727741 - RNA, 16 nt, Human
caggaccucaggugag

SEQ ID NO: 2727742 - RNA, 23 nt, Human
caggaccucaggugagaagcaga

SEQ ID NO: 2727743 - RNA, 21 nt, Human
caggaccagggauuuccauga

SEQ ID NO: 2727744 - RNA, 16 nt, Human
caggaaagagaacuuc

SEQ ID NO: 2727745 - RNA, 20 nt, Human
caggaaagagaacuuccaga

SEQ ID NO: 2727746 - RNA, 16 nt, Human
caggaaaggcuccagg

SEQ ID NO: 2727747 - RNA, 17 nt, Human
caggaaaggcuccagga

SEQ ID NO: 2727748 - RNA, 19 nt, Human
caggaaaggcuccaggagc

SEQ ID NO: 2727749 - RNA, 20 nt, Human
caggaaaggcuccaggagca

SEQ ID NO: 2727750 - RNA, 14 nt, Human
cagcuuauugucua

SEQ ID NO: 2727751 - RNA, 20 nt, Human
cagcuguaugauucccagcc

SEQ ID NO: 2727752 - RNA, 20 nt, Human
cagcuuauugucuagugaaa

SEQ ID NO: 2727753 - RNA, 11 nt, Human
cagcugccucc

SEQ ID NO: 2727754 - RNA, 10 nt, Human
cagcugccuc

SEQ ID NO: 2727755 - RNA, 9 nt, Human
cagcugccu

SEQ ID NO: 2727756 - RNA, 14 nt, Human
cagcugccuccccu

SEQ ID NO: 2727757 - RNA, 15 nt, Human
cagcugccuccccuc

SEQ ID NO: 2727758 - RNA, 16 nt, Human
cagcugccuccccucc

SEQ ID NO: 2727759 - RNA, 17 nt, Human
cagcugccuccccuccu

SEQ ID NO: 2727760 - RNA, 18 nt, Human
cagcugccuccccuccuc

SEQ ID NO: 2727761 - RNA, 19 nt, Human
cagcugccuccccuccucu

SEQ ID NO: 2727762 - RNA, 20 nt, Human
cagcugccuccccuccucug

SEQ ID NO: 2727763 - RNA, 19 nt, Human
cagcuguaugauucccagc

SEQ ID NO: 2727764 - RNA, 21 nt, Human
cagcugacuuuucuguccgag

SEQ ID NO: 2727765 - RNA, 17 nt, Human
cagccugcuccagcugu

SEQ ID NO: 2727766 - RNA, 19 nt, Human
cagccugcuccagcuguuc

SEQ ID NO: 2727767 - RNA, 15 nt, Human
cagccugcuccagcu

SEQ ID NO: 2727768 - RNA, 16 nt, Human
cagccugcuccagcug

SEQ ID NO: 2727769 - RNA, 19 nt, Human
cagcguuucuaugacacau

SEQ ID NO: 2727770 - RNA, 15 nt, Human
cagcuaacauggaag

SEQ ID NO: 2727771 - RNA, 17 nt, Human
caaucagccuaguugau

SEQ ID NO: 2727772 - RNA, 14 nt, Human
caaucaaaucugcu

SEQ ID NO: 2727773 - RNA, 13 nt, Human
caauggcagccuu

SEQ ID NO: 2727774 - RNA, 14 nt, Human
caauggcagccuug

SEQ ID NO: 2727775 - RNA, 15 nt, Human
caauggcagccuugg

SEQ ID NO: 2727776 - RNA, 13 nt, Human
caauuuauuaugg

SEQ ID NO: 2727777 - RNA, 20 nt, Human
caauuuauuauggcacauca

SEQ ID NO: 2727778 - RNA, 20 nt, Human
caaguuauuuuuaauuuggu

SEQ ID NO: 2727779 - RNA, 15 nt, Human
caagcucugcuccuc

SEQ ID NO: 2727780 - RNA, 16 nt, Human
caagcucugcuccucu

SEQ ID NO: 2727781 - RNA, 12 nt, Human
caagcucccagg

SEQ ID NO: 2727782 - RNA, 14 nt, Human
caagcucccaggca

SEQ ID NO: 2727783 - RNA, 15 nt, Human
caagcucccaggcau

SEQ ID NO: 2727784 - RNA, 17 nt, Human
caagcucccaggcauuc

SEQ ID NO: 2727785 - RNA, 19 nt, Human
caagcuccaagcucccagg

SEQ ID NO: 2727786 - RNA, 21 nt, Human
caagcuccaagcucccaggca

SEQ ID NO: 2727787 - RNA, 17 nt, Human
caagcuccaagcuccca

SEQ ID NO: 2727788 - RNA, 18 nt, Human
caagcuccaagcucccag

SEQ ID NO: 2727789 - RNA, 13 nt, Human
caaguauuauacc

SEQ ID NO: 2727790 - RNA, 22 nt, Human
caaguauuauaccuuuuuuaga

SEQ ID NO: 2727791 - RNA, 17 nt, Human
caaguauuauaccuuuu

SEQ ID NO: 2727792 - RNA, 14 nt, Human
caaggcaaggcugu

SEQ ID NO: 2727793 - RNA, 19 nt, Human
caaggauugcuacuguccu

SEQ ID NO: 2727794 - RNA, 20 nt, Human
caaggauugcuacuguccua

SEQ ID NO: 2727795 - RNA, 19 nt, Human
caacuauauuguuugcuaa

SEQ ID NO: 2727796 - RNA, 19 nt, Human
caacuaucucauuuccaag

SEQ ID NO: 2727797 - RNA, 17 nt, Human
caaccccuucgcuccug

SEQ ID NO: 2727798 - RNA, 14 nt, Human
caaccccuucgcuc

SEQ ID NO: 2727799 - RNA, 16 nt, Human
caaccccuucgcuccu

SEQ ID NO: 2727800 - RNA, 14 nt, Human
caacccccagccug

SEQ ID NO: 2727801 - RNA, 12 nt, Human
caacuccagaaa

SEQ ID NO: 2727802 - RNA, 15 nt, Human
caacuauuuuuccaa

SEQ ID NO: 2727803 - RNA, 15 nt, Human
caagaagcccaggaa

SEQ ID NO: 2727804 - RNA, 18 nt, Human
caagaagcccaggaaagg

SEQ ID NO: 2727805 - RNA, 17 nt, Human
caagaaggaugauucaa

SEQ ID NO: 2727806 - RNA, 14 nt, Human
caagcaaguauuag

SEQ ID NO: 2727807 - RNA, 16 nt, Human
caagaccacguuucua

SEQ ID NO: 2727808 - RNA, 14 nt, Human
caagaccacguuuc

SEQ ID NO: 2727809 - RNA, 13 nt, Human
caagcaccuccug

SEQ ID NO: 2727810 - RNA, 14 nt, Human
caagcaccuccugc

SEQ ID NO: 2727811 - RNA, 11 nt, Human
cacugaagaag

SEQ ID NO: 2727812 - RNA, 23 nt, Human
cacugaagaagcaccaaucauga

SEQ ID NO: 2727813 - RNA, 16 nt, Human
cacggaagagccuugc

SEQ ID NO: 2727814 - RNA, 22 nt, Human
cacggaagagccuugcggaagg

SEQ ID NO: 2727815 - RNA, 14 nt, Human
cacuacauucuguu

SEQ ID NO: 2727816 - RNA, 13 nt, Human
cacuacauucugu

SEQ ID NO: 2727817 - RNA, 21 nt, Human
cacuacauuauaaaugucucu

SEQ ID NO: 2727818 - RNA, 15 nt, Human
cacuacauucuguua

SEQ ID NO: 2727819 - RNA, 21 nt, Human
cacgcuggagugcagugagcc

SEQ ID NO: 2727820 - RNA, 16 nt, Human
cacgcuggagugcagu

SEQ ID NO: 2727821 - RNA, 17 nt, Human
cacgcuggagugcagug

SEQ ID NO: 2727822 - RNA, 18 nt, Human
cacgcuggagugcaguga

SEQ ID NO: 2727823 - RNA, 20 nt, Human
cacgcuggagugcagugagc

SEQ ID NO: 2727824 - RNA, 15 nt, Human
cacgcuggagugcag

SEQ ID NO: 2727825 - RNA, 17 nt, Human
cacccuggggagaaagu

SEQ ID NO: 2727826 - RNA, 11 nt, Human
caccugccagg

SEQ ID NO: 2727827 - RNA, 12 nt, Human
caccugccaggg

SEQ ID NO: 2727828 - RNA, 18 nt, Human
caccugccccucaacucu

SEQ ID NO: 2727829 - RNA, 21 nt, Human
caccugccccucaacucuccu

SEQ ID NO: 2727830 - RNA, 12 nt, Human
cacccugcucuc

SEQ ID NO: 2727831 - RNA, 12 nt, Human
cacccuccuuuc

SEQ ID NO: 2727832 - RNA, 16 nt, Human
caccugcggugcuauc

SEQ ID NO: 2727833 - RNA, 17 nt, Human
caccugcggugcuaucu

SEQ ID NO: 2727834 - RNA, 19 nt, Human
caccugcggugcuaucucc

SEQ ID NO: 2727835 - RNA, 23 nt, Human
cacaucagcuugcccuguuaaaa

SEQ ID NO: 2727836 - RNA, 13 nt, Human
cacaucagcuugc

SEQ ID NO: 2727837 - RNA, 13 nt, Human
cacaucuugcucu

SEQ ID NO: 2727838 - RNA, 14 nt, Human
cacaucuugcucug

SEQ ID NO: 2727839 - RNA, 15 nt, Human
cacaucuugcucugc

SEQ ID NO: 2727840 - RNA, 20 nt, Human
cacaucuugcucugcugaca

SEQ ID NO: 2727841 - RNA, 21 nt, Human
cacaucuugcucugcugacag

SEQ ID NO: 2727842 - RNA, 22 nt, Human
cacaucuugcucugcugacaga

SEQ ID NO: 2727843 - RNA, 12 nt, Human
cacccagcccac

SEQ ID NO: 2727844 - RNA, 19 nt, Human
caccagcccuuagcaggga

SEQ ID NO: 2727845 - RNA, 18 nt, Human
caccagccccagugccca

SEQ ID NO: 2727846 - RNA, 21 nt, Human
caccagccccagugcccacag

SEQ ID NO: 2727847 - RNA, 22 nt, Human
caccagccccagugcccacagg

SEQ ID NO: 2727848 - RNA, 23 nt, Human
cacaucuugcucugcugacagac

SEQ ID NO: 2727849 - RNA, 19 nt, Human
cacaucuugcucugcugac

SEQ ID NO: 2727850 - RNA, 17 nt, Human
cacauuuauucugcuca

SEQ ID NO: 2727851 - RNA, 18 nt, Human
cacauuuauucugcucac

SEQ ID NO: 2727852 - RNA, 17 nt, Human
caccagccccagugccc

SEQ ID NO: 2727853 - RNA, 18 nt, Human
auuuucuauaauuuaaau

SEQ ID NO: 2727854 - RNA, 17 nt, Human
auuuucuauaauuuaaa

SEQ ID NO: 2727855 - RNA, 19 nt, Human
auuuucuauaauuuaaaua

SEQ ID NO: 2727856 - RNA, 14 nt, Human
auuuguuauaauga

SEQ ID NO: 2727857 - RNA, 22 nt, Human
auuuguguugaagagguuuuaa

SEQ ID NO: 2727858 - RNA, 18 nt, Human
auuuguguugaagagguu

SEQ ID NO: 2727859 - RNA, 15 nt, Human
auuuguguugaagag

SEQ ID NO: 2727860 - RNA, 14 nt, Human
auuuguguugaaga

SEQ ID NO: 2727861 - RNA, 13 nt, Human
caaaagcauguga

SEQ ID NO: 2727862 - RNA, 19 nt, Human
caaaagcaucuaugugaga

SEQ ID NO: 2727863 - RNA, 17 nt, Human
caaacauauauaacaau

SEQ ID NO: 2727864 - RNA, 20 nt, Human
caaaagguuaauaaaguaau

SEQ ID NO: 2727865 - RNA, 19 nt, Human
auuuuuauauuugaaauau

SEQ ID NO: 2727866 - RNA, 16 nt, Human
auuuuuauauuugaaa

SEQ ID NO: 2727867 - RNA, 22 nt, Human
auuuuguuuuugucuuaaaaag

SEQ ID NO: 2727868 - RNA, 16 nt, Human
auuuuuauuaaauuau

SEQ ID NO: 2727869 - RNA, 18 nt, Human
auuuuuuuguuguuuguu

SEQ ID NO: 2727870 - RNA, 17 nt, Human
auuuuuuucugaaauuu

SEQ ID NO: 2727871 - RNA, 16 nt, Human
auuuuuuucugaaauu

SEQ ID NO: 2727872 - RNA, 14 nt, Human
caaaccaucauuga

SEQ ID NO: 2727873 - RNA, 16 nt, Human
caaaccaucauugaaa

SEQ ID NO: 2727874 - RNA, 17 nt, Human
caaaccaucauugaaau

SEQ ID NO: 2727875 - RNA, 16 nt, Human
auuucagcagcugcag

SEQ ID NO: 2727876 - RNA, 14 nt, Human
auuucacucuccuu

SEQ ID NO: 2727877 - RNA, 12 nt, Human
auuucacucucc

SEQ ID NO: 2727878 - RNA, 22 nt, Human
auuuaauagguuuggacaaaau

SEQ ID NO: 2727879 - RNA, 18 nt, Human
auuuaauaauuauaugcu

SEQ ID NO: 2727880 - RNA, 15 nt, Human
auuuaauaauuauau

SEQ ID NO: 2727881 - RNA, 13 nt, Human
auuuaauaauuau

SEQ ID NO: 2727882 - RNA, 12 nt, Human
auugauaaguuc

SEQ ID NO: 2727883 - RNA, 15 nt, Human
auugauaaguucaua

SEQ ID NO: 2727884 - RNA, 16 nt, Human
auugauaaguucauac

SEQ ID NO: 2727885 - RNA, 17 nt, Human
auugauaaguucauaca

SEQ ID NO: 2727886 - RNA, 18 nt, Human
auugauaaguucauacau

SEQ ID NO: 2727887 - RNA, 19 nt, Human
auugauaaguucauacauu

SEQ ID NO: 2727888 - RNA, 21 nt, Human
auugauaaguucauacauugu

SEQ ID NO: 2727889 - RNA, 19 nt, Human
auuucuguuuagauaauac

SEQ ID NO: 2727890 - RNA, 20 nt, Human
auuucuguuuagauaauaca

SEQ ID NO: 2727891 - RNA, 21 nt, Human
auuucuguuuagauaauacac

SEQ ID NO: 2727892 - RNA, 22 nt, Human
auugaggacacugauauggguc

SEQ ID NO: 2727893 - RNA, 15 nt, Human
auucucuuauccaac

SEQ ID NO: 2727894 - RNA, 19 nt, Human
auucucuaguuugauuaaa

SEQ ID NO: 2727895 - RNA, 20 nt, Human
auucucuaguuugauuaaau

SEQ ID NO: 2727896 - RNA, 14 nt, Human
auucucuuauccaa

SEQ ID NO: 2727897 - RNA, 12 nt, Human
auucucuuaucc

SEQ ID NO: 2727898 - RNA, 23 nt, Human
auucucuaguuugauuaaauucu

SEQ ID NO: 2727899 - RNA, 12 nt, Human
auuauguaaauc

SEQ ID NO: 2727900 - RNA, 14 nt, Human
auuauguaaauccc

SEQ ID NO: 2727901 - RNA, 13 nt, Human
auuauguaaaucc

SEQ ID NO: 2727902 - RNA, 23 nt, Human
auuauguaaaucccauuauucaa

SEQ ID NO: 2727903 - RNA, 22 nt, Human
auuauguaaaucccauuauuca

SEQ ID NO: 2727904 - RNA, 17 nt, Human
auuauguaaaucccauu

SEQ ID NO: 2727905 - RNA, 15 nt, Human
auuauguaaauccca

SEQ ID NO: 2727906 - RNA, 14 nt, Human
auucauauuuacuu

SEQ ID NO: 2727907 - RNA, 22 nt, Human
auuacaagcgugagccacugca

SEQ ID NO: 2727908 - RNA, 12 nt, Human
ccuuuucccaac

SEQ ID NO: 2727909 - RNA, 23 nt, Human
cgccaaggcugggggaagaagcu

SEQ ID NO: 2727910 - RNA, 17 nt, Human
cgcuggagugcagugag

SEQ ID NO: 2727911 - RNA, 18 nt, Human
cgcuggagugcagugagc

SEQ ID NO: 2727912 - RNA, 19 nt, Human
cgcugauaagcguucaugg

SEQ ID NO: 2727913 - RNA, 19 nt, Human
cgcugccccuggcagcccc

SEQ ID NO: 2727914 - RNA, 20 nt, Human
cgcugccccuggcagccccu

SEQ ID NO: 2727915 - RNA, 23 nt, Human
cggagucccaccuuggcugcagg

SEQ ID NO: 2727916 - RNA, 21 nt, Human
cggagucccaccuuggcugca

SEQ ID NO: 2727917 - RNA, 22 nt, Human
cggagucccaccuuggcugcag

SEQ ID NO: 2727918 - RNA, 20 nt, Human
cggagacggagucccaccuu

SEQ ID NO: 2727919 - RNA, 17 nt, Human
cggagacggagucccac

SEQ ID NO: 2727920 - RNA, 19 nt, Human
cgggcucagcaaaagaugc

SEQ ID NO: 2727921 - RNA, 12 nt, Human
cgggcucugccu

SEQ ID NO: 2727922 - RNA, 22 nt, Human
cguacacauuuuauuuuauuau

SEQ ID NO: 2727923 - RNA, 20 nt, Human
cgguggcucacgccuguaau

SEQ ID NO: 2727924 - RNA, 20 nt, Human
cuacaaaaacacagcaaggg

SEQ ID NO: 2727925 - RNA, 19 nt, Human
cuacaaaaagcauaaaaau

SEQ ID NO: 2727926 - RNA, 14 nt, Human
cuaaguuuuuaugg

SEQ ID NO: 2727927 - RNA, 14 nt, Human
cuaacuugucuuug

SEQ ID NO: 2727928 - RNA, 22 nt, Human
cuaacuugucuuuggacccuga

SEQ ID NO: 2727929 - RNA, 11 nt, Human
cuaaagcugcc

SEQ ID NO: 2727930 - RNA, 15 nt, Human
cguguuaugacucca

SEQ ID NO: 2727931 - RNA, 19 nt, Human
cguguuaugacuccagaau

SEQ ID NO: 2727932 - RNA, 19 nt, Human
cgugaguccuggcauggga

SEQ ID NO: 2727933 - RNA, 18 nt, Human
cgugaguccuggcauggg

SEQ ID NO: 2727934 - RNA, 22 nt, Human
cgugagccacugcaccgggcca

SEQ ID NO: 2727935 - RNA, 14 nt, Human
cgugaggccagaga

SEQ ID NO: 2727936 - RNA, 14 nt, Human
cgugagccacugca

SEQ ID NO: 2727937 - RNA, 15 nt, Human
cgugagccacugcac

SEQ ID NO: 2727938 - RNA, 20 nt, Human
cgugagccacugcaccgggc

SEQ ID NO: 2727939 - RNA, 14 nt, Human
cgugacaacacuug

SEQ ID NO: 2727940 - RNA, 15 nt, Human
cgugacaacacuugu

SEQ ID NO: 2727941 - RNA, 12 nt, Human
cgugacaacacu

SEQ ID NO: 2727942 - RNA, 20 nt, Human
ccuucuguccuacucugugu

SEQ ID NO: 2727943 - RNA, 21 nt, Human
ccuucuguccuacucuguguc

SEQ ID NO: 2727944 - RNA, 22 nt, Human
ccuucuguccuacucuguguca

SEQ ID NO: 2727945 - RNA, 21 nt, Human
ccuucucuccagccccuggau

SEQ ID NO: 2727946 - RNA, 23 nt, Human
ccuucucuccagccccuggaugc

SEQ ID NO: 2727947 - RNA, 14 nt, Human
ccuucucugaagga

SEQ ID NO: 2727948 - RNA, 16 nt, Human
ccuucucugaaggaca

SEQ ID NO: 2727949 - RNA, 20 nt, Human
ccuucucuccagccccugga

SEQ ID NO: 2727950 - RNA, 15 nt, Human
ccuuucaauaggaaa

SEQ ID NO: 2727951 - RNA, 18 nt, Human
ccuuucaauaggaaaaac

SEQ ID NO: 2727952 - RNA, 17 nt, Human
ccuuucaauaggaaaaa

SEQ ID NO: 2727953 - RNA, 13 nt, Human
ccuguucagcucc

SEQ ID NO: 2727954 - RNA, 12 nt, Human
ccuuauggaaca

SEQ ID NO: 2727955 - RNA, 22 nt, Human
ccuuauggaacacucugagacu

SEQ ID NO: 2727956 - RNA, 19 nt, Human
ccuuauggaacacucugag

SEQ ID NO: 2727957 - RNA, 20 nt, Human
ccuuauggaacacucugaga

SEQ ID NO: 2727958 - RNA, 14 nt, Human
ccuuauggaacacu

SEQ ID NO: 2727959 - RNA, 16 nt, Human
ccuuauggaacacucu

SEQ ID NO: 2727960 - RNA, 17 nt, Human
ccuuauggaacacucug

SEQ ID NO: 2727961 - RNA, 18 nt, Human
ccuuauggaacacucuga

SEQ ID NO: 2727962 - RNA, 12 nt, Human
ccuucccaccuc

SEQ ID NO: 2727963 - RNA, 14 nt, Human
ccuucccaccucuc

SEQ ID NO: 2727964 - RNA, 19 nt, Human
ccuucccaccucucucacu

SEQ ID NO: 2727965 - RNA, 16 nt, Human
ccuuagcaaauucugu

SEQ ID NO: 2727966 - RNA, 19 nt, Human
ccuuagcagggaaacagcu

SEQ ID NO: 2727967 - RNA, 20 nt, Human
ccuuagcagggaaacagcua

SEQ ID NO: 2727968 - RNA, 16 nt, Human
ccuguugggccaggag

SEQ ID NO: 2727969 - RNA, 17 nt, Human
ccuguugggccaggagc

SEQ ID NO: 2727970 - RNA, 18 nt, Human
ccuguugggccaggagcc

SEQ ID NO: 2727971 - RNA, 19 nt, Human
ccuguugggccaggagccu

SEQ ID NO: 2727972 - RNA, 20 nt, Human
ccuguugggccaggagccuc

SEQ ID NO: 2727973 - RNA, 18 nt, Human
ccuguucccaugagauga

SEQ ID NO: 2727974 - RNA, 12 nt, Human
ccuguucuggca

SEQ ID NO: 2727975 - RNA, 17 nt, Human
ccuguucuggcagaguu

SEQ ID NO: 2727976 - RNA, 23 nt, Human
ccuguucagcuccagcucaccag

SEQ ID NO: 2727977 - RNA, 20 nt, Human
ccuguucagcuccagcucac

SEQ ID NO: 2727978 - RNA, 21 nt, Human
ccuguucagcuccagcucacc

SEQ ID NO: 2727979 - RNA, 14 nt, Human
ccuguucagcucca

SEQ ID NO: 2727980 - RNA, 15 nt, Human
ccuguucagcuccag

SEQ ID NO: 2727981 - RNA, 16 nt, Human
ccuguucagcuccagc

SEQ ID NO: 2727982 - RNA, 19 nt, Human
ccuguucagcuccagcuca

SEQ ID NO: 2727983 - RNA, 18 nt, Human
cuauguugcccaggcagg

SEQ ID NO: 2727984 - RNA, 19 nt, Human
cuauguugcccaggcaggu

SEQ ID NO: 2727985 - RNA, 21 nt, Human
cuauguugcccaggcaggucu

SEQ ID NO: 2727986 - RNA, 22 nt, Human
cuauguugcccaggcaggucuu

SEQ ID NO: 2727987 - RNA, 18 nt, Human
cuaucucauuuccaagca

SEQ ID NO: 2727988 - RNA, 13 nt, Human
cuaucucccccag

SEQ ID NO: 2727989 - RNA, 14 nt, Human
cuaucucccccagc

SEQ ID NO: 2727990 - RNA, 14 nt, Human
cuaugugagaccau

SEQ ID NO: 2727991 - RNA, 21 nt, Human
cucaagugauucuccugccuc

SEQ ID NO: 2727992 - RNA, 23 nt, Human
cucaauuauuuugcauuuuuucu

SEQ ID NO: 2727993 - RNA, 20 nt, Human
cucagucuggcccuuccuuu

SEQ ID NO: 2727994 - RNA, 15 nt, Human
cucaguccauagcag

SEQ ID NO: 2727995 - RNA, 17 nt, Human
cucaguccauagcagag

SEQ ID NO: 2727996 - RNA, 22 nt, Human
cucagucuggcccuuccuuuuc

SEQ ID NO: 2727997 - RNA, 23 nt, Human
cucaggugucccugcacuugcag

SEQ ID NO: 2727998 - RNA, 15 nt, Human
cucaggccagcugcu

SEQ ID NO: 2727999 - RNA, 21 nt, Human
cucaggccaaacucaccugcc

SEQ ID NO: 2728000 - RNA, 19 nt, Human
cucaggccaaacucaccug

SEQ ID NO: 2728001 - RNA, 20 nt, Human
cucaggccaaacucaccugc

SEQ ID NO: 2728002 - RNA, 22 nt, Human
cucaggccugggggcugggcag

SEQ ID NO: 2728003 - RNA, 11 nt, Human
cucaggccugg

SEQ ID NO: 2728004 - RNA, 16 nt, Human
cucaggccagcugcuu

SEQ ID NO: 2728005 - RNA, 17 nt, Human
cucaggccagcugcuug

SEQ ID NO: 2728006 - RNA, 18 nt, Human
cucaggccagcugcuugg

SEQ ID NO: 2728007 - RNA, 13 nt, Human
cucagaagacacu

SEQ ID NO: 2728008 - RNA, 15 nt, Human
cucagaagacacuga

SEQ ID NO: 2728009 - RNA, 17 nt, Human
cucagaagacacugaug

SEQ ID NO: 2728010 - RNA, 20 nt, Human
cucagaagacacugaugggc

SEQ ID NO: 2728011 - RNA, 22 nt, Human
cucagaagacacugaugggcaa

SEQ ID NO: 2728012 - RNA, 17 nt, Human
cucaccuuucccaucuu

SEQ ID NO: 2728013 - RNA, 23 nt, Human
cucagaagacacugaugggcaac

SEQ ID NO: 2728014 - RNA, 19 nt, Human
cucagccucccgaauagcu

SEQ ID NO: 2728015 - RNA, 21 nt, Human
cucagccucccgaauagcugg

SEQ ID NO: 2728016 - RNA, 22 nt, Human
cucagccucccgaauagcuggg

SEQ ID NO: 2728017 - RNA, 19 nt, Human
cucccuccaccucccugca

SEQ ID NO: 2728018 - RNA, 20 nt, Human
cucccuccaccucccugcaa

SEQ ID NO: 2728019 - RNA, 21 nt, Human
cucccuccaccucccugcaau

SEQ ID NO: 2728020 - RNA, 22 nt, Human
cucccuccaccucccugcaaua

SEQ ID NO: 2728021 - RNA, 20 nt, Human
cucccucuuucccucccuuc

SEQ ID NO: 2728022 - RNA, 23 nt, Human
cuccaggugcacaagcuccaagc

SEQ ID NO: 2728023 - RNA, 15 nt, Human
cuccaggcuccuuua

SEQ ID NO: 2728024 - RNA, 23 nt, Human
cuccaggcuccuuuagcgcccag

SEQ ID NO: 2728025 - RNA, 20 nt, Human
cuccaggcuguaucccauga

SEQ ID NO: 2728026 - RNA, 16 nt, Human
cuccuguaccucuuga

SEQ ID NO: 2728027 - RNA, 15 nt, Human
cuccuuucaccacau

SEQ ID NO: 2728028 - RNA, 14 nt, Human
cuccuuguguuacu

SEQ ID NO: 2728029 - RNA, 22 nt, Human
cuccucugcuugccaucccucc

SEQ ID NO: 2728030 - RNA, 15 nt, Human
cuccucugcugcugg

SEQ ID NO: 2728031 - RNA, 13 nt, Human
cuccucugcugcu

SEQ ID NO: 2728032 - RNA, 14 nt, Human
cuccucugcugcug

SEQ ID NO: 2728033 - RNA, 19 nt, Human
cuccuggccucaagugauu

SEQ ID NO: 2728034 - RNA, 18 nt, Human
cuccugggcuaagugauc

SEQ ID NO: 2728035 - RNA, 19 nt, Human
cuccuggcccacugcaucg

SEQ ID NO: 2728036 - RNA, 23 nt, Human
cuccgcuuucuacccagcgagcc

SEQ ID NO: 2728037 - RNA, 16 nt, Human
cucuccuccagaguca

SEQ ID NO: 2728038 - RNA, 12 nt, Human
cucuccuccaga

SEQ ID NO: 2728039 - RNA, 13 nt, Human
cucuccuccagag

SEQ ID NO: 2728040 - RNA, 15 nt, Human
cucuccuccagaguc

SEQ ID NO: 2728041 - RNA, 16 nt, Human
cucuccccaugauguu

SEQ ID NO: 2728042 - RNA, 15 nt, Human
cucuccccaugaugu

SEQ ID NO: 2728043 - RNA, 17 nt, Human
cucgguguggagaagcg

SEQ ID NO: 2728044 - RNA, 16 nt, Human
cucgguguggagaagc

SEQ ID NO: 2728045 - RNA, 17 nt, Human
cuccuuugugaggaagc

SEQ ID NO: 2728046 - RNA, 18 nt, Human
cuccuuugugaggaagcc

SEQ ID NO: 2728047 - RNA, 20 nt, Human
cucugcacaagcugcacccu

SEQ ID NO: 2728048 - RNA, 21 nt, Human
cucugcacaagcugcacccuc

SEQ ID NO: 2728049 - RNA, 19 nt, Human
cucugcacaagcugcaccc

SEQ ID NO: 2728050 - RNA, 14 nt, Human
cucugcacuccccu

SEQ ID NO: 2728051 - RNA, 15 nt, Human
cucugcacuccccug

SEQ ID NO: 2728052 - RNA, 16 nt, Human
cucugcacuccccugc

SEQ ID NO: 2728053 - RNA, 21 nt, Human
cucugcuccucuccccagcaa

SEQ ID NO: 2728054 - RNA, 17 nt, Human
cucugcacuccccugcu

SEQ ID NO: 2728055 - RNA, 21 nt, Human
cucugcugacagacacaggcc

SEQ ID NO: 2728056 - RNA, 22 nt, Human
cucugcugacagacacaggccc

SEQ ID NO: 2728057 - RNA, 20 nt, Human
cucugcugacagacacaggc

SEQ ID NO: 2728058 - RNA, 13 nt, Human
cucugcugcuggc

SEQ ID NO: 2728059 - RNA, 23 nt, Human
cucugcugacagacacaggcccg

SEQ ID NO: 2728060 - RNA, 13 nt, Human
cucuguacagagc

SEQ ID NO: 2728061 - RNA, 14 nt, Human
cucuguacagagcc

SEQ ID NO: 2728062 - RNA, 15 nt, Human
cucuguacagagccc

SEQ ID NO: 2728063 - RNA, 16 nt, Human
cucugcugcuggcugg

SEQ ID NO: 2728064 - RNA, 14 nt, Human
cucugcugcuggcu

SEQ ID NO: 2728065 - RNA, 15 nt, Human
cucugcugcuggcug

SEQ ID NO: 2728066 - RNA, 16 nt, Human
cucuguacagagccca

SEQ ID NO: 2728067 - RNA, 16 nt, Human
ccgugaggccagagac

SEQ ID NO: 2728068 - RNA, 17 nt, Human
ccgucuaccugaggggc

SEQ ID NO: 2728069 - RNA, 12 nt, Human
ccgugaggccag

SEQ ID NO: 2728070 - RNA, 13 nt, Human
ccgugaggccaga

SEQ ID NO: 2728071 - RNA, 14 nt, Human
ccgugaggccagag

SEQ ID NO: 2728072 - RNA, 12 nt, Human
ccggcuccaggc

SEQ ID NO: 2728073 - RNA, 13 nt, Human
ccggcuccaggcu

SEQ ID NO: 2728074 - RNA, 14 nt, Human
ccggcuccaggcuc

SEQ ID NO: 2728075 - RNA, 15 nt, Human
ccggcuccaggcucc

SEQ ID NO: 2728076 - RNA, 14 nt, Human
ccgucuaccugagg

SEQ ID NO: 2728077 - RNA, 15 nt, Human
ccgucuaccugaggg

SEQ ID NO: 2728078 - RNA, 14 nt, Human
ccuaaucuucugaa

SEQ ID NO: 2728079 - RNA, 12 nt, Human
ccuaaggacuuc

SEQ ID NO: 2728080 - RNA, 11 nt, Human
ccuaaggacuu

SEQ ID NO: 2728081 - RNA, 23 nt, Human
ccuaaggacuucuuuaauuuugg

SEQ ID NO: 2728082 - RNA, 18 nt, Human
ccuaaggacuucuuuaau

SEQ ID NO: 2728083 - RNA, 17 nt, Human
ccuaaggacuucuuuaa

SEQ ID NO: 2728084 - RNA, 16 nt, Human
ccuaaggacuucuuua

SEQ ID NO: 2728085 - RNA, 20 nt, Human
ccuagccugugccucuggga

SEQ ID NO: 2728086 - RNA, 19 nt, Human
ccuagcauacguacacauu

SEQ ID NO: 2728087 - RNA, 17 nt, Human
ccuagcacuuugggagg

SEQ ID NO: 2728088 - RNA, 18 nt, Human
ccggcaggguccuagaaa

SEQ ID NO: 2728089 - RNA, 15 nt, Human
ccggccccugcuggu

SEQ ID NO: 2728090 - RNA, 16 nt, Human
ccggccaccugcggug

SEQ ID NO: 2728091 - RNA, 15 nt, Human
cccuuccucuuucca

SEQ ID NO: 2728092 - RNA, 19 nt, Human
ccgaaagggacuuggaagc

SEQ ID NO: 2728093 - RNA, 16 nt, Human
ccgaaaacguggcugc

SEQ ID NO: 2728094 - RNA, 17 nt, Human
ccgaaaacguggcugcu

SEQ ID NO: 2728095 - RNA, 16 nt, Human
ccgaauagcugggacu

SEQ ID NO: 2728096 - RNA, 17 nt, Human
ccgaauagcugggacua

SEQ ID NO: 2728097 - RNA, 18 nt, Human
ccgaccagacaccuugac

SEQ ID NO: 2728098 - RNA, 15 nt, Human
ccgcagacaggacca

SEQ ID NO: 2728099 - RNA, 13 nt, Human
ccgaccagacacc

SEQ ID NO: 2728100 - RNA, 17 nt, Human
ccgaccagacaccuuga

SEQ ID NO: 2728101 - RNA, 12 nt, Human
ccgcccaggcuu

SEQ ID NO: 2728102 - RNA, 16 nt, Human
ccgcagacaggaccag

SEQ ID NO: 2728103 - RNA, 17 nt, Human
ccgcagacaggaccagg

SEQ ID NO: 2728104 - RNA, 23 nt, Human
cccugugauggggcccugccucc

SEQ ID NO: 2728105 - RNA, 21 nt, Human
cccugugauggggcccugccu

SEQ ID NO: 2728106 - RNA, 22 nt, Human
cccugugauggggcccugccuc

SEQ ID NO: 2728107 - RNA, 14 nt, Human
cccugagcaggauu

SEQ ID NO: 2728108 - RNA, 16 nt, Human
cccugagcuuucugcu

SEQ ID NO: 2728109 - RNA, 20 nt, Human
cccugcccaccuggccucug

SEQ ID NO: 2728110 - RNA, 22 nt, Human
cccugcccaccuggccucugca

SEQ ID NO: 2728111 - RNA, 14 nt, Human
cccugcccggcugc

SEQ ID NO: 2728112 - RNA, 17 nt, Human
cccugcccggcugcgga

SEQ ID NO: 2728113 - RNA, 13 nt, Human
cccuggaugcagc

SEQ ID NO: 2728114 - RNA, 17 nt, Human
cccuggaugcagccuca

SEQ ID NO: 2728115 - RNA, 21 nt, Human
cccuggaugcagccucacagu

SEQ ID NO: 2728116 - RNA, 13 nt, Human
cccucggagaaga

SEQ ID NO: 2728117 - RNA, 18 nt, Human
cccugaaagcccugagcu

SEQ ID NO: 2728118 - RNA, 16 nt, Human
cccugaaagcccugag

SEQ ID NO: 2728119 - RNA, 12 nt, Human
cccugaaggccc

SEQ ID NO: 2728120 - RNA, 13 nt, Human
cccugaaggcccc

SEQ ID NO: 2728121 - RNA, 14 nt, Human
cccugaaggccccg

SEQ ID NO: 2728122 - RNA, 16 nt, Human
cccugaaggccccgcc

SEQ ID NO: 2728123 - RNA, 19 nt, Human
cccugaaggccccgcccag

SEQ ID NO: 2728124 - RNA, 14 nt, Human
cccugacaacacuc

SEQ ID NO: 2728125 - RNA, 20 nt, Human
cccugaaggccccgcccagg

SEQ ID NO: 2728126 - RNA, 22 nt, Human
cccugaaggccccgcccaggcu

SEQ ID NO: 2728127 - RNA, 16 nt, Human
cccugacaacacucau

SEQ ID NO: 2728128 - RNA, 22 nt, Human
cccugacaacacucauugaccu

SEQ ID NO: 2728129 - RNA, 20 nt, Human
cccugaauuuaaauagcuuu

SEQ ID NO: 2728130 - RNA, 17 nt, Human
ccucuccugggcagcug

SEQ ID NO: 2728131 - RNA, 18 nt, Human
ccucuccugggcagcugc

SEQ ID NO: 2728132 - RNA, 19 nt, Human
ccucuccugggcagcugcc

SEQ ID NO: 2728133 - RNA, 20 nt, Human
ccucuccugggcagcugccu

SEQ ID NO: 2728134 - RNA, 14 nt, Human
ccucuccugggcag

SEQ ID NO: 2728135 - RNA, 15 nt, Human
ccucuccugggcagc

SEQ ID NO: 2728136 - RNA, 16 nt, Human
ccucuccugggcagcu

SEQ ID NO: 2728137 - RNA, 21 nt, Human
ccucuccugggcagcugccuc

SEQ ID NO: 2728138 - RNA, 22 nt, Human
ccucuccugggcagcugccucc

SEQ ID NO: 2728139 - RNA, 20 nt, Human
ccucugccucugacacacag

SEQ ID NO: 2728140 - RNA, 21 nt, Human
ccucugccucugacacacagc

SEQ ID NO: 2728141 - RNA, 23 nt, Human
ccucugccucugacacacagcuc

SEQ ID NO: 2728142 - RNA, 11 nt, Human
ccucugccuga

SEQ ID NO: 2728143 - RNA, 20 nt, Human
ccucugccugaagucacaca

SEQ ID NO: 2728144 - RNA, 12 nt, Human
ccucucucacuc

SEQ ID NO: 2728145 - RNA, 16 nt, Human
ccucgaacuggcugca

SEQ ID NO: 2728146 - RNA, 15 nt, Human
ccucgaacuggcugc

SEQ ID NO: 2728147 - RNA, 18 nt, Human
ccuccuuugugaggaagc

SEQ ID NO: 2728148 - RNA, 19 nt, Human
ccuccuuugugaggaagcc

SEQ ID NO: 2728149 - RNA, 20 nt, Human
ccuccuuugugaggaagccg

SEQ ID NO: 2728150 - RNA, 11 nt, Human
ccucaggcagg

SEQ ID NO: 2728151 - RNA, 17 nt, Human
ccucccaacucacccca

SEQ ID NO: 2728152 - RNA, 20 nt, Human
ccucccaacucaccccagcc

SEQ ID NO: 2728153 - RNA, 21 nt, Human
ccucccaacucaccccagccc

SEQ ID NO: 2728154 - RNA, 23 nt, Human
ccucccaacucaccccagcccca

SEQ ID NO: 2728155 - RNA, 12 nt, Human
ccugaggggccu

SEQ ID NO: 2728156 - RNA, 16 nt, Human
ccugaggggccucuua

SEQ ID NO: 2728157 - RNA, 16 nt, Human
ccugaggcugggcucc

SEQ ID NO: 2728158 - RNA, 17 nt, Human
ccugaggcugggcuccc

SEQ ID NO: 2728159 - RNA, 19 nt, Human
ccugaggcugggcucccuu

SEQ ID NO: 2728160 - RNA, 21 nt, Human
ccugaggcugggcucccuucc

SEQ ID NO: 2728161 - RNA, 23 nt, Human
ccugcaggcagccaggccacaag

SEQ ID NO: 2728162 - RNA, 18 nt, Human
ccugcaggcagccaggcc

SEQ ID NO: 2728163 - RNA, 19 nt, Human
ccugcaggcagccaggcca

SEQ ID NO: 2728164 - RNA, 20 nt, Human
ccugcaggcagccaggccac

SEQ ID NO: 2728165 - RNA, 21 nt, Human
ccugcaggcagccaggccaca

SEQ ID NO: 2728166 - RNA, 15 nt, Human
ccugcaggcagccag

SEQ ID NO: 2728167 - RNA, 12 nt, Human
ccugcagagggc

SEQ ID NO: 2728168 - RNA, 16 nt, Human
ccugcaggcagccagg

SEQ ID NO: 2728169 - RNA, 17 nt, Human
ccugcaggcagccaggc

SEQ ID NO: 2728170 - RNA, 21 nt, Human
ccucugccugaagucacacag

SEQ ID NO: 2728171 - RNA, 16 nt, Human
ccucuuugagugaagc

SEQ ID NO: 2728172 - RNA, 19 nt, Human
ccucuuuggucuacacugu

SEQ ID NO: 2728173 - RNA, 22 nt, Human
ccugcugcaguugccagucacc

SEQ ID NO: 2728174 - RNA, 11 nt, Human
ccugcugcagu

SEQ ID NO: 2728175 - RNA, 12 nt, Human
ccugcugcaguu

SEQ ID NO: 2728176 - RNA, 16 nt, Human
ccugcugcaguugcca

SEQ ID NO: 2728177 - RNA, 15 nt, Human
ccugccucuucucua

SEQ ID NO: 2728178 - RNA, 23 nt, Human
ccugccuccuuugugaggaagcc

SEQ ID NO: 2728179 - RNA, 21 nt, Human
ccugccuccuuugugaggaag

SEQ ID NO: 2728180 - RNA, 22 nt, Human
ccugccuccuuugugaggaagc

SEQ ID NO: 2728181 - RNA, 13 nt, Human
ccugccuccuuug

SEQ ID NO: 2728182 - RNA, 15 nt, Human
ccugccuccuuugug

SEQ ID NO: 2728183 - RNA, 19 nt, Human
ccugccuccuuugugagga

SEQ ID NO: 2728184 - RNA, 20 nt, Human
ccugccuccuuugugaggaa

SEQ ID NO: 2728185 - RNA, 14 nt, Human
cccccuuccaugga

SEQ ID NO: 2728186 - RNA, 12 nt, Human
ccccgcccaggc

SEQ ID NO: 2728187 - RNA, 13 nt, Human
ccccggccaccug

SEQ ID NO: 2728188 - RNA, 14 nt, Human
ccccggccaccugc

SEQ ID NO: 2728189 - RNA, 18 nt, Human
ccccggccaccugcggug

SEQ ID NO: 2728190 - RNA, 14 nt, Human
ccccgcccaggcuu

SEQ ID NO: 2728191 - RNA, 10 nt, Human
ccccagcccc

SEQ ID NO: 2728192 - RNA, 12 nt, Human
ccccagccccaa

SEQ ID NO: 2728193 - RNA, 21 nt, Human
ccccauucugccugcccaggc

SEQ ID NO: 2728194 - RNA, 14 nt, Human
ccccagccccaucc

SEQ ID NO: 2728195 - RNA, 14 nt, Human
ccccagccccaaaa

SEQ ID NO: 2728196 - RNA, 20 nt, Human
ccccaaaacucuccucugcu

SEQ ID NO: 2728197 - RNA, 18 nt, Human
ccccaaaacucuccucug

SEQ ID NO: 2728198 - RNA, 23 nt, Human
cccauucugccugcccaggcccc

SEQ ID NO: 2728199 - RNA, 21 nt, Human
cccagccccaaaacucuccuc

SEQ ID NO: 2728200 - RNA, 23 nt, Human
cccagccccaaaacucuccucug

SEQ ID NO: 2728201 - RNA, 17 nt, Human
cccagcccacuucugcc

SEQ ID NO: 2728202 - RNA, 19 nt, Human
cccagcccacuucugccau

SEQ ID NO: 2728203 - RNA, 19 nt, Human
cccaggcuggcgugcagug

SEQ ID NO: 2728204 - RNA, 20 nt, Human
cccaggcuggcgugcagugg

SEQ ID NO: 2728205 - RNA, 18 nt, Human
cccaggcuggcgugcagu

SEQ ID NO: 2728206 - RNA, 14 nt, Human
cccauccucuguac

SEQ ID NO: 2728207 - RNA, 20 nt, Human
cccauccucuguacagagcc

SEQ ID NO: 2728208 - RNA, 15 nt, Human
cccauccucuguaca

SEQ ID NO: 2728209 - RNA, 19 nt, Human
cccauccucuguacagagc

SEQ ID NO: 2728210 - RNA, 18 nt, Human
ccaugggcacugugggua

SEQ ID NO: 2728211 - RNA, 19 nt, Human
ccaugggauaaaugccauc

SEQ ID NO: 2728212 - RNA, 17 nt, Human
ccaugggauaaaugcca

SEQ ID NO: 2728213 - RNA, 16 nt, Human
ccaugaggaacaaggc

SEQ ID NO: 2728214 - RNA, 17 nt, Human
ccaugaggaacaaggca

SEQ ID NO: 2728215 - RNA, 18 nt, Human
ccaugaggaacaaggcaa

SEQ ID NO: 2728216 - RNA, 17 nt, Human
ccaugggccuccugugu

SEQ ID NO: 2728217 - RNA, 13 nt, Human
ccauuuaaagcuu

SEQ ID NO: 2728218 - RNA, 15 nt, Human
cccacccaagggccu

SEQ ID NO: 2728219 - RNA, 18 nt, Human
cccaccaucaugucuggc

SEQ ID NO: 2728220 - RNA, 17 nt, Human
cccaagcucugcuccuc

SEQ ID NO: 2728221 - RNA, 15 nt, Human
cccaccgcagacagg

SEQ ID NO: 2728222 - RNA, 18 nt, Human
cccaccgcagacaggacc

SEQ ID NO: 2728223 - RNA, 19 nt, Human
ccacugcacuauagccuag

SEQ ID NO: 2728224 - RNA, 20 nt, Human
ccacugcacuauagccuagg

SEQ ID NO: 2728225 - RNA, 13 nt, Human
ccacugcaccggg

SEQ ID NO: 2728226 - RNA, 14 nt, Human
ccacugcaccgggc

SEQ ID NO: 2728227 - RNA, 17 nt, Human
ccacugcaccgggccac

SEQ ID NO: 2728228 - RNA, 19 nt, Human
ccacugcaccgggccacag

SEQ ID NO: 2728229 - RNA, 13 nt, Human
ccacuuucuagcc

SEQ ID NO: 2728230 - RNA, 18 nt, Human
ccacuuucuagccagagg

SEQ ID NO: 2728231 - RNA, 19 nt, Human
ccacuuucuagccagagga

SEQ ID NO: 2728232 - RNA, 20 nt, Human
ccacuuucuagccagaggag

SEQ ID NO: 2728233 - RNA, 17 nt, Human
ccagacccggcugcgug

SEQ ID NO: 2728234 - RNA, 16 nt, Human
ccagacccggcugcgu

SEQ ID NO: 2728235 - RNA, 22 nt, Human
ccacuuuuguucuugguuugua

SEQ ID NO: 2728236 - RNA, 21 nt, Human
ccacuuuuguucuugguuugu

SEQ ID NO: 2728237 - RNA, 15 nt, Human
ccacuuuuguucuug

SEQ ID NO: 2728238 - RNA, 14 nt, Human
ccacuuuuguucuu

SEQ ID NO: 2728239 - RNA, 16 nt, Human
ccagagacacaagccu

SEQ ID NO: 2728240 - RNA, 18 nt, Human
ccagagacacaagccuuc

SEQ ID NO: 2728241 - RNA, 13 nt, Human
ccagagagggugg

SEQ ID NO: 2728242 - RNA, 13 nt, Human
ccagaugcaccag

SEQ ID NO: 2728243 - RNA, 14 nt, Human
ccagaugcaccagc

SEQ ID NO: 2728244 - RNA, 15 nt, Human
ccaggggccaugaau

SEQ ID NO: 2728245 - RNA, 20 nt, Human
ccaggggugggacacccugu

SEQ ID NO: 2728246 - RNA, 21 nt, Human
ccaggggugggacacccugug

SEQ ID NO: 2728247 - RNA, 22 nt, Human
ccaggggugggacacccuguga

SEQ ID NO: 2728248 - RNA, 13 nt, Human
ccaguaucuugaa

SEQ ID NO: 2728249 - RNA, 19 nt, Human
ccaguaucuugaagacuuu

SEQ ID NO: 2728250 - RNA, 22 nt, Human
ccaguaucuugaagacuuuucu

SEQ ID NO: 2728251 - RNA, 16 nt, Human
ccagucaccccggcca

SEQ ID NO: 2728252 - RNA, 14 nt, Human
ccaguauuguacaa

SEQ ID NO: 2728253 - RNA, 17 nt, Human
ccagucaccccggccac

SEQ ID NO: 2728254 - RNA, 18 nt, Human
ccagucaccccggccacc

SEQ ID NO: 2728255 - RNA, 21 nt, Human
ccagcgagcccugguggcagu

SEQ ID NO: 2728256 - RNA, 18 nt, Human
ccagccccuucugaccca

SEQ ID NO: 2728257 - RNA, 18 nt, Human
ccagccccuggaugcagc

SEQ ID NO: 2728258 - RNA, 15 nt, Human
ccagccccuucugac

SEQ ID NO: 2728259 - RNA, 16 nt, Human
ccagccccuucugacc

SEQ ID NO: 2728260 - RNA, 17 nt, Human
ccagccccuucugaccc

SEQ ID NO: 2728261 - RNA, 13 nt, Human
ccagccccuggau

SEQ ID NO: 2728262 - RNA, 14 nt, Human
ccagccccuggaug

SEQ ID NO: 2728263 - RNA, 15 nt, Human
ccagccccuggaugc

SEQ ID NO: 2728264 - RNA, 13 nt, Human
ccagcagccugga

SEQ ID NO: 2728265 - RNA, 23 nt, Human
ccagccccauccucuguacagag

SEQ ID NO: 2728266 - RNA, 18 nt, Human
ccagccccauccucugua

SEQ ID NO: 2728267 - RNA, 11 nt, Human
ccagcagccug

SEQ ID NO: 2728268 - RNA, 12 nt, Human
ccagcagccugg

SEQ ID NO: 2728269 - RNA, 12 nt, Human
ccagcagaaaug

SEQ ID NO: 2728270 - RNA, 22 nt, Human
ccagcagaaaugccuuacccuc

SEQ ID NO: 2728271 - RNA, 17 nt, Human
ccagcagaaaugccuua

SEQ ID NO: 2728272 - RNA, 16 nt, Human
ccagcagaaaugccuu

SEQ ID NO: 2728273 - RNA, 17 nt, Human
ccaggaaaggcuccagg

SEQ ID NO: 2728274 - RNA, 18 nt, Human
ccaggaaaggcuccagga

SEQ ID NO: 2728275 - RNA, 19 nt, Human
ccaggaaaggcuccaggag

SEQ ID NO: 2728276 - RNA, 20 nt, Human
ccaggaaaggcuccaggagc

SEQ ID NO: 2728277 - RNA, 18 nt, Human
aaauuucagcagcugcag

SEQ ID NO: 2728278 - RNA, 17 nt, Human
aaauuucagcagcugca

SEQ ID NO: 2728279 - RNA, 20 nt, Human
aaauuuaguauuuuguuuca

SEQ ID NO: 2728280 - RNA, 15 nt, Human
guauuuuuuuacuaa

SEQ ID NO: 2728281 - RNA, 14 nt, Human
guauuuuuuuacua

SEQ ID NO: 2728282 - RNA, 22 nt, Human
aaauuuccugggagcuuuugua

SEQ ID NO: 2728283 - RNA, 20 nt, Human
guauuuuugacagaauaugu

SEQ ID NO: 2728284 - RNA, 19 nt, Human
gucaaaguggugagaggca

SEQ ID NO: 2728285 - RNA, 18 nt, Human
gucaaaguggugagaggc

SEQ ID NO: 2728286 - RNA, 21 nt, Human
guauuuuuuuacuaauagaca

SEQ ID NO: 2728287 - RNA, 17 nt, Human
guauuuuuuuacuaaua

SEQ ID NO: 2728288 - RNA, 19 nt, Human
gucaacucauauuuucaug

SEQ ID NO: 2728289 - RNA, 16 nt, Human
gucacacacuuuggcu

SEQ ID NO: 2728290 - RNA, 20 nt, Human
gucacacaguauuacuucug

SEQ ID NO: 2728291 - RNA, 20 nt, Human
guauuuaauagguuuggaca

SEQ ID NO: 2728292 - RNA, 22 nt, Human
guauuggcuagagguucaaaga

SEQ ID NO: 2728293 - RNA, 19 nt, Human
aaauuaacuuuuauaaacu

SEQ ID NO: 2728294 - RNA, 21 nt, Human
aaauuaacuuuuauaaacuuu

SEQ ID NO: 2728295 - RNA, 23 nt, Human
aaauuaacuuuuauaaacuuuac

SEQ ID NO: 2728296 - RNA, 22 nt, Human
aaauuaacuuuuauaaacuuua

SEQ ID NO: 2728297 - RNA, 16 nt, Human
aaauuccccacccuga

SEQ ID NO: 2728298 - RNA, 14 nt, Human
aaauucaugcugcu

SEQ ID NO: 2728299 - RNA, 22 nt, Human
aaauuauuuuguucauacauau

SEQ ID NO: 2728300 - RNA, 20 nt, Human
aaauuauuuuguucauacau

SEQ ID NO: 2728301 - RNA, 21 nt, Human
aaauuauuuuguucauacaua

SEQ ID NO: 2728302 - RNA, 22 nt, Human
aaauuauauaaguauucuaaau

SEQ ID NO: 2728303 - RNA, 17 nt, Human
aaauuauuuuguucaua

SEQ ID NO: 2728304 - RNA, 19 nt, Human
aaauuauuuuguucauaca

SEQ ID NO: 2728305 - RNA, 16 nt, Human
aaauuauauaaguauu

SEQ ID NO: 2728306 - RNA, 18 nt, Human
aaauuauauaaguauucu

SEQ ID NO: 2728307 - RNA, 22 nt, Human
aaauguaagggaaacugccagc

SEQ ID NO: 2728308 - RNA, 18 nt, Human
aaaugggggugcauuuga

SEQ ID NO: 2728309 - RNA, 17 nt, Human
aaaugggggugcauuug

SEQ ID NO: 2728310 - RNA, 16 nt, Human
aaaugggggugcauuu

SEQ ID NO: 2728311 - RNA, 15 nt, Human
aaaugggggugcauu

SEQ ID NO: 2728312 - RNA, 14 nt, Human
guaugauucccagc

SEQ ID NO: 2728313 - RNA, 14 nt, Human
guaugggagagaag

SEQ ID NO: 2728314 - RNA, 15 nt, Human
guaucccuacuguaa

SEQ ID NO: 2728315 - RNA, 22 nt, Human
guaugaucacggcucacugcag

SEQ ID NO: 2728316 - RNA, 21 nt, Human
guaucccaugagccucagcau

SEQ ID NO: 2728317 - RNA, 13 nt, Human
guaugugugaagu

SEQ ID NO: 2728318 - RNA, 21 nt, Human
guauucucuccuguaccucuu

SEQ ID NO: 2728319 - RNA, 17 nt, Human
guaugugugaagugagu

SEQ ID NO: 2728320 - RNA, 15 nt, Human
guauucuuauuuaau

SEQ ID NO: 2728321 - RNA, 13 nt, Human
guaugguggcugg

SEQ ID NO: 2728322 - RNA, 15 nt, Human
guaugggagagaaga

SEQ ID NO: 2728323 - RNA, 17 nt, Human
aaaugaaaaucgugaca

SEQ ID NO: 2728324 - RNA, 19 nt, Human
aaaucucaaauuucuaaau

SEQ ID NO: 2728325 - RNA, 17 nt, Human
aaaucucaaauuucuaa

SEQ ID NO: 2728326 - RNA, 16 nt, Human
aaaucucaaauuucua

SEQ ID NO: 2728327 - RNA, 15 nt, Human
aaaucucaaauuucu

SEQ ID NO: 2728328 - RNA, 14 nt, Human
aaauccuugaagau

SEQ ID NO: 2728329 - RNA, 13 nt, Human
aaaucgaugcagu

SEQ ID NO: 2728330 - RNA, 15 nt, Human
aaaucccauuuaaaa

SEQ ID NO: 2728331 - RNA, 18 nt, Human
aaaucccuuaccucggug

SEQ ID NO: 2728332 - RNA, 22 nt, Human
aaaucccauuauucaaaguugc

SEQ ID NO: 2728333 - RNA, 21 nt, Human
aaaucccauuauucaaaguug

SEQ ID NO: 2728334 - RNA, 20 nt, Human
aaaucccauuauucaaaguu

SEQ ID NO: 2728335 - RNA, 19 nt, Human
aaaucccauuauucaaagu

SEQ ID NO: 2728336 - RNA, 17 nt, Human
aaaucccauuauucaaa

SEQ ID NO: 2728337 - RNA, 16 nt, Human
aaaucccauuauucaa

SEQ ID NO: 2728338 - RNA, 15 nt, Human
aaaucccauuauuca

SEQ ID NO: 2728339 - RNA, 13 nt, Human
aaaucccauuauu

SEQ ID NO: 2728340 - RNA, 23 nt, Human
aaauccauuuggaaaucuuuaaa

SEQ ID NO: 2728341 - RNA, 22 nt, Human
aaauccauuuggaaaucuuuaa

SEQ ID NO: 2728342 - RNA, 21 nt, Human
aaauccauuuggaaaucuuua

SEQ ID NO: 2728343 - RNA, 18 nt, Human
aaauccauuuggaaaucu

SEQ ID NO: 2728344 - RNA, 12 nt, Human
guagcugggacu

SEQ ID NO: 2728345 - RNA, 18 nt, Human
guagcugggacuacaggc

SEQ ID NO: 2728346 - RNA, 19 nt, Human
guagcugggacuacaggca

SEQ ID NO: 2728347 - RNA, 21 nt, Human
guagcugggacuacaggcacc

SEQ ID NO: 2728348 - RNA, 14 nt, Human
aaauccauuuggaa

SEQ ID NO: 2728349 - RNA, 16 nt, Human
aaauccauuuggaaau

SEQ ID NO: 2728350 - RNA, 15 nt, Human
aaauccauuuggaaa

SEQ ID NO: 2728351 - RNA, 15 nt, Human
guaggaagacuuugg

SEQ ID NO: 2728352 - RNA, 18 nt, Human
guaggaagguuaauguuc

SEQ ID NO: 2728353 - RNA, 13 nt, Human
aaaugagccuggc

SEQ ID NO: 2728354 - RNA, 19 nt, Human
aaaugagccuggcaagaau

SEQ ID NO: 2728355 - RNA, 23 nt, Human
aaaugagguacucuccuggaaau

SEQ ID NO: 2728356 - RNA, 16 nt, Human
aaaugagguacucucc

SEQ ID NO: 2728357 - RNA, 17 nt, Human
aaaugaggucagagccu

SEQ ID NO: 2728358 - RNA, 19 nt, Human
aaaugaggucagagccugc

SEQ ID NO: 2728359 - RNA, 14 nt, Human
aaaugcauuucuaa

SEQ ID NO: 2728360 - RNA, 13 nt, Human
aaaugcccagccc

SEQ ID NO: 2728361 - RNA, 13 nt, Human
aaaugcccagcuu

SEQ ID NO: 2728362 - RNA, 18 nt, Human
aaaugcccagccccuucu

SEQ ID NO: 2728363 - RNA, 14 nt, Human
aaaugcccagcccc

SEQ ID NO: 2728364 - RNA, 15 nt, Human
aaaugcccagccccu

SEQ ID NO: 2728365 - RNA, 19 nt, Human
aaauggcuuccuggcaaua

SEQ ID NO: 2728366 - RNA, 15 nt, Human
aaaugggcagagcag

SEQ ID NO: 2728367 - RNA, 18 nt, Human
aaaugggcagagcagaga

SEQ ID NO: 2728368 - RNA, 20 nt, Human
aaaugggcagagcagagacc

SEQ ID NO: 2728369 - RNA, 22 nt, Human
aaaugcaccuggaauauauaac

SEQ ID NO: 2728370 - RNA, 18 nt, Human
aaaugcaccuggaauaua

SEQ ID NO: 2728371 - RNA, 14 nt, Human
aaaugcaccuggaa

SEQ ID NO: 2728372 - RNA, 18 nt, Human
aacauuugguaaggggaa

SEQ ID NO: 2728373 - RNA, 14 nt, Human
aacauacucccauc

SEQ ID NO: 2728374 - RNA, 15 nt, Human
aacauacucccaucu

SEQ ID NO: 2728375 - RNA, 23 nt, Human
aacaggcugggcuucaguggcag

SEQ ID NO: 2728376 - RNA, 19 nt, Human
aacagguuuuccugaagaa

SEQ ID NO: 2728377 - RNA, 19 nt, Human
aacagacuggaagcacagc

SEQ ID NO: 2728378 - RNA, 22 nt, Human
aacaggcugggcuucaguggca

SEQ ID NO: 2728379 - RNA, 13 nt, Human
aacaggcugggcu

SEQ ID NO: 2728380 - RNA, 19 nt, Human
aacaguuguguuugaagca

SEQ ID NO: 2728381 - RNA, 13 nt, Human
guccgagcuuuga

SEQ ID NO: 2728382 - RNA, 21 nt, Human
guccggucccugucccagugc

SEQ ID NO: 2728383 - RNA, 21 nt, Human
aacagaaauguacagcaagga

SEQ ID NO: 2728384 - RNA, 15 nt, Human
aacagaaauguacag

SEQ ID NO: 2728385 - RNA, 10 nt, Human
aacagaaaug

SEQ ID NO: 2728386 - RNA, 21 nt, Human
aacaagccuccuuuuaaagua

SEQ ID NO: 2728387 - RNA, 15 nt, Human
aacaaggaugaauua

SEQ ID NO: 2728388 - RNA, 19 nt, Human
aacaagaccacguuucuaa

SEQ ID NO: 2728389 - RNA, 17 nt, Human
aacaagaccacguuucu

SEQ ID NO: 2728390 - RNA, 16 nt, Human
aacaagaccacguuuc

SEQ ID NO: 2728391 - RNA, 16 nt, Human
gucacaggcaggucca

SEQ ID NO: 2728392 - RNA, 13 nt, Human
gucacaggcaggu

SEQ ID NO: 2728393 - RNA, 15 nt, Human
gucacaggcaggucc

SEQ ID NO: 2728394 - RNA, 18 nt, Human
aacaagucagucauucag

SEQ ID NO: 2728395 - RNA, 15 nt, Human
aacaagucagucauu

SEQ ID NO: 2728396 - RNA, 23 nt, Human
aacaaggcaaggcugucaauuac

SEQ ID NO: 2728397 - RNA, 18 nt, Human
aacaaugaagauaaaaag

SEQ ID NO: 2728398 - RNA, 14 nt, Human
aacaaugaagauaa

SEQ ID NO: 2728399 - RNA, 21 nt, Human
guccaagcauuuagauguaua

SEQ ID NO: 2728400 - RNA, 24 nt, Human
guccaagcauaccaacacgagcag

SEQ ID NO: 2728401 - RNA, 22 nt, Human
gucauuugagcagggcucagcg

SEQ ID NO: 2728402 - RNA, 21 nt, Human
aacacuguucucugcccucca

SEQ ID NO: 2728403 - RNA, 21 nt, Human
gucauuugagcagggcucagc

SEQ ID NO: 2728404 - RNA, 17 nt, Human
aacacucauugaccuga

SEQ ID NO: 2728405 - RNA, 21 nt, Human
aacacucauugaccugaggcc

SEQ ID NO: 2728406 - RNA, 12 nt, Human
aacacuccuuca

SEQ ID NO: 2728407 - RNA, 11 nt, Human
aacacucugag

SEQ ID NO: 2728408 - RNA, 14 nt, Human
aacacucugagacu

SEQ ID NO: 2728409 - RNA, 12 nt, Human
aacacucugaga

SEQ ID NO: 2728410 - RNA, 13 nt, Human
aacacucugagac

SEQ ID NO: 2728411 - RNA, 15 nt, Human
aacacuguucucugc

SEQ ID NO: 2728412 - RNA, 20 nt, Human
aacacuguucucugcccucc

SEQ ID NO: 2728413 - RNA, 14 nt, Human
aacuccagaaagug

SEQ ID NO: 2728414 - RNA, 21 nt, Human
aacuccagaaagugacaagcu

SEQ ID NO: 2728415 - RNA, 18 nt, Human
aacucguuaauuuguagu

SEQ ID NO: 2728416 - RNA, 15 nt, Human
gugaacacaucagcu

SEQ ID NO: 2728417 - RNA, 19 nt, Human
gugaaccaccacacccagc

SEQ ID NO: 2728418 - RNA, 22 nt, Human
aacguggcugcuucaaggaucc

SEQ ID NO: 2728419 - RNA, 16 nt, Human
aacguggcugcuucaa

SEQ ID NO: 2728420 - RNA, 19 nt, Human
aacguggcugcuucaagga

SEQ ID NO: 2728421 - RNA, 15 nt, Human
aacguggcugcuuca

SEQ ID NO: 2728422 - RNA, 21 nt, Human
gucuuaauuaaaagaauauuu

SEQ ID NO: 2728423 - RNA, 19 nt, Human
gucuuaauuaaaagaauau

SEQ ID NO: 2728424 - RNA, 22 nt, Human
gucuuaauuaaaagaauauuuu

SEQ ID NO: 2728425 - RNA, 15 nt, Human
gucuuagauguauau

SEQ ID NO: 2728426 - RNA, 24 nt, Human
gucuuuucuugcaugaggcuagug

SEQ ID NO: 2728427 - RNA, 14 nt, Human
gucuuuucuugcau

SEQ ID NO: 2728428 - RNA, 19 nt, Human
gucuuuucuugcaugaggc

SEQ ID NO: 2728429 - RNA, 17 nt, Human
gucuuuggacccugagg

SEQ ID NO: 2728430 - RNA, 14 nt, Human
gucuuuggacccug

SEQ ID NO: 2728431 - RNA, 15 nt, Human
gucuuuggacccuga

SEQ ID NO: 2728432 - RNA, 12 nt, Human
aaccacagcagu

SEQ ID NO: 2728433 - RNA, 18 nt, Human
aaccacaucuugcucugc

SEQ ID NO: 2728434 - RNA, 23 nt, Human
aaccaucauugaaaucuuuuugc

SEQ ID NO: 2728435 - RNA, 21 nt, Human
aaccaucauugaaaucuuuuu

SEQ ID NO: 2728436 - RNA, 20 nt, Human
aaccaugggauaaaugccau

SEQ ID NO: 2728437 - RNA, 18 nt, Human
aaccaugggauaaaugcc

SEQ ID NO: 2728438 - RNA, 17 nt, Human
aaccaugggauaaaugc

SEQ ID NO: 2728439 - RNA, 15 nt, Human
aaccaugggauaaau

SEQ ID NO: 2728440 - RNA, 20 nt, Human
aaccacaucuugcucugcug

SEQ ID NO: 2728441 - RNA, 22 nt, Human
aaccacaucuugcucugcugac

SEQ ID NO: 2728442 - RNA, 19 nt, Human
aaccaucauugaaaucuuu

SEQ ID NO: 2728443 - RNA, 20 nt, Human
aaccaucauugaaaucuuuu

SEQ ID NO: 2728444 - RNA, 16 nt, Human
aacauuuugucauaua

SEQ ID NO: 2728445 - RNA, 20 nt, Human
aaccuagggugauauuaacc

SEQ ID NO: 2728446 - RNA, 17 nt, Human
aaccucaaaaugucuaa

SEQ ID NO: 2728447 - RNA, 13 nt, Human
aacccccagccug

SEQ ID NO: 2728448 - RNA, 14 nt, Human
aacccccagccugc

SEQ ID NO: 2728449 - RNA, 15 nt, Human
aacccccagccugcu

SEQ ID NO: 2728450 - RNA, 17 nt, Human
aaccuccgccucuuggg

SEQ ID NO: 2728451 - RNA, 14 nt, Human
aaccuccugggcua

SEQ ID NO: 2728452 - RNA, 24 nt, Human
aaccucuaaauucuuucauuuuag

SEQ ID NO: 2728453 - RNA, 11 nt, Human
aacccagcucu

SEQ ID NO: 2728454 - RNA, 13 nt, Human
aacccagcucugg

SEQ ID NO: 2728455 - RNA, 14 nt, Human
aacccagcucuggu

SEQ ID NO: 2728456 - RNA, 23 nt, Human
aaccauuuugcugucccuuuucc

SEQ ID NO: 2728457 - RNA, 21 nt, Human
aaccaugggauaaaugccauc

SEQ ID NO: 2728458 - RNA, 17 nt, Human
aacccagcucuggucca

SEQ ID NO: 2728459 - RNA, 13 nt, Human
guuggguggaugc

SEQ ID NO: 2728460 - RNA, 18 nt, Human
guuggucccccuuccaug

SEQ ID NO: 2728461 - RNA, 16 nt, Human
guuuaaaaucauuucu

SEQ ID NO: 2728462 - RNA, 10 nt, Human
guuuaaaauc

SEQ ID NO: 2728463 - RNA, 19 nt, Human
aaggaugcuuguacauaau

SEQ ID NO: 2728464 - RNA, 17 nt, Human
aaggaugcuuguacaua

SEQ ID NO: 2728465 - RNA, 18 nt, Human
aaggaugcacagaguugu

SEQ ID NO: 2728466 - RNA, 16 nt, Human
aaggaugcuuguacau

SEQ ID NO: 2728467 - RNA, 15 nt, Human
aaggaugcuuguaca

SEQ ID NO: 2728468 - RNA, 23 nt, Human
guugaugaucuuugcagacaggc

SEQ ID NO: 2728469 - RNA, 14 nt, Human
aaggauccugagcc

SEQ ID NO: 2728470 - RNA, 13 nt, Human
aaggauccugagc

SEQ ID NO: 2728471 - RNA, 15 nt, Human
aaggauccugagcca

SEQ ID NO: 2728472 - RNA, 17 nt, Human
aaggauccugagccaga

SEQ ID NO: 2728473 - RNA, 18 nt, Human
aaggaugaucuaggaaga

SEQ ID NO: 2728474 - RNA, 23 nt, Human
aaggaugaucuaggaagacuuug

SEQ ID NO: 2728475 - RNA, 19 nt, Human
aaggcuaccuuuguauucu

SEQ ID NO: 2728476 - RNA, 18 nt, Human
aaggccaaaggaagcaca

SEQ ID NO: 2728477 - RNA, 17 nt, Human
guugcccaggcaggucu

SEQ ID NO: 2728478 - RNA, 14 nt, Human
aaggcuccaggagc

SEQ ID NO: 2728479 - RNA, 18 nt, Human
guugcccaggcaggucuu

SEQ ID NO: 2728480 - RNA, 19 nt, Human
guugcccaggcaggucuug

SEQ ID NO: 2728481 - RNA, 21 nt, Human
guugcccaggcuggcgugcag

SEQ ID NO: 2728482 - RNA, 15 nt, Human
guugcccaggcaggu

SEQ ID NO: 2728483 - RNA, 17 nt, Human
guugcccaggcuggcgu

SEQ ID NO: 2728484 - RNA, 14 nt, Human
guugccuaaaucca

SEQ ID NO: 2728485 - RNA, 16 nt, Human
guugccuaaauccauu

SEQ ID NO: 2728486 - RNA, 15 nt, Human
guugccuaaauccau

SEQ ID NO: 2728487 - RNA, 21 nt, Human
guuucaaacauauauaacaau

SEQ ID NO: 2728488 - RNA, 13 nt, Human
aagggccuggccu

SEQ ID NO: 2728489 - RNA, 22 nt, Human
aaggggaauguuugccucugcc

SEQ ID NO: 2728490 - RNA, 23 nt, Human
aaggggaauguuugccucugccu

SEQ ID NO: 2728491 - RNA, 19 nt, Human
aagggccuggccugagcug

SEQ ID NO: 2728492 - RNA, 14 nt, Human
aagggccuggccug

SEQ ID NO: 2728493 - RNA, 17 nt, Human
aagggccuggccugagc

SEQ ID NO: 2728494 - RNA, 16 nt, Human
aaggguaucaggugcu

SEQ ID NO: 2728495 - RNA, 12 nt, Human
aaguaauaugca

SEQ ID NO: 2728496 - RNA, 19 nt, Human
guuucuaaaggcuaccuuu

SEQ ID NO: 2728497 - RNA, 16 nt, Human
aaguaauaugcacaca

SEQ ID NO: 2728498 - RNA, 15 nt, Human
aaguaauaugcacac

SEQ ID NO: 2728499 - RNA, 23 nt, Human
guuuucugagaaagacuauucaa

SEQ ID NO: 2728500 - RNA, 11 nt, Human
guuuucuguuc

SEQ ID NO: 2728501 - RNA, 19 nt, Human
guuuucuguucuuucuggc

SEQ ID NO: 2728502 - RNA, 18 nt, Human
guuuggggaugagaaagg

SEQ ID NO: 2728503 - RNA, 22 nt, Human
guuugauucagacagcugccug

SEQ ID NO: 2728504 - RNA, 20 nt, Human
guuucuguacuuuuuggcau

SEQ ID NO: 2728505 - RNA, 23 nt, Human
guuucuaaaggcuaccuuuguau

SEQ ID NO: 2728506 - RNA, 22 nt, Human
guuucuaaaggcuaccuuugua

SEQ ID NO: 2728507 - RNA, 13 nt, Human
guuugccucugcc

SEQ ID NO: 2728508 - RNA, 16 nt, Human
guuugccucugccucu

SEQ ID NO: 2728509 - RNA, 23 nt, Human
aagcuuguauuccuuuuucucuc

SEQ ID NO: 2728510 - RNA, 22 nt, Human
aagcuauucaguaauaacucua

SEQ ID NO: 2728511 - RNA, 21 nt, Human
aagcucuacugaggugcuaug

SEQ ID NO: 2728512 - RNA, 16 nt, Human
guucccauuugcuccu

SEQ ID NO: 2728513 - RNA, 20 nt, Human
guucccauuugcuccuuucu

SEQ ID NO: 2728514 - RNA, 20 nt, Human
guuccauggccucuucagau

SEQ ID NO: 2728515 - RNA, 14 nt, Human
guugacaugggaca

SEQ ID NO: 2728516 - RNA, 18 nt, Human
guugacaugggacauuug

SEQ ID NO: 2728517 - RNA, 22 nt, Human
guugaugaucuuugcagacagg

SEQ ID NO: 2728518 - RNA, 13 nt, Human
guugacaugggac

SEQ ID NO: 2728519 - RNA, 21 nt, Human
guucuugguuuguaaauuaac

SEQ ID NO: 2728520 - RNA, 17 nt, Human
guucuuaguuugcaguu

SEQ ID NO: 2728521 - RNA, 18 nt, Human
guucuagcauggcauauu

SEQ ID NO: 2728522 - RNA, 20 nt, Human
guucccuuugacgccauccc

SEQ ID NO: 2728523 - RNA, 21 nt, Human
guucccuuugacgccauccca

SEQ ID NO: 2728524 - RNA, 22 nt, Human
guucccuuugacgccaucccag

SEQ ID NO: 2728525 - RNA, 16 nt, Human
guucuacccaggugcu

SEQ ID NO: 2728526 - RNA, 23 nt, Human
guucugggacacaguucaauucu

SEQ ID NO: 2728527 - RNA, 11 nt, Human
guucauacauu

SEQ ID NO: 2728528 - RNA, 14 nt, Human
guucauacauugua

SEQ ID NO: 2728529 - RNA, 19 nt, Human
aagccuccuccagccgcca

SEQ ID NO: 2728530 - RNA, 17 nt, Human
aagcuaggccuggccag

SEQ ID NO: 2728531 - RNA, 18 nt, Human
aagcuaggccuggccaga

SEQ ID NO: 2728532 - RNA, 16 nt, Human
aagcuaggccuggcca

SEQ ID NO: 2728533 - RNA, 22 nt, Human
aagcuaggccuggccagaugca

SEQ ID NO: 2728534 - RNA, 9 nt, Human
guucauaca

SEQ ID NO: 2728535 - RNA, 10 nt, Human
guucauacau

SEQ ID NO: 2728536 - RNA, 13 nt, Human
guucauacauauu

SEQ ID NO: 2728537 - RNA, 14 nt, Human
guucauacauauuu

SEQ ID NO: 2728538 - RNA, 23 nt, Human
guucauacauauuuuuguagcac

SEQ ID NO: 2728539 - RNA, 17 nt, Human
guucaggguuggccccu

SEQ ID NO: 2728540 - RNA, 18 nt, Human
guucaggguuggccccug

SEQ ID NO: 2728541 - RNA, 19 nt, Human
guucaggguuggccccugc

SEQ ID NO: 2728542 - RNA, 15 nt, Human
guucagcuccagcuc

SEQ ID NO: 2728543 - RNA, 18 nt, Human
guucagcuccagcucacc

SEQ ID NO: 2728544 - RNA, 16 nt, Human
guucagcuccagcuca

SEQ ID NO: 2728545 - RNA, 17 nt, Human
guucagcuccagcucac

SEQ ID NO: 2728546 - RNA, 14 nt, Human
guuaaguaugugua

SEQ ID NO: 2728547 - RNA, 18 nt, Human
guuaaugauagcuacugu

SEQ ID NO: 2728548 - RNA, 12 nt, Human
guuagaucuagu

SEQ ID NO: 2728549 - RNA, 20 nt, Human
guuaguaugaggcauuuguu

SEQ ID NO: 2728550 - RNA, 17 nt, Human
guuaguaugaggcauuu

SEQ ID NO: 2728551 - RNA, 17 nt, Human
gugugacuacuccccca

SEQ ID NO: 2728552 - RNA, 18 nt, Human
gugucuuuuuucacuaca

SEQ ID NO: 2728553 - RNA, 17 nt, Human
gugucuugcaauggcag

SEQ ID NO: 2728554 - RNA, 18 nt, Human
gugucuugcaauggcagc

SEQ ID NO: 2728555 - RNA, 23 nt, Human
guguuuccuggcacugcuuccag

SEQ ID NO: 2728556 - RNA, 18 nt, Human
guguuuccauauuuuaua

SEQ ID NO: 2728557 - RNA, 19 nt, Human
guguuguacucaauuuuaa

SEQ ID NO: 2728558 - RNA, 18 nt, Human
aagagguuuuaaaaaaau

SEQ ID NO: 2728559 - RNA, 18 nt, Human
aagagguuuuaaagcuuc

SEQ ID NO: 2728560 - RNA, 14 nt, Human
aagagguuuuaaag

SEQ ID NO: 2728561 - RNA, 20 nt, Human
guggugguuuucuguucuuu

SEQ ID NO: 2728562 - RNA, 17 nt, Human
gugguuuucuguucuuu

SEQ ID NO: 2728563 - RNA, 12 nt, Human
aagaugcagccg

SEQ ID NO: 2728564 - RNA, 14 nt, Human
aagaugugacaugu

SEQ ID NO: 2728565 - RNA, 18 nt, Human
aagaugugacauguuuua

SEQ ID NO: 2728566 - RNA, 12 nt, Human
aagcaaaggaga

SEQ ID NO: 2728567 - RNA, 13 nt, Human
aagcaaaggagau

SEQ ID NO: 2728568 - RNA, 19 nt, Human
aagagcuguucacagccag

SEQ ID NO: 2728569 - RNA, 22 nt, Human
aagacccuuguggucccacccc

SEQ ID NO: 2728570 - RNA, 18 nt, Human
aagacccuugugguccca

SEQ ID NO: 2728571 - RNA, 21 nt, Human
aagacccuuguggucccaccc

SEQ ID NO: 2728572 - RNA, 17 nt, Human
aagacuaucuaaauguu

SEQ ID NO: 2728573 - RNA, 16 nt, Human
aagacuaucuaaaugu

SEQ ID NO: 2728574 - RNA, 17 nt, Human
aagacuguacaaaguag

SEQ ID NO: 2728575 - RNA, 21 nt, Human
aagacugaguacguugugcau

SEQ ID NO: 2728576 - RNA, 18 nt, Human
aagacuaucuaaauguug

SEQ ID NO: 2728577 - RNA, 17 nt, Human
aagacugaguacguugu

SEQ ID NO: 2728578 - RNA, 21 nt, Human
gugggacagucaccucaugga

SEQ ID NO: 2728579 - RNA, 22 nt, Human
gugggacacccugugauggggc

SEQ ID NO: 2728580 - RNA, 23 nt, Human
guggcgcagcauauucaggaagc

SEQ ID NO: 2728581 - RNA, 22 nt, Human
guggcgcagcauauucaggaag

SEQ ID NO: 2728582 - RNA, 23 nt, Human
gugggaggaucucuugagccugg

SEQ ID NO: 2728583 - RNA, 13 nt, Human
gugggagugggcc

SEQ ID NO: 2728584 - RNA, 14 nt, Human
gugggagugggccc

SEQ ID NO: 2728585 - RNA, 13 nt, Human
gugggauccucca

SEQ ID NO: 2728586 - RNA, 14 nt, Human
guggguacgggagg

SEQ ID NO: 2728587 - RNA, 20 nt, Human
gugggggaucacagccucug

SEQ ID NO: 2728588 - RNA, 14 nt, Human
guggugguuuucug

SEQ ID NO: 2728589 - RNA, 16 nt, Human
gugguuucagaaaugu

SEQ ID NO: 2728590 - RNA, 18 nt, Human
gugcuaguaauuggaaag

SEQ ID NO: 2728591 - RNA, 21 nt, Human
gugcuaucucccccagcccca

SEQ ID NO: 2728592 - RNA, 17 nt, Human
gugcuaggaacacuccu

SEQ ID NO: 2728593 - RNA, 22 nt, Human
gugcuaggaacacuccuucaca

SEQ ID NO: 2728594 - RNA, 18 nt, Human
gugcuaggaacacuccuu

SEQ ID NO: 2728595 - RNA, 22 nt, Human
aagaaagacuaucuaaauguug

SEQ ID NO: 2728596 - RNA, 20 nt, Human
aagaaagacuaucuaaaugu

SEQ ID NO: 2728597 - RNA, 17 nt, Human
aagaaaaaggaugcaca

SEQ ID NO: 2728598 - RNA, 15 nt, Human
aagaaaaaggaugca

SEQ ID NO: 2728599 - RNA, 18 nt, Human
aagaaaaaggaugcacag

SEQ ID NO: 2728600 - RNA, 13 nt, Human
gugccucugggac

SEQ ID NO: 2728601 - RNA, 12 nt, Human
gugccucuggga

SEQ ID NO: 2728602 - RNA, 14 nt, Human
gugccuuauggaac

SEQ ID NO: 2728603 - RNA, 21 nt, Human
gugccuuauggaacacucuga

SEQ ID NO: 2728604 - RNA, 23 nt, Human
gugccuuauggaacacucugaga

SEQ ID NO: 2728605 - RNA, 22 nt, Human
gugccgagaaggaagccuccca

SEQ ID NO: 2728606 - RNA, 21 nt, Human
gugaaccaccacacccagccc

SEQ ID NO: 2728607 - RNA, 15 nt, Human
gugccucaagagaag

SEQ ID NO: 2728608 - RNA, 11 nt, Human
gugccuuaugg

SEQ ID NO: 2728609 - RNA, 17 nt, Human
aacuuggcgcugccccu

SEQ ID NO: 2728610 - RNA, 22 nt, Human
aacuugucuuuggacccugagg

SEQ ID NO: 2728611 - RNA, 18 nt, Human
aacuugucuuuggacccu

SEQ ID NO: 2728612 - RNA, 13 nt, Human
aacuuuaccuuuu

SEQ ID NO: 2728613 - RNA, 16 nt, Human
aagaaugauuaugaau

SEQ ID NO: 2728614 - RNA, 20 nt, Human
guggcagcucaccucucccu

SEQ ID NO: 2728615 - RNA, 14 nt, Human
guggcagcucaccu

SEQ ID NO: 2728616 - RNA, 16 nt, Human
guggcagcucaccucu

SEQ ID NO: 2728617 - RNA, 18 nt, Human
guggcaccagcagccugg

SEQ ID NO: 2728618 - RNA, 19 nt, Human
guggcaccagcagccugga

SEQ ID NO: 2728619 - RNA, 19 nt, Human
guggauuuaacagaaaugu

SEQ ID NO: 2728620 - RNA, 18 nt, Human
guggauuuaacagaaaug

SEQ ID NO: 2728621 - RNA, 18 nt, Human
aagaaugauuaugaauua

SEQ ID NO: 2728622 - RNA, 16 nt, Human
aagaauugaagcagga

SEQ ID NO: 2728623 - RNA, 22 nt, Human
aagaaugguccgugcuaaggac

SEQ ID NO: 2728624 - RNA, 19 nt, Human
aagaaugguccgugcuaag

SEQ ID NO: 2728625 - RNA, 16 nt, Human
aagacaaaaagcuacu

SEQ ID NO: 2728626 - RNA, 23 nt, Human
aagacaaaaagcuacuuauugua

SEQ ID NO: 2728627 - RNA, 20 nt, Human
aagacaaaaagcuacuuauu

SEQ ID NO: 2728628 - RNA, 12 nt, Human
gugcuauguucu

SEQ ID NO: 2728629 - RNA, 19 nt, Human
gugcuaucucccccagccc

SEQ ID NO: 2728630 - RNA, 22 nt, Human
gugcuaucucccccagccccau

SEQ ID NO: 2728631 - RNA, 21 nt, Human
gugcugggauuacaagcguga

SEQ ID NO: 2728632 - RNA, 22 nt, Human
gugcugggauuacaagcgugag

SEQ ID NO: 2728633 - RNA, 20 nt, Human
gugcugggauuacaggugug

SEQ ID NO: 2728634 - RNA, 23 nt, Human
guggacacagcucuucuccaggc

SEQ ID NO: 2728635 - RNA, 18 nt, Human
guggacacagcucuucuc

SEQ ID NO: 2728636 - RNA, 22 nt, Human
guggacacagcucuucuccagg

SEQ ID NO: 2728637 - RNA, 21 nt, Human
guggaugccugguggcagcug

SEQ ID NO: 2728638 - RNA, 21 nt, Human
aaugagagacacacugaagaa

SEQ ID NO: 2728639 - RNA, 15 nt, Human
aaugagccuggcaag

SEQ ID NO: 2728640 - RNA, 18 nt, Human
aaugacuuacuguacaug

SEQ ID NO: 2728641 - RNA, 17 nt, Human
aaugacuuacuguacau

SEQ ID NO: 2728642 - RNA, 14 nt, Human
aaugacuuacugua

SEQ ID NO: 2728643 - RNA, 16 nt, Human
uaaugauaacuggaaa

SEQ ID NO: 2728644 - RNA, 13 nt, Human
uaaugaggaaacu

SEQ ID NO: 2728645 - RNA, 14 nt, Human
uaaugguguuuuaa

SEQ ID NO: 2728646 - RNA, 20 nt, Human
aaucuuuaaaaaaaaaauug

SEQ ID NO: 2728647 - RNA, 19 nt, Human
aaucuuuaaaaaaaaaauu

SEQ ID NO: 2728648 - RNA, 19 nt, Human
uaaugaaagacuguacaaa

SEQ ID NO: 2728649 - RNA, 18 nt, Human
uaaugaaagacuguacaa

SEQ ID NO: 2728650 - RNA, 17 nt, Human
uaaugaaagacuguaca

SEQ ID NO: 2728651 - RNA, 14 nt, Human
uaaugaaagacugu

SEQ ID NO: 2728652 - RNA, 23 nt, Human
uaaugaaagacuguacaaaguag

SEQ ID NO: 2728653 - RNA, 22 nt, Human
uaaugaaagacuguacaaagua

SEQ ID NO: 2728654 - RNA, 15 nt, Human
uaaugacuuaagcac

SEQ ID NO: 2728655 - RNA, 21 nt, Human
uaaugacuuaagcacacuuga

SEQ ID NO: 2728656 - RNA, 23 nt, Human
uaaucagugugucuaaauuugaa

SEQ ID NO: 2728657 - RNA, 19 nt, Human
uaauagguuuggacaaaau

SEQ ID NO: 2728658 - RNA, 14 nt, Human
uaauagguuuggac

SEQ ID NO: 2728659 - RNA, 13 nt, Human
aaucuucugaacu

SEQ ID NO: 2728660 - RNA, 20 nt, Human
aaucuucugaacuuggcgcu

SEQ ID NO: 2728661 - RNA, 18 nt, Human
uaaguuuuuuuuuaaaaa

SEQ ID NO: 2728662 - RNA, 20 nt, Human
uaaguuuuuauggcuuuugu

SEQ ID NO: 2728663 - RNA, 14 nt, Human
uaaguucauacauu

SEQ ID NO: 2728664 - RNA, 13 nt, Human
uaaguucauacau

SEQ ID NO: 2728665 - RNA, 12 nt, Human
uaaguucauaca

SEQ ID NO: 2728666 - RNA, 19 nt, Human
uaaguacuauguaucaaug

SEQ ID NO: 2728667 - RNA, 20 nt, Human
uaaguauguguaaaauguga

SEQ ID NO: 2728668 - RNA, 23 nt, Human
aaucaugaauuaguuuuauaugc

SEQ ID NO: 2728669 - RNA, 19 nt, Human
aaucaugaauuaguuuuau

SEQ ID NO: 2728670 - RNA, 17 nt, Human
aaucaugaauuaguuuu

SEQ ID NO: 2728671 - RNA, 15 nt, Human
aaucaucaagucuuu

SEQ ID NO: 2728672 - RNA, 13 nt, Human
aauccuugaagau

SEQ ID NO: 2728673 - RNA, 12 nt, Human
aaucuaaaugga

SEQ ID NO: 2728674 - RNA, 18 nt, Human
aaucuaaauggaaccacu

SEQ ID NO: 2728675 - RNA, 15 nt, Human
aaucuaaauggaacc

SEQ ID NO: 2728676 - RNA, 13 nt, Human
aaucuaaauggaa

SEQ ID NO: 2728677 - RNA, 16 nt, Human
aaucuuauaauuuaaa

SEQ ID NO: 2728678 - RNA, 14 nt, Human
aaucuuauaauuua

SEQ ID NO: 2728679 - RNA, 19 nt, Human
aaucugugaacuugaaauu

SEQ ID NO: 2728680 - RNA, 18 nt, Human
aaucugugaacuugaaau

SEQ ID NO: 2728681 - RNA, 17 nt, Human
aaucugugaacuugaaa

SEQ ID NO: 2728682 - RNA, 15 nt, Human
aaucugugaacuuga

SEQ ID NO: 2728683 - RNA, 13 nt, Human
aaucugugaacuu

SEQ ID NO: 2728684 - RNA, 13 nt, Human
aaucucaaauaac

SEQ ID NO: 2728685 - RNA, 15 nt, Human
aaucucaaauaacua

SEQ ID NO: 2728686 - RNA, 12 nt, Human
aaucucaaauuu

SEQ ID NO: 2728687 - RNA, 14 nt, Human
aaucucaaauuucu

SEQ ID NO: 2728688 - RNA, 15 nt, Human
uacaaaaacacagca

SEQ ID NO: 2728689 - RNA, 15 nt, Human
uacaaaaagcauaaa

SEQ ID NO: 2728690 - RNA, 20 nt, Human
uacaaaaagcauaaaaauua

SEQ ID NO: 2728691 - RNA, 15 nt, Human
uacaaaagcauguga

SEQ ID NO: 2728692 - RNA, 14 nt, Human
uacaaaaacacagc

SEQ ID NO: 2728693 - RNA, 13 nt, Human
uacaaaaacacag

SEQ ID NO: 2728694 - RNA, 14 nt, Human
aaugagccuggcaa

SEQ ID NO: 2728695 - RNA, 13 nt, Human
uaauucaagaaaa

SEQ ID NO: 2728696 - RNA, 17 nt, Human
uaauuuauacaggucau

SEQ ID NO: 2728697 - RNA, 18 nt, Human
aauggaagacagcucuua

SEQ ID NO: 2728698 - RNA, 16 nt, Human
aauggacguguuauga

SEQ ID NO: 2728699 - RNA, 12 nt, Human
aaugcuguguua

SEQ ID NO: 2728700 - RNA, 13 nt, Human
aaugcugugcccu

SEQ ID NO: 2728701 - RNA, 21 nt, Human
aaugccccugaauuuaaauag

SEQ ID NO: 2728702 - RNA, 21 nt, Human
aaugcugugcccuaaagugua

SEQ ID NO: 2728703 - RNA, 20 nt, Human
aaugcugugcccuaaagugu

SEQ ID NO: 2728704 - RNA, 20 nt, Human
aaugcccagccccuucugac

SEQ ID NO: 2728705 - RNA, 22 nt, Human
aaugcccagccccuucugaccc

SEQ ID NO: 2728706 - RNA, 23 nt, Human
aaugcccagccccuucugaccca

SEQ ID NO: 2728707 - RNA, 24 nt, Human
aaugcccagccccuucugacccau

SEQ ID NO: 2728708 - RNA, 13 nt, Human
aaugcccagcccc

SEQ ID NO: 2728709 - RNA, 14 nt, Human
aaugcccagccccu

SEQ ID NO: 2728710 - RNA, 15 nt, Human
aaugcccagccccuu

SEQ ID NO: 2728711 - RNA, 19 nt, Human
uacacuaagagagaaugag

SEQ ID NO: 2728712 - RNA, 18 nt, Human
uacagaggccaugggccu

SEQ ID NO: 2728713 - RNA, 23 nt, Human
uacagagcccacgcccccacugg

SEQ ID NO: 2728714 - RNA, 14 nt, Human
uacaguauaauuaa

SEQ ID NO: 2728715 - RNA, 17 nt, Human
uacaguauaauuaacau

SEQ ID NO: 2728716 - RNA, 16 nt, Human
uacaguauaauuaaca

SEQ ID NO: 2728717 - RNA, 19 nt, Human
aauggacuuuuguacauag

SEQ ID NO: 2728718 - RNA, 20 nt, Human
aauggacuguggugacuuug

SEQ ID NO: 2728719 - RNA, 20 nt, Human
uacaccacuacauucuguua

SEQ ID NO: 2728720 - RNA, 19 nt, Human
uacaccacuacauucuguu

SEQ ID NO: 2728721 - RNA, 18 nt, Human
uacaccacuacauucugu

SEQ ID NO: 2728722 - RNA, 17 nt, Human
uacaccacuacauucug

SEQ ID NO: 2728723 - RNA, 16 nt, Human
uacaccacuacauucu

SEQ ID NO: 2728724 - RNA, 15 nt, Human
uacaccacuacauuc

SEQ ID NO: 2728725 - RNA, 14 nt, Human
aauguauguguaag

SEQ ID NO: 2728726 - RNA, 12 nt, Human
aauguaugugua

SEQ ID NO: 2728727 - RNA, 18 nt, Human
aauguacugcauaugaaa

SEQ ID NO: 2728728 - RNA, 14 nt, Human
aauguacugcauau

SEQ ID NO: 2728729 - RNA, 20 nt, Human
uacauaaugcgugcauacca

SEQ ID NO: 2728730 - RNA, 19 nt, Human
uacauaaugcgugcauacc

SEQ ID NO: 2728731 - RNA, 15 nt, Human
uacaguaucucaggg

SEQ ID NO: 2728732 - RNA, 17 nt, Human
uacauaaugcgugcaua

SEQ ID NO: 2728733 - RNA, 23 nt, Human
uacaguauaauuaacauguuaaa

SEQ ID NO: 2728734 - RNA, 19 nt, Human
uacaguauaauuaacaugu

SEQ ID NO: 2728735 - RNA, 18 nt, Human
uacaguauaauuaacaug

SEQ ID NO: 2728736 - RNA, 12 nt, Human
aauguacugcau

SEQ ID NO: 2728737 - RNA, 17 nt, Human
uacauauuuuuguagca

SEQ ID NO: 2728738 - RNA, 18 nt, Human
uacauauuuuuguagcac

SEQ ID NO: 2728739 - RNA, 20 nt, Human
aauaauuuuuauauuugaaa

SEQ ID NO: 2728740 - RNA, 14 nt, Human
uaaauaaauagcua

SEQ ID NO: 2728741 - RNA, 17 nt, Human
uaaauaaauaaauagcu

SEQ ID NO: 2728742 - RNA, 19 nt, Human
uaaauaaugugaaacugga

SEQ ID NO: 2728743 - RNA, 17 nt, Human
aauaauuuuuauauuug

SEQ ID NO: 2728744 - RNA, 19 nt, Human
aauaauuuuuauauuugaa

SEQ ID NO: 2728745 - RNA, 16 nt, Human
aauaauuuuuauauuu

SEQ ID NO: 2728746 - RNA, 21 nt, Human
aauaauuuuaagaaaucaaag

SEQ ID NO: 2728747 - RNA, 20 nt, Human
aauaacugugaaguuuacau

SEQ ID NO: 2728748 - RNA, 14 nt, Human
aauaacugugaagu

SEQ ID NO: 2728749 - RNA, 16 nt, Human
aauaacugugaaguuu

SEQ ID NO: 2728750 - RNA, 14 nt, Human
uaaauuaacuuuua

SEQ ID NO: 2728751 - RNA, 12 nt, Human
uaaauuaacuuu

SEQ ID NO: 2728752 - RNA, 16 nt, Human
uaaauuaacuuuuaua

SEQ ID NO: 2728753 - RNA, 15 nt, Human
uaaauuaacuuuuau

SEQ ID NO: 2728754 - RNA, 17 nt, Human
uaaauuaacuuuuauaa

SEQ ID NO: 2728755 - RNA, 18 nt, Human
uaaauuaacuuuuauaaa

SEQ ID NO: 2728756 - RNA, 17 nt, Human
uaaauuuugaguucuac

SEQ ID NO: 2728757 - RNA, 20 nt, Human
uaaauguugaaagaucaaaa

SEQ ID NO: 2728758 - RNA, 15 nt, Human
uaaauguugaaagau

SEQ ID NO: 2728759 - RNA, 23 nt, Human
uaaaugcaccuggaauauauaac

SEQ ID NO: 2728760 - RNA, 22 nt, Human
uaaaucugugaacuugaaauuu

SEQ ID NO: 2728761 - RNA, 21 nt, Human
uaaaucugugaacuugaaauu

SEQ ID NO: 2728762 - RNA, 19 nt, Human
uaaaucugugaacuugaaa

SEQ ID NO: 2728763 - RNA, 18 nt, Human
uaaaucugugaacuugaa

SEQ ID NO: 2728764 - RNA, 17 nt, Human
uaaaucugugaacuuga

SEQ ID NO: 2728765 - RNA, 22 nt, Human
uaaaucuccaaaauaaaacuuu

SEQ ID NO: 2728766 - RNA, 16 nt, Human
uaaaucugugaacuug

SEQ ID NO: 2728767 - RNA, 15 nt, Human
uaaaucugugaacuu

SEQ ID NO: 2728768 - RNA, 14 nt, Human
uaaaucuccaaaau

SEQ ID NO: 2728769 - RNA, 18 nt, Human
uaaaucuccaaaauaaaa

SEQ ID NO: 2728770 - RNA, 15 nt, Human
uaaaucuccaaaaua

SEQ ID NO: 2728771 - RNA, 18 nt, Human
uaaauagcuagacuggug

SEQ ID NO: 2728772 - RNA, 21 nt, Human
aauaacaaugaaaguugauaa

SEQ ID NO: 2728773 - RNA, 13 nt, Human
aauaacugugaag

SEQ ID NO: 2728774 - RNA, 22 nt, Human
aauaacauguaauuaaguacua

SEQ ID NO: 2728775 - RNA, 18 nt, Human
aauaaaacuuuuuaaaau

SEQ ID NO: 2728776 - RNA, 12 nt, Human
aauaaaacuuuu

SEQ ID NO: 2728777 - RNA, 15 nt, Human
aauaaaacuuuuuaa

SEQ ID NO: 2728778 - RNA, 14 nt, Human
aauaaaacuuuuua

SEQ ID NO: 2728779 - RNA, 16 nt, Human
aauaaaucauaaaacu

SEQ ID NO: 2728780 - RNA, 20 nt, Human
aaguuuuuauggcuuuugug

SEQ ID NO: 2728781 - RNA, 20 nt, Human
aauaucugaaaauguaugug

SEQ ID NO: 2728782 - RNA, 16 nt, Human
aauaucuccgucaacu

SEQ ID NO: 2728783 - RNA, 21 nt, Human
aauaucuccgucaacucauau

SEQ ID NO: 2728784 - RNA, 19 nt, Human
aauaucugaaaauguaugu

SEQ ID NO: 2728785 - RNA, 18 nt, Human
aauaucugaaaauguaug

SEQ ID NO: 2728786 - RNA, 17 nt, Human
aauaucugaaaauguau

SEQ ID NO: 2728787 - RNA, 16 nt, Human
aauaucugaaaaugua

SEQ ID NO: 2728788 - RNA, 15 nt, Human
uaacuuuuauaaacu

SEQ ID NO: 2728789 - RNA, 18 nt, Human
uaacuuuuauaaacuuua

SEQ ID NO: 2728790 - RNA, 17 nt, Human
uaacuuuuauaaacuuu

SEQ ID NO: 2728791 - RNA, 15 nt, Human
aauauuucagauaau

SEQ ID NO: 2728792 - RNA, 14 nt, Human
aauauuucagauaa

SEQ ID NO: 2728793 - RNA, 18 nt, Human
aauauuguguugugaaug

SEQ ID NO: 2728794 - RNA, 20 nt, Human
aauauugcuuuggucauaug

SEQ ID NO: 2728795 - RNA, 18 nt, Human
aauauuuuaugauccagc

SEQ ID NO: 2728796 - RNA, 17 nt, Human
aauauuuuaugauccag

SEQ ID NO: 2728797 - RNA, 24 nt, Human
aauaugcaaagcacugacuucuaa

SEQ ID NO: 2728798 - RNA, 15 nt, Human
aauaugcacacauuu

SEQ ID NO: 2728799 - RNA, 17 nt, Human
aauauugauaugcuuau

SEQ ID NO: 2728800 - RNA, 18 nt, Human
aauauugauaugcuuaua

SEQ ID NO: 2728801 - RNA, 17 nt, Human
aauaugcaaagcacuga

SEQ ID NO: 2728802 - RNA, 15 nt, Human
aauaugcaaagcacu

SEQ ID NO: 2728803 - RNA, 11 nt, Human
aauauugcuga

SEQ ID NO: 2728804 - RNA, 12 nt, Human
aauauugcugau

SEQ ID NO: 2728805 - RNA, 13 nt, Human
aauauugcugaug

SEQ ID NO: 2728806 - RNA, 15 nt, Human
aauauugcugauggu

SEQ ID NO: 2728807 - RNA, 18 nt, Human
aauauugcugauggugca

SEQ ID NO: 2728808 - RNA, 21 nt, Human
aauauugcugauggugcaaug

SEQ ID NO: 2728809 - RNA, 22 nt, Human
aauauugcugauggugcaauga

SEQ ID NO: 2728810 - RNA, 15 nt, Human
aauaucacuugucaa

SEQ ID NO: 2728811 - RNA, 12 nt, Human
aauaucacuugu

SEQ ID NO: 2728812 - RNA, 15 nt, Human
aauaguauuugagag

SEQ ID NO: 2728813 - RNA, 14 nt, Human
uaacauggaaguac

SEQ ID NO: 2728814 - RNA, 14 nt, Human
uaacauaaaucugu

SEQ ID NO: 2728815 - RNA, 15 nt, Human
uaacauaaaucugug

SEQ ID NO: 2728816 - RNA, 20 nt, Human
uaacauaaaucugugaacuu

SEQ ID NO: 2728817 - RNA, 18 nt, Human
uaacauaaaucugugaac

SEQ ID NO: 2728818 - RNA, 17 nt, Human
uaacauaaaucugugaa

SEQ ID NO: 2728819 - RNA, 16 nt, Human
uaacauaaaucuguga

SEQ ID NO: 2728820 - RNA, 16 nt, Human
uaacauggaaguacua

SEQ ID NO: 2728821 - RNA, 15 nt, Human
uaacauggaaguacu

SEQ ID NO: 2728822 - RNA, 16 nt, Human
uaaccucuaaauucuu

SEQ ID NO: 2728823 - RNA, 15 nt, Human
uaacuaaaagguaug

SEQ ID NO: 2728824 - RNA, 14 nt, Human
uaacuaaaagguau

SEQ ID NO: 2728825 - RNA, 18 nt, Human
aauaggcguaacuaauuu

SEQ ID NO: 2728826 - RNA, 24 nt, Human
aauagcuuuuuucucugauacaga

SEQ ID NO: 2728827 - RNA, 19 nt, Human
aauaggaaaaacugauuuu

SEQ ID NO: 2728828 - RNA, 17 nt, Human
aauaggaaaaacugauu

SEQ ID NO: 2728829 - RNA, 18 nt, Human
aauaggaaaaacugauuu

SEQ ID NO: 2728830 - RNA, 15 nt, Human
aauaggaaaaacuga

SEQ ID NO: 2728831 - RNA, 16 nt, Human
aauaggaaaaacugau

SEQ ID NO: 2728832 - RNA, 18 nt, Human
aauagacaauuuauuaug

SEQ ID NO: 2728833 - RNA, 20 nt, Human
uaaauuuugucuuuaacuca

SEQ ID NO: 2728834 - RNA, 18 nt, Human
uaaauuuugaguucuaca

SEQ ID NO: 2728835 - RNA, 19 nt, Human
uaaauuuugaguucuacau

SEQ ID NO: 2728836 - RNA, 23 nt, Human
aauagacaauuuauuauggcaca

SEQ ID NO: 2728837 - RNA, 20 nt, Human
aauagccugccucuucucua

SEQ ID NO: 2728838 - RNA, 13 nt, Human
aauagcugggacu

SEQ ID NO: 2728839 - RNA, 14 nt, Human
aauagcugggacua

SEQ ID NO: 2728840 - RNA, 16 nt, Human
uagcuacuaauuuuaa

SEQ ID NO: 2728841 - RNA, 18 nt, Human
acaaugaagauaaaaaga

SEQ ID NO: 2728842 - RNA, 18 nt, Human
uagcuagacuggugacug

SEQ ID NO: 2728843 - RNA, 15 nt, Human
uagcuagacugguga

SEQ ID NO: 2728844 - RNA, 16 nt, Human
uagcucaggugucccu

SEQ ID NO: 2728845 - RNA, 22 nt, Human
acaagcuccaagcucccaggca

SEQ ID NO: 2728846 - RNA, 15 nt, Human
acaagcuccaagcuc

SEQ ID NO: 2728847 - RNA, 16 nt, Human
acaagcuccaagcucc

SEQ ID NO: 2728848 - RNA, 17 nt, Human
acaagcuccaagcuccc

SEQ ID NO: 2728849 - RNA, 19 nt, Human
acaagcuccaagcucccag

SEQ ID NO: 2728850 - RNA, 15 nt, Human
acaacagcuggugcc

SEQ ID NO: 2728851 - RNA, 17 nt, Human
acaacaucuuuuucuac

SEQ ID NO: 2728852 - RNA, 22 nt, Human
acaagcucacagaccuuugaac

SEQ ID NO: 2728853 - RNA, 13 nt, Human
acaagcuccaagc

SEQ ID NO: 2728854 - RNA, 17 nt, Human
acaagcgugagccacug

SEQ ID NO: 2728855 - RNA, 16 nt, Human
acaagaccacguuucu

SEQ ID NO: 2728856 - RNA, 17 nt, Human
acaagaccacguuucua

SEQ ID NO: 2728857 - RNA, 17 nt, Human
acaagaugguucuagca

SEQ ID NO: 2728858 - RNA, 22 nt, Human
acaagagcccaggccuccuaca

SEQ ID NO: 2728859 - RNA, 22 nt, Human
aauuuuuucucuaggaaauauu

SEQ ID NO: 2728860 - RNA, 22 nt, Human
aauuuuuuuaucgucacugcuu

SEQ ID NO: 2728861 - RNA, 21 nt, Human
aauuuuucuuauuucauuucu

SEQ ID NO: 2728862 - RNA, 15 nt, Human
aauuuuguuucugua

SEQ ID NO: 2728863 - RNA, 16 nt, Human
aauuuuguuucuguac

SEQ ID NO: 2728864 - RNA, 20 nt, Human
uacuuuuuggcauaacauaa

SEQ ID NO: 2728865 - RNA, 19 nt, Human
uacuuuuuggcauaacaua

SEQ ID NO: 2728866 - RNA, 22 nt, Human
uacuuugugcugggguuaucug

SEQ ID NO: 2728867 - RNA, 16 nt, Human
uacuuugugcuggggu

SEQ ID NO: 2728868 - RNA, 14 nt, Human
uacuuuuuggcaua

SEQ ID NO: 2728869 - RNA, 13 nt, Human
aauuugguuuuca

SEQ ID NO: 2728870 - RNA, 20 nt, Human
aauuugugauacaaugcugu

SEQ ID NO: 2728871 - RNA, 21 nt, Human
aauuugguuuucacauuggaa

SEQ ID NO: 2728872 - RNA, 15 nt, Human
aauuugguuuucaca

SEQ ID NO: 2728873 - RNA, 16 nt, Human
aauuuguuauaaugaa

SEQ ID NO: 2728874 - RNA, 21 nt, Human
uagaugcaguucugaagaaga

SEQ ID NO: 2728875 - RNA, 20 nt, Human
uagaugcaguucugaagaag

SEQ ID NO: 2728876 - RNA, 14 nt, Human
uagaucuaguucac

SEQ ID NO: 2728877 - RNA, 22 nt, Human
uagauaggucagugcaaauacu

SEQ ID NO: 2728878 - RNA, 17 nt, Human
uagauaggccaugggca

SEQ ID NO: 2728879 - RNA, 20 nt, Human
acaaaguauuaagcauauau

SEQ ID NO: 2728880 - RNA, 21 nt, Human
acaaagcgugguggacaugca

SEQ ID NO: 2728881 - RNA, 14 nt, Human
acaaaacuuuucua

SEQ ID NO: 2728882 - RNA, 16 nt, Human
uacuucaugcugucua

SEQ ID NO: 2728883 - RNA, 13 nt, Human
uacuucuccaccc

SEQ ID NO: 2728884 - RNA, 18 nt, Human
uacuucuccacccugcuc

SEQ ID NO: 2728885 - RNA, 19 nt, Human
uacuucuuaggguuaugau

SEQ ID NO: 2728886 - RNA, 15 nt, Human
uacuucugcuacaua

SEQ ID NO: 2728887 - RNA, 20 nt, Human
uacuucuccacccugcucuc

SEQ ID NO: 2728888 - RNA, 16 nt, Human
uacuucuuauacauuu

SEQ ID NO: 2728889 - RNA, 15 nt, Human
uacuucuuauacauu

SEQ ID NO: 2728890 - RNA, 14 nt, Human
uacuucuuauacau

SEQ ID NO: 2728891 - RNA, 15 nt, Human
aauuuaccugaaguc

SEQ ID NO: 2728892 - RNA, 15 nt, Human
aauuuacauacucug

SEQ ID NO: 2728893 - RNA, 17 nt, Human
aauuuaccugaagucuu

SEQ ID NO: 2728894 - RNA, 13 nt, Human
aauuuaguauuuu

SEQ ID NO: 2728895 - RNA, 19 nt, Human
aauuucucccagucauuua

SEQ ID NO: 2728896 - RNA, 23 nt, Human
aauuucuaggacugaauuaugaa

SEQ ID NO: 2728897 - RNA, 14 nt, Human
aauuuauuauggca

SEQ ID NO: 2728898 - RNA, 13 nt, Human
aauuuauuauggc

SEQ ID NO: 2728899 - RNA, 17 nt, Human
aauuucuaggacugaau

SEQ ID NO: 2728900 - RNA, 22 nt, Human
aauuucuaggacugaauuauga

SEQ ID NO: 2728901 - RNA, 18 nt, Human
aauuucuaggacugaauu

SEQ ID NO: 2728902 - RNA, 16 nt, Human
aauuuauacaggucau

SEQ ID NO: 2728903 - RNA, 17 nt, Human
aauuuauacaggucaua

SEQ ID NO: 2728904 - RNA, 18 nt, Human
aauugaggacacugauau

SEQ ID NO: 2728905 - RNA, 22 nt, Human
uacugaaauaaacgucuuaaau

SEQ ID NO: 2728906 - RNA, 19 nt, Human
uacugaaauaaacgucuua

SEQ ID NO: 2728907 - RNA, 15 nt, Human
uacuguaauuuguga

SEQ ID NO: 2728908 - RNA, 17 nt, Human
uacuguaauuugugaua

SEQ ID NO: 2728909 - RNA, 16 nt, Human
uacuguaauuugugau

SEQ ID NO: 2728910 - RNA, 13 nt, Human
uacgugaguccug

SEQ ID NO: 2728911 - RNA, 16 nt, Human
uacgucugacaggcaa

SEQ ID NO: 2728912 - RNA, 16 nt, Human
uacucuacccucuuag

SEQ ID NO: 2728913 - RNA, 22 nt, Human
uacucuacccucuuagaaaaac

SEQ ID NO: 2728914 - RNA, 15 nt, Human
uacgucugacaggca

SEQ ID NO: 2728915 - RNA, 13 nt, Human
acacacugaagaa

SEQ ID NO: 2728916 - RNA, 20 nt, Human
acacacucaaaucaagaaac

SEQ ID NO: 2728917 - RNA, 19 nt, Human
acacacagcucuguccugg

SEQ ID NO: 2728918 - RNA, 11 nt, Human
acacacagcuc

SEQ ID NO: 2728919 - RNA, 12 nt, Human
acacacagcucu

SEQ ID NO: 2728920 - RNA, 14 nt, Human
acacaacuauauug

SEQ ID NO: 2728921 - RNA, 17 nt, Human
acacaacuauauuguuu

SEQ ID NO: 2728922 - RNA, 21 nt, Human
acaaugguuuucuuguguguu

SEQ ID NO: 2728923 - RNA, 18 nt, Human
acacaacuauuuuuccaa

SEQ ID NO: 2728924 - RNA, 14 nt, Human
acaaugcuguauuu

SEQ ID NO: 2728925 - RNA, 17 nt, Human
acaaugcuguauuuuaa

SEQ ID NO: 2728926 - RNA, 15 nt, Human
acaaugguuuucuug

SEQ ID NO: 2728927 - RNA, 14 nt, Human
acacacugaagaag

SEQ ID NO: 2728928 - RNA, 22 nt, Human
acacagcucuucuccaggcugu

SEQ ID NO: 2728929 - RNA, 11 nt, Human
acacagugagu

SEQ ID NO: 2728930 - RNA, 14 nt, Human
uaguaauagagcaa

SEQ ID NO: 2728931 - RNA, 21 nt, Human
uagguuggcaaaaaggcagga

SEQ ID NO: 2728932 - RNA, 16 nt, Human
uaguguuggagaagaa

SEQ ID NO: 2728933 - RNA, 17 nt, Human
uaguguuggagaagaac

SEQ ID NO: 2728934 - RNA, 12 nt, Human
uaguguuggaga

SEQ ID NO: 2728935 - RNA, 22 nt, Human
uagucuugucucagauuuuauu

SEQ ID NO: 2728936 - RNA, 17 nt, Human
uagucuugucucagauu

SEQ ID NO: 2728937 - RNA, 13 nt, Human
uaguagagacagg

SEQ ID NO: 2728938 - RNA, 20 nt, Human
uaguaauagagcaaaauuga

SEQ ID NO: 2728939 - RNA, 17 nt, Human
acacuaagagagaauga

SEQ ID NO: 2728940 - RNA, 19 nt, Human
acacuaaccacgcuggacc

SEQ ID NO: 2728941 - RNA, 16 nt, Human
acacuaaccacgcugg

SEQ ID NO: 2728942 - RNA, 17 nt, Human
acacuaaccacgcugga

SEQ ID NO: 2728943 - RNA, 18 nt, Human
acacuaagagagaaugag

SEQ ID NO: 2728944 - RNA, 19 nt, Human
acacuaagagagaaugaga

SEQ ID NO: 2728945 - RNA, 22 nt, Human
uauaaccaguguuguggauuua

SEQ ID NO: 2728946 - RNA, 18 nt, Human
acaccucugcacaagcug

SEQ ID NO: 2728947 - RNA, 14 nt, Human
acaccuugacaggg

SEQ ID NO: 2728948 - RNA, 15 nt, Human
acaccuugacagggc

SEQ ID NO: 2728949 - RNA, 16 nt, Human
acaccuugacagggca

SEQ ID NO: 2728950 - RNA, 13 nt, Human
acacauguccaag

SEQ ID NO: 2728951 - RNA, 18 nt, Human
acacauguccaagaagcc

SEQ ID NO: 2728952 - RNA, 19 nt, Human
acacauguccaagaagccc

SEQ ID NO: 2728953 - RNA, 12 nt, Human
acacccagccca

SEQ ID NO: 2728954 - RNA, 13 nt, Human
acacccagcccac

SEQ ID NO: 2728955 - RNA, 21 nt, Human
acacauguccaagaagcccag

SEQ ID NO: 2728956 - RNA, 22 nt, Human
acacauguccaagaagcccagg

SEQ ID NO: 2728957 - RNA, 23 nt, Human
uauaaaauaauuuuuauauuuga

SEQ ID NO: 2728958 - RNA, 18 nt, Human
uaguucagguaacaggca

SEQ ID NO: 2728959 - RNA, 13 nt, Human
acacuccuucaca

SEQ ID NO: 2728960 - RNA, 11 nt, Human
acacucugaga

SEQ ID NO: 2728961 - RNA, 13 nt, Human
acacucugagacu

SEQ ID NO: 2728962 - RNA, 16 nt, Human
uauaaguauucuaaau

SEQ ID NO: 2728963 - RNA, 12 nt, Human
acacugaagaag

SEQ ID NO: 2728964 - RNA, 14 nt, Human
acacugaagaagca

SEQ ID NO: 2728965 - RNA, 14 nt, Human
acacuguucucugc

SEQ ID NO: 2728966 - RNA, 15 nt, Human
acacuguucucugcc

SEQ ID NO: 2728967 - RNA, 22 nt, Human
acacuguucucugcccuccaag

SEQ ID NO: 2728968 - RNA, 23 nt, Human
acacuguucucugcccuccaaga

SEQ ID NO: 2728969 - RNA, 16 nt, Human
acacuguucucugccc

SEQ ID NO: 2728970 - RNA, 17 nt, Human
acacuguucucugcccu

SEQ ID NO: 2728971 - RNA, 18 nt, Human
acacuguucucugcccuc

SEQ ID NO: 2728972 - RNA, 20 nt, Human
acacuguucucugcccucca

SEQ ID NO: 2728973 - RNA, 12 nt, Human
uauauuuacaaa

SEQ ID NO: 2728974 - RNA, 15 nt, Human
uauauuuaaugauaa

SEQ ID NO: 2728975 - RNA, 17 nt, Human
acagacuggaagcacag

SEQ ID NO: 2728976 - RNA, 19 nt, Human
acagacuggaagcacagcu

SEQ ID NO: 2728977 - RNA, 21 nt, Human
acagacuggaagcacagcuuc

SEQ ID NO: 2728978 - RNA, 18 nt, Human
acagacacaggcccggcu

SEQ ID NO: 2728979 - RNA, 22 nt, Human
acagacacaggcccggcuccag

SEQ ID NO: 2728980 - RNA, 17 nt, Human
acagacacaggcccggc

SEQ ID NO: 2728981 - RNA, 15 nt, Human
acagacacaggcccg

SEQ ID NO: 2728982 - RNA, 15 nt, Human
acacuguuucaaacu

SEQ ID NO: 2728983 - RNA, 23 nt, Human
acacuguuucaaacuuuacuaug

SEQ ID NO: 2728984 - RNA, 18 nt, Human
acagaaaauucuucucca

SEQ ID NO: 2728985 - RNA, 20 nt, Human
acagcccuucuuuccacaga

SEQ ID NO: 2728986 - RNA, 21 nt, Human
acagcccuucuuuccacagaa

SEQ ID NO: 2728987 - RNA, 23 nt, Human
acagcccgggcucugccucccau

SEQ ID NO: 2728988 - RNA, 21 nt, Human
acagcccgggcucugccuccc

SEQ ID NO: 2728989 - RNA, 22 nt, Human
acagcccgggcucugccuccca

SEQ ID NO: 2728990 - RNA, 16 nt, Human
uaucuuguagcuuuau

SEQ ID NO: 2728991 - RNA, 14 nt, Human
acagauaaucagug

SEQ ID NO: 2728992 - RNA, 15 nt, Human
acagaguuguuacau

SEQ ID NO: 2728993 - RNA, 22 nt, Human
acagaguuguuacauuuuuaag

SEQ ID NO: 2728994 - RNA, 21 nt, Human
acagaguuguuacauuuuuaa

SEQ ID NO: 2728995 - RNA, 20 nt, Human
acagauagauauaugcucug

SEQ ID NO: 2728996 - RNA, 23 nt, Human
acagaugggugcuuggaggaagg

SEQ ID NO: 2728997 - RNA, 19 nt, Human
uauauuuauuacuguaaga

SEQ ID NO: 2728998 - RNA, 15 nt, Human
uauauuuauuacugu

SEQ ID NO: 2728999 - RNA, 20 nt, Human
uaucccuacuguaauuugug

SEQ ID NO: 2729000 - RNA, 19 nt, Human
uaucccuacuguaauuugu

SEQ ID NO: 2729001 - RNA, 13 nt, Human
uaucucagggccu

SEQ ID NO: 2729002 - RNA, 15 nt, Human
uaucucagggccugg

SEQ ID NO: 2729003 - RNA, 21 nt, Human
acagagcaagugagacccugu

SEQ ID NO: 2729004 - RNA, 16 nt, Human
acagaguuguuacauu

SEQ ID NO: 2729005 - RNA, 20 nt, Human
acagaguuguuacauuuuua

SEQ ID NO: 2729006 - RNA, 19 nt, Human
acagaguuguuacauuuuu

SEQ ID NO: 2729007 - RNA, 18 nt, Human
acagaguuguuacauuuu

SEQ ID NO: 2729008 - RNA, 17 nt, Human
acagaguuguuacauuu

SEQ ID NO: 2729009 - RNA, 19 nt, Human
acaugagcaucaggccagg

SEQ ID NO: 2729010 - RNA, 17 nt, Human
acaugagcaucaggcca

SEQ ID NO: 2729011 - RNA, 18 nt, Human
acaugagcaucaggccag

SEQ ID NO: 2729012 - RNA, 17 nt, Human
acaugaucuucuuuaua

SEQ ID NO: 2729013 - RNA, 15 nt, Human
acaugaucuucuuua

SEQ ID NO: 2729014 - RNA, 20 nt, Human
acaugagcaucaggccaggc

SEQ ID NO: 2729015 - RNA, 22 nt, Human
acaugcuacacacugcauguuu

SEQ ID NO: 2729016 - RNA, 18 nt, Human
ucaaauaacuaaaaggua

SEQ ID NO: 2729017 - RNA, 14 nt, Human
ucaaagcugaaaug

SEQ ID NO: 2729018 - RNA, 22 nt, Human
ucaaaguugccuaaauccauuu

SEQ ID NO: 2729019 - RNA, 21 nt, Human
ucaaaguugccuaaauccauu

SEQ ID NO: 2729020 - RNA, 19 nt, Human
ucaaaguugccuaaaucca

SEQ ID NO: 2729021 - RNA, 18 nt, Human
ucaaaguugccuaaaucc

SEQ ID NO: 2729022 - RNA, 17 nt, Human
ucaaagggugaaaauua

SEQ ID NO: 2729023 - RNA, 19 nt, Human
uauuuuugacagaauaugu

SEQ ID NO: 2729024 - RNA, 23 nt, Human
uauuuuugacagaauauguuuca

SEQ ID NO: 2729025 - RNA, 13 nt, Human
uauuuuugacaga

SEQ ID NO: 2729026 - RNA, 14 nt, Human
uauuuuugacagaa

SEQ ID NO: 2729027 - RNA, 15 nt, Human
uauuuuugacagaau

SEQ ID NO: 2729028 - RNA, 16 nt, Human
uauuuuuauauuuacu

SEQ ID NO: 2729029 - RNA, 21 nt, Human
ucaaaauaccaugccauuuaa

SEQ ID NO: 2729030 - RNA, 23 nt, Human
ucaaaauaccaugccauuuaaag

SEQ ID NO: 2729031 - RNA, 21 nt, Human
ucaaaauaugccccauucaac

SEQ ID NO: 2729032 - RNA, 14 nt, Human
ucaaaaugucuaag

SEQ ID NO: 2729033 - RNA, 19 nt, Human
acauguccaagaagcccag

SEQ ID NO: 2729034 - RNA, 21 nt, Human
acauguccaagaagcccagga

SEQ ID NO: 2729035 - RNA, 17 nt, Human
ucaaauuucuaaaucuc

SEQ ID NO: 2729036 - RNA, 16 nt, Human
ucaacagguuuuccug

SEQ ID NO: 2729037 - RNA, 12 nt, Human
acauucuguuaa

SEQ ID NO: 2729038 - RNA, 14 nt, Human
ucaaauuucuaaau

SEQ ID NO: 2729039 - RNA, 15 nt, Human
acauucuguuaauca

SEQ ID NO: 2729040 - RNA, 16 nt, Human
ucaaauuucuaaaucu

SEQ ID NO: 2729041 - RNA, 15 nt, Human
ucaaauuucuaaauc

SEQ ID NO: 2729042 - RNA, 22 nt, Human
ucaagaugaugaugaucuuuaa

SEQ ID NO: 2729043 - RNA, 11 nt, Human
ucaaguauuau

SEQ ID NO: 2729044 - RNA, 15 nt, Human
ucaaguauuauaccu

SEQ ID NO: 2729045 - RNA, 23 nt, Human
ucaaguauuauaccuuuuuuaga

SEQ ID NO: 2729046 - RNA, 21 nt, Human
ucaaguauuauaccuuuuuua

SEQ ID NO: 2729047 - RNA, 16 nt, Human
ucaaguauuauaccuu

SEQ ID NO: 2729048 - RNA, 15 nt, Human
acaguuuucugagaa

SEQ ID NO: 2729049 - RNA, 17 nt, Human
acaguuuucugagaaag

SEQ ID NO: 2729050 - RNA, 16 nt, Human
acaguuuucugagaaa

SEQ ID NO: 2729051 - RNA, 20 nt, Human
acaguuuguuaguaugaggc

SEQ ID NO: 2729052 - RNA, 16 nt, Human
acaguuuguuaguaug

SEQ ID NO: 2729053 - RNA, 21 nt, Human
acaguuuucugagaaagacua

SEQ ID NO: 2729054 - RNA, 20 nt, Human
acaguuuucugagaaagacu

SEQ ID NO: 2729055 - RNA, 19 nt, Human
acaguuuucugagaaagac

SEQ ID NO: 2729056 - RNA, 18 nt, Human
acaguuuucugagaaaga

SEQ ID NO: 2729057 - RNA, 16 nt, Human
acauaaaaacaacuuu

SEQ ID NO: 2729058 - RNA, 19 nt, Human
acauaaaaacaacuuuaua

SEQ ID NO: 2729059 - RNA, 21 nt, Human
acauaaaaacaacuuuauacc

SEQ ID NO: 2729060 - RNA, 14 nt, Human
acauacucugcuua

SEQ ID NO: 2729061 - RNA, 17 nt, Human
acauacucccaucugug

SEQ ID NO: 2729062 - RNA, 13 nt, Human
acauacucccauc

SEQ ID NO: 2729063 - RNA, 22 nt, Human
acauacuaaccagcagaaaugc

SEQ ID NO: 2729064 - RNA, 21 nt, Human
acauacuaaccagcagaaaug

SEQ ID NO: 2729065 - RNA, 13 nt, Human
acauacuaaccag

SEQ ID NO: 2729066 - RNA, 21 nt, Human
uaugaaauauuauguuaaaac

SEQ ID NO: 2729067 - RNA, 13 nt, Human
uauuucauuucuu

SEQ ID NO: 2729068 - RNA, 21 nt, Human
uauuuccauuaaaaaaucagu

SEQ ID NO: 2729069 - RNA, 23 nt, Human
uauuuccuauauuguuuucagug

SEQ ID NO: 2729070 - RNA, 22 nt, Human
uauuucccucaccuuucccauc

SEQ ID NO: 2729071 - RNA, 20 nt, Human
acaguugaaaaacagcugag

SEQ ID NO: 2729072 - RNA, 15 nt, Human
acaguugaaaaacag

SEQ ID NO: 2729073 - RNA, 16 nt, Human
acaguugaaaaacagc

SEQ ID NO: 2729074 - RNA, 18 nt, Human
uauuucuauauuuucauu

SEQ ID NO: 2729075 - RNA, 17 nt, Human
uauuucuauauuuucau

SEQ ID NO: 2729076 - RNA, 16 nt, Human
uauuucuauauuuuca

SEQ ID NO: 2729077 - RNA, 18 nt, Human
acaucaacaucuugguca

SEQ ID NO: 2729078 - RNA, 16 nt, Human
acaucaacaucuuggu

SEQ ID NO: 2729079 - RNA, 16 nt, Human
acaugaaaacacauuu

SEQ ID NO: 2729080 - RNA, 19 nt, Human
acaugaaaacacauuuuuc

SEQ ID NO: 2729081 - RNA, 18 nt, Human
acaugaaaacacauuuuu

SEQ ID NO: 2729082 - RNA, 21 nt, Human
acaucuugcucugcugacaga

SEQ ID NO: 2729083 - RNA, 17 nt, Human
acaugaaaacacauuuu

SEQ ID NO: 2729084 - RNA, 18 nt, Human
acaucuugcucugcugac

SEQ ID NO: 2729085 - RNA, 19 nt, Human
acaucuugcucugcugaca

SEQ ID NO: 2729086 - RNA, 13 nt, Human
acaucuugcucug

SEQ ID NO: 2729087 - RNA, 19 nt, Human
acauauauaacaaugcugu

SEQ ID NO: 2729088 - RNA, 20 nt, Human
acauagucuggcuguaccca

SEQ ID NO: 2729089 - RNA, 15 nt, Human
acauagucuggcugu

SEQ ID NO: 2729090 - RNA, 14 nt, Human
acauagucuggcug

SEQ ID NO: 2729091 - RNA, 16 nt, Human
acauauugauuuccgu

SEQ ID NO: 2729092 - RNA, 14 nt, Human
acauauugauuucc

SEQ ID NO: 2729093 - RNA, 23 nt, Human
acauauugauuuccguuaaaaua

SEQ ID NO: 2729094 - RNA, 22 nt, Human
acauauugauuuccguuaaaau

SEQ ID NO: 2729095 - RNA, 18 nt, Human
acauauugauuuccguua

SEQ ID NO: 2729096 - RNA, 17 nt, Human
acauaucuaguaugaaa

SEQ ID NO: 2729097 - RNA, 23 nt, Human
acauaucuaguaugaaauuauau

SEQ ID NO: 2729098 - RNA, 20 nt, Human
acauaucuaguaugaaauua

SEQ ID NO: 2729099 - RNA, 22 nt, Human
acauaucuaguaugaaauuaua

SEQ ID NO: 2729100 - RNA, 15 nt, Human
ucaccugccccucaa

SEQ ID NO: 2729101 - RNA, 13 nt, Human
ucaccugccccuc

SEQ ID NO: 2729102 - RNA, 15 nt, Human
ucaccucucccuugg

SEQ ID NO: 2729103 - RNA, 16 nt, Human
ucaccugaagacucau

SEQ ID NO: 2729104 - RNA, 18 nt, Human
ucacuauguugcccaggc

SEQ ID NO: 2729105 - RNA, 17 nt, Human
ucacuauguugcccagg

SEQ ID NO: 2729106 - RNA, 19 nt, Human
ucacuauguugcccaggca

SEQ ID NO: 2729107 - RNA, 20 nt, Human
ucacuauguugcccaggcag

SEQ ID NO: 2729108 - RNA, 17 nt, Human
ucacuaccuucaugcau

SEQ ID NO: 2729109 - RNA, 18 nt, Human
accacuuguguuuugcaa

SEQ ID NO: 2729110 - RNA, 15 nt, Human
accacuuuuguucuu

SEQ ID NO: 2729111 - RNA, 21 nt, Human
accacuuuuguucuugguuug

SEQ ID NO: 2729112 - RNA, 16 nt, Human
accacuuuuguucuug

SEQ ID NO: 2729113 - RNA, 17 nt, Human
accacugcacuccagcc

SEQ ID NO: 2729114 - RNA, 20 nt, Human
accacugcacuccagccugg

SEQ ID NO: 2729115 - RNA, 17 nt, Human
ucaccccggccaccugc

SEQ ID NO: 2729116 - RNA, 18 nt, Human
ucaccccggccaccugcg

SEQ ID NO: 2729117 - RNA, 21 nt, Human
accacugcacuccagccuggg

SEQ ID NO: 2729118 - RNA, 11 nt, Human
accagacaggu

SEQ ID NO: 2729119 - RNA, 14 nt, Human
accagacaccuuga

SEQ ID NO: 2729120 - RNA, 12 nt, Human
accagagcccac

SEQ ID NO: 2729121 - RNA, 14 nt, Human
accagagcccaccu

SEQ ID NO: 2729122 - RNA, 16 nt, Human
accagagcccaccuug

SEQ ID NO: 2729123 - RNA, 22 nt, Human
accacuuuuguucuugguuugu

SEQ ID NO: 2729124 - RNA, 15 nt, Human
ucaauucuugccaaa

SEQ ID NO: 2729125 - RNA, 13 nt, Human
ucaauuuuaacaa

SEQ ID NO: 2729126 - RNA, 23 nt, Human
ucaauuuuucuuauuucauuucu

SEQ ID NO: 2729127 - RNA, 20 nt, Human
ucaauuuuucuuauuucauu

SEQ ID NO: 2729128 - RNA, 13 nt, Human
accaaucaugaau

SEQ ID NO: 2729129 - RNA, 15 nt, Human
accaaucaugaauua

SEQ ID NO: 2729130 - RNA, 15 nt, Human
accaauguucucucu

SEQ ID NO: 2729131 - RNA, 15 nt, Human
ucaagugaaaaagga

SEQ ID NO: 2729132 - RNA, 23 nt, Human
ucaagugaaaaaggaggaagaga

SEQ ID NO: 2729133 - RNA, 17 nt, Human
accaacauacucccauc

SEQ ID NO: 2729134 - RNA, 19 nt, Human
accaacauacucccaucug

SEQ ID NO: 2729135 - RNA, 21 nt, Human
accaacauacucccaucugug

SEQ ID NO: 2729136 - RNA, 22 nt, Human
accaacauacucccaucuguga

SEQ ID NO: 2729137 - RNA, 12 nt, Human
ucacauaucugu

SEQ ID NO: 2729138 - RNA, 15 nt, Human
ucacauaucugucau

SEQ ID NO: 2729139 - RNA, 17 nt, Human
ucacauaucuaguauga

SEQ ID NO: 2729140 - RNA, 21 nt, Human
ucacauaucuaguaugaaauu

SEQ ID NO: 2729141 - RNA, 22 nt, Human
ucacauaucuaguaugaaauua

SEQ ID NO: 2729142 - RNA, 15 nt, Human
ucacaguucucuccu

SEQ ID NO: 2729143 - RNA, 13 nt, Human
ucaccccagcccc

SEQ ID NO: 2729144 - RNA, 14 nt, Human
ucaccccagcccca

SEQ ID NO: 2729145 - RNA, 20 nt, Human
ucaccccagccccaaaacuc

SEQ ID NO: 2729146 - RNA, 15 nt, Human
ucaccccggccaccu

SEQ ID NO: 2729147 - RNA, 23 nt, Human
accauuucuugagguaaaagcau

SEQ ID NO: 2729148 - RNA, 10 nt, Human
acccacugcu

SEQ ID NO: 2729149 - RNA, 11 nt, Human
acccacugcuc

SEQ ID NO: 2729150 - RNA, 13 nt, Human
acccacugcucug

SEQ ID NO: 2729151 - RNA, 14 nt, Human
acccacugcucugg

SEQ ID NO: 2729152 - RNA, 15 nt, Human
acccacugcucuggu

SEQ ID NO: 2729153 - RNA, 11 nt, Human
acccacugcuu

SEQ ID NO: 2729154 - RNA, 19 nt, Human
accaugggauaaaugccau

SEQ ID NO: 2729155 - RNA, 22 nt, Human
accauggucggaaaacaugcua

SEQ ID NO: 2729156 - RNA, 21 nt, Human
ucacucuuauugcccacgcug

SEQ ID NO: 2729157 - RNA, 23 nt, Human
ucacucuuauugcccacgcugga

SEQ ID NO: 2729158 - RNA, 14 nt, Human
ucagaagacacuga

SEQ ID NO: 2729159 - RNA, 19 nt, Human
ucagaaguuucugccgcag

SEQ ID NO: 2729160 - RNA, 22 nt, Human
ucagaaguuucugccgcagccc

SEQ ID NO: 2729161 - RNA, 19 nt, Human
ucagaaucucaaauaacua

SEQ ID NO: 2729162 - RNA, 18 nt, Human
ucagaaucucaaauaacu

SEQ ID NO: 2729163 - RNA, 21 nt, Human
ucagagacuccugcaggcagc

SEQ ID NO: 2729164 - RNA, 16 nt, Human
ucagagacuccugcag

SEQ ID NO: 2729165 - RNA, 17 nt, Human
ucagagacuccugcagg

SEQ ID NO: 2729166 - RNA, 20 nt, Human
ucagagacuccugcaggcag

SEQ ID NO: 2729167 - RNA, 12 nt, Human
ucagagccugca

SEQ ID NO: 2729168 - RNA, 23 nt, Human
ucagagagggugggagugggccc

SEQ ID NO: 2729169 - RNA, 16 nt, Human
ucagagagggugggag

SEQ ID NO: 2729170 - RNA, 21 nt, Human
ucagagagggugggagugggc

SEQ ID NO: 2729171 - RNA, 13 nt, Human
ucagagccugcag

SEQ ID NO: 2729172 - RNA, 14 nt, Human
ucagagccugcagu

SEQ ID NO: 2729173 - RNA, 15 nt, Human
ucagagccugcaguu

SEQ ID NO: 2729174 - RNA, 18 nt, Human
ucagagccugcaguuauu

SEQ ID NO: 2729175 - RNA, 12 nt, Human
ucagagcugccc

SEQ ID NO: 2729176 - RNA, 22 nt, Human
ucagccaagaauucuuaaauau

SEQ ID NO: 2729177 - RNA, 23 nt, Human
ucagccguguaaccauggaccca

SEQ ID NO: 2729178 - RNA, 19 nt, Human
acccagcgagcccuggugg

SEQ ID NO: 2729179 - RNA, 23 nt, Human
acccagcgagcccugguggcagu

SEQ ID NO: 2729180 - RNA, 24 nt, Human
acccagcgagcccugguggcagug

SEQ ID NO: 2729181 - RNA, 13 nt, Human
ucaggaaagagaa

SEQ ID NO: 2729182 - RNA, 19 nt, Human
ucaggaaagagaacuucca

SEQ ID NO: 2729183 - RNA, 21 nt, Human
ucaggaaaucaaauaugcaaa

SEQ ID NO: 2729184 - RNA, 20 nt, Human
ucaggaaaucaaauaugcaa

SEQ ID NO: 2729185 - RNA, 14 nt, Human
ucagcggggacagc

SEQ ID NO: 2729186 - RNA, 20 nt, Human
ucagcuuguaaauagcucag

SEQ ID NO: 2729187 - RNA, 16 nt, Human
accccuucgcuccugu

SEQ ID NO: 2729188 - RNA, 14 nt, Human
accccuucgcuccu

SEQ ID NO: 2729189 - RNA, 15 nt, Human
accccuucgcuccug

SEQ ID NO: 2729190 - RNA, 12 nt, Human
acccccacccaa

SEQ ID NO: 2729191 - RNA, 22 nt, Human
acgccagauucuuuccugaggc

SEQ ID NO: 2729192 - RNA, 23 nt, Human
acgccagauucuuuccugaggcu

SEQ ID NO: 2729193 - RNA, 18 nt, Human
uccauuuaauaauuauau

SEQ ID NO: 2729194 - RNA, 16 nt, Human
ucccaaagcagugcau

SEQ ID NO: 2729195 - RNA, 18 nt, Human
ucccaaacccuucagugc

SEQ ID NO: 2729196 - RNA, 13 nt, Human
ucccaaagugcug

SEQ ID NO: 2729197 - RNA, 14 nt, Human
ucccaaagugcugg

SEQ ID NO: 2729198 - RNA, 21 nt, Human
ucccaaagcagugcaugcugu

SEQ ID NO: 2729199 - RNA, 17 nt, Human
ucccaaagcagugcaug

SEQ ID NO: 2729200 - RNA, 18 nt, Human
ucccaaagcagugcaugc

SEQ ID NO: 2729201 - RNA, 20 nt, Human
acgggaggguaaggcugugg

SEQ ID NO: 2729202 - RNA, 16 nt, Human
ucccacaaaggagagc

SEQ ID NO: 2729203 - RNA, 15 nt, Human
ucccaccccacacac

SEQ ID NO: 2729204 - RNA, 20 nt, Human
ucccaccccacacacgccag

SEQ ID NO: 2729205 - RNA, 20 nt, Human
acgugggcauucaaauguau

SEQ ID NO: 2729206 - RNA, 17 nt, Human
acgugggcauucaaaug

SEQ ID NO: 2729207 - RNA, 23 nt, Human
acguggcugcuucaaggauccug

SEQ ID NO: 2729208 - RNA, 15 nt, Human
acgguuuuacugcag

SEQ ID NO: 2729209 - RNA, 17 nt, Human
acgguuuuacugcagcu

SEQ ID NO: 2729210 - RNA, 22 nt, Human
ucccagucauuuaauaaaugug

SEQ ID NO: 2729211 - RNA, 14 nt, Human
ucccagucauuuaa

SEQ ID NO: 2729212 - RNA, 22 nt, Human
ucccauaugccugggcagaagg

SEQ ID NO: 2729213 - RNA, 16 nt, Human
ucccauaugccugggc

SEQ ID NO: 2729214 - RNA, 15 nt, Human
ucccaucacccgcua

SEQ ID NO: 2729215 - RNA, 15 nt, Human
acuacauucuguuaa

SEQ ID NO: 2729216 - RNA, 17 nt, Human
uccccaccgcagacagg

SEQ ID NO: 2729217 - RNA, 18 nt, Human
uccccaccgcagacagga

SEQ ID NO: 2729218 - RNA, 21 nt, Human
uccccaccgcagacaggacca

SEQ ID NO: 2729219 - RNA, 22 nt, Human
uccccaccgcagacaggaccag

SEQ ID NO: 2729220 - RNA, 17 nt, Human
ucccagccagcaguuca

SEQ ID NO: 2729221 - RNA, 18 nt, Human
ucccagccagcaguucag

SEQ ID NO: 2729222 - RNA, 12 nt, Human
ucccagccccaa

SEQ ID NO: 2729223 - RNA, 17 nt, Human
ucccagcugugcucugg

SEQ ID NO: 2729224 - RNA, 14 nt, Human
acuacauucuguua

SEQ ID NO: 2729225 - RNA, 13 nt, Human
acuacauucuguu

SEQ ID NO: 2729226 - RNA, 12 nt, Human
acuacauucugu

SEQ ID NO: 2729227 - RNA, 11 nt, Human
acuacauucug

SEQ ID NO: 2729228 - RNA, 15 nt, Human
acuacaguuuguuag

SEQ ID NO: 2729229 - RNA, 11 nt, Human
acuacaggcac

SEQ ID NO: 2729230 - RNA, 15 nt, Human
acuacaggcacccac

SEQ ID NO: 2729231 - RNA, 17 nt, Human
acuacaguccucccauc

SEQ ID NO: 2729232 - RNA, 14 nt, Human
acuacaguuuguua

SEQ ID NO: 2729233 - RNA, 13 nt, Human
acuacaguuuguu

SEQ ID NO: 2729234 - RNA, 12 nt, Human
acuaaccacgcu

SEQ ID NO: 2729235 - RNA, 16 nt, Human
uccccucggagaagag

SEQ ID NO: 2729236 - RNA, 17 nt, Human
uccccucggagaagagc

SEQ ID NO: 2729237 - RNA, 20 nt, Human
ucccgaauagcugggacuac

SEQ ID NO: 2729238 - RNA, 15 nt, Human
ucccgaguagcuggg

SEQ ID NO: 2729239 - RNA, 18 nt, Human
ucccgaguagcugggacu

SEQ ID NO: 2729240 - RNA, 16 nt, Human
ucccgaguagcuggga

SEQ ID NO: 2729241 - RNA, 17 nt, Human
ucccgaguagcugggac

SEQ ID NO: 2729242 - RNA, 17 nt, Human
acuacucccccaggugg

SEQ ID NO: 2729243 - RNA, 12 nt, Human
acucaccccagc

SEQ ID NO: 2729244 - RNA, 21 nt, Human
acucacauuuauucugcucac

SEQ ID NO: 2729245 - RNA, 13 nt, Human
ucccucccuccac

SEQ ID NO: 2729246 - RNA, 14 nt, Human
ucccucccuccacc

SEQ ID NO: 2729247 - RNA, 21 nt, Human
ucccuccaccucccugcaaua

SEQ ID NO: 2729248 - RNA, 23 nt, Human
ucccuccaccucccugcaauaaa

SEQ ID NO: 2729249 - RNA, 15 nt, Human
ucccucccuccaccu

SEQ ID NO: 2729250 - RNA, 16 nt, Human
ucccucccuccaccuc

SEQ ID NO: 2729251 - RNA, 14 nt, Human
ucccucuuucccuc

SEQ ID NO: 2729252 - RNA, 20 nt, Human
ucccucuuucccucccuucc

SEQ ID NO: 2729253 - RNA, 18 nt, Human
ucccucuuucccucccuu

SEQ ID NO: 2729254 - RNA, 21 nt, Human
ucccucuuucccucccuuccu

SEQ ID NO: 2729255 - RNA, 11 nt, Human
ucccugaaggc

SEQ ID NO: 2729256 - RNA, 15 nt, Human
ucccugaaggccccg

SEQ ID NO: 2729257 - RNA, 11 nt, Human
ucccugagcag

SEQ ID NO: 2729258 - RNA, 16 nt, Human
ucccugaaggccccgc

SEQ ID NO: 2729259 - RNA, 14 nt, Human
acuccaaagaaaug

SEQ ID NO: 2729260 - RNA, 15 nt, Human
acucauugaccugag

SEQ ID NO: 2729261 - RNA, 18 nt, Human
acuccaaagaaauguaag

SEQ ID NO: 2729262 - RNA, 15 nt, Human
acuccaaagaaaugu

SEQ ID NO: 2729263 - RNA, 21 nt, Human
acuccaaagaaauguaaggga

SEQ ID NO: 2729264 - RNA, 18 nt, Human
acuccagaaagugacaag

SEQ ID NO: 2729265 - RNA, 15 nt, Human
acuccagaauuuccc

SEQ ID NO: 2729266 - RNA, 17 nt, Human
acuccagaauuucccaa

SEQ ID NO: 2729267 - RNA, 15 nt, Human
acucauucuucugua

SEQ ID NO: 2729268 - RNA, 14 nt, Human
acucauugaccuga

SEQ ID NO: 2729269 - RNA, 18 nt, Human
acuccugcaggcagccag

SEQ ID NO: 2729270 - RNA, 19 nt, Human
acuccugcaggcagccagg

SEQ ID NO: 2729271 - RNA, 17 nt, Human
acuccugcaggcagcca

SEQ ID NO: 2729272 - RNA, 23 nt, Human
acuccagaauuucccaaagcagu

SEQ ID NO: 2729273 - RNA, 12 nt, Human
acuccagccugg

SEQ ID NO: 2729274 - RNA, 13 nt, Human
acuccagccuggg

SEQ ID NO: 2729275 - RNA, 12 nt, Human
ucccuuuuccuu

SEQ ID NO: 2729276 - RNA, 19 nt, Human
ucccuuucugcuuguguua

SEQ ID NO: 2729277 - RNA, 17 nt, Human
uccggucccugucccag

SEQ ID NO: 2729278 - RNA, 16 nt, Human
uccuagaaauucccca

SEQ ID NO: 2729279 - RNA, 17 nt, Human
ucccuuacgugaguccu

SEQ ID NO: 2729280 - RNA, 12 nt, Human
ucccugucccag

SEQ ID NO: 2729281 - RNA, 15 nt, Human
ucccugguggcagcu

SEQ ID NO: 2729282 - RNA, 21 nt, Human
acuccugcaggcagccaggcc

SEQ ID NO: 2729283 - RNA, 12 nt, Human
ucauucuucugu

SEQ ID NO: 2729284 - RNA, 12 nt, Human
ucauugaaaucu

SEQ ID NO: 2729285 - RNA, 13 nt, Human
ucauugaaaucuu

SEQ ID NO: 2729286 - RNA, 22 nt, Human
ucauugaaaucuuuuugcuuug

SEQ ID NO: 2729287 - RNA, 12 nt, Human
ucauugaccuga

SEQ ID NO: 2729288 - RNA, 14 nt, Human
ucauugaccugagg

SEQ ID NO: 2729289 - RNA, 15 nt, Human
ucauugaccugaggc

SEQ ID NO: 2729290 - RNA, 13 nt, Human
accuccugggcua

SEQ ID NO: 2729291 - RNA, 19 nt, Human
accucggugccuuccucuu

SEQ ID NO: 2729292 - RNA, 14 nt, Human
accugaggcccuuc

SEQ ID NO: 2729293 - RNA, 14 nt, Human
accucuaaauucuu

SEQ ID NO: 2729294 - RNA, 14 nt, Human
accugauugugucu

SEQ ID NO: 2729295 - RNA, 15 nt, Human
accugauugugucuc

SEQ ID NO: 2729296 - RNA, 17 nt, Human
accugauugugucucuu

SEQ ID NO: 2729297 - RNA, 18 nt, Human
accugauugugucucuug

SEQ ID NO: 2729298 - RNA, 22 nt, Human
accugaggcccuucucuccagc

SEQ ID NO: 2729299 - RNA, 15 nt, Human
accugaggcccuucu

SEQ ID NO: 2729300 - RNA, 16 nt, Human
accugaggcccuucuc

SEQ ID NO: 2729301 - RNA, 20 nt, Human
accugaggcccuucucucca

SEQ ID NO: 2729302 - RNA, 21 nt, Human
accugaggcccuucucuccag

SEQ ID NO: 2729303 - RNA, 21 nt, Human
accuagggugauauuaaccag

SEQ ID NO: 2729304 - RNA, 19 nt, Human
accucaaaaugucuaagau

SEQ ID NO: 2729305 - RNA, 23 nt, Human
ucaggaaaucaaauaugcaaagc

SEQ ID NO: 2729306 - RNA, 22 nt, Human
ucaggaaaucaaauaugcaaag

SEQ ID NO: 2729307 - RNA, 12 nt, Human
ucaggaagcuca

SEQ ID NO: 2729308 - RNA, 15 nt, Human
ucaggaagcucaggg

SEQ ID NO: 2729309 - RNA, 13 nt, Human
ucaggaagcucag

SEQ ID NO: 2729310 - RNA, 14 nt, Human
ucaggaagcucagg

SEQ ID NO: 2729311 - RNA, 16 nt, Human
ucaugaauuaguuuua

SEQ ID NO: 2729312 - RNA, 22 nt, Human
ucauccuucuggaauaaggaga

SEQ ID NO: 2729313 - RNA, 14 nt, Human
ucauccuucuggaa

SEQ ID NO: 2729314 - RNA, 18 nt, Human
ucauccucauacccaccc

SEQ ID NO: 2729315 - RNA, 13 nt, Human
ucauccuccucag

SEQ ID NO: 2729316 - RNA, 19 nt, Human
ucauccuccucagaucuuc

SEQ ID NO: 2729317 - RNA, 12 nt, Human
accucccugcaa

SEQ ID NO: 2729318 - RNA, 13 nt, Human
accucccugcaau

SEQ ID NO: 2729319 - RNA, 13 nt, Human
accuccugccucg

SEQ ID NO: 2729320 - RNA, 12 nt, Human
accuccugccuc

SEQ ID NO: 2729321 - RNA, 23 nt, Human
accuccugccucgaacuggcugc

SEQ ID NO: 2729322 - RNA, 15 nt, Human
ucauccuaagcuauu

SEQ ID NO: 2729323 - RNA, 14 nt, Human
acgagaaaacaaua

SEQ ID NO: 2729324 - RNA, 22 nt, Human
accuuuuuuauacauaaacaag

SEQ ID NO: 2729325 - RNA, 21 nt, Human
accuuuuuuauacauaaacaa

SEQ ID NO: 2729326 - RNA, 21 nt, Human
uccaggcuguaucccaugagc

SEQ ID NO: 2729327 - RNA, 20 nt, Human
accuuuuuuauacauaaaca

SEQ ID NO: 2729328 - RNA, 19 nt, Human
accuuuuuuauacauaaac

SEQ ID NO: 2729329 - RNA, 20 nt, Human
acgagcaggcuacugucagc

SEQ ID NO: 2729330 - RNA, 19 nt, Human
acgagcaggcuacugucag

SEQ ID NO: 2729331 - RNA, 16 nt, Human
acgagcaggcuucuuc

SEQ ID NO: 2729332 - RNA, 19 nt, Human
acgccagauucuuuccuga

SEQ ID NO: 2729333 - RNA, 17 nt, Human
acgccagauucuuuccu

SEQ ID NO: 2729334 - RNA, 13 nt, Human
uccagccccugga

SEQ ID NO: 2729335 - RNA, 12 nt, Human
uccagccccugg

SEQ ID NO: 2729336 - RNA, 14 nt, Human
uccaggcuguaucc

SEQ ID NO: 2729337 - RNA, 19 nt, Human
uccagacccggcugcgugg

SEQ ID NO: 2729338 - RNA, 15 nt, Human
uccagacccggcugc

SEQ ID NO: 2729339 - RNA, 18 nt, Human
uccagacccggcugcgug

SEQ ID NO: 2729340 - RNA, 14 nt, Human
uccagacccggcug

SEQ ID NO: 2729341 - RNA, 20 nt, Human
uccagaauuucccaaagcag

SEQ ID NO: 2729342 - RNA, 22 nt, Human
uccagaauuucccaaagcagug

SEQ ID NO: 2729343 - RNA, 16 nt, Human
uccagaauuucccaaa

SEQ ID NO: 2729344 - RNA, 14 nt, Human
accuuuugagugcc

SEQ ID NO: 2729345 - RNA, 17 nt, Human
accuuuugagugccuua

SEQ ID NO: 2729346 - RNA, 20 nt, Human
accuuuugagugccuuacac

SEQ ID NO: 2729347 - RNA, 21 nt, Human
uccaacuaucucauuuccaag

SEQ ID NO: 2729348 - RNA, 12 nt, Human
uccaagaagccc

SEQ ID NO: 2729349 - RNA, 16 nt, Human
uccaagcuggucccac

SEQ ID NO: 2729350 - RNA, 20 nt, Human
uccaagcuggucccacucag

SEQ ID NO: 2729351 - RNA, 21 nt, Human
uccaagcuggucccacucagu

SEQ ID NO: 2729352 - RNA, 18 nt, Human
uccaaggguacuaaggaa

SEQ ID NO: 2729353 - RNA, 23 nt, Human
uccaacccucaucaccaacgucu

SEQ ID NO: 2729354 - RNA, 16 nt, Human
uccaacccucaucacc

SEQ ID NO: 2729355 - RNA, 17 nt, Human
uccaacccucaucacca

SEQ ID NO: 2729356 - RNA, 14 nt, Human
uccaacccucauca

SEQ ID NO: 2729357 - RNA, 12 nt, Human
accugccaggaa

SEQ ID NO: 2729358 - RNA, 14 nt, Human
accugccaggaagc

SEQ ID NO: 2729359 - RNA, 15 nt, Human
accugccaggaagcc

SEQ ID NO: 2729360 - RNA, 14 nt, Human
accuggccucugca

SEQ ID NO: 2729361 - RNA, 16 nt, Human
accuggccucugcacu

SEQ ID NO: 2729362 - RNA, 17 nt, Human
accuggccucugcacuc

SEQ ID NO: 2729363 - RNA, 17 nt, Human
uccacccaccucagccu

SEQ ID NO: 2729364 - RNA, 18 nt, Human
uccacccaccucagccuc

SEQ ID NO: 2729365 - RNA, 19 nt, Human
uccacccaccucagccucc

SEQ ID NO: 2729366 - RNA, 12 nt, Human
uccacccaggag

SEQ ID NO: 2729367 - RNA, 14 nt, Human
uccacccaggagcc

SEQ ID NO: 2729368 - RNA, 15 nt, Human
uccacccaggagccc

SEQ ID NO: 2729369 - RNA, 23 nt, Human
accuggccucugcacuccccugc

SEQ ID NO: 2729370 - RNA, 18 nt, Human
accuggccucugcacucc

SEQ ID NO: 2729371 - RNA, 20 nt, Human
accuggccucugcacucccc

SEQ ID NO: 2729372 - RNA, 19 nt, Human
accuguuucugcagccacu

SEQ ID NO: 2729373 - RNA, 18 nt, Human
accuuagacagucccugc

SEQ ID NO: 2729374 - RNA, 19 nt, Human
accuuagacagucccugcc

SEQ ID NO: 2729375 - RNA, 20 nt, Human
accuuagacagucccugcca

SEQ ID NO: 2729376 - RNA, 15 nt, Human
ucgagcaugccugga

SEQ ID NO: 2729377 - RNA, 18 nt, Human
ucgagcaugccuggaugg

SEQ ID NO: 2729378 - RNA, 16 nt, Human
ucgagcaugccuggau

SEQ ID NO: 2729379 - RNA, 19 nt, Human
ucgcgacaaugcaaaccau

SEQ ID NO: 2729380 - RNA, 16 nt, Human
ucgcgacaaugcaaac

SEQ ID NO: 2729381 - RNA, 22 nt, Human
uccuuuagcgcccaguugggug

SEQ ID NO: 2729382 - RNA, 23 nt, Human
uccuuuagcgcccaguugggugg

SEQ ID NO: 2729383 - RNA, 15 nt, Human
uccuuuagcgcccag

SEQ ID NO: 2729384 - RNA, 19 nt, Human
uccuuuagcgcccaguugg

SEQ ID NO: 2729385 - RNA, 23 nt, Human
uccuuguguuacuaaguuuuuau

SEQ ID NO: 2729386 - RNA, 14 nt, Human
uccuuguguuacua

SEQ ID NO: 2729387 - RNA, 14 nt, Human
uccuucagugccuu

SEQ ID NO: 2729388 - RNA, 15 nt, Human
uccuucagugccuua

SEQ ID NO: 2729389 - RNA, 16 nt, Human
uccuucagugccuuau

SEQ ID NO: 2729390 - RNA, 17 nt, Human
uccuucagugccuuaug

SEQ ID NO: 2729391 - RNA, 14 nt, Human
acugcauuauauuu

SEQ ID NO: 2729392 - RNA, 15 nt, Human
acugcauuauauuua

SEQ ID NO: 2729393 - RNA, 20 nt, Human
acugcaucaagaugugacau

SEQ ID NO: 2729394 - RNA, 22 nt, Human
acugcaucaagaugugacaugu

SEQ ID NO: 2729395 - RNA, 16 nt, Human
acugcauguuugugau

SEQ ID NO: 2729396 - RNA, 15 nt, Human
acugcauguuuguga

SEQ ID NO: 2729397 - RNA, 21 nt, Human
uccuagaaauuccccacccug

SEQ ID NO: 2729398 - RNA, 22 nt, Human
uccuagaaauuccccacccuga

SEQ ID NO: 2729399 - RNA, 16 nt, Human
acugcauaugaaagga

SEQ ID NO: 2729400 - RNA, 13 nt, Human
acugccuucucaa

SEQ ID NO: 2729401 - RNA, 19 nt, Human
acugccuucucaacuccaa

SEQ ID NO: 2729402 - RNA, 18 nt, Human
acugcuuaacuucacaua

SEQ ID NO: 2729403 - RNA, 20 nt, Human
acuggcacaguuuucugaga

SEQ ID NO: 2729404 - RNA, 19 nt, Human
acuggcacaguuuucugag

SEQ ID NO: 2729405 - RNA, 13 nt, Human
acuggcacaguuu

SEQ ID NO: 2729406 - RNA, 15 nt, Human
acuggauuaaacuua

SEQ ID NO: 2729407 - RNA, 21 nt, Human
acugcuugugaaaggaaagag

SEQ ID NO: 2729408 - RNA, 17 nt, Human
acugcuuccagugaggc

SEQ ID NO: 2729409 - RNA, 20 nt, Human
acugcuuaacuucacauauu

SEQ ID NO: 2729410 - RNA, 20 nt, Human
ucuaaagccauuguaguccu

SEQ ID NO: 2729411 - RNA, 13 nt, Human
ucuaaagcugcca

SEQ ID NO: 2729412 - RNA, 14 nt, Human
ucuaaagcugccag

SEQ ID NO: 2729413 - RNA, 16 nt, Human
ucuaaagcugccagcc

SEQ ID NO: 2729414 - RNA, 15 nt, Human
ucuaaagcugccagc

SEQ ID NO: 2729415 - RNA, 22 nt, Human
ucuaaguaaaaccacagcaguu

SEQ ID NO: 2729416 - RNA, 21 nt, Human
ucuaaguaaaaccacagcagu

SEQ ID NO: 2729417 - RNA, 20 nt, Human
ucuaaguaaaaccacagcag

SEQ ID NO: 2729418 - RNA, 16 nt, Human
ucuacauacuauggaa

SEQ ID NO: 2729419 - RNA, 17 nt, Human
ucuacauaaguaauuca

SEQ ID NO: 2729420 - RNA, 20 nt, Human
ucuacauaaguaauucaaga

SEQ ID NO: 2729421 - RNA, 23 nt, Human
ucuaaguaaaaccacagcaguug

SEQ ID NO: 2729422 - RNA, 19 nt, Human
acuguucucugcccuccaa

SEQ ID NO: 2729423 - RNA, 21 nt, Human
acuguucucugcccuccaaga

SEQ ID NO: 2729424 - RNA, 15 nt, Human
acuguucucugcccu

SEQ ID NO: 2729425 - RNA, 20 nt, Human
acuguucucugcccuccaag

SEQ ID NO: 2729426 - RNA, 14 nt, Human
acuguucucugccc

SEQ ID NO: 2729427 - RNA, 22 nt, Human
ucuacauaaguaauucaagaaa

SEQ ID NO: 2729428 - RNA, 15 nt, Human
acuuaaauaauguga

SEQ ID NO: 2729429 - RNA, 16 nt, Human
acuuaaauaaugugaa

SEQ ID NO: 2729430 - RNA, 18 nt, Human
acuuaaauaaugugaaac

SEQ ID NO: 2729431 - RNA, 17 nt, Human
acuuaaauaaugugaaa

SEQ ID NO: 2729432 - RNA, 17 nt, Human
acuguugcccaggcugg

SEQ ID NO: 2729433 - RNA, 18 nt, Human
acuguugcccaggcuggc

SEQ ID NO: 2729434 - RNA, 12 nt, Human
acuguugcccag

SEQ ID NO: 2729435 - RNA, 13 nt, Human
acuguugcccagg

SEQ ID NO: 2729436 - RNA, 14 nt, Human
acuguugcccaggc

SEQ ID NO: 2729437 - RNA, 13 nt, Human
acuuaaucuaaau

SEQ ID NO: 2729438 - RNA, 16 nt, Human
acuuaaucuaaaugga

SEQ ID NO: 2729439 - RNA, 15 nt, Human
acuuaaucuaaaugg

SEQ ID NO: 2729440 - RNA, 18 nt, Human
acugggacaggggagaac

SEQ ID NO: 2729441 - RNA, 21 nt, Human
acugucagcuccccucggaga

SEQ ID NO: 2729442 - RNA, 18 nt, Human
acuguccuacccacccuc

SEQ ID NO: 2729443 - RNA, 23 nt, Human
acuguccuacccacccuccuuuc

SEQ ID NO: 2729444 - RNA, 17 nt, Human
acuguccuacccacccu

SEQ ID NO: 2729445 - RNA, 18 nt, Human
acuguggguagacacaca

SEQ ID NO: 2729446 - RNA, 12 nt, Human
acuguggugacu

SEQ ID NO: 2729447 - RNA, 15 nt, Human
acuguggugacuuug

SEQ ID NO: 2729448 - RNA, 14 nt, Human
acuguggugacuuu

SEQ ID NO: 2729449 - RNA, 21 nt, Human
acuguggugacuuuggauaau

SEQ ID NO: 2729450 - RNA, 20 nt, Human
acuguggugacuuuggauaa

SEQ ID NO: 2729451 - RNA, 18 nt, Human
acuguggugacuuuggau

SEQ ID NO: 2729452 - RNA, 22 nt, Human
ucggguuuuauuguuuaaaauc

SEQ ID NO: 2729453 - RNA, 11 nt, Human
ucgggcaugac

SEQ ID NO: 2729454 - RNA, 12 nt, Human
ucgggcaugaca

SEQ ID NO: 2729455 - RNA, 17 nt, Human
ucgggaggucgaggcag

SEQ ID NO: 2729456 - RNA, 19 nt, Human
ucgggaggucgaggcagga

SEQ ID NO: 2729457 - RNA, 21 nt, Human
ucgggaggucgaggcaggagg

SEQ ID NO: 2729458 - RNA, 12 nt, Human
ucugaagaagau

SEQ ID NO: 2729459 - RNA, 19 nt, Human
ucugaagucagaucugccu

SEQ ID NO: 2729460 - RNA, 15 nt, Human
ucugaagucagaucu

SEQ ID NO: 2729461 - RNA, 20 nt, Human
agaaauaucugaaaauguau

SEQ ID NO: 2729462 - RNA, 17 nt, Human
agaaaucaaagagagaa

SEQ ID NO: 2729463 - RNA, 19 nt, Human
agaaauaucugaaaaugua

SEQ ID NO: 2729464 - RNA, 14 nt, Human
agaaauauaauuga

SEQ ID NO: 2729465 - RNA, 13 nt, Human
ucugauacagaaa

SEQ ID NO: 2729466 - RNA, 18 nt, Human
ucugauucccaagcucug

SEQ ID NO: 2729467 - RNA, 18 nt, Human
ucugcacuccccugcugg

SEQ ID NO: 2729468 - RNA, 19 nt, Human
ucugcacuccccugcuggg

SEQ ID NO: 2729469 - RNA, 14 nt, Human
ucugacuaugacau

SEQ ID NO: 2729470 - RNA, 22 nt, Human
ucugagacucgcgacaaugcaa

SEQ ID NO: 2729471 - RNA, 16 nt, Human
ucugacuaugacauaa

SEQ ID NO: 2729472 - RNA, 23 nt, Human
ucugagacucgcgacaaugcaaa

SEQ ID NO: 2729473 - RNA, 20 nt, Human
ucugcacuccccugcugggu

SEQ ID NO: 2729474 - RNA, 18 nt, Human
ucugcagcaauaaagcag

SEQ ID NO: 2729475 - RNA, 17 nt, Human
ucucuugagccugggag

SEQ ID NO: 2729476 - RNA, 18 nt, Human
ucucuugagccugggagg

SEQ ID NO: 2729477 - RNA, 14 nt, Human
ucucuugauucaua

SEQ ID NO: 2729478 - RNA, 16 nt, Human
ucucuugauucauaau

SEQ ID NO: 2729479 - RNA, 13 nt, Human
agaaaaagaaaaa

SEQ ID NO: 2729480 - RNA, 20 nt, Human
ucucuuuaaugucacaggca

SEQ ID NO: 2729481 - RNA, 21 nt, Human
ucucuuuaaugucacaggcag

SEQ ID NO: 2729482 - RNA, 17 nt, Human
agaaaaaggaugcacag

SEQ ID NO: 2729483 - RNA, 17 nt, Human
ucucuccuguaccucuu

SEQ ID NO: 2729484 - RNA, 16 nt, Human
ucucuccuguaccucu

SEQ ID NO: 2729485 - RNA, 14 nt, Human
ucucuccuguaccu

SEQ ID NO: 2729486 - RNA, 11 nt, Human
ucucugcccuc

SEQ ID NO: 2729487 - RNA, 15 nt, Human
ucucugcccuccaag

SEQ ID NO: 2729488 - RNA, 16 nt, Human
ucucugcccuccaaga

SEQ ID NO: 2729489 - RNA, 17 nt, Human
ucucugcccuccaagac

SEQ ID NO: 2729490 - RNA, 17 nt, Human
ucucucacuuguuuuau

SEQ ID NO: 2729491 - RNA, 13 nt, Human
ucucucacuccuu

SEQ ID NO: 2729492 - RNA, 15 nt, Human
ucucucacuccuuga

SEQ ID NO: 2729493 - RNA, 18 nt, Human
acuuugaccucugcagca

SEQ ID NO: 2729494 - RNA, 16 nt, Human
acuuugaccucugcag

SEQ ID NO: 2729495 - RNA, 15 nt, Human
acuuugaccucugca

SEQ ID NO: 2729496 - RNA, 17 nt, Human
ucucuccagccccugga

SEQ ID NO: 2729497 - RNA, 16 nt, Human
ucucuccagccccugg

SEQ ID NO: 2729498 - RNA, 18 nt, Human
ucucuccagccccuggau

SEQ ID NO: 2729499 - RNA, 19 nt, Human
ucucuccagccccuggaug

SEQ ID NO: 2729500 - RNA, 15 nt, Human
acuucuccacccugc

SEQ ID NO: 2729501 - RNA, 16 nt, Human
acuucuccacccugcu

SEQ ID NO: 2729502 - RNA, 16 nt, Human
acuugaaauuugaauu

SEQ ID NO: 2729503 - RNA, 19 nt, Human
acuugaaauuugaauuuug

SEQ ID NO: 2729504 - RNA, 20 nt, Human
acuugaaauuugaauuuugu

SEQ ID NO: 2729505 - RNA, 19 nt, Human
acuugagcccagagugaac

SEQ ID NO: 2729506 - RNA, 16 nt, Human
acuugucaauaaaauc

SEQ ID NO: 2729507 - RNA, 16 nt, Human
acuuguggacacagcu

SEQ ID NO: 2729508 - RNA, 17 nt, Human
acuuguggacacagcuc

SEQ ID NO: 2729509 - RNA, 18 nt, Human
acuuguggacacagcucu

SEQ ID NO: 2729510 - RNA, 23 nt, Human
acuucuaaguaaaaccacagcag

SEQ ID NO: 2729511 - RNA, 14 nt, Human
acuucuccacccug

SEQ ID NO: 2729512 - RNA, 22 nt, Human
acuucgggaggucgaggcagga

SEQ ID NO: 2729513 - RNA, 13 nt, Human
ucucacuccuuga

SEQ ID NO: 2729514 - RNA, 12 nt, Human
ucucacucuguc

SEQ ID NO: 2729515 - RNA, 11 nt, Human
acuucagcuga

SEQ ID NO: 2729516 - RNA, 16 nt, Human
acuucagcugacuuuu

SEQ ID NO: 2729517 - RNA, 23 nt, Human
ucucacacaugagcaucaggcca

SEQ ID NO: 2729518 - RNA, 11 nt, Human
ucucacuccuu

SEQ ID NO: 2729519 - RNA, 21 nt, Human
ucucacagcuccaagaauuuc

SEQ ID NO: 2729520 - RNA, 12 nt, Human
ucucaggaaauc

SEQ ID NO: 2729521 - RNA, 12 nt, Human
ucucagggccug

SEQ ID NO: 2729522 - RNA, 13 nt, Human
ucucagggccugg

SEQ ID NO: 2729523 - RNA, 15 nt, Human
acuuguggacacagc

SEQ ID NO: 2729524 - RNA, 19 nt, Human
ucucagggccuggucguuu

SEQ ID NO: 2729525 - RNA, 14 nt, Human
ucucagggccuggu

SEQ ID NO: 2729526 - RNA, 15 nt, Human
ucucagggccugguc

SEQ ID NO: 2729527 - RNA, 13 nt, Human
ucuccaaaauaaa

SEQ ID NO: 2729528 - RNA, 22 nt, Human
ucuccaaaauaaaacuuuuuaa

SEQ ID NO: 2729529 - RNA, 19 nt, Human
ucuccaaaauaaaacuuuu

SEQ ID NO: 2729530 - RNA, 17 nt, Human
ucuccaaaauaaaacuu

SEQ ID NO: 2729531 - RNA, 11 nt, Human
ucuccaggcug

SEQ ID NO: 2729532 - RNA, 16 nt, Human
ucuccaggcuguaucc

SEQ ID NO: 2729533 - RNA, 16 nt, Human
acuuguguuuugcaag

SEQ ID NO: 2729534 - RNA, 15 nt, Human
acuuguuagaucuag

SEQ ID NO: 2729535 - RNA, 14 nt, Human
acuuguuagaucua

SEQ ID NO: 2729536 - RNA, 23 nt, Human
acuuguuagaucuaguucacucu

SEQ ID NO: 2729537 - RNA, 21 nt, Human
ucuccuccuuuucacaguucu

SEQ ID NO: 2729538 - RNA, 16 nt, Human
acuuucuagccagagg

SEQ ID NO: 2729539 - RNA, 17 nt, Human
acuuucuagccagagga

SEQ ID NO: 2729540 - RNA, 14 nt, Human
acuuugaccucugc

SEQ ID NO: 2729541 - RNA, 16 nt, Human
ucuccauguuugaugu

SEQ ID NO: 2729542 - RNA, 16 nt, Human
agacacacugaagaag

SEQ ID NO: 2729543 - RNA, 17 nt, Human
agacacacugaagaagc

SEQ ID NO: 2729544 - RNA, 17 nt, Human
agacacaggcccggcuc

SEQ ID NO: 2729545 - RNA, 19 nt, Human
agacacaggcccggcucca

SEQ ID NO: 2729546 - RNA, 20 nt, Human
agacacaggcccggcuccag

SEQ ID NO: 2729547 - RNA, 21 nt, Human
agacacaggcccggcuccagg

SEQ ID NO: 2729548 - RNA, 22 nt, Human
agacacaggcccggcuccaggc

SEQ ID NO: 2729549 - RNA, 14 nt, Human
agacacaagccuuc

SEQ ID NO: 2729550 - RNA, 13 nt, Human
agacacaagccuu

SEQ ID NO: 2729551 - RNA, 19 nt, Human
agacacaacuauuuuucca

SEQ ID NO: 2729552 - RNA, 20 nt, Human
agacacaacuauuuuuccaa

SEQ ID NO: 2729553 - RNA, 17 nt, Human
agaauucucuuauccaa

SEQ ID NO: 2729554 - RNA, 19 nt, Human
agaauucucuaguuugauu

SEQ ID NO: 2729555 - RNA, 18 nt, Human
agaauucucuaguuugau

SEQ ID NO: 2729556 - RNA, 22 nt, Human
agacaccuugacagggcacacc

SEQ ID NO: 2729557 - RNA, 19 nt, Human
agacaccuugacagggcac

SEQ ID NO: 2729558 - RNA, 24 nt, Human
agacacauguccaagaagcccagg

SEQ ID NO: 2729559 - RNA, 23 nt, Human
agacacaggcccggcuccaggcu

SEQ ID NO: 2729560 - RNA, 21 nt, Human
agacacauguccaagaagccc

SEQ ID NO: 2729561 - RNA, 22 nt, Human
agacacauguccaagaagccca

SEQ ID NO: 2729562 - RNA, 13 nt, Human
agacagcugccug

SEQ ID NO: 2729563 - RNA, 14 nt, Human
agacagcugccugg

SEQ ID NO: 2729564 - RNA, 23 nt, Human
ucuuagaugcaguucugaagaag

SEQ ID NO: 2729565 - RNA, 12 nt, Human
ucuuagauguau

SEQ ID NO: 2729566 - RNA, 22 nt, Human
ucuuagaugcaguucugaagaa

SEQ ID NO: 2729567 - RNA, 13 nt, Human
agacagucccugc

SEQ ID NO: 2729568 - RNA, 14 nt, Human
agacagucccugcc

SEQ ID NO: 2729569 - RNA, 19 nt, Human
agacagucccugccaaugg

SEQ ID NO: 2729570 - RNA, 12 nt, Human
agacagucccug

SEQ ID NO: 2729571 - RNA, 15 nt, Human
agacagcugccuggg

SEQ ID NO: 2729572 - RNA, 16 nt, Human
agacagcugccuggga

SEQ ID NO: 2729573 - RNA, 23 nt, Human
ucuguuuagauaauacaccacua

SEQ ID NO: 2729574 - RNA, 19 nt, Human
ucuguuuagauaauacacc

SEQ ID NO: 2729575 - RNA, 16 nt, Human
ucuguuuagauaauac

SEQ ID NO: 2729576 - RNA, 22 nt, Human
ucugugaacuugaaauuugaau

SEQ ID NO: 2729577 - RNA, 19 nt, Human
ucugugaacuugaaauuug

SEQ ID NO: 2729578 - RNA, 13 nt, Human
ucuguacuuuuug

SEQ ID NO: 2729579 - RNA, 17 nt, Human
ucuguacuuuuuggcau

SEQ ID NO: 2729580 - RNA, 14 nt, Human
ucuguacuuuuugg

SEQ ID NO: 2729581 - RNA, 18 nt, Human
ucuguacgucugacaggc

SEQ ID NO: 2729582 - RNA, 20 nt, Human
agaauuauaauuaguuccuc

SEQ ID NO: 2729583 - RNA, 20 nt, Human
agaauucucagaaucucaaa

SEQ ID NO: 2729584 - RNA, 14 nt, Human
agaauucucuaguu

SEQ ID NO: 2729585 - RNA, 21 nt, Human
agaauguguuuaaacuugguu

SEQ ID NO: 2729586 - RNA, 23 nt, Human
agaaccccaggguccuguagccc

SEQ ID NO: 2729587 - RNA, 22 nt, Human
agagaaaaaauauuuuccugcc

SEQ ID NO: 2729588 - RNA, 19 nt, Human
agacuuuucuuucagccaa

SEQ ID NO: 2729589 - RNA, 20 nt, Human
agacucgcgacaaugcaaac

SEQ ID NO: 2729590 - RNA, 12 nt, Human
agacuggugacu

SEQ ID NO: 2729591 - RNA, 14 nt, Human
agacuggugacuga

SEQ ID NO: 2729592 - RNA, 13 nt, Human
agacuggugacug

SEQ ID NO: 2729593 - RNA, 16 nt, Human
agacuguacaaaguag

SEQ ID NO: 2729594 - RNA, 15 nt, Human
agacuguacaaagua

SEQ ID NO: 2729595 - RNA, 14 nt, Human
agacuguacaaagu

SEQ ID NO: 2729596 - RNA, 17 nt, Human
agacuggugacugauuc

SEQ ID NO: 2729597 - RNA, 16 nt, Human
agacuggugacugauu

SEQ ID NO: 2729598 - RNA, 14 nt, Human
ucuugguuuguaaa

SEQ ID NO: 2729599 - RNA, 22 nt, Human
ucuuuaaugucacaggcagguc

SEQ ID NO: 2729600 - RNA, 16 nt, Human
ucuugguuuguaaauu

SEQ ID NO: 2729601 - RNA, 20 nt, Human
ucuuuaaugucacaggcagg

SEQ ID NO: 2729602 - RNA, 15 nt, Human
agacucgcgacaaug

SEQ ID NO: 2729603 - RNA, 17 nt, Human
agacucgcgacaaugca

SEQ ID NO: 2729604 - RNA, 18 nt, Human
agacucgcgacaaugcaa

SEQ ID NO: 2729605 - RNA, 19 nt, Human
agacucgcgacaaugcaaa

SEQ ID NO: 2729606 - RNA, 18 nt, Human
ucuuucuggcuaugcauu

SEQ ID NO: 2729607 - RNA, 19 nt, Human
ucuuucuggcuaugcauuu

SEQ ID NO: 2729608 - RNA, 13 nt, Human
ucuuucugcuuug

SEQ ID NO: 2729609 - RNA, 20 nt, Human
ucuuuauaauucuacuuuga

SEQ ID NO: 2729610 - RNA, 15 nt, Human
ucuuauuucauuucu

SEQ ID NO: 2729611 - RNA, 17 nt, Human
ucuuauuuaaugaaaga

SEQ ID NO: 2729612 - RNA, 16 nt, Human
ucuuauuucauuucuu

SEQ ID NO: 2729613 - RNA, 22 nt, Human
ucuucugcuucagccucccgag

SEQ ID NO: 2729614 - RNA, 21 nt, Human
ucuucuguacgucugacaggc

SEQ ID NO: 2729615 - RNA, 22 nt, Human
ucuucuguacgucugacaggca

SEQ ID NO: 2729616 - RNA, 20 nt, Human
ucuucuguacgucugacagg

SEQ ID NO: 2729617 - RNA, 23 nt, Human
ucuucuguacgucugacaggcaa

SEQ ID NO: 2729618 - RNA, 23 nt, Human
agacauacuaaccagcagaaaug

SEQ ID NO: 2729619 - RNA, 23 nt, Human
agacuauucaaacagucucagga

SEQ ID NO: 2729620 - RNA, 19 nt, Human
ucuugagccuugaacuuug

SEQ ID NO: 2729621 - RNA, 18 nt, Human
ucuugagccuugaacuuu

SEQ ID NO: 2729622 - RNA, 15 nt, Human
agacucauucuucug

SEQ ID NO: 2729623 - RNA, 17 nt, Human
ucuugagccuugaacuu

SEQ ID NO: 2729624 - RNA, 14 nt, Human
agacccggcugcgu

SEQ ID NO: 2729625 - RNA, 16 nt, Human
agaguuuagcuggaaa

SEQ ID NO: 2729626 - RNA, 17 nt, Human
agaguuuagcuggaaaa

SEQ ID NO: 2729627 - RNA, 21 nt, Human
agaguuguuacauuuuuaagu

SEQ ID NO: 2729628 - RNA, 12 nt, Human
agaguuguuaca

SEQ ID NO: 2729629 - RNA, 17 nt, Human
agaguugauacuacagu

SEQ ID NO: 2729630 - RNA, 22 nt, Human
agaguugauacuacaguuuguu

SEQ ID NO: 2729631 - RNA, 20 nt, Human
agaguugauacuacaguuug

SEQ ID NO: 2729632 - RNA, 20 nt, Human
ugaaugguuuucaaaauaaa

SEQ ID NO: 2729633 - RNA, 19 nt, Human
ugaaugucagugugacuga

SEQ ID NO: 2729634 - RNA, 22 nt, Human
agagucagaaguuucugccgca

SEQ ID NO: 2729635 - RNA, 20 nt, Human
ugacacacagcucuguccug

SEQ ID NO: 2729636 - RNA, 23 nt, Human
ugaauuuauuggcuuuucugauc

SEQ ID NO: 2729637 - RNA, 22 nt, Human
ugaauuuauuggcuuuucugau

SEQ ID NO: 2729638 - RNA, 15 nt, Human
ugaauuucuuuugcc

SEQ ID NO: 2729639 - RNA, 16 nt, Human
ugaauuuuacauggcu

SEQ ID NO: 2729640 - RNA, 21 nt, Human
ugaauuuauuggcuuuucuga

SEQ ID NO: 2729641 - RNA, 17 nt, Human
ugaauuuauuggcuuuu

SEQ ID NO: 2729642 - RNA, 17 nt, Human
agaucacgccacugcac

SEQ ID NO: 2729643 - RNA, 18 nt, Human
agaucacgccacugcacu

SEQ ID NO: 2729644 - RNA, 14 nt, Human
agaucacgccacug

SEQ ID NO: 2729645 - RNA, 15 nt, Human
agaucacgccacugc

SEQ ID NO: 2729646 - RNA, 16 nt, Human
agaucacgccacugca

SEQ ID NO: 2729647 - RNA, 12 nt, Human
agauacugaaau

SEQ ID NO: 2729648 - RNA, 15 nt, Human
agauacugaaauaaa

SEQ ID NO: 2729649 - RNA, 13 nt, Human
agauacugaaaua

SEQ ID NO: 2729650 - RNA, 12 nt, Human
agauaaaugugc

SEQ ID NO: 2729651 - RNA, 18 nt, Human
agaugcaguucugaagaa

SEQ ID NO: 2729652 - RNA, 19 nt, Human
agaugcaguucugaagaag

SEQ ID NO: 2729653 - RNA, 17 nt, Human
agaugcaguucugaaga

SEQ ID NO: 2729654 - RNA, 14 nt, Human
agaugcaccagccc

SEQ ID NO: 2729655 - RNA, 15 nt, Human
agaugcaccagcccu

SEQ ID NO: 2729656 - RNA, 23 nt, Human
ugaccauucuccaccugccaggg

SEQ ID NO: 2729657 - RNA, 12 nt, Human
ugacccacugcu

SEQ ID NO: 2729658 - RNA, 13 nt, Human
ugacccacugcuu

SEQ ID NO: 2729659 - RNA, 15 nt, Human
agaugcuucucacug

SEQ ID NO: 2729660 - RNA, 13 nt, Human
agaucagccuggg

SEQ ID NO: 2729661 - RNA, 15 nt, Human
agaucagccugggca

SEQ ID NO: 2729662 - RNA, 18 nt, Human
ugacauaaaaacaacuuu

SEQ ID NO: 2729663 - RNA, 20 nt, Human
ugacauaaaaacaacuuuau

SEQ ID NO: 2729664 - RNA, 20 nt, Human
ugacauuguuggccaaagcc

SEQ ID NO: 2729665 - RNA, 21 nt, Human
ugacauuguuggccaaagcca

SEQ ID NO: 2729666 - RNA, 18 nt, Human
ugaccaaugauggucacc

SEQ ID NO: 2729667 - RNA, 17 nt, Human
ugacauaaaaacaacuu

SEQ ID NO: 2729668 - RNA, 20 nt, Human
ugacagggcacaccgggcac

SEQ ID NO: 2729669 - RNA, 11 nt, Human
ugacagggcac

SEQ ID NO: 2729670 - RNA, 16 nt, Human
ugacagggcacaccgg

SEQ ID NO: 2729671 - RNA, 20 nt, Human
ugacaggcaaugcuggcugu

SEQ ID NO: 2729672 - RNA, 21 nt, Human
ugacacacagcucuguccugg

SEQ ID NO: 2729673 - RNA, 12 nt, Human
agagguuuuaaa

SEQ ID NO: 2729674 - RNA, 22 nt, Human
ugaagcacagugaucaaguuau

SEQ ID NO: 2729675 - RNA, 24 nt, Human
agaggcagccccauucugccugcc

SEQ ID NO: 2729676 - RNA, 13 nt, Human
agaggcagcccca

SEQ ID NO: 2729677 - RNA, 19 nt, Human
agaggcagccccauucugc

SEQ ID NO: 2729678 - RNA, 19 nt, Human
agaggccaugggccuccug

SEQ ID NO: 2729679 - RNA, 17 nt, Human
agaggcuaugugagcac

SEQ ID NO: 2729680 - RNA, 10 nt, Human
agaggcaggg

SEQ ID NO: 2729681 - RNA, 13 nt, Human
agaggcagggucu

SEQ ID NO: 2729682 - RNA, 21 nt, Human
agagcuguucacagccagacu

SEQ ID NO: 2729683 - RNA, 19 nt, Human
agagcuguucacagccaga

SEQ ID NO: 2729684 - RNA, 22 nt, Human
agagcugcccucuccugggcag

SEQ ID NO: 2729685 - RNA, 22 nt, Human
ugaacuuugaccucugcagcaa

SEQ ID NO: 2729686 - RNA, 17 nt, Human
ugaacuuugaccucugc

SEQ ID NO: 2729687 - RNA, 20 nt, Human
ugaacuuugaccucugcagc

SEQ ID NO: 2729688 - RNA, 19 nt, Human
ugaacuuugaccucugcag

SEQ ID NO: 2729689 - RNA, 23 nt, Human
ugaacuagaguuuagcuggaaaa

SEQ ID NO: 2729690 - RNA, 14 nt, Human
ugaacuccuggccu

SEQ ID NO: 2729691 - RNA, 15 nt, Human
ugaacuccuggccuc

SEQ ID NO: 2729692 - RNA, 12 nt, Human
ugaacuccuggc

SEQ ID NO: 2729693 - RNA, 15 nt, Human
ugaaauuuuuauuaa

SEQ ID NO: 2729694 - RNA, 22 nt, Human
ugaaccgaugagaaauaaaguu

SEQ ID NO: 2729695 - RNA, 18 nt, Human
ugaaauauuauguuaaaa

SEQ ID NO: 2729696 - RNA, 15 nt, Human
ugaaauuguauuaca

SEQ ID NO: 2729697 - RNA, 17 nt, Human
ugaaauuugaauuuugu

SEQ ID NO: 2729698 - RNA, 14 nt, Human
ugaaauuugaauuu

SEQ ID NO: 2729699 - RNA, 16 nt, Human
ugaaauuugaauuuug

SEQ ID NO: 2729700 - RNA, 15 nt, Human
ugaaauuugaauuuu

SEQ ID NO: 2729701 - RNA, 23 nt, Human
ugaaauuuccugggagcuuuugu

SEQ ID NO: 2729702 - RNA, 20 nt, Human
ugaaauuguaauuauaucug

SEQ ID NO: 2729703 - RNA, 21 nt, Human
ugaaauuguaauuauaucuga

SEQ ID NO: 2729704 - RNA, 15 nt, Human
agagcugcccucucc

SEQ ID NO: 2729705 - RNA, 13 nt, Human
agagcugcccucu

SEQ ID NO: 2729706 - RNA, 14 nt, Human
agagcugcccucuc

SEQ ID NO: 2729707 - RNA, 18 nt, Human
agagcugccaccugccug

SEQ ID NO: 2729708 - RNA, 20 nt, Human
agagcagagaccaucccuga

SEQ ID NO: 2729709 - RNA, 17 nt, Human
agagcagagaccauccc

SEQ ID NO: 2729710 - RNA, 18 nt, Human
agagcagagaccaucccu

SEQ ID NO: 2729711 - RNA, 11 nt, Human
agagccuugcg

SEQ ID NO: 2729712 - RNA, 21 nt, Human
agagccuugcggaagguucua

SEQ ID NO: 2729713 - RNA, 22 nt, Human
agagauuuuuuuguuguuuguu

SEQ ID NO: 2729714 - RNA, 23 nt, Human
agagauuuuuuuguuguuuguuu

SEQ ID NO: 2729715 - RNA, 17 nt, Human
ucuuuggacccugaggc

SEQ ID NO: 2729716 - RNA, 21 nt, Human
ucuuuggacccugaggcccag

SEQ ID NO: 2729717 - RNA, 14 nt, Human
agagcaaaauugau

SEQ ID NO: 2729718 - RNA, 12 nt, Human
agagcagagacc

SEQ ID NO: 2729719 - RNA, 20 nt, Human
agcaucacaugaacuuguaa

SEQ ID NO: 2729720 - RNA, 21 nt, Human
agcauauucaggaagcucagg

SEQ ID NO: 2729721 - RNA, 17 nt, Human
agcauauucaggaagcu

SEQ ID NO: 2729722 - RNA, 19 nt, Human
agcauauucaggaagcuca

SEQ ID NO: 2729723 - RNA, 15 nt, Human
ugaucacggcucacu

SEQ ID NO: 2729724 - RNA, 13 nt, Human
ugaucacggcuca

SEQ ID NO: 2729725 - RNA, 14 nt, Human
ugaucacggcucac

SEQ ID NO: 2729726 - RNA, 21 nt, Human
ugauacagaaaaguugaauuu

SEQ ID NO: 2729727 - RNA, 23 nt, Human
agcaucaggccaggcccucugcc

SEQ ID NO: 2729728 - RNA, 22 nt, Human
agcaucaggccaggcccucugc

SEQ ID NO: 2729729 - RNA, 21 nt, Human
agcaucaggccaggcccucug

SEQ ID NO: 2729730 - RNA, 16 nt, Human
agcauauucaggaagc

SEQ ID NO: 2729731 - RNA, 13 nt, Human
agcauccuggaau

SEQ ID NO: 2729732 - RNA, 13 nt, Human
agcauggcugcca

SEQ ID NO: 2729733 - RNA, 15 nt, Human
agcauccuggaauau

SEQ ID NO: 2729734 - RNA, 14 nt, Human
agcauccuggaaua

SEQ ID NO: 2729735 - RNA, 22 nt, Human
agcauuuagauguauagguuga

SEQ ID NO: 2729736 - RNA, 19 nt, Human
agcauggcugccaauggga

SEQ ID NO: 2729737 - RNA, 18 nt, Human
agcauuuguguugaagag

SEQ ID NO: 2729738 - RNA, 17 nt, Human
agcauuuguguugaaga

SEQ ID NO: 2729739 - RNA, 22 nt, Human
agcauuuugcuaaaugugaaug

SEQ ID NO: 2729740 - RNA, 15 nt, Human
agcauuuugcuaaau

SEQ ID NO: 2729741 - RNA, 16 nt, Human
ugauuaaguaaugaua

SEQ ID NO: 2729742 - RNA, 16 nt, Human
agccacggccaggcca

SEQ ID NO: 2729743 - RNA, 15 nt, Human
ugauuaaguaaugau

SEQ ID NO: 2729744 - RNA, 20 nt, Human
ugauuaaccacuucagcuga

SEQ ID NO: 2729745 - RNA, 17 nt, Human
ugauuaaauucuugcaa

SEQ ID NO: 2729746 - RNA, 16 nt, Human
ugauuaaauucuugca

SEQ ID NO: 2729747 - RNA, 13 nt, Human
ugauuaaauucuu

SEQ ID NO: 2729748 - RNA, 22 nt, Human
ugauggggcccugccuccuuug

SEQ ID NO: 2729749 - RNA, 19 nt, Human
ugauguuuuccaugagucc

SEQ ID NO: 2729750 - RNA, 21 nt, Human
ugauguuuuaaggaugcuugu

SEQ ID NO: 2729751 - RNA, 17 nt, Human
ugauguuuuccaugagu

SEQ ID NO: 2729752 - RNA, 21 nt, Human
ugaugggcaacccccagccug

SEQ ID NO: 2729753 - RNA, 22 nt, Human
ugaugggcaacccccagccugc

SEQ ID NO: 2729754 - RNA, 13 nt, Human
ugauggggcccug

SEQ ID NO: 2729755 - RNA, 21 nt, Human
ugaugaucuuugcagacaggc

SEQ ID NO: 2729756 - RNA, 22 nt, Human
ugaugaaaugaggucagagccu

SEQ ID NO: 2729757 - RNA, 14 nt, Human
ugaucuaggaagac

SEQ ID NO: 2729758 - RNA, 15 nt, Human
ugaucuaggaagacu

SEQ ID NO: 2729759 - RNA, 23 nt, Human
ugaugaaaugaggucagagccug

SEQ ID NO: 2729760 - RNA, 19 nt, Human
ugaugaucuuugcagacag

SEQ ID NO: 2729761 - RNA, 20 nt, Human
ugaugaucuuugcagacagg

SEQ ID NO: 2729762 - RNA, 19 nt, Human
ugauccagcagauuauuca

SEQ ID NO: 2729763 - RNA, 20 nt, Human
ugauccagcagauuauucac

SEQ ID NO: 2729764 - RNA, 13 nt, Human
ugaucuaggaaga

SEQ ID NO: 2729765 - RNA, 19 nt, Human
ugauccucccaccucagcc

SEQ ID NO: 2729766 - RNA, 20 nt, Human
ugauccucccaccucagccu

SEQ ID NO: 2729767 - RNA, 18 nt, Human
ugauccucccaccucagc

SEQ ID NO: 2729768 - RNA, 14 nt, Human
agcaggcuacuguc

SEQ ID NO: 2729769 - RNA, 20 nt, Human
agcaggcuacugucagcucc

SEQ ID NO: 2729770 - RNA, 19 nt, Human
agcaggcuacugucagcuc

SEQ ID NO: 2729771 - RNA, 17 nt, Human
agcaggcuacugucagc

SEQ ID NO: 2729772 - RNA, 16 nt, Human
agcaggcuacugucag

SEQ ID NO: 2729773 - RNA, 13 nt, Human
agcaggacaugga

SEQ ID NO: 2729774 - RNA, 15 nt, Human
agcagccacauuccu

SEQ ID NO: 2729775 - RNA, 11 nt, Human
agcagccacau

SEQ ID NO: 2729776 - RNA, 16 nt, Human
agcagcagggagggcu

SEQ ID NO: 2729777 - RNA, 20 nt, Human
ugacccaugcugcccuguga

SEQ ID NO: 2729778 - RNA, 17 nt, Human
ugacccaugcugcccug

SEQ ID NO: 2729779 - RNA, 18 nt, Human
ugacccaugcugcccugu

SEQ ID NO: 2729780 - RNA, 19 nt, Human
ugacccaugcugcccugug

SEQ ID NO: 2729781 - RNA, 19 nt, Human
agcagggcauggcugggaa

SEQ ID NO: 2729782 - RNA, 20 nt, Human
agcagggagggcuucugcca

SEQ ID NO: 2729783 - RNA, 13 nt, Human
agcagggcucagc

SEQ ID NO: 2729784 - RNA, 14 nt, Human
agcagggcucagcg

SEQ ID NO: 2729785 - RNA, 15 nt, Human
agcagggcucagcgg

SEQ ID NO: 2729786 - RNA, 22 nt, Human
agcagggcucagcggggacagc

SEQ ID NO: 2729787 - RNA, 13 nt, Human
agcagggaaacag

SEQ ID NO: 2729788 - RNA, 14 nt, Human
agcagggaaacagc

SEQ ID NO: 2729789 - RNA, 15 nt, Human
agcagggaaacagcu

SEQ ID NO: 2729790 - RNA, 21 nt, Human
agcaggcucucaggccagcug

SEQ ID NO: 2729791 - RNA, 22 nt, Human
agcaggcucucaggccagcugc

SEQ ID NO: 2729792 - RNA, 23 nt, Human
agcaggcucucaggccagcugcu

SEQ ID NO: 2729793 - RNA, 17 nt, Human
agcaggcucgggcuccc

SEQ ID NO: 2729794 - RNA, 13 nt, Human
agcaggcucucag

SEQ ID NO: 2729795 - RNA, 14 nt, Human
agcaggcucucagg

SEQ ID NO: 2729796 - RNA, 15 nt, Human
agcaggcucucaggc

SEQ ID NO: 2729797 - RNA, 16 nt, Human
agcaggcucucaggcc

SEQ ID NO: 2729798 - RNA, 17 nt, Human
agcaggcucucaggcca

SEQ ID NO: 2729799 - RNA, 18 nt, Human
agcaggcucucaggccag

SEQ ID NO: 2729800 - RNA, 19 nt, Human
agcaggcucucaggccagc

SEQ ID NO: 2729801 - RNA, 22 nt, Human
agcauaccaacacgagcaggcu

SEQ ID NO: 2729802 - RNA, 19 nt, Human
agcauaccaacacgagcag

SEQ ID NO: 2729803 - RNA, 15 nt, Human
agcauauauuuuuau

SEQ ID NO: 2729804 - RNA, 13 nt, Human
agcauaccaacac

SEQ ID NO: 2729805 - RNA, 23 nt, Human
agcauaaaaauuagccaagugug

SEQ ID NO: 2729806 - RNA, 22 nt, Human
agcauauauuuuuauauuuacu

SEQ ID NO: 2729807 - RNA, 20 nt, Human
agcauauauuuuuauauuua

SEQ ID NO: 2729808 - RNA, 18 nt, Human
agcauauauuuuuauauu

SEQ ID NO: 2729809 - RNA, 19 nt, Human
ugaguacguugugcauuug

SEQ ID NO: 2729810 - RNA, 18 nt, Human
ugaguacguugugcauuu

SEQ ID NO: 2729811 - RNA, 17 nt, Human
ugaguacguugugcauu

SEQ ID NO: 2729812 - RNA, 16 nt, Human
ugaguacguugugcau

SEQ ID NO: 2729813 - RNA, 19 nt, Human
agcagucaggaaagagaac

SEQ ID NO: 2729814 - RNA, 19 nt, Human
agcauaaaaauuagccaag

SEQ ID NO: 2729815 - RNA, 17 nt, Human
agcagucaggaaagaga

SEQ ID NO: 2729816 - RNA, 18 nt, Human
agcagucaggaaagagaa

SEQ ID NO: 2729817 - RNA, 21 nt, Human
ugagugggggaucacagccuc

SEQ ID NO: 2729818 - RNA, 18 nt, Human
ugaguucauacccuguua

SEQ ID NO: 2729819 - RNA, 15 nt, Human
ugauacaaugcugug

SEQ ID NO: 2729820 - RNA, 14 nt, Human
ugauacaaugcugu

SEQ ID NO: 2729821 - RNA, 15 nt, Human
ugaguucuacauaag

SEQ ID NO: 2729822 - RNA, 20 nt, Human
ugaguucuacauaaguaauu

SEQ ID NO: 2729823 - RNA, 22 nt, Human
ugaguucuacauaaguaauuca

SEQ ID NO: 2729824 - RNA, 16 nt, Human
ugauaaguaaaugcua

SEQ ID NO: 2729825 - RNA, 13 nt, Human
ugauaaguucaua

SEQ ID NO: 2729826 - RNA, 15 nt, Human
ugauaaguucauaca

SEQ ID NO: 2729827 - RNA, 17 nt, Human
ugauaaguucauacauu

SEQ ID NO: 2729828 - RNA, 19 nt, Human
ugauaaguucauacauugu

SEQ ID NO: 2729829 - RNA, 20 nt, Human
ugaguacguugugcauuugg

SEQ ID NO: 2729830 - RNA, 18 nt, Human
ugagucaccaagcccagu

SEQ ID NO: 2729831 - RNA, 16 nt, Human
ugagugccuuacacaa

SEQ ID NO: 2729832 - RNA, 17 nt, Human
ugagugcagcucuggag

SEQ ID NO: 2729833 - RNA, 13 nt, Human
ugagugccuuaca

SEQ ID NO: 2729834 - RNA, 14 nt, Human
ugagugccuuacac

SEQ ID NO: 2729835 - RNA, 17 nt, Human
ugccaguuauggcuaua

SEQ ID NO: 2729836 - RNA, 17 nt, Human
ugccagccgagauagcc

SEQ ID NO: 2729837 - RNA, 22 nt, Human
ugccagccgagauagccaaggc

SEQ ID NO: 2729838 - RNA, 13 nt, Human
ugccaauggacua

SEQ ID NO: 2729839 - RNA, 14 nt, Human
ugccaaugggagcu

SEQ ID NO: 2729840 - RNA, 16 nt, Human
ugcauuuaaaagauac

SEQ ID NO: 2729841 - RNA, 19 nt, Human
agccugugccucugggacu

SEQ ID NO: 2729842 - RNA, 18 nt, Human
agccugugccucugggac

SEQ ID NO: 2729843 - RNA, 17 nt, Human
agccugugccucuggga

SEQ ID NO: 2729844 - RNA, 20 nt, Human
agccuuagaagucacacagu

SEQ ID NO: 2729845 - RNA, 23 nt, Human
agccuugaacuuugaccucugca

SEQ ID NO: 2729846 - RNA, 13 nt, Human
agccuugaacuuu

SEQ ID NO: 2729847 - RNA, 19 nt, Human
agccuugcggaagguucua

SEQ ID NO: 2729848 - RNA, 21 nt, Human
agccuugaccauucuccaccu

SEQ ID NO: 2729849 - RNA, 18 nt, Human
agccuugaccauucucca

SEQ ID NO: 2729850 - RNA, 19 nt, Human
agccuugaccauucuccac

SEQ ID NO: 2729851 - RNA, 14 nt, Human
ugcauaccacuuuu

SEQ ID NO: 2729852 - RNA, 20 nt, Human
ugcauagauucccugagcag

SEQ ID NO: 2729853 - RNA, 16 nt, Human
ugcauaccacuuuugu

SEQ ID NO: 2729854 - RNA, 20 nt, Human
ugcauaccacuuuuguucuu

SEQ ID NO: 2729855 - RNA, 18 nt, Human
ugcauaccacuuuuguuc

SEQ ID NO: 2729856 - RNA, 18 nt, Human
ugcaugcugucccuuacg

SEQ ID NO: 2729857 - RNA, 19 nt, Human
ugcaugcugucccuuacgu

SEQ ID NO: 2729858 - RNA, 21 nt, Human
ugcaugcugucccuuacguga

SEQ ID NO: 2729859 - RNA, 17 nt, Human
ugcaucguuucaucuuc

SEQ ID NO: 2729860 - RNA, 13 nt, Human
agccuccugcccu

SEQ ID NO: 2729861 - RNA, 14 nt, Human
agccuccugcccuu

SEQ ID NO: 2729862 - RNA, 18 nt, Human
agccuccugcccuuaccu

SEQ ID NO: 2729863 - RNA, 12 nt, Human
ugcagacaggca

SEQ ID NO: 2729864 - RNA, 13 nt, Human
ugcagacaggcaa

SEQ ID NO: 2729865 - RNA, 21 nt, Human
ugcagacaggcaagcaccucc

SEQ ID NO: 2729866 - RNA, 18 nt, Human
ugcagccucacaguccuu

SEQ ID NO: 2729867 - RNA, 17 nt, Human
ugcagccucacaguccu

SEQ ID NO: 2729868 - RNA, 21 nt, Human
ugcagccucacaguccuuacc

SEQ ID NO: 2729869 - RNA, 17 nt, Human
ugcaauaaaauggguuu

SEQ ID NO: 2729870 - RNA, 21 nt, Human
ugcaauaaaauggguuuuacu

SEQ ID NO: 2729871 - RNA, 12 nt, Human
agcccaggccuc

SEQ ID NO: 2729872 - RNA, 15 nt, Human
ugcaaggucauuuuu

SEQ ID NO: 2729873 - RNA, 15 nt, Human
ugcaagccagauuuu

SEQ ID NO: 2729874 - RNA, 21 nt, Human
ugcaagccagauuuuccugaa

SEQ ID NO: 2729875 - RNA, 13 nt, Human
ugcaacaggcugg

SEQ ID NO: 2729876 - RNA, 18 nt, Human
ugcaaagcacugacuucu

SEQ ID NO: 2729877 - RNA, 22 nt, Human
ugcaaagcacugacuucuaagu

SEQ ID NO: 2729878 - RNA, 20 nt, Human
ugcaaagcacugacuucuaa

SEQ ID NO: 2729879 - RNA, 18 nt, Human
ugcaaaccaucauugaaa

SEQ ID NO: 2729880 - RNA, 20 nt, Human
ugcaaaccaucauugaaauc

SEQ ID NO: 2729881 - RNA, 21 nt, Human
ugcaaaggguaucaggugcug

SEQ ID NO: 2729882 - RNA, 20 nt, Human
ugcaaaguaucccuacugua

SEQ ID NO: 2729883 - RNA, 17 nt, Human
agccacggccaggccag

SEQ ID NO: 2729884 - RNA, 18 nt, Human
agccacggccaggccaga

SEQ ID NO: 2729885 - RNA, 12 nt, Human
ugcaaaccauca

SEQ ID NO: 2729886 - RNA, 13 nt, Human
ugcaaaccaucau

SEQ ID NO: 2729887 - RNA, 23 nt, Human
ugauuugacauagucuggcugua

SEQ ID NO: 2729888 - RNA, 15 nt, Human
ugcacuccagccugg

SEQ ID NO: 2729889 - RNA, 16 nt, Human
ugcacuccagccuggg

SEQ ID NO: 2729890 - RNA, 14 nt, Human
ugcacuccagccug

SEQ ID NO: 2729891 - RNA, 16 nt, Human
ugcaccggcuggccug

SEQ ID NO: 2729892 - RNA, 14 nt, Human
ugcaccggcuggcc

SEQ ID NO: 2729893 - RNA, 15 nt, Human
ugcaccggcuggccu

SEQ ID NO: 2729894 - RNA, 21 nt, Human
ugcaccacugcacuccagccu

SEQ ID NO: 2729895 - RNA, 13 nt, Human
ugcaccagcccuu

SEQ ID NO: 2729896 - RNA, 15 nt, Human
ugcaccacugcacuc

SEQ ID NO: 2729897 - RNA, 22 nt, Human
agccccuggaugcagccucaca

SEQ ID NO: 2729898 - RNA, 14 nt, Human
agccccgaggccuu

SEQ ID NO: 2729899 - RNA, 14 nt, Human
agcccaggccuccu

SEQ ID NO: 2729900 - RNA, 19 nt, Human
agcccaggccuccuacagc

SEQ ID NO: 2729901 - RNA, 16 nt, Human
agcccgggcucugccu

SEQ ID NO: 2729902 - RNA, 14 nt, Human
agcccugcagaggg

SEQ ID NO: 2729903 - RNA, 15 nt, Human
agcccugcagagggc

SEQ ID NO: 2729904 - RNA, 16 nt, Human
agcccugcagagggca

SEQ ID NO: 2729905 - RNA, 19 nt, Human
agcccugcagagggcacag

SEQ ID NO: 2729906 - RNA, 14 nt, Human
agccccuucugacc

SEQ ID NO: 2729907 - RNA, 15 nt, Human
agccccuucugaccc

SEQ ID NO: 2729908 - RNA, 16 nt, Human
agccccuucugaccca

SEQ ID NO: 2729909 - RNA, 19 nt, Human
agccccuucugacccaugc

SEQ ID NO: 2729910 - RNA, 13 nt, Human
agcccgggcucug

SEQ ID NO: 2729911 - RNA, 14 nt, Human
agcccgggcucugc

SEQ ID NO: 2729912 - RNA, 15 nt, Human
agcccgggcucugcc

SEQ ID NO: 2729913 - RNA, 14 nt, Human
aggaauucuguaua

SEQ ID NO: 2729914 - RNA, 13 nt, Human
aggaauucuguau

SEQ ID NO: 2729915 - RNA, 22 nt, Human
aggacuuuucuuuguggcuucc

SEQ ID NO: 2729916 - RNA, 17 nt, Human
aggacuuuucuuugugg

SEQ ID NO: 2729917 - RNA, 19 nt, Human
aggacuuuucuuuguggcu

SEQ ID NO: 2729918 - RNA, 23 nt, Human
aggacuucuuuaauuuuggaauu

SEQ ID NO: 2729919 - RNA, 22 nt, Human
aggacuucuuuaauuuuggaau

SEQ ID NO: 2729920 - RNA, 21 nt, Human
aggacuucuuuaauuuuggaa

SEQ ID NO: 2729921 - RNA, 16 nt, Human
aggacuucuuuaauuu

SEQ ID NO: 2729922 - RNA, 14 nt, Human
aggacuucuuuaau

SEQ ID NO: 2729923 - RNA, 17 nt, Human
aggagaguagaacagau

SEQ ID NO: 2729924 - RNA, 12 nt, Human
aggagcagccac

SEQ ID NO: 2729925 - RNA, 13 nt, Human
aggagcagccaca

SEQ ID NO: 2729926 - RNA, 16 nt, Human
aggagccuccugcccu

SEQ ID NO: 2729927 - RNA, 17 nt, Human
aggagccccgaggccuu

SEQ ID NO: 2729928 - RNA, 17 nt, Human
ugcuuuuaaaaaaaaau

SEQ ID NO: 2729929 - RNA, 18 nt, Human
ugcuuuuggucuguguga

SEQ ID NO: 2729930 - RNA, 23 nt, Human
ugcuuuuuaauauugauaugcuu

SEQ ID NO: 2729931 - RNA, 20 nt, Human
ugcuuuugucuaugggacuc

SEQ ID NO: 2729932 - RNA, 17 nt, Human
ugcuuugugauuuuugu

SEQ ID NO: 2729933 - RNA, 22 nt, Human
ugcuuugugauuuuuguaauuu

SEQ ID NO: 2729934 - RNA, 15 nt, Human
ugcuugagcucagga

SEQ ID NO: 2729935 - RNA, 17 nt, Human
aggagccuccugcccuu

SEQ ID NO: 2729936 - RNA, 23 nt, Human
uggaaauuuguuauaaugaauga

SEQ ID NO: 2729937 - RNA, 21 nt, Human
uggaaauuuguuauaaugaau

SEQ ID NO: 2729938 - RNA, 15 nt, Human
uggaagacagcucuu

SEQ ID NO: 2729939 - RNA, 16 nt, Human
uggaagacagcucuua

SEQ ID NO: 2729940 - RNA, 16 nt, Human
aggauucuuccucccu

SEQ ID NO: 2729941 - RNA, 22 nt, Human
aggaugcacagaguuguuacau

SEQ ID NO: 2729942 - RNA, 22 nt, Human
aggaugaucuaggaagacuuug

SEQ ID NO: 2729943 - RNA, 23 nt, Human
aggaugaucuaggaagacuuugg

SEQ ID NO: 2729944 - RNA, 19 nt, Human
aggauucuuccucccuccc

SEQ ID NO: 2729945 - RNA, 17 nt, Human
aggauucuuccucccuc

SEQ ID NO: 2729946 - RNA, 13 nt, Human
aggaucagucuga

SEQ ID NO: 2729947 - RNA, 17 nt, Human
aggcaagcaccuccugc

SEQ ID NO: 2729948 - RNA, 17 nt, Human
uggagcucguggaacag

SEQ ID NO: 2729949 - RNA, 21 nt, Human
uggagcucguggaacaguuac

SEQ ID NO: 2729950 - RNA, 20 nt, Human
aggcaagcaccuccugccuc

SEQ ID NO: 2729951 - RNA, 18 nt, Human
aggcaagcaccuccugcc

SEQ ID NO: 2729952 - RNA, 19 nt, Human
aggcaagcaccuccugccu

SEQ ID NO: 2729953 - RNA, 16 nt, Human
aggcaaggcugucaau

SEQ ID NO: 2729954 - RNA, 17 nt, Human
aggcaaggcugucaauu

SEQ ID NO: 2729955 - RNA, 14 nt, Human
uggagaaaauggac

SEQ ID NO: 2729956 - RNA, 18 nt, Human
aggauugcuacuguccua

SEQ ID NO: 2729957 - RNA, 15 nt, Human
aggauugcuacuguc

SEQ ID NO: 2729958 - RNA, 17 nt, Human
aggauugcuacuguccu

SEQ ID NO: 2729959 - RNA, 18 nt, Human
aggcauugugggaagggg

SEQ ID NO: 2729960 - RNA, 22 nt, Human
aggcauaaagucagggguuccc

SEQ ID NO: 2729961 - RNA, 15 nt, Human
aggcauaaagucagg

SEQ ID NO: 2729962 - RNA, 17 nt, Human
aggcaggugggauggau

SEQ ID NO: 2729963 - RNA, 12 nt, Human
aggcagggucuc

SEQ ID NO: 2729964 - RNA, 22 nt, Human
aggcaggucuugaacuccuggc

SEQ ID NO: 2729965 - RNA, 15 nt, Human
aggcagcuugaaacu

SEQ ID NO: 2729966 - RNA, 14 nt, Human
uggaguugaaaauc

SEQ ID NO: 2729967 - RNA, 20 nt, Human
uggagguacgaaaagagggg

SEQ ID NO: 2729968 - RNA, 16 nt, Human
aggcauuugcugaaua

SEQ ID NO: 2729969 - RNA, 20 nt, Human
aggcauuugcugaauacaga

SEQ ID NO: 2729970 - RNA, 14 nt, Human
uggagugcagugag

SEQ ID NO: 2729971 - RNA, 21 nt, Human
uggcacaucagcacgauuucu

SEQ ID NO: 2729972 - RNA, 23 nt, Human
uggcacaucagcacgauuucugu

SEQ ID NO: 2729973 - RNA, 21 nt, Human
uggaugccugguggcagcugc

SEQ ID NO: 2729974 - RNA, 23 nt, Human
uggaugccugguggcagcugcgg

SEQ ID NO: 2729975 - RNA, 15 nt, Human
aggcccccaggugcc

SEQ ID NO: 2729976 - RNA, 14 nt, Human
aggccccgcccagg

SEQ ID NO: 2729977 - RNA, 13 nt, Human
aggcccggcucca

SEQ ID NO: 2729978 - RNA, 17 nt, Human
aggcccggcuccaggcu

SEQ ID NO: 2729979 - RNA, 13 nt, Human
aggcccagagggc

SEQ ID NO: 2729980 - RNA, 13 nt, Human
uggcagcucagag

SEQ ID NO: 2729981 - RNA, 23 nt, Human
uggcagcucaccucucccuugga

SEQ ID NO: 2729982 - RNA, 21 nt, Human
uggcagcucaccucucccuug

SEQ ID NO: 2729983 - RNA, 22 nt, Human
uggcagcucaccucucccuugg

SEQ ID NO: 2729984 - RNA, 18 nt, Human
uggcacccggccccugcu

SEQ ID NO: 2729985 - RNA, 19 nt, Human
uggcacccggccccugcug

SEQ ID NO: 2729986 - RNA, 20 nt, Human
uggcacccggccccugcugg

SEQ ID NO: 2729987 - RNA, 15 nt, Human
aggccagccuugacc

SEQ ID NO: 2729988 - RNA, 13 nt, Human
aggccagccuuga

SEQ ID NO: 2729989 - RNA, 22 nt, Human
aggaaaucaaauaugcaaagca

SEQ ID NO: 2729990 - RNA, 21 nt, Human
aggaaaucaaauaugcaaagc

SEQ ID NO: 2729991 - RNA, 20 nt, Human
aggaaaucaaauaugcaaag

SEQ ID NO: 2729992 - RNA, 19 nt, Human
aggaaaucaaauaugcaaa

SEQ ID NO: 2729993 - RNA, 23 nt, Human
aggaaaggcuccaggagcagcca

SEQ ID NO: 2729994 - RNA, 16 nt, Human
aggaagcucagggccu

SEQ ID NO: 2729995 - RNA, 15 nt, Human
aggaagcucagggcc

SEQ ID NO: 2729996 - RNA, 13 nt, Human
aggaagcucaggg

SEQ ID NO: 2729997 - RNA, 14 nt, Human
aggaagcucagggc

SEQ ID NO: 2729998 - RNA, 22 nt, Human
ugcuauuucuauauuuucauuc

SEQ ID NO: 2729999 - RNA, 21 nt, Human
ugcuauuucuauauuuucauu

SEQ ID NO: 2730000 - RNA, 18 nt, Human
ugcuaucucccccagccc

SEQ ID NO: 2730001 - RNA, 16 nt, Human
aggaaaagcugcugac

SEQ ID NO: 2730002 - RNA, 13 nt, Human
ugcuaucuccccc

SEQ ID NO: 2730003 - RNA, 14 nt, Human
ugcuaucuccccca

SEQ ID NO: 2730004 - RNA, 17 nt, Human
ugcuaucucccccagcc

SEQ ID NO: 2730005 - RNA, 14 nt, Human
ugcucugcugacag

SEQ ID NO: 2730006 - RNA, 15 nt, Human
ugcucugcugacaga

SEQ ID NO: 2730007 - RNA, 20 nt, Human
ugcuccagcuguucagcugg

SEQ ID NO: 2730008 - RNA, 21 nt, Human
ugcuccagcuguucagcuggu

SEQ ID NO: 2730009 - RNA, 17 nt, Human
ugccuuuucccaacucc

SEQ ID NO: 2730010 - RNA, 19 nt, Human
ugccuuuucccaacuccag

SEQ ID NO: 2730011 - RNA, 14 nt, Human
ugcgguccacccag

SEQ ID NO: 2730012 - RNA, 15 nt, Human
ugcgguccacccagg

SEQ ID NO: 2730013 - RNA, 14 nt, Human
ugcuacaaaaacac

SEQ ID NO: 2730014 - RNA, 11 nt, Human
ugcuacacacu

SEQ ID NO: 2730015 - RNA, 20 nt, Human
agcuuaaaggggcuagagug

SEQ ID NO: 2730016 - RNA, 19 nt, Human
agcuugcccuguuaaaaga

SEQ ID NO: 2730017 - RNA, 18 nt, Human
agcuugcccuguuaaaag

SEQ ID NO: 2730018 - RNA, 16 nt, Human
agcuugcccuguuaaa

SEQ ID NO: 2730019 - RNA, 22 nt, Human
agcuugaggguugggcuggugu

SEQ ID NO: 2730020 - RNA, 23 nt, Human
agcuugaccgugaggccagagac

SEQ ID NO: 2730021 - RNA, 20 nt, Human
agcuugaccgugaggccaga

SEQ ID NO: 2730022 - RNA, 22 nt, Human
agcuugaccgugaggccagaga

SEQ ID NO: 2730023 - RNA, 14 nt, Human
aggaaaagcugcug

SEQ ID NO: 2730024 - RNA, 20 nt, Human
ugcccuguuaaaagaugaaa

SEQ ID NO: 2730025 - RNA, 19 nt, Human
ugcccuguuaaaagaugaa

SEQ ID NO: 2730026 - RNA, 13 nt, Human
agcugcccucucc

SEQ ID NO: 2730027 - RNA, 14 nt, Human
agcugcccucuccu

SEQ ID NO: 2730028 - RNA, 15 nt, Human
agcugcccucuccug

SEQ ID NO: 2730029 - RNA, 16 nt, Human
agcugcccucuccugg

SEQ ID NO: 2730030 - RNA, 18 nt, Human
ugcccuuaccugccagga

SEQ ID NO: 2730031 - RNA, 14 nt, Human
ugccgcagcccugc

SEQ ID NO: 2730032 - RNA, 12 nt, Human
ugccgcagcccu

SEQ ID NO: 2730033 - RNA, 12 nt, Human
ugccucagccuc

SEQ ID NO: 2730034 - RNA, 13 nt, Human
ugccucagccucc

SEQ ID NO: 2730035 - RNA, 16 nt, Human
agcucuguccugggag

SEQ ID NO: 2730036 - RNA, 21 nt, Human
agcucuguccugggagugagc

SEQ ID NO: 2730037 - RNA, 23 nt, Human
agcucuguccugggagugagcug

SEQ ID NO: 2730038 - RNA, 14 nt, Human
agcugccagccgag

SEQ ID NO: 2730039 - RNA, 20 nt, Human
agcugccagccgagauagcc

SEQ ID NO: 2730040 - RNA, 14 nt, Human
agcucuguccuggg

SEQ ID NO: 2730041 - RNA, 17 nt, Human
agcucugguccauagag

SEQ ID NO: 2730042 - RNA, 12 nt, Human
agcucuggucca

SEQ ID NO: 2730043 - RNA, 16 nt, Human
agcuccuucuguccua

SEQ ID NO: 2730044 - RNA, 21 nt, Human
agcuccuucuguccuacucug

SEQ ID NO: 2730045 - RNA, 13 nt, Human
agcucccaggcau

SEQ ID NO: 2730046 - RNA, 23 nt, Human
agcucccaggcauuccccaggag

SEQ ID NO: 2730047 - RNA, 15 nt, Human
agcuccuucuguccu

SEQ ID NO: 2730048 - RNA, 22 nt, Human
ugccaucaauaaaaaauuauga

SEQ ID NO: 2730049 - RNA, 14 nt, Human
ugccaucaauaaaa

SEQ ID NO: 2730050 - RNA, 14 nt, Human
agcuguucacagcc

SEQ ID NO: 2730051 - RNA, 19 nt, Human
agcuguuacugucuucagu

SEQ ID NO: 2730052 - RNA, 21 nt, Human
ugccuuacccucauguucuua

SEQ ID NO: 2730053 - RNA, 16 nt, Human
ugccuuggggacaaga

SEQ ID NO: 2730054 - RNA, 20 nt, Human
ugccuuacccucauguucuu

SEQ ID NO: 2730055 - RNA, 16 nt, Human
ugccuguugggccagg

SEQ ID NO: 2730056 - RNA, 17 nt, Human
ugccuguugggccagga

SEQ ID NO: 2730057 - RNA, 17 nt, Human
agcugugcucuggacag

SEQ ID NO: 2730058 - RNA, 18 nt, Human
agcugugcucuggacagg

SEQ ID NO: 2730059 - RNA, 18 nt, Human
agcuguuacugucuucag

SEQ ID NO: 2730060 - RNA, 14 nt, Human
agcuguuacugucu

SEQ ID NO: 2730061 - RNA, 22 nt, Human
agcugggguggggaccucaggc

SEQ ID NO: 2730062 - RNA, 23 nt, Human
agcugggguggggaccucaggcc

SEQ ID NO: 2730063 - RNA, 20 nt, Human
agcugggacuacaggcaccc

SEQ ID NO: 2730064 - RNA, 23 nt, Human
agcugggacuacaggcacccacc

SEQ ID NO: 2730065 - RNA, 16 nt, Human
agcugggacuacaggu

SEQ ID NO: 2730066 - RNA, 20 nt, Human
agcugggguggggaccucag

SEQ ID NO: 2730067 - RNA, 20 nt, Human
agcugcuugggcuucauccu

SEQ ID NO: 2730068 - RNA, 16 nt, Human
agcugcuugggcuuca

SEQ ID NO: 2730069 - RNA, 18 nt, Human
agcugccuguucagcucc

SEQ ID NO: 2730070 - RNA, 14 nt, Human
agcugccuguucag

SEQ ID NO: 2730071 - RNA, 16 nt, Human
agcugccuguucagcu

SEQ ID NO: 2730072 - RNA, 16 nt, Human
ugccuggauggggcug

SEQ ID NO: 2730073 - RNA, 17 nt, Human
ugccuggauggggcugc

SEQ ID NO: 2730074 - RNA, 20 nt, Human
ugccuggauggggcugcacc

SEQ ID NO: 2730075 - RNA, 21 nt, Human
ugccuggauggggcugcaccg

SEQ ID NO: 2730076 - RNA, 20 nt, Human
ugccugcccaggccccugcc

SEQ ID NO: 2730077 - RNA, 22 nt, Human
ugccugcccaggccccugccac

SEQ ID NO: 2730078 - RNA, 23 nt, Human
ugccugcccaggccccugccacc

SEQ ID NO: 2730079 - RNA, 14 nt, Human
ugccucagccuccc

SEQ ID NO: 2730080 - RNA, 18 nt, Human
ugccucugccucugacac

SEQ ID NO: 2730081 - RNA, 20 nt, Human
ugccucugccucugacacac

SEQ ID NO: 2730082 - RNA, 17 nt, Human
ugccucugccucugaca

SEQ ID NO: 2730083 - RNA, 16 nt, Human
uguaaaggaauuuaaa

SEQ ID NO: 2730084 - RNA, 16 nt, Human
uguaaauaguauuuga

SEQ ID NO: 2730085 - RNA, 15 nt, Human
uguaaauagcucagg

SEQ ID NO: 2730086 - RNA, 16 nt, Human
uguaaauagcucaggu

SEQ ID NO: 2730087 - RNA, 15 nt, Human
uguaaauacaauuuu

SEQ ID NO: 2730088 - RNA, 14 nt, Human
ugguuauggagagg

SEQ ID NO: 2730089 - RNA, 14 nt, Human
ugguuuucaaaaua

SEQ ID NO: 2730090 - RNA, 15 nt, Human
ugguuuguaaauuaa

SEQ ID NO: 2730091 - RNA, 17 nt, Human
ugguuuucaaaauaaaa

SEQ ID NO: 2730092 - RNA, 15 nt, Human
ugguuuucaaaauaa

SEQ ID NO: 2730093 - RNA, 14 nt, Human
aggugauccaccca

SEQ ID NO: 2730094 - RNA, 20 nt, Human
aggugauccacccaccucag

SEQ ID NO: 2730095 - RNA, 18 nt, Human
aggugccucaagagaagg

SEQ ID NO: 2730096 - RNA, 15 nt, Human
aggugggauccucca

SEQ ID NO: 2730097 - RNA, 16 nt, Human
agguggggcagcuuga

SEQ ID NO: 2730098 - RNA, 18 nt, Human
aggugggauccuccaggu

SEQ ID NO: 2730099 - RNA, 23 nt, Human
agguggggcagcuugaggguugg

SEQ ID NO: 2730100 - RNA, 16 nt, Human
aggugggauccuccag

SEQ ID NO: 2730101 - RNA, 17 nt, Human
aggugggauccuccagg

SEQ ID NO: 2730102 - RNA, 14 nt, Human
agguuuaagcuguu

SEQ ID NO: 2730103 - RNA, 19 nt, Human
agguggggucacucuggca

SEQ ID NO: 2730104 - RNA, 17 nt, Human
aggugugaaccaccaca

SEQ ID NO: 2730105 - RNA, 15 nt, Human
aggugugcucugauc

SEQ ID NO: 2730106 - RNA, 20 nt, Human
aggugugcucugaucaucca

SEQ ID NO: 2730107 - RNA, 16 nt, Human
uggugcgaucuggguu

SEQ ID NO: 2730108 - RNA, 17 nt, Human
uggugcgaucuggguuc

SEQ ID NO: 2730109 - RNA, 14 nt, Human
uggugcccugcuuu

SEQ ID NO: 2730110 - RNA, 20 nt, Human
uggugcccugcuuucagaua

SEQ ID NO: 2730111 - RNA, 19 nt, Human
uggugcccugcuuucagau

SEQ ID NO: 2730112 - RNA, 16 nt, Human
uggugcccugcuuuca

SEQ ID NO: 2730113 - RNA, 18 nt, Human
ugguuaggcauuguggga

SEQ ID NO: 2730114 - RNA, 20 nt, Human
ugguuaggcauugugggaag

SEQ ID NO: 2730115 - RNA, 14 nt, Human
ugguggcagcugcg

SEQ ID NO: 2730116 - RNA, 13 nt, Human
ugguggcagcugc

SEQ ID NO: 2730117 - RNA, 15 nt, Human
ugguggcagcugcgg

SEQ ID NO: 2730118 - RNA, 16 nt, Human
aggucuugaacuccug

SEQ ID NO: 2730119 - RNA, 15 nt, Human
uggucagauuugaac

SEQ ID NO: 2730120 - RNA, 16 nt, Human
uggucagauuugaacu

SEQ ID NO: 2730121 - RNA, 13 nt, Human
aggucagagccug

SEQ ID NO: 2730122 - RNA, 14 nt, Human
aggucagagccugc

SEQ ID NO: 2730123 - RNA, 15 nt, Human
aggucagagccugca

SEQ ID NO: 2730124 - RNA, 17 nt, Human
aggucagagccugcagu

SEQ ID NO: 2730125 - RNA, 18 nt, Human
aggucagagccugcaguu

SEQ ID NO: 2730126 - RNA, 22 nt, Human
aggugacagagugagacucugu

SEQ ID NO: 2730127 - RNA, 13 nt, Human
aggugaccccagg

SEQ ID NO: 2730128 - RNA, 17 nt, Human
aggucuugaacuccugg

SEQ ID NO: 2730129 - RNA, 13 nt, Human
aggugacagagug

SEQ ID NO: 2730130 - RNA, 15 nt, Human
aggugacagagugag

SEQ ID NO: 2730131 - RNA, 21 nt, Human
aggugagaagcagaggaagga

SEQ ID NO: 2730132 - RNA, 23 nt, Human
aggugagaagcagaggaaggaga

SEQ ID NO: 2730133 - RNA, 16 nt, Human
aggugagaagcagagg

SEQ ID NO: 2730134 - RNA, 14 nt, Human
uguaguguuggaga

SEQ ID NO: 2730135 - RNA, 15 nt, Human
uguaguguuggagaa

SEQ ID NO: 2730136 - RNA, 18 nt, Human
uguaucacaaaucuuaac

SEQ ID NO: 2730137 - RNA, 15 nt, Human
uguaucacaaaucuu

SEQ ID NO: 2730138 - RNA, 17 nt, Human
uguaucaaugaguaaca

SEQ ID NO: 2730139 - RNA, 22 nt, Human
uguauuacaaauccaaugaaau

SEQ ID NO: 2730140 - RNA, 20 nt, Human
uguauucuagcuaauguaau

SEQ ID NO: 2730141 - RNA, 13 nt, Human
uguauuacaaauc

SEQ ID NO: 2730142 - RNA, 22 nt, Human
uguauucuagcuaauguaauaa

SEQ ID NO: 2730143 - RNA, 16 nt, Human
uguauuuuuuuacuaa

SEQ ID NO: 2730144 - RNA, 20 nt, Human
uguauucucuccuguaccuc

SEQ ID NO: 2730145 - RNA, 19 nt, Human
uguauucucuccuguaccu

SEQ ID NO: 2730146 - RNA, 15 nt, Human
aguaugguggcuggg

SEQ ID NO: 2730147 - RNA, 16 nt, Human
aguaugguggcugggu

SEQ ID NO: 2730148 - RNA, 18 nt, Human
aguauuagaauaccacag

SEQ ID NO: 2730149 - RNA, 18 nt, Human
aguauuacuucugcuaca

SEQ ID NO: 2730150 - RNA, 15 nt, Human
aguauuacuucugcu

SEQ ID NO: 2730151 - RNA, 17 nt, Human
aguaugguggcuggguu

SEQ ID NO: 2730152 - RNA, 16 nt, Human
aguaguaauagagcaa

SEQ ID NO: 2730153 - RNA, 19 nt, Human
ugucaauuacaggaaguac

SEQ ID NO: 2730154 - RNA, 17 nt, Human
ugucaauuacaggaagu

SEQ ID NO: 2730155 - RNA, 14 nt, Human
ugucaauuacagga

SEQ ID NO: 2730156 - RNA, 15 nt, Human
ugucaauuacaggaa

SEQ ID NO: 2730157 - RNA, 14 nt, Human
agucaccucaugga

SEQ ID NO: 2730158 - RNA, 15 nt, Human
agucaccucauggaa

SEQ ID NO: 2730159 - RNA, 17 nt, Human
agucaccucauggaauu

SEQ ID NO: 2730160 - RNA, 19 nt, Human
agucaccccggccaccugc

SEQ ID NO: 2730161 - RNA, 15 nt, Human
agucacacagugagu

SEQ ID NO: 2730162 - RNA, 23 nt, Human
agucacacagugagucgaggaca

SEQ ID NO: 2730163 - RNA, 18 nt, Human
aguauuucuaugaaauau

SEQ ID NO: 2730164 - RNA, 23 nt, Human
agucacacaguauuacuucugcu

SEQ ID NO: 2730165 - RNA, 17 nt, Human
aguauuucuaugaaaua

SEQ ID NO: 2730166 - RNA, 16 nt, Human
aguauuucuaugaaau

SEQ ID NO: 2730167 - RNA, 14 nt, Human
aguaugguggcugg

SEQ ID NO: 2730168 - RNA, 13 nt, Human
aguaaugauaacu

SEQ ID NO: 2730169 - RNA, 17 nt, Human
aguaaugauaacuggaa

SEQ ID NO: 2730170 - RNA, 18 nt, Human
aguaaugauaacuggaaa

SEQ ID NO: 2730171 - RNA, 20 nt, Human
aguaaugauaacuggaaacu

SEQ ID NO: 2730172 - RNA, 14 nt, Human
aguaauagagcaaa

SEQ ID NO: 2730173 - RNA, 15 nt, Human
aguaauaugcacaca

SEQ ID NO: 2730174 - RNA, 14 nt, Human
aguaauaugcacac

SEQ ID NO: 2730175 - RNA, 13 nt, Human
aguaaaauccaca

SEQ ID NO: 2730176 - RNA, 16 nt, Human
uguagagccagggucu

SEQ ID NO: 2730177 - RNA, 18 nt, Human
uguagagccagggucuca

SEQ ID NO: 2730178 - RNA, 16 nt, Human
aguacauuuggagaca

SEQ ID NO: 2730179 - RNA, 20 nt, Human
aguagaagucuuagauguau

SEQ ID NO: 2730180 - RNA, 19 nt, Human
aguagaagucuuagaugua

SEQ ID NO: 2730181 - RNA, 21 nt, Human
aguagaagucuuagauguaua

SEQ ID NO: 2730182 - RNA, 17 nt, Human
aguagaagucuuagaug

SEQ ID NO: 2730183 - RNA, 15 nt, Human
aguaauucaagaaaa

SEQ ID NO: 2730184 - RNA, 17 nt, Human
uguaggcauaaagucag

SEQ ID NO: 2730185 - RNA, 20 nt, Human
uguaggcauaaagucagggg

SEQ ID NO: 2730186 - RNA, 11 nt, Human
aguagagacag

SEQ ID NO: 2730187 - RNA, 13 nt, Human
agggaaauuucag

SEQ ID NO: 2730188 - RNA, 21 nt, Human
aggcccggcuccaggcuccuu

SEQ ID NO: 2730189 - RNA, 18 nt, Human
aggcccggcuccaggcuc

SEQ ID NO: 2730190 - RNA, 20 nt, Human
aggcccggcuccaggcuccu

SEQ ID NO: 2730191 - RNA, 22 nt, Human
agggaaggauacaaaagcaugu

SEQ ID NO: 2730192 - RNA, 14 nt, Human
ugggacuacaggca

SEQ ID NO: 2730193 - RNA, 15 nt, Human
ugggacuacaggcac

SEQ ID NO: 2730194 - RNA, 16 nt, Human
ugggacuacaggcacc

SEQ ID NO: 2730195 - RNA, 20 nt, Human
ugggacucaaugcacugaca

SEQ ID NO: 2730196 - RNA, 22 nt, Human
ugggagaaccaaaaagaggcua

SEQ ID NO: 2730197 - RNA, 18 nt, Human
ugggaggaucucuugagc

SEQ ID NO: 2730198 - RNA, 16 nt, Human
ugggagagccuuccag

SEQ ID NO: 2730199 - RNA, 19 nt, Human
ugggagagaagagaaugca

SEQ ID NO: 2730200 - RNA, 21 nt, Human
ugggagagaagagaaugcaca

SEQ ID NO: 2730201 - RNA, 15 nt, Human
agggagggagggcuc

SEQ ID NO: 2730202 - RNA, 13 nt, Human
agggagggcucca

SEQ ID NO: 2730203 - RNA, 16 nt, Human
ugggcccccaaaugga

SEQ ID NO: 2730204 - RNA, 21 nt, Human
ugggcccccaaauggaaaugg

SEQ ID NO: 2730205 - RNA, 20 nt, Human
ugggaggaucucuugagccu

SEQ ID NO: 2730206 - RNA, 21 nt, Human
ugggaggaucucuugagccug

SEQ ID NO: 2730207 - RNA, 22 nt, Human
ugggaggaucucuugagccugg

SEQ ID NO: 2730208 - RNA, 19 nt, Human
ugggaggccaaggugggag

SEQ ID NO: 2730209 - RNA, 20 nt, Human
ugggaggccaaggugggagg

SEQ ID NO: 2730210 - RNA, 12 nt, Human
ugggcagaagga

SEQ ID NO: 2730211 - RNA, 11 nt, Human
ugggcagagca

SEQ ID NO: 2730212 - RNA, 12 nt, Human
ugggcagagcag

SEQ ID NO: 2730213 - RNA, 18 nt, Human
ugggccaggagccuccug

SEQ ID NO: 2730214 - RNA, 19 nt, Human
agggcucagcggggacagc

SEQ ID NO: 2730215 - RNA, 20 nt, Human
agggcucagcggggacagcu

SEQ ID NO: 2730216 - RNA, 22 nt, Human
agggcucagcggggacagcucc

SEQ ID NO: 2730217 - RNA, 23 nt, Human
agggcucagcggggacagcuccu

SEQ ID NO: 2730218 - RNA, 16 nt, Human
agggagggcuccagac

SEQ ID NO: 2730219 - RNA, 14 nt, Human
agggagggcuccag

SEQ ID NO: 2730220 - RNA, 15 nt, Human
agggagggcuccaga

SEQ ID NO: 2730221 - RNA, 21 nt, Human
aggggaauguuugccucugcc

SEQ ID NO: 2730222 - RNA, 19 nt, Human
aggggaauguuugccucug

SEQ ID NO: 2730223 - RNA, 20 nt, Human
aggggaauguuugccucugc

SEQ ID NO: 2730224 - RNA, 18 nt, Human
aggggugggacacccugu

SEQ ID NO: 2730225 - RNA, 20 nt, Human
aggggguggccucccaacuc

SEQ ID NO: 2730226 - RNA, 15 nt, Human
aggguaaggcugugg

SEQ ID NO: 2730227 - RNA, 14 nt, Human
agggucucacucug

SEQ ID NO: 2730228 - RNA, 15 nt, Human
agggucucacucugu

SEQ ID NO: 2730229 - RNA, 16 nt, Human
agggucucacucuguc

SEQ ID NO: 2730230 - RNA, 20 nt, Human
ugguagagugugccugaagu

SEQ ID NO: 2730231 - RNA, 17 nt, Human
uggguggcaccagcagc

SEQ ID NO: 2730232 - RNA, 20 nt, Human
uggguggcaccagcagccug

SEQ ID NO: 2730233 - RNA, 21 nt, Human
uggguggcaccagcagccugg

SEQ ID NO: 2730234 - RNA, 16 nt, Human
aggguggugaccucug

SEQ ID NO: 2730235 - RNA, 15 nt, Human
agggugggagugggc

SEQ ID NO: 2730236 - RNA, 22 nt, Human
uggggcugcaccggcuggccug

SEQ ID NO: 2730237 - RNA, 23 nt, Human
uggggcugcaccggcuggccugg

SEQ ID NO: 2730238 - RNA, 21 nt, Human
uggggccaguuggucccccuu

SEQ ID NO: 2730239 - RNA, 12 nt, Human
uggggcccugcc

SEQ ID NO: 2730240 - RNA, 16 nt, Human
uggggaccucaggccu

SEQ ID NO: 2730241 - RNA, 17 nt, Human
uggggaccucaggccug

SEQ ID NO: 2730242 - RNA, 14 nt, Human
uggggaccucaggc

SEQ ID NO: 2730243 - RNA, 15 nt, Human
uggggaccucaggcc

SEQ ID NO: 2730244 - RNA, 15 nt, Human
agggcuccagacaca

SEQ ID NO: 2730245 - RNA, 12 nt, Human
agggcuccagac

SEQ ID NO: 2730246 - RNA, 13 nt, Human
aggggaaaagagg

SEQ ID NO: 2730247 - RNA, 18 nt, Human
aggggaaaaucagccugc

SEQ ID NO: 2730248 - RNA, 22 nt, Human
aggggaaaaucagccugcucca

SEQ ID NO: 2730249 - RNA, 14 nt, Human
aggggaacagacug

SEQ ID NO: 2730250 - RNA, 13 nt, Human
aggggaauguuug

SEQ ID NO: 2730251 - RNA, 16 nt, Human
uggggucacucuggca

SEQ ID NO: 2730252 - RNA, 22 nt, Human
uggggucacucuggcagcucag

SEQ ID NO: 2730253 - RNA, 17 nt, Human
ugggguacccacugcuc

SEQ ID NO: 2730254 - RNA, 18 nt, Human
ugggguacccacugcucu

SEQ ID NO: 2730255 - RNA, 19 nt, Human
ugggguacccacugcucug

SEQ ID NO: 2730256 - RNA, 15 nt, Human
ugggguaugggagag

SEQ ID NO: 2730257 - RNA, 13 nt, Human
uggggucacucug

SEQ ID NO: 2730258 - RNA, 14 nt, Human
uggggucacucugg

SEQ ID NO: 2730259 - RNA, 16 nt, Human
aguucugaagaagaug

SEQ ID NO: 2730260 - RNA, 14 nt, Human
uguuuugcaagcca

SEQ ID NO: 2730261 - RNA, 14 nt, Human
aguucugguuccua

SEQ ID NO: 2730262 - RNA, 19 nt, Human
uguuuucauuaucucaaaa

SEQ ID NO: 2730263 - RNA, 20 nt, Human
uguuuuccaugaguccccug

SEQ ID NO: 2730264 - RNA, 19 nt, Human
uguuuugaaucucauaauu

SEQ ID NO: 2730265 - RNA, 19 nt, Human
uguuuggaccaaaaaccag

SEQ ID NO: 2730266 - RNA, 21 nt, Human
uguuuuauuuuaauucaguug

SEQ ID NO: 2730267 - RNA, 21 nt, Human
uguuuuauuuaaccucuaaau

SEQ ID NO: 2730268 - RNA, 14 nt, Human
uguuuauuacagua

SEQ ID NO: 2730269 - RNA, 19 nt, Human
uguuuauugucaaaguggu

SEQ ID NO: 2730270 - RNA, 17 nt, Human
uguuuauugucaaagug

SEQ ID NO: 2730271 - RNA, 23 nt, Human
uguuuagucuugucucagauuuu

SEQ ID NO: 2730272 - RNA, 20 nt, Human
uguuuagucuugucucagau

SEQ ID NO: 2730273 - RNA, 22 nt, Human
uguuuagucuugucucagauuu

SEQ ID NO: 2730274 - RNA, 19 nt, Human
uguugcccaggcaggucuu

SEQ ID NO: 2730275 - RNA, 17 nt, Human
uguuugauucagacagc

SEQ ID NO: 2730276 - RNA, 22 nt, Human
uguuugauucagacagcugccu

SEQ ID NO: 2730277 - RNA, 14 nt, Human
uguuuauuuauaga

SEQ ID NO: 2730278 - RNA, 24 nt, Human
uguuuauuuauagaguguacuuaa

SEQ ID NO: 2730279 - RNA, 16 nt, Human
aguuuagcuggaaaag

SEQ ID NO: 2730280 - RNA, 20 nt, Human
aguuuaauauuaaagccaug

SEQ ID NO: 2730281 - RNA, 19 nt, Human
aguuuaauauuaaagccau

SEQ ID NO: 2730282 - RNA, 18 nt, Human
aguuuaauauuaaagcca

SEQ ID NO: 2730283 - RNA, 16 nt, Human
aguuuaauauuaaagc

SEQ ID NO: 2730284 - RNA, 15 nt, Human
aguuuaauauuaaag

SEQ ID NO: 2730285 - RNA, 21 nt, Human
aguuguuugauucagacagcu

SEQ ID NO: 2730286 - RNA, 23 nt, Human
aguuguuugauucagacagcugc

SEQ ID NO: 2730287 - RNA, 18 nt, Human
aguuggucccccuuccau

SEQ ID NO: 2730288 - RNA, 20 nt, Human
aguuggguguauugugcgcu

SEQ ID NO: 2730289 - RNA, 17 nt, Human
aguuggguguauugugc

SEQ ID NO: 2730290 - RNA, 16 nt, Human
aguuggcuaggacccc

SEQ ID NO: 2730291 - RNA, 16 nt, Human
aguuggguguauugug

SEQ ID NO: 2730292 - RNA, 21 nt, Human
aguuggguggaugccuggugg

SEQ ID NO: 2730293 - RNA, 17 nt, Human
aguuggguggaugccug

SEQ ID NO: 2730294 - RNA, 19 nt, Human
aguugccuaaauccauuug

SEQ ID NO: 2730295 - RNA, 23 nt, Human
aguugccuaaauccauuuggaaa

SEQ ID NO: 2730296 - RNA, 22 nt, Human
aguugccuaaauccauuuggaa

SEQ ID NO: 2730297 - RNA, 14 nt, Human
uuaacaacagcugg

SEQ ID NO: 2730298 - RNA, 20 nt, Human
uuaaauucuugcaaaguauc

SEQ ID NO: 2730299 - RNA, 14 nt, Human
uuaccuuacagaag

SEQ ID NO: 2730300 - RNA, 12 nt, Human
uuaccugggaaa

SEQ ID NO: 2730301 - RNA, 20 nt, Human
uuacauaagauaaaugugcu

SEQ ID NO: 2730302 - RNA, 19 nt, Human
uuacuauggcccuggccua

SEQ ID NO: 2730303 - RNA, 23 nt, Human
uuacucagaauucucuaguuuga

SEQ ID NO: 2730304 - RNA, 18 nt, Human
uuacucagaauucucuag

SEQ ID NO: 2730305 - RNA, 15 nt, Human
uuacuguaagaaaau

SEQ ID NO: 2730306 - RNA, 14 nt, Human
uuagaaauauaauu

SEQ ID NO: 2730307 - RNA, 12 nt, Human
uuagaaauauaa

SEQ ID NO: 2730308 - RNA, 11 nt, Human
uuagaaauaua

SEQ ID NO: 2730309 - RNA, 11 nt, Human
uuagacagagu

SEQ ID NO: 2730310 - RNA, 20 nt, Human
auaaaucugugaacuugaaa

SEQ ID NO: 2730311 - RNA, 22 nt, Human
auaaaucugugaacuugaaauu

SEQ ID NO: 2730312 - RNA, 21 nt, Human
auaaaucugugaacuugaaau

SEQ ID NO: 2730313 - RNA, 18 nt, Human
auaaauagcuagacuggu

SEQ ID NO: 2730314 - RNA, 16 nt, Human
auaaauagcuagacug

SEQ ID NO: 2730315 - RNA, 14 nt, Human
uuacaggaaguacu

SEQ ID NO: 2730316 - RNA, 20 nt, Human
uuacaguauaauuaacaugu

SEQ ID NO: 2730317 - RNA, 19 nt, Human
uuacaguauaauuaacaug

SEQ ID NO: 2730318 - RNA, 18 nt, Human
uuacaguauaauuaacau

SEQ ID NO: 2730319 - RNA, 13 nt, Human
uuacaguauaauu

SEQ ID NO: 2730320 - RNA, 17 nt, Human
uuacaguauaauuaaca

SEQ ID NO: 2730321 - RNA, 16 nt, Human
uuacaguauaauuaac

SEQ ID NO: 2730322 - RNA, 16 nt, Human
auaacuaaaagguaug

SEQ ID NO: 2730323 - RNA, 20 nt, Human
uuaagaagacugcauuauau

SEQ ID NO: 2730324 - RNA, 22 nt, Human
uuaagaagacugcauuauauuu

SEQ ID NO: 2730325 - RNA, 13 nt, Human
uuaagaggcaggg

SEQ ID NO: 2730326 - RNA, 15 nt, Human
uuaagaggcaggguc

SEQ ID NO: 2730327 - RNA, 16 nt, Human
uuaagaggcagggucu

SEQ ID NO: 2730328 - RNA, 18 nt, Human
uuaaguaaugauaacugg

SEQ ID NO: 2730329 - RNA, 17 nt, Human
uuaaguacuauguauca

SEQ ID NO: 2730330 - RNA, 22 nt, Human
uuaagugcugcauuuaaaagau

SEQ ID NO: 2730331 - RNA, 15 nt, Human
auaaaauaauuuuua

SEQ ID NO: 2730332 - RNA, 16 nt, Human
auaaaauaauuuuuau

SEQ ID NO: 2730333 - RNA, 21 nt, Human
auaaaauaauuuuuauauuug

SEQ ID NO: 2730334 - RNA, 18 nt, Human
auaaaauccauacauuug

SEQ ID NO: 2730335 - RNA, 19 nt, Human
auaaaauccauacauuugu

SEQ ID NO: 2730336 - RNA, 20 nt, Human
uuaaugaaagacuguacaaa

SEQ ID NO: 2730337 - RNA, 23 nt, Human
uuaaugaaagacuguacaaagua

SEQ ID NO: 2730338 - RNA, 15 nt, Human
uuaauucuuagcuca

SEQ ID NO: 2730339 - RNA, 17 nt, Human
uuaauuccaauuauaug

SEQ ID NO: 2730340 - RNA, 19 nt, Human
uuaauuuuuuugagacaga

SEQ ID NO: 2730341 - RNA, 22 nt, Human
auaaacaagaccacguuucuaa

SEQ ID NO: 2730342 - RNA, 15 nt, Human
auaaacaagaccacg

SEQ ID NO: 2730343 - RNA, 23 nt, Human
auaaacaagaccacguuucuaaa

SEQ ID NO: 2730344 - RNA, 18 nt, Human
agucuuucacauuuaaau

SEQ ID NO: 2730345 - RNA, 14 nt, Human
agucuuuguacaga

SEQ ID NO: 2730346 - RNA, 20 nt, Human
agugaaacucguuaauuugu

SEQ ID NO: 2730347 - RNA, 22 nt, Human
agucucaggaaaucaaauaugc

SEQ ID NO: 2730348 - RNA, 16 nt, Human
agucucaggaaaucaa

SEQ ID NO: 2730349 - RNA, 16 nt, Human
ugugacugaauuucuu

SEQ ID NO: 2730350 - RNA, 15 nt, Human
ugugacugaauuucu

SEQ ID NO: 2730351 - RNA, 17 nt, Human
ugugaaccaccacaccc

SEQ ID NO: 2730352 - RNA, 12 nt, Human
ugugaacuugaa

SEQ ID NO: 2730353 - RNA, 16 nt, Human
ugugaacuugaaauuu

SEQ ID NO: 2730354 - RNA, 15 nt, Human
ugugaacuugaaauu

SEQ ID NO: 2730355 - RNA, 14 nt, Human
ugugaacuugaaau

SEQ ID NO: 2730356 - RNA, 19 nt, Human
ugugaaccaccacacccag

SEQ ID NO: 2730357 - RNA, 20 nt, Human
ugugaacaguuguguuugaa

SEQ ID NO: 2730358 - RNA, 20 nt, Human
ugugaaccaccacacccagc

SEQ ID NO: 2730359 - RNA, 21 nt, Human
ugugaaccaccacacccagcc

SEQ ID NO: 2730360 - RNA, 15 nt, Human
ugugaaaggaaagag

SEQ ID NO: 2730361 - RNA, 18 nt, Human
ugugaaaggaaagaggcu

SEQ ID NO: 2730362 - RNA, 21 nt, Human
ugugaaaggaaagagggaggu

SEQ ID NO: 2730363 - RNA, 18 nt, Human
agucacuaccuucaugca

SEQ ID NO: 2730364 - RNA, 15 nt, Human
agugaaagaaaauaa

SEQ ID NO: 2730365 - RNA, 14 nt, Human
ugugauguauucua

SEQ ID NO: 2730366 - RNA, 18 nt, Human
ugugauggggcccugccu

SEQ ID NO: 2730367 - RNA, 19 nt, Human
ugugauggggcccugccuc

SEQ ID NO: 2730368 - RNA, 20 nt, Human
ugugauggggcccugccucc

SEQ ID NO: 2730369 - RNA, 23 nt, Human
ugugcauuuggugguuucagaaa

SEQ ID NO: 2730370 - RNA, 20 nt, Human
ugugccagguuuuuggucug

SEQ ID NO: 2730371 - RNA, 12 nt, Human
ugugccaugugc

SEQ ID NO: 2730372 - RNA, 16 nt, Human
ugugccaugugccagg

SEQ ID NO: 2730373 - RNA, 15 nt, Human
agugaggcucugccc

SEQ ID NO: 2730374 - RNA, 14 nt, Human
agugaggcucugcc

SEQ ID NO: 2730375 - RNA, 16 nt, Human
agugaggcucugcccu

SEQ ID NO: 2730376 - RNA, 17 nt, Human
agugaggcucugcccuu

SEQ ID NO: 2730377 - RNA, 15 nt, Human
agugagucgaggaca

SEQ ID NO: 2730378 - RNA, 21 nt, Human
agugaguugauagcacagacc

SEQ ID NO: 2730379 - RNA, 21 nt, Human
agugaggcucugcccuugguu

SEQ ID NO: 2730380 - RNA, 19 nt, Human
agugaggcucugcccuugg

SEQ ID NO: 2730381 - RNA, 20 nt, Human
agugaggcucugcccuuggu

SEQ ID NO: 2730382 - RNA, 21 nt, Human
ugugcccccauguaagcaccc

SEQ ID NO: 2730383 - RNA, 21 nt, Human
uguggaguucaucuugaauug

SEQ ID NO: 2730384 - RNA, 18 nt, Human
ugugcugggguuaucuga

SEQ ID NO: 2730385 - RNA, 17 nt, Human
uguggaguucaucuuga

SEQ ID NO: 2730386 - RNA, 23 nt, Human
uguggguuucuaaagcugccagc

SEQ ID NO: 2730387 - RNA, 21 nt, Human
uguggguuucuaaagcugcca

SEQ ID NO: 2730388 - RNA, 13 nt, Human
uguggucccaccc

SEQ ID NO: 2730389 - RNA, 15 nt, Human
uguggucccacccca

SEQ ID NO: 2730390 - RNA, 20 nt, Human
ugugguguuuccuggcacug

SEQ ID NO: 2730391 - RNA, 18 nt, Human
uguguaagacaaaaagcu

SEQ ID NO: 2730392 - RNA, 14 nt, Human
ugugguguuuccug

SEQ ID NO: 2730393 - RNA, 16 nt, Human
ugugguguuuccuggc

SEQ ID NO: 2730394 - RNA, 20 nt, Human
agugcugggauuacaggugu

SEQ ID NO: 2730395 - RNA, 19 nt, Human
agugcugcauuuaaaagau

SEQ ID NO: 2730396 - RNA, 17 nt, Human
agugcugcauuuaaaag

SEQ ID NO: 2730397 - RNA, 16 nt, Human
agugcugcauuuaaaa

SEQ ID NO: 2730398 - RNA, 21 nt, Human
agugcugggauuacaggugug

SEQ ID NO: 2730399 - RNA, 13 nt, Human
agugcugcauuua

SEQ ID NO: 2730400 - RNA, 12 nt, Human
agugcugcauuu

SEQ ID NO: 2730401 - RNA, 20 nt, Human
agugaguuggguguauugug

SEQ ID NO: 2730402 - RNA, 19 nt, Human
agugaguuggguguauugu

SEQ ID NO: 2730403 - RNA, 22 nt, Human
agugaguugauagcacagaccc

SEQ ID NO: 2730404 - RNA, 23 nt, Human
agugaguugauagcacagacccu

SEQ ID NO: 2730405 - RNA, 13 nt, Human
uguguaaguagau

SEQ ID NO: 2730406 - RNA, 17 nt, Human
ugugucucuugguccug

SEQ ID NO: 2730407 - RNA, 20 nt, Human
ugugucucuugguccugcug

SEQ ID NO: 2730408 - RNA, 21 nt, Human
ugugucuugcaauggcagccu

SEQ ID NO: 2730409 - RNA, 21 nt, Human
ugugucucuugguccugcugc

SEQ ID NO: 2730410 - RNA, 20 nt, Human
ugugucuugcaauggcagcc

SEQ ID NO: 2730411 - RNA, 19 nt, Human
uguguguuuauugucaaag

SEQ ID NO: 2730412 - RNA, 23 nt, Human
uguguguuuauugucaaaguggu

SEQ ID NO: 2730413 - RNA, 15 nt, Human
uguuaaguaugugua

SEQ ID NO: 2730414 - RNA, 16 nt, Human
uguuaaguauguguaa

SEQ ID NO: 2730415 - RNA, 19 nt, Human
uguguuaaguauguguaaa

SEQ ID NO: 2730416 - RNA, 13 nt, Human
uguguugaagagg

SEQ ID NO: 2730417 - RNA, 15 nt, Human
uguuauaaucuuuca

SEQ ID NO: 2730418 - RNA, 14 nt, Human
agugugucuaaauu

SEQ ID NO: 2730419 - RNA, 20 nt, Human
agugugucuuagugugugca

SEQ ID NO: 2730420 - RNA, 20 nt, Human
uguuccacaaguuaaauaaa

SEQ ID NO: 2730421 - RNA, 18 nt, Human
uguuccuagugaaagagg

SEQ ID NO: 2730422 - RNA, 14 nt, Human
uguuccuagugaaa

SEQ ID NO: 2730423 - RNA, 16 nt, Human
uguucugggacacagu

SEQ ID NO: 2730424 - RNA, 13 nt, Human
uguugcccaggca

SEQ ID NO: 2730425 - RNA, 12 nt, Human
uguugcccaggc

SEQ ID NO: 2730426 - RNA, 15 nt, Human
uguugcccaggcagg

SEQ ID NO: 2730427 - RNA, 16 nt, Human
uguugcccaggcaggu

SEQ ID NO: 2730428 - RNA, 17 nt, Human
uguugcccaggcagguc

SEQ ID NO: 2730429 - RNA, 18 nt, Human
uguugcccaggcaggucu

SEQ ID NO: 2730430 - RNA, 21 nt, Human
agugguggugaacagaacaaa

SEQ ID NO: 2730431 - RNA, 18 nt, Human
aguggugguuuucuguuc

SEQ ID NO: 2730432 - RNA, 17 nt, Human
aguggugguuuucuguu

SEQ ID NO: 2730433 - RNA, 23 nt, Human
aguggugguuuucuguucuuucu

SEQ ID NO: 2730434 - RNA, 21 nt, Human
aguggugguuuucuguucuuu

SEQ ID NO: 2730435 - RNA, 20 nt, Human
aguggugguuuucuguucuu

SEQ ID NO: 2730436 - RNA, 19 nt, Human
aguggugguuuucuguucu

SEQ ID NO: 2730437 - RNA, 17 nt, Human
aguggugcgaucugggu

SEQ ID NO: 2730438 - RNA, 17 nt, Human
aguguacuuaacuauuc

SEQ ID NO: 2730439 - RNA, 17 nt, Human
agugugguguuuccugg

SEQ ID NO: 2730440 - RNA, 19 nt, Human
agugugguguuuccuggca

SEQ ID NO: 2730441 - RNA, 16 nt, Human
agugugguguuuccug

SEQ ID NO: 2730442 - RNA, 19 nt, Human
aucaauuuuucuuauuuca

SEQ ID NO: 2730443 - RNA, 22 nt, Human
aucacggcucacugcagccuca

SEQ ID NO: 2730444 - RNA, 13 nt, Human
aucaaguauuaua

SEQ ID NO: 2730445 - RNA, 18 nt, Human
aucaaguauuauaccuuu

SEQ ID NO: 2730446 - RNA, 14 nt, Human
aucaaguauuauac

SEQ ID NO: 2730447 - RNA, 13 nt, Human
auauuuuaugauc

SEQ ID NO: 2730448 - RNA, 12 nt, Human
auauuuuaugau

SEQ ID NO: 2730449 - RNA, 22 nt, Human
auauuuuaugauccagcagauu

SEQ ID NO: 2730450 - RNA, 17 nt, Human
auauuuuaugauccagc

SEQ ID NO: 2730451 - RNA, 13 nt, Human
uuccuaauccucu

SEQ ID NO: 2730452 - RNA, 15 nt, Human
uuccuaauccucuag

SEQ ID NO: 2730453 - RNA, 11 nt, Human
uuccuucagug

SEQ ID NO: 2730454 - RNA, 14 nt, Human
uuccuucagugccu

SEQ ID NO: 2730455 - RNA, 21 nt, Human
auauuuucaugcuguucauga

SEQ ID NO: 2730456 - RNA, 18 nt, Human
auauuuucaugcuguuca

SEQ ID NO: 2730457 - RNA, 15 nt, Human
uuccugggagcuuuu

SEQ ID NO: 2730458 - RNA, 11 nt, Human
uuccucuuucc

SEQ ID NO: 2730459 - RNA, 16 nt, Human
uuccugggagcuuuug

SEQ ID NO: 2730460 - RNA, 17 nt, Human
uuccuguucccaugaga

SEQ ID NO: 2730461 - RNA, 13 nt, Human
auauuugaaauau

SEQ ID NO: 2730462 - RNA, 17 nt, Human
auauuguuuucagugua

SEQ ID NO: 2730463 - RNA, 20 nt, Human
auauuguuuucaguguacau

SEQ ID NO: 2730464 - RNA, 17 nt, Human
auauuguguugugaaug

SEQ ID NO: 2730465 - RNA, 18 nt, Human
auauuguguugugaaugu

SEQ ID NO: 2730466 - RNA, 17 nt, Human
auauugcugauggugca

SEQ ID NO: 2730467 - RNA, 21 nt, Human
auauugcugauggugcaauga

SEQ ID NO: 2730468 - RNA, 22 nt, Human
auauuuguaucacaaaucuuaa

SEQ ID NO: 2730469 - RNA, 12 nt, Human
auauuuuaacuu

SEQ ID NO: 2730470 - RNA, 23 nt, Human
auauuugaaauauugacuuuuua

SEQ ID NO: 2730471 - RNA, 14 nt, Human
auauuugaaauauu

SEQ ID NO: 2730472 - RNA, 19 nt, Human
auauuugaaauauugacuu

SEQ ID NO: 2730473 - RNA, 22 nt, Human
auauuaaggaagacaaugugaa

SEQ ID NO: 2730474 - RNA, 24 nt, Human
auauuaagaaagacuaucuaaaug

SEQ ID NO: 2730475 - RNA, 23 nt, Human
auauuaaagccauguuuauuaca

SEQ ID NO: 2730476 - RNA, 18 nt, Human
auauuaaagccauguuua

SEQ ID NO: 2730477 - RNA, 15 nt, Human
auauuaaagccaugu

SEQ ID NO: 2730478 - RNA, 14 nt, Human
auauuaaagccaug

SEQ ID NO: 2730479 - RNA, 20 nt, Human
auauguuuuaagaggcaggg

SEQ ID NO: 2730480 - RNA, 18 nt, Human
auauguuuuaagaggcag

SEQ ID NO: 2730481 - RNA, 17 nt, Human
auauguuucaaacuuug

SEQ ID NO: 2730482 - RNA, 19 nt, Human
auauugauuuccguuaaaa

SEQ ID NO: 2730483 - RNA, 22 nt, Human
auauugauuuccguuaaaauac

SEQ ID NO: 2730484 - RNA, 21 nt, Human
auauugauuuccguuaaaaua

SEQ ID NO: 2730485 - RNA, 23 nt, Human
auauucucacagcuccaagaauu

SEQ ID NO: 2730486 - RNA, 22 nt, Human
auauucucacagcuccaagaau

SEQ ID NO: 2730487 - RNA, 16 nt, Human
auauucuguuggccag

SEQ ID NO: 2730488 - RNA, 21 nt, Human
auauucucacagcuccaagaa

SEQ ID NO: 2730489 - RNA, 12 nt, Human
uucugaagaaga

SEQ ID NO: 2730490 - RNA, 13 nt, Human
uucugaagaagau

SEQ ID NO: 2730491 - RNA, 21 nt, Human
uucugaaauuuccugggagcu

SEQ ID NO: 2730492 - RNA, 14 nt, Human
uucugaagaagaug

SEQ ID NO: 2730493 - RNA, 23 nt, Human
uucugcaucagcugcugaaacaa

SEQ ID NO: 2730494 - RNA, 16 nt, Human
uucugcaucagcugcu

SEQ ID NO: 2730495 - RNA, 19 nt, Human
aucauugaaaucuuuuugc

SEQ ID NO: 2730496 - RNA, 15 nt, Human
uucugaaagggacgc

SEQ ID NO: 2730497 - RNA, 23 nt, Human
uucugccgcagcccugcagaggg

SEQ ID NO: 2730498 - RNA, 16 nt, Human
uucugccgcagcccug

SEQ ID NO: 2730499 - RNA, 10 nt, Human
uucugggaca

SEQ ID NO: 2730500 - RNA, 11 nt, Human
uucugggacac

SEQ ID NO: 2730501 - RNA, 22 nt, Human
uucugggacacaguucaauucu

SEQ ID NO: 2730502 - RNA, 11 nt, Human
aucccucccuc

SEQ ID NO: 2730503 - RNA, 13 nt, Human
aucccucccucca

SEQ ID NO: 2730504 - RNA, 23 nt, Human
aucccucccuccaccucccugca

SEQ ID NO: 2730505 - RNA, 16 nt, Human
aucccauaugccuggg

SEQ ID NO: 2730506 - RNA, 17 nt, Human
aucccauaugccugggc

SEQ ID NO: 2730507 - RNA, 15 nt, Human
auccagguucagcuu

SEQ ID NO: 2730508 - RNA, 16 nt, Human
auccagguucagcuug

SEQ ID NO: 2730509 - RNA, 14 nt, Human
uucucaacuccaaa

SEQ ID NO: 2730510 - RNA, 18 nt, Human
uucucaacuccaaacuga

SEQ ID NO: 2730511 - RNA, 13 nt, Human
uucuaggccuggg

SEQ ID NO: 2730512 - RNA, 23 nt, Human
uucuaggacugaauuaugaaacu

SEQ ID NO: 2730513 - RNA, 22 nt, Human
uucucagaaucucaaauaacua

SEQ ID NO: 2730514 - RNA, 19 nt, Human
uucucagaaucucaaauaa

SEQ ID NO: 2730515 - RNA, 23 nt, Human
uucucagaaucucaaauaacuaa

SEQ ID NO: 2730516 - RNA, 14 nt, Human
aucauugaaaucuu

SEQ ID NO: 2730517 - RNA, 15 nt, Human
aucauugaaaucuuu

SEQ ID NO: 2730518 - RNA, 20 nt, Human
aucagugugucuaaauuuga

SEQ ID NO: 2730519 - RNA, 19 nt, Human
aucagugugucuaaauuug

SEQ ID NO: 2730520 - RNA, 16 nt, Human
aucagcacgauuucug

SEQ ID NO: 2730521 - RNA, 15 nt, Human
aucagcacgauuucu

SEQ ID NO: 2730522 - RNA, 18 nt, Human
aucagcacgauuucuguu

SEQ ID NO: 2730523 - RNA, 17 nt, Human
aucagcacgauuucugu

SEQ ID NO: 2730524 - RNA, 17 nt, Human
uuauuguuuaaaaucau

SEQ ID NO: 2730525 - RNA, 17 nt, Human
auagcugggacuacagg

SEQ ID NO: 2730526 - RNA, 22 nt, Human
uuauuuaaugaaagacuguaca

SEQ ID NO: 2730527 - RNA, 18 nt, Human
uuauuuaaugaaagacug

SEQ ID NO: 2730528 - RNA, 14 nt, Human
uuauuuaaauuuua

SEQ ID NO: 2730529 - RNA, 16 nt, Human
uuauuuaguuccuuga

SEQ ID NO: 2730530 - RNA, 18 nt, Human
auagcuacuaauuuuaaa

SEQ ID NO: 2730531 - RNA, 14 nt, Human
auagcuagacuggu

SEQ ID NO: 2730532 - RNA, 16 nt, Human
auagcuagacugguga

SEQ ID NO: 2730533 - RNA, 15 nt, Human
auagcuagacuggug

SEQ ID NO: 2730534 - RNA, 23 nt, Human
auagcuagacuggugacugauuc

SEQ ID NO: 2730535 - RNA, 19 nt, Human
auagcuagacuggugacug

SEQ ID NO: 2730536 - RNA, 18 nt, Human
auagcuagacuggugacu

SEQ ID NO: 2730537 - RNA, 19 nt, Human
auagcucaggugucccugc

SEQ ID NO: 2730538 - RNA, 22 nt, Human
auagcucaggugucccugcacu

SEQ ID NO: 2730539 - RNA, 20 nt, Human
auagcucaggugucccugca

SEQ ID NO: 2730540 - RNA, 21 nt, Human
auagcucaggugucccugcac

SEQ ID NO: 2730541 - RNA, 12 nt, Human
auagcugggacu

SEQ ID NO: 2730542 - RNA, 17 nt, Human
auagcuacuaauuuuaa

SEQ ID NO: 2730543 - RNA, 14 nt, Human
auagcuacuaauuu

SEQ ID NO: 2730544 - RNA, 18 nt, Human
auagccugccucuucucu

SEQ ID NO: 2730545 - RNA, 17 nt, Human
auaagauaaaugugcug

SEQ ID NO: 2730546 - RNA, 13 nt, Human
auaagauaaaugu

SEQ ID NO: 2730547 - RNA, 19 nt, Human
auaggaacuuaaauaaugu

SEQ ID NO: 2730548 - RNA, 14 nt, Human
uucacauuggaaac

SEQ ID NO: 2730549 - RNA, 22 nt, Human
uucaccacaugugcacaugcac

SEQ ID NO: 2730550 - RNA, 13 nt, Human
uucacauuggaaa

SEQ ID NO: 2730551 - RNA, 17 nt, Human
uucacauauugauuucc

SEQ ID NO: 2730552 - RNA, 20 nt, Human
uucacauaucuaguaugaaa

SEQ ID NO: 2730553 - RNA, 21 nt, Human
uucacauaucuaguaugaaau

SEQ ID NO: 2730554 - RNA, 15 nt, Human
uucaaacauauauaa

SEQ ID NO: 2730555 - RNA, 16 nt, Human
uucaaacuuuggaaca

SEQ ID NO: 2730556 - RNA, 17 nt, Human
uucaaaauaaaaaugag

SEQ ID NO: 2730557 - RNA, 15 nt, Human
uucaaggauccugag

SEQ ID NO: 2730558 - RNA, 22 nt, Human
uucaagaaaacaacuucaauau

SEQ ID NO: 2730559 - RNA, 16 nt, Human
uucaaggauccugagc

SEQ ID NO: 2730560 - RNA, 18 nt, Human
uucaaggauccugagcca

SEQ ID NO: 2730561 - RNA, 19 nt, Human
uucaaggauccugagccag

SEQ ID NO: 2730562 - RNA, 21 nt, Human
uucaaggauccugagccagau

SEQ ID NO: 2730563 - RNA, 17 nt, Human
auagucaaauuguguga

SEQ ID NO: 2730564 - RNA, 18 nt, Human
auagucaaauugugugaa

SEQ ID NO: 2730565 - RNA, 19 nt, Human
auauauaacaaugcuguau

SEQ ID NO: 2730566 - RNA, 17 nt, Human
auauauaacaaugcugu

SEQ ID NO: 2730567 - RNA, 18 nt, Human
auauauaacaaugcugua

SEQ ID NO: 2730568 - RNA, 19 nt, Human
auauaaguauucuaaauuu

SEQ ID NO: 2730569 - RNA, 19 nt, Human
auauaagcuuguauuccuu

SEQ ID NO: 2730570 - RNA, 17 nt, Human
auauaaguauucuaaau

SEQ ID NO: 2730571 - RNA, 12 nt, Human
auauaacaaugc

SEQ ID NO: 2730572 - RNA, 15 nt, Human
auauaacaaugcugu

SEQ ID NO: 2730573 - RNA, 14 nt, Human
uucagccaagaauu

SEQ ID NO: 2730574 - RNA, 19 nt, Human
uucagccaagaauucuuaa

SEQ ID NO: 2730575 - RNA, 21 nt, Human
uucagcaaaaauauuuuauga

SEQ ID NO: 2730576 - RNA, 17 nt, Human
uucagaucucuaacuuc

SEQ ID NO: 2730577 - RNA, 13 nt, Human
uucagaaaauauu

SEQ ID NO: 2730578 - RNA, 14 nt, Human
uucagaaaauauua

SEQ ID NO: 2730579 - RNA, 20 nt, Human
uucagaaaauauuauguguu

SEQ ID NO: 2730580 - RNA, 21 nt, Human
uucagaaaauauuauguguuu

SEQ ID NO: 2730581 - RNA, 15 nt, Human
auaugcaaagcacug

SEQ ID NO: 2730582 - RNA, 16 nt, Human
auaugcaaagcacuga

SEQ ID NO: 2730583 - RNA, 23 nt, Human
auaugcaaagcacugacuucuaa

SEQ ID NO: 2730584 - RNA, 14 nt, Human
auaugucaagccau

SEQ ID NO: 2730585 - RNA, 13 nt, Human
auaugugaacagu

SEQ ID NO: 2730586 - RNA, 20 nt, Human
auaugauuuaaaucagccgu

SEQ ID NO: 2730587 - RNA, 22 nt, Human
auaugauucaaaugucuauaaa

SEQ ID NO: 2730588 - RNA, 13 nt, Human
auaugauucaaau

SEQ ID NO: 2730589 - RNA, 12 nt, Human
auaugauucaaa

SEQ ID NO: 2730590 - RNA, 23 nt, Human
auaucugaggaauucuguauaga

SEQ ID NO: 2730591 - RNA, 22 nt, Human
auaucugaggaauucuguauag

SEQ ID NO: 2730592 - RNA, 21 nt, Human
auaucugaggaauucuguaua

SEQ ID NO: 2730593 - RNA, 20 nt, Human
auaucugaggaauucuguau

SEQ ID NO: 2730594 - RNA, 19 nt, Human
auaucugaggaauucugua

SEQ ID NO: 2730595 - RNA, 22 nt, Human
auaucugaaaauguauguguaa

SEQ ID NO: 2730596 - RNA, 18 nt, Human
auaucugaggaauucugu

SEQ ID NO: 2730597 - RNA, 17 nt, Human
auaucugaggaauucug

SEQ ID NO: 2730598 - RNA, 16 nt, Human
auaucugaggaauucu

SEQ ID NO: 2730599 - RNA, 15 nt, Human
auaucugaggaauuc

SEQ ID NO: 2730600 - RNA, 14 nt, Human
uucaguaauaacuc

SEQ ID NO: 2730601 - RNA, 21 nt, Human
uucauauuuacuucuuauaca

SEQ ID NO: 2730602 - RNA, 16 nt, Human
uucauauuuacuucuu

SEQ ID NO: 2730603 - RNA, 18 nt, Human
uucaucauccuaagcuau

SEQ ID NO: 2730604 - RNA, 21 nt, Human
uucaucauccuaagcuauuca

SEQ ID NO: 2730605 - RNA, 22 nt, Human
auaucuauauuuuacauaaauu

SEQ ID NO: 2730606 - RNA, 20 nt, Human
auaucuauauuuuacauaaa

SEQ ID NO: 2730607 - RNA, 16 nt, Human
auaucuauauuuuaca

SEQ ID NO: 2730608 - RNA, 17 nt, Human
auaucuauauuuuacau

SEQ ID NO: 2730609 - RNA, 18 nt, Human
augaacuuguaaaggaau

SEQ ID NO: 2730610 - RNA, 17 nt, Human
augaaugaaacauuuug

SEQ ID NO: 2730611 - RNA, 23 nt, Human
augaaccacaucuugcucugcug

SEQ ID NO: 2730612 - RNA, 22 nt, Human
augaaccacaucuugcucugcu

SEQ ID NO: 2730613 - RNA, 20 nt, Human
uugguuuucacauuggaaac

SEQ ID NO: 2730614 - RNA, 17 nt, Human
uuggugucgggcaugac

SEQ ID NO: 2730615 - RNA, 18 nt, Human
uuggugucgggcaugaca

SEQ ID NO: 2730616 - RNA, 19 nt, Human
uuggugucgggcaugacac

SEQ ID NO: 2730617 - RNA, 14 nt, Human
uugguuuguaaauu

SEQ ID NO: 2730618 - RNA, 19 nt, Human
uuggugguuucagaaaugu

SEQ ID NO: 2730619 - RNA, 18 nt, Human
uuggugguuucagaaaug

SEQ ID NO: 2730620 - RNA, 16 nt, Human
augaaugucaguguga

SEQ ID NO: 2730621 - RNA, 18 nt, Human
augaaugucagugugacu

SEQ ID NO: 2730622 - RNA, 15 nt, Human
aucuuauaauuuaaa

SEQ ID NO: 2730623 - RNA, 16 nt, Human
aucuuauaauuuaaaa

SEQ ID NO: 2730624 - RNA, 14 nt, Human
aucuugcucugcug

SEQ ID NO: 2730625 - RNA, 15 nt, Human
aucuugcucugcuga

SEQ ID NO: 2730626 - RNA, 16 nt, Human
aucuugcucugcugac

SEQ ID NO: 2730627 - RNA, 12 nt, Human
aucugucauuug

SEQ ID NO: 2730628 - RNA, 17 nt, Human
aucugucauuugagcag

SEQ ID NO: 2730629 - RNA, 22 nt, Human
aucugucauuugagcagggcuc

SEQ ID NO: 2730630 - RNA, 15 nt, Human
aucuuuaaaauacac

SEQ ID NO: 2730631 - RNA, 12 nt, Human
aucuuuaaaaua

SEQ ID NO: 2730632 - RNA, 15 nt, Human
uugcuuugugauuuu

SEQ ID NO: 2730633 - RNA, 17 nt, Human
uuggagaagaacugaaa

SEQ ID NO: 2730634 - RNA, 22 nt, Human
uuggagaagaacugaaaucaua

SEQ ID NO: 2730635 - RNA, 15 nt, Human
uuggagaagaacuga

SEQ ID NO: 2730636 - RNA, 18 nt, Human
uuggagacacaacuauuu

SEQ ID NO: 2730637 - RNA, 20 nt, Human
uugcuuugugauuuuuguaa

SEQ ID NO: 2730638 - RNA, 17 nt, Human
uuggaaaauaaauuauu

SEQ ID NO: 2730639 - RNA, 15 nt, Human
aucucaaaacugcac

SEQ ID NO: 2730640 - RNA, 20 nt, Human
aucucaaaacugcacuguca

SEQ ID NO: 2730641 - RNA, 19 nt, Human
aucucaaaacugcacuguc

SEQ ID NO: 2730642 - RNA, 21 nt, Human
aucucaaauaacuaaaaggua

SEQ ID NO: 2730643 - RNA, 14 nt, Human
aucucaaauaacua

SEQ ID NO: 2730644 - RNA, 23 nt, Human
aucucaaauaacuaaaagguaug

SEQ ID NO: 2730645 - RNA, 14 nt, Human
aucucaaauuucua

SEQ ID NO: 2730646 - RNA, 19 nt, Human
aucuagauacuguaucaug

SEQ ID NO: 2730647 - RNA, 19 nt, Human
aucuaggaagacuuuggaa

SEQ ID NO: 2730648 - RNA, 17 nt, Human
aucuaggaagacuuugg

SEQ ID NO: 2730649 - RNA, 18 nt, Human
aucuaggaagacuuugga

SEQ ID NO: 2730650 - RNA, 21 nt, Human
uugagugcugucuccauguuu

SEQ ID NO: 2730651 - RNA, 11 nt, Human
uugagugccuu

SEQ ID NO: 2730652 - RNA, 18 nt, Human
uugauagcacagacccug

SEQ ID NO: 2730653 - RNA, 17 nt, Human
uugauacuacaguuugu

SEQ ID NO: 2730654 - RNA, 15 nt, Human
uugauacuacaguuu

SEQ ID NO: 2730655 - RNA, 20 nt, Human
aucuaauauguaacaagcca

SEQ ID NO: 2730656 - RNA, 23 nt, Human
aucuaauauguaacaagccaccc

SEQ ID NO: 2730657 - RNA, 18 nt, Human
aucuagauacuguaucau

SEQ ID NO: 2730658 - RNA, 13 nt, Human
uugacaugggaca

SEQ ID NO: 2730659 - RNA, 13 nt, Human
uugacaucaacug

SEQ ID NO: 2730660 - RNA, 16 nt, Human
uugacaucaacugcau

SEQ ID NO: 2730661 - RNA, 19 nt, Human
uugacaggauuauuggaaa

SEQ ID NO: 2730662 - RNA, 10 nt, Human
uugacagggc

SEQ ID NO: 2730663 - RNA, 12 nt, Human
uugacagggcac

SEQ ID NO: 2730664 - RNA, 12 nt, Human
uugacuuuuuau

SEQ ID NO: 2730665 - RNA, 17 nt, Human
uugaccauucuccaccu

SEQ ID NO: 2730666 - RNA, 11 nt, Human
uugagacagag

SEQ ID NO: 2730667 - RNA, 12 nt, Human
uugagcagggcu

SEQ ID NO: 2730668 - RNA, 16 nt, Human
uugagcagggcucagc

SEQ ID NO: 2730669 - RNA, 17 nt, Human
aucucaaauuucuaaau

SEQ ID NO: 2730670 - RNA, 16 nt, Human
aucucaaauuucuaaa

SEQ ID NO: 2730671 - RNA, 23 nt, Human
aucucacacaugagcaucaggcc

SEQ ID NO: 2730672 - RNA, 23 nt, Human
aucugaagucagaucugccuaag

SEQ ID NO: 2730673 - RNA, 18 nt, Human
aucugaagucagaucugc

SEQ ID NO: 2730674 - RNA, 17 nt, Human
aucugaagucagaucug

SEQ ID NO: 2730675 - RNA, 16 nt, Human
aucugaagucagaucu

SEQ ID NO: 2730676 - RNA, 21 nt, Human
uugauuaaauucuugcaaagu

SEQ ID NO: 2730677 - RNA, 20 nt, Human
uugauuaaauucuugcaaag

SEQ ID NO: 2730678 - RNA, 16 nt, Human
uugauuaaauucuugc

SEQ ID NO: 2730679 - RNA, 15 nt, Human
uugauuaaauucuug

SEQ ID NO: 2730680 - RNA, 20 nt, Human
uugauguguuuauuuauaga

SEQ ID NO: 2730681 - RNA, 14 nt, Human
aucugacuaugaca

SEQ ID NO: 2730682 - RNA, 17 nt, Human
aucugacuaugacauaa

SEQ ID NO: 2730683 - RNA, 23 nt, Human
uugauguucuuucacccuuuucu

SEQ ID NO: 2730684 - RNA, 11 nt, Human
uugcccaggcu

SEQ ID NO: 2730685 - RNA, 12 nt, Human
uugcccaggcug

SEQ ID NO: 2730686 - RNA, 14 nt, Human
uugcccaggcuggc

SEQ ID NO: 2730687 - RNA, 23 nt, Human
uugcccaggcuggcgugcagugg

SEQ ID NO: 2730688 - RNA, 13 nt, Human
uugcccaggcagg

SEQ ID NO: 2730689 - RNA, 14 nt, Human
uugcccaggcaggu

SEQ ID NO: 2730690 - RNA, 16 nt, Human
uugcccaggcaggucu

SEQ ID NO: 2730691 - RNA, 18 nt, Human
uugcccaggcaggucuug

SEQ ID NO: 2730692 - RNA, 21 nt, Human
uugcaccacugcacuccagcc

SEQ ID NO: 2730693 - RNA, 14 nt, Human
uugcaauggcagcc

SEQ ID NO: 2730694 - RNA, 12 nt, Human
uugcaugaggcu

SEQ ID NO: 2730695 - RNA, 14 nt, Human
uugcaugaggcuag

SEQ ID NO: 2730696 - RNA, 21 nt, Human
uuuauaugcuucuguuuuaua

SEQ ID NO: 2730697 - RNA, 19 nt, Human
uuuauaugcuucuguuuua

SEQ ID NO: 2730698 - RNA, 23 nt, Human
uuuagucuugucucagauuuuau

SEQ ID NO: 2730699 - RNA, 17 nt, Human
uuuagucuugucucaga

SEQ ID NO: 2730700 - RNA, 17 nt, Human
uuuagggguagcauuug

SEQ ID NO: 2730701 - RNA, 15 nt, Human
uuuagucuugucuca

SEQ ID NO: 2730702 - RNA, 15 nt, Human
uuuacuucuuauaca

SEQ ID NO: 2730703 - RNA, 14 nt, Human
uuuacuucuuauac

SEQ ID NO: 2730704 - RNA, 13 nt, Human
uuuacuucuuaua

SEQ ID NO: 2730705 - RNA, 16 nt, Human
uuuacugcagcuuugu

SEQ ID NO: 2730706 - RNA, 11 nt, Human
uuuacuuaaac

SEQ ID NO: 2730707 - RNA, 22 nt, Human
uuuaccugaagucuuuguacag

SEQ ID NO: 2730708 - RNA, 18 nt, Human
uuuaccugaagucuuugu

SEQ ID NO: 2730709 - RNA, 14 nt, Human
augccuuuucccaa

SEQ ID NO: 2730710 - RNA, 15 nt, Human
augccucucucaggc

SEQ ID NO: 2730711 - RNA, 20 nt, Human
augccuuuucccaacuccag

SEQ ID NO: 2730712 - RNA, 22 nt, Human
augccuuuucccaacuccagaa

SEQ ID NO: 2730713 - RNA, 13 nt, Human
augccucucucag

SEQ ID NO: 2730714 - RNA, 14 nt, Human
augccucucucagg

SEQ ID NO: 2730715 - RNA, 18 nt, Human
augcuacaggauuugaaa

SEQ ID NO: 2730716 - RNA, 20 nt, Human
augcgugcauaccacuuuug

SEQ ID NO: 2730717 - RNA, 22 nt, Human
augcgugcauaccacuuuuguu

SEQ ID NO: 2730718 - RNA, 14 nt, Human
augccaucaauaaa

SEQ ID NO: 2730719 - RNA, 23 nt, Human
uuuaaugaaagacuguacaaagu

SEQ ID NO: 2730720 - RNA, 21 nt, Human
uuuaaugaaagacuguacaaa

SEQ ID NO: 2730721 - RNA, 17 nt, Human
augcccagccccuucug

SEQ ID NO: 2730722 - RNA, 20 nt, Human
augccccugaauuuaaauag

SEQ ID NO: 2730723 - RNA, 15 nt, Human
augccccugaauuua

SEQ ID NO: 2730724 - RNA, 15 nt, Human
augcccagccccuuc

SEQ ID NO: 2730725 - RNA, 16 nt, Human
augcccagccccuucu

SEQ ID NO: 2730726 - RNA, 21 nt, Human
augccaugaggaacaaggcaa

SEQ ID NO: 2730727 - RNA, 23 nt, Human
augcuguauuuuaaaagaaugau

SEQ ID NO: 2730728 - RNA, 23 nt, Human
augcuguucaugaaagauucaau

SEQ ID NO: 2730729 - RNA, 19 nt, Human
augcuguauuuuaaaagaa

SEQ ID NO: 2730730 - RNA, 22 nt, Human
augcuguauuuuaaaagaauga

SEQ ID NO: 2730731 - RNA, 19 nt, Human
augcuggcuguuggcuggg

SEQ ID NO: 2730732 - RNA, 20 nt, Human
augcuggcuguuggcugggg

SEQ ID NO: 2730733 - RNA, 21 nt, Human
augcuucuguuuuauaauuuu

SEQ ID NO: 2730734 - RNA, 16 nt, Human
augcuucucacugcca

SEQ ID NO: 2730735 - RNA, 20 nt, Human
augcuucucacugccaugcc

SEQ ID NO: 2730736 - RNA, 17 nt, Human
auggaagacagcucuua

SEQ ID NO: 2730737 - RNA, 18 nt, Human
auggaagacagcucuuau

SEQ ID NO: 2730738 - RNA, 14 nt, Human
uuuaucagaauucu

SEQ ID NO: 2730739 - RNA, 14 nt, Human
augcuccuggccca

SEQ ID NO: 2730740 - RNA, 19 nt, Human
augcuccuggcccacugca

SEQ ID NO: 2730741 - RNA, 18 nt, Human
augcuggcuguuggcugg

SEQ ID NO: 2730742 - RNA, 19 nt, Human
uuucaaacauauauaacaa

SEQ ID NO: 2730743 - RNA, 12 nt, Human
uuucaaacuuua

SEQ ID NO: 2730744 - RNA, 22 nt, Human
uuucacauaucuaguaugaaau

SEQ ID NO: 2730745 - RNA, 17 nt, Human
uuucaaacauauauaac

SEQ ID NO: 2730746 - RNA, 21 nt, Human
auggaaugcuguguuaaauaa

SEQ ID NO: 2730747 - RNA, 17 nt, Human
auggaaugcuguguuaa

SEQ ID NO: 2730748 - RNA, 13 nt, Human
uuucacauuggaa

SEQ ID NO: 2730749 - RNA, 19 nt, Human
uuucacauuggaaacaagu

SEQ ID NO: 2730750 - RNA, 14 nt, Human
uuucacauuggaaa

SEQ ID NO: 2730751 - RNA, 16 nt, Human
uuucccuauuagagaa

SEQ ID NO: 2730752 - RNA, 19 nt, Human
uuucaugcuguucaugaaa

SEQ ID NO: 2730753 - RNA, 21 nt, Human
uuucaugcuguucaugaaaga

SEQ ID NO: 2730754 - RNA, 12 nt, Human
uuucagaaaugu

SEQ ID NO: 2730755 - RNA, 11 nt, Human
uuucagaaaug

SEQ ID NO: 2730756 - RNA, 21 nt, Human
uuuaaauauaugcuaagucuu

SEQ ID NO: 2730757 - RNA, 11 nt, Human
uuuaaaugcac

SEQ ID NO: 2730758 - RNA, 22 nt, Human
uuuaaggaugcuuguacauaau

SEQ ID NO: 2730759 - RNA, 21 nt, Human
uuuaaggaugcuuguacauaa

SEQ ID NO: 2730760 - RNA, 20 nt, Human
uuuaaggaugcuuguacaua

SEQ ID NO: 2730761 - RNA, 16 nt, Human
uuuaaugaaagacugu

SEQ ID NO: 2730762 - RNA, 19 nt, Human
uuuaaggaugcuuguacau

SEQ ID NO: 2730763 - RNA, 21 nt, Human
uuuaagcuguuacugucuuca

SEQ ID NO: 2730764 - RNA, 12 nt, Human
uuuaagagaaau

SEQ ID NO: 2730765 - RNA, 14 nt, Human
uuuaagaggcaggg

SEQ ID NO: 2730766 - RNA, 14 nt, Human
augcaaagcacuga

SEQ ID NO: 2730767 - RNA, 13 nt, Human
augcaaagcacug

SEQ ID NO: 2730768 - RNA, 12 nt, Human
augcaaagcacu

SEQ ID NO: 2730769 - RNA, 21 nt, Human
augcacuuuguucuggcucuu

SEQ ID NO: 2730770 - RNA, 18 nt, Human
uuuaaaaaaauuccaagu

SEQ ID NO: 2730771 - RNA, 23 nt, Human
augcacuuuguucuggcucuucc

SEQ ID NO: 2730772 - RNA, 16 nt, Human
uuguucauacauauuu

SEQ ID NO: 2730773 - RNA, 18 nt, Human
uuguucauacauauuuuu

SEQ ID NO: 2730774 - RNA, 19 nt, Human
uuguucuugguuuguaaau

SEQ ID NO: 2730775 - RNA, 17 nt, Human
uuguucuugguuuguaa

SEQ ID NO: 2730776 - RNA, 16 nt, Human
uuguagcuuuaucaaa

SEQ ID NO: 2730777 - RNA, 17 nt, Human
uuguagcuuuaucaaag

SEQ ID NO: 2730778 - RNA, 18 nt, Human
uuguagcauccuggaaua

SEQ ID NO: 2730779 - RNA, 16 nt, Human
uuguagcauccuggaa

SEQ ID NO: 2730780 - RNA, 22 nt, Human
augaggucagagccugcaguua

SEQ ID NO: 2730781 - RNA, 19 nt, Human
augaggucagagccugcag

SEQ ID NO: 2730782 - RNA, 20 nt, Human
augaggucagagccugcagu

SEQ ID NO: 2730783 - RNA, 15 nt, Human
augaggucagagccu

SEQ ID NO: 2730784 - RNA, 16 nt, Human
augaggucagagccug

SEQ ID NO: 2730785 - RNA, 18 nt, Human
augaggucagagccugca

SEQ ID NO: 2730786 - RNA, 20 nt, Human
uugucaauaaaauccauaca

SEQ ID NO: 2730787 - RNA, 13 nt, Human
augaguccccugu

SEQ ID NO: 2730788 - RNA, 23 nt, Human
augaguccccuguuuguuucuga

SEQ ID NO: 2730789 - RNA, 17 nt, Human
uugucacacacuuuggc

SEQ ID NO: 2730790 - RNA, 21 nt, Human
uugucauauaagauucauauu

SEQ ID NO: 2730791 - RNA, 20 nt, Human
uuguucaauaauaaauauuu

SEQ ID NO: 2730792 - RNA, 22 nt, Human
uuguucaauaauaaauauuuuu

SEQ ID NO: 2730793 - RNA, 13 nt, Human
uuguucauacaua

SEQ ID NO: 2730794 - RNA, 13 nt, Human
uugugaggaagcc

SEQ ID NO: 2730795 - RNA, 20 nt, Human
uugugauacaaugcugugcc

SEQ ID NO: 2730796 - RNA, 19 nt, Human
uugugauacaaugcugugc

SEQ ID NO: 2730797 - RNA, 17 nt, Human
uugugaggaagccgcug

SEQ ID NO: 2730798 - RNA, 18 nt, Human
uugugaggaagccgcugg

SEQ ID NO: 2730799 - RNA, 15 nt, Human
uuguccccgacccuu

SEQ ID NO: 2730800 - RNA, 16 nt, Human
uuguccccgacccuug

SEQ ID NO: 2730801 - RNA, 18 nt, Human
uuguccccaccgcagaca

SEQ ID NO: 2730802 - RNA, 20 nt, Human
uuguccccaccgcagacagg

SEQ ID NO: 2730803 - RNA, 15 nt, Human
auuacuguaagaaaa

SEQ ID NO: 2730804 - RNA, 16 nt, Human
auuacuguaagaaaau

SEQ ID NO: 2730805 - RNA, 14 nt, Human
auuacuucugcuac

SEQ ID NO: 2730806 - RNA, 12 nt, Human
auuacuucugcu

SEQ ID NO: 2730807 - RNA, 13 nt, Human
auuacuucugcua

SEQ ID NO: 2730808 - RNA, 13 nt, Human
auuagagaagaga

SEQ ID NO: 2730809 - RNA, 21 nt, Human
auuagaauucuguauagauua

SEQ ID NO: 2730810 - RNA, 14 nt, Human
uuuugugaagcaaa

SEQ ID NO: 2730811 - RNA, 23 nt, Human
uuuugugcauuaucuagauacug

SEQ ID NO: 2730812 - RNA, 15 nt, Human
uuuuggaauuuuccu

SEQ ID NO: 2730813 - RNA, 15 nt, Human
uuuuguuuucauuau

SEQ ID NO: 2730814 - RNA, 16 nt, Human
uuuuguuuuugucuua

SEQ ID NO: 2730815 - RNA, 20 nt, Human
uuuuuauauuuacuaaaaug

SEQ ID NO: 2730816 - RNA, 23 nt, Human
uuuuuauacauaaacaagaccac

SEQ ID NO: 2730817 - RNA, 15 nt, Human
uuuuugaagcuguau

SEQ ID NO: 2730818 - RNA, 12 nt, Human
uuuuugacagaa

SEQ ID NO: 2730819 - RNA, 13 nt, Human
uuuuugacagaau

SEQ ID NO: 2730820 - RNA, 18 nt, Human
auuaaguacuauguauca

SEQ ID NO: 2730821 - RNA, 19 nt, Human
auuaaguacuauguaucaa

SEQ ID NO: 2730822 - RNA, 16 nt, Human
auuaaguacuauguau

SEQ ID NO: 2730823 - RNA, 13 nt, Human
auuaaggaagaca

SEQ ID NO: 2730824 - RNA, 17 nt, Human
uuuuuguagcacugaca

SEQ ID NO: 2730825 - RNA, 19 nt, Human
uuuuuguagcacugacaga

SEQ ID NO: 2730826 - RNA, 20 nt, Human
uuuuuguagcacugacagau

SEQ ID NO: 2730827 - RNA, 21 nt, Human
uuuuuguagcacugacagauu

SEQ ID NO: 2730828 - RNA, 24 nt, Human
uuuuuggcauaacauaaaucugug

SEQ ID NO: 2730829 - RNA, 23 nt, Human
uuuuuggcauaacauaaaucugu

SEQ ID NO: 2730830 - RNA, 17 nt, Human
auuccaagugauugaaa

SEQ ID NO: 2730831 - RNA, 17 nt, Human
auucccaagcucugcuc

SEQ ID NO: 2730832 - RNA, 22 nt, Human
auuccccaggaggccagccuug

SEQ ID NO: 2730833 - RNA, 20 nt, Human
auuccccaggaggccagccu

SEQ ID NO: 2730834 - RNA, 18 nt, Human
auucccaagcucugcucc

SEQ ID NO: 2730835 - RNA, 19 nt, Human
auucccaagcucugcuccu

SEQ ID NO: 2730836 - RNA, 17 nt, Human
auucacugauuugacau

SEQ ID NO: 2730837 - RNA, 12 nt, Human
auucacugauuu

SEQ ID NO: 2730838 - RNA, 21 nt, Human
auucaggagaguagaacagau

SEQ ID NO: 2730839 - RNA, 22 nt, Human
auucaggagaguagaacagaua

SEQ ID NO: 2730840 - RNA, 20 nt, Human
auuauauggcuugaguuuaa

SEQ ID NO: 2730841 - RNA, 19 nt, Human
auuauaugcuauuucuaua

SEQ ID NO: 2730842 - RNA, 17 nt, Human
auuauaugcuauuucua

SEQ ID NO: 2730843 - RNA, 18 nt, Human
auuauaugcuauuucuau

SEQ ID NO: 2730844 - RNA, 19 nt, Human
auuauucacugauuugaca

SEQ ID NO: 2730845 - RNA, 24 nt, Human
auuauucaaaguugccuaaaucca

SEQ ID NO: 2730846 - RNA, 18 nt, Human
auuauucaaaguugccua

SEQ ID NO: 2730847 - RNA, 22 nt, Human
auuauucaaaguugccuaaauc

SEQ ID NO: 2730848 - RNA, 19 nt, Human
auuauucaaaguugccuaa

SEQ ID NO: 2730849 - RNA, 19 nt, Human
auuauaucugaggaauucu

SEQ ID NO: 2730850 - RNA, 18 nt, Human
auuauaucugaggaauuc

SEQ ID NO: 2730851 - RNA, 16 nt, Human
auuauaugcuauuucu

SEQ ID NO: 2730852 - RNA, 22 nt, Human
auuauaucugaggaauucugua

SEQ ID NO: 2730853 - RNA, 21 nt, Human
auuauaucugaggaauucugu

SEQ ID NO: 2730854 - RNA, 20 nt, Human
auuauaucugaggaauucug

SEQ ID NO: 2730855 - RNA, 22 nt, Human
auucaaacagucucaggaaauc

SEQ ID NO: 2730856 - RNA, 19 nt, Human
uuugcuaagcauuccaacu

SEQ ID NO: 2730857 - RNA, 22 nt, Human
uuuggauuggaugaauuccaaa

SEQ ID NO: 2730858 - RNA, 18 nt, Human
uuugauucagacagcugc

SEQ ID NO: 2730859 - RNA, 22 nt, Human
uuugggguacccacugcucugg

SEQ ID NO: 2730860 - RNA, 21 nt, Human
uuugggguacccacugcucug

SEQ ID NO: 2730861 - RNA, 12 nt, Human
uuuggcugcuga

SEQ ID NO: 2730862 - RNA, 13 nt, Human
uuuggcugcugaa

SEQ ID NO: 2730863 - RNA, 15 nt, Human
uuugauucagacagc

SEQ ID NO: 2730864 - RNA, 14 nt, Human
uuugauccaagcug

SEQ ID NO: 2730865 - RNA, 13 nt, Human
uuugagaguucua

SEQ ID NO: 2730866 - RNA, 15 nt, Human
uuugauccaagcugg

SEQ ID NO: 2730867 - RNA, 13 nt, Human
uuugagacagagu

SEQ ID NO: 2730868 - RNA, 18 nt, Human
uuugaccucugcagcaau

SEQ ID NO: 2730869 - RNA, 14 nt, Human
uuugacaaggggca

SEQ ID NO: 2730870 - RNA, 21 nt, Human
uuugaccucugcagcaauaaa

SEQ ID NO: 2730871 - RNA, 19 nt, Human
uuugaccucugcagcaaua

SEQ ID NO: 2730872 - RNA, 18 nt, Human
uuugacagaauauguuuc

SEQ ID NO: 2730873 - RNA, 19 nt, Human
uuugacagaauauguuuca

SEQ ID NO: 2730874 - RNA, 20 nt, Human
uuugacagaauauguuucaa

SEQ ID NO: 2730875 - RNA, 21 nt, Human
uuugacagaauauguuucaaa

SEQ ID NO: 2730876 - RNA, 23 nt, Human
uuucccucccuuccucuuuccau

SEQ ID NO: 2730877 - RNA, 14 nt, Human
uuugaauuuugugu

SEQ ID NO: 2730878 - RNA, 12 nt, Human
uuugaauuuugu

SEQ ID NO: 2730879 - RNA, 17 nt, Human
uuuguaguguuggagaa

SEQ ID NO: 2730880 - RNA, 16 nt, Human
uuuguaauuuuuuuau

SEQ ID NO: 2730881 - RNA, 14 nt, Human
uuuguacagacaac

SEQ ID NO: 2730882 - RNA, 23 nt, Human
uuugucuuaaaaaguggaaaaau

SEQ ID NO: 2730883 - RNA, 16 nt, Human
uuugugauacaaugcu

SEQ ID NO: 2730884 - RNA, 13 nt, Human
uuugucuuaaaaa

SEQ ID NO: 2730885 - RNA, 14 nt, Human
uuugucuuaaaaag

SEQ ID NO: 2730886 - RNA, 19 nt, Human
uuugugcauuaucuagaua

SEQ ID NO: 2730887 - RNA, 15 nt, Human
uuugugauacaaugc

SEQ ID NO: 2730888 - RNA, 22 nt, Human
uuugugauacaaugcugugccc

SEQ ID NO: 2730889 - RNA, 22 nt, Human
uuugugcauuaucuagauacug

SEQ ID NO: 2730890 - RNA, 14 nt, Human
uuuguuucugaaag

SEQ ID NO: 2730891 - RNA, 16 nt, Human
uuuguuucugaaaggg

SEQ ID NO: 2730892 - RNA, 23 nt, Human
augucgucaaagcugaaauggac

SEQ ID NO: 2730893 - RNA, 14 nt, Human
augugagacugguu

SEQ ID NO: 2730894 - RNA, 13 nt, Human
augugagaccauu

SEQ ID NO: 2730895 - RNA, 12 nt, Human
auguaucaauga

SEQ ID NO: 2730896 - RNA, 16 nt, Human
auguccaagaagccca

SEQ ID NO: 2730897 - RNA, 17 nt, Human
auguccaagaagcccag

SEQ ID NO: 2730898 - RNA, 21 nt, Human
augugcuaguaauuggaaagg

SEQ ID NO: 2730899 - RNA, 20 nt, Human
augugcuaguaauuggaaag

SEQ ID NO: 2730900 - RNA, 21 nt, Human
augugccagguuuuuggucug

SEQ ID NO: 2730901 - RNA, 18 nt, Human
uuuuaaaaaacugcugac

SEQ ID NO: 2730902 - RNA, 12 nt, Human
auguguuuccau

SEQ ID NO: 2730903 - RNA, 20 nt, Human
auguuacauaagauaaaugu

SEQ ID NO: 2730904 - RNA, 12 nt, Human
auguuaagcaga

SEQ ID NO: 2730905 - RNA, 19 nt, Human
auguuacauaagauaaaug

SEQ ID NO: 2730906 - RNA, 13 nt, Human
auguuaagcagau

SEQ ID NO: 2730907 - RNA, 12 nt, Human
auguugaaagau

SEQ ID NO: 2730908 - RNA, 18 nt, Human
auguugaaagaucaaaag

SEQ ID NO: 2730909 - RNA, 13 nt, Human
auguugcccaggc

SEQ ID NO: 2730910 - RNA, 14 nt, Human
auguugcccaggca

SEQ ID NO: 2730911 - RNA, 15 nt, Human
auguugcccaggcag

SEQ ID NO: 2730912 - RNA, 21 nt, Human
uuuuagacccuauugcugcuu

SEQ ID NO: 2730913 - RNA, 17 nt, Human
uuuuagaguugauacua

SEQ ID NO: 2730914 - RNA, 22 nt, Human
uuuuauggcacuaguauuucua

SEQ ID NO: 2730915 - RNA, 19 nt, Human
uuuuauggcuuuugugcau

SEQ ID NO: 2730916 - RNA, 18 nt, Human
uuuuauggcuuuugugca

SEQ ID NO: 2730917 - RNA, 15 nt, Human
uuuuaguagagacag

SEQ ID NO: 2730918 - RNA, 12 nt, Human
uuuuauuaaauu

SEQ ID NO: 2730919 - RNA, 21 nt, Human
uuuuauggcuuuugugcauua

SEQ ID NO: 2730920 - RNA, 20 nt, Human
uuuucaggcuagauguaugu

SEQ ID NO: 2730921 - RNA, 16 nt, Human
uuuucuauaauuuaaa

SEQ ID NO: 2730922 - RNA, 16 nt, Human
uuuucucuaggaaaua

SEQ ID NO: 2730923 - RNA, 17 nt, Human
uuuucucugauacagaa

SEQ ID NO: 2730924 - RNA, 23 nt, Human
auguuuauuacaguauaauuaac

SEQ ID NO: 2730925 - RNA, 22 nt, Human
auguuuauuacaguauaauuaa

SEQ ID NO: 2730926 - RNA, 19 nt, Human
auguuuauuacaguauaau

SEQ ID NO: 2730927 - RNA, 18 nt, Human
auguuuauuacaguauaa

SEQ ID NO: 2730928 - RNA, 16 nt, Human
auguuuauuacaguau

SEQ ID NO: 2730929 - RNA, 15 nt, Human
auguuuauuacagua

SEQ ID NO: 2730930 - RNA, 23 nt, Human
auuaaaaaucucaaauuucuaaa

SEQ ID NO: 2730931 - RNA, 19 nt, Human
auuaaaacacaacaucuuu

SEQ ID NO: 2730932 - RNA, 17 nt, Human
auguuggccaggcuggu

SEQ ID NO: 2730933 - RNA, 12 nt, Human
auguuuauuaca

SEQ ID NO: 2730934 - RNA, 19 nt, Human
uuuucugauccaguuuugu

SEQ ID NO: 2730935 - RNA, 13 nt, Human
uuuucuguucuuu

SEQ ID NO: 2730936 - RNA, 12 nt, Human
auugauguguuu

SEQ ID NO: 2730937 - RNA, 19 nt, Human
auugauguguuuauuuaua

SEQ ID NO: 2730938 - RNA, 12 nt, Human
auugcaccacug

SEQ ID NO: 2730939 - RNA, 19 nt, Human
auugcaacaggcugggcuu

SEQ ID NO: 2730940 - RNA, 17 nt, Human
auugcaacaggcugggc

SEQ ID NO: 2730941 - RNA, 18 nt, Human
auugcaacaggcugggcu

SEQ ID NO: 2730942 - RNA, 16 nt, Human
auugcaacaggcuggg

SEQ ID NO: 2730943 - RNA, 16 nt, Human
auuggagcucguggaa

SEQ ID NO: 2730944 - RNA, 17 nt, Human
auuggagcucgugggac

SEQ ID NO: 2730945 - RNA, 19 nt, Human
auuggcuagagguucaaag

SEQ ID NO: 2730946 - RNA, 22 nt, Human
auuggcuagagguucaaagaua

SEQ ID NO: 2730947 - RNA, 20 nt, Human
auuggcuagagguucaaaga

SEQ ID NO: 2730948 - RNA, 22 nt, Human
auuggggauucuuaaaguugaa

SEQ ID NO: 2730949 - RNA, 17 nt, Human
auuguacgaagaguauu

SEQ ID NO: 2730950 - RNA, 21 nt, Human
auuggggauucuuaaaguuga

SEQ ID NO: 2730951 - RNA, 20 nt, Human
auuggggauucuuaaaguug

SEQ ID NO: 2730952 - RNA, 16 nt, Human
auuggggauucuuaaa

SEQ ID NO: 2730953 - RNA, 15 nt, Human
auuggggauucuuaa

SEQ ID NO: 2730954 - RNA, 14 nt, Human
auuggggauucuua

SEQ ID NO: 2730955 - RNA, 23 nt, Human
auuggcuagagguucaaagauau

SEQ ID NO: 2730956 - RNA, 13 nt, Human
auuggaaacaagu

SEQ ID NO: 2730957 - RNA, 14 nt, Human
auuggaaacaaguc

SEQ ID NO: 2730958 - RNA, 20 nt, Human
auuucuugagguaaaagcau

SEQ ID NO: 2730959 - RNA, 16 nt, Human
auuucuuccacaagag

SEQ ID NO: 2730960 - RNA, 13 nt, Human
auuugaauguuaa

SEQ ID NO: 2730961 - RNA, 18 nt, Human
auuugaauguuaagcaga

SEQ ID NO: 2730962 - RNA, 13 nt, Human
auuugaauuuugu

SEQ ID NO: 2730963 - RNA, 19 nt, Human
auuugaauguuaagcagau

SEQ ID NO: 2730964 - RNA, 15 nt, Human
auuugagcagggcuc

SEQ ID NO: 2730965 - RNA, 15 nt, Human
auuugaggucuguuc

SEQ ID NO: 2730966 - RNA, 18 nt, Human
auuugaggucuguucuuu

SEQ ID NO: 2730967 - RNA, 17 nt, Human
auuugaggucuguucuu

SEQ ID NO: 2730968 - RNA, 21 nt, Human
auuuggugguuucagaaaugu

SEQ ID NO: 2730969 - RNA, 14 nt, Human
auuugguuuucaca

SEQ ID NO: 2730970 - RNA, 12 nt, Human
auuugguuuuca

SEQ ID NO: 2730971 - RNA, 18 nt, Human
auuugauaugugaacagu

SEQ ID NO: 2730972 - RNA, 19 nt, Human
auuugauaugugaacaguu

SEQ ID NO: 2730973 - RNA, 21 nt, Human
auuugaggucuguucuuucca

SEQ ID NO: 2730974 - RNA, 21 nt, Human
auuuauuuuaauaauguuuca

SEQ ID NO: 2730975 - RNA, 23 nt, Human
auuuauuggcuuuucugauccag

SEQ ID NO: 2730976 - RNA, 20 nt, Human
auuuauuggcuuuucugauc

SEQ ID NO: 2730977 - RNA, 17 nt, Human
auuuccguuaaaauacc

SEQ ID NO: 2730978 - RNA, 14 nt, Human
auuucccaaagcag

SEQ ID NO: 2730979 - RNA, 16 nt, Human
auuucccaaagcagug

SEQ ID NO: 2730980 - RNA, 19 nt, Human
auuuauuacuguaagaaaa

SEQ ID NO: 2730981 - RNA, 20 nt, Human
auuuauuacuguaagaaaau

SEQ ID NO: 2730982 - RNA, 18 nt, Human
auuuauuggcuuuucuga

SEQ ID NO: 2730983 - RNA, 14 nt, Human
auuuauuggcuuuu

SEQ ID NO: 2730984 - RNA, 19 nt, Human
auuguuuucaguguacaug

SEQ ID NO: 2730985 - RNA, 18 nt, Human
auuguuuucaguguacau

SEQ ID NO: 2730986 - RNA, 14 nt, Human
auuuaaaaaaaauc

SEQ ID NO: 2730987 - RNA, 16 nt, Human
auuguaguccuguaau

SEQ ID NO: 2730988 - RNA, 15 nt, Human
auuguacuuugugcu

SEQ ID NO: 2730989 - RNA, 17 nt, Human
auuguagcauccuggaa

SEQ ID NO: 2730990 - RNA, 17 nt, Human
auuguuuucaguguaca

SEQ ID NO: 2730991 - RNA, 20 nt, Human
auuguagcauccuggaauau

SEQ ID NO: 2730992 - RNA, 15 nt, Human
auuuaccacuugugu

SEQ ID NO: 2730993 - RNA, 22 nt, Human
auuuaccacuuguguuuugcaa

SEQ ID NO: 2730994 - RNA, 20 nt, Human
auuuacuaaaauggacugug

SEQ ID NO: 2730995 - RNA, 19 nt, Human
auuuacuaaaauggacugu

SEQ ID NO: 2730996 - RNA, 16 nt, Human
auuuacuaaaauggac

SEQ ID NO: 2730997 - RNA, 22 nt, Human
auuuacaacugggggaggguga

SEQ ID NO: 2730998 - RNA, 16 nt, Human
auuuaaauagcuuuuu

SEQ ID NO: 2730999 - RNA, 20 nt, Human
auuuacuucuuauacauuug

SEQ ID NO: 2731000 - RNA, 19 nt, Human
auuuacuucuuauacauuu

SEQ ID NO: 2731001 - RNA, 18 nt, Human
auuuuaauaauguuucaa

SEQ ID NO: 2731002 - RNA, 19 nt, Human
auuuuaauaauguuucaaa

SEQ ID NO: 2731003 - RNA, 17 nt, Human
auuuuaacaacagcugg

SEQ ID NO: 2731004 - RNA, 14 nt, Human
caaagaaauguaag

SEQ ID NO: 2731005 - RNA, 14 nt, Human
caaagagguuuuaa

SEQ ID NO: 2731006 - RNA, 21 nt, Human
caaagagguuuuaaaaaaauc

SEQ ID NO: 2731007 - RNA, 20 nt, Human
caaaggguaucaggugcugc

SEQ ID NO: 2731008 - RNA, 21 nt, Human
caaaggguaucaggugcugcc

SEQ ID NO: 2731009 - RNA, 23 nt, Human
caaaggguaucaggugcugccau

SEQ ID NO: 2731010 - RNA, 16 nt, Human
caaaguggugagaggc

SEQ ID NO: 2731011 - RNA, 17 nt, Human
caaaguggugagaggca

SEQ ID NO: 2731012 - RNA, 20 nt, Human
caaaggagauuggaaggaac

SEQ ID NO: 2731013 - RNA, 14 nt, Human
caaaggagauugga

SEQ ID NO: 2731014 - RNA, 19 nt, Human
caaaguggugagaggcauc

SEQ ID NO: 2731015 - RNA, 14 nt, Human
caaaguugccuaaa

SEQ ID NO: 2731016 - RNA, 17 nt, Human
caaaguugccuaaaucc

SEQ ID NO: 2731017 - RNA, 15 nt, Human
caaaguugccuaaau

SEQ ID NO: 2731018 - RNA, 20 nt, Human
caacaggcugggcuucagug

SEQ ID NO: 2731019 - RNA, 18 nt, Human
caaaguugccuaaaucca

SEQ ID NO: 2731020 - RNA, 19 nt, Human
caagacugcacaucaaaau

SEQ ID NO: 2731021 - RNA, 21 nt, Human
caagacgcugugcugcccugc

SEQ ID NO: 2731022 - RNA, 22 nt, Human
caagacgcugugcugcccugcc

SEQ ID NO: 2731023 - RNA, 13 nt, Human
caagaccuucucc

SEQ ID NO: 2731024 - RNA, 19 nt, Human
caagacgcugugcugcccu

SEQ ID NO: 2731025 - RNA, 20 nt, Human
caagacgcugugcugcccug

SEQ ID NO: 2731026 - RNA, 23 nt, Human
caagacccuuguggucccacccc

SEQ ID NO: 2731027 - RNA, 17 nt, Human
caagagcccaggccucc

SEQ ID NO: 2731028 - RNA, 12 nt, Human
caagagggucug

SEQ ID NO: 2731029 - RNA, 16 nt, Human
caagagggucugagga

SEQ ID NO: 2731030 - RNA, 17 nt, Human
caagagggucugaggaa

SEQ ID NO: 2731031 - RNA, 16 nt, Human
caagcauaccaacacg

SEQ ID NO: 2731032 - RNA, 21 nt, Human
caagcauaccaacacgagcag

SEQ ID NO: 2731033 - RNA, 16 nt, Human
caagcauuuagaugua

SEQ ID NO: 2731034 - RNA, 19 nt, Human
caagcauuuagauguauag

SEQ ID NO: 2731035 - RNA, 21 nt, Human
caaggcugggggaagaagcuc

SEQ ID NO: 2731036 - RNA, 13 nt, Human
caaggcugucaau

SEQ ID NO: 2731037 - RNA, 14 nt, Human
caaggcugucaauu

SEQ ID NO: 2731038 - RNA, 17 nt, Human
caaggauccugagccag

SEQ ID NO: 2731039 - RNA, 15 nt, Human
caaggauccugagcc

SEQ ID NO: 2731040 - RNA, 16 nt, Human
caaggauccugagcca

SEQ ID NO: 2731041 - RNA, 14 nt, Human
caaggauccugagc

SEQ ID NO: 2731042 - RNA, 22 nt, Human
caagugaaaaaggaggaagaga

SEQ ID NO: 2731043 - RNA, 23 nt, Human
caagugaaaaaggaggaagagaa

SEQ ID NO: 2731044 - RNA, 14 nt, Human
caagugagacccug

SEQ ID NO: 2731045 - RNA, 15 nt, Human
caagugagacccugu

SEQ ID NO: 2731046 - RNA, 19 nt, Human
caagugagacccugucuca

SEQ ID NO: 2731047 - RNA, 19 nt, Human
caagugauucuccugccuc

SEQ ID NO: 2731048 - RNA, 18 nt, Human
caagugauucuccugccu

SEQ ID NO: 2731049 - RNA, 20 nt, Human
caagugauucuccugccuca

SEQ ID NO: 2731050 - RNA, 21 nt, Human
caaggggaauguuugccucug

SEQ ID NO: 2731051 - RNA, 15 nt, Human
caagggccuggccug

SEQ ID NO: 2731052 - RNA, 13 nt, Human
caagggccuggcc

SEQ ID NO: 2731053 - RNA, 14 nt, Human
caagggccuggccu

SEQ ID NO: 2731054 - RNA, 13 nt, Human
caaggucauuuuu

SEQ ID NO: 2731055 - RNA, 23 nt, Human
caaggggaauguuugccucugcc

SEQ ID NO: 2731056 - RNA, 14 nt, Human
caacaggcugggcu

SEQ ID NO: 2731057 - RNA, 17 nt, Human
caacaggcugggcuuca

SEQ ID NO: 2731058 - RNA, 16 nt, Human
caacauacucccaucu

SEQ ID NO: 2731059 - RNA, 14 nt, Human
caacauacucccau

SEQ ID NO: 2731060 - RNA, 15 nt, Human
caacauacucccauc

SEQ ID NO: 2731061 - RNA, 17 nt, Human
caacugcaucaagaugu

SEQ ID NO: 2731062 - RNA, 20 nt, Human
caacugcaucaagaugugac

SEQ ID NO: 2731063 - RNA, 23 nt, Human
caacugcaucaagaugugacaug

SEQ ID NO: 2731064 - RNA, 17 nt, Human
caaccugauugugucuc

SEQ ID NO: 2731065 - RNA, 19 nt, Human
caaccugauugugucucuu

SEQ ID NO: 2731066 - RNA, 21 nt, Human
caaccugauugugucucuugg

SEQ ID NO: 2731067 - RNA, 17 nt, Human
cacaaagguagcuuuuc

SEQ ID NO: 2731068 - RNA, 17 nt, Human
cacaaacgggcucagca

SEQ ID NO: 2731069 - RNA, 15 nt, Human
cacaaacagaggccg

SEQ ID NO: 2731070 - RNA, 17 nt, Human
caauuuuguuucuguac

SEQ ID NO: 2731071 - RNA, 16 nt, Human
caauuuuguuucugua

SEQ ID NO: 2731072 - RNA, 14 nt, Human
caauuuuguuucug

SEQ ID NO: 2731073 - RNA, 13 nt, Human
caauuuuguuucu

SEQ ID NO: 2731074 - RNA, 18 nt, Human
caaugguuuucuugugug

SEQ ID NO: 2731075 - RNA, 14 nt, Human
caaugcacuuuguu

SEQ ID NO: 2731076 - RNA, 14 nt, Human
cacacccagcccac

SEQ ID NO: 2731077 - RNA, 20 nt, Human
cacacccagcccacuucugc

SEQ ID NO: 2731078 - RNA, 13 nt, Human
cacacagcucugu

SEQ ID NO: 2731079 - RNA, 14 nt, Human
cacacagcucuguc

SEQ ID NO: 2731080 - RNA, 15 nt, Human
cacacagcucugucc

SEQ ID NO: 2731081 - RNA, 21 nt, Human
cacaccagagcccaccuuggc

SEQ ID NO: 2731082 - RNA, 22 nt, Human
cacaccagagcccaccuuggcu

SEQ ID NO: 2731083 - RNA, 15 nt, Human
cacacaccagagccc

SEQ ID NO: 2731084 - RNA, 16 nt, Human
cacacaccagagccca

SEQ ID NO: 2731085 - RNA, 20 nt, Human
cacacaccagagcccaccuu

SEQ ID NO: 2731086 - RNA, 14 nt, Human
cacacacuuuggcu

SEQ ID NO: 2731087 - RNA, 21 nt, Human
cacacagaggcugccucuccc

SEQ ID NO: 2731088 - RNA, 20 nt, Human
caaugcaaaccaucauugaa

SEQ ID NO: 2731089 - RNA, 23 nt, Human
caaugcaaaccaucauugaaauc

SEQ ID NO: 2731090 - RNA, 14 nt, Human
caaugcacugacau

SEQ ID NO: 2731091 - RNA, 13 nt, Human
caaugcacuuugu

SEQ ID NO: 2731092 - RNA, 14 nt, Human
caaugcaaaccauc

SEQ ID NO: 2731093 - RNA, 14 nt, Human
caaugauggucacc

SEQ ID NO: 2731094 - RNA, 21 nt, Human
caaugcaaaccaucauugaaa

SEQ ID NO: 2731095 - RNA, 22 nt, Human
caaugcaaaccaucauugaaau

SEQ ID NO: 2731096 - RNA, 13 nt, Human
caaugaccuuuca

SEQ ID NO: 2731097 - RNA, 14 nt, Human
caaugaccuuucaa

SEQ ID NO: 2731098 - RNA, 13 nt, Human
caaugauggucac

SEQ ID NO: 2731099 - RNA, 15 nt, Human
caaugaccuuucaau

SEQ ID NO: 2731100 - RNA, 16 nt, Human
caaugaccuuucaaua

SEQ ID NO: 2731101 - RNA, 17 nt, Human
cacaugaaguccaagca

SEQ ID NO: 2731102 - RNA, 20 nt, Human
cacaugaaguccaagcauuu

SEQ ID NO: 2731103 - RNA, 16 nt, Human
cacaugaaguccaagc

SEQ ID NO: 2731104 - RNA, 20 nt, Human
cacaguuuucugagaaagac

SEQ ID NO: 2731105 - RNA, 22 nt, Human
cacaguuuucugagaaagacua

SEQ ID NO: 2731106 - RNA, 21 nt, Human
cacaguuuucugagaaagacu

SEQ ID NO: 2731107 - RNA, 13 nt, Human
cacaugagcauca

SEQ ID NO: 2731108 - RNA, 17 nt, Human
cacaugagcaucaggcc

SEQ ID NO: 2731109 - RNA, 18 nt, Human
cacaugagcaucaggcca

SEQ ID NO: 2731110 - RNA, 19 nt, Human
cacaugagcaucaggccag

SEQ ID NO: 2731111 - RNA, 20 nt, Human
cacaugagcaucaggccagg

SEQ ID NO: 2731112 - RNA, 21 nt, Human
cacaugagcaucaggccaggc

SEQ ID NO: 2731113 - RNA, 20 nt, Human
cacaugccucucucaggcca

SEQ ID NO: 2731114 - RNA, 21 nt, Human
cacaugccucucucaggccaa

SEQ ID NO: 2731115 - RNA, 16 nt, Human
cacauguccaagaagc

SEQ ID NO: 2731116 - RNA, 17 nt, Human
cacauguccaagaagcc

SEQ ID NO: 2731117 - RNA, 19 nt, Human
cacaugcaaggucauuuuu

SEQ ID NO: 2731118 - RNA, 17 nt, Human
cacaugcaaggucauuu

SEQ ID NO: 2731119 - RNA, 18 nt, Human
cacaugcacgugugugca

SEQ ID NO: 2731120 - RNA, 20 nt, Human
cacaugcaaggucauuuuuu

SEQ ID NO: 2731121 - RNA, 23 nt, Human
cacaguccuuaccagcagagcac

SEQ ID NO: 2731122 - RNA, 14 nt, Human
cacaggcccggcuc

SEQ ID NO: 2731123 - RNA, 19 nt, Human
cacaggcagguccaggguu

SEQ ID NO: 2731124 - RNA, 17 nt, Human
cacaggaucagucugau

SEQ ID NO: 2731125 - RNA, 19 nt, Human
cacagcucuucuccaggcu

SEQ ID NO: 2731126 - RNA, 20 nt, Human
cacagcucuucuccaggcug

SEQ ID NO: 2731127 - RNA, 22 nt, Human
cacacggacacucaaaagcugg

SEQ ID NO: 2731128 - RNA, 18 nt, Human
cacagcucuucuccaggc

SEQ ID NO: 2731129 - RNA, 19 nt, Human
caccacacccagcccacuu

SEQ ID NO: 2731130 - RNA, 17 nt, Human
caccagagcccaccuug

SEQ ID NO: 2731131 - RNA, 18 nt, Human
caccagagcccaccuugg

SEQ ID NO: 2731132 - RNA, 20 nt, Human
caccagagcccaccuuggcu

SEQ ID NO: 2731133 - RNA, 22 nt, Human
caccagagcccaccuuggcuca

SEQ ID NO: 2731134 - RNA, 15 nt, Human
caccagagcccaccu

SEQ ID NO: 2731135 - RNA, 12 nt, Human
caccaagcccag

SEQ ID NO: 2731136 - RNA, 13 nt, Human
caccaagcccagu

SEQ ID NO: 2731137 - RNA, 17 nt, Human
caccaacgucugugcca

SEQ ID NO: 2731138 - RNA, 18 nt, Human
cacauguccaagaagccc

SEQ ID NO: 2731139 - RNA, 19 nt, Human
cacauguccaagaagccca

SEQ ID NO: 2731140 - RNA, 21 nt, Human
cacauguccaagaagcccagg

SEQ ID NO: 2731141 - RNA, 22 nt, Human
cacauguccaagaagcccagga

SEQ ID NO: 2731142 - RNA, 18 nt, Human
caccaucaugucuggcua

SEQ ID NO: 2731143 - RNA, 15 nt, Human
caccaucaugucugg

SEQ ID NO: 2731144 - RNA, 17 nt, Human
caccaucaugucuggcu

SEQ ID NO: 2731145 - RNA, 16 nt, Human
caccaucaagccacca

SEQ ID NO: 2731146 - RNA, 17 nt, Human
caccaucaagccaccaa

SEQ ID NO: 2731147 - RNA, 19 nt, Human
caccaucaagccaccaaca

SEQ ID NO: 2731148 - RNA, 24 nt, Human
caccaucaagccaccaacauacuc

SEQ ID NO: 2731149 - RNA, 13 nt, Human
caccaucaagcca

SEQ ID NO: 2731150 - RNA, 14 nt, Human
caccaucaagccac

SEQ ID NO: 2731151 - RNA, 15 nt, Human
caccaucaagccacc

SEQ ID NO: 2731152 - RNA, 21 nt, Human
caccauauuaccacagacaua

SEQ ID NO: 2731153 - RNA, 13 nt, Human
cacccaagggccu

SEQ ID NO: 2731154 - RNA, 13 nt, Human
cccaggugccagu

SEQ ID NO: 2731155 - RNA, 22 nt, Human
cccaggugcuaggaacacuccu

SEQ ID NO: 2731156 - RNA, 23 nt, Human
cccaggugcuaggaacacuccuu

SEQ ID NO: 2731157 - RNA, 20 nt, Human
cccagucuggaaugcagugg

SEQ ID NO: 2731158 - RNA, 13 nt, Human
cccagugcccaca

SEQ ID NO: 2731159 - RNA, 17 nt, Human
cccaggccuccuacagc

SEQ ID NO: 2731160 - RNA, 18 nt, Human
cccaggccuccuacagcu

SEQ ID NO: 2731161 - RNA, 11 nt, Human
cccaggcaggu

SEQ ID NO: 2731162 - RNA, 13 nt, Human
cccaggcaggucu

SEQ ID NO: 2731163 - RNA, 21 nt, Human
cccaggagccccgaggccuuc

SEQ ID NO: 2731164 - RNA, 18 nt, Human
cccaggagccccgaggcc

SEQ ID NO: 2731165 - RNA, 13 nt, Human
cccaggaggccag

SEQ ID NO: 2731166 - RNA, 22 nt, Human
cccaggaggccagccuugacca

SEQ ID NO: 2731167 - RNA, 18 nt, Human
cccaggcauuccccagga

SEQ ID NO: 2731168 - RNA, 17 nt, Human
cccaggcaggucuugaa

SEQ ID NO: 2731169 - RNA, 20 nt, Human
cccaggcauuccccaggagg

SEQ ID NO: 2731170 - RNA, 21 nt, Human
cccaggcauuccccaggaggc

SEQ ID NO: 2731171 - RNA, 22 nt, Human
cccaggcauuccccaggaggcc

SEQ ID NO: 2731172 - RNA, 23 nt, Human
cccaggcauuccccaggaggcca

SEQ ID NO: 2731173 - RNA, 11 nt, Human
cccaggccccu

SEQ ID NO: 2731174 - RNA, 16 nt, Human
cccaggccccugccac

SEQ ID NO: 2731175 - RNA, 18 nt, Human
cccaggccccugccaccc

SEQ ID NO: 2731176 - RNA, 21 nt, Human
cccaggccccugccacccugg

SEQ ID NO: 2731177 - RNA, 22 nt, Human
cccaggccccugccacccuggg

SEQ ID NO: 2731178 - RNA, 23 nt, Human
cccaaugcacuuuguucuggcuc

SEQ ID NO: 2731179 - RNA, 23 nt, Human
cccaagggccuggccugagcugg

SEQ ID NO: 2731180 - RNA, 18 nt, Human
cccaagggccuggccuga

SEQ ID NO: 2731181 - RNA, 19 nt, Human
cccaagggccuggccugag

SEQ ID NO: 2731182 - RNA, 17 nt, Human
cccaagggccuggccug

SEQ ID NO: 2731183 - RNA, 23 nt, Human
cccaaauggaaaugggcagagca

SEQ ID NO: 2731184 - RNA, 20 nt, Human
cccagagggccugcaaggga

SEQ ID NO: 2731185 - RNA, 18 nt, Human
cccagagggccugcaagg

SEQ ID NO: 2731186 - RNA, 20 nt, Human
cccagauugcaacaggcugg

SEQ ID NO: 2731187 - RNA, 21 nt, Human
cccagauugcaacaggcuggg

SEQ ID NO: 2731188 - RNA, 22 nt, Human
cccagauugcaacaggcugggc

SEQ ID NO: 2731189 - RNA, 16 nt, Human
cccagcaagugagagc

SEQ ID NO: 2731190 - RNA, 18 nt, Human
cccagcaagugagagcug

SEQ ID NO: 2731191 - RNA, 11 nt, Human
cccagccccuu

SEQ ID NO: 2731192 - RNA, 23 nt, Human
cccagcaagugagagcugggugu

SEQ ID NO: 2731193 - RNA, 19 nt, Human
cccagcaagugagagcugg

SEQ ID NO: 2731194 - RNA, 20 nt, Human
cccagcaagugagagcuggg

SEQ ID NO: 2731195 - RNA, 21 nt, Human
cccagcaagugagagcugggu

SEQ ID NO: 2731196 - RNA, 22 nt, Human
cccagcaagugagagcugggug

SEQ ID NO: 2731197 - RNA, 12 nt, Human
cccagccugcua

SEQ ID NO: 2731198 - RNA, 18 nt, Human
cccagccccuucugaccc

SEQ ID NO: 2731199 - RNA, 19 nt, Human
cccagcgagcccugguggc

SEQ ID NO: 2731200 - RNA, 23 nt, Human
cccagcgagcccugguggcagug

SEQ ID NO: 2731201 - RNA, 17 nt, Human
cccagcgagcccuggug

SEQ ID NO: 2731202 - RNA, 18 nt, Human
cccagcgagcccuggugg

SEQ ID NO: 2731203 - RNA, 15 nt, Human
cccagcgagcccugg

SEQ ID NO: 2731204 - RNA, 18 nt, Human
cccagugccgagaaggaa

SEQ ID NO: 2731205 - RNA, 17 nt, Human
cccagugccgagaagga

SEQ ID NO: 2731206 - RNA, 15 nt, Human
cccagugcccacagg

SEQ ID NO: 2731207 - RNA, 20 nt, Human
cccagugcccacaggaucag

SEQ ID NO: 2731208 - RNA, 15 nt, Human
cccaugcugcccugu

SEQ ID NO: 2731209 - RNA, 16 nt, Human
cccaugcugcccugug

SEQ ID NO: 2731210 - RNA, 17 nt, Human
cccaugcugcccuguga

SEQ ID NO: 2731211 - RNA, 18 nt, Human
cccaugcugcccugugag

SEQ ID NO: 2731212 - RNA, 13 nt, Human
cccauucugccug

SEQ ID NO: 2731213 - RNA, 22 nt, Human
ccccaaauggaaaugggcagag

SEQ ID NO: 2731214 - RNA, 14 nt, Human
ccccacccaagggc

SEQ ID NO: 2731215 - RNA, 20 nt, Human
ccccacccaagggccuggcc

SEQ ID NO: 2731216 - RNA, 17 nt, Human
ccccaggaggccagccu

SEQ ID NO: 2731217 - RNA, 22 nt, Human
ccccucagggucccugguggca

SEQ ID NO: 2731218 - RNA, 18 nt, Human
ccaucaaggguacacugc

SEQ ID NO: 2731219 - RNA, 13 nt, Human
ccaucaccagaca

SEQ ID NO: 2731220 - RNA, 20 nt, Human
ccaucaauaaaaaauuauga

SEQ ID NO: 2731221 - RNA, 19 nt, Human
ccaucaauaaaaaauuaug

SEQ ID NO: 2731222 - RNA, 17 nt, Human
ccagugaggcucugccc

SEQ ID NO: 2731223 - RNA, 20 nt, Human
ccagugaggcucugcccuug

SEQ ID NO: 2731224 - RNA, 18 nt, Human
ccagugaggcucugcccu

SEQ ID NO: 2731225 - RNA, 19 nt, Human
ccagugaggcucugcccuu

SEQ ID NO: 2731226 - RNA, 22 nt, Human
ccaucauugaaaucuuuuugcu

SEQ ID NO: 2731227 - RNA, 12 nt, Human
ccauccucugua

SEQ ID NO: 2731228 - RNA, 19 nt, Human
ccauccucuguacagagcc

SEQ ID NO: 2731229 - RNA, 16 nt, Human
ccaugauguuuagaaa

SEQ ID NO: 2731230 - RNA, 18 nt, Human
ccaugauguuuuccauga

SEQ ID NO: 2731231 - RNA, 19 nt, Human
ccaugauuaaccacuucag

SEQ ID NO: 2731232 - RNA, 21 nt, Human
ccaugauuaaccacuucagcu

SEQ ID NO: 2731233 - RNA, 11 nt, Human
ccaugcugccc

SEQ ID NO: 2731234 - RNA, 13 nt, Human
ccaugcugcccug

SEQ ID NO: 2731235 - RNA, 14 nt, Human
ccaugcugcccugu

SEQ ID NO: 2731236 - RNA, 20 nt, Human
ccauccucuguacagagccc

SEQ ID NO: 2731237 - RNA, 20 nt, Human
cccaaaacucuccucugcug

SEQ ID NO: 2731238 - RNA, 22 nt, Human
ccauuuugggguacccacugcu

SEQ ID NO: 2731239 - RNA, 20 nt, Human
ccauuuugggguacccacug

SEQ ID NO: 2731240 - RNA, 23 nt, Human
ccauuuuggauucuuauggacaa

SEQ ID NO: 2731241 - RNA, 16 nt, Human
cccaaagcagugcaug

SEQ ID NO: 2731242 - RNA, 12 nt, Human
cccaaagaugca

SEQ ID NO: 2731243 - RNA, 15 nt, Human
cccaaagaugcagcc

SEQ ID NO: 2731244 - RNA, 13 nt, Human
ccauggacuuugu

SEQ ID NO: 2731245 - RNA, 14 nt, Human
ccauggacuuuguu

SEQ ID NO: 2731246 - RNA, 15 nt, Human
ccauucuccaccugc

SEQ ID NO: 2731247 - RNA, 16 nt, Human
ccauucuccaccugcc

SEQ ID NO: 2731248 - RNA, 21 nt, Human
ccauucugccugcccaggccc

SEQ ID NO: 2731249 - RNA, 14 nt, Human
ccauucuccaccug

SEQ ID NO: 2731250 - RNA, 19 nt, Human
ccauucugccugcccaggc

SEQ ID NO: 2731251 - RNA, 20 nt, Human
ccauucugccugcccaggcc

SEQ ID NO: 2731252 - RNA, 16 nt, Human
ccauucugccugccca

SEQ ID NO: 2731253 - RNA, 17 nt, Human
ccauucuccaccugcca

SEQ ID NO: 2731254 - RNA, 17 nt, Human
ccauucugccugcccag

SEQ ID NO: 2731255 - RNA, 18 nt, Human
ccauucugccugcccagg

SEQ ID NO: 2731256 - RNA, 17 nt, Human
ccaggugccaguuaugg

SEQ ID NO: 2731257 - RNA, 19 nt, Human
ccaggugcuaggaacacuc

SEQ ID NO: 2731258 - RNA, 23 nt, Human
ccaguaaaugggggugcauuuga

SEQ ID NO: 2731259 - RNA, 14 nt, Human
ccagguucagcuug

SEQ ID NO: 2731260 - RNA, 16 nt, Human
ccagugaauucuugaa

SEQ ID NO: 2731261 - RNA, 20 nt, Human
ccagugaauucuugaaggaa

SEQ ID NO: 2731262 - RNA, 20 nt, Human
ccaggcuguaucccaugagc

SEQ ID NO: 2731263 - RNA, 19 nt, Human
ccaggcuggucucaaacuc

SEQ ID NO: 2731264 - RNA, 13 nt, Human
ccaggccccugcc

SEQ ID NO: 2731265 - RNA, 13 nt, Human
ccaggcauggugg

SEQ ID NO: 2731266 - RNA, 14 nt, Human
ccaggcauucccca

SEQ ID NO: 2731267 - RNA, 24 nt, Human
ccaggcauuccccaggaggccagc

SEQ ID NO: 2731268 - RNA, 23 nt, Human
ccaggcauuccccaggaggccag

SEQ ID NO: 2731269 - RNA, 22 nt, Human
ccaggcauuccccaggaggcca

SEQ ID NO: 2731270 - RNA, 13 nt, Human
ccaggaggccagc

SEQ ID NO: 2731271 - RNA, 12 nt, Human
ccaggaggccag

SEQ ID NO: 2731272 - RNA, 18 nt, Human
ccaggagccuccugcccu

SEQ ID NO: 2731273 - RNA, 13 nt, Human
ccaggagccuccu

SEQ ID NO: 2731274 - RNA, 14 nt, Human
ccaggagccuccug

SEQ ID NO: 2731275 - RNA, 15 nt, Human
ccaggagccccgagg

SEQ ID NO: 2731276 - RNA, 15 nt, Human
ccaggagcagccaca

SEQ ID NO: 2731277 - RNA, 16 nt, Human
ccaggagcagccacau

SEQ ID NO: 2731278 - RNA, 20 nt, Human
ccaggaagccagcaggcucu

SEQ ID NO: 2731279 - RNA, 22 nt, Human
ccaggaagccagcaggcucuca

SEQ ID NO: 2731280 - RNA, 20 nt, Human
ccaggaauggagccugcacg

SEQ ID NO: 2731281 - RNA, 11 nt, Human
ccagcucuggu

SEQ ID NO: 2731282 - RNA, 12 nt, Human
ccagcucugguc

SEQ ID NO: 2731283 - RNA, 13 nt, Human
ccagcucuggucc

SEQ ID NO: 2731284 - RNA, 14 nt, Human
ccagcgagcccugg

SEQ ID NO: 2731285 - RNA, 22 nt, Human
ccagccuugaccauucuccacc

SEQ ID NO: 2731286 - RNA, 15 nt, Human
ccagcgagcccuggu

SEQ ID NO: 2731287 - RNA, 16 nt, Human
ccagcgagcccuggug

SEQ ID NO: 2731288 - RNA, 22 nt, Human
ccagagcccaccuuggcucaag

SEQ ID NO: 2731289 - RNA, 16 nt, Human
ccagagcccaccuugg

SEQ ID NO: 2731290 - RNA, 19 nt, Human
ccagccuugaccauucucc

SEQ ID NO: 2731291 - RNA, 20 nt, Human
ccagccuugaccauucucca

SEQ ID NO: 2731292 - RNA, 20 nt, Human
ccagcugcuugggcuucauc

SEQ ID NO: 2731293 - RNA, 23 nt, Human
ccagcugcuugggcuucauccuc

SEQ ID NO: 2731294 - RNA, 14 nt, Human
ccagcucuggucca

SEQ ID NO: 2731295 - RNA, 17 nt, Human
ccagcucugguccauag

SEQ ID NO: 2731296 - RNA, 21 nt, Human
ccagcucugguccauagagag

SEQ ID NO: 2731297 - RNA, 22 nt, Human
ccagcucugguccauagagagc

SEQ ID NO: 2731298 - RNA, 23 nt, Human
ccacugcacuccagccuggguga

SEQ ID NO: 2731299 - RNA, 13 nt, Human
ccacuucagcuga

SEQ ID NO: 2731300 - RNA, 14 nt, Human
ccacuucagcugac

SEQ ID NO: 2731301 - RNA, 23 nt, Human
ccagaaguuugagaucagccugg

SEQ ID NO: 2731302 - RNA, 22 nt, Human
ccagaaguuugagaucagccug

SEQ ID NO: 2731303 - RNA, 12 nt, Human
ccagaauuuccc

SEQ ID NO: 2731304 - RNA, 19 nt, Human
ccagaauuucccaaagcag

SEQ ID NO: 2731305 - RNA, 18 nt, Human
ccagaauuucccaaagca

SEQ ID NO: 2731306 - RNA, 21 nt, Human
ccagaauuucccaaagcagug

SEQ ID NO: 2731307 - RNA, 21 nt, Human
ccagacaccuugacagggcac

SEQ ID NO: 2731308 - RNA, 15 nt, Human
ccaccccacacacgc

SEQ ID NO: 2731309 - RNA, 23 nt, Human
ccacggccaggccagagggagug

SEQ ID NO: 2731310 - RNA, 18 nt, Human
ccacgcuggagugcagug

SEQ ID NO: 2731311 - RNA, 19 nt, Human
ccacgcuggagugcaguga

SEQ ID NO: 2731312 - RNA, 16 nt, Human
ccacggccaggccaga

SEQ ID NO: 2731313 - RNA, 18 nt, Human
ccacggccaggccagagg

SEQ ID NO: 2731314 - RNA, 15 nt, Human
ccacccccacccaag

SEQ ID NO: 2731315 - RNA, 16 nt, Human
ccacgcuggagugcag

SEQ ID NO: 2731316 - RNA, 13 nt, Human
ccacgcuggagug

SEQ ID NO: 2731317 - RNA, 17 nt, Human
ccacuacauucuguuaa

SEQ ID NO: 2731318 - RNA, 16 nt, Human
ccacuacauucuguua

SEQ ID NO: 2731319 - RNA, 11 nt, Human
ccacuacauuc

SEQ ID NO: 2731320 - RNA, 14 nt, Human
ccacuacauucugu

SEQ ID NO: 2731321 - RNA, 15 nt, Human
ccacuacauucuguu

SEQ ID NO: 2731322 - RNA, 20 nt, Human
ccacaggaaccacaagacug

SEQ ID NO: 2731323 - RNA, 16 nt, Human
ccacaggaucagucug

SEQ ID NO: 2731324 - RNA, 21 nt, Human
ccacacccagcccacuucugc

SEQ ID NO: 2731325 - RNA, 22 nt, Human
ccacacccagcccacuucugcc

SEQ ID NO: 2731326 - RNA, 20 nt, Human
ccacacccagcccacuucug

SEQ ID NO: 2731327 - RNA, 15 nt, Human
ccacacccagcccac

SEQ ID NO: 2731328 - RNA, 16 nt, Human
ccacaugugcacaugc

SEQ ID NO: 2731329 - RNA, 16 nt, Human
ccacauuccugaugcu

SEQ ID NO: 2731330 - RNA, 19 nt, Human
ccacaucuugcucugcuga

SEQ ID NO: 2731331 - RNA, 18 nt, Human
ccacaucuugcucugcug

SEQ ID NO: 2731332 - RNA, 17 nt, Human
ccacaucuugcucugcu

SEQ ID NO: 2731333 - RNA, 21 nt, Human
ccaccaacauacucccaucug

SEQ ID NO: 2731334 - RNA, 21 nt, Human
ccacccaggagccccgaggcc

SEQ ID NO: 2731335 - RNA, 23 nt, Human
ccacccaggagccccgaggccuu

SEQ ID NO: 2731336 - RNA, 17 nt, Human
ccacccccacccaaggg

SEQ ID NO: 2731337 - RNA, 22 nt, Human
ccaaacugacucuuaagaagac

SEQ ID NO: 2731338 - RNA, 19 nt, Human
ccaaagcagugcaugcugu

SEQ ID NO: 2731339 - RNA, 19 nt, Human
ccaaagccaaagcuaggcc

SEQ ID NO: 2731340 - RNA, 23 nt, Human
ccaaagcagugcaugcugucccu

SEQ ID NO: 2731341 - RNA, 17 nt, Human
ccaaagccuccuccagc

SEQ ID NO: 2731342 - RNA, 22 nt, Human
ccaaagccuccuccagccgcca

SEQ ID NO: 2731343 - RNA, 20 nt, Human
ccaaacucaccugccccuca

SEQ ID NO: 2731344 - RNA, 21 nt, Human
ccaaagcuaggccuggccaga

SEQ ID NO: 2731345 - RNA, 16 nt, Human
ccaaagcuaggccugg

SEQ ID NO: 2731346 - RNA, 17 nt, Human
ccaaagcuaggccuggc

SEQ ID NO: 2731347 - RNA, 15 nt, Human
ccaaagcuaggccug

SEQ ID NO: 2731348 - RNA, 23 nt, Human
ccaaaggaagcacaugccucucu

SEQ ID NO: 2731349 - RNA, 15 nt, Human
ccaaaggaagcacau

SEQ ID NO: 2731350 - RNA, 16 nt, Human
ccaaaggcucucuccu

SEQ ID NO: 2731351 - RNA, 23 nt, Human
ccaaauuucauaccuaucaucuu

SEQ ID NO: 2731352 - RNA, 20 nt, Human
ccaaaguacacuguuucaaa

SEQ ID NO: 2731353 - RNA, 18 nt, Human
ccaaaguacacuguuuca

SEQ ID NO: 2731354 - RNA, 15 nt, Human
ccaaaguacacuguu

SEQ ID NO: 2731355 - RNA, 13 nt, Human
ccaacaucaacau

SEQ ID NO: 2731356 - RNA, 21 nt, Human
ccaacauacucccaucuguga

SEQ ID NO: 2731357 - RNA, 22 nt, Human
ccaacauacucccaucugugaa

SEQ ID NO: 2731358 - RNA, 16 nt, Human
ccaacauacucccauc

SEQ ID NO: 2731359 - RNA, 17 nt, Human
ccaacauacucccaucu

SEQ ID NO: 2731360 - RNA, 18 nt, Human
ccaacauacucccaucug

SEQ ID NO: 2731361 - RNA, 19 nt, Human
ccaacauacucccaucugu

SEQ ID NO: 2731362 - RNA, 20 nt, Human
ccaacauacucccaucugug

SEQ ID NO: 2731363 - RNA, 19 nt, Human
ccaagaagcccaggaaagg

SEQ ID NO: 2731364 - RNA, 20 nt, Human
ccaagaagcccaggaaaggc

SEQ ID NO: 2731365 - RNA, 15 nt, Human
ccaagaagcccagga

SEQ ID NO: 2731366 - RNA, 12 nt, Human
ccaacccucauc

SEQ ID NO: 2731367 - RNA, 14 nt, Human
ccaagcaaguauua

SEQ ID NO: 2731368 - RNA, 17 nt, Human
ccaagcauuuagaugua

SEQ ID NO: 2731369 - RNA, 22 nt, Human
ccaagcauaccaacacgagcag

SEQ ID NO: 2731370 - RNA, 14 nt, Human
ccaagcucccaggc

SEQ ID NO: 2731371 - RNA, 15 nt, Human
ccaagcucccaggca

SEQ ID NO: 2731372 - RNA, 16 nt, Human
ccaagcucccaggcau

SEQ ID NO: 2731373 - RNA, 22 nt, Human
ccaagcucccaggcauucccca

SEQ ID NO: 2731374 - RNA, 17 nt, Human
ccaaggccaaaggaagc

SEQ ID NO: 2731375 - RNA, 20 nt, Human
ccaagucaagugaaaaagga

SEQ ID NO: 2731376 - RNA, 23 nt, Human
ccaagguuuggggaagaacgaag

SEQ ID NO: 2731377 - RNA, 13 nt, Human
ccaaggugggagg

SEQ ID NO: 2731378 - RNA, 15 nt, Human
ccaagggccuggccu

SEQ ID NO: 2731379 - RNA, 18 nt, Human
ccaaggccaaaggaagca

SEQ ID NO: 2731380 - RNA, 21 nt, Human
ccaaggccaaaggaagcacau

SEQ ID NO: 2731381 - RNA, 22 nt, Human
ccaaggggaauguuugccucug

SEQ ID NO: 2731382 - RNA, 19 nt, Human
ccaagggccuggccugagc

SEQ ID NO: 2731383 - RNA, 16 nt, Human
ccaagggccuggccug

SEQ ID NO: 2731384 - RNA, 18 nt, Human
ccaagggccuggccugag

SEQ ID NO: 2731385 - RNA, 23 nt, Human
cauuuaauaauuauaugcuauuu

SEQ ID NO: 2731386 - RNA, 12 nt, Human
cauuuaaaagau

SEQ ID NO: 2731387 - RNA, 16 nt, Human
cauuuaaaagauacag

SEQ ID NO: 2731388 - RNA, 15 nt, Human
cauuuaaaagauaca

SEQ ID NO: 2731389 - RNA, 14 nt, Human
cauuuaauaauuau

SEQ ID NO: 2731390 - RNA, 12 nt, Human
cauuuaauaauu

SEQ ID NO: 2731391 - RNA, 19 nt, Human
cauuuaauaauuauaugcu

SEQ ID NO: 2731392 - RNA, 17 nt, Human
cauuuaauaauuauaug

SEQ ID NO: 2731393 - RNA, 16 nt, Human
cauuuaauaauuauau

SEQ ID NO: 2731394 - RNA, 15 nt, Human
cauuuaauaauuaua

SEQ ID NO: 2731395 - RNA, 12 nt, Human
cauuuccugugu

SEQ ID NO: 2731396 - RNA, 13 nt, Human
cauuuccuguguc

SEQ ID NO: 2731397 - RNA, 17 nt, Human
cauuguuggccaaagcc

SEQ ID NO: 2731398 - RNA, 18 nt, Human
cauuguuggccaaagcca

SEQ ID NO: 2731399 - RNA, 14 nt, Human
cacccaagggccug

SEQ ID NO: 2731400 - RNA, 15 nt, Human
cacccaagggccugg

SEQ ID NO: 2731401 - RNA, 13 nt, Human
cauuugcucaugg

SEQ ID NO: 2731402 - RNA, 18 nt, Human
cauuugcucauggaauug

SEQ ID NO: 2731403 - RNA, 13 nt, Human
cauuugcuccuuu

SEQ ID NO: 2731404 - RNA, 14 nt, Human
cauuugcuccuuuc

SEQ ID NO: 2731405 - RNA, 17 nt, Human
cauuuguuugaacugau

SEQ ID NO: 2731406 - RNA, 22 nt, Human
cauuuguuugaacugauaaaga

SEQ ID NO: 2731407 - RNA, 20 nt, Human
cauuuguuugaacugauaaa

SEQ ID NO: 2731408 - RNA, 20 nt, Human
cauuugagcagggcucagcg

SEQ ID NO: 2731409 - RNA, 17 nt, Human
cauuugagcagggcuca

SEQ ID NO: 2731410 - RNA, 18 nt, Human
cauuugagcagggcucag

SEQ ID NO: 2731411 - RNA, 20 nt, Human
cauuugaaaauuuugauguu

SEQ ID NO: 2731412 - RNA, 22 nt, Human
cauuugaaaauuuugauguuuu

SEQ ID NO: 2731413 - RNA, 17 nt, Human
ccaaacucaccugcccc

SEQ ID NO: 2731414 - RNA, 19 nt, Human
cauuuuagggguagcauuu

SEQ ID NO: 2731415 - RNA, 15 nt, Human
cggccuuuggcuuca

SEQ ID NO: 2731416 - RNA, 15 nt, Human
cggcuggccuggccc

SEQ ID NO: 2731417 - RNA, 16 nt, Human
cggcuggccuggcccc

SEQ ID NO: 2731418 - RNA, 14 nt, Human
cggcuggccuggcc

SEQ ID NO: 2731419 - RNA, 18 nt, Human
cggcuggccuggccccuc

SEQ ID NO: 2731420 - RNA, 20 nt, Human
cgggaggauguucugggaca

SEQ ID NO: 2731421 - RNA, 17 nt, Human
cgggaggucgaggcagg

SEQ ID NO: 2731422 - RNA, 16 nt, Human
cgggaggucgaggcag

SEQ ID NO: 2731423 - RNA, 15 nt, Human
cgggcaugacacgaa

SEQ ID NO: 2731424 - RNA, 12 nt, Human
cgggcaugacac

SEQ ID NO: 2731425 - RNA, 13 nt, Human
cggaugauuucua

SEQ ID NO: 2731426 - RNA, 14 nt, Human
cggaugauuucuau

SEQ ID NO: 2731427 - RNA, 20 nt, Human
cggaaugaaccacaucuugc

SEQ ID NO: 2731428 - RNA, 15 nt, Human
cggacagccacggcc

SEQ ID NO: 2731429 - RNA, 16 nt, Human
cggacagccacggcca

SEQ ID NO: 2731430 - RNA, 18 nt, Human
cggacagccacggccagg

SEQ ID NO: 2731431 - RNA, 13 nt, Human
cgcuccugugucu

SEQ ID NO: 2731432 - RNA, 23 nt, Human
cgcacuucgggaggucgaggcag

SEQ ID NO: 2731433 - RNA, 12 nt, Human
cgauuucuguuu

SEQ ID NO: 2731434 - RNA, 19 nt, Human
cgaucuggguucacugcaa

SEQ ID NO: 2731435 - RNA, 21 nt, Human
cgauucuucugcuucagccuc

SEQ ID NO: 2731436 - RNA, 13 nt, Human
cgauucuucugcu

SEQ ID NO: 2731437 - RNA, 19 nt, Human
cgauucuucugcuucagcc

SEQ ID NO: 2731438 - RNA, 15 nt, Human
ccuuuguauucucuc

SEQ ID NO: 2731439 - RNA, 20 nt, Human
ccuuuguauucucuccugua

SEQ ID NO: 2731440 - RNA, 18 nt, Human
ccuuuguauucucuccug

SEQ ID NO: 2731441 - RNA, 18 nt, Human
cgaggccuucucugaagg

SEQ ID NO: 2731442 - RNA, 19 nt, Human
cgaggccuucucugaagga

SEQ ID NO: 2731443 - RNA, 13 nt, Human
cgaggacagggag

SEQ ID NO: 2731444 - RNA, 12 nt, Human
cgaggacaggga

SEQ ID NO: 2731445 - RNA, 23 nt, Human
ccuuugacgccaucccagcccca

SEQ ID NO: 2731446 - RNA, 12 nt, Human
ccuuggcugcag

SEQ ID NO: 2731447 - RNA, 13 nt, Human
ccuuggcugcagg

SEQ ID NO: 2731448 - RNA, 20 nt, Human
ccuuguggucccaccccaca

SEQ ID NO: 2731449 - RNA, 16 nt, Human
ccuuguggucccaccc

SEQ ID NO: 2731450 - RNA, 19 nt, Human
ccuuguggucccaccccac

SEQ ID NO: 2731451 - RNA, 13 nt, Human
ccuuuaagagaaa

SEQ ID NO: 2731452 - RNA, 16 nt, Human
ccuuucucuuucguua

SEQ ID NO: 2731453 - RNA, 13 nt, Human
cgcagacaggacc

SEQ ID NO: 2731454 - RNA, 14 nt, Human
cgcagacaggacca

SEQ ID NO: 2731455 - RNA, 15 nt, Human
cgcccccacugguga

SEQ ID NO: 2731456 - RNA, 15 nt, Human
cgcgacaaugcaaac

SEQ ID NO: 2731457 - RNA, 16 nt, Human
cgcgacaaugcaaacc

SEQ ID NO: 2731458 - RNA, 17 nt, Human
cgcgacaaugcaaacca

SEQ ID NO: 2731459 - RNA, 21 nt, Human
cgcuaagagggagggagggcu

SEQ ID NO: 2731460 - RNA, 15 nt, Human
cgcuaagagggaggg

SEQ ID NO: 2731461 - RNA, 16 nt, Human
cgcuaagagggaggga

SEQ ID NO: 2731462 - RNA, 14 nt, Human
cgcuaagagggagg

SEQ ID NO: 2731463 - RNA, 21 nt, Human
cgcguugaaauuguaauuaua

SEQ ID NO: 2731464 - RNA, 17 nt, Human
cgcguugaaauuguaau

SEQ ID NO: 2731465 - RNA, 16 nt, Human
cgcgugcacacaccag

SEQ ID NO: 2731466 - RNA, 19 nt, Human
cgcgugcacacaccagagc

SEQ ID NO: 2731467 - RNA, 13 nt, Human
cgcguugaaauug

SEQ ID NO: 2731468 - RNA, 20 nt, Human
cgcgugcacacaccagagcc

SEQ ID NO: 2731469 - RNA, 13 nt, Human
cgucugacaggca

SEQ ID NO: 2731470 - RNA, 14 nt, Human
cgucugacaggcaa

SEQ ID NO: 2731471 - RNA, 14 nt, Human
cgucuaccugaggg

SEQ ID NO: 2731472 - RNA, 14 nt, Human
cguccccugucccc

SEQ ID NO: 2731473 - RNA, 11 nt, Human
cguccccuguc

SEQ ID NO: 2731474 - RNA, 20 nt, Human
cgugcacacaccagagccca

SEQ ID NO: 2731475 - RNA, 21 nt, Human
cgugcacacaccagagcccac

SEQ ID NO: 2731476 - RNA, 19 nt, Human
cgugcauaccacuuuuguu

SEQ ID NO: 2731477 - RNA, 22 nt, Human
cgugcaguggugcgaucugggu

SEQ ID NO: 2731478 - RNA, 22 nt, Human
cgugcacacaccagagcccacc

SEQ ID NO: 2731479 - RNA, 18 nt, Human
cgugcauaccacuuuugu

SEQ ID NO: 2731480 - RNA, 14 nt, Human
cgugcauaccacuu

SEQ ID NO: 2731481 - RNA, 23 nt, Human
cggugcuaucucccccagcccca

SEQ ID NO: 2731482 - RNA, 20 nt, Human
cgucaacucauauuuucaug

SEQ ID NO: 2731483 - RNA, 16 nt, Human
cgucaacucauauuuu

SEQ ID NO: 2731484 - RNA, 22 nt, Human
cguucauggaacgcguugaaau

SEQ ID NO: 2731485 - RNA, 17 nt, Human
cguggcugcuucaagga

SEQ ID NO: 2731486 - RNA, 21 nt, Human
cguucauggaacgcguugaaa

SEQ ID NO: 2731487 - RNA, 23 nt, Human
cguucauggaacgcguugaaauu

SEQ ID NO: 2731488 - RNA, 12 nt, Human
cguggcugcuuc

SEQ ID NO: 2731489 - RNA, 14 nt, Human
cguggcugcuucaa

SEQ ID NO: 2731490 - RNA, 15 nt, Human
cguggcugcuucaag

SEQ ID NO: 2731491 - RNA, 13 nt, Human
cguugaaauugua

SEQ ID NO: 2731492 - RNA, 20 nt, Human
cguuucuaugacacaugcaa

SEQ ID NO: 2731493 - RNA, 21 nt, Human
cguuucuaaaggcuaccuuug

SEQ ID NO: 2731494 - RNA, 19 nt, Human
cguuucuaaaggcuaccuu

SEQ ID NO: 2731495 - RNA, 20 nt, Human
ccugggcagcugccuccccu

SEQ ID NO: 2731496 - RNA, 12 nt, Human
ccugguggcagc

SEQ ID NO: 2731497 - RNA, 13 nt, Human
ccugguggcagcu

SEQ ID NO: 2731498 - RNA, 20 nt, Human
ccuguaauccuagcacuuug

SEQ ID NO: 2731499 - RNA, 12 nt, Human
ccuguaccucuu

SEQ ID NO: 2731500 - RNA, 14 nt, Human
ccugguggcagcuc

SEQ ID NO: 2731501 - RNA, 16 nt, Human
ccugguggcagcucac

SEQ ID NO: 2731502 - RNA, 17 nt, Human
ccugguggcagcucacc

SEQ ID NO: 2731503 - RNA, 18 nt, Human
ccugguggcagcucaccu

SEQ ID NO: 2731504 - RNA, 21 nt, Human
ccuguagagugggagcugagu

SEQ ID NO: 2731505 - RNA, 19 nt, Human
ccuguagagugggagcuga

SEQ ID NO: 2731506 - RNA, 23 nt, Human
ccuguagagugggagcugagugg

SEQ ID NO: 2731507 - RNA, 18 nt, Human
ccuguccccgcacugggc

SEQ ID NO: 2731508 - RNA, 16 nt, Human
ccugucccccugacaa

SEQ ID NO: 2731509 - RNA, 17 nt, Human
ccugucccccugacaac

SEQ ID NO: 2731510 - RNA, 20 nt, Human
ccugugaguacuacaguccu

SEQ ID NO: 2731511 - RNA, 17 nt, Human
ccugugauggggcccug

SEQ ID NO: 2731512 - RNA, 18 nt, Human
ccugugauggggcccugc

SEQ ID NO: 2731513 - RNA, 19 nt, Human
ccugugauggggcccugcc

SEQ ID NO: 2731514 - RNA, 22 nt, Human
ccugugauggggcccugccucc

SEQ ID NO: 2731515 - RNA, 20 nt, Human
ccugugauggggcccugccu

SEQ ID NO: 2731516 - RNA, 21 nt, Human
ccugugauggggcccugccuc

SEQ ID NO: 2731517 - RNA, 17 nt, Human
ccugugccucugggacu

SEQ ID NO: 2731518 - RNA, 15 nt, Human
ccugugccucuggga

SEQ ID NO: 2731519 - RNA, 19 nt, Human
ccugugccucugggacugg

SEQ ID NO: 2731520 - RNA, 15 nt, Human
ccugggcagcugccu

SEQ ID NO: 2731521 - RNA, 16 nt, Human
ccugggcagcugccuc

SEQ ID NO: 2731522 - RNA, 17 nt, Human
ccugggcagcugccucc

SEQ ID NO: 2731523 - RNA, 18 nt, Human
ccugggcagcugccuccc

SEQ ID NO: 2731524 - RNA, 14 nt, Human
ccugggcagaagga

SEQ ID NO: 2731525 - RNA, 12 nt, Human
ccugggcagaag

SEQ ID NO: 2731526 - RNA, 20 nt, Human
ccugggaggucaaggcugca

SEQ ID NO: 2731527 - RNA, 16 nt, Human
ccugggaucccucauc

SEQ ID NO: 2731528 - RNA, 20 nt, Human
ccugggaucccucauccuca

SEQ ID NO: 2731529 - RNA, 18 nt, Human
ccuggcaugggaaugaau

SEQ ID NO: 2731530 - RNA, 14 nt, Human
ccuggccccucagg

SEQ ID NO: 2731531 - RNA, 13 nt, Human
ccuggacccugug

SEQ ID NO: 2731532 - RNA, 14 nt, Human
ccuggacccugugg

SEQ ID NO: 2731533 - RNA, 21 nt, Human
ccuggcacugcuuccagugag

SEQ ID NO: 2731534 - RNA, 14 nt, Human
ccuggcagccccug

SEQ ID NO: 2731535 - RNA, 16 nt, Human
ccuggcagccccuguu

SEQ ID NO: 2731536 - RNA, 16 nt, Human
ccuggcaugggaauga

SEQ ID NO: 2731537 - RNA, 17 nt, Human
ccuggcaugggaaugaa

SEQ ID NO: 2731538 - RNA, 20 nt, Human
ccuggcacugcuuccaguga

SEQ ID NO: 2731539 - RNA, 17 nt, Human
ccuggcacugcuuccag

SEQ ID NO: 2731540 - RNA, 12 nt, Human
ccugcuccagcu

SEQ ID NO: 2731541 - RNA, 13 nt, Human
ccugcuccagcug

SEQ ID NO: 2731542 - RNA, 14 nt, Human
ccugcuccagcugu

SEQ ID NO: 2731543 - RNA, 22 nt, Human
ccugcuccagcuguucagcugg

SEQ ID NO: 2731544 - RNA, 23 nt, Human
ccugcgucucauacucaccucac

SEQ ID NO: 2731545 - RNA, 19 nt, Human
ccugcaacaccuuguuucc

SEQ ID NO: 2731546 - RNA, 16 nt, Human
ccugcaaccugauugu

SEQ ID NO: 2731547 - RNA, 18 nt, Human
ccugcaacaccuuguuuc

SEQ ID NO: 2731548 - RNA, 16 nt, Human
ccugcuuucagauacu

SEQ ID NO: 2731549 - RNA, 15 nt, Human
ccugcuuucagauac

SEQ ID NO: 2731550 - RNA, 21 nt, Human
ccugcuuucagauacuggauu

SEQ ID NO: 2731551 - RNA, 19 nt, Human
ccugcugguucaggguugg

SEQ ID NO: 2731552 - RNA, 13 nt, Human
ccugcugguucag

SEQ ID NO: 2731553 - RNA, 21 nt, Human
ccugcuggguguggcgcagca

SEQ ID NO: 2731554 - RNA, 13 nt, Human
ccuucagugccuu

SEQ ID NO: 2731555 - RNA, 14 nt, Human
ccuucagugccuua

SEQ ID NO: 2731556 - RNA, 19 nt, Human
ccuucagugccuuauggaa

SEQ ID NO: 2731557 - RNA, 15 nt, Human
ccuucagugccuuau

SEQ ID NO: 2731558 - RNA, 20 nt, Human
ccuucagugccuuauggaac

SEQ ID NO: 2731559 - RNA, 14 nt, Human
ccuuccucuuucca

SEQ ID NO: 2731560 - RNA, 18 nt, Human
ccuuccaggggugggaca

SEQ ID NO: 2731561 - RNA, 22 nt, Human
ccuuccaggggugggacacccu

SEQ ID NO: 2731562 - RNA, 15 nt, Human
ccuuccagggguggg

SEQ ID NO: 2731563 - RNA, 16 nt, Human
ccuuccagggguggga

SEQ ID NO: 2731564 - RNA, 16 nt, Human
ccuuagacagucccug

SEQ ID NO: 2731565 - RNA, 17 nt, Human
ccuuagacagucccugc

SEQ ID NO: 2731566 - RNA, 21 nt, Human
ccuuagacagucccugccaau

SEQ ID NO: 2731567 - RNA, 18 nt, Human
ccuuagacagucccugcc

SEQ ID NO: 2731568 - RNA, 19 nt, Human
ccuuagacagucccugcca

SEQ ID NO: 2731569 - RNA, 14 nt, Human
ccuuaccagcagag

SEQ ID NO: 2731570 - RNA, 20 nt, Human
ccuuaccucggugccuuccu

SEQ ID NO: 2731571 - RNA, 14 nt, Human
ccuuaccugccagg

SEQ ID NO: 2731572 - RNA, 17 nt, Human
ccuuaccagcagagcac

SEQ ID NO: 2731573 - RNA, 15 nt, Human
ccuuaccagcagagc

SEQ ID NO: 2731574 - RNA, 16 nt, Human
ccuuaccagcagagca

SEQ ID NO: 2731575 - RNA, 11 nt, Human
ccuuuggcuuc

SEQ ID NO: 2731576 - RNA, 22 nt, Human
ccuugaguugauucagcucugc

SEQ ID NO: 2731577 - RNA, 23 nt, Human
ccuugaguugauucagcucugca

SEQ ID NO: 2731578 - RNA, 21 nt, Human
ccuugaccauucuccaccugc

SEQ ID NO: 2731579 - RNA, 19 nt, Human
ccuuggauuguccccgacc

SEQ ID NO: 2731580 - RNA, 14 nt, Human
ccuugacagggcac

SEQ ID NO: 2731581 - RNA, 13 nt, Human
ccuugacagggca

SEQ ID NO: 2731582 - RNA, 15 nt, Human
ccuugacagggcaca

SEQ ID NO: 2731583 - RNA, 17 nt, Human
ccuugacagggcacacc

SEQ ID NO: 2731584 - RNA, 19 nt, Human
ccuugaccauucuccaccu

SEQ ID NO: 2731585 - RNA, 20 nt, Human
ccuugaccauucuccaccug

SEQ ID NO: 2731586 - RNA, 15 nt, Human
ccuugaaaacacugu

SEQ ID NO: 2731587 - RNA, 13 nt, Human
ccuucgcuccugu

SEQ ID NO: 2731588 - RNA, 14 nt, Human
ccuucgcuccugug

SEQ ID NO: 2731589 - RNA, 15 nt, Human
ccuucgcuccugugu

SEQ ID NO: 2731590 - RNA, 18 nt, Human
ccuucgcuccugugucuu

SEQ ID NO: 2731591 - RNA, 14 nt, Human
ccuugaacugggua

SEQ ID NO: 2731592 - RNA, 22 nt, Human
ccuugaaaacacuguucucugc

SEQ ID NO: 2731593 - RNA, 19 nt, Human
ccuugaaaacacuguucuc

SEQ ID NO: 2731594 - RNA, 21 nt, Human
ccuugaaaacacuguucucug

SEQ ID NO: 2731595 - RNA, 16 nt, Human
ccuugaacuggguacu

SEQ ID NO: 2731596 - RNA, 17 nt, Human
ccuugaacuuugaccuc

SEQ ID NO: 2731597 - RNA, 17 nt, Human
ccuugaaugaugccaug

SEQ ID NO: 2731598 - RNA, 17 nt, Human
ccuccccuccucugcuu

SEQ ID NO: 2731599 - RNA, 18 nt, Human
ccuccccuccucugcuug

SEQ ID NO: 2731600 - RNA, 15 nt, Human
ccucccucccucuuu

SEQ ID NO: 2731601 - RNA, 13 nt, Human
ccucccucccucu

SEQ ID NO: 2731602 - RNA, 12 nt, Human
ccucccugcaau

SEQ ID NO: 2731603 - RNA, 16 nt, Human
ccucccugcaauaaaa

SEQ ID NO: 2731604 - RNA, 16 nt, Human
ccucccucccucuuuc

SEQ ID NO: 2731605 - RNA, 11 nt, Human
ccuccucugcu

SEQ ID NO: 2731606 - RNA, 13 nt, Human
ccuccugccucga

SEQ ID NO: 2731607 - RNA, 13 nt, Human
ccuccugggcuaa

SEQ ID NO: 2731608 - RNA, 13 nt, Human
ccuccugugugug

SEQ ID NO: 2731609 - RNA, 15 nt, Human
ccuccugugugugcg

SEQ ID NO: 2731610 - RNA, 22 nt, Human
ccuccugugugugcgccuacag

SEQ ID NO: 2731611 - RNA, 15 nt, Human
ccuccccuccucugc

SEQ ID NO: 2731612 - RNA, 14 nt, Human
ccuccccuccucug

SEQ ID NO: 2731613 - RNA, 15 nt, Human
ccucagucuggcccu

SEQ ID NO: 2731614 - RNA, 16 nt, Human
ccucaggugagaagca

SEQ ID NO: 2731615 - RNA, 15 nt, Human
ccucagggucccugg

SEQ ID NO: 2731616 - RNA, 22 nt, Human
ccucaggugagaagcagaggaa

SEQ ID NO: 2731617 - RNA, 22 nt, Human
ccucaggugauccacccaccuc

SEQ ID NO: 2731618 - RNA, 17 nt, Human
ccucaggugauccaccc

SEQ ID NO: 2731619 - RNA, 19 nt, Human
ccucaggugauccacccac

SEQ ID NO: 2731620 - RNA, 20 nt, Human
ccucagaaaacaaggaugaa

SEQ ID NO: 2731621 - RNA, 16 nt, Human
ccucagcauccuggca

SEQ ID NO: 2731622 - RNA, 17 nt, Human
ccucagcauccuggcac

SEQ ID NO: 2731623 - RNA, 14 nt, Human
ccucagcauccugg

SEQ ID NO: 2731624 - RNA, 14 nt, Human
ccucagggucccug

SEQ ID NO: 2731625 - RNA, 11 nt, Human
ccucaggccug

SEQ ID NO: 2731626 - RNA, 14 nt, Human
ccucaggccugggg

SEQ ID NO: 2731627 - RNA, 21 nt, Human
ccucaggccugggggcugggc

SEQ ID NO: 2731628 - RNA, 17 nt, Human
ccucugcuugccauccc

SEQ ID NO: 2731629 - RNA, 20 nt, Human
ccucugcuugccaucccucc

SEQ ID NO: 2731630 - RNA, 21 nt, Human
ccucugcuugccaucccuccc

SEQ ID NO: 2731631 - RNA, 12 nt, Human
ccucugggacug

SEQ ID NO: 2731632 - RNA, 11 nt, Human
ccucugcacaa

SEQ ID NO: 2731633 - RNA, 15 nt, Human
ccucugcacaagcug

SEQ ID NO: 2731634 - RNA, 17 nt, Human
ccucugacacacagcuc

SEQ ID NO: 2731635 - RNA, 18 nt, Human
ccucugacacacagcucu

SEQ ID NO: 2731636 - RNA, 20 nt, Human
ccucugcacaagcugcaccc

SEQ ID NO: 2731637 - RNA, 17 nt, Human
ccucugcacaagcugca

SEQ ID NO: 2731638 - RNA, 19 nt, Human
ccucugcacaagcugcacc

SEQ ID NO: 2731639 - RNA, 22 nt, Human
ccucugcacuccccugcugggu

SEQ ID NO: 2731640 - RNA, 14 nt, Human
ccucugcacucccc

SEQ ID NO: 2731641 - RNA, 19 nt, Human
ccucugcacuccccugcug

SEQ ID NO: 2731642 - RNA, 20 nt, Human
ccucugcacuccccugcugg

SEQ ID NO: 2731643 - RNA, 21 nt, Human
ccucugcacuccccugcuggg

SEQ ID NO: 2731644 - RNA, 11 nt, Human
ccucuccuggg

SEQ ID NO: 2731645 - RNA, 12 nt, Human
ccucuccugggc

SEQ ID NO: 2731646 - RNA, 13 nt, Human
ccucuccugggca

SEQ ID NO: 2731647 - RNA, 23 nt, Human
ccucugaaaaccaauguucucuc

SEQ ID NO: 2731648 - RNA, 16 nt, Human
ccucugacacacagcu

SEQ ID NO: 2731649 - RNA, 15 nt, Human
ccucugacacacagc

SEQ ID NO: 2731650 - RNA, 23 nt, Human
ccuccugugugugcgccuacagg

SEQ ID NO: 2731651 - RNA, 12 nt, Human
ccucucccauca

SEQ ID NO: 2731652 - RNA, 23 nt, Human
ccugaggcccuucucuccagccc

SEQ ID NO: 2731653 - RNA, 21 nt, Human
ccugaggcccuucucuccagc

SEQ ID NO: 2731654 - RNA, 22 nt, Human
ccugaggcccuucucuccagcc

SEQ ID NO: 2731655 - RNA, 16 nt, Human
ccugaggcccuucucu

SEQ ID NO: 2731656 - RNA, 17 nt, Human
ccugaggcccuucucuc

SEQ ID NO: 2731657 - RNA, 19 nt, Human
ccugaggcccuucucucca

SEQ ID NO: 2731658 - RNA, 20 nt, Human
ccugaggcccuucucuccag

SEQ ID NO: 2731659 - RNA, 12 nt, Human
ccugaggcccag

SEQ ID NO: 2731660 - RNA, 13 nt, Human
ccugaggcccaga

SEQ ID NO: 2731661 - RNA, 14 nt, Human
ccugaggcccagag

SEQ ID NO: 2731662 - RNA, 12 nt, Human
ccugacaacacu

SEQ ID NO: 2731663 - RNA, 14 nt, Human
ccugacaacacuca

SEQ ID NO: 2731664 - RNA, 15 nt, Human
ccugacaacacucau

SEQ ID NO: 2731665 - RNA, 16 nt, Human
ccugacaacacucauu

SEQ ID NO: 2731666 - RNA, 14 nt, Human
ccugaugcuucuuc

SEQ ID NO: 2731667 - RNA, 13 nt, Human
ccugauuaaagaa

SEQ ID NO: 2731668 - RNA, 23 nt, Human
ccugauugugucucuugguccug

SEQ ID NO: 2731669 - RNA, 12 nt, Human
ccugauuaaaga

SEQ ID NO: 2731670 - RNA, 17 nt, Human
ccugaugcuucuucaga

SEQ ID NO: 2731671 - RNA, 18 nt, Human
ccugaugcuucuucagag

SEQ ID NO: 2731672 - RNA, 17 nt, Human
ccucuuaugggcugggu

SEQ ID NO: 2731673 - RNA, 22 nt, Human
ccucuuuggucuacacugugcu

SEQ ID NO: 2731674 - RNA, 20 nt, Human
ccugaacaggauauucucac

SEQ ID NO: 2731675 - RNA, 21 nt, Human
ccugaagacucauucuucugu

SEQ ID NO: 2731676 - RNA, 15 nt, Human
ccugaagucacacag

SEQ ID NO: 2731677 - RNA, 13 nt, Human
ccugaaggccccg

SEQ ID NO: 2731678 - RNA, 16 nt, Human
ccugaagucacacagu

SEQ ID NO: 2731679 - RNA, 17 nt, Human
ccugaagucacacagug

SEQ ID NO: 2731680 - RNA, 23 nt, Human
ccucuuagaugcaguucugaaga

SEQ ID NO: 2731681 - RNA, 14 nt, Human
ccucuuaugggcug

SEQ ID NO: 2731682 - RNA, 15 nt, Human
ccucuuaugggcugg

SEQ ID NO: 2731683 - RNA, 16 nt, Human
ccucuuaugggcuggg

SEQ ID NO: 2731684 - RNA, 14 nt, Human
ccucuuagaaaaac

SEQ ID NO: 2731685 - RNA, 14 nt, Human
ccucuguacagagc

SEQ ID NO: 2731686 - RNA, 15 nt, Human
ccucuguacagagcc

SEQ ID NO: 2731687 - RNA, 16 nt, Human
ccucuguacagagccc

SEQ ID NO: 2731688 - RNA, 23 nt, Human
ccucuguacagagcccacgcccc

SEQ ID NO: 2731689 - RNA, 17 nt, Human
ccucuguacagagccca

SEQ ID NO: 2731690 - RNA, 18 nt, Human
ccucuguacagagcccac

SEQ ID NO: 2731691 - RNA, 15 nt, Human
cccuugaugaagaag

SEQ ID NO: 2731692 - RNA, 16 nt, Human
cccuugaugaagaagu

SEQ ID NO: 2731693 - RNA, 19 nt, Human
cccuuaccucggugccuuc

SEQ ID NO: 2731694 - RNA, 22 nt, Human
cccuugccgucuaccugagggg

SEQ ID NO: 2731695 - RNA, 17 nt, Human
cccuugccgucuaccug

SEQ ID NO: 2731696 - RNA, 18 nt, Human
cccuugccgucuaccuga

SEQ ID NO: 2731697 - RNA, 20 nt, Human
cccuuugacgccaucccagc

SEQ ID NO: 2731698 - RNA, 18 nt, Human
cccuuguggucccacccc

SEQ ID NO: 2731699 - RNA, 18 nt, Human
cccuuggggagcaggcuc

SEQ ID NO: 2731700 - RNA, 14 nt, Human
cccuugugguccca

SEQ ID NO: 2731701 - RNA, 16 nt, Human
cccuuguggucccacc

SEQ ID NO: 2731702 - RNA, 18 nt, Human
ccgagaucacgccacugc

SEQ ID NO: 2731703 - RNA, 17 nt, Human
ccgaggccuucucugaa

SEQ ID NO: 2731704 - RNA, 19 nt, Human
cccuuuuuuggcugcugaa

SEQ ID NO: 2731705 - RNA, 17 nt, Human
ccgagaaggaagccucc

SEQ ID NO: 2731706 - RNA, 18 nt, Human
ccgagauagccaaggcca

SEQ ID NO: 2731707 - RNA, 19 nt, Human
ccgagauagccaaggccaa

SEQ ID NO: 2731708 - RNA, 22 nt, Human
ccgagauagccaaggccaaagg

SEQ ID NO: 2731709 - RNA, 11 nt, Human
cccuuuuccuu

SEQ ID NO: 2731710 - RNA, 13 nt, Human
cccuuuucuguuu

SEQ ID NO: 2731711 - RNA, 17 nt, Human
cccuuuuuuggcugcug

SEQ ID NO: 2731712 - RNA, 18 nt, Human
cccuuuuuuggcugcuga

SEQ ID NO: 2731713 - RNA, 21 nt, Human
cccccgcugucagccauuccu

SEQ ID NO: 2731714 - RNA, 12 nt, Human
cccccagcccca

SEQ ID NO: 2731715 - RNA, 14 nt, Human
ccccaggaggccag

SEQ ID NO: 2731716 - RNA, 15 nt, Human
ccccaggaggccagc

SEQ ID NO: 2731717 - RNA, 21 nt, Human
ccccaggaggccagccuugac

SEQ ID NO: 2731718 - RNA, 22 nt, Human
ccccaggaggccagccuugacc

SEQ ID NO: 2731719 - RNA, 13 nt, Human
ccccaggaggcca

SEQ ID NO: 2731720 - RNA, 14 nt, Human
ccccacuggugaca

SEQ ID NO: 2731721 - RNA, 12 nt, Human
ccccacugguga

SEQ ID NO: 2731722 - RNA, 13 nt, Human
ccccacuggugac

SEQ ID NO: 2731723 - RNA, 18 nt, Human
cccugugggcccccaaau

SEQ ID NO: 2731724 - RNA, 15 nt, Human
cccuguuuguuucug

SEQ ID NO: 2731725 - RNA, 16 nt, Human
cccugugggcccccaa

SEQ ID NO: 2731726 - RNA, 15 nt, Human
cccugugggccccca

SEQ ID NO: 2731727 - RNA, 17 nt, Human
ccccucagggucccugg

SEQ ID NO: 2731728 - RNA, 18 nt, Human
ccccucagggucccuggu

SEQ ID NO: 2731729 - RNA, 20 nt, Human
ccccucagggucccuggugg

SEQ ID NO: 2731730 - RNA, 21 nt, Human
cccugguggcagugggagcug

SEQ ID NO: 2731731 - RNA, 15 nt, Human
cccugguggcagugg

SEQ ID NO: 2731732 - RNA, 16 nt, Human
cccugguggcaguggg

SEQ ID NO: 2731733 - RNA, 19 nt, Human
cccugguggcagugggagc

SEQ ID NO: 2731734 - RNA, 13 nt, Human
ccggcuggccugg

SEQ ID NO: 2731735 - RNA, 15 nt, Human
ccgggcacucagaag

SEQ ID NO: 2731736 - RNA, 12 nt, Human
ccggcuggccug

SEQ ID NO: 2731737 - RNA, 23 nt, Human
ccgcuuucuacccagcgagcccu

SEQ ID NO: 2731738 - RNA, 13 nt, Human
ccgugcuaaggac

SEQ ID NO: 2731739 - RNA, 15 nt, Human
ccucaccccacugug

SEQ ID NO: 2731740 - RNA, 12 nt, Human
ccucaccccacu

SEQ ID NO: 2731741 - RNA, 21 nt, Human
ccucacccacccuuuuuuaaa

SEQ ID NO: 2731742 - RNA, 20 nt, Human
ccucacaguccuuaccagca

SEQ ID NO: 2731743 - RNA, 22 nt, Human
ccucacaguccuuaccagcaga

SEQ ID NO: 2731744 - RNA, 17 nt, Human
ccucaccuuucccaucu

SEQ ID NO: 2731745 - RNA, 17 nt, Human
ccucacaguccuuacca

SEQ ID NO: 2731746 - RNA, 21 nt, Human
cuggucccagccagcaguuca

SEQ ID NO: 2731747 - RNA, 15 nt, Human
cuggucccacucagu

SEQ ID NO: 2731748 - RNA, 18 nt, Human
cuggucccacucagucca

SEQ ID NO: 2731749 - RNA, 18 nt, Human
cugguccauagagagcaa

SEQ ID NO: 2731750 - RNA, 19 nt, Human
cuggguucuacccaggugc

SEQ ID NO: 2731751 - RNA, 13 nt, Human
cuggguuggaggg

SEQ ID NO: 2731752 - RNA, 15 nt, Human
cugguccauagagag

SEQ ID NO: 2731753 - RNA, 17 nt, Human
cugguccauagagagca

SEQ ID NO: 2731754 - RNA, 19 nt, Human
cugguggcagugggagcug

SEQ ID NO: 2731755 - RNA, 23 nt, Human
cugguggcagugggagcugccug

SEQ ID NO: 2731756 - RNA, 21 nt, Human
cuggguacuuguggacacagc

SEQ ID NO: 2731757 - RNA, 23 nt, Human
cuggguacuuguggacacagcuc

SEQ ID NO: 2731758 - RNA, 20 nt, Human
cuggguacuuguggacacag

SEQ ID NO: 2731759 - RNA, 23 nt, Human
cugggguggggaccucaggccug

SEQ ID NO: 2731760 - RNA, 21 nt, Human
cugggguggggaccucaggcc

SEQ ID NO: 2731761 - RNA, 22 nt, Human
cugggguggggaccucaggccu

SEQ ID NO: 2731762 - RNA, 13 nt, Human
cugggggccucag

SEQ ID NO: 2731763 - RNA, 17 nt, Human
cugggggccucagugcc

SEQ ID NO: 2731764 - RNA, 18 nt, Human
cugggggccucagugcca

SEQ ID NO: 2731765 - RNA, 17 nt, Human
cugggguggggaccuca

SEQ ID NO: 2731766 - RNA, 18 nt, Human
cugggguggggaccucag

SEQ ID NO: 2731767 - RNA, 19 nt, Human
cugggguggggaccucagg

SEQ ID NO: 2731768 - RNA, 21 nt, Human
cugggcuuggggaccagagcu

SEQ ID NO: 2731769 - RNA, 17 nt, Human
cugggcuuggggaccag

SEQ ID NO: 2731770 - RNA, 20 nt, Human
cugggcuuggggaccagagc

SEQ ID NO: 2731771 - RNA, 21 nt, Human
cugggcuucaguggcagcugc

SEQ ID NO: 2731772 - RNA, 22 nt, Human
cugggcuucaguggcagcugcu

SEQ ID NO: 2731773 - RNA, 23 nt, Human
cugggcuucaguggcagcugcuu

SEQ ID NO: 2731774 - RNA, 13 nt, Human
cugggcuugggga

SEQ ID NO: 2731775 - RNA, 18 nt, Human
cugggcuucaguggcagc

SEQ ID NO: 2731776 - RNA, 17 nt, Human
cugggcuucaguggcag

SEQ ID NO: 2731777 - RNA, 19 nt, Human
cugggcuucaguggcagcu

SEQ ID NO: 2731778 - RNA, 20 nt, Human
cugggcuucaguggcagcug

SEQ ID NO: 2731779 - RNA, 22 nt, Human
cugggaacccaaguccaagcau

SEQ ID NO: 2731780 - RNA, 16 nt, Human
cugggagcuuuuguag

SEQ ID NO: 2731781 - RNA, 18 nt, Human
cugggaggucaaggcugc

SEQ ID NO: 2731782 - RNA, 20 nt, Human
cugggcaaugugauaaaacc

SEQ ID NO: 2731783 - RNA, 16 nt, Human
cugggagugagcuggu

SEQ ID NO: 2731784 - RNA, 13 nt, Human
cugggagugagcu

SEQ ID NO: 2731785 - RNA, 12 nt, Human
cugggagugagc

SEQ ID NO: 2731786 - RNA, 13 nt, Human
cuggccugagcug

SEQ ID NO: 2731787 - RNA, 17 nt, Human
cuggcucuuccaggcug

SEQ ID NO: 2731788 - RNA, 20 nt, Human
cuggcucuuccaggcuggga

SEQ ID NO: 2731789 - RNA, 18 nt, Human
cuggcucuuccaggcugg

SEQ ID NO: 2731790 - RNA, 19 nt, Human
cuggcucuuccaggcuggg

SEQ ID NO: 2731791 - RNA, 22 nt, Human
cuggcuggguggcaccagcagc

SEQ ID NO: 2731792 - RNA, 19 nt, Human
cuggcuguuggcugggggc

SEQ ID NO: 2731793 - RNA, 21 nt, Human
cuggcuggguggcaccagcag

SEQ ID NO: 2731794 - RNA, 20 nt, Human
cuggcuguuggcugggggcc

SEQ ID NO: 2731795 - RNA, 19 nt, Human
cuggcacaguuuucugaga

SEQ ID NO: 2731796 - RNA, 18 nt, Human
cuggcacaguuuucugag

SEQ ID NO: 2731797 - RNA, 23 nt, Human
cuggcacuauaauguaagcucua

SEQ ID NO: 2731798 - RNA, 13 nt, Human
cuggcacugcuuc

SEQ ID NO: 2731799 - RNA, 14 nt, Human
cuggcacugcuucc

SEQ ID NO: 2731800 - RNA, 20 nt, Human
cuggauuguacuuugugcug

SEQ ID NO: 2731801 - RNA, 19 nt, Human
cuggauuguacuuugugcu

SEQ ID NO: 2731802 - RNA, 15 nt, Human
cuggauggggcugca

SEQ ID NO: 2731803 - RNA, 16 nt, Human
cuggauggggcugcac

SEQ ID NO: 2731804 - RNA, 23 nt, Human
cuggauuaaacuuaaucuaaaug

SEQ ID NO: 2731805 - RNA, 13 nt, Human
cuggauuaaacuu

SEQ ID NO: 2731806 - RNA, 16 nt, Human
cuggccagaugcacca

SEQ ID NO: 2731807 - RNA, 17 nt, Human
cuggcacugcuuccagu

SEQ ID NO: 2731808 - RNA, 15 nt, Human
cuggcacugcuucca

SEQ ID NO: 2731809 - RNA, 16 nt, Human
cuggcacugcuuccag

SEQ ID NO: 2731810 - RNA, 21 nt, Human
cuggccagaugcaccagcccu

SEQ ID NO: 2731811 - RNA, 17 nt, Human
cuggccagaugcaccag

SEQ ID NO: 2731812 - RNA, 18 nt, Human
cuggccagaugcaccagc

SEQ ID NO: 2731813 - RNA, 19 nt, Human
cuggccagaugcaccagcc

SEQ ID NO: 2731814 - RNA, 20 nt, Human
cuggccagaugcaccagccc

SEQ ID NO: 2731815 - RNA, 12 nt, Human
cuggcccacugc

SEQ ID NO: 2731816 - RNA, 13 nt, Human
cuggcccacugca

SEQ ID NO: 2731817 - RNA, 17 nt, Human
cuggccuagcauacgua

SEQ ID NO: 2731818 - RNA, 23 nt, Human
cuggccuagcauacguacacauu

SEQ ID NO: 2731819 - RNA, 23 nt, Human
cuggaauaauccuaaacauauga

SEQ ID NO: 2731820 - RNA, 14 nt, Human
cuggaagcacagcu

SEQ ID NO: 2731821 - RNA, 18 nt, Human
cuggaagcacagcuucau

SEQ ID NO: 2731822 - RNA, 15 nt, Human
cuggaagcacagcuu

SEQ ID NO: 2731823 - RNA, 14 nt, Human
cuggaaugcagugg

SEQ ID NO: 2731824 - RNA, 15 nt, Human
cuggaaugcaguggu

SEQ ID NO: 2731825 - RNA, 13 nt, Human
cugcugaaacaac

SEQ ID NO: 2731826 - RNA, 21 nt, Human
cugcuuucagauacuggauug

SEQ ID NO: 2731827 - RNA, 18 nt, Human
cugcuuucagauacugga

SEQ ID NO: 2731828 - RNA, 16 nt, Human
cugcuuucagauacug

SEQ ID NO: 2731829 - RNA, 16 nt, Human
cuggagcuagaauuug

SEQ ID NO: 2731830 - RNA, 22 nt, Human
cuggagcuagaauuugauaugu

SEQ ID NO: 2731831 - RNA, 17 nt, Human
cuggagcuagaauuuga

SEQ ID NO: 2731832 - RNA, 21 nt, Human
cugccuaaggacuucuuuaau

SEQ ID NO: 2731833 - RNA, 20 nt, Human
cugccuaaggacuucuuuaa

SEQ ID NO: 2731834 - RNA, 22 nt, Human
cugccuaaggacuucuuuaauu

SEQ ID NO: 2731835 - RNA, 19 nt, Human
cugccuaaggacuucuuua

SEQ ID NO: 2731836 - RNA, 14 nt, Human
cugccucagccucc

SEQ ID NO: 2731837 - RNA, 13 nt, Human
cugccucagccuc

SEQ ID NO: 2731838 - RNA, 13 nt, Human
cugccucuucucu

SEQ ID NO: 2731839 - RNA, 23 nt, Human
cugccugaagucacacagugagu

SEQ ID NO: 2731840 - RNA, 15 nt, Human
cugccugcccaggcc

SEQ ID NO: 2731841 - RNA, 13 nt, Human
cugccugcccagg

SEQ ID NO: 2731842 - RNA, 14 nt, Human
cugccugcccaggc

SEQ ID NO: 2731843 - RNA, 14 nt, Human
cugcuccagcuguu

SEQ ID NO: 2731844 - RNA, 16 nt, Human
cugcgguccacccagg

SEQ ID NO: 2731845 - RNA, 21 nt, Human
cugcggaaugaaccacaucuu

SEQ ID NO: 2731846 - RNA, 15 nt, Human
cugcgguccacccag

SEQ ID NO: 2731847 - RNA, 20 nt, Human
cugcggaaugaaccacaucu

SEQ ID NO: 2731848 - RNA, 16 nt, Human
cugcuccucuccccag

SEQ ID NO: 2731849 - RNA, 17 nt, Human
cugcuccucuccccagc

SEQ ID NO: 2731850 - RNA, 15 nt, Human
cugcuccagcuguuc

SEQ ID NO: 2731851 - RNA, 18 nt, Human
cugcuccucuccccagca

SEQ ID NO: 2731852 - RNA, 16 nt, Human
cugccauuucugagau

SEQ ID NO: 2731853 - RNA, 13 nt, Human
cugcccaggcccc

SEQ ID NO: 2731854 - RNA, 14 nt, Human
cugccccuggcagc

SEQ ID NO: 2731855 - RNA, 15 nt, Human
cugccccuggcagcc

SEQ ID NO: 2731856 - RNA, 16 nt, Human
cugccccuggcagccc

SEQ ID NO: 2731857 - RNA, 17 nt, Human
cugccccuggcagcccc

SEQ ID NO: 2731858 - RNA, 13 nt, Human
cugcccugcccac

SEQ ID NO: 2731859 - RNA, 14 nt, Human
cugcccugcccacc

SEQ ID NO: 2731860 - RNA, 15 nt, Human
cugcccugcccaccu

SEQ ID NO: 2731861 - RNA, 16 nt, Human
cugcccugcccaccug

SEQ ID NO: 2731862 - RNA, 11 nt, Human
cugcccggcug

SEQ ID NO: 2731863 - RNA, 15 nt, Human
cugcccggcugcgga

SEQ ID NO: 2731864 - RNA, 19 nt, Human
cugcccuccaagaccuucu

SEQ ID NO: 2731865 - RNA, 15 nt, Human
cugccaugccagcuu

SEQ ID NO: 2731866 - RNA, 17 nt, Human
cugccaugccagcuuau

SEQ ID NO: 2731867 - RNA, 19 nt, Human
cugccaugccagcuuaucu

SEQ ID NO: 2731868 - RNA, 19 nt, Human
cugccagccgagauagcca

SEQ ID NO: 2731869 - RNA, 15 nt, Human
cugccaggaagccag

SEQ ID NO: 2731870 - RNA, 16 nt, Human
cugccaggaagccagc

SEQ ID NO: 2731871 - RNA, 18 nt, Human
cugccaggaagccagcag

SEQ ID NO: 2731872 - RNA, 19 nt, Human
cugccaggaagccagcagg

SEQ ID NO: 2731873 - RNA, 14 nt, Human
cugccacccugggg

SEQ ID NO: 2731874 - RNA, 15 nt, Human
cugccacccugggga

SEQ ID NO: 2731875 - RNA, 16 nt, Human
cugccacccuggggag

SEQ ID NO: 2731876 - RNA, 20 nt, Human
cugccacccuggggagaaag

SEQ ID NO: 2731877 - RNA, 14 nt, Human
cugcacuugcagac

SEQ ID NO: 2731878 - RNA, 16 nt, Human
cugcacuugcagacuc

SEQ ID NO: 2731879 - RNA, 17 nt, Human
cugcacuugcagacucu

SEQ ID NO: 2731880 - RNA, 17 nt, Human
cugcaccggcuggccug

SEQ ID NO: 2731881 - RNA, 18 nt, Human
cugcaccggcuggccugg

SEQ ID NO: 2731882 - RNA, 19 nt, Human
cugcaccggcuggccuggc

SEQ ID NO: 2731883 - RNA, 22 nt, Human
cugcagccucaaccuccugggc

SEQ ID NO: 2731884 - RNA, 19 nt, Human
cugcagccucaaccuccug

SEQ ID NO: 2731885 - RNA, 20 nt, Human
cugcagccucaaccuccugg

SEQ ID NO: 2731886 - RNA, 22 nt, Human
cugcagggaguccgaaagggac

SEQ ID NO: 2731887 - RNA, 11 nt, Human
cugcagccuca

SEQ ID NO: 2731888 - RNA, 13 nt, Human
cugcacaagcugc

SEQ ID NO: 2731889 - RNA, 14 nt, Human
cugcacaagcugca

SEQ ID NO: 2731890 - RNA, 15 nt, Human
cugcacaagcugcac

SEQ ID NO: 2731891 - RNA, 16 nt, Human
cugcacaagcugcacc

SEQ ID NO: 2731892 - RNA, 17 nt, Human
cugcacccucaggcagg

SEQ ID NO: 2731893 - RNA, 16 nt, Human
cugcacccucaggcag

SEQ ID NO: 2731894 - RNA, 18 nt, Human
cugcacccucaggcaggu

SEQ ID NO: 2731895 - RNA, 20 nt, Human
cugcaauuucauaugcugua

SEQ ID NO: 2731896 - RNA, 18 nt, Human
cugcaauuucauaugcug

SEQ ID NO: 2731897 - RNA, 15 nt, Human
cugauucuucagcaa

SEQ ID NO: 2731898 - RNA, 21 nt, Human
cugauguuccuagugaaagag

SEQ ID NO: 2731899 - RNA, 20 nt, Human
cugauguuccuagugaaaga

SEQ ID NO: 2731900 - RNA, 18 nt, Human
cugauguuccuagugaaa

SEQ ID NO: 2731901 - RNA, 13 nt, Human
cugauguuccuag

SEQ ID NO: 2731902 - RNA, 22 nt, Human
cugauucccaagcucugcuccu

SEQ ID NO: 2731903 - RNA, 19 nt, Human
cugauucccaagcucugcu

SEQ ID NO: 2731904 - RNA, 20 nt, Human
cugauucccaagcucugcuc

SEQ ID NO: 2731905 - RNA, 17 nt, Human
cugauucccaagcucug

SEQ ID NO: 2731906 - RNA, 18 nt, Human
cugauucccaagcucugc

SEQ ID NO: 2731907 - RNA, 15 nt, Human
cugauucccaagcuc

SEQ ID NO: 2731908 - RNA, 20 nt, Human
cugauagaggaagccugauu

SEQ ID NO: 2731909 - RNA, 21 nt, Human
cugauaaagaugagugagcau

SEQ ID NO: 2731910 - RNA, 20 nt, Human
cugauccaguuuuguuugga

SEQ ID NO: 2731911 - RNA, 22 nt, Human
cugagugggggaucacagccuc

SEQ ID NO: 2731912 - RNA, 13 nt, Human
cugauaaagauga

SEQ ID NO: 2731913 - RNA, 13 nt, Human
cugagucugaagg

SEQ ID NO: 2731914 - RNA, 14 nt, Human
cugagucugaaggc

SEQ ID NO: 2731915 - RNA, 15 nt, Human
cugagucugaaggcu

SEQ ID NO: 2731916 - RNA, 16 nt, Human
cugagucugaaggcug

SEQ ID NO: 2731917 - RNA, 13 nt, Human
cucuuaagaagac

SEQ ID NO: 2731918 - RNA, 13 nt, Human
cucuuaaaaccca

SEQ ID NO: 2731919 - RNA, 24 nt, Human
cucuuaaaacccaagugccuuagc

SEQ ID NO: 2731920 - RNA, 19 nt, Human
cucuggcagcucagagagg

SEQ ID NO: 2731921 - RNA, 17 nt, Human
cucuggcagcucagaga

SEQ ID NO: 2731922 - RNA, 18 nt, Human
cucuggcagcucagagag

SEQ ID NO: 2731923 - RNA, 12 nt, Human
cucuucuccagg

SEQ ID NO: 2731924 - RNA, 23 nt, Human
cucuuccaggcugggagagccuu

SEQ ID NO: 2731925 - RNA, 22 nt, Human
cucuuccaggcugggagagccu

SEQ ID NO: 2731926 - RNA, 21 nt, Human
cucuuccaggcugggagagcc

SEQ ID NO: 2731927 - RNA, 18 nt, Human
cucuugguccugcugcag

SEQ ID NO: 2731928 - RNA, 19 nt, Human
cucuugguccugcugcagu

SEQ ID NO: 2731929 - RNA, 16 nt, Human
cucuugaccucaggug

SEQ ID NO: 2731930 - RNA, 13 nt, Human
cucuugaccucag

SEQ ID NO: 2731931 - RNA, 15 nt, Human
cucuugaccucaggu

SEQ ID NO: 2731932 - RNA, 17 nt, Human
cucuuucuauuguuucu

SEQ ID NO: 2731933 - RNA, 15 nt, Human
cucuuuggacacuca

SEQ ID NO: 2731934 - RNA, 18 nt, Human
cucuuuggacacucacac

SEQ ID NO: 2731935 - RNA, 17 nt, Human
cucuuuccaucuacccu

SEQ ID NO: 2731936 - RNA, 16 nt, Human
cugaauacagaggcaa

SEQ ID NO: 2731937 - RNA, 21 nt, Human
cugaagucagaucugccuaag

SEQ ID NO: 2731938 - RNA, 14 nt, Human
cugaagucagaucu

SEQ ID NO: 2731939 - RNA, 24 nt, Human
cugaagucuuuguacagacaacaa

SEQ ID NO: 2731940 - RNA, 16 nt, Human
cugaagucagaucugc

SEQ ID NO: 2731941 - RNA, 15 nt, Human
cugaagucagaucug

SEQ ID NO: 2731942 - RNA, 14 nt, Human
cugaagucacacag

SEQ ID NO: 2731943 - RNA, 15 nt, Human
cugaagucacacagu

SEQ ID NO: 2731944 - RNA, 19 nt, Human
cugaagacucauucuucug

SEQ ID NO: 2731945 - RNA, 21 nt, Human
cugaagacucauucuucugua

SEQ ID NO: 2731946 - RNA, 15 nt, Human
cugaacuuggcgcug

SEQ ID NO: 2731947 - RNA, 16 nt, Human
cugaacuuggcgcugc

SEQ ID NO: 2731948 - RNA, 21 nt, Human
cugaacuuggcgcugccccug

SEQ ID NO: 2731949 - RNA, 21 nt, Human
cugaaccuggguaacuaggga

SEQ ID NO: 2731950 - RNA, 18 nt, Human
cucuuugggccuggcucc

SEQ ID NO: 2731951 - RNA, 19 nt, Human
cucuuuggucuacacugug

SEQ ID NO: 2731952 - RNA, 21 nt, Human
cucuuuggucuacacugugcu

SEQ ID NO: 2731953 - RNA, 11 nt, Human
cugacccacug

SEQ ID NO: 2731954 - RNA, 17 nt, Human
cugacauuguuggccaa

SEQ ID NO: 2731955 - RNA, 20 nt, Human
cugacaggcaaugcuggcug

SEQ ID NO: 2731956 - RNA, 16 nt, Human
cugacaggcaaugcug

SEQ ID NO: 2731957 - RNA, 17 nt, Human
cugacaggcaaugcugg

SEQ ID NO: 2731958 - RNA, 18 nt, Human
cugacaggcaaugcuggc

SEQ ID NO: 2731959 - RNA, 19 nt, Human
cugacaggcaaugcuggcu

SEQ ID NO: 2731960 - RNA, 11 nt, Human
cugacaggcaa

SEQ ID NO: 2731961 - RNA, 21 nt, Human
cugacagacacaggcccggcu

SEQ ID NO: 2731962 - RNA, 18 nt, Human
cugaauuuaaauagcuuu

SEQ ID NO: 2731963 - RNA, 14 nt, Human
cugaauuuaaauag

SEQ ID NO: 2731964 - RNA, 23 nt, Human
cugaauuuaaauagcuuuuuucu

SEQ ID NO: 2731965 - RNA, 19 nt, Human
cugacagacacaggcccgg

SEQ ID NO: 2731966 - RNA, 21 nt, Human
cucuccugggcagcugccucc

SEQ ID NO: 2731967 - RNA, 13 nt, Human
cucuccuguaccu

SEQ ID NO: 2731968 - RNA, 15 nt, Human
cucuccuguaccucu

SEQ ID NO: 2731969 - RNA, 14 nt, Human
cucuccuguaccuc

SEQ ID NO: 2731970 - RNA, 22 nt, Human
cucuccuguaccucuugagccu

SEQ ID NO: 2731971 - RNA, 18 nt, Human
cucuccuguaccucuuga

SEQ ID NO: 2731972 - RNA, 17 nt, Human
cucuccuguaccucuug

SEQ ID NO: 2731973 - RNA, 14 nt, Human
cucucucacuccuu

SEQ ID NO: 2731974 - RNA, 15 nt, Human
cucucucacuccuug

SEQ ID NO: 2731975 - RNA, 16 nt, Human
cucucucacuccuuga

SEQ ID NO: 2731976 - RNA, 12 nt, Human
cucucucaggcc

SEQ ID NO: 2731977 - RNA, 22 nt, Human
cucucaggccagcugcuugggc

SEQ ID NO: 2731978 - RNA, 23 nt, Human
cucucaggccagcugcuugggcu

SEQ ID NO: 2731979 - RNA, 13 nt, Human
cucuccagccccu

SEQ ID NO: 2731980 - RNA, 12 nt, Human
cucuccagcccc

SEQ ID NO: 2731981 - RNA, 13 nt, Human
cucuccauuuaau

SEQ ID NO: 2731982 - RNA, 13 nt, Human
cucucccaucacu

SEQ ID NO: 2731983 - RNA, 18 nt, Human
cucucccaucacuucccu

SEQ ID NO: 2731984 - RNA, 14 nt, Human
cucucccaucacuu

SEQ ID NO: 2731985 - RNA, 20 nt, Human
cucucccaucacuucccuac

SEQ ID NO: 2731986 - RNA, 22 nt, Human
cucugcaagaauugaagcagga

SEQ ID NO: 2731987 - RNA, 14 nt, Human
cucugccucugaca

SEQ ID NO: 2731988 - RNA, 14 nt, Human
cucugcccuccaag

SEQ ID NO: 2731989 - RNA, 15 nt, Human
cucugcccuccaaga

SEQ ID NO: 2731990 - RNA, 16 nt, Human
cucugcccuccaagac

SEQ ID NO: 2731991 - RNA, 23 nt, Human
cucugcccuccaagaccuucucc

SEQ ID NO: 2731992 - RNA, 14 nt, Human
cuccaccucccugc

SEQ ID NO: 2731993 - RNA, 15 nt, Human
cuccaccucccugca

SEQ ID NO: 2731994 - RNA, 16 nt, Human
cuccaccucccugcaa

SEQ ID NO: 2731995 - RNA, 17 nt, Human
cuccaccucccugcaau

SEQ ID NO: 2731996 - RNA, 12 nt, Human
cuccacccugcu

SEQ ID NO: 2731997 - RNA, 15 nt, Human
cuccaccugccaggg

SEQ ID NO: 2731998 - RNA, 17 nt, Human
cuccaccugccagggac

SEQ ID NO: 2731999 - RNA, 18 nt, Human
cuccaccugccagggaca

SEQ ID NO: 2732000 - RNA, 21 nt, Human
cuccaccugccagggacagag

SEQ ID NO: 2732001 - RNA, 11 nt, Human
cuccacccugc

SEQ ID NO: 2732002 - RNA, 19 nt, Human
cuccagcucaccagcccca

SEQ ID NO: 2732003 - RNA, 20 nt, Human
cuccagcucaccagccccag

SEQ ID NO: 2732004 - RNA, 17 nt, Human
cucccagucauuuaaua

SEQ ID NO: 2732005 - RNA, 22 nt, Human
cucccaggcauuccccaggagg

SEQ ID NO: 2732006 - RNA, 17 nt, Human
cucccaggcauucccca

SEQ ID NO: 2732007 - RNA, 19 nt, Human
cucccaggcauuccccagg

SEQ ID NO: 2732008 - RNA, 20 nt, Human
cucccaggcauuccccagga

SEQ ID NO: 2732009 - RNA, 21 nt, Human
cucccaggcauuccccaggag

SEQ ID NO: 2732010 - RNA, 14 nt, Human
cuccaugugggcua

SEQ ID NO: 2732011 - RNA, 22 nt, Human
cucccaaggggcccaaauucuu

SEQ ID NO: 2732012 - RNA, 21 nt, Human
cucccaaggggcccaaauucu

SEQ ID NO: 2732013 - RNA, 15 nt, Human
cucccaggcauuccc

SEQ ID NO: 2732014 - RNA, 11 nt, Human
cuccaggcucc

SEQ ID NO: 2732015 - RNA, 18 nt, Human
cuccagcuguucagcugg

SEQ ID NO: 2732016 - RNA, 19 nt, Human
cuccagcuguucagcuggu

SEQ ID NO: 2732017 - RNA, 13 nt, Human
cuccagcuguuca

SEQ ID NO: 2732018 - RNA, 21 nt, Human
cucauuagcauuuugcuaaau

SEQ ID NO: 2732019 - RNA, 14 nt, Human
cucauauuuucaug

SEQ ID NO: 2732020 - RNA, 16 nt, Human
cucauugaccugaggc

SEQ ID NO: 2732021 - RNA, 23 nt, Human
cucauucuucuguacgucugaca

SEQ ID NO: 2732022 - RNA, 13 nt, Human
cucauugaccuga

SEQ ID NO: 2732023 - RNA, 15 nt, Human
cucauugaccugagg

SEQ ID NO: 2732024 - RNA, 13 nt, Human
cucauucuucugu

SEQ ID NO: 2732025 - RNA, 14 nt, Human
cucauucuucugua

SEQ ID NO: 2732026 - RNA, 12 nt, Human
cucauucuucug

SEQ ID NO: 2732027 - RNA, 19 nt, Human
cucaggugucccugcacuu

SEQ ID NO: 2732028 - RNA, 17 nt, Human
cucaggugucccugcac

SEQ ID NO: 2732029 - RNA, 18 nt, Human
cucaggugucccugcacu

SEQ ID NO: 2732030 - RNA, 22 nt, Human
cucauaauuuauacaggucaua

SEQ ID NO: 2732031 - RNA, 13 nt, Human
cucauaauuuaua

SEQ ID NO: 2732032 - RNA, 15 nt, Human
cucauaauuuauaca

SEQ ID NO: 2732033 - RNA, 20 nt, Human
cucauaguaugguggcuggg

SEQ ID NO: 2732034 - RNA, 18 nt, Human
cucauaguaugguggcug

SEQ ID NO: 2732035 - RNA, 19 nt, Human
cucauaguaugguggcugg

SEQ ID NO: 2732036 - RNA, 23 nt, Human
cuaaaagguaugcaaucaaaucu

SEQ ID NO: 2732037 - RNA, 12 nt, Human
cucagggucccu

SEQ ID NO: 2732038 - RNA, 14 nt, Human
cucagggucccugg

SEQ ID NO: 2732039 - RNA, 15 nt, Human
cucaggugucccugc

SEQ ID NO: 2732040 - RNA, 16 nt, Human
cucaggugucccugca

SEQ ID NO: 2732041 - RNA, 22 nt, Human
cucagguggggucacucuggca

SEQ ID NO: 2732042 - RNA, 23 nt, Human
cucagguggggucacucuggcag

SEQ ID NO: 2732043 - RNA, 12 nt, Human
cucggagaagag

SEQ ID NO: 2732044 - RNA, 20 nt, Human
cucggagaagagcuguucac

SEQ ID NO: 2732045 - RNA, 13 nt, Human
cucggagaagagc

SEQ ID NO: 2732046 - RNA, 17 nt, Human
cucuaaauucuuucauu

SEQ ID NO: 2732047 - RNA, 13 nt, Human
cucuaaauucuuu

SEQ ID NO: 2732048 - RNA, 20 nt, Human
cucgaguuacagacaaagcg

SEQ ID NO: 2732049 - RNA, 16 nt, Human
cucgaguuacagacaa

SEQ ID NO: 2732050 - RNA, 15 nt, Human
cucgcgacaaugcaa

SEQ ID NO: 2732051 - RNA, 13 nt, Human
cucgcgacaaugc

SEQ ID NO: 2732052 - RNA, 15 nt, Human
cuccugugucuugca

SEQ ID NO: 2732053 - RNA, 23 nt, Human
cuccugugucuugcaauggcagc

SEQ ID NO: 2732054 - RNA, 11 nt, Human
cuccugugugu

SEQ ID NO: 2732055 - RNA, 22 nt, Human
cuccugcaggcagccaggccac

SEQ ID NO: 2732056 - RNA, 15 nt, Human
cuccugcaggcagcc

SEQ ID NO: 2732057 - RNA, 21 nt, Human
cuccugcaggcagccaggcca

SEQ ID NO: 2732058 - RNA, 14 nt, Human
cuccuucaccuuug

SEQ ID NO: 2732059 - RNA, 16 nt, Human
cuccuucaccuuuguc

SEQ ID NO: 2732060 - RNA, 19 nt, Human
cuccuucaccuuugucccc

SEQ ID NO: 2732061 - RNA, 21 nt, Human
cuccuucaccuuuguccccac

SEQ ID NO: 2732062 - RNA, 11 nt, Human
cuccuucuucc

SEQ ID NO: 2732063 - RNA, 21 nt, Human
cuccuugaaaacacuguucuc

SEQ ID NO: 2732064 - RNA, 16 nt, Human
cucgaacuggcugcaa

SEQ ID NO: 2732065 - RNA, 14 nt, Human
cuccuucuguccua

SEQ ID NO: 2732066 - RNA, 15 nt, Human
cuccuucuguccuac

SEQ ID NO: 2732067 - RNA, 20 nt, Human
cuccuucuguccuacucugu

SEQ ID NO: 2732068 - RNA, 17 nt, Human
cucccuuggauuguccc

SEQ ID NO: 2732069 - RNA, 14 nt, Human
cucccuuccucuuu

SEQ ID NO: 2732070 - RNA, 13 nt, Human
cucccuuccucuu

SEQ ID NO: 2732071 - RNA, 10 nt, Human
cucccuuccu

SEQ ID NO: 2732072 - RNA, 23 nt, Human
cucccuucccaccucucucacuc

SEQ ID NO: 2732073 - RNA, 15 nt, Human
cucccaucucacaca

SEQ ID NO: 2732074 - RNA, 18 nt, Human
cucccaucucacacauga

SEQ ID NO: 2732075 - RNA, 14 nt, Human
cucccaucucacac

SEQ ID NO: 2732076 - RNA, 12 nt, Human
cuccugcaggca

SEQ ID NO: 2732077 - RNA, 13 nt, Human
cuccugcaggcag

SEQ ID NO: 2732078 - RNA, 14 nt, Human
cuccugcaggcagc

SEQ ID NO: 2732079 - RNA, 18 nt, Human
cuccuaucaccugucuug

SEQ ID NO: 2732080 - RNA, 12 nt, Human
cuccucagaucu

SEQ ID NO: 2732081 - RNA, 14 nt, Human
cuccucagaucuuc

SEQ ID NO: 2732082 - RNA, 20 nt, Human
cuucgggaggucgaggcagg

SEQ ID NO: 2732083 - RNA, 21 nt, Human
cuucgggaggucgaggcagga

SEQ ID NO: 2732084 - RNA, 19 nt, Human
cuuccuuggacucauuuua

SEQ ID NO: 2732085 - RNA, 13 nt, Human
cuucgcuccugug

SEQ ID NO: 2732086 - RNA, 14 nt, Human
cuucgcuccugugu

SEQ ID NO: 2732087 - RNA, 15 nt, Human
cuucgcuccuguguc

SEQ ID NO: 2732088 - RNA, 18 nt, Human
cuucugcuucagccuccc

SEQ ID NO: 2732089 - RNA, 16 nt, Human
cuucugcuucagccuc

SEQ ID NO: 2732090 - RNA, 17 nt, Human
cuucugcuucagccucc

SEQ ID NO: 2732091 - RNA, 15 nt, Human
cuucugccauauucu

SEQ ID NO: 2732092 - RNA, 17 nt, Human
cuucugccauauucugu

SEQ ID NO: 2732093 - RNA, 21 nt, Human
cuucugccauauucuguuggc

SEQ ID NO: 2732094 - RNA, 17 nt, Human
cuucuccaggcuguauc

SEQ ID NO: 2732095 - RNA, 16 nt, Human
cuucuccacccugcuc

SEQ ID NO: 2732096 - RNA, 14 nt, Human
cuucuccaggcugu

SEQ ID NO: 2732097 - RNA, 14 nt, Human
cuucuccacccugc

SEQ ID NO: 2732098 - RNA, 15 nt, Human
cuucuccacccugcu

SEQ ID NO: 2732099 - RNA, 22 nt, Human
cuucuccuucaccuuugucccc

SEQ ID NO: 2732100 - RNA, 18 nt, Human
cuucagcgguuuauauaa

SEQ ID NO: 2732101 - RNA, 11 nt, Human
cuucagcugac

SEQ ID NO: 2732102 - RNA, 22 nt, Human
cuuccacaagagcccaggccuc

SEQ ID NO: 2732103 - RNA, 23 nt, Human
cuuccacaagagcccaggccucc

SEQ ID NO: 2732104 - RNA, 11 nt, Human
cuucagugccu

SEQ ID NO: 2732105 - RNA, 12 nt, Human
cuucagugccuu

SEQ ID NO: 2732106 - RNA, 18 nt, Human
cuucauuuccugugucuu

SEQ ID NO: 2732107 - RNA, 13 nt, Human
cuucagugccuua

SEQ ID NO: 2732108 - RNA, 14 nt, Human
cuucagugccuuau

SEQ ID NO: 2732109 - RNA, 19 nt, Human
cuuccagauccuggaaauc

SEQ ID NO: 2732110 - RNA, 22 nt, Human
cuuccaggggugggacacccug

SEQ ID NO: 2732111 - RNA, 24 nt, Human
cuuccaggggugggacacccugug

SEQ ID NO: 2732112 - RNA, 14 nt, Human
cuuccagugaggcu

SEQ ID NO: 2732113 - RNA, 15 nt, Human
cuuccagugaggcuc

SEQ ID NO: 2732114 - RNA, 13 nt, Human
cuuauaauuuaaa

SEQ ID NO: 2732115 - RNA, 21 nt, Human
cuuaggguuaugauuaaguaa

SEQ ID NO: 2732116 - RNA, 17 nt, Human
cuuagguuggcaaaaag

SEQ ID NO: 2732117 - RNA, 14 nt, Human
cuuauaauuuaaaa

SEQ ID NO: 2732118 - RNA, 15 nt, Human
cuuaugauugcagau

SEQ ID NO: 2732119 - RNA, 15 nt, Human
cuuauuuaaugaaag

SEQ ID NO: 2732120 - RNA, 19 nt, Human
cuuagaugcaguucugaag

SEQ ID NO: 2732121 - RNA, 11 nt, Human
cuuagacaguc

SEQ ID NO: 2732122 - RNA, 19 nt, Human
cuuagacagucccugccaa

SEQ ID NO: 2732123 - RNA, 17 nt, Human
cuuagacagucccugcc

SEQ ID NO: 2732124 - RNA, 18 nt, Human
cuuagacagucccugcca

SEQ ID NO: 2732125 - RNA, 15 nt, Human
cuuagaagucacaca

SEQ ID NO: 2732126 - RNA, 14 nt, Human
cuuagacagucccu

SEQ ID NO: 2732127 - RNA, 15 nt, Human
cuuagacagucccug

SEQ ID NO: 2732128 - RNA, 16 nt, Human
cuuagacagucccugc

SEQ ID NO: 2732129 - RNA, 15 nt, Human
cuuacgugaguccug

SEQ ID NO: 2732130 - RNA, 13 nt, Human
cuuacuguacaug

SEQ ID NO: 2732131 - RNA, 16 nt, Human
cuuacuguacaugaaa

SEQ ID NO: 2732132 - RNA, 19 nt, Human
cuguuuuauaauuuuguga

SEQ ID NO: 2732133 - RNA, 21 nt, Human
cuguuuguuucugaaagggac

SEQ ID NO: 2732134 - RNA, 23 nt, Human
cuguuuguuucugaaagggacgc

SEQ ID NO: 2732135 - RNA, 13 nt, Human
cuguuuucucuug

SEQ ID NO: 2732136 - RNA, 14 nt, Human
cuguuuucucuuga

SEQ ID NO: 2732137 - RNA, 21 nt, Human
cuguuuuauuuuaauucaguu

SEQ ID NO: 2732138 - RNA, 17 nt, Human
cuguuuucucuugagag

SEQ ID NO: 2732139 - RNA, 18 nt, Human
cuguuuugaaucucauaa

SEQ ID NO: 2732140 - RNA, 12 nt, Human
cuguuuagauaa

SEQ ID NO: 2732141 - RNA, 18 nt, Human
cuguuuguuucugaaagg

SEQ ID NO: 2732142 - RNA, 16 nt, Human
cuuaaucuaaauggaa

SEQ ID NO: 2732143 - RNA, 14 nt, Human
cuuaaucuaaaugg

SEQ ID NO: 2732144 - RNA, 11 nt, Human
cuuaacuauuc

SEQ ID NO: 2732145 - RNA, 14 nt, Human
cuuaacuucacaua

SEQ ID NO: 2732146 - RNA, 12 nt, Human
cuuaacuucaca

SEQ ID NO: 2732147 - RNA, 22 nt, Human
cuuaacuucacauauugauuuc

SEQ ID NO: 2732148 - RNA, 17 nt, Human
cuuaacuucacauauug

SEQ ID NO: 2732149 - RNA, 16 nt, Human
cuuaacuucacauauu

SEQ ID NO: 2732150 - RNA, 15 nt, Human
cuuaacuucacauau

SEQ ID NO: 2732151 - RNA, 19 nt, Human
gaaaauaacaauaaaagac

SEQ ID NO: 2732152 - RNA, 20 nt, Human
gaaaaguauguuagugcaaa

SEQ ID NO: 2732153 - RNA, 14 nt, Human
gaaaaguauguuag

SEQ ID NO: 2732154 - RNA, 19 nt, Human
gaaaacaugcuacacacug

SEQ ID NO: 2732155 - RNA, 14 nt, Human
gaaaacaaggauga

SEQ ID NO: 2732156 - RNA, 18 nt, Human
gaaaacacuguucucugc

SEQ ID NO: 2732157 - RNA, 19 nt, Human
gaaaacacuguucucugcc

SEQ ID NO: 2732158 - RNA, 18 nt, Human
gaaaacaugcuacacacu

SEQ ID NO: 2732159 - RNA, 16 nt, Human
gaaaacaugcuacaca

SEQ ID NO: 2732160 - RNA, 20 nt, Human
gaaaacacuguucucugccc

SEQ ID NO: 2732161 - RNA, 21 nt, Human
gaaaacacuguucucugcccu

SEQ ID NO: 2732162 - RNA, 16 nt, Human
cuuuuuuagaguugau

SEQ ID NO: 2732163 - RNA, 20 nt, Human
cuuuuguucuugguuuguaa

SEQ ID NO: 2732164 - RNA, 22 nt, Human
cuuuuguucuugguuuguaaau

SEQ ID NO: 2732165 - RNA, 14 nt, Human
cuuuuucauuauuu

SEQ ID NO: 2732166 - RNA, 13 nt, Human
cuuuuucauuauu

SEQ ID NO: 2732167 - RNA, 12 nt, Human
cuuuuucauuau

SEQ ID NO: 2732168 - RNA, 15 nt, Human
cuuuuuuaaauaaau

SEQ ID NO: 2732169 - RNA, 15 nt, Human
cuuuucuguuugcua

SEQ ID NO: 2732170 - RNA, 18 nt, Human
cuuuucugauccaguuuu

SEQ ID NO: 2732171 - RNA, 16 nt, Human
cuuuucugauccaguu

SEQ ID NO: 2732172 - RNA, 21 nt, Human
cuuuguuuguugucagcugaa

SEQ ID NO: 2732173 - RNA, 11 nt, Human
cuuuucugauc

SEQ ID NO: 2732174 - RNA, 15 nt, Human
cuuuucugauccagu

SEQ ID NO: 2732175 - RNA, 14 nt, Human
cuuuucugauccag

SEQ ID NO: 2732176 - RNA, 16 nt, Human
cuuuccucuuuggucu

SEQ ID NO: 2732177 - RNA, 23 nt, Human
cuuugggaggccaaggugggagg

SEQ ID NO: 2732178 - RNA, 23 nt, Human
cuuugugaggaagccgcuggggc

SEQ ID NO: 2732179 - RNA, 13 nt, Human
cuuuguggcuucc

SEQ ID NO: 2732180 - RNA, 12 nt, Human
cuuugugauuuu

SEQ ID NO: 2732181 - RNA, 19 nt, Human
cuuugugaggaagccgcug

SEQ ID NO: 2732182 - RNA, 16 nt, Human
cuuuguucuggcucuu

SEQ ID NO: 2732183 - RNA, 21 nt, Human
cuuuguucuggcucuuccagg

SEQ ID NO: 2732184 - RNA, 12 nt, Human
cuuuggaaagac

SEQ ID NO: 2732185 - RNA, 23 nt, Human
cuuuggaaagacuuuuccaaccc

SEQ ID NO: 2732186 - RNA, 14 nt, Human
cuuuggauaauaag

SEQ ID NO: 2732187 - RNA, 16 nt, Human
cuuuggauaauaagga

SEQ ID NO: 2732188 - RNA, 17 nt, Human
cuuguacuuuauuuucu

SEQ ID NO: 2732189 - RNA, 15 nt, Human
cuugguuuguaaauu

SEQ ID NO: 2732190 - RNA, 14 nt, Human
cuugguuuguaaau

SEQ ID NO: 2732191 - RNA, 18 nt, Human
cuuggggcugaugcaguu

SEQ ID NO: 2732192 - RNA, 16 nt, Human
cuuggggcugaugcag

SEQ ID NO: 2732193 - RNA, 16 nt, Human
cuuggacucauuuuaa

SEQ ID NO: 2732194 - RNA, 18 nt, Human
cuugggccacugugaaga

SEQ ID NO: 2732195 - RNA, 20 nt, Human
cuugggccacugugaagaga

SEQ ID NO: 2732196 - RNA, 17 nt, Human
cuuuaaaaaaaaaauug

SEQ ID NO: 2732197 - RNA, 17 nt, Human
cuuuaccuuuuuuauac

SEQ ID NO: 2732198 - RNA, 20 nt, Human
cuuuaccuuuuuuauacaua

SEQ ID NO: 2732199 - RNA, 19 nt, Human
cuuuaccuuuuuuauacau

SEQ ID NO: 2732200 - RNA, 15 nt, Human
cuuguggucccaccc

SEQ ID NO: 2732201 - RNA, 16 nt, Human
cuuguuaagauaguua

SEQ ID NO: 2732202 - RNA, 16 nt, Human
cuuguggucccacccc

SEQ ID NO: 2732203 - RNA, 19 nt, Human
cuuguggucccaccccaca

SEQ ID NO: 2732204 - RNA, 16 nt, Human
cuuguuagaucuaguu

SEQ ID NO: 2732205 - RNA, 13 nt, Human
cuuguuagaucua

SEQ ID NO: 2732206 - RNA, 22 nt, Human
cuugcccuguuaaaagaugaaa

SEQ ID NO: 2732207 - RNA, 22 nt, Human
cuugcucugcugacagacacag

SEQ ID NO: 2732208 - RNA, 20 nt, Human
cuugcuugauuguauggugg

SEQ ID NO: 2732209 - RNA, 20 nt, Human
cuuggaagcuccgcuuucua

SEQ ID NO: 2732210 - RNA, 14 nt, Human
cuuggaagcuccgc

SEQ ID NO: 2732211 - RNA, 14 nt, Human
cuugccaucccucc

SEQ ID NO: 2732212 - RNA, 17 nt, Human
cuugcaugaggcuagug

SEQ ID NO: 2732213 - RNA, 13 nt, Human
cuugcaugaggcu

SEQ ID NO: 2732214 - RNA, 14 nt, Human
cuugcaugaggcua

SEQ ID NO: 2732215 - RNA, 17 nt, Human
cuugccaucccucccuc

SEQ ID NO: 2732216 - RNA, 15 nt, Human
cuugccaucccuccc

SEQ ID NO: 2732217 - RNA, 16 nt, Human
cuugccaucccucccu

SEQ ID NO: 2732218 - RNA, 19 nt, Human
cuugccaucccucccucca

SEQ ID NO: 2732219 - RNA, 14 nt, Human
cuugcccuguuaaa

SEQ ID NO: 2732220 - RNA, 21 nt, Human
cuugcagacucuacagaggcc

SEQ ID NO: 2732221 - RNA, 20 nt, Human
cuugcagacucuacagaggc

SEQ ID NO: 2732222 - RNA, 20 nt, Human
cuugaguugauucagcucug

SEQ ID NO: 2732223 - RNA, 18 nt, Human
cuugaguugauucagcuc

SEQ ID NO: 2732224 - RNA, 19 nt, Human
cuugaguugauucagcucu

SEQ ID NO: 2732225 - RNA, 15 nt, Human
cuugcaauggcagcc

SEQ ID NO: 2732226 - RNA, 16 nt, Human
cuugcaauggcagccu

SEQ ID NO: 2732227 - RNA, 17 nt, Human
cuugcaauggcagccuu

SEQ ID NO: 2732228 - RNA, 18 nt, Human
cuugcaauggcagccuug

SEQ ID NO: 2732229 - RNA, 15 nt, Human
cuugaggguugggcu

SEQ ID NO: 2732230 - RNA, 17 nt, Human
cuugaggguugggcugg

SEQ ID NO: 2732231 - RNA, 12 nt, Human
cuugagccuggg

SEQ ID NO: 2732232 - RNA, 15 nt, Human
cuugagccugggagg

SEQ ID NO: 2732233 - RNA, 24 nt, Human
gacugcauuauauuuauuacugua

SEQ ID NO: 2732234 - RNA, 13 nt, Human
gacugauucuuca

SEQ ID NO: 2732235 - RNA, 16 nt, Human
gacugauucuucagca

SEQ ID NO: 2732236 - RNA, 18 nt, Human
gacugaguacguugugca

SEQ ID NO: 2732237 - RNA, 15 nt, Human
gacucuacagaggcc

SEQ ID NO: 2732238 - RNA, 21 nt, Human
gacucuacagaggccaugggc

SEQ ID NO: 2732239 - RNA, 16 nt, Human
gacugaauuucuuuug

SEQ ID NO: 2732240 - RNA, 18 nt, Human
gacuacaggcacccacca

SEQ ID NO: 2732241 - RNA, 13 nt, Human
gacuacaggcacc

SEQ ID NO: 2732242 - RNA, 15 nt, Human
gacuacaggcaccca

SEQ ID NO: 2732243 - RNA, 18 nt, Human
gacuccugcaggcagcca

SEQ ID NO: 2732244 - RNA, 19 nt, Human
gacuccugcaggcagccag

SEQ ID NO: 2732245 - RNA, 20 nt, Human
gacuccugcaggcagccagg

SEQ ID NO: 2732246 - RNA, 21 nt, Human
gacuccugcaggcagccaggc

SEQ ID NO: 2732247 - RNA, 14 nt, Human
gacuggcacaguuu

SEQ ID NO: 2732248 - RNA, 22 nt, Human
gacuggcacaguuuucugagaa

SEQ ID NO: 2732249 - RNA, 18 nt, Human
gacuggcacaguuuucug

SEQ ID NO: 2732250 - RNA, 23 nt, Human
gacuggccaagguuuggggaaga

SEQ ID NO: 2732251 - RNA, 23 nt, Human
gacuuacuguacaugaaaacaca

SEQ ID NO: 2732252 - RNA, 18 nt, Human
gacuuacuguacaugaaa

SEQ ID NO: 2732253 - RNA, 12 nt, Human
gacuuacuguac

SEQ ID NO: 2732254 - RNA, 16 nt, Human
gacuuacuguacauga

SEQ ID NO: 2732255 - RNA, 15 nt, Human
gacuuacuguacaug

SEQ ID NO: 2732256 - RNA, 12 nt, Human
gacuucaucccu

SEQ ID NO: 2732257 - RNA, 20 nt, Human
gacuucaucccucuggggcu

SEQ ID NO: 2732258 - RNA, 23 nt, Human
gacggagucccaccuuggcugca

SEQ ID NO: 2732259 - RNA, 13 nt, Human
gacggagucccac

SEQ ID NO: 2732260 - RNA, 21 nt, Human
gacgcugugcugcccugccca

SEQ ID NO: 2732261 - RNA, 22 nt, Human
gacgcugugcugcccugcccac

SEQ ID NO: 2732262 - RNA, 22 nt, Human
gaccuuuaagagaaaugagcug

SEQ ID NO: 2732263 - RNA, 11 nt, Human
gaccuuucaau

SEQ ID NO: 2732264 - RNA, 19 nt, Human
gaccuuucaauaggaaaaa

SEQ ID NO: 2732265 - RNA, 20 nt, Human
gaccuuucaauaggaaaaac

SEQ ID NO: 2732266 - RNA, 16 nt, Human
gacuaacuugucuuug

SEQ ID NO: 2732267 - RNA, 23 nt, Human
gacuaacuugucuuuggacccug

SEQ ID NO: 2732268 - RNA, 11 nt, Human
gacguguuaug

SEQ ID NO: 2732269 - RNA, 14 nt, Human
gacguguuaugacu

SEQ ID NO: 2732270 - RNA, 15 nt, Human
gacguguuaugacuc

SEQ ID NO: 2732271 - RNA, 19 nt, Human
gacccuugccgucuaccug

SEQ ID NO: 2732272 - RNA, 20 nt, Human
gacccuugccgucuaccuga

SEQ ID NO: 2732273 - RNA, 23 nt, Human
gacccuugccgucuaccugaggg

SEQ ID NO: 2732274 - RNA, 14 nt, Human
gaccuucuccuuca

SEQ ID NO: 2732275 - RNA, 15 nt, Human
gaccuucuccuucac

SEQ ID NO: 2732276 - RNA, 16 nt, Human
gaccuucuccuucacc

SEQ ID NO: 2732277 - RNA, 14 nt, Human
gaccuugaacuggg

SEQ ID NO: 2732278 - RNA, 20 nt, Human
gaccuucuccuucaccuuug

SEQ ID NO: 2732279 - RNA, 21 nt, Human
gaccuucuccuucaccuuugu

SEQ ID NO: 2732280 - RNA, 22 nt, Human
gaccagacaccuugacagggca

SEQ ID NO: 2732281 - RNA, 21 nt, Human
gaccagacaccuugacagggc

SEQ ID NO: 2732282 - RNA, 16 nt, Human
gaccacguuucuaaag

SEQ ID NO: 2732283 - RNA, 21 nt, Human
gaccagagcugccaccugccu

SEQ ID NO: 2732284 - RNA, 23 nt, Human
gaccagacaccuugacagggcac

SEQ ID NO: 2732285 - RNA, 20 nt, Human
gaccagcaccaucucuccuc

SEQ ID NO: 2732286 - RNA, 21 nt, Human
gaccagcaccaucucuccucc

SEQ ID NO: 2732287 - RNA, 18 nt, Human
gaccacaaaacuuuucua

SEQ ID NO: 2732288 - RNA, 18 nt, Human
gacccaugcugcccugug

SEQ ID NO: 2732289 - RNA, 19 nt, Human
gacccaugcugcccuguga

SEQ ID NO: 2732290 - RNA, 20 nt, Human
gacccaugcugcccugugag

SEQ ID NO: 2732291 - RNA, 17 nt, Human
gacccaugcugcccugu

SEQ ID NO: 2732292 - RNA, 10 nt, Human
gacccugagg

SEQ ID NO: 2732293 - RNA, 11 nt, Human
gacccugaggc

SEQ ID NO: 2732294 - RNA, 12 nt, Human
gacccugaggcc

SEQ ID NO: 2732295 - RNA, 16 nt, Human
gacccugaggcccaga

SEQ ID NO: 2732296 - RNA, 17 nt, Human
gacccugcccugugggc

SEQ ID NO: 2732297 - RNA, 20 nt, Human
gacccugcccugugggcccc

SEQ ID NO: 2732298 - RNA, 22 nt, Human
gacccugcccugugggccccca

SEQ ID NO: 2732299 - RNA, 23 nt, Human
gacaggaugguucccuugaugaa

SEQ ID NO: 2732300 - RNA, 13 nt, Human
gacaggcaagcac

SEQ ID NO: 2732301 - RNA, 17 nt, Human
gacaggcaagcaccucc

SEQ ID NO: 2732302 - RNA, 18 nt, Human
gacaggcaagcaccuccu

SEQ ID NO: 2732303 - RNA, 23 nt, Human
gacaggcaaugcuggcuguuggc

SEQ ID NO: 2732304 - RNA, 20 nt, Human
gacaggcauguucucugagg

SEQ ID NO: 2732305 - RNA, 21 nt, Human
gacaggcauguucucugagga

SEQ ID NO: 2732306 - RNA, 20 nt, Human
gacaggcaagcaccuccugc

SEQ ID NO: 2732307 - RNA, 21 nt, Human
gacaggcaagcaccuccugcc

SEQ ID NO: 2732308 - RNA, 18 nt, Human
gacaggcaaugcuggcug

SEQ ID NO: 2732309 - RNA, 19 nt, Human
gacaggcaaugcuggcugu

SEQ ID NO: 2732310 - RNA, 16 nt, Human
gacaucaacugcauca

SEQ ID NO: 2732311 - RNA, 23 nt, Human
gacaucaacugcaucaagaugug

SEQ ID NO: 2732312 - RNA, 17 nt, Human
gacauaaaaacaacuuu

SEQ ID NO: 2732313 - RNA, 22 nt, Human
gacaggcauguucucugaggac

SEQ ID NO: 2732314 - RNA, 12 nt, Human
gacagaggcagc

SEQ ID NO: 2732315 - RNA, 20 nt, Human
gacagagcuacacaggggaa

SEQ ID NO: 2732316 - RNA, 23 nt, Human
gacagaggcagccccauucugcc

SEQ ID NO: 2732317 - RNA, 19 nt, Human
gacagagugagacucuguc

SEQ ID NO: 2732318 - RNA, 21 nt, Human
gacagagucucacuguugccc

SEQ ID NO: 2732319 - RNA, 16 nt, Human
gacagagugagacucu

SEQ ID NO: 2732320 - RNA, 16 nt, Human
gacacuagaagauuuu

SEQ ID NO: 2732321 - RNA, 17 nt, Human
gacagacacaggcccgg

SEQ ID NO: 2732322 - RNA, 20 nt, Human
gacagacacaggcccggcuc

SEQ ID NO: 2732323 - RNA, 22 nt, Human
gacagacacaggcccggcucca

SEQ ID NO: 2732324 - RNA, 22 nt, Human
gaauuucccaaagcagugcaug

SEQ ID NO: 2732325 - RNA, 16 nt, Human
gaauuucccaaagcag

SEQ ID NO: 2732326 - RNA, 18 nt, Human
gaauuucccaaagcagug

SEQ ID NO: 2732327 - RNA, 22 nt, Human
gacacgaauauugcugauggug

SEQ ID NO: 2732328 - RNA, 12 nt, Human
gaaguccaagca

SEQ ID NO: 2732329 - RNA, 22 nt, Human
gaaguccaagcauuuagaugua

SEQ ID NO: 2732330 - RNA, 21 nt, Human
gaaguuucugccgcagcccug

SEQ ID NO: 2732331 - RNA, 15 nt, Human
gaagucuuagaugua

SEQ ID NO: 2732332 - RNA, 20 nt, Human
gaaguuucugccgcagcccu

SEQ ID NO: 2732333 - RNA, 18 nt, Human
gaaguacuauaauuuacc

SEQ ID NO: 2732334 - RNA, 15 nt, Human
gaaguacuggagaaa

SEQ ID NO: 2732335 - RNA, 22 nt, Human
gaaguaauaugcacacauuuuu

SEQ ID NO: 2732336 - RNA, 14 nt, Human
gaagcggcuggcag

SEQ ID NO: 2732337 - RNA, 15 nt, Human
gaagggggcugggac

SEQ ID NO: 2732338 - RNA, 16 nt, Human
gaagggggcugggaca

SEQ ID NO: 2732339 - RNA, 19 nt, Human
gaagggggcugggacaugg

SEQ ID NO: 2732340 - RNA, 16 nt, Human
gaauauuuuaacuucc

SEQ ID NO: 2732341 - RNA, 13 nt, Human
gaauaccuguccc

SEQ ID NO: 2732342 - RNA, 15 nt, Human
gaauaccuguccccc

SEQ ID NO: 2732343 - RNA, 23 nt, Human
gaauagcugggacuacaggugug

SEQ ID NO: 2732344 - RNA, 22 nt, Human
gaauagcugggacuacaggugu

SEQ ID NO: 2732345 - RNA, 20 nt, Human
gaauacucuuauaucuauau

SEQ ID NO: 2732346 - RNA, 20 nt, Human
gaaguuugagaucagccugg

SEQ ID NO: 2732347 - RNA, 19 nt, Human
gaauaacauguaauuaagu

SEQ ID NO: 2732348 - RNA, 18 nt, Human
gaauaacauguaauuaag

SEQ ID NO: 2732349 - RNA, 21 nt, Human
gaauacagaggcaacugcauu

SEQ ID NO: 2732350 - RNA, 17 nt, Human
gaauaauacaguaucuc

SEQ ID NO: 2732351 - RNA, 22 nt, Human
gaauuuauuggcuuuucugauc

SEQ ID NO: 2732352 - RNA, 15 nt, Human
gaauuucccaaagca

SEQ ID NO: 2732353 - RNA, 21 nt, Human
gaauuuauuggcuuuucugau

SEQ ID NO: 2732354 - RNA, 20 nt, Human
gaauuuauuggcuuuucuga

SEQ ID NO: 2732355 - RNA, 16 nt, Human
gaauuuauuggcuuuu

SEQ ID NO: 2732356 - RNA, 14 nt, Human
gaauuuauuggcuu

SEQ ID NO: 2732357 - RNA, 22 nt, Human
gaauuuaaauagcuuuuuucuc

SEQ ID NO: 2732358 - RNA, 22 nt, Human
gaauuguaaggaaugauuaauu

SEQ ID NO: 2732359 - RNA, 20 nt, Human
gaaugucagugugacugauc

SEQ ID NO: 2732360 - RNA, 21 nt, Human
gaaugucagugugacugaucu

SEQ ID NO: 2732361 - RNA, 17 nt, Human
gaauucucagaaucuca

SEQ ID NO: 2732362 - RNA, 17 nt, Human
gaauucucuaguuugau

SEQ ID NO: 2732363 - RNA, 14 nt, Human
gaauugaaaaacca

SEQ ID NO: 2732364 - RNA, 23 nt, Human
gaauucuugaaggaaaaugauac

SEQ ID NO: 2732365 - RNA, 11 nt, Human
gaauucuguau

SEQ ID NO: 2732366 - RNA, 19 nt, Human
gaauucucuaguuugauua

SEQ ID NO: 2732367 - RNA, 19 nt, Human
gaaugaagauacugaaaua

SEQ ID NO: 2732368 - RNA, 11 nt, Human
gaaugcagugg

SEQ ID NO: 2732369 - RNA, 21 nt, Human
gaaugaagauacugaaauaaa

SEQ ID NO: 2732370 - RNA, 18 nt, Human
gaaugaagauacugaaau

SEQ ID NO: 2732371 - RNA, 17 nt, Human
gaaugaagauacugaaa

SEQ ID NO: 2732372 - RNA, 23 nt, Human
gaaugaaccacaucuugcucugc

SEQ ID NO: 2732373 - RNA, 22 nt, Human
gaaugaaccacaucuugcucug

SEQ ID NO: 2732374 - RNA, 18 nt, Human
gaaugaaccacaucuugc

SEQ ID NO: 2732375 - RNA, 14 nt, Human
gaaugucaguguga

SEQ ID NO: 2732376 - RNA, 22 nt, Human
gaaugguuuucaaaauaaaaau

SEQ ID NO: 2732377 - RNA, 23 nt, Human
gaaugguccgugcuaaggacuug

SEQ ID NO: 2732378 - RNA, 22 nt, Human
gaaugguccgugcuaaggacuu

SEQ ID NO: 2732379 - RNA, 20 nt, Human
gaaugguccgugcuaaggac

SEQ ID NO: 2732380 - RNA, 21 nt, Human
gaauggcuuuguauagaaccu

SEQ ID NO: 2732381 - RNA, 15 nt, Human
gaagauacugaaaua

SEQ ID NO: 2732382 - RNA, 20 nt, Human
gaagauaauauuaaggaaga

SEQ ID NO: 2732383 - RNA, 20 nt, Human
gaagagguuuuaaagcuucc

SEQ ID NO: 2732384 - RNA, 17 nt, Human
gaagcauuuacuuugug

SEQ ID NO: 2732385 - RNA, 23 nt, Human
gaagcccaggaaaggcuccagga

SEQ ID NO: 2732386 - RNA, 23 nt, Human
gaagcccuucuaccuuccugcaa

SEQ ID NO: 2732387 - RNA, 20 nt, Human
gaagccagcaggcucucagg

SEQ ID NO: 2732388 - RNA, 19 nt, Human
gaagccagcaggcucucag

SEQ ID NO: 2732389 - RNA, 21 nt, Human
gaagccagcaggcucucaggc

SEQ ID NO: 2732390 - RNA, 22 nt, Human
gaagccagcaggcucucaggcc

SEQ ID NO: 2732391 - RNA, 13 nt, Human
gaagcccaggaaa

SEQ ID NO: 2732392 - RNA, 15 nt, Human
gaagcccaggaaagg

SEQ ID NO: 2732393 - RNA, 16 nt, Human
gaagcccaggaaaggc

SEQ ID NO: 2732394 - RNA, 19 nt, Human
gaagcccaggaaaggcucc

SEQ ID NO: 2732395 - RNA, 12 nt, Human
gaagaacugaaa

SEQ ID NO: 2732396 - RNA, 19 nt, Human
gaagacugcauuauauuua

SEQ ID NO: 2732397 - RNA, 17 nt, Human
gaagacugcauuauauu

SEQ ID NO: 2732398 - RNA, 11 nt, Human
gaagacuuugg

SEQ ID NO: 2732399 - RNA, 13 nt, Human
gaagacuuuggaa

SEQ ID NO: 2732400 - RNA, 23 nt, Human
gaacuuugaccucugcagcaaua

SEQ ID NO: 2732401 - RNA, 19 nt, Human
gaagagaaugcacaaacag

SEQ ID NO: 2732402 - RNA, 20 nt, Human
gaagacuuuucuuucagcca

SEQ ID NO: 2732403 - RNA, 14 nt, Human
gaagacuuuggaaa

SEQ ID NO: 2732404 - RNA, 17 nt, Human
gaagacuuuggaaagag

SEQ ID NO: 2732405 - RNA, 17 nt, Human
gaaauuguaauuauauc

SEQ ID NO: 2732406 - RNA, 13 nt, Human
gaacacucugaga

SEQ ID NO: 2732407 - RNA, 14 nt, Human
gaacacucugagac

SEQ ID NO: 2732408 - RNA, 16 nt, Human
gaaauuguauuacaaa

SEQ ID NO: 2732409 - RNA, 15 nt, Human
gaacacucugagacu

SEQ ID NO: 2732410 - RNA, 15 nt, Human
gaacauaaaauacaa

SEQ ID NO: 2732411 - RNA, 18 nt, Human
gaaccuuuugagugccuu

SEQ ID NO: 2732412 - RNA, 19 nt, Human
gaaccuuuugagugccuua

SEQ ID NO: 2732413 - RNA, 21 nt, Human
gaaccuuuugagugccuuaca

SEQ ID NO: 2732414 - RNA, 22 nt, Human
gaaccuuuugagugccuuacac

SEQ ID NO: 2732415 - RNA, 13 nt, Human
gaucuuuaaaaua

SEQ ID NO: 2732416 - RNA, 22 nt, Human
gaucuucuguggguuucuaaag

SEQ ID NO: 2732417 - RNA, 19 nt, Human
gaucuucuuuauaauucua

SEQ ID NO: 2732418 - RNA, 15 nt, Human
gaugaaaugagguca

SEQ ID NO: 2732419 - RNA, 21 nt, Human
gaugaaaugaggucagagccu

SEQ ID NO: 2732420 - RNA, 14 nt, Human
gaugcagugcuucc

SEQ ID NO: 2732421 - RNA, 14 nt, Human
gaugccugguggca

SEQ ID NO: 2732422 - RNA, 15 nt, Human
gaugccugguggcag

SEQ ID NO: 2732423 - RNA, 16 nt, Human
gaugccugguggcagc

SEQ ID NO: 2732424 - RNA, 20 nt, Human
gaugaccuugaaugaugcca

SEQ ID NO: 2732425 - RNA, 23 nt, Human
gaugagaaauaaaguuucuguug

SEQ ID NO: 2732426 - RNA, 18 nt, Human
gaugaccuugaaugaugc

SEQ ID NO: 2732427 - RNA, 14 nt, Human
gaugcaccagcccu

SEQ ID NO: 2732428 - RNA, 14 nt, Human
gaugagaggaaauc

SEQ ID NO: 2732429 - RNA, 15 nt, Human
gaugcaccagcccuu

SEQ ID NO: 2732430 - RNA, 23 nt, Human
gaugcaccagcccuuagcaggga

SEQ ID NO: 2732431 - RNA, 14 nt, Human
gauccuggaaauca

SEQ ID NO: 2732432 - RNA, 12 nt, Human
gauccugagcca

SEQ ID NO: 2732433 - RNA, 13 nt, Human
gaucuaggaagac

SEQ ID NO: 2732434 - RNA, 14 nt, Human
gaucuaggaagacu

SEQ ID NO: 2732435 - RNA, 18 nt, Human
gaucuaggaagacuuugg

SEQ ID NO: 2732436 - RNA, 20 nt, Human
gaucuaggaagacuuuggaa

SEQ ID NO: 2732437 - RNA, 17 nt, Human
gaucuaguucacucucc

SEQ ID NO: 2732438 - RNA, 13 nt, Human
gaucauccacugu

SEQ ID NO: 2732439 - RNA, 18 nt, Human
gauccuaggcauuugcug

SEQ ID NO: 2732440 - RNA, 16 nt, Human
gauccucccaccucag

SEQ ID NO: 2732441 - RNA, 14 nt, Human
gauccuccaggugc

SEQ ID NO: 2732442 - RNA, 17 nt, Human
gauccucccaccucagc

SEQ ID NO: 2732443 - RNA, 21 nt, Human
gauaauaaggaaaaguuuaau

SEQ ID NO: 2732444 - RNA, 20 nt, Human
gauaauaaggaaaaguuuaa

SEQ ID NO: 2732445 - RNA, 24 nt, Human
gauaauacaccacuacauucuguu

SEQ ID NO: 2732446 - RNA, 23 nt, Human
gauaauacaccacuacauucugu

SEQ ID NO: 2732447 - RNA, 12 nt, Human
gauaauacacca

SEQ ID NO: 2732448 - RNA, 22 nt, Human
gauaauaaggaaaaguuuaaua

SEQ ID NO: 2732449 - RNA, 11 nt, Human
gaguucuacau

SEQ ID NO: 2732450 - RNA, 23 nt, Human
gaucagcuuauugucuagugaaa

SEQ ID NO: 2732451 - RNA, 23 nt, Human
gaucacggcucacugcagccuca

SEQ ID NO: 2732452 - RNA, 20 nt, Human
gaucacggcucacugcagcc

SEQ ID NO: 2732453 - RNA, 14 nt, Human
gaucacagccucug

SEQ ID NO: 2732454 - RNA, 17 nt, Human
gauaggucagugcaaau

SEQ ID NO: 2732455 - RNA, 16 nt, Human
gauacaaaagcaugug

SEQ ID NO: 2732456 - RNA, 20 nt, Human
gauagugucccacggugccu

SEQ ID NO: 2732457 - RNA, 18 nt, Human
gauauaugcucugcaugu

SEQ ID NO: 2732458 - RNA, 16 nt, Human
gcaagaugugggcagu

SEQ ID NO: 2732459 - RNA, 12 nt, Human
gcaagauguggg

SEQ ID NO: 2732460 - RNA, 18 nt, Human
gcaagcaccuccugccuc

SEQ ID NO: 2732461 - RNA, 20 nt, Human
gcaagcaccuccugccucga

SEQ ID NO: 2732462 - RNA, 15 nt, Human
gcaagcaccuccugc

SEQ ID NO: 2732463 - RNA, 16 nt, Human
gcaagcaccuccugcc

SEQ ID NO: 2732464 - RNA, 17 nt, Human
gcaauccugcaagaaca

SEQ ID NO: 2732465 - RNA, 13 nt, Human
gcaaggcugucaa

SEQ ID NO: 2732466 - RNA, 14 nt, Human
gcaaggucauuuuu

SEQ ID NO: 2732467 - RNA, 14 nt, Human
gcaaggcugucaau

SEQ ID NO: 2732468 - RNA, 18 nt, Human
gcaaggcugucaauuaca

SEQ ID NO: 2732469 - RNA, 18 nt, Human
gcaacugcauuggcuuug

SEQ ID NO: 2732470 - RNA, 16 nt, Human
gcaaaccaucauugaa

SEQ ID NO: 2732471 - RNA, 17 nt, Human
gcaaaccaucauugaaa

SEQ ID NO: 2732472 - RNA, 19 nt, Human
gcaaaccaucauugaaauc

SEQ ID NO: 2732473 - RNA, 20 nt, Human
gcaaaccaucauugaaaucu

SEQ ID NO: 2732474 - RNA, 21 nt, Human
gcaaaccaucauugaaaucuu

SEQ ID NO: 2732475 - RNA, 17 nt, Human
gaugccugguggcagcu

SEQ ID NO: 2732476 - RNA, 18 nt, Human
gauguucuagcauggcug

SEQ ID NO: 2732477 - RNA, 22 nt, Human
gauuaaguaaugauaacuggaa

SEQ ID NO: 2732478 - RNA, 14 nt, Human
gauuaaguaaugau

SEQ ID NO: 2732479 - RNA, 15 nt, Human
gauucccaagcucug

SEQ ID NO: 2732480 - RNA, 13 nt, Human
gauuacaagcgug

SEQ ID NO: 2732481 - RNA, 21 nt, Human
gauuacaagcgugagccacug

SEQ ID NO: 2732482 - RNA, 13 nt, Human
gauucagacagcu

SEQ ID NO: 2732483 - RNA, 14 nt, Human
gauucagacagcug

SEQ ID NO: 2732484 - RNA, 17 nt, Human
gauucagacagcugccu

SEQ ID NO: 2732485 - RNA, 18 nt, Human
gauucagacagcugccug

SEQ ID NO: 2732486 - RNA, 16 nt, Human
gauugcaacaggcugg

SEQ ID NO: 2732487 - RNA, 20 nt, Human
gauucuuuccugaggcuggg

SEQ ID NO: 2732488 - RNA, 22 nt, Human
gauucuuuccugaggcugggcu

SEQ ID NO: 2732489 - RNA, 16 nt, Human
gauucccaagcucugc

SEQ ID NO: 2732490 - RNA, 17 nt, Human
gauucccaagcucugcu

SEQ ID NO: 2732491 - RNA, 19 nt, Human
gauucuuuccugaggcugg

SEQ ID NO: 2732492 - RNA, 15 nt, Human
gauugcaacaggcug

SEQ ID NO: 2732493 - RNA, 17 nt, Human
gauugcaacaggcuggg

SEQ ID NO: 2732494 - RNA, 18 nt, Human
gauugcaacaggcugggc

SEQ ID NO: 2732495 - RNA, 19 nt, Human
gauuuguuaaugauagcua

SEQ ID NO: 2732496 - RNA, 21 nt, Human
gauuucuguuuagauaauaca

SEQ ID NO: 2732497 - RNA, 22 nt, Human
gauuucuguuuagauaauacac

SEQ ID NO: 2732498 - RNA, 12 nt, Human
gcagaaggaaga

SEQ ID NO: 2732499 - RNA, 13 nt, Human
gcagaaggaagac

SEQ ID NO: 2732500 - RNA, 14 nt, Human
gcagaaggaagacu

SEQ ID NO: 2732501 - RNA, 15 nt, Human
gcacugucaagauga

SEQ ID NO: 2732502 - RNA, 22 nt, Human
gcacugggcuuggggaccagag

SEQ ID NO: 2732503 - RNA, 23 nt, Human
gcacugggcuuggggaccagagc

SEQ ID NO: 2732504 - RNA, 14 nt, Human
gcacugggcuuggg

SEQ ID NO: 2732505 - RNA, 17 nt, Human
gcacuaaggugugcucu

SEQ ID NO: 2732506 - RNA, 18 nt, Human
gcacuaaggugugcucug

SEQ ID NO: 2732507 - RNA, 20 nt, Human
gcacagccucuuagaugcag

SEQ ID NO: 2732508 - RNA, 13 nt, Human
gcaaugaccuuuc

SEQ ID NO: 2732509 - RNA, 14 nt, Human
gcaaugaccuuuca

SEQ ID NO: 2732510 - RNA, 19 nt, Human
gcacagcuaacauggaagu

SEQ ID NO: 2732511 - RNA, 16 nt, Human
gcacagcuucauuucc

SEQ ID NO: 2732512 - RNA, 22 nt, Human
gcacaugccucucucaggccaa

SEQ ID NO: 2732513 - RNA, 14 nt, Human
gcacccggccccug

SEQ ID NO: 2732514 - RNA, 15 nt, Human
gcacccggccccugc

SEQ ID NO: 2732515 - RNA, 17 nt, Human
gcacccggccccugcug

SEQ ID NO: 2732516 - RNA, 14 nt, Human
gcaccuccugccuc

SEQ ID NO: 2732517 - RNA, 15 nt, Human
gcaccuccugccucg

SEQ ID NO: 2732518 - RNA, 19 nt, Human
gcaccacugcacuccagcc

SEQ ID NO: 2732519 - RNA, 18 nt, Human
gcagauggaaugcugugu

SEQ ID NO: 2732520 - RNA, 22 nt, Human
gcagauggaaugcuguguuaaa

SEQ ID NO: 2732521 - RNA, 19 nt, Human
gcagaguugaagacagagc

SEQ ID NO: 2732522 - RNA, 16 nt, Human
gcagaguugaagacag

SEQ ID NO: 2732523 - RNA, 17 nt, Human
gcagaguugaagacaga

SEQ ID NO: 2732524 - RNA, 12 nt, Human
gcagcaauaaag

SEQ ID NO: 2732525 - RNA, 17 nt, Human
gcagagaccaucccuga

SEQ ID NO: 2732526 - RNA, 14 nt, Human
gcagagaccauccc

SEQ ID NO: 2732527 - RNA, 15 nt, Human
gcagagaccaucccu

SEQ ID NO: 2732528 - RNA, 15 nt, Human
gcagaguugaagaca

SEQ ID NO: 2732529 - RNA, 19 nt, Human
gcagagaaugaaagggccc

SEQ ID NO: 2732530 - RNA, 20 nt, Human
gcagagaaugaaagggccca

SEQ ID NO: 2732531 - RNA, 21 nt, Human
gcagagaaugaaagggcccag

SEQ ID NO: 2732532 - RNA, 21 nt, Human
gcagagaauucucuuauccaa

SEQ ID NO: 2732533 - RNA, 22 nt, Human
gcagagaaugaaagggcccaga

SEQ ID NO: 2732534 - RNA, 23 nt, Human
gcagagaaugaaagggcccagag

SEQ ID NO: 2732535 - RNA, 20 nt, Human
gcagcagggagggcuucugc

SEQ ID NO: 2732536 - RNA, 19 nt, Human
gcagccucaaccuccuggg

SEQ ID NO: 2732537 - RNA, 20 nt, Human
gcagccucaaccuccugggc

SEQ ID NO: 2732538 - RNA, 21 nt, Human
gcagccucaaccuccugggcu

SEQ ID NO: 2732539 - RNA, 22 nt, Human
gcagccucaaccuccugggcua

SEQ ID NO: 2732540 - RNA, 14 nt, Human
gcagccuggacccu

SEQ ID NO: 2732541 - RNA, 15 nt, Human
gcaggcuacugucag

SEQ ID NO: 2732542 - RNA, 20 nt, Human
gcaggauucuuccucccucc

SEQ ID NO: 2732543 - RNA, 16 nt, Human
gcagggagggcuucug

SEQ ID NO: 2732544 - RNA, 12 nt, Human
gcagggcucagc

SEQ ID NO: 2732545 - RNA, 23 nt, Human
gcagugcuuccaaggauggacca

SEQ ID NO: 2732546 - RNA, 16 nt, Human
gcagugggagcugccu

SEQ ID NO: 2732547 - RNA, 13 nt, Human
gcaguucugaaga

SEQ ID NO: 2732548 - RNA, 18 nt, Human
gcauagauucccugagca

SEQ ID NO: 2732549 - RNA, 17 nt, Human
gcagugggagcugccug

SEQ ID NO: 2732550 - RNA, 18 nt, Human
gcagugggagcugccugu

SEQ ID NO: 2732551 - RNA, 20 nt, Human
gcauauucaggaagcucagg

SEQ ID NO: 2732552 - RNA, 17 nt, Human
gcauauucaggaagcuc

SEQ ID NO: 2732553 - RNA, 18 nt, Human
gcauauucaggaagcuca

SEQ ID NO: 2732554 - RNA, 21 nt, Human
gcaucaagaugugacauguuu

SEQ ID NO: 2732555 - RNA, 16 nt, Human
gcauauauuuuuauau

SEQ ID NO: 2732556 - RNA, 11 nt, Human
gcauauauuuu

SEQ ID NO: 2732557 - RNA, 15 nt, Human
gcauauauuuuuaua

SEQ ID NO: 2732558 - RNA, 14 nt, Human
gcauauauuuuuau

SEQ ID NO: 2732559 - RNA, 15 nt, Human
gcauauucaggaagc

SEQ ID NO: 2732560 - RNA, 17 nt, Human
gcaugccuggauggggc

SEQ ID NO: 2732561 - RNA, 22 nt, Human
gcaugccuggauggggcugcac

SEQ ID NO: 2732562 - RNA, 23 nt, Human
gcaugaaguaauaugcacacauu

SEQ ID NO: 2732563 - RNA, 16 nt, Human
gcaucaggccaggccc

SEQ ID NO: 2732564 - RNA, 17 nt, Human
gcaucaggccaggcccu

SEQ ID NO: 2732565 - RNA, 13 nt, Human
gcaucaggccagg

SEQ ID NO: 2732566 - RNA, 15 nt, Human
gcaucaggccaggcc

SEQ ID NO: 2732567 - RNA, 17 nt, Human
gcauguuugugauugac

SEQ ID NO: 2732568 - RNA, 15 nt, Human
gcaugcugucccuua

SEQ ID NO: 2732569 - RNA, 19 nt, Human
gccaaacucaccugccccu

SEQ ID NO: 2732570 - RNA, 21 nt, Human
gccaaacucaccugccccuca

SEQ ID NO: 2732571 - RNA, 14 nt, Human
gccaaaggaagcac

SEQ ID NO: 2732572 - RNA, 16 nt, Human
gccaaaggaagcacau

SEQ ID NO: 2732573 - RNA, 20 nt, Human
gccaaaggaagcacaugccu

SEQ ID NO: 2732574 - RNA, 22 nt, Human
gcauuuugcuaaaugugaauga

SEQ ID NO: 2732575 - RNA, 12 nt, Human
gcauuccccacu

SEQ ID NO: 2732576 - RNA, 12 nt, Human
gcauuccccagg

SEQ ID NO: 2732577 - RNA, 23 nt, Human
gcauuugcugaauacagaggcaa

SEQ ID NO: 2732578 - RNA, 17 nt, Human
gcauuugcugaauacag

SEQ ID NO: 2732579 - RNA, 21 nt, Human
gcauuuggugguuucagaaau

SEQ ID NO: 2732580 - RNA, 18 nt, Human
gcccucuccugggcagcu

SEQ ID NO: 2732581 - RNA, 19 nt, Human
gcccucuccugggcagcug

SEQ ID NO: 2732582 - RNA, 21 nt, Human
gcccucuccugggcagcugcc

SEQ ID NO: 2732583 - RNA, 22 nt, Human
gcccucugcccacucccugcaa

SEQ ID NO: 2732584 - RNA, 15 nt, Human
gcccucuccugggca

SEQ ID NO: 2732585 - RNA, 16 nt, Human
gcccucuccugggcag

SEQ ID NO: 2732586 - RNA, 21 nt, Human
gcccgggcucugccucccauc

SEQ ID NO: 2732587 - RNA, 19 nt, Human
gcccgggcucugccuccca

SEQ ID NO: 2732588 - RNA, 20 nt, Human
gcccgggcucugccucccau

SEQ ID NO: 2732589 - RNA, 20 nt, Human
gccccuucugacccaugcug

SEQ ID NO: 2732590 - RNA, 19 nt, Human
gccccuucugacccaugcu

SEQ ID NO: 2732591 - RNA, 12 nt, Human
gcccggcuccag

SEQ ID NO: 2732592 - RNA, 13 nt, Human
gcccggcuccagg

SEQ ID NO: 2732593 - RNA, 14 nt, Human
gcccggcuccaggc

SEQ ID NO: 2732594 - RNA, 15 nt, Human
gcccggcuccaggcu

SEQ ID NO: 2732595 - RNA, 12 nt, Human
gcccgggcucug

SEQ ID NO: 2732596 - RNA, 13 nt, Human
gcccgggcucugc

SEQ ID NO: 2732597 - RNA, 14 nt, Human
gcccgggcucugcc

SEQ ID NO: 2732598 - RNA, 15 nt, Human
gcccgggcucugccu

SEQ ID NO: 2732599 - RNA, 18 nt, Human
gcccgggcucugccuccc

SEQ ID NO: 2732600 - RNA, 23 nt, Human
gccccuggcagccccuguucugg

SEQ ID NO: 2732601 - RNA, 19 nt, Human
gccccucagggucccuggu

SEQ ID NO: 2732602 - RNA, 21 nt, Human
gccccucagggucccuggugg

SEQ ID NO: 2732603 - RNA, 23 nt, Human
gccccucaacucuccuccagagu

SEQ ID NO: 2732604 - RNA, 22 nt, Human
gccccgaggccuucucugaagg

SEQ ID NO: 2732605 - RNA, 14 nt, Human
gccccgcccaggcu

SEQ ID NO: 2732606 - RNA, 23 nt, Human
gccccgaggccuucucugaagga

SEQ ID NO: 2732607 - RNA, 22 nt, Human
gccccauucugccugcccaggc

SEQ ID NO: 2732608 - RNA, 23 nt, Human
gccccauucugccugcccaggcc

SEQ ID NO: 2732609 - RNA, 11 nt, Human
gcccaggcugg

SEQ ID NO: 2732610 - RNA, 12 nt, Human
gcccaggaaagg

SEQ ID NO: 2732611 - RNA, 15 nt, Human
gcccaggaaaggcuc

SEQ ID NO: 2732612 - RNA, 16 nt, Human
gcccaggaaaggcucc

SEQ ID NO: 2732613 - RNA, 18 nt, Human
gcccaggccuccuacagc

SEQ ID NO: 2732614 - RNA, 22 nt, Human
gcccagucuggaaugcaguggu

SEQ ID NO: 2732615 - RNA, 20 nt, Human
gcccagucuggaaugcagug

SEQ ID NO: 2732616 - RNA, 16 nt, Human
gcccaggcuggcgugc

SEQ ID NO: 2732617 - RNA, 14 nt, Human
gcccaggcuggcgu

SEQ ID NO: 2732618 - RNA, 15 nt, Human
gcccaggcuggcgug

SEQ ID NO: 2732619 - RNA, 23 nt, Human
gccccauccucuguacagagccc

SEQ ID NO: 2732620 - RNA, 17 nt, Human
gccccauucugccugcc

SEQ ID NO: 2732621 - RNA, 18 nt, Human
gccccauucugccugccc

SEQ ID NO: 2732622 - RNA, 20 nt, Human
gccccauucugccugcccag

SEQ ID NO: 2732623 - RNA, 21 nt, Human
gccccauucugccugcccagg

SEQ ID NO: 2732624 - RNA, 15 nt, Human
gccccagugcccaca

SEQ ID NO: 2732625 - RNA, 16 nt, Human
gccccagugcccacag

SEQ ID NO: 2732626 - RNA, 17 nt, Human
gccccagugcccacagg

SEQ ID NO: 2732627 - RNA, 21 nt, Human
gccccagugcccacaggauca

SEQ ID NO: 2732628 - RNA, 16 nt, Human
gcccacagcuguauga

SEQ ID NO: 2732629 - RNA, 15 nt, Human
gcccaaagaugcagc

SEQ ID NO: 2732630 - RNA, 16 nt, Human
gcccaaagaugcagcc

SEQ ID NO: 2732631 - RNA, 15 nt, Human
gcccaccccucaaca

SEQ ID NO: 2732632 - RNA, 19 nt, Human
gcccacaggaucagucuga

SEQ ID NO: 2732633 - RNA, 13 nt, Human
gcccacaggauca

SEQ ID NO: 2732634 - RNA, 18 nt, Human
gcccacaggaucagucug

SEQ ID NO: 2732635 - RNA, 22 nt, Human
gccauuuaaagcuuauuaaaac

SEQ ID NO: 2732636 - RNA, 17 nt, Human
gccauuucuuccacaag

SEQ ID NO: 2732637 - RNA, 20 nt, Human
gccauuucuuccacaagagc

SEQ ID NO: 2732638 - RNA, 22 nt, Human
gccauuucuuccacaagagccc

SEQ ID NO: 2732639 - RNA, 15 nt, Human
gccaucccucccucc

SEQ ID NO: 2732640 - RNA, 16 nt, Human
gccaucccucccucca

SEQ ID NO: 2732641 - RNA, 11 nt, Human
gccaucccucc

SEQ ID NO: 2732642 - RNA, 13 nt, Human
gccaucccucccu

SEQ ID NO: 2732643 - RNA, 14 nt, Human
gccaucccucccuc

SEQ ID NO: 2732644 - RNA, 14 nt, Human
gccauccagguuca

SEQ ID NO: 2732645 - RNA, 17 nt, Human
gccaucccagccccaau

SEQ ID NO: 2732646 - RNA, 13 nt, Human
gccaucccagccc

SEQ ID NO: 2732647 - RNA, 14 nt, Human
gccaucccagcccc

SEQ ID NO: 2732648 - RNA, 15 nt, Human
gccaucccagcccca

SEQ ID NO: 2732649 - RNA, 16 nt, Human
gccaucccagccccaa

SEQ ID NO: 2732650 - RNA, 19 nt, Human
gccauccagguucagcuug

SEQ ID NO: 2732651 - RNA, 20 nt, Human
gccauccagguucagcuugu

SEQ ID NO: 2732652 - RNA, 23 nt, Human
gccaggggaaaaucagccugcuc

SEQ ID NO: 2732653 - RNA, 21 nt, Human
gccaggggaaaaucagccugc

SEQ ID NO: 2732654 - RNA, 22 nt, Human
gccaggggaaaaucagccugcu

SEQ ID NO: 2732655 - RNA, 17 nt, Human
gccaggggaaaaucagc

SEQ ID NO: 2732656 - RNA, 19 nt, Human
gccaggaagccagcaggcu

SEQ ID NO: 2732657 - RNA, 11 nt, Human
gccaggaagcc

SEQ ID NO: 2732658 - RNA, 17 nt, Human
gccaggaagccagcagg

SEQ ID NO: 2732659 - RNA, 18 nt, Human
gccaggaagccagcaggc

SEQ ID NO: 2732660 - RNA, 16 nt, Human
gccacggccaggccag

SEQ ID NO: 2732661 - RNA, 21 nt, Human
gccacuauuguuagucucuug

SEQ ID NO: 2732662 - RNA, 20 nt, Human
gccacuauuguuagucucuu

SEQ ID NO: 2732663 - RNA, 14 nt, Human
gccacggccaggcc

SEQ ID NO: 2732664 - RNA, 15 nt, Human
gccacggccaggcca

SEQ ID NO: 2732665 - RNA, 17 nt, Human
gccacugcaccgggcca

SEQ ID NO: 2732666 - RNA, 18 nt, Human
gccacugcaccgggccac

SEQ ID NO: 2732667 - RNA, 18 nt, Human
gccagagggagugacaga

SEQ ID NO: 2732668 - RNA, 12 nt, Human
gccagagacaca

SEQ ID NO: 2732669 - RNA, 15 nt, Human
gccagagacacaagc

SEQ ID NO: 2732670 - RNA, 17 nt, Human
gccagauucuuuccuga

SEQ ID NO: 2732671 - RNA, 19 nt, Human
gccagagggagugacagag

SEQ ID NO: 2732672 - RNA, 20 nt, Human
gccagagggagugacagagg

SEQ ID NO: 2732673 - RNA, 16 nt, Human
gccagauucuuuccug

SEQ ID NO: 2732674 - RNA, 21 nt, Human
gccagccgagauagccaaggc

SEQ ID NO: 2732675 - RNA, 20 nt, Human
gccagccgagauagccaagg

SEQ ID NO: 2732676 - RNA, 12 nt, Human
gccagccuugac

SEQ ID NO: 2732677 - RNA, 15 nt, Human
gccagcugcuugggc

SEQ ID NO: 2732678 - RNA, 14 nt, Human
gccagcugcuuggg

SEQ ID NO: 2732679 - RNA, 14 nt, Human
gccagccuugacca

SEQ ID NO: 2732680 - RNA, 20 nt, Human
gccagccuugaccauucucc

SEQ ID NO: 2732681 - RNA, 21 nt, Human
gccagccuugaccauucucca

SEQ ID NO: 2732682 - RNA, 22 nt, Human
gccagccuugaccauucuccac

SEQ ID NO: 2732683 - RNA, 22 nt, Human
gccuuuuucauuauuuuauuau

SEQ ID NO: 2732684 - RNA, 20 nt, Human
gccuuuuucauuauuuuauu

SEQ ID NO: 2732685 - RNA, 16 nt, Human
gccuuuuucauuauuu

SEQ ID NO: 2732686 - RNA, 12 nt, Human
gccuuuuucauu

SEQ ID NO: 2732687 - RNA, 16 nt, Human
gccugguggcagcugc

SEQ ID NO: 2732688 - RNA, 17 nt, Human
gccugguggcagcugcg

SEQ ID NO: 2732689 - RNA, 15 nt, Human
gccugguggcagcug

SEQ ID NO: 2732690 - RNA, 23 nt, Human
gccuuauggaacacucugagacu

SEQ ID NO: 2732691 - RNA, 21 nt, Human
gccuuauggaacacucugaga

SEQ ID NO: 2732692 - RNA, 22 nt, Human
gccuuauggaacacucugagac

SEQ ID NO: 2732693 - RNA, 19 nt, Human
gccuuacccucauguucuu

SEQ ID NO: 2732694 - RNA, 20 nt, Human
gccuuagaagucacacagua

SEQ ID NO: 2732695 - RNA, 14 nt, Human
gcgugagccacugc

SEQ ID NO: 2732696 - RNA, 15 nt, Human
gcgugagccacugca

SEQ ID NO: 2732697 - RNA, 14 nt, Human
gcuaacauggaagu

SEQ ID NO: 2732698 - RNA, 17 nt, Human
gcuaacauggaaguacu

SEQ ID NO: 2732699 - RNA, 18 nt, Human
gcuaacauggaaguacua

SEQ ID NO: 2732700 - RNA, 22 nt, Human
gcuacacaggggaaaagaggag

SEQ ID NO: 2732701 - RNA, 22 nt, Human
gcuagacuggugacugauucuu

SEQ ID NO: 2732702 - RNA, 20 nt, Human
gcuagacuggugacugauuc

SEQ ID NO: 2732703 - RNA, 19 nt, Human
gcuagacuggugacugauu

SEQ ID NO: 2732704 - RNA, 16 nt, Human
gcuagacuggugacug

SEQ ID NO: 2732705 - RNA, 15 nt, Human
gcuagacuggugacu

SEQ ID NO: 2732706 - RNA, 13 nt, Human
gcuagacugguga

SEQ ID NO: 2732707 - RNA, 21 nt, Human
gcuagacgagcaggcuucuuc

SEQ ID NO: 2732708 - RNA, 22 nt, Human
gcuagacgagcaggcuucuucc

SEQ ID NO: 2732709 - RNA, 23 nt, Human
gcggggacagcuccuucuguccu

SEQ ID NO: 2732710 - RNA, 20 nt, Human
gcgguccacccaggagcccc

SEQ ID NO: 2732711 - RNA, 23 nt, Human
gcgguccacccaggagccccgag

SEQ ID NO: 2732712 - RNA, 19 nt, Human
gcggaaugaaccacaucuu

SEQ ID NO: 2732713 - RNA, 16 nt, Human
gcggacagccacggcc

SEQ ID NO: 2732714 - RNA, 19 nt, Human
gcggacagccacggccagg

SEQ ID NO: 2732715 - RNA, 18 nt, Human
gcggggacagcuccuucu

SEQ ID NO: 2732716 - RNA, 19 nt, Human
gcggggacagcuccuucug

SEQ ID NO: 2732717 - RNA, 23 nt, Human
gcggacagccacggccaggccag

SEQ ID NO: 2732718 - RNA, 17 nt, Human
gcgcugccccuggcagc

SEQ ID NO: 2732719 - RNA, 14 nt, Human
gcgcugccccuggc

SEQ ID NO: 2732720 - RNA, 20 nt, Human
gcgccuacaggagugagcac

SEQ ID NO: 2732721 - RNA, 21 nt, Human
gcgccuacaggagugagcacu

SEQ ID NO: 2732722 - RNA, 18 nt, Human
gcgccuacaggagugagc

SEQ ID NO: 2732723 - RNA, 11 nt, Human
gccuccccucc

SEQ ID NO: 2732724 - RNA, 12 nt, Human
gccuccccuccu

SEQ ID NO: 2732725 - RNA, 13 nt, Human
gccuccccuccuc

SEQ ID NO: 2732726 - RNA, 14 nt, Human
gccuccccuccucu

SEQ ID NO: 2732727 - RNA, 18 nt, Human
gccucccgaauagcuggg

SEQ ID NO: 2732728 - RNA, 19 nt, Human
gccucccgaauagcuggga

SEQ ID NO: 2732729 - RNA, 20 nt, Human
gccucccgaauagcugggac

SEQ ID NO: 2732730 - RNA, 21 nt, Human
gccucccgaguagcugggacu

SEQ ID NO: 2732731 - RNA, 23 nt, Human
gccucccgaguagcugggacuac

SEQ ID NO: 2732732 - RNA, 22 nt, Human
gccucagccucccaaagugcug

SEQ ID NO: 2732733 - RNA, 12 nt, Human
gccucagccucc

SEQ ID NO: 2732734 - RNA, 14 nt, Human
gccucagccuccca

SEQ ID NO: 2732735 - RNA, 15 nt, Human
gccucucccaucacu

SEQ ID NO: 2732736 - RNA, 11 nt, Human
gccugcccagg

SEQ ID NO: 2732737 - RNA, 12 nt, Human
gccugcccaggc

SEQ ID NO: 2732738 - RNA, 14 nt, Human
gccuggacccugug

SEQ ID NO: 2732739 - RNA, 15 nt, Human
gccucugacacacag

SEQ ID NO: 2732740 - RNA, 16 nt, Human
gccucugacacacagc

SEQ ID NO: 2732741 - RNA, 16 nt, Human
gccucugcacuccccu

SEQ ID NO: 2732742 - RNA, 17 nt, Human
gccucugcacuccccug

SEQ ID NO: 2732743 - RNA, 18 nt, Human
gccucugcacuccccugc

SEQ ID NO: 2732744 - RNA, 19 nt, Human
gccucugcacuccccugcu

SEQ ID NO: 2732745 - RNA, 20 nt, Human
gccucugcacuccccugcug

SEQ ID NO: 2732746 - RNA, 15 nt, Human
gccucugcacucccc

SEQ ID NO: 2732747 - RNA, 21 nt, Human
gccucugcacuccccugcugg

SEQ ID NO: 2732748 - RNA, 19 nt, Human
gcccuucuuuccacagaag

SEQ ID NO: 2732749 - RNA, 23 nt, Human
gcccuucucuccagccccuggau

SEQ ID NO: 2732750 - RNA, 13 nt, Human
gcccuucucucca

SEQ ID NO: 2732751 - RNA, 16 nt, Human
gccgagauagccaagg

SEQ ID NO: 2732752 - RNA, 13 nt, Human
gccgcagcccugc

SEQ ID NO: 2732753 - RNA, 17 nt, Human
gccgagauagccaaggc

SEQ ID NO: 2732754 - RNA, 15 nt, Human
gccgcagcccugcag

SEQ ID NO: 2732755 - RNA, 16 nt, Human
gccgcagcccugcaga

SEQ ID NO: 2732756 - RNA, 17 nt, Human
gccgcagcccugcagag

SEQ ID NO: 2732757 - RNA, 13 nt, Human
gccuaaggacuuc

SEQ ID NO: 2732758 - RNA, 12 nt, Human
gccuaaggacuu

SEQ ID NO: 2732759 - RNA, 18 nt, Human
gccuaaggacuucuuuaa

SEQ ID NO: 2732760 - RNA, 15 nt, Human
gccuaaggacuucuu

SEQ ID NO: 2732761 - RNA, 14 nt, Human
gccuaaggacuucu

SEQ ID NO: 2732762 - RNA, 22 nt, Human
gccucaagugauucuccugccu

SEQ ID NO: 2732763 - RNA, 24 nt, Human
gccucaagugauucuccugccuca

SEQ ID NO: 2732764 - RNA, 18 nt, Human
gccucagcauccuggcac

SEQ ID NO: 2732765 - RNA, 17 nt, Human
gccucagcauccuggca

SEQ ID NO: 2732766 - RNA, 21 nt, Human
gccucagcauccuggcacccg

SEQ ID NO: 2732767 - RNA, 18 nt, Human
gccgucuaccugaggggc

SEQ ID NO: 2732768 - RNA, 20 nt, Human
gccgucuaccugaggggccu

SEQ ID NO: 2732769 - RNA, 22 nt, Human
gccgucuaccugaggggccucu

SEQ ID NO: 2732770 - RNA, 23 nt, Human
gccgucuaccugaggggccucuu

SEQ ID NO: 2732771 - RNA, 11 nt, Human
gccuaaaucca

SEQ ID NO: 2732772 - RNA, 22 nt, Human
ggcagcugccuccccuccucug

SEQ ID NO: 2732773 - RNA, 21 nt, Human
ggcagcuugaggguugggcug

SEQ ID NO: 2732774 - RNA, 18 nt, Human
ggcagcugccuccccucc

SEQ ID NO: 2732775 - RNA, 21 nt, Human
ggcagcugccuccccuccucu

SEQ ID NO: 2732776 - RNA, 19 nt, Human
ggcagcugcgguccaccca

SEQ ID NO: 2732777 - RNA, 16 nt, Human
ggcagcucaccucucc

SEQ ID NO: 2732778 - RNA, 22 nt, Human
ggcagcucaccucucccuugga

SEQ ID NO: 2732779 - RNA, 18 nt, Human
ggcagcucaccucucccu

SEQ ID NO: 2732780 - RNA, 21 nt, Human
ggcagcucaccucucccuugg

SEQ ID NO: 2732781 - RNA, 23 nt, Human
ggcaggucuugaacuccuggccu

SEQ ID NO: 2732782 - RNA, 13 nt, Human
ggcagguccaggg

SEQ ID NO: 2732783 - RNA, 17 nt, Human
ggcagaggaaagcaaag

SEQ ID NO: 2732784 - RNA, 23 nt, Human
ggcagauacaggaaaagcugcug

SEQ ID NO: 2732785 - RNA, 23 nt, Human
ggcagaguugaagacagagcuac

SEQ ID NO: 2732786 - RNA, 18 nt, Human
ggcaacugcauuggcuuu

SEQ ID NO: 2732787 - RNA, 19 nt, Human
ggcaacugcauuggcuuug

SEQ ID NO: 2732788 - RNA, 15 nt, Human
ggcaaggcugucaau

SEQ ID NO: 2732789 - RNA, 21 nt, Human
ggaucagucugauucccaagc

SEQ ID NO: 2732790 - RNA, 19 nt, Human
ggcaacccccagccugcua

SEQ ID NO: 2732791 - RNA, 16 nt, Human
ggcaaggcugucaauu

SEQ ID NO: 2732792 - RNA, 15 nt, Human
ggcacccggccccug

SEQ ID NO: 2732793 - RNA, 16 nt, Human
ggcacccggccccugc

SEQ ID NO: 2732794 - RNA, 20 nt, Human
ggcagagcagagaccauccc

SEQ ID NO: 2732795 - RNA, 15 nt, Human
ggcagagcagagacc

SEQ ID NO: 2732796 - RNA, 16 nt, Human
ggcagagcagagacca

SEQ ID NO: 2732797 - RNA, 12 nt, Human
ggcagagcagag

SEQ ID NO: 2732798 - RNA, 13 nt, Human
ggccaugggccuc

SEQ ID NO: 2732799 - RNA, 16 nt, Human
ggccccucaggguccc

SEQ ID NO: 2732800 - RNA, 19 nt, Human
ggccccucagggucccugg

SEQ ID NO: 2732801 - RNA, 20 nt, Human
ggccccucagggucccuggu

SEQ ID NO: 2732802 - RNA, 21 nt, Human
ggccccucagggucccuggug

SEQ ID NO: 2732803 - RNA, 17 nt, Human
ggccccugccacccugg

SEQ ID NO: 2732804 - RNA, 18 nt, Human
ggccccugccacccuggg

SEQ ID NO: 2732805 - RNA, 13 nt, Human
ggccccugcccgg

SEQ ID NO: 2732806 - RNA, 13 nt, Human
ggccccugccacc

SEQ ID NO: 2732807 - RNA, 16 nt, Human
ggccccugccacccug

SEQ ID NO: 2732808 - RNA, 12 nt, Human
ggccccugccac

SEQ ID NO: 2732809 - RNA, 15 nt, Human
ggcagguuggugggg

SEQ ID NO: 2732810 - RNA, 23 nt, Human
ggcauguucucugaggacacuaa

SEQ ID NO: 2732811 - RNA, 15 nt, Human
ggcauuccccaggag

SEQ ID NO: 2732812 - RNA, 16 nt, Human
ggccacaagacccuug

SEQ ID NO: 2732813 - RNA, 17 nt, Human
ggccacaagacccuugu

SEQ ID NO: 2732814 - RNA, 16 nt, Human
ggccaccugcggugcu

SEQ ID NO: 2732815 - RNA, 22 nt, Human
ggccaccugcggugcuaucucc

SEQ ID NO: 2732816 - RNA, 11 nt, Human
ggccacuguga

SEQ ID NO: 2732817 - RNA, 16 nt, Human
ggccacugugaagaga

SEQ ID NO: 2732818 - RNA, 14 nt, Human
ggccaggagccucc

SEQ ID NO: 2732819 - RNA, 16 nt, Human
ggccaggagccuccug

SEQ ID NO: 2732820 - RNA, 11 nt, Human
ggccaggcugg

SEQ ID NO: 2732821 - RNA, 14 nt, Human
ggccaggccagagg

SEQ ID NO: 2732822 - RNA, 16 nt, Human
ggccaggccagaggga

SEQ ID NO: 2732823 - RNA, 12 nt, Human
ggagggagggcu

SEQ ID NO: 2732824 - RNA, 12 nt, Human
ggagggcuccag

SEQ ID NO: 2732825 - RNA, 13 nt, Human
ggagggcuccaga

SEQ ID NO: 2732826 - RNA, 23 nt, Human
ggaggaucacuugaguccagaag

SEQ ID NO: 2732827 - RNA, 17 nt, Human
ggaggaucucuugagcc

SEQ ID NO: 2732828 - RNA, 21 nt, Human
ggaggaucucuugagccuggg

SEQ ID NO: 2732829 - RNA, 15 nt, Human
ggaggauguucuggg

SEQ ID NO: 2732830 - RNA, 17 nt, Human
ggagggcuccagacaca

SEQ ID NO: 2732831 - RNA, 14 nt, Human
ggagggcuccagac

SEQ ID NO: 2732832 - RNA, 15 nt, Human
ggagggcuccagaca

SEQ ID NO: 2732833 - RNA, 20 nt, Human
ggagucccaccuuggcugca

SEQ ID NO: 2732834 - RNA, 21 nt, Human
ggagucccaccuuggcugcag

SEQ ID NO: 2732835 - RNA, 11 nt, Human
ggagugacaga

SEQ ID NO: 2732836 - RNA, 16 nt, Human
ggagugacagaggcag

SEQ ID NO: 2732837 - RNA, 16 nt, Human
ggaucacagccucuga

SEQ ID NO: 2732838 - RNA, 12 nt, Human
ggagugagcugg

SEQ ID NO: 2732839 - RNA, 14 nt, Human
ggagugagcugguu

SEQ ID NO: 2732840 - RNA, 21 nt, Human
ggagugaguugauagcacaga

SEQ ID NO: 2732841 - RNA, 17 nt, Human
ggagugacagaggcagc

SEQ ID NO: 2732842 - RNA, 18 nt, Human
ggagugacagaggcagcc

SEQ ID NO: 2732843 - RNA, 19 nt, Human
ggagugacagaggcagccc

SEQ ID NO: 2732844 - RNA, 21 nt, Human
ggagugacagaggcagcccca

SEQ ID NO: 2732845 - RNA, 20 nt, Human
ggaagccagcaggcucucag

SEQ ID NO: 2732846 - RNA, 15 nt, Human
ggagaggggcacagg

SEQ ID NO: 2732847 - RNA, 20 nt, Human
ggagauuuacaacuggggga

SEQ ID NO: 2732848 - RNA, 20 nt, Human
ggagcaaaaucgaugcagug

SEQ ID NO: 2732849 - RNA, 21 nt, Human
ggagaccccuuggggagcagg

SEQ ID NO: 2732850 - RNA, 17 nt, Human
ggagagcuagcagcagg

SEQ ID NO: 2732851 - RNA, 21 nt, Human
ggagagcuagcagcagggagg

SEQ ID NO: 2732852 - RNA, 22 nt, Human
gcuguauuuuaaaagaaugauu

SEQ ID NO: 2732853 - RNA, 22 nt, Human
gcugguucaggguuggccccug

SEQ ID NO: 2732854 - RNA, 16 nt, Human
gcugucaauuacagga

SEQ ID NO: 2732855 - RNA, 15 nt, Human
gcugguucaggguug

SEQ ID NO: 2732856 - RNA, 21 nt, Human
gcugguuagagguucccuuug

SEQ ID NO: 2732857 - RNA, 24 nt, Human
gcuggugcccugcuuucagauacu

SEQ ID NO: 2732858 - RNA, 14 nt, Human
gcuggucccacuca

SEQ ID NO: 2732859 - RNA, 22 nt, Human
gcuggugcccugcuuucagaua

SEQ ID NO: 2732860 - RNA, 20 nt, Human
gcuggucccacucaguccau

SEQ ID NO: 2732861 - RNA, 16 nt, Human
gcuggugucaccugaa

SEQ ID NO: 2732862 - RNA, 18 nt, Human
gcuggugucaccugaaga

SEQ ID NO: 2732863 - RNA, 19 nt, Human
gcugucccuuacgugaguc

SEQ ID NO: 2732864 - RNA, 22 nt, Human
gcugucccuuacgugaguccug

SEQ ID NO: 2732865 - RNA, 21 nt, Human
gcugucccuuacgugaguccu

SEQ ID NO: 2732866 - RNA, 17 nt, Human
gcugucaauuacaggaa

SEQ ID NO: 2732867 - RNA, 19 nt, Human
gcugucaauuacaggaagu

SEQ ID NO: 2732868 - RNA, 22 nt, Human
gcugucaauuacaggaaguacu

SEQ ID NO: 2732869 - RNA, 23 nt, Human
gcugucaauuacaggaaguacug

SEQ ID NO: 2732870 - RNA, 17 nt, Human
gcugucuccauguuuga

SEQ ID NO: 2732871 - RNA, 17 nt, Human
gcugggcuucaguggca

SEQ ID NO: 2732872 - RNA, 21 nt, Human
gcugggaugauuggagggggg

SEQ ID NO: 2732873 - RNA, 19 nt, Human
gcugggagagccuuccagg

SEQ ID NO: 2732874 - RNA, 22 nt, Human
gcugggagagccuuccaggggu

SEQ ID NO: 2732875 - RNA, 12 nt, Human
gcugggagagcc

SEQ ID NO: 2732876 - RNA, 13 nt, Human
gcugggagagccu

SEQ ID NO: 2732877 - RNA, 17 nt, Human
gcugggagagccuucca

SEQ ID NO: 2732878 - RNA, 18 nt, Human
gcugggagagccuuccag

SEQ ID NO: 2732879 - RNA, 19 nt, Human
gcugggggccucagugcca

SEQ ID NO: 2732880 - RNA, 20 nt, Human
gcugggggccucagugccac

SEQ ID NO: 2732881 - RNA, 15 nt, Human
gcuggucccacucag

SEQ ID NO: 2732882 - RNA, 19 nt, Human
gcuggucccacucagucca

SEQ ID NO: 2732883 - RNA, 23 nt, Human
gcugggggaagaagcucucuccu

SEQ ID NO: 2732884 - RNA, 12 nt, Human
gcuggggccagu

SEQ ID NO: 2732885 - RNA, 18 nt, Human
gcugggcuucaguggcag

SEQ ID NO: 2732886 - RNA, 19 nt, Human
gcugggcuucaguggcagc

SEQ ID NO: 2732887 - RNA, 18 nt, Human
gcuagauguauguacuuc

SEQ ID NO: 2732888 - RNA, 16 nt, Human
gcuagauguauguacu

SEQ ID NO: 2732889 - RNA, 11 nt, Human
gcugcccugug

SEQ ID NO: 2732890 - RNA, 16 nt, Human
gcugcgguccacccag

SEQ ID NO: 2732891 - RNA, 12 nt, Human
gcugcccuguga

SEQ ID NO: 2732892 - RNA, 14 nt, Human
gcugcccugugagu

SEQ ID NO: 2732893 - RNA, 23 nt, Human
gcugcuucaaggauccugagcca

SEQ ID NO: 2732894 - RNA, 21 nt, Human
gcugcuucaaggauccugagc

SEQ ID NO: 2732895 - RNA, 22 nt, Human
gcugcuucaaggauccugagcc

SEQ ID NO: 2732896 - RNA, 16 nt, Human
gcugcuugggcuucau

SEQ ID NO: 2732897 - RNA, 13 nt, Human
gcugcuucaagga

SEQ ID NO: 2732898 - RNA, 19 nt, Human
gcugcgguccacccaggag

SEQ ID NO: 2732899 - RNA, 17 nt, Human
gcugcgguccacccagg

SEQ ID NO: 2732900 - RNA, 18 nt, Human
gcugcgguccacccagga

SEQ ID NO: 2732901 - RNA, 19 nt, Human
gcugggacuacagguguga

SEQ ID NO: 2732902 - RNA, 13 nt, Human
gcugggacuacag

SEQ ID NO: 2732903 - RNA, 18 nt, Human
gcugggacuacaggcacc

SEQ ID NO: 2732904 - RNA, 19 nt, Human
gcugggacuacaggcaccc

SEQ ID NO: 2732905 - RNA, 20 nt, Human
gcugggacuacaggcaccca

SEQ ID NO: 2732906 - RNA, 20 nt, Human
gcugggacaugggaaagggg

SEQ ID NO: 2732907 - RNA, 16 nt, Human
gcuggaccuugaacug

SEQ ID NO: 2732908 - RNA, 18 nt, Human
gcuggaccuugaacuggg

SEQ ID NO: 2732909 - RNA, 17 nt, Human
gcugcuugggcuucauc

SEQ ID NO: 2732910 - RNA, 22 nt, Human
gcugcuugggcuucauccuccu

SEQ ID NO: 2732911 - RNA, 21 nt, Human
gcuggaccuugaacuggguac

SEQ ID NO: 2732912 - RNA, 22 nt, Human
gcuggaccuugaacuggguacu

SEQ ID NO: 2732913 - RNA, 19 nt, Human
ggaacagacuggaagcaca

SEQ ID NO: 2732914 - RNA, 20 nt, Human
ggaacagacuggaagcacag

SEQ ID NO: 2732915 - RNA, 21 nt, Human
ggaacgcguugaaauuguaau

SEQ ID NO: 2732916 - RNA, 16 nt, Human
ggaacgcguugaaauu

SEQ ID NO: 2732917 - RNA, 17 nt, Human
ggaacgcguugaaauug

SEQ ID NO: 2732918 - RNA, 13 nt, Human
ggaaauauuuauu

SEQ ID NO: 2732919 - RNA, 15 nt, Human
ggaaauauuuauuuu

SEQ ID NO: 2732920 - RNA, 12 nt, Human
ggaaauauuuau

SEQ ID NO: 2732921 - RNA, 17 nt, Human
ggaaauauuuauuuuaa

SEQ ID NO: 2732922 - RNA, 18 nt, Human
ggaaauauuuauuuuaau

SEQ ID NO: 2732923 - RNA, 17 nt, Human
ggaacagacuggaagca

SEQ ID NO: 2732924 - RNA, 15 nt, Human
ggaaaaucagccugc

SEQ ID NO: 2732925 - RNA, 14 nt, Human
ggaaaauaaauuau

SEQ ID NO: 2732926 - RNA, 18 nt, Human
ggaaaaguuuaauauuaa

SEQ ID NO: 2732927 - RNA, 19 nt, Human
ggaaaaguuuaauauuaaa

SEQ ID NO: 2732928 - RNA, 13 nt, Human
ggaagccagcagg

SEQ ID NO: 2732929 - RNA, 14 nt, Human
ggaagccagcaggc

SEQ ID NO: 2732930 - RNA, 15 nt, Human
ggaagccagcaggcu

SEQ ID NO: 2732931 - RNA, 16 nt, Human
ggaagccagcaggcuc

SEQ ID NO: 2732932 - RNA, 17 nt, Human
ggaagccagcaggcucu

SEQ ID NO: 2732933 - RNA, 18 nt, Human
ggaagccagcaggcucuc

SEQ ID NO: 2732934 - RNA, 23 nt, Human
ggaagcacaugccucucucaggc

SEQ ID NO: 2732935 - RNA, 21 nt, Human
ggaagcacaugccucucucag

SEQ ID NO: 2732936 - RNA, 22 nt, Human
ggaagcacaugccucucucagg

SEQ ID NO: 2732937 - RNA, 13 nt, Human
ggaagagccuugc

SEQ ID NO: 2732938 - RNA, 17 nt, Human
ggaagcacagcuucauu

SEQ ID NO: 2732939 - RNA, 13 nt, Human
ggaagcacaugcc

SEQ ID NO: 2732940 - RNA, 14 nt, Human
ggaagcacaugccu

SEQ ID NO: 2732941 - RNA, 15 nt, Human
ggaagcacaugccuc

SEQ ID NO: 2732942 - RNA, 17 nt, Human
ggaagcacaugccucuc

SEQ ID NO: 2732943 - RNA, 23 nt, Human
gcuguucacagccagacuggcac

SEQ ID NO: 2732944 - RNA, 18 nt, Human
gcuuccagugaggcucug

SEQ ID NO: 2732945 - RNA, 16 nt, Human
gcuguucacagccaga

SEQ ID NO: 2732946 - RNA, 15 nt, Human
gcuguucacagccag

SEQ ID NO: 2732947 - RNA, 21 nt, Human
gcuuccagugaggcucugccc

SEQ ID NO: 2732948 - RNA, 19 nt, Human
gcuuccagugaggcucugc

SEQ ID NO: 2732949 - RNA, 20 nt, Human
gcuuccagugaggcucugcc

SEQ ID NO: 2732950 - RNA, 18 nt, Human
gcuugccaucccucccuc

SEQ ID NO: 2732951 - RNA, 21 nt, Human
gcuugccaucccucccuccac

SEQ ID NO: 2732952 - RNA, 13 nt, Human
gcuuggaggaagg

SEQ ID NO: 2732953 - RNA, 14 nt, Human
gcuuggaggaagga

SEQ ID NO: 2732954 - RNA, 15 nt, Human
gcuuggaggaaggaa

SEQ ID NO: 2732955 - RNA, 16 nt, Human
gcuugccaucccuccc

SEQ ID NO: 2732956 - RNA, 22 nt, Human
gcuugaggguugggcugguguc

SEQ ID NO: 2732957 - RNA, 17 nt, Human
gcuuuuaaaaaaaaaua

SEQ ID NO: 2732958 - RNA, 20 nt, Human
ggaaaaaauaacaaugaaag

SEQ ID NO: 2732959 - RNA, 14 nt, Human
gcuuuuacuuaaac

SEQ ID NO: 2732960 - RNA, 13 nt, Human
ggaaaaauagccu

SEQ ID NO: 2732961 - RNA, 14 nt, Human
ggaaaaacugauuu

SEQ ID NO: 2732962 - RNA, 15 nt, Human
ggaaaaauagccugc

SEQ ID NO: 2732963 - RNA, 14 nt, Human
gcuuuaucaaaggg

SEQ ID NO: 2732964 - RNA, 22 nt, Human
ggcuugaguuuaaauuguaaua

SEQ ID NO: 2732965 - RNA, 19 nt, Human
ggcuuggggaccagagcug

SEQ ID NO: 2732966 - RNA, 21 nt, Human
ggcuuggggaccagagcugcc

SEQ ID NO: 2732967 - RNA, 12 nt, Human
ggcuuuucugau

SEQ ID NO: 2732968 - RNA, 10 nt, Human
ggcuuuugug

SEQ ID NO: 2732969 - RNA, 16 nt, Human
ggcuuuucugauccag

SEQ ID NO: 2732970 - RNA, 13 nt, Human
ggcuuuucugauc

SEQ ID NO: 2732971 - RNA, 21 nt, Human
ggcuuagucacugagacagcc

SEQ ID NO: 2732972 - RNA, 17 nt, Human
ggcugggcucccuuccc

SEQ ID NO: 2732973 - RNA, 12 nt, Human
ggcugggcuuca

SEQ ID NO: 2732974 - RNA, 15 nt, Human
ggcuuaaaacaacac

SEQ ID NO: 2732975 - RNA, 13 nt, Human
ggcugggcuucag

SEQ ID NO: 2732976 - RNA, 17 nt, Human
ggcugggcuucaguggc

SEQ ID NO: 2732977 - RNA, 12 nt, Human
gggaccucaggc

SEQ ID NO: 2732978 - RNA, 13 nt, Human
gggaccucaggcc

SEQ ID NO: 2732979 - RNA, 15 nt, Human
gggaccucaggccug

SEQ ID NO: 2732980 - RNA, 17 nt, Human
gggacuacaggcaccca

SEQ ID NO: 2732981 - RNA, 16 nt, Human
gggacucaaugcacug

SEQ ID NO: 2732982 - RNA, 17 nt, Human
gggaagggggcugggac

SEQ ID NO: 2732983 - RNA, 14 nt, Human
gggaagggggcugg

SEQ ID NO: 2732984 - RNA, 16 nt, Human
gggaagggggcuggga

SEQ ID NO: 2732985 - RNA, 13 nt, Human
gggaaugaagaua

SEQ ID NO: 2732986 - RNA, 23 nt, Human
gggaaggauacaaaagcauguga

SEQ ID NO: 2732987 - RNA, 21 nt, Human
gggaaggauacaaaagcaugu

SEQ ID NO: 2732988 - RNA, 16 nt, Human
gggaaggauacaaaag

SEQ ID NO: 2732989 - RNA, 17 nt, Human
ggcuuuucugauccagu

SEQ ID NO: 2732990 - RNA, 14 nt, Human
ggcuuuugugcauu

SEQ ID NO: 2732991 - RNA, 11 nt, Human
ggcugcuucaa

SEQ ID NO: 2732992 - RNA, 12 nt, Human
ggcugcuucaag

SEQ ID NO: 2732993 - RNA, 14 nt, Human
ggcugcuucaagga

SEQ ID NO: 2732994 - RNA, 22 nt, Human
ggcugcuucaaggauccugagc

SEQ ID NO: 2732995 - RNA, 18 nt, Human
ggcugcugaaggcucgag

SEQ ID NO: 2732996 - RNA, 15 nt, Human
ggcugcugaaggcuc

SEQ ID NO: 2732997 - RNA, 17 nt, Human
ggcugcugaaggcucga

SEQ ID NO: 2732998 - RNA, 12 nt, Human
ggcugcagggag

SEQ ID NO: 2732999 - RNA, 13 nt, Human
ggcugcagggagu

SEQ ID NO: 2733000 - RNA, 14 nt, Human
ggcugcugaaggcu

SEQ ID NO: 2733001 - RNA, 23 nt, Human
ggcugcuucaaggauccugagcc

SEQ ID NO: 2733002 - RNA, 19 nt, Human
ggcugggagagccuuccag

SEQ ID NO: 2733003 - RNA, 18 nt, Human
ggcugggagagccuucca

SEQ ID NO: 2733004 - RNA, 15 nt, Human
ggcugggcagaggaa

SEQ ID NO: 2733005 - RNA, 19 nt, Human
ggcugggcagaggaaagca

SEQ ID NO: 2733006 - RNA, 13 nt, Human
ggcugggcagagg

SEQ ID NO: 2733007 - RNA, 14 nt, Human
ggcugggcagagga

SEQ ID NO: 2733008 - RNA, 20 nt, Human
ggcugggagagccuuccagg

SEQ ID NO: 2733009 - RNA, 23 nt, Human
ggcugggagagccuuccaggggu

SEQ ID NO: 2733010 - RNA, 13 nt, Human
ggcugagguggga

SEQ ID NO: 2733011 - RNA, 15 nt, Human
ggcugaggugggagg

SEQ ID NO: 2733012 - RNA, 20 nt, Human
ggccccugcccggcugcgga

SEQ ID NO: 2733013 - RNA, 17 nt, Human
ggcucugccucccauca

SEQ ID NO: 2733014 - RNA, 16 nt, Human
ggccccugcccggcug

SEQ ID NO: 2733015 - RNA, 17 nt, Human
ggccccugcccggcugc

SEQ ID NO: 2733016 - RNA, 24 nt, Human
ggcugcaaaggguaucaggugcug

SEQ ID NO: 2733017 - RNA, 17 nt, Human
ggcugcaccggcuggcc

SEQ ID NO: 2733018 - RNA, 18 nt, Human
ggcugcaccggcuggccu

SEQ ID NO: 2733019 - RNA, 19 nt, Human
ggcugcaccggcuggccug

SEQ ID NO: 2733020 - RNA, 18 nt, Human
ggcugcaaaggguaucag

SEQ ID NO: 2733021 - RNA, 22 nt, Human
ggcugcaaaggguaucaggugc

SEQ ID NO: 2733022 - RNA, 23 nt, Human
ggcugcaaaggguaucaggugcu

SEQ ID NO: 2733023 - RNA, 14 nt, Human
gggccuggccugag

SEQ ID NO: 2733024 - RNA, 18 nt, Human
gggccuggccugagcugg

SEQ ID NO: 2733025 - RNA, 17 nt, Human
gggccuggcucaggugg

SEQ ID NO: 2733026 - RNA, 13 nt, Human
gggccuggcuccc

SEQ ID NO: 2733027 - RNA, 12 nt, Human
gggccuggccug

SEQ ID NO: 2733028 - RNA, 13 nt, Human
gggccuggccuga

SEQ ID NO: 2733029 - RNA, 13 nt, Human
gggcccugccucc

SEQ ID NO: 2733030 - RNA, 12 nt, Human
gggcaugacacg

SEQ ID NO: 2733031 - RNA, 17 nt, Human
gggcccagagagggugg

SEQ ID NO: 2733032 - RNA, 23 nt, Human
gggccacagagaaaguacuucuc

SEQ ID NO: 2733033 - RNA, 16 nt, Human
gggccacagagaaagu

SEQ ID NO: 2733034 - RNA, 21 nt, Human
gggauaugauuuaaaucagcc

SEQ ID NO: 2733035 - RNA, 13 nt, Human
gggauagagagag

SEQ ID NO: 2733036 - RNA, 15 nt, Human
gggauccuccaggug

SEQ ID NO: 2733037 - RNA, 16 nt, Human
gggauccuccaggugc

SEQ ID NO: 2733038 - RNA, 23 nt, Human
gggauccuggaguucugguuccu

SEQ ID NO: 2733039 - RNA, 20 nt, Human
gggcaacccccagccugcua

SEQ ID NO: 2733040 - RNA, 18 nt, Human
gggcaacccuggugacca

SEQ ID NO: 2733041 - RNA, 16 nt, Human
gggaggugaccccagg

SEQ ID NO: 2733042 - RNA, 17 nt, Human
gggaggugggauccucc

SEQ ID NO: 2733043 - RNA, 18 nt, Human
gggagugacagaggcagc

SEQ ID NO: 2733044 - RNA, 11 nt, Human
gggagugagcu

SEQ ID NO: 2733045 - RNA, 14 nt, Human
gggagugagcuggu

SEQ ID NO: 2733046 - RNA, 20 nt, Human
gggcacagaaaauggaagac

SEQ ID NO: 2733047 - RNA, 21 nt, Human
gggcacagaaaauggaagaca

SEQ ID NO: 2733048 - RNA, 18 nt, Human
gggcacagaaaauggaag

SEQ ID NO: 2733049 - RNA, 23 nt, Human
gggcacaccgggcacucagaaga

SEQ ID NO: 2733050 - RNA, 13 nt, Human
gggcacagggucu

SEQ ID NO: 2733051 - RNA, 16 nt, Human
gggcacagggucucua

SEQ ID NO: 2733052 - RNA, 16 nt, Human
gggcacucagaagaca

SEQ ID NO: 2733053 - RNA, 19 nt, Human
gggcacucagaagacacug

SEQ ID NO: 2733054 - RNA, 17 nt, Human
gggcagguugguggggg

SEQ ID NO: 2733055 - RNA, 11 nt, Human
gggcagagcag

SEQ ID NO: 2733056 - RNA, 20 nt, Human
gggcacucagaagacacuga

SEQ ID NO: 2733057 - RNA, 14 nt, Human
gggcagaaggaaga

SEQ ID NO: 2733058 - RNA, 18 nt, Human
gggcagaaggaagacuuc

SEQ ID NO: 2733059 - RNA, 23 nt, Human
ggugcuacaaaaacacagcaagg

SEQ ID NO: 2733060 - RNA, 21 nt, Human
ggugcuacaaaaacacagcaa

SEQ ID NO: 2733061 - RNA, 16 nt, Human
ggugcuaucuccccca

SEQ ID NO: 2733062 - RNA, 17 nt, Human
ggugcuaucucccccag

SEQ ID NO: 2733063 - RNA, 19 nt, Human
ggugcuaucucccccagcc

SEQ ID NO: 2733064 - RNA, 20 nt, Human
ggugcuaucucccccagccc

SEQ ID NO: 2733065 - RNA, 15 nt, Human
ggugagaagcagagg

SEQ ID NO: 2733066 - RNA, 16 nt, Human
ggugagaggggaacag

SEQ ID NO: 2733067 - RNA, 15 nt, Human
ggugcugccauccag

SEQ ID NO: 2733068 - RNA, 21 nt, Human
ggugcugccauccagguucag

SEQ ID NO: 2733069 - RNA, 19 nt, Human
gguggcagugggagcugcc

SEQ ID NO: 2733070 - RNA, 22 nt, Human
gguggcagugggagcugccugu

SEQ ID NO: 2733071 - RNA, 16 nt, Human
gguggcagugggagcu

SEQ ID NO: 2733072 - RNA, 22 nt, Human
gguggccucccaacucacccca

SEQ ID NO: 2733073 - RNA, 23 nt, Human
gguggccucccaacucaccccag

SEQ ID NO: 2733074 - RNA, 22 nt, Human
ggucucacucugucgcccaguc

SEQ ID NO: 2733075 - RNA, 23 nt, Human
ggucucacucugucgcccagucu

SEQ ID NO: 2733076 - RNA, 17 nt, Human
ggucccaccccacacac

SEQ ID NO: 2733077 - RNA, 14 nt, Human
ggucccaccccaca

SEQ ID NO: 2733078 - RNA, 21 nt, Human
ggugacagagugagacucugu

SEQ ID NO: 2733079 - RNA, 14 nt, Human
ggucugacccacug

SEQ ID NO: 2733080 - RNA, 18 nt, Human
ggugacuuuggauaauaa

SEQ ID NO: 2733081 - RNA, 14 nt, Human
ggugacuuuggaua

SEQ ID NO: 2733082 - RNA, 21 nt, Human
ggugacuuuggauaauaagga

SEQ ID NO: 2733083 - RNA, 20 nt, Human
ggugacuuuggauaauaagg

SEQ ID NO: 2733084 - RNA, 19 nt, Human
ggugacuuuggauaauaag

SEQ ID NO: 2733085 - RNA, 21 nt, Human
ggugaccucugccugaaguca

SEQ ID NO: 2733086 - RNA, 22 nt, Human
ggugaccagcaccaucucuccu

SEQ ID NO: 2733087 - RNA, 13 nt, Human
gguugagguuuca

SEQ ID NO: 2733088 - RNA, 21 nt, Human
gguucaaagauauuuugcuuu

SEQ ID NO: 2733089 - RNA, 13 nt, Human
gguucaaagauau

SEQ ID NO: 2733090 - RNA, 17 nt, Human
gguuaggcauuguggga

SEQ ID NO: 2733091 - RNA, 13 nt, Human
gguuauggagagg

SEQ ID NO: 2733092 - RNA, 20 nt, Human
gguuaucugaagucagaucu

SEQ ID NO: 2733093 - RNA, 21 nt, Human
gguuacccaguuagcucucaa

SEQ ID NO: 2733094 - RNA, 19 nt, Human
ggugucaagagggucugag

SEQ ID NO: 2733095 - RNA, 17 nt, Human
ggugucaagagggucug

SEQ ID NO: 2733096 - RNA, 16 nt, Human
gguguaugugugaagu

SEQ ID NO: 2733097 - RNA, 19 nt, Human
ggugucaccugaagacuca

SEQ ID NO: 2733098 - RNA, 21 nt, Human
ggugguuauggagaggguguc

SEQ ID NO: 2733099 - RNA, 18 nt, Human
ggugguuucagaaaugug

SEQ ID NO: 2733100 - RNA, 17 nt, Human
ggugguuucagaaaugu

SEQ ID NO: 2733101 - RNA, 18 nt, Human
ggugguuuucuguucuuu

SEQ ID NO: 2733102 - RNA, 15 nt, Human
ggugguuuucuguuc

SEQ ID NO: 2733103 - RNA, 16 nt, Human
gguggugaccucugcc

SEQ ID NO: 2733104 - RNA, 14 nt, Human
gguggugaccucug

SEQ ID NO: 2733105 - RNA, 15 nt, Human
gguggugaccucugc

SEQ ID NO: 2733106 - RNA, 11 nt, Human
ggucagagccu

SEQ ID NO: 2733107 - RNA, 15 nt, Human
ggucccaccccacac

SEQ ID NO: 2733108 - RNA, 16 nt, Human
ggucccaccccacaca

SEQ ID NO: 2733109 - RNA, 18 nt, Human
gguagcauuuguguugaa

SEQ ID NO: 2733110 - RNA, 23 nt, Human
gguagaaauaucugaaaauguau

SEQ ID NO: 2733111 - RNA, 22 nt, Human
gguagaagcccuucuaccuucc

SEQ ID NO: 2733112 - RNA, 22 nt, Human
gguagaaauaucugaaaaugua

SEQ ID NO: 2733113 - RNA, 16 nt, Human
gguacuuguggacaca

SEQ ID NO: 2733114 - RNA, 17 nt, Human
gguacuuguggacacag

SEQ ID NO: 2733115 - RNA, 11 nt, Human
gguacccacug

SEQ ID NO: 2733116 - RNA, 13 nt, Human
gguacccacugcu

SEQ ID NO: 2733117 - RNA, 19 nt, Human
gggugacagagcaagugag

SEQ ID NO: 2733118 - RNA, 17 nt, Human
gggugaagugaagacaa

SEQ ID NO: 2733119 - RNA, 22 nt, Human
ggguucaagcgauucuucugcu

SEQ ID NO: 2733120 - RNA, 23 nt, Human
ggguucaagcgauucuucugcuu

SEQ ID NO: 2733121 - RNA, 12 nt, Human
ggguucuaccca

SEQ ID NO: 2733122 - RNA, 12 nt, Human
gggucucacucu

SEQ ID NO: 2733123 - RNA, 14 nt, Human
gggucucacucugu

SEQ ID NO: 2733124 - RNA, 17 nt, Human
ggguaagugagagaggg

SEQ ID NO: 2733125 - RNA, 12 nt, Human
gggucugaggaa

SEQ ID NO: 2733126 - RNA, 21 nt, Human
gggucugaggaauccagaccc

SEQ ID NO: 2733127 - RNA, 12 nt, Human
gggguggccucc

SEQ ID NO: 2733128 - RNA, 17 nt, Human
gggguggggaccucagg

SEQ ID NO: 2733129 - RNA, 23 nt, Human
ggggcugcaccggcuggccuggc

SEQ ID NO: 2733130 - RNA, 22 nt, Human
gggggaggugggauccuccagg

SEQ ID NO: 2733131 - RNA, 19 nt, Human
ggggcugaggugggaggau

SEQ ID NO: 2733132 - RNA, 12 nt, Human
ggggcugcaccg

SEQ ID NO: 2733133 - RNA, 21 nt, Human
ggggcugcaccggcuggccug

SEQ ID NO: 2733134 - RNA, 22 nt, Human
ggggcugcaccggcuggccugg

SEQ ID NO: 2733135 - RNA, 22 nt, Human
gggcuuggggaccagagcugcc

SEQ ID NO: 2733136 - RNA, 16 nt, Human
ggggaaaaucagccug

SEQ ID NO: 2733137 - RNA, 17 nt, Human
ggggaaaaucagccugc

SEQ ID NO: 2733138 - RNA, 19 nt, Human
ggggaaaaucagccugcuc

SEQ ID NO: 2733139 - RNA, 15 nt, Human
ggggauucuuaaagu

SEQ ID NO: 2733140 - RNA, 11 nt, Human
ggggauucuua

SEQ ID NO: 2733141 - RNA, 21 nt, Human
ggggaaaaucagccugcucca

SEQ ID NO: 2733142 - RNA, 16 nt, Human
ggggcaacccugguga

SEQ ID NO: 2733143 - RNA, 17 nt, Human
ggggcugaggugggagg

SEQ ID NO: 2733144 - RNA, 19 nt, Human
uauauuuuuauauuuacua

SEQ ID NO: 2733145 - RNA, 17 nt, Human
uaucaggugcugccauc

SEQ ID NO: 2733146 - RNA, 16 nt, Human
uaucaugacaaagacu

SEQ ID NO: 2733147 - RNA, 19 nt, Human
uaucgucacugcuuaacuu

SEQ ID NO: 2733148 - RNA, 15 nt, Human
uaucuaaauguugaa

SEQ ID NO: 2733149 - RNA, 20 nt, Human
uauauuuauuacuguaagaa

SEQ ID NO: 2733150 - RNA, 23 nt, Human
uauauuuauuacuguaagaaaau

SEQ ID NO: 2733151 - RNA, 14 nt, Human
uauauuugaaauau

SEQ ID NO: 2733152 - RNA, 13 nt, Human
uauauuugaaaua

SEQ ID NO: 2733153 - RNA, 18 nt, Human
uauauuuuuauauuuacu

SEQ ID NO: 2733154 - RNA, 18 nt, Human
uauauaaguauucuaaau

SEQ ID NO: 2733155 - RNA, 16 nt, Human
uauaugcuauuucuau

SEQ ID NO: 2733156 - RNA, 18 nt, Human
uauaugcuauuucuauau

SEQ ID NO: 2733157 - RNA, 18 nt, Human
uagucaaauugugugaaa

SEQ ID NO: 2733158 - RNA, 13 nt, Human
uaguuucuccaag

SEQ ID NO: 2733159 - RNA, 12 nt, Human
uaguuugcaguu

SEQ ID NO: 2733160 - RNA, 23 nt, Human
uaguuugauuaaauucuugcaaa

SEQ ID NO: 2733161 - RNA, 15 nt, Human
uaguggauguucuga

SEQ ID NO: 2733162 - RNA, 20 nt, Human
uauaaugaaugaaacauuuu

SEQ ID NO: 2733163 - RNA, 18 nt, Human
uauaaugaaugaaacauu

SEQ ID NO: 2733164 - RNA, 17 nt, Human
uauaauucuacuuugag

SEQ ID NO: 2733165 - RNA, 21 nt, Human
uauaauucagaaggaucuuca

SEQ ID NO: 2733166 - RNA, 20 nt, Human
uauaauguaagcucuacuga

SEQ ID NO: 2733167 - RNA, 19 nt, Human
uauaauguaagcucuacug

SEQ ID NO: 2733168 - RNA, 14 nt, Human
uauaauguaagcuc

SEQ ID NO: 2733169 - RNA, 16 nt, Human
uauacccagaaaguua

SEQ ID NO: 2733170 - RNA, 15 nt, Human
uaggaagguuaaugu

SEQ ID NO: 2733171 - RNA, 13 nt, Human
uaggccuggccag

SEQ ID NO: 2733172 - RNA, 14 nt, Human
uaggccuggccaga

SEQ ID NO: 2733173 - RNA, 17 nt, Human
uaggaacacuccuucac

SEQ ID NO: 2733174 - RNA, 21 nt, Human
uaggaacuuaaauaaugugaa

SEQ ID NO: 2733175 - RNA, 13 nt, Human
uaggaacacuccu

SEQ ID NO: 2733176 - RNA, 14 nt, Human
uaggaacacuccuu

SEQ ID NO: 2733177 - RNA, 13 nt, Human
uaggaagacuuug

SEQ ID NO: 2733178 - RNA, 14 nt, Human
uaggaagacuuugg

SEQ ID NO: 2733179 - RNA, 15 nt, Human
uaggaagacuuugga

SEQ ID NO: 2733180 - RNA, 16 nt, Human
uaggaagacuuuggaa

SEQ ID NO: 2733181 - RNA, 17 nt, Human
uaggaagacuuuggaaa

SEQ ID NO: 2733182 - RNA, 16 nt, Human
uagccuaggugacaga

SEQ ID NO: 2733183 - RNA, 14 nt, Human
uagcccaaaaccaa

SEQ ID NO: 2733184 - RNA, 17 nt, Human
uagccugccucuucucu

SEQ ID NO: 2733185 - RNA, 22 nt, Human
uagcucauucuccuuguguuac

SEQ ID NO: 2733186 - RNA, 21 nt, Human
uagcucuaggagggcuggcaa

SEQ ID NO: 2733187 - RNA, 11 nt, Human
uagcugggacu

SEQ ID NO: 2733188 - RNA, 18 nt, Human
uagcugggacuacaggug

SEQ ID NO: 2733189 - RNA, 20 nt, Human
uagcugggacuacaggcacc

SEQ ID NO: 2733190 - RNA, 17 nt, Human
uagaguuuagcuggaaa

SEQ ID NO: 2733191 - RNA, 18 nt, Human
uagaguuuagcuggaaaa

SEQ ID NO: 2733192 - RNA, 15 nt, Human
uagagaguguugaaa

SEQ ID NO: 2733193 - RNA, 14 nt, Human
uagagaguguugaa

SEQ ID NO: 2733194 - RNA, 16 nt, Human
uagagagagaccacuu

SEQ ID NO: 2733195 - RNA, 21 nt, Human
uagagguucaaagauauuuug

SEQ ID NO: 2733196 - RNA, 16 nt, Human
uagagguucaaagaua

SEQ ID NO: 2733197 - RNA, 19 nt, Human
uagagguucaaagauauuu

SEQ ID NO: 2733198 - RNA, 11 nt, Human
uagagacaggg

SEQ ID NO: 2733199 - RNA, 18 nt, Human
uagacuggugacugauuc

SEQ ID NO: 2733200 - RNA, 17 nt, Human
uagacuggugacugauu

SEQ ID NO: 2733201 - RNA, 14 nt, Human
uagacuggugacug

SEQ ID NO: 2733202 - RNA, 13 nt, Human
uagacuggugacu

SEQ ID NO: 2733203 - RNA, 20 nt, Human
uagauguauguacuucaugc

SEQ ID NO: 2733204 - RNA, 16 nt, Human
uagauguauguacuuc

SEQ ID NO: 2733205 - RNA, 18 nt, Human
uagauaauacaccacuac

SEQ ID NO: 2733206 - RNA, 12 nt, Human
uagauguauaua

SEQ ID NO: 2733207 - RNA, 20 nt, Human
uagcagggcauggcugggaa

SEQ ID NO: 2733208 - RNA, 19 nt, Human
uagcagagaaugaaagggc

SEQ ID NO: 2733209 - RNA, 23 nt, Human
uagcagagaaugaaagggcccag

SEQ ID NO: 2733210 - RNA, 16 nt, Human
uagcacuuugggaggc

SEQ ID NO: 2733211 - RNA, 15 nt, Human
uacugaggugcuaug

SEQ ID NO: 2733212 - RNA, 23 nt, Human
uacugauguuccuagugaaagag

SEQ ID NO: 2733213 - RNA, 12 nt, Human
uacucccaucug

SEQ ID NO: 2733214 - RNA, 14 nt, Human
uacucccaucugug

SEQ ID NO: 2733215 - RNA, 16 nt, Human
uacucccaucugugaa

SEQ ID NO: 2733216 - RNA, 17 nt, Human
uacucccaucugugaaa

SEQ ID NO: 2733217 - RNA, 16 nt, Human
uacucagaauucucua

SEQ ID NO: 2733218 - RNA, 22 nt, Human
uacucagaauucucuaguuuga

SEQ ID NO: 2733219 - RNA, 20 nt, Human
uacuacaguccucccaucuc

SEQ ID NO: 2733220 - RNA, 20 nt, Human
uacuacaguuuguuaguaug

SEQ ID NO: 2733221 - RNA, 12 nt, Human
uacucaccucac

SEQ ID NO: 2733222 - RNA, 14 nt, Human
uacucaccucaccc

SEQ ID NO: 2733223 - RNA, 22 nt, Human
uaccuuuuuuauacauaaacaa

SEQ ID NO: 2733224 - RNA, 20 nt, Human
uacgaagaguauuuuugaca

SEQ ID NO: 2733225 - RNA, 22 nt, Human
uacgaagaguauuuuugacaga

SEQ ID NO: 2733226 - RNA, 23 nt, Human
uacgaagaguauuuuugacagaa

SEQ ID NO: 2733227 - RNA, 17 nt, Human
uacuaaccagcagaaau

SEQ ID NO: 2733228 - RNA, 18 nt, Human
uacuaaccagcagaaaug

SEQ ID NO: 2733229 - RNA, 19 nt, Human
uacuaaccagcagaaaugc

SEQ ID NO: 2733230 - RNA, 12 nt, Human
uacuacaguccu

SEQ ID NO: 2733231 - RNA, 17 nt, Human
uacuacaguccucccau

SEQ ID NO: 2733232 - RNA, 22 nt, Human
uacuaauaaaauuuaaaagucu

SEQ ID NO: 2733233 - RNA, 17 nt, Human
uacuaauagacaauuua

SEQ ID NO: 2733234 - RNA, 15 nt, Human
uacuaauagacaauu

SEQ ID NO: 2733235 - RNA, 22 nt, Human
uacccaucccauaugccugggc

SEQ ID NO: 2733236 - RNA, 18 nt, Human
uaccuuuuuuauacauaa

SEQ ID NO: 2733237 - RNA, 20 nt, Human
uaccuuuuuuauacauaaac

SEQ ID NO: 2733238 - RNA, 19 nt, Human
uaccuuuuuuauacauaaa

SEQ ID NO: 2733239 - RNA, 20 nt, Human
uaccuuuguauucucuccug

SEQ ID NO: 2733240 - RNA, 21 nt, Human
uacuguaucaugacaaagacu

SEQ ID NO: 2733241 - RNA, 17 nt, Human
uacugcauaugaaagga

SEQ ID NO: 2733242 - RNA, 14 nt, Human
uacuuguggacaca

SEQ ID NO: 2733243 - RNA, 19 nt, Human
uacuuguggacacagcucu

SEQ ID NO: 2733244 - RNA, 15 nt, Human
uacuuguggacacag

SEQ ID NO: 2733245 - RNA, 18 nt, Human
uacuuguggacacagcuc

SEQ ID NO: 2733246 - RNA, 23 nt, Human
uagaaauaucugaaaauguaugu

SEQ ID NO: 2733247 - RNA, 21 nt, Human
uagaaauaucugaaaauguau

SEQ ID NO: 2733248 - RNA, 20 nt, Human
uagaaauaucugaaaaugua

SEQ ID NO: 2733249 - RNA, 15 nt, Human
uagaaauauaauuga

SEQ ID NO: 2733250 - RNA, 17 nt, Human
uagaacagauaaucagu

SEQ ID NO: 2733251 - RNA, 23 nt, Human
uaccacaggaaccacaagacugc

SEQ ID NO: 2733252 - RNA, 23 nt, Human
uaccauuuugggguacccacugc

SEQ ID NO: 2733253 - RNA, 13 nt, Human
uaccacagacaua

SEQ ID NO: 2733254 - RNA, 11 nt, Human
uacccacugcu

SEQ ID NO: 2733255 - RNA, 12 nt, Human
uacccacugcuc

SEQ ID NO: 2733256 - RNA, 13 nt, Human
uacccacugcucu

SEQ ID NO: 2733257 - RNA, 14 nt, Human
uacccacugcucug

SEQ ID NO: 2733258 - RNA, 16 nt, Human
uacccagcgagcccug

SEQ ID NO: 2733259 - RNA, 18 nt, Human
uacccagcgagcccuggu

SEQ ID NO: 2733260 - RNA, 22 nt, Human
uacccaggugcuaggaacacuc

SEQ ID NO: 2733261 - RNA, 15 nt, Human
uacccaaauuaagag

SEQ ID NO: 2733262 - RNA, 12 nt, Human
uacccaccccca

SEQ ID NO: 2733263 - RNA, 15 nt, Human
uacccacccccaccc

SEQ ID NO: 2733264 - RNA, 23 nt, Human
uacccacccccacccaagggccu

SEQ ID NO: 2733265 - RNA, 17 nt, Human
uacccacccccacccaa

SEQ ID NO: 2733266 - RNA, 19 nt, Human
uacccacccccacccaagg

SEQ ID NO: 2733267 - RNA, 17 nt, Human
uacauuuguauaaaaua

SEQ ID NO: 2733268 - RNA, 11 nt, Human
uacauuugugu

SEQ ID NO: 2733269 - RNA, 16 nt, Human
uacauuuguauaaaau

SEQ ID NO: 2733270 - RNA, 23 nt, Human
uacauuuggagacacaacuauuu

SEQ ID NO: 2733271 - RNA, 16 nt, Human
uaccaacacgagcagg

SEQ ID NO: 2733272 - RNA, 22 nt, Human
uacauaagauaaaugugcugaa

SEQ ID NO: 2733273 - RNA, 19 nt, Human
uacauaagauaaaugugcu

SEQ ID NO: 2733274 - RNA, 18 nt, Human
uacauaagauaaaugugc

SEQ ID NO: 2733275 - RNA, 19 nt, Human
uacaguuacucagaauucu

SEQ ID NO: 2733276 - RNA, 23 nt, Human
uacaguuacucagaauucucuag

SEQ ID NO: 2733277 - RNA, 13 nt, Human
uacagaauuuuau

SEQ ID NO: 2733278 - RNA, 24 nt, Human
uacagcaaggagauuuacaacugg

SEQ ID NO: 2733279 - RNA, 13 nt, Human
uacacuuuaugca

SEQ ID NO: 2733280 - RNA, 18 nt, Human
uacagaaaaguugaauuu

SEQ ID NO: 2733281 - RNA, 22 nt, Human
uacagaaaaguugaauuuuaca

SEQ ID NO: 2733282 - RNA, 19 nt, Human
uacacuguuucaaacuuua

SEQ ID NO: 2733283 - RNA, 18 nt, Human
uacacuguuucaaacuuu

SEQ ID NO: 2733284 - RNA, 17 nt, Human
uacacuguuucaaacuu

SEQ ID NO: 2733285 - RNA, 14 nt, Human
uacaggauuugaaa

SEQ ID NO: 2733286 - RNA, 16 nt, Human
uacaggcacccaccau

SEQ ID NO: 2733287 - RNA, 19 nt, Human
uacaggaaaagcugcugac

SEQ ID NO: 2733288 - RNA, 23 nt, Human
uacagcuugaccgugaggccaga

SEQ ID NO: 2733289 - RNA, 17 nt, Human
uacaggaaaagcugcug

SEQ ID NO: 2733290 - RNA, 18 nt, Human
uacaggaaaagcugcuga

SEQ ID NO: 2733291 - RNA, 22 nt, Human
uacagcuugaccgugaggccag

SEQ ID NO: 2733292 - RNA, 21 nt, Human
uacagcuugaccgugaggcca

SEQ ID NO: 2733293 - RNA, 22 nt, Human
uacacacugcauguuugugauu

SEQ ID NO: 2733294 - RNA, 14 nt, Human
uacacuguuucaaa

SEQ ID NO: 2733295 - RNA, 16 nt, Human
uacacugugcugaguc

SEQ ID NO: 2733296 - RNA, 17 nt, Human
uacacacugcauguuug

SEQ ID NO: 2733297 - RNA, 21 nt, Human
uacacacacacgcgugcacac

SEQ ID NO: 2733298 - RNA, 15 nt, Human
uacacacacauacac

SEQ ID NO: 2733299 - RNA, 17 nt, Human
uacacaaugguuuucuu

SEQ ID NO: 2733300 - RNA, 21 nt, Human
uacacaaugguuuucuugugu

SEQ ID NO: 2733301 - RNA, 23 nt, Human
uacacaaugguuuucuugugugu

SEQ ID NO: 2733302 - RNA, 13 nt, Human
uaauuuuggaauu

SEQ ID NO: 2733303 - RNA, 12 nt, Human
uaauuuuggaau

SEQ ID NO: 2733304 - RNA, 18 nt, Human
uacaauuuuguuucugua

SEQ ID NO: 2733305 - RNA, 21 nt, Human
uacaauuuuguuucuguacuu

SEQ ID NO: 2733306 - RNA, 19 nt, Human
uacaauuuuguuucuguac

SEQ ID NO: 2733307 - RNA, 19 nt, Human
uaaugauaaguaaaugcua

SEQ ID NO: 2733308 - RNA, 11 nt, Human
uaaucuaaaug

SEQ ID NO: 2733309 - RNA, 14 nt, Human
uaauauauuuccau

SEQ ID NO: 2733310 - RNA, 12 nt, Human
uaauauuaaagc

SEQ ID NO: 2733311 - RNA, 14 nt, Human
uaauauuaaagcca

SEQ ID NO: 2733312 - RNA, 13 nt, Human
uaauauuaaagcc

SEQ ID NO: 2733313 - RNA, 15 nt, Human
uaauaauguuucaaa

SEQ ID NO: 2733314 - RNA, 23 nt, Human
uaauaauuauaugcuauuucuau

SEQ ID NO: 2733315 - RNA, 22 nt, Human
uaauaauuauaugcuauuucua

SEQ ID NO: 2733316 - RNA, 20 nt, Human
uaauaauuauaugcuauuuc

SEQ ID NO: 2733317 - RNA, 19 nt, Human
uaauaauuauaugcuauuu

SEQ ID NO: 2733318 - RNA, 16 nt, Human
uaauaauuauaugcua

SEQ ID NO: 2733319 - RNA, 15 nt, Human
uaauaauuauaugcu

SEQ ID NO: 2733320 - RNA, 21 nt, Human
uaauaguucagguaacaggca

SEQ ID NO: 2733321 - RNA, 15 nt, Human
uaauaacugugaagu

SEQ ID NO: 2733322 - RNA, 18 nt, Human
uaauaaggaaaaguuuaa

SEQ ID NO: 2733323 - RNA, 20 nt, Human
uaauaaggaaaaguuuaaua

SEQ ID NO: 2733324 - RNA, 20 nt, Human
uaagugguacuaacuuuccu

SEQ ID NO: 2733325 - RNA, 20 nt, Human
uaauuuguaguguuggagaa

SEQ ID NO: 2733326 - RNA, 18 nt, Human
uaauuugguuuucacauu

SEQ ID NO: 2733327 - RNA, 17 nt, Human
uaauuugguuuucacau

SEQ ID NO: 2733328 - RNA, 15 nt, Human
uaauuugguuuucac

SEQ ID NO: 2733329 - RNA, 23 nt, Human
uaauuuguaguguuggagaagaa

SEQ ID NO: 2733330 - RNA, 14 nt, Human
uaauuugugauaca

SEQ ID NO: 2733331 - RNA, 18 nt, Human
uaauuugugauacaaugc

SEQ ID NO: 2733332 - RNA, 15 nt, Human
uaauuugugauacaa

SEQ ID NO: 2733333 - RNA, 13 nt, Human
uaauuuuaagaaa

SEQ ID NO: 2733334 - RNA, 22 nt, Human
uaauuugugauacaaugcugug

SEQ ID NO: 2733335 - RNA, 19 nt, Human
uaauuugugauacaaugcu

SEQ ID NO: 2733336 - RNA, 22 nt, Human
uaauuggaaaggcagcucuaaa

SEQ ID NO: 2733337 - RNA, 20 nt, Human
uaauuaaaagaauauuuuaa

SEQ ID NO: 2733338 - RNA, 17 nt, Human
uaauuaaaacacaacau

SEQ ID NO: 2733339 - RNA, 23 nt, Human
uaauuaaauuuugaguucuacau

SEQ ID NO: 2733340 - RNA, 19 nt, Human
uaauuaacauguuaaacca

SEQ ID NO: 2733341 - RNA, 18 nt, Human
uaauuaacauguuaaacc

SEQ ID NO: 2733342 - RNA, 17 nt, Human
uaauuaacauguuaaac

SEQ ID NO: 2733343 - RNA, 15 nt, Human
uaauuaacauguuaa

SEQ ID NO: 2733344 - RNA, 14 nt, Human
uaauuaacauguua

SEQ ID NO: 2733345 - RNA, 12 nt, Human
uaauuaacaugu

SEQ ID NO: 2733346 - RNA, 15 nt, Human
uaauguuucaaacau

SEQ ID NO: 2733347 - RNA, 14 nt, Human
uaauguuucaaaca

SEQ ID NO: 2733348 - RNA, 14 nt, Human
uaaugcgugcauac

SEQ ID NO: 2733349 - RNA, 18 nt, Human
uaauucuuagcucauucu

SEQ ID NO: 2733350 - RNA, 22 nt, Human
uaauugacaggauuauuggaaa

SEQ ID NO: 2733351 - RNA, 20 nt, Human
uaauugacaggauuauugga

SEQ ID NO: 2733352 - RNA, 19 nt, Human
uaacaaugcuguauuuuaa

SEQ ID NO: 2733353 - RNA, 14 nt, Human
uaaauuuaguauuu

SEQ ID NO: 2733354 - RNA, 19 nt, Human
uaaaucccauuauucaaag

SEQ ID NO: 2733355 - RNA, 17 nt, Human
uaaaucccauuauucaa

SEQ ID NO: 2733356 - RNA, 16 nt, Human
uaaaucccauuauuca

SEQ ID NO: 2733357 - RNA, 23 nt, Human
uaaauccauuuggaaaucuuuaa

SEQ ID NO: 2733358 - RNA, 22 nt, Human
uaaauccauuuggaaaucuuua

SEQ ID NO: 2733359 - RNA, 19 nt, Human
uaaauccauuuggaaaucu

SEQ ID NO: 2733360 - RNA, 18 nt, Human
uaaauccauuuggaaauc

SEQ ID NO: 2733361 - RNA, 12 nt, Human
uaacagaaaugu

SEQ ID NO: 2733362 - RNA, 15 nt, Human
uaacagaaauguaca

SEQ ID NO: 2733363 - RNA, 14 nt, Human
uaacagaaauguac

SEQ ID NO: 2733364 - RNA, 13 nt, Human
uaacagaaaugua

SEQ ID NO: 2733365 - RNA, 20 nt, Human
uaacuuuuauaaacuuuacc

SEQ ID NO: 2733366 - RNA, 19 nt, Human
uaaccagcagaaaugccuu

SEQ ID NO: 2733367 - RNA, 16 nt, Human
uaaccagcagaaaugc

SEQ ID NO: 2733368 - RNA, 14 nt, Human
uaaccagcagaaau

SEQ ID NO: 2733369 - RNA, 18 nt, Human
uaacauguuaaaccaugg

SEQ ID NO: 2733370 - RNA, 19 nt, Human
uaacaggcagauacaggaa

SEQ ID NO: 2733371 - RNA, 17 nt, Human
uaacauguuaaaccaug

SEQ ID NO: 2733372 - RNA, 16 nt, Human
uaacauguuaaaccau

SEQ ID NO: 2733373 - RNA, 23 nt, Human
uaagagggauuagggagagaaga

SEQ ID NO: 2733374 - RNA, 23 nt, Human
uaagagggagggagggcuccaga

SEQ ID NO: 2733375 - RNA, 12 nt, Human
uaagagggaggg

SEQ ID NO: 2733376 - RNA, 22 nt, Human
uaagagggagggagggcuccag

SEQ ID NO: 2733377 - RNA, 14 nt, Human
uaagauaaaugugc

SEQ ID NO: 2733378 - RNA, 17 nt, Human
uaagauaaaugugcuga

SEQ ID NO: 2733379 - RNA, 16 nt, Human
uaagauaaaugugcug

SEQ ID NO: 2733380 - RNA, 23 nt, Human
uaagagagaaugagagacacacu

SEQ ID NO: 2733381 - RNA, 17 nt, Human
uaagagagucuauuuac

SEQ ID NO: 2733382 - RNA, 22 nt, Human
uaagaggcagggucucacucug

SEQ ID NO: 2733383 - RNA, 22 nt, Human
uaagaaccuuuugagugccuua

SEQ ID NO: 2733384 - RNA, 24 nt, Human
uaagaaagacuaucuaaauguuga

SEQ ID NO: 2733385 - RNA, 19 nt, Human
uaacuuuuauaaacuuuac

SEQ ID NO: 2733386 - RNA, 13 nt, Human
uaacugugaaguu

SEQ ID NO: 2733387 - RNA, 22 nt, Human
uaacuuuuauaaacuuuaccuu

SEQ ID NO: 2733388 - RNA, 21 nt, Human
uaacuuuuauaaacuuuaccu

SEQ ID NO: 2733389 - RNA, 20 nt, Human
uaagcauuccaacuaucuca

SEQ ID NO: 2733390 - RNA, 16 nt, Human
uaagcauuccaacuau

SEQ ID NO: 2733391 - RNA, 18 nt, Human
uaagcauuccaacuaucu

SEQ ID NO: 2733392 - RNA, 23 nt, Human
uaagcauauauuuuuauauuuac

SEQ ID NO: 2733393 - RNA, 16 nt, Human
uaagcauauauuuuua

SEQ ID NO: 2733394 - RNA, 19 nt, Human
uaagcauauauuuuuauau

SEQ ID NO: 2733395 - RNA, 22 nt, Human
uaagcauauauuuuuauauuua

SEQ ID NO: 2733396 - RNA, 21 nt, Human
uaagcauauauuuuuauauuu

SEQ ID NO: 2733397 - RNA, 19 nt, Human
uaaggaugcuuguacauaa

SEQ ID NO: 2733398 - RNA, 18 nt, Human
uaaggaugcuuguacaua

SEQ ID NO: 2733399 - RNA, 23 nt, Human
uaaggaugcuuguacauaaugcg

SEQ ID NO: 2733400 - RNA, 22 nt, Human
uaaggaugcuuguacauaaugc

SEQ ID NO: 2733401 - RNA, 21 nt, Human
uaaggaugcuuguacauaaug

SEQ ID NO: 2733402 - RNA, 20 nt, Human
uaaggaugcuuguacauaau

SEQ ID NO: 2733403 - RNA, 13 nt, Human
guuuagcaguaua

SEQ ID NO: 2733404 - RNA, 18 nt, Human
guuuagucuugucucaga

SEQ ID NO: 2733405 - RNA, 14 nt, Human
guuuagucuugucu

SEQ ID NO: 2733406 - RNA, 18 nt, Human
gguuggcaaaaaggcagg

SEQ ID NO: 2733407 - RNA, 21 nt, Human
gguuggccccugcccggcugc

SEQ ID NO: 2733408 - RNA, 16 nt, Human
guuuccuggcacugcu

SEQ ID NO: 2733409 - RNA, 20 nt, Human
guuuccuggcacugcuucca

SEQ ID NO: 2733410 - RNA, 21 nt, Human
guuuccuggcacugcuuccag

SEQ ID NO: 2733411 - RNA, 22 nt, Human
guuuccuggcacugcuuccagu

SEQ ID NO: 2733412 - RNA, 18 nt, Human
guuucagaaauguguuau

SEQ ID NO: 2733413 - RNA, 14 nt, Human
guuucagaaaugug

SEQ ID NO: 2733414 - RNA, 23 nt, Human
guuugugcugguguaugugugaa

SEQ ID NO: 2733415 - RNA, 17 nt, Human
guuuguaaauuaacuuu

SEQ ID NO: 2733416 - RNA, 19 nt, Human
guuuguaaauuaacuuuua

SEQ ID NO: 2733417 - RNA, 22 nt, Human
guuugauuaaauucuugcaaag

SEQ ID NO: 2733418 - RNA, 19 nt, Human
guuugauuaaauucuugca

SEQ ID NO: 2733419 - RNA, 17 nt, Human
guuugauuaaauucuug

SEQ ID NO: 2733420 - RNA, 20 nt, Human
guuucuaaagcugccagccg

SEQ ID NO: 2733421 - RNA, 16 nt, Human
guuucuaaagcugcca

SEQ ID NO: 2733422 - RNA, 14 nt, Human
guuucuaaagcugc

SEQ ID NO: 2733423 - RNA, 15 nt, Human
guuucuaaagcugcc

SEQ ID NO: 2733424 - RNA, 18 nt, Human
guuugagaucagccuggg

SEQ ID NO: 2733425 - RNA, 16 nt, Human
guuugaaccaagaacu

SEQ ID NO: 2733426 - RNA, 16 nt, Human
uaaaaaagaaacauuu

SEQ ID NO: 2733427 - RNA, 20 nt, Human
uaaaaaacugcugacuguuu

SEQ ID NO: 2733428 - RNA, 23 nt, Human
uaaaaaacugcugacuguuuucu

SEQ ID NO: 2733429 - RNA, 18 nt, Human
guuuucaggcuagaugua

SEQ ID NO: 2733430 - RNA, 16 nt, Human
guuuucaguguacaug

SEQ ID NO: 2733431 - RNA, 17 nt, Human
guuuucaguguacaugg

SEQ ID NO: 2733432 - RNA, 12 nt, Human
guuuguuuaguc

SEQ ID NO: 2733433 - RNA, 16 nt, Human
guuuucauuaucucaa

SEQ ID NO: 2733434 - RNA, 12 nt, Human
guuuucucuuga

SEQ ID NO: 2733435 - RNA, 19 nt, Human
guuuucucuugagagggug

SEQ ID NO: 2733436 - RNA, 19 nt, Human
guuuuuauggcuuuugugc

SEQ ID NO: 2733437 - RNA, 23 nt, Human
guuuuuauggcuuuugugcauua

SEQ ID NO: 2733438 - RNA, 22 nt, Human
guuuuuauggcuuuugugcauu

SEQ ID NO: 2733439 - RNA, 14 nt, Human
uaaaagaugaaaau

SEQ ID NO: 2733440 - RNA, 19 nt, Human
uaaaauccauacauuugug

SEQ ID NO: 2733441 - RNA, 18 nt, Human
uaaaauccauacauuugu

SEQ ID NO: 2733442 - RNA, 17 nt, Human
uaaaauggguuuuacug

SEQ ID NO: 2733443 - RNA, 18 nt, Human
uaaacaagaccacguuuc

SEQ ID NO: 2733444 - RNA, 23 nt, Human
uaaacaagaccacguuucuaaag

SEQ ID NO: 2733445 - RNA, 22 nt, Human
uaaacuuuaccuuuuuuauaca

SEQ ID NO: 2733446 - RNA, 16 nt, Human
uaaacuuuaccuuuuu

SEQ ID NO: 2733447 - RNA, 19 nt, Human
uaaacuuaaucuaaaugga

SEQ ID NO: 2733448 - RNA, 18 nt, Human
uaaacuuaaucuaaaugg

SEQ ID NO: 2733449 - RNA, 13 nt, Human
uaaacuuaaucua

SEQ ID NO: 2733450 - RNA, 14 nt, Human
uaaacuuaaucuaa

SEQ ID NO: 2733451 - RNA, 14 nt, Human
uaaaggaauuuaaa

SEQ ID NO: 2733452 - RNA, 15 nt, Human
uaaacuuuucugaua

SEQ ID NO: 2733453 - RNA, 14 nt, Human
uaaacuuuucugau

SEQ ID NO: 2733454 - RNA, 13 nt, Human
uaaacuuuucuga

SEQ ID NO: 2733455 - RNA, 17 nt, Human
uaaauaaaaauaauccu

SEQ ID NO: 2733456 - RNA, 13 nt, Human
uaaaguuucuguu

SEQ ID NO: 2733457 - RNA, 21 nt, Human
uaaaguguauuuuuuuacuaa

SEQ ID NO: 2733458 - RNA, 23 nt, Human
uaaaguguauuuuuuuacuaaua

SEQ ID NO: 2733459 - RNA, 22 nt, Human
uaaaguguauuuuuuuacuaau

SEQ ID NO: 2733460 - RNA, 20 nt, Human
uaaaguguauuuuuuuacua

SEQ ID NO: 2733461 - RNA, 13 nt, Human
uaaaguugaauuu

SEQ ID NO: 2733462 - RNA, 15 nt, Human
uaaaguugaauuuau

SEQ ID NO: 2733463 - RNA, 14 nt, Human
uaaaguugaauuua

SEQ ID NO: 2733464 - RNA, 23 nt, Human
uaaaguugaauuuauuggcuuuu

SEQ ID NO: 2733465 - RNA, 21 nt, Human
uaaaguugaauuuauuggcuu

SEQ ID NO: 2733466 - RNA, 19 nt, Human
uaaaguugaauuuauuggc

SEQ ID NO: 2733467 - RNA, 17 nt, Human
uaaaguugaauuuauug

SEQ ID NO: 2733468 - RNA, 18 nt, Human
uaaauauaugcuaagucu

SEQ ID NO: 2733469 - RNA, 22 nt, Human
uaaauaaaccucaaaaugucua

SEQ ID NO: 2733470 - RNA, 14 nt, Human
uaaauccauuugga

SEQ ID NO: 2733471 - RNA, 16 nt, Human
uaaauccauuuggaaa

SEQ ID NO: 2733472 - RNA, 15 nt, Human
uaaauccauuuggaa

SEQ ID NO: 2733473 - RNA, 19 nt, Human
uaaaucagccguguaacca

SEQ ID NO: 2733474 - RNA, 21 nt, Human
uauuucuaugaaauauuaugu

SEQ ID NO: 2733475 - RNA, 22 nt, Human
uauuucuaugaaauauuauguu

SEQ ID NO: 2733476 - RNA, 23 nt, Human
uauuuauuaaaugcccagccccu

SEQ ID NO: 2733477 - RNA, 15 nt, Human
uaucugaggaauucu

SEQ ID NO: 2733478 - RNA, 18 nt, Human
uaucugaagucagaucug

SEQ ID NO: 2733479 - RNA, 17 nt, Human
uaucugaagucagaucu

SEQ ID NO: 2733480 - RNA, 20 nt, Human
uaucugaaaauguaugugua

SEQ ID NO: 2733481 - RNA, 15 nt, Human
uaucugaaaauguau

SEQ ID NO: 2733482 - RNA, 14 nt, Human
uaucugaaaaugua

SEQ ID NO: 2733483 - RNA, 18 nt, Human
uauuugagaguucuaaau

SEQ ID NO: 2733484 - RNA, 19 nt, Human
uauuugagaguucuaaauu

SEQ ID NO: 2733485 - RNA, 15 nt, Human
uauuugagaguucua

SEQ ID NO: 2733486 - RNA, 16 nt, Human
uauuugagaguucuaa

SEQ ID NO: 2733487 - RNA, 13 nt, Human
ucaaaacugcacu

SEQ ID NO: 2733488 - RNA, 22 nt, Human
ucaaaacgguuuuacugcagcu

SEQ ID NO: 2733489 - RNA, 14 nt, Human
ucaaacucuuaaaa

SEQ ID NO: 2733490 - RNA, 17 nt, Human
uauuuuuuucugaaauu

SEQ ID NO: 2733491 - RNA, 16 nt, Human
uauuuuuuucugaaau

SEQ ID NO: 2733492 - RNA, 15 nt, Human
uauuuuuuuacuaau

SEQ ID NO: 2733493 - RNA, 12 nt, Human
uauuuuaugauc

SEQ ID NO: 2733494 - RNA, 19 nt, Human
ucaacuccaaacugacucu

SEQ ID NO: 2733495 - RNA, 13 nt, Human
ucaaccuccuggg

SEQ ID NO: 2733496 - RNA, 14 nt, Human
ucaaccuccugggc

SEQ ID NO: 2733497 - RNA, 16 nt, Human
ucaaacuuuacuaugg

SEQ ID NO: 2733498 - RNA, 22 nt, Human
ucaaacucuugaccucagguga

SEQ ID NO: 2733499 - RNA, 13 nt, Human
ucaaacuuuacua

SEQ ID NO: 2733500 - RNA, 15 nt, Human
ucaaacuuuacuaug

SEQ ID NO: 2733501 - RNA, 16 nt, Human
ucaagcgauucuucug

SEQ ID NO: 2733502 - RNA, 20 nt, Human
ucaaggauccugagccagau

SEQ ID NO: 2733503 - RNA, 22 nt, Human
ucaagugauucuccugccucag

SEQ ID NO: 2733504 - RNA, 18 nt, Human
ucaaggauccugagccag

SEQ ID NO: 2733505 - RNA, 19 nt, Human
ucaaggauccugagccaga

SEQ ID NO: 2733506 - RNA, 23 nt, Human
ucacaggacagcccuucuuucca

SEQ ID NO: 2733507 - RNA, 11 nt, Human
ucacaggcagg

SEQ ID NO: 2733508 - RNA, 21 nt, Human
ucacacaugagcaucaggcca

SEQ ID NO: 2733509 - RNA, 22 nt, Human
ucacacagugagucgaggacag

SEQ ID NO: 2733510 - RNA, 23 nt, Human
ucacacagugagucgaggacagg

SEQ ID NO: 2733511 - RNA, 21 nt, Human
ucacacaguauuacuucugcu

SEQ ID NO: 2733512 - RNA, 22 nt, Human
ucacacaguauuacuucugcua

SEQ ID NO: 2733513 - RNA, 13 nt, Human
ucacacagugagu

SEQ ID NO: 2733514 - RNA, 19 nt, Human
ucaauuacaggaaguacug

SEQ ID NO: 2733515 - RNA, 13 nt, Human
ucaauaggaaaaa

SEQ ID NO: 2733516 - RNA, 14 nt, Human
ucaaugcacugaca

SEQ ID NO: 2733517 - RNA, 14 nt, Human
ucaauaggaaaaac

SEQ ID NO: 2733518 - RNA, 18 nt, Human
ucaaugcacugacauugu

SEQ ID NO: 2733519 - RNA, 22 nt, Human
ucaaugccccugaauuuaaaua

SEQ ID NO: 2733520 - RNA, 13 nt, Human
ucaauuacaggaa

SEQ ID NO: 2733521 - RNA, 18 nt, Human
ucaauuacaggaaguacu

SEQ ID NO: 2733522 - RNA, 19 nt, Human
ucagacagcugccugggau

SEQ ID NO: 2733523 - RNA, 20 nt, Human
ucagacagcugccugggauc

SEQ ID NO: 2733524 - RNA, 15 nt, Human
ucagacagcugccug

SEQ ID NO: 2733525 - RNA, 16 nt, Human
ucagacagcugccugg

SEQ ID NO: 2733526 - RNA, 17 nt, Human
ucagacagcugccuggg

SEQ ID NO: 2733527 - RNA, 18 nt, Human
ucagacagcugccuggga

SEQ ID NO: 2733528 - RNA, 18 nt, Human
ucagcacgauuucuguuu

SEQ ID NO: 2733529 - RNA, 19 nt, Human
ucagcacgauuucuguuua

SEQ ID NO: 2733530 - RNA, 17 nt, Human
ucacuugucaauaaaau

SEQ ID NO: 2733531 - RNA, 19 nt, Human
ucacucugucgcccagucu

SEQ ID NO: 2733532 - RNA, 12 nt, Human
ucacucugucgc

SEQ ID NO: 2733533 - RNA, 16 nt, Human
ucacucugucgcccag

SEQ ID NO: 2733534 - RNA, 20 nt, Human
ucacugcuuaacuucacaua

SEQ ID NO: 2733535 - RNA, 18 nt, Human
ucacugcuuaacuucaca

SEQ ID NO: 2733536 - RNA, 17 nt, Human
ucacugcuuaacuucac

SEQ ID NO: 2733537 - RNA, 15 nt, Human
ucacugcuuaacuuc

SEQ ID NO: 2733538 - RNA, 19 nt, Human
ucagaaaauauuauguguu

SEQ ID NO: 2733539 - RNA, 20 nt, Human
ucagaaaauauuauguguuu

SEQ ID NO: 2733540 - RNA, 17 nt, Human
ucagaaaauauuaugug

SEQ ID NO: 2733541 - RNA, 14 nt, Human
ucacggaagagccu

SEQ ID NO: 2733542 - RNA, 16 nt, Human
ucacggaagagccuug

SEQ ID NO: 2733543 - RNA, 17 nt, Human
ucacggaagagccuugc

SEQ ID NO: 2733544 - RNA, 13 nt, Human
ucacggcucacug

SEQ ID NO: 2733545 - RNA, 15 nt, Human
ucacggcucacugca

SEQ ID NO: 2733546 - RNA, 20 nt, Human
ucacggcucacugcagccuc

SEQ ID NO: 2733547 - RNA, 13 nt, Human
ucacuccuugaaa

SEQ ID NO: 2733548 - RNA, 18 nt, Human
ucacucuccauuuaauaa

SEQ ID NO: 2733549 - RNA, 12 nt, Human
ucacucuccuug

SEQ ID NO: 2733550 - RNA, 14 nt, Human
ucacucuccuuggu

SEQ ID NO: 2733551 - RNA, 23 nt, Human
ucacucuccuuggugucgggcau

SEQ ID NO: 2733552 - RNA, 12 nt, Human
ucacucuggcag

SEQ ID NO: 2733553 - RNA, 13 nt, Human
ucacucuggcagc

SEQ ID NO: 2733554 - RNA, 14 nt, Human
ucacucuggcagcu

SEQ ID NO: 2733555 - RNA, 15 nt, Human
ucacucuggcagcuc

SEQ ID NO: 2733556 - RNA, 16 nt, Human
ucacucuggcagcuca

SEQ ID NO: 2733557 - RNA, 17 nt, Human
ucacucuggcagcucag

SEQ ID NO: 2733558 - RNA, 18 nt, Human
ucacucuggcagcucaga

SEQ ID NO: 2733559 - RNA, 19 nt, Human
ucacucuggcagcucagag

SEQ ID NO: 2733560 - RNA, 20 nt, Human
ucacucuggcagcucagaga

SEQ ID NO: 2733561 - RNA, 22 nt, Human
ucacucuggcagcucagagagg

SEQ ID NO: 2733562 - RNA, 19 nt, Human
ucacgccuguaauccuagc

SEQ ID NO: 2733563 - RNA, 20 nt, Human
ucacgccuguaauccuagca

SEQ ID NO: 2733564 - RNA, 16 nt, Human
ucacgccacugcacua

SEQ ID NO: 2733565 - RNA, 13 nt, Human
ucacgccacugca

SEQ ID NO: 2733566 - RNA, 14 nt, Human
ucacgccacugcac

SEQ ID NO: 2733567 - RNA, 22 nt, Human
ucaccuuuguccccaccgcaga

SEQ ID NO: 2733568 - RNA, 14 nt, Human
ucaccuuugucccc

SEQ ID NO: 2733569 - RNA, 15 nt, Human
ucaccuuugucccca

SEQ ID NO: 2733570 - RNA, 17 nt, Human
ucaccuuuguccccacc

SEQ ID NO: 2733571 - RNA, 18 nt, Human
ucaccuuuguccccaccg

SEQ ID NO: 2733572 - RNA, 14 nt, Human
ucaccuuucccauc

SEQ ID NO: 2733573 - RNA, 12 nt, Human
ucaccuuugucc

SEQ ID NO: 2733574 - RNA, 19 nt, Human
ucacaggcagguccagggu

SEQ ID NO: 2733575 - RNA, 12 nt, Human
ucacaggcaggu

SEQ ID NO: 2733576 - RNA, 15 nt, Human
ucacaggcaggucca

SEQ ID NO: 2733577 - RNA, 16 nt, Human
ucccaaauuucauacc

SEQ ID NO: 2733578 - RNA, 13 nt, Human
ucccaacucaccc

SEQ ID NO: 2733579 - RNA, 16 nt, Human
ucccaacucaccccag

SEQ ID NO: 2733580 - RNA, 14 nt, Human
ucccaacucacccc

SEQ ID NO: 2733581 - RNA, 15 nt, Human
ucccaacucacccca

SEQ ID NO: 2733582 - RNA, 17 nt, Human
ucccaagcucugcuccu

SEQ ID NO: 2733583 - RNA, 12 nt, Human
ucccaagcucug

SEQ ID NO: 2733584 - RNA, 13 nt, Human
ucccaagcucugc

SEQ ID NO: 2733585 - RNA, 14 nt, Human
ucccaagcucugcu

SEQ ID NO: 2733586 - RNA, 15 nt, Human
ucccaagcucugcuc

SEQ ID NO: 2733587 - RNA, 23 nt, Human
uccagcucaccagccccagugcc

SEQ ID NO: 2733588 - RNA, 13 nt, Human
uccauggacuuug

SEQ ID NO: 2733589 - RNA, 14 nt, Human
uccauggacuuugu

SEQ ID NO: 2733590 - RNA, 15 nt, Human
uccauggacuuuguu

SEQ ID NO: 2733591 - RNA, 21 nt, Human
ucccaaagugcugggauuaca

SEQ ID NO: 2733592 - RNA, 13 nt, Human
ucccaccucagcc

SEQ ID NO: 2733593 - RNA, 14 nt, Human
ucccaccucagccu

SEQ ID NO: 2733594 - RNA, 15 nt, Human
ucccaccucagccuc

SEQ ID NO: 2733595 - RNA, 20 nt, Human
ucccaggcauuccccaggag

SEQ ID NO: 2733596 - RNA, 21 nt, Human
ucccaggcauuccccaggagg

SEQ ID NO: 2733597 - RNA, 22 nt, Human
ucccaggcauuccccaggaggc

SEQ ID NO: 2733598 - RNA, 23 nt, Human
ucccaucucacacaugagcauca

SEQ ID NO: 2733599 - RNA, 20 nt, Human
ucccaucucacacaugagca

SEQ ID NO: 2733600 - RNA, 22 nt, Human
uccccacuugagaauuacccuu

SEQ ID NO: 2733601 - RNA, 17 nt, Human
ucccucccuccaccucc

SEQ ID NO: 2733602 - RNA, 17 nt, Human
ucccucccucuuucccu

SEQ ID NO: 2733603 - RNA, 15 nt, Human
ucccucccucuuucc

SEQ ID NO: 2733604 - RNA, 15 nt, Human
ucccuacuguaauuu

SEQ ID NO: 2733605 - RNA, 19 nt, Human
uccccuguagagugggagc

SEQ ID NO: 2733606 - RNA, 24 nt, Human
uccccugcuggguguggcgcagca

SEQ ID NO: 2733607 - RNA, 22 nt, Human
uccccuguagagugggagcuga

SEQ ID NO: 2733608 - RNA, 23 nt, Human
uccccuguccccgcacugggcuu

SEQ ID NO: 2733609 - RNA, 14 nt, Human
uccccugcugggug

SEQ ID NO: 2733610 - RNA, 15 nt, Human
uccccugcugggugu

SEQ ID NO: 2733611 - RNA, 20 nt, Human
uccccugcuggguguggcgc

SEQ ID NO: 2733612 - RNA, 21 nt, Human
uccccugcuggguguggcgca

SEQ ID NO: 2733613 - RNA, 13 nt, Human
uccccaggaggcc

SEQ ID NO: 2733614 - RNA, 20 nt, Human
uccccgcacugggcuugggg

SEQ ID NO: 2733615 - RNA, 21 nt, Human
ucccccuuccauggacuuugu

SEQ ID NO: 2733616 - RNA, 17 nt, Human
uccaagcauuuagaugu

SEQ ID NO: 2733617 - RNA, 23 nt, Human
uccaagcauaccaacacgagcag

SEQ ID NO: 2733618 - RNA, 19 nt, Human
uccaagaccuucuccuuca

SEQ ID NO: 2733619 - RNA, 20 nt, Human
uccaagaagcccaggaaagg

SEQ ID NO: 2733620 - RNA, 22 nt, Human
uccaagaagcccaggaaaggcu

SEQ ID NO: 2733621 - RNA, 14 nt, Human
uccaagaauuucua

SEQ ID NO: 2733622 - RNA, 14 nt, Human
ucauuucuuugagu

SEQ ID NO: 2733623 - RNA, 22 nt, Human
ucauuucugcaucagcugcuga

SEQ ID NO: 2733624 - RNA, 16 nt, Human
ucauuucugcaucagc

SEQ ID NO: 2733625 - RNA, 22 nt, Human
ucauucagauaugauucaaaug

SEQ ID NO: 2733626 - RNA, 12 nt, Human
uccaaagaaaug

SEQ ID NO: 2733627 - RNA, 23 nt, Human
uccaaacugacucuuaagaagac

SEQ ID NO: 2733628 - RNA, 17 nt, Human
uccaaaauaaaacuuuu

SEQ ID NO: 2733629 - RNA, 16 nt, Human
uccaaaauaaaacuuu

SEQ ID NO: 2733630 - RNA, 23 nt, Human
uccaccucccugcaauaaaaugg

SEQ ID NO: 2733631 - RNA, 12 nt, Human
uccaccugccag

SEQ ID NO: 2733632 - RNA, 12 nt, Human
uccaccucccug

SEQ ID NO: 2733633 - RNA, 20 nt, Human
uccaagcauuuagauguaua

SEQ ID NO: 2733634 - RNA, 22 nt, Human
uccaagcaggacauggacaagg

SEQ ID NO: 2733635 - RNA, 14 nt, Human
uccacaagagccca

SEQ ID NO: 2733636 - RNA, 14 nt, Human
uccagauccuggaa

SEQ ID NO: 2733637 - RNA, 16 nt, Human
uccagauccuggaaau

SEQ ID NO: 2733638 - RNA, 17 nt, Human
uccagauccuggaaauc

SEQ ID NO: 2733639 - RNA, 20 nt, Human
uccagcagauuauucacuga

SEQ ID NO: 2733640 - RNA, 17 nt, Human
uccagcagauuauucac

SEQ ID NO: 2733641 - RNA, 22 nt, Human
uccagcagauuauucacugauu

SEQ ID NO: 2733642 - RNA, 13 nt, Human
uccaccugccagg

SEQ ID NO: 2733643 - RNA, 16 nt, Human
ucauuaggugugacug

SEQ ID NO: 2733644 - RNA, 22 nt, Human
ucauuaggugugacugaauuuc

SEQ ID NO: 2733645 - RNA, 21 nt, Human
ucauuaggugugacugaauuu

SEQ ID NO: 2733646 - RNA, 18 nt, Human
ucauuaggugugacugaa

SEQ ID NO: 2733647 - RNA, 13 nt, Human
ucauuauuuuauu

SEQ ID NO: 2733648 - RNA, 15 nt, Human
ucauuauuuuauuau

SEQ ID NO: 2733649 - RNA, 14 nt, Human
ucauuauuuuauua

SEQ ID NO: 2733650 - RNA, 19 nt, Human
ucauuauuuuauuaugaaa

SEQ ID NO: 2733651 - RNA, 18 nt, Human
ucauuauuuuauuaugaa

SEQ ID NO: 2733652 - RNA, 16 nt, Human
ucauuauuuuauuaug

SEQ ID NO: 2733653 - RNA, 20 nt, Human
ucauacccacccccacccaa

SEQ ID NO: 2733654 - RNA, 14 nt, Human
ucauacccaccccc

SEQ ID NO: 2733655 - RNA, 15 nt, Human
ucauacccaccccca

SEQ ID NO: 2733656 - RNA, 13 nt, Human
ucaguuguacagu

SEQ ID NO: 2733657 - RNA, 13 nt, Human
ucauaaugacuua

SEQ ID NO: 2733658 - RNA, 13 nt, Human
ucauacauuguac

SEQ ID NO: 2733659 - RNA, 15 nt, Human
ucauacauuguacga

SEQ ID NO: 2733660 - RNA, 13 nt, Human
ucauacccacccc

SEQ ID NO: 2733661 - RNA, 16 nt, Human
ucauacauuguacgaa

SEQ ID NO: 2733662 - RNA, 15 nt, Human
ucauaauuuauacag

SEQ ID NO: 2733663 - RNA, 15 nt, Human
ucagucuggcccuuc

SEQ ID NO: 2733664 - RNA, 24 nt, Human
ucagucugauucccaagcucugcu

SEQ ID NO: 2733665 - RNA, 17 nt, Human
ucagugugacugaucuc

SEQ ID NO: 2733666 - RNA, 13 nt, Human
ucagugugacuga

SEQ ID NO: 2733667 - RNA, 11 nt, Human
ucaguguacau

SEQ ID NO: 2733668 - RNA, 23 nt, Human
ucagugguuggcaauuguuucaa

SEQ ID NO: 2733669 - RNA, 16 nt, Human
ucugaaaauguaugug

SEQ ID NO: 2733670 - RNA, 15 nt, Human
ucucuuuucaaaaca

SEQ ID NO: 2733671 - RNA, 16 nt, Human
ucucuuuucaaaacau

SEQ ID NO: 2733672 - RNA, 14 nt, Human
ucugaaauuuccug

SEQ ID NO: 2733673 - RNA, 14 nt, Human
ucugaaaauguaug

SEQ ID NO: 2733674 - RNA, 23 nt, Human
ucugaaaauguauguguaaguau

SEQ ID NO: 2733675 - RNA, 13 nt, Human
ucugaaagggacg

SEQ ID NO: 2733676 - RNA, 14 nt, Human
ucugacccaugcug

SEQ ID NO: 2733677 - RNA, 21 nt, Human
ucugaacuuggcgcugccccu

SEQ ID NO: 2733678 - RNA, 20 nt, Human
ucugaacuuggcgcugcccc

SEQ ID NO: 2733679 - RNA, 15 nt, Human
ucugacccaugcugc

SEQ ID NO: 2733680 - RNA, 16 nt, Human
ucugacccaugcugcc

SEQ ID NO: 2733681 - RNA, 17 nt, Human
ucugacccaugcugccc

SEQ ID NO: 2733682 - RNA, 18 nt, Human
ucugacccaugcugcccu

SEQ ID NO: 2733683 - RNA, 19 nt, Human
ucugcacaagcugcacccu

SEQ ID NO: 2733684 - RNA, 14 nt, Human
ucugcacaagcugc

SEQ ID NO: 2733685 - RNA, 23 nt, Human
ucugauucccaagcucugcuccu

SEQ ID NO: 2733686 - RNA, 19 nt, Human
ucugaggaauucuguauag

SEQ ID NO: 2733687 - RNA, 20 nt, Human
ucugaggaauucuguauaga

SEQ ID NO: 2733688 - RNA, 20 nt, Human
ucugaggacacuaaccacgc

SEQ ID NO: 2733689 - RNA, 23 nt, Human
ucugaggacacuaaccacgcugg

SEQ ID NO: 2733690 - RNA, 16 nt, Human
ucugaggaauccagac

SEQ ID NO: 2733691 - RNA, 17 nt, Human
ucugaggaauccagacc

SEQ ID NO: 2733692 - RNA, 13 nt, Human
ucucuaggaaaua

SEQ ID NO: 2733693 - RNA, 19 nt, Human
ucucuaggaaauauuuauu

SEQ ID NO: 2733694 - RNA, 19 nt, Human
ucucuaguuugauuaaauu

SEQ ID NO: 2733695 - RNA, 18 nt, Human
ucucuaguuugauuaaau

SEQ ID NO: 2733696 - RNA, 21 nt, Human
ucuccugggcagcugccuccc

SEQ ID NO: 2733697 - RNA, 19 nt, Human
ucuccugggcagcugccuc

SEQ ID NO: 2733698 - RNA, 20 nt, Human
ucuccugggcagcugccucc

SEQ ID NO: 2733699 - RNA, 15 nt, Human
ucucuacaaaaagca

SEQ ID NO: 2733700 - RNA, 13 nt, Human
ucuccuguaccuc

SEQ ID NO: 2733701 - RNA, 13 nt, Human
ucucugaggacac

SEQ ID NO: 2733702 - RNA, 14 nt, Human
ucucccccagcccc

SEQ ID NO: 2733703 - RNA, 15 nt, Human
ucucccccagcccca

SEQ ID NO: 2733704 - RNA, 17 nt, Human
ucucccccagccccauc

SEQ ID NO: 2733705 - RNA, 22 nt, Human
ucucccccagccccauccucug

SEQ ID NO: 2733706 - RNA, 13 nt, Human
ucucccccagccc

SEQ ID NO: 2733707 - RNA, 18 nt, Human
ucucccccagccccaucc

SEQ ID NO: 2733708 - RNA, 20 nt, Human
ucucccccagccccauccuc

SEQ ID NO: 2733709 - RNA, 14 nt, Human
ucuccugggcagcu

SEQ ID NO: 2733710 - RNA, 13 nt, Human
ucuccugggcagc

SEQ ID NO: 2733711 - RNA, 15 nt, Human
ucuccugggcagcug

SEQ ID NO: 2733712 - RNA, 16 nt, Human
ucuccugggcagcugc

SEQ ID NO: 2733713 - RNA, 17 nt, Human
ucuccugggcagcugcc

SEQ ID NO: 2733714 - RNA, 18 nt, Human
ucuccugggcagcugccu

SEQ ID NO: 2733715 - RNA, 22 nt, Human
ucuccugccucagccucccaaa

SEQ ID NO: 2733716 - RNA, 19 nt, Human
ucuccugccucagccuccc

SEQ ID NO: 2733717 - RNA, 15 nt, Human
uccuugcaucaauuu

SEQ ID NO: 2733718 - RNA, 12 nt, Human
uccuucuguccu

SEQ ID NO: 2733719 - RNA, 19 nt, Human
uccuucuguccuacucugu

SEQ ID NO: 2733720 - RNA, 20 nt, Human
uccuucugugaaaguacauu

SEQ ID NO: 2733721 - RNA, 17 nt, Human
uccuggcccacugcauc

SEQ ID NO: 2733722 - RNA, 10 nt, Human
ucccucccuu

SEQ ID NO: 2733723 - RNA, 22 nt, Human
uccuggcaugggaaugaauguc

SEQ ID NO: 2733724 - RNA, 15 nt, Human
uccugguguggaaga

SEQ ID NO: 2733725 - RNA, 17 nt, Human
ucgaguuacagacaaag

SEQ ID NO: 2733726 - RNA, 15 nt, Human
ucgaguuacagacaa

SEQ ID NO: 2733727 - RNA, 21 nt, Human
ucuacacuaagagagaaugag

SEQ ID NO: 2733728 - RNA, 22 nt, Human
ucuaacuucaccauauuaccac

SEQ ID NO: 2733729 - RNA, 16 nt, Human
ucuaacuucaccauau

SEQ ID NO: 2733730 - RNA, 15 nt, Human
ucuaacuucaccaua

SEQ ID NO: 2733731 - RNA, 22 nt, Human
ucuaaaucuccaaaauaaaacu

SEQ ID NO: 2733732 - RNA, 16 nt, Human
ucuaaauucuuucauu

SEQ ID NO: 2733733 - RNA, 13 nt, Human
ucuaaauuugaau

SEQ ID NO: 2733734 - RNA, 17 nt, Human
ucuaaauuugaauguua

SEQ ID NO: 2733735 - RNA, 19 nt, Human
ucuaacaaaaaaauauauu

SEQ ID NO: 2733736 - RNA, 22 nt, Human
ucuaaauuugaauguuaagcag

SEQ ID NO: 2733737 - RNA, 23 nt, Human
ucuaaauuugaauguuaagcaga

SEQ ID NO: 2733738 - RNA, 18 nt, Human
ucuaaauuuuauaucuug

SEQ ID NO: 2733739 - RNA, 23 nt, Human
ucuaaauuuuauaucuuguagcu

SEQ ID NO: 2733740 - RNA, 17 nt, Human
ucuacacuaagagagaa

SEQ ID NO: 2733741 - RNA, 12 nt, Human
ucuacacugugc

SEQ ID NO: 2733742 - RNA, 14 nt, Human
ucuacacugugcug

SEQ ID NO: 2733743 - RNA, 19 nt, Human
ucuacugaggugcuauguu

SEQ ID NO: 2733744 - RNA, 18 nt, Human
ucuacugaggugcuaugu

SEQ ID NO: 2733745 - RNA, 21 nt, Human
ucuacacugugcugagucuga

SEQ ID NO: 2733746 - RNA, 15 nt, Human
ucuacacugugcuga

SEQ ID NO: 2733747 - RNA, 22 nt, Human
ucuacugaggugcuauguucuu

SEQ ID NO: 2733748 - RNA, 19 nt, Human
ucuagggaaaaaccagcgu

SEQ ID NO: 2733749 - RNA, 22 nt, Human
ucuagggaaaaaccagcgugug

SEQ ID NO: 2733750 - RNA, 17 nt, Human
ucucacuguugcccagg

SEQ ID NO: 2733751 - RNA, 21 nt, Human
ucucagaaucucaaauaacua

SEQ ID NO: 2733752 - RNA, 17 nt, Human
ucucagaaucucaaaua

SEQ ID NO: 2733753 - RNA, 18 nt, Human
ucucacuguugcccaggc

SEQ ID NO: 2733754 - RNA, 19 nt, Human
ucucacuguugcccaggcu

SEQ ID NO: 2733755 - RNA, 20 nt, Human
ucucacuguugcccaggcug

SEQ ID NO: 2733756 - RNA, 21 nt, Human
ucucacuguugcccaggcugg

SEQ ID NO: 2733757 - RNA, 18 nt, Human
ucucacucugucgcccag

SEQ ID NO: 2733758 - RNA, 22 nt, Human
ucucacucugucgcccagucug

SEQ ID NO: 2733759 - RNA, 16 nt, Human
ucucacucugucgccc

SEQ ID NO: 2733760 - RNA, 17 nt, Human
ucucacucugucgccca

SEQ ID NO: 2733761 - RNA, 21 nt, Human
ucucaaauuuggauugcuaau

SEQ ID NO: 2733762 - RNA, 22 nt, Human
ucucaaacucuugaccucaggu

SEQ ID NO: 2733763 - RNA, 13 nt, Human
ucucaaacucuug

SEQ ID NO: 2733764 - RNA, 21 nt, Human
ucucaaacucuugaccucagg

SEQ ID NO: 2733765 - RNA, 15 nt, Human
ucuaguaugaaauua

SEQ ID NO: 2733766 - RNA, 17 nt, Human
ucuaguaugaaauuaua

SEQ ID NO: 2733767 - RNA, 14 nt, Human
ugaacacaucagcu

SEQ ID NO: 2733768 - RNA, 18 nt, Human
ugaacucuucaaucucuu

SEQ ID NO: 2733769 - RNA, 20 nt, Human
ugaaccacaucuugcucugc

SEQ ID NO: 2733770 - RNA, 21 nt, Human
ugaaccacaucuugcucugcu

SEQ ID NO: 2733771 - RNA, 15 nt, Human
ugaacucuucaaucu

SEQ ID NO: 2733772 - RNA, 22 nt, Human
ugaaccacaucuugcucugcug

SEQ ID NO: 2733773 - RNA, 13 nt, Human
ugaacugauaaag

SEQ ID NO: 2733774 - RNA, 15 nt, Human
ugaacugauaaagau

SEQ ID NO: 2733775 - RNA, 22 nt, Human
ugaacuuguaaaggaauuuaaa

SEQ ID NO: 2733776 - RNA, 14 nt, Human
ugaagacagagcua

SEQ ID NO: 2733777 - RNA, 16 nt, Human
ugaagacagagcuaca

SEQ ID NO: 2733778 - RNA, 19 nt, Human
ugaacuggguacuugugga

SEQ ID NO: 2733779 - RNA, 14 nt, Human
ugaacuuggcgcug

SEQ ID NO: 2733780 - RNA, 12 nt, Human
ugaacuugguuc

SEQ ID NO: 2733781 - RNA, 14 nt, Human
ugaagacuuuucuu

SEQ ID NO: 2733782 - RNA, 17 nt, Human
ugaagacuuuucuuuca

SEQ ID NO: 2733783 - RNA, 22 nt, Human
ugaagacuuuucuuucagccaa

SEQ ID NO: 2733784 - RNA, 21 nt, Human
ugaaguccaagcauuuagaug

SEQ ID NO: 2733785 - RNA, 22 nt, Human
ugaaguccaagcauuuagaugu

SEQ ID NO: 2733786 - RNA, 21 nt, Human
ugaaggcucgagcaugccugg

SEQ ID NO: 2733787 - RNA, 20 nt, Human
ugaaggcucgagcaugccug

SEQ ID NO: 2733788 - RNA, 13 nt, Human
ugaaagauucaau

SEQ ID NO: 2733789 - RNA, 12 nt, Human
ugaaaggaaaga

SEQ ID NO: 2733790 - RNA, 17 nt, Human
ugaaaggaaagaggcuc

SEQ ID NO: 2733791 - RNA, 22 nt, Human
ugaaaagacuccaaagaaaugu

SEQ ID NO: 2733792 - RNA, 17 nt, Human
ugaaaucuuuuugcuuu

SEQ ID NO: 2733793 - RNA, 15 nt, Human
ugaaagggcccagag

SEQ ID NO: 2733794 - RNA, 16 nt, Human
ugaaagggcccagaga

SEQ ID NO: 2733795 - RNA, 17 nt, Human
ugaaagggcccagagag

SEQ ID NO: 2733796 - RNA, 18 nt, Human
ugaaagggcccagagagg

SEQ ID NO: 2733797 - RNA, 19 nt, Human
ugaaaugaggucagagccu

SEQ ID NO: 2733798 - RNA, 20 nt, Human
ugaaaugaggucagagccug

SEQ ID NO: 2733799 - RNA, 23 nt, Human
ugaaaugaggucagagccugcag

SEQ ID NO: 2733800 - RNA, 21 nt, Human
ugaaaugaggucagagccugc

SEQ ID NO: 2733801 - RNA, 22 nt, Human
ugaaaugaggucagagccugca

SEQ ID NO: 2733802 - RNA, 19 nt, Human
ugaaaagacuccaaagaaa

SEQ ID NO: 2733803 - RNA, 17 nt, Human
ugaaaagacuccaaaga

SEQ ID NO: 2733804 - RNA, 16 nt, Human
ugaaaagacuccaaag

SEQ ID NO: 2733805 - RNA, 15 nt, Human
ugaaaagacuccaaa

SEQ ID NO: 2733806 - RNA, 16 nt, Human
ucuuuuugcuuugcuu

SEQ ID NO: 2733807 - RNA, 19 nt, Human
ucuuuugccguuauuaaaa

SEQ ID NO: 2733808 - RNA, 17 nt, Human
ucuuuugccguuauuaa

SEQ ID NO: 2733809 - RNA, 20 nt, Human
ucuguuuuauaauuuuguga

SEQ ID NO: 2733810 - RNA, 22 nt, Human
ucuguuuuauaauuuugugaag

SEQ ID NO: 2733811 - RNA, 18 nt, Human
ucuuaaaaaguggaaaaa

SEQ ID NO: 2733812 - RNA, 19 nt, Human
ucuguccgagcuuugaaaa

SEQ ID NO: 2733813 - RNA, 22 nt, Human
ucuguggguuucuaaagcugcc

SEQ ID NO: 2733814 - RNA, 17 nt, Human
ucuguacgucugacagg

SEQ ID NO: 2733815 - RNA, 23 nt, Human
ucuguggguuucuaaagcugcca

SEQ ID NO: 2733816 - RNA, 22 nt, Human
ucugugucagguggggcagcuu

SEQ ID NO: 2733817 - RNA, 14 nt, Human
ucuggcuaugcauu

SEQ ID NO: 2733818 - RNA, 23 nt, Human
ucuguacagagcccacgccccca

SEQ ID NO: 2733819 - RNA, 17 nt, Human
ucuggcucuuccaggcu

SEQ ID NO: 2733820 - RNA, 15 nt, Human
ucuggcucuuccagg

SEQ ID NO: 2733821 - RNA, 16 nt, Human
ucuggcucuuccaggc

SEQ ID NO: 2733822 - RNA, 13 nt, Human
ucugggacacagu

SEQ ID NO: 2733823 - RNA, 12 nt, Human
ucugggacacag

SEQ ID NO: 2733824 - RNA, 13 nt, Human
ucuuaaaaagugg

SEQ ID NO: 2733825 - RNA, 16 nt, Human
ucuuaguggauguucu

SEQ ID NO: 2733826 - RNA, 14 nt, Human
ucuuagugugugca

SEQ ID NO: 2733827 - RNA, 14 nt, Human
ucuuauacauuuga

SEQ ID NO: 2733828 - RNA, 15 nt, Human
ucuuauacauuugau

SEQ ID NO: 2733829 - RNA, 15 nt, Human
ucuucaguaagccgu

SEQ ID NO: 2733830 - RNA, 13 nt, Human
ucuuaugggcugg

SEQ ID NO: 2733831 - RNA, 19 nt, Human
ucuucuccacuuucuagcc

SEQ ID NO: 2733832 - RNA, 21 nt, Human
ucuucuccacuuucuagccag

SEQ ID NO: 2733833 - RNA, 14 nt, Human
ucuuccaggcuggg

SEQ ID NO: 2733834 - RNA, 16 nt, Human
ucuucaguaagccgug

SEQ ID NO: 2733835 - RNA, 21 nt, Human
ucuuccacaagagcccaggcc

SEQ ID NO: 2733836 - RNA, 19 nt, Human
ucuugucucagauuuuauu

SEQ ID NO: 2733837 - RNA, 19 nt, Human
ucuuuaaaaaaaaaauugg

SEQ ID NO: 2733838 - RNA, 18 nt, Human
ucuuuaaaaaaaaaauug

SEQ ID NO: 2733839 - RNA, 12 nt, Human
ucuugcucugcu

SEQ ID NO: 2733840 - RNA, 13 nt, Human
ucuugcucugcug

SEQ ID NO: 2733841 - RNA, 11 nt, Human
ucuugcucugc

SEQ ID NO: 2733842 - RNA, 21 nt, Human
ucuugaauuguaaggaaugau

SEQ ID NO: 2733843 - RNA, 15 nt, Human
ucuucuccaggcugu

SEQ ID NO: 2733844 - RNA, 16 nt, Human
ucuugaacuccuggcc

SEQ ID NO: 2733845 - RNA, 17 nt, Human
ucuugaacuccuggccu

SEQ ID NO: 2733846 - RNA, 18 nt, Human
ucuugaacuccuggccuc

SEQ ID NO: 2733847 - RNA, 13 nt, Human
ucuucuccaggcu

SEQ ID NO: 2733848 - RNA, 14 nt, Human
ucuucuccaggcug

SEQ ID NO: 2733849 - RNA, 12 nt, Human
ucuucuccaggc

SEQ ID NO: 2733850 - RNA, 18 nt, Human
ugccuccccuccucugcu

SEQ ID NO: 2733851 - RNA, 19 nt, Human
ugccuccccuccucugcuu

SEQ ID NO: 2733852 - RNA, 22 nt, Human
ugccuccccuccucugcuugcc

SEQ ID NO: 2733853 - RNA, 23 nt, Human
ugccuccccuccucugcuugcca

SEQ ID NO: 2733854 - RNA, 23 nt, Human
ugccuaaggacuucuuuaauuuu

SEQ ID NO: 2733855 - RNA, 23 nt, Human
ugcccaggcuggcgugcaguggu

SEQ ID NO: 2733856 - RNA, 11 nt, Human
ugcccagcccc

SEQ ID NO: 2733857 - RNA, 14 nt, Human
ugccucugggacug

SEQ ID NO: 2733858 - RNA, 16 nt, Human
ugccuccuuugugagg

SEQ ID NO: 2733859 - RNA, 17 nt, Human
ugccuccuuugugagga

SEQ ID NO: 2733860 - RNA, 18 nt, Human
ugccuccuuugugaggaa

SEQ ID NO: 2733861 - RNA, 22 nt, Human
ugccugaagucacacagugagu

SEQ ID NO: 2733862 - RNA, 18 nt, Human
ugccugaagucacacagu

SEQ ID NO: 2733863 - RNA, 17 nt, Human
ugccugaagucacacag

SEQ ID NO: 2733864 - RNA, 22 nt, Human
ugccuucucaacuccaaacuga

SEQ ID NO: 2733865 - RNA, 17 nt, Human
ugccuucucaacuccaa

SEQ ID NO: 2733866 - RNA, 13 nt, Human
ugcgccuacagga

SEQ ID NO: 2733867 - RNA, 23 nt, Human
ugcggugcuaucucccccagccc

SEQ ID NO: 2733868 - RNA, 18 nt, Human
ugccuuauggaacacucu

SEQ ID NO: 2733869 - RNA, 20 nt, Human
ugccuuauggaacacucuga

SEQ ID NO: 2733870 - RNA, 21 nt, Human
ugccuuauggaacacucugag

SEQ ID NO: 2733871 - RNA, 22 nt, Human
ugccuuauggaacacucugaga

SEQ ID NO: 2733872 - RNA, 15 nt, Human
ugcgugcauaccacu

SEQ ID NO: 2733873 - RNA, 16 nt, Human
ugcuaggaacacuccu

SEQ ID NO: 2733874 - RNA, 17 nt, Human
ugcuaggaacacuccuu

SEQ ID NO: 2733875 - RNA, 19 nt, Human
ugcuaggaacacuccuuca

SEQ ID NO: 2733876 - RNA, 18 nt, Human
ugcuccucuccccagcaa

SEQ ID NO: 2733877 - RNA, 19 nt, Human
ugcuccucuccccagcaag

SEQ ID NO: 2733878 - RNA, 16 nt, Human
ugcuagguuaauucca

SEQ ID NO: 2733879 - RNA, 23 nt, Human
ugcuagguuaauuccaauuauau

SEQ ID NO: 2733880 - RNA, 18 nt, Human
ugcugaauacagaggcaa

SEQ ID NO: 2733881 - RNA, 23 nt, Human
ugcugaauacagaggcaacugca

SEQ ID NO: 2733882 - RNA, 21 nt, Human
ugcugaaggcucgagcaugcc

SEQ ID NO: 2733883 - RNA, 22 nt, Human
ugcugaaugguuuucaaaauaa

SEQ ID NO: 2733884 - RNA, 18 nt, Human
ugcugaaugguuuucaaa

SEQ ID NO: 2733885 - RNA, 17 nt, Human
ugcugaaugguuuucaa

SEQ ID NO: 2733886 - RNA, 19 nt, Human
ugcuccuggcccacugcau

SEQ ID NO: 2733887 - RNA, 15 nt, Human
ugcugcaguugccag

SEQ ID NO: 2733888 - RNA, 16 nt, Human
ugcugcaguugccagu

SEQ ID NO: 2733889 - RNA, 20 nt, Human
ugcugauggugcaaugaccu

SEQ ID NO: 2733890 - RNA, 23 nt, Human
ugcugauggugcaaugaccuuuc

SEQ ID NO: 2733891 - RNA, 15 nt, Human
ugcugacagacacag

SEQ ID NO: 2733892 - RNA, 16 nt, Human
ugcugacagacacagg

SEQ ID NO: 2733893 - RNA, 19 nt, Human
ugcugacagacacaggccc

SEQ ID NO: 2733894 - RNA, 17 nt, Human
ugcugaguuugugcugg

SEQ ID NO: 2733895 - RNA, 15 nt, Human
ugcugaguuugugcu

SEQ ID NO: 2733896 - RNA, 15 nt, Human
ugcacuuuguucugg

SEQ ID NO: 2733897 - RNA, 18 nt, Human
ugcacuuuguucuggcuc

SEQ ID NO: 2733898 - RNA, 19 nt, Human
ugcacuuuguucuggcucu

SEQ ID NO: 2733899 - RNA, 20 nt, Human
ugcacuuuguucuggcucuu

SEQ ID NO: 2733900 - RNA, 21 nt, Human
ugcacuugcagacucuacaga

SEQ ID NO: 2733901 - RNA, 16 nt, Human
ugcacuugcagacucu

SEQ ID NO: 2733902 - RNA, 19 nt, Human
ugcacggugaauggcuuug

SEQ ID NO: 2733903 - RNA, 23 nt, Human
ugcacggugaauggcuuuguaua

SEQ ID NO: 2733904 - RNA, 22 nt, Human
ugcacggugaauggcuuuguau

SEQ ID NO: 2733905 - RNA, 16 nt, Human
ugcacguacacacaca

SEQ ID NO: 2733906 - RNA, 18 nt, Human
ugcaggaccucaggugag

SEQ ID NO: 2733907 - RNA, 15 nt, Human
ugcaggaccucaggu

SEQ ID NO: 2733908 - RNA, 16 nt, Human
ugcaggaccucaggug

SEQ ID NO: 2733909 - RNA, 14 nt, Human
ugcaggaccucagg

SEQ ID NO: 2733910 - RNA, 16 nt, Human
ugcagcaauaaagcag

SEQ ID NO: 2733911 - RNA, 15 nt, Human
ugcagcaauaaagca

SEQ ID NO: 2733912 - RNA, 14 nt, Human
ugcagcaauaaagc

SEQ ID NO: 2733913 - RNA, 15 nt, Human
ugcacaucaaaauau

SEQ ID NO: 2733914 - RNA, 23 nt, Human
ugcacagcuaacauggaaguacu

SEQ ID NO: 2733915 - RNA, 18 nt, Human
ugcacagcuaacauggaa

SEQ ID NO: 2733916 - RNA, 20 nt, Human
ugcacagcuaacauggaagu

SEQ ID NO: 2733917 - RNA, 17 nt, Human
ugcacagcuaacaugga

SEQ ID NO: 2733918 - RNA, 23 nt, Human
ugcacagaguuguuacauuuuua

SEQ ID NO: 2733919 - RNA, 22 nt, Human
ugcacagaguuguuacauuuuu

SEQ ID NO: 2733920 - RNA, 21 nt, Human
ugcacagaguuguuacauuuu

SEQ ID NO: 2733921 - RNA, 22 nt, Human
ugaagucuuuguacagacaaca

SEQ ID NO: 2733922 - RNA, 17 nt, Human
ugaagucuuuguacaga

SEQ ID NO: 2733923 - RNA, 20 nt, Human
ugaagucuuuguacagacaa

SEQ ID NO: 2733924 - RNA, 21 nt, Human
ugccaucccucccuccaccuc

SEQ ID NO: 2733925 - RNA, 22 nt, Human
ugccaucccucccuccaccucc

SEQ ID NO: 2733926 - RNA, 15 nt, Human
ugccaucccucccuc

SEQ ID NO: 2733927 - RNA, 19 nt, Human
ugccaucccucccuccacc

SEQ ID NO: 2733928 - RNA, 20 nt, Human
ugccaucccucccuccaccu

SEQ ID NO: 2733929 - RNA, 24 nt, Human
ugccagguuuuuggucugacccac

SEQ ID NO: 2733930 - RNA, 14 nt, Human
ugccagucaccccg

SEQ ID NO: 2733931 - RNA, 11 nt, Human
ugccagggaca

SEQ ID NO: 2733932 - RNA, 22 nt, Human
ugccagggacagaggggguggc

SEQ ID NO: 2733933 - RNA, 15 nt, Human
ugcccaccuggccuc

SEQ ID NO: 2733934 - RNA, 17 nt, Human
ugcccaccuggccucug

SEQ ID NO: 2733935 - RNA, 10 nt, Human
ugcccagccc

SEQ ID NO: 2733936 - RNA, 14 nt, Human
ugcccaccuggccu

SEQ ID NO: 2733937 - RNA, 18 nt, Human
ugcccaccuggccucugc

SEQ ID NO: 2733938 - RNA, 22 nt, Human
ugcaucagcugcugaaacaaca

SEQ ID NO: 2733939 - RNA, 19 nt, Human
ugcaucagcugcugaaaca

SEQ ID NO: 2733940 - RNA, 19 nt, Human
ugcaggcagccaggccaca

SEQ ID NO: 2733941 - RNA, 17 nt, Human
ugcaggcagccaggcca

SEQ ID NO: 2733942 - RNA, 18 nt, Human
ugcaggcagccaggccac

SEQ ID NO: 2733943 - RNA, 16 nt, Human
ugcaggcagccaggcc

SEQ ID NO: 2733944 - RNA, 15 nt, Human
ugcaucguuucaucu

SEQ ID NO: 2733945 - RNA, 14 nt, Human
ugcauuauauuuau

SEQ ID NO: 2733946 - RNA, 20 nt, Human
ugcauuauauuuauuacugu

SEQ ID NO: 2733947 - RNA, 15 nt, Human
ugcauuauauuuauu

SEQ ID NO: 2733948 - RNA, 19 nt, Human
ugcauguuacauaagauaa

SEQ ID NO: 2733949 - RNA, 11 nt, Human
uggaagacagc

SEQ ID NO: 2733950 - RNA, 12 nt, Human
uggaagacagcu

SEQ ID NO: 2733951 - RNA, 16 nt, Human
uggaaaauaaauuauu

SEQ ID NO: 2733952 - RNA, 15 nt, Human
uggaaaauaaauuau

SEQ ID NO: 2733953 - RNA, 22 nt, Human
uggaaaaguauguuagugcaaa

SEQ ID NO: 2733954 - RNA, 16 nt, Human
uggaauaucuccguca

SEQ ID NO: 2733955 - RNA, 16 nt, Human
uggaauacucuuauau

SEQ ID NO: 2733956 - RNA, 14 nt, Human
uggaagacagcucu

SEQ ID NO: 2733957 - RNA, 14 nt, Human
ugcuucuguuuuau

SEQ ID NO: 2733958 - RNA, 16 nt, Human
ugcuucuucagagacu

SEQ ID NO: 2733959 - RNA, 18 nt, Human
ugcuuccagugaggcucu

SEQ ID NO: 2733960 - RNA, 19 nt, Human
ugcuuccagugaggcucug

SEQ ID NO: 2733961 - RNA, 20 nt, Human
ugcuuccagugaggcucugc

SEQ ID NO: 2733962 - RNA, 12 nt, Human
ugcuuucagaua

SEQ ID NO: 2733963 - RNA, 21 nt, Human
ugcuuucagauacuggauugu

SEQ ID NO: 2733964 - RNA, 20 nt, Human
ugcuuucagauacuggauug

SEQ ID NO: 2733965 - RNA, 17 nt, Human
ugcuuucagauacugga

SEQ ID NO: 2733966 - RNA, 16 nt, Human
ugcuuucagauacugg

SEQ ID NO: 2733967 - RNA, 12 nt, Human
uggacaggcaug

SEQ ID NO: 2733968 - RNA, 16 nt, Human
uggacaggcauguucu

SEQ ID NO: 2733969 - RNA, 15 nt, Human
uggagcaaagcugau

SEQ ID NO: 2733970 - RNA, 22 nt, Human
uggaggcaugugaugagaggaa

SEQ ID NO: 2733971 - RNA, 15 nt, Human
uggcauaacauaaau

SEQ ID NO: 2733972 - RNA, 20 nt, Human
uggcagugggagcugccugu

SEQ ID NO: 2733973 - RNA, 13 nt, Human
uggcagugggagc

SEQ ID NO: 2733974 - RNA, 14 nt, Human
uggcagugggagcu

SEQ ID NO: 2733975 - RNA, 15 nt, Human
uggcagugggagcug

SEQ ID NO: 2733976 - RNA, 16 nt, Human
uggcagugggagcugc

SEQ ID NO: 2733977 - RNA, 19 nt, Human
uggcagugggagcugccug

SEQ ID NO: 2733978 - RNA, 14 nt, Human
uggaugccuggugg

SEQ ID NO: 2733979 - RNA, 18 nt, Human
uggcacugcuuccaguga

SEQ ID NO: 2733980 - RNA, 14 nt, Human
uggcacugcuucca

SEQ ID NO: 2733981 - RNA, 16 nt, Human
uggcacugcuuccagu

SEQ ID NO: 2733982 - RNA, 23 nt, Human
uggcagcugcgguccacccagga

SEQ ID NO: 2733983 - RNA, 21 nt, Human
uggcagcugcgguccacccag

SEQ ID NO: 2733984 - RNA, 22 nt, Human
uggcagcugcgguccacccagg

SEQ ID NO: 2733985 - RNA, 17 nt, Human
uggguagacacacauga

SEQ ID NO: 2733986 - RNA, 16 nt, Human
uggguagacacacaug

SEQ ID NO: 2733987 - RNA, 17 nt, Human
ugggguggggaccucag

SEQ ID NO: 2733988 - RNA, 14 nt, Human
uggguguggcgcag

SEQ ID NO: 2733989 - RNA, 23 nt, Human
uggguucaagcgauucuucugcu

SEQ ID NO: 2733990 - RNA, 16 nt, Human
uggguucacugcaacc

SEQ ID NO: 2733991 - RNA, 21 nt, Human
ugggugucaagagggucugag

SEQ ID NO: 2733992 - RNA, 23 nt, Human
ugggugucaagagggucugagga

SEQ ID NO: 2733993 - RNA, 16 nt, Human
ugggagcuuuuguaga

SEQ ID NO: 2733994 - RNA, 24 nt, Human
ugggagcugccuguucagcuccag

SEQ ID NO: 2733995 - RNA, 14 nt, Human
ugggccuccugugu

SEQ ID NO: 2733996 - RNA, 16 nt, Human
ugggccuccugugugu

SEQ ID NO: 2733997 - RNA, 22 nt, Human
ugggccuccugugugugcgccu

SEQ ID NO: 2733998 - RNA, 19 nt, Human
ugggcuuggggaccagagc

SEQ ID NO: 2733999 - RNA, 20 nt, Human
ugggcuucaguggcagcugc

SEQ ID NO: 2734000 - RNA, 16 nt, Human
uggggcagcuugaggg

SEQ ID NO: 2734001 - RNA, 21 nt, Human
ugggcuuggggaccagagcug

SEQ ID NO: 2734002 - RNA, 18 nt, Human
ugggcuucaguggcagcu

SEQ ID NO: 2734003 - RNA, 19 nt, Human
ugggcuucaguggcagcug

SEQ ID NO: 2734004 - RNA, 18 nt, Human
ugggacagucaccucaug

SEQ ID NO: 2734005 - RNA, 20 nt, Human
ugggacagucaccucaugga

SEQ ID NO: 2734006 - RNA, 21 nt, Human
ugggacagucaccucauggaa

SEQ ID NO: 2734007 - RNA, 22 nt, Human
ugggaaugaaugucagugugac

SEQ ID NO: 2734008 - RNA, 22 nt, Human
uggcuuuguauagaaccucuuu

SEQ ID NO: 2734009 - RNA, 14 nt, Human
uggcuuuguauaga

SEQ ID NO: 2734010 - RNA, 15 nt, Human
uggcuguacccagga

SEQ ID NO: 2734011 - RNA, 14 nt, Human
uggcugggggccuc

SEQ ID NO: 2734012 - RNA, 22 nt, Human
uggcugguuagagguucccuuu

SEQ ID NO: 2734013 - RNA, 19 nt, Human
ugggacauuugcucaugga

SEQ ID NO: 2734014 - RNA, 20 nt, Human
ugggacauuugcucauggaa

SEQ ID NO: 2734015 - RNA, 16 nt, Human
ugggacaugggaaagg

SEQ ID NO: 2734016 - RNA, 23 nt, Human
ugggagcugccuguucagcucca

SEQ ID NO: 2734017 - RNA, 15 nt, Human
uggccagaugcacca

SEQ ID NO: 2734018 - RNA, 22 nt, Human
uggcgugcaguggugcgaucug

SEQ ID NO: 2734019 - RNA, 15 nt, Human
uggcgcugccccugg

SEQ ID NO: 2734020 - RNA, 14 nt, Human
uggcgcugccccug

SEQ ID NO: 2734021 - RNA, 16 nt, Human
uggcucuuccaggcug

SEQ ID NO: 2734022 - RNA, 12 nt, Human
uggcugggggcc

SEQ ID NO: 2734023 - RNA, 13 nt, Human
uggcucuuccagg

SEQ ID NO: 2734024 - RNA, 15 nt, Human
uggcucuuccaggcu

SEQ ID NO: 2734025 - RNA, 22 nt, Human
uggcucagguggggucacucug

SEQ ID NO: 2734026 - RNA, 20 nt, Human
uggcucagguggggucacuc

SEQ ID NO: 2734027 - RNA, 19 nt, Human
uuaaaagaaugauuaugaa

SEQ ID NO: 2734028 - RNA, 13 nt, Human
uuaaaagaaugau

SEQ ID NO: 2734029 - RNA, 18 nt, Human
uuaaacuuaaucuaaaug

SEQ ID NO: 2734030 - RNA, 16 nt, Human
uuaaacuuaaucuaaa

SEQ ID NO: 2734031 - RNA, 20 nt, Human
uuaaagcuuauuaaaacuca

SEQ ID NO: 2734032 - RNA, 20 nt, Human
uuaaacuuaaucuaaaugga

SEQ ID NO: 2734033 - RNA, 19 nt, Human
uuaaauagcuuuuuucucu

SEQ ID NO: 2734034 - RNA, 20 nt, Human
uuaaagcuuccauuguuguc

SEQ ID NO: 2734035 - RNA, 15 nt, Human
uuaaagcuuccauug

SEQ ID NO: 2734036 - RNA, 16 nt, Human
uuaaaugcaccuggaa

SEQ ID NO: 2734037 - RNA, 18 nt, Human
uuaaaugcaccuggaaua

SEQ ID NO: 2734038 - RNA, 17 nt, Human
uuaaaugcaccuggaau

SEQ ID NO: 2734039 - RNA, 17 nt, Human
uuaaaugcccagccccu

SEQ ID NO: 2734040 - RNA, 18 nt, Human
uuaaaugcccagccccuu

SEQ ID NO: 2734041 - RNA, 12 nt, Human
uuaacauguuaa

SEQ ID NO: 2734042 - RNA, 19 nt, Human
uuaacauguuaaaccaugg

SEQ ID NO: 2734043 - RNA, 18 nt, Human
uuaacauguuaaaccaug

SEQ ID NO: 2734044 - RNA, 20 nt, Human
uguuuccuggcacugcuucc

SEQ ID NO: 2734045 - RNA, 21 nt, Human
uguuuccuggcacugcuucca

SEQ ID NO: 2734046 - RNA, 22 nt, Human
uguuuccuggcacugcuuccag

SEQ ID NO: 2734047 - RNA, 12 nt, Human
uguuuguuuagu

SEQ ID NO: 2734048 - RNA, 17 nt, Human
uguuuguugucagcuga

SEQ ID NO: 2734049 - RNA, 16 nt, Human
uguuuguugucagcug

SEQ ID NO: 2734050 - RNA, 12 nt, Human
uguuuuaaaaaa

SEQ ID NO: 2734051 - RNA, 21 nt, Human
uguuuguuuagucuugucuca

SEQ ID NO: 2734052 - RNA, 13 nt, Human
uguuuuugucuua

SEQ ID NO: 2734053 - RNA, 18 nt, Human
uuaauaauguuucaaaca

SEQ ID NO: 2734054 - RNA, 18 nt, Human
uuaauaauuauaugcuau

SEQ ID NO: 2734055 - RNA, 16 nt, Human
uuaauagguuuggaca

SEQ ID NO: 2734056 - RNA, 23 nt, Human
uuaauaauuauaugcuauuucua

SEQ ID NO: 2734057 - RNA, 20 nt, Human
uuaauaauuauaugcuauuu

SEQ ID NO: 2734058 - RNA, 16 nt, Human
uuaauaauguuucaaa

SEQ ID NO: 2734059 - RNA, 22 nt, Human
uuaaggaugcuuguacauaaug

SEQ ID NO: 2734060 - RNA, 21 nt, Human
uuaaggaagacaaugugaaaa

SEQ ID NO: 2734061 - RNA, 20 nt, Human
uuaaggaugcuuguacauaa

SEQ ID NO: 2734062 - RNA, 19 nt, Human
uuaaggaugcuuguacaua

SEQ ID NO: 2734063 - RNA, 18 nt, Human
uuaaggaugcuuguacau

SEQ ID NO: 2734064 - RNA, 17 nt, Human
uuaaggaugcuuguaca

SEQ ID NO: 2734065 - RNA, 22 nt, Human
uuaaugucaauucuugccaaau

SEQ ID NO: 2734066 - RNA, 17 nt, Human
uuaaugucacaggcagg

SEQ ID NO: 2734067 - RNA, 18 nt, Human
uuaaugucacaggcaggu

SEQ ID NO: 2734068 - RNA, 21 nt, Human
uuaauagguuuggacaaaaug

SEQ ID NO: 2734069 - RNA, 14 nt, Human
uuacauuuguauaa

SEQ ID NO: 2734070 - RNA, 15 nt, Human
uuacauuuguauaaa

SEQ ID NO: 2734071 - RNA, 22 nt, Human
uuacauggcuggagcuagaauu

SEQ ID NO: 2734072 - RNA, 23 nt, Human
uuacauggcuggagcuagaauuu

SEQ ID NO: 2734073 - RNA, 21 nt, Human
uuaccacuuguguuuugcaag

SEQ ID NO: 2734074 - RNA, 14 nt, Human
uuaccagcagagca

SEQ ID NO: 2734075 - RNA, 23 nt, Human
uuacauuuuuaagugcugcauuu

SEQ ID NO: 2734076 - RNA, 22 nt, Human
uuacauuuuuaagugcugcauu

SEQ ID NO: 2734077 - RNA, 21 nt, Human
uuacauuuuuaagugcugcau

SEQ ID NO: 2734078 - RNA, 20 nt, Human
uuacauuuuuaagugcugca

SEQ ID NO: 2734079 - RNA, 16 nt, Human
uuacggaacucaaaua

SEQ ID NO: 2734080 - RNA, 20 nt, Human
uuacgguuuuccagguuuaa

SEQ ID NO: 2734081 - RNA, 22 nt, Human
uuaccuuuuuuauacauaaaca

SEQ ID NO: 2734082 - RNA, 20 nt, Human
uuaccuuuuuuauacauaaa

SEQ ID NO: 2734083 - RNA, 19 nt, Human
uuaccuuuuuuauacauaa

SEQ ID NO: 2734084 - RNA, 13 nt, Human
uguguuuauuguc

SEQ ID NO: 2734085 - RNA, 16 nt, Human
uguguagggcgggagg

SEQ ID NO: 2734086 - RNA, 17 nt, Human
ugugugaagugagugag

SEQ ID NO: 2734087 - RNA, 16 nt, Human
uguucacagccagacu

SEQ ID NO: 2734088 - RNA, 14 nt, Human
uguucagcuccagc

SEQ ID NO: 2734089 - RNA, 11 nt, Human
uguucagcugg

SEQ ID NO: 2734090 - RNA, 15 nt, Human
uguucagcuccagcu

SEQ ID NO: 2734091 - RNA, 16 nt, Human
uguucagcuccagcuc

SEQ ID NO: 2734092 - RNA, 14 nt, Human
uguuagugcaaauu

SEQ ID NO: 2734093 - RNA, 16 nt, Human
uguuagaucuaguuca

SEQ ID NO: 2734094 - RNA, 12 nt, Human
uguuauaaucuu

SEQ ID NO: 2734095 - RNA, 13 nt, Human
uguuacauuuuua

SEQ ID NO: 2734096 - RNA, 22 nt, Human
uguuacauuuuuaagugcugca

SEQ ID NO: 2734097 - RNA, 15 nt, Human
uguuacugucuucag

SEQ ID NO: 2734098 - RNA, 16 nt, Human
uguuacugucuucagu

SEQ ID NO: 2734099 - RNA, 23 nt, Human
uguuaaaccaugggauaaaugcc

SEQ ID NO: 2734100 - RNA, 16 nt, Human
uguuaaaccaugggau

SEQ ID NO: 2734101 - RNA, 18 nt, Human
uguuaaaccaugggauaa

SEQ ID NO: 2734102 - RNA, 21 nt, Human
uguuaaaccaugggauaaaug

SEQ ID NO: 2734103 - RNA, 20 nt, Human
uguuaaaccaugggauaaau

SEQ ID NO: 2734104 - RNA, 13 nt, Human
uguuuaaaaucau

SEQ ID NO: 2734105 - RNA, 14 nt, Human
uguuguuuguuuag

SEQ ID NO: 2734106 - RNA, 14 nt, Human
uguuggccaggcug

SEQ ID NO: 2734107 - RNA, 21 nt, Human
uguuggagaagaacugaaauc

SEQ ID NO: 2734108 - RNA, 11 nt, Human
uguuggccagg

SEQ ID NO: 2734109 - RNA, 19 nt, Human
uguugaagagguuuuaaag

SEQ ID NO: 2734110 - RNA, 13 nt, Human
uguucucugagga

SEQ ID NO: 2734111 - RNA, 16 nt, Human
uguucucugaggacac

SEQ ID NO: 2734112 - RNA, 18 nt, Human
uguucucugaggacacua

SEQ ID NO: 2734113 - RNA, 12 nt, Human
uguucucugccc

SEQ ID NO: 2734114 - RNA, 20 nt, Human
uguucaugaaagauucaaug

SEQ ID NO: 2734115 - RNA, 20 nt, Human
uguucuuuccaaaguacacu

SEQ ID NO: 2734116 - RNA, 20 nt, Human
uguugaaacggaugauuucu

SEQ ID NO: 2734117 - RNA, 22 nt, Human
uguucuuucuggcuaugcauuu

SEQ ID NO: 2734118 - RNA, 20 nt, Human
uguucuuucuggcuaugcau

SEQ ID NO: 2734119 - RNA, 11 nt, Human
uguugaaagau

SEQ ID NO: 2734120 - RNA, 23 nt, Human
uguugaaacggaugauuucuaug

SEQ ID NO: 2734121 - RNA, 22 nt, Human
uguugaaacggaugauuucuau

SEQ ID NO: 2734122 - RNA, 21 nt, Human
uguugaaacggaugauuucua

SEQ ID NO: 2734123 - RNA, 14 nt, Human
uguucuuucuggcu

SEQ ID NO: 2734124 - RNA, 18 nt, Human
uguucugacccugcuuca

SEQ ID NO: 2734125 - RNA, 15 nt, Human
uguucugacccugcu

SEQ ID NO: 2734126 - RNA, 19 nt, Human
uguucucugcccuccaaga

SEQ ID NO: 2734127 - RNA, 16 nt, Human
uguaugauucccagcc

SEQ ID NO: 2734128 - RNA, 16 nt, Human
uguauagaaccucuuu

SEQ ID NO: 2734129 - RNA, 16 nt, Human
uguaucccaugagccu

SEQ ID NO: 2734130 - RNA, 19 nt, Human
uguaucccaugagccucag

SEQ ID NO: 2734131 - RNA, 23 nt, Human
uguaucccaugagccucagcauc

SEQ ID NO: 2734132 - RNA, 16 nt, Human
uguagcacugacagau

SEQ ID NO: 2734133 - RNA, 17 nt, Human
uguagcacugacagauu

SEQ ID NO: 2734134 - RNA, 22 nt, Human
uguagcacugacagauuuccau

SEQ ID NO: 2734135 - RNA, 12 nt, Human
ugucagugugac

SEQ ID NO: 2734136 - RNA, 20 nt, Human
ugucagugugacugaucucu

SEQ ID NO: 2734137 - RNA, 23 nt, Human
ugucccaaaaagaaaggagggga

SEQ ID NO: 2734138 - RNA, 13 nt, Human
uguaaauuaacuu

SEQ ID NO: 2734139 - RNA, 17 nt, Human
uguaaauuaacuuuuau

SEQ ID NO: 2734140 - RNA, 16 nt, Human
uguaaauuaacuuuua

SEQ ID NO: 2734141 - RNA, 15 nt, Human
uguaaauuaacuuuu

SEQ ID NO: 2734142 - RNA, 14 nt, Human
uguaaauuaacuuu

SEQ ID NO: 2734143 - RNA, 20 nt, Human
uguaaaaugugaagugaaug

SEQ ID NO: 2734144 - RNA, 17 nt, Human
uguagauaauacaguuc

SEQ ID NO: 2734145 - RNA, 17 nt, Human
uguacgucugacaggca

SEQ ID NO: 2734146 - RNA, 16 nt, Human
uguacgucugacaggc

SEQ ID NO: 2734147 - RNA, 13 nt, Human
uguacucaauuuu

SEQ ID NO: 2734148 - RNA, 23 nt, Human
uguaccucuugagccuugaacuu

SEQ ID NO: 2734149 - RNA, 14 nt, Human
uguaccucuugagc

SEQ ID NO: 2734150 - RNA, 22 nt, Human
uguaccucuugagccuugaacu

SEQ ID NO: 2734151 - RNA, 20 nt, Human
ugugcgugcauguguguuca

SEQ ID NO: 2734152 - RNA, 23 nt, Human
ugugcgcuaaacuuuucugauag

SEQ ID NO: 2734153 - RNA, 22 nt, Human
ugugcgcuaaacuuuucugaua

SEQ ID NO: 2734154 - RNA, 19 nt, Human
ugugcgcuaaacuuuucug

SEQ ID NO: 2734155 - RNA, 14 nt, Human
ugugcgcuaaacuu

SEQ ID NO: 2734156 - RNA, 17 nt, Human
ugugccucugggacugg

SEQ ID NO: 2734157 - RNA, 16 nt, Human
ugugcacaugcacgug

SEQ ID NO: 2734158 - RNA, 22 nt, Human
ugugcacaugcacgugugugca

SEQ ID NO: 2734159 - RNA, 16 nt, Human
ugugccucugggacug

SEQ ID NO: 2734160 - RNA, 15 nt, Human
ugugccucugggacu

SEQ ID NO: 2734161 - RNA, 13 nt, Human
ugugccucuggga

SEQ ID NO: 2734162 - RNA, 15 nt, Human
uguggacacagcucu

SEQ ID NO: 2734163 - RNA, 16 nt, Human
uguggacacagcucuu

SEQ ID NO: 2734164 - RNA, 12 nt, Human
uguggagaagcg

SEQ ID NO: 2734165 - RNA, 21 nt, Human
uguggagaagcggcuggcagc

SEQ ID NO: 2734166 - RNA, 14 nt, Human
uguggacacagcuc

SEQ ID NO: 2734167 - RNA, 13 nt, Human
uguggacacagcu

SEQ ID NO: 2734168 - RNA, 12 nt, Human
ugugggaagggg

SEQ ID NO: 2734169 - RNA, 13 nt, Human
ugugaaaggaaag

SEQ ID NO: 2734170 - RNA, 14 nt, Human
ugugaaaggaaaga

SEQ ID NO: 2734171 - RNA, 20 nt, Human
ugugaaguuuacauuguaaa

SEQ ID NO: 2734172 - RNA, 14 nt, Human
ugugaaguuuacau

SEQ ID NO: 2734173 - RNA, 17 nt, Human
ugucuuuggacccugag

SEQ ID NO: 2734174 - RNA, 18 nt, Human
ugucuuuggacccugagg

SEQ ID NO: 2734175 - RNA, 16 nt, Human
ugucuuuuuucacuac

SEQ ID NO: 2734176 - RNA, 19 nt, Human
ugucuuuggacccugaggc

SEQ ID NO: 2734177 - RNA, 22 nt, Human
ugucuuuggacccugaggccca

SEQ ID NO: 2734178 - RNA, 21 nt, Human
ugugacaaggauugcuacugu

SEQ ID NO: 2734179 - RNA, 18 nt, Human
ugugaguacuacaguccu

SEQ ID NO: 2734180 - RNA, 23 nt, Human
ugugaguacuacaguccucccau

SEQ ID NO: 2734181 - RNA, 19 nt, Human
ugugaguacuacaguccuc

SEQ ID NO: 2734182 - RNA, 20 nt, Human
ugugaguacuacaguccucc

SEQ ID NO: 2734183 - RNA, 21 nt, Human
ugugauacaaugcugugcccu

SEQ ID NO: 2734184 - RNA, 16 nt, Human
uugggaggccauuugu

SEQ ID NO: 2734185 - RNA, 22 nt, Human
uuggcuuuggguugcaggaccu

SEQ ID NO: 2734186 - RNA, 15 nt, Human
uuggcuuuucugauc

SEQ ID NO: 2734187 - RNA, 22 nt, Human
uuggcuuuucugauccaguuuu

SEQ ID NO: 2734188 - RNA, 19 nt, Human
uuggcuuuucugauccagu

SEQ ID NO: 2734189 - RNA, 16 nt, Human
uuggguggaugccugg

SEQ ID NO: 2734190 - RNA, 21 nt, Human
uuggcugggggccucagugcc

SEQ ID NO: 2734191 - RNA, 22 nt, Human
uuggcugggggccucagugcca

SEQ ID NO: 2734192 - RNA, 18 nt, Human
uuggcugggggccucagu

SEQ ID NO: 2734193 - RNA, 16 nt, Human
uuggcugcugaaggcu

SEQ ID NO: 2734194 - RNA, 13 nt, Human
uuggcauucccca

SEQ ID NO: 2734195 - RNA, 14 nt, Human
uuggccaggcuggu

SEQ ID NO: 2734196 - RNA, 24 nt, Human
uuggccaaagccaaagcuaggccu

SEQ ID NO: 2734197 - RNA, 14 nt, Human
uuguauuacaaauc

SEQ ID NO: 2734198 - RNA, 21 nt, Human
uuguauucucuccuguaccuc

SEQ ID NO: 2734199 - RNA, 19 nt, Human
uuguaucacaaaucuuaac

SEQ ID NO: 2734200 - RNA, 14 nt, Human
uuguagagccaggg

SEQ ID NO: 2734201 - RNA, 15 nt, Human
uuguagagccagggu

SEQ ID NO: 2734202 - RNA, 18 nt, Human
uuguaaaugugcuuuuaa

SEQ ID NO: 2734203 - RNA, 14 nt, Human
uuguaaaugugcuu

SEQ ID NO: 2734204 - RNA, 11 nt, Human
uuguaaaugug

SEQ ID NO: 2734205 - RNA, 12 nt, Human
uuguacagacaa

SEQ ID NO: 2734206 - RNA, 13 nt, Human
uuguacagacaac

SEQ ID NO: 2734207 - RNA, 16 nt, Human
uuguaaaggaauuuaa

SEQ ID NO: 2734208 - RNA, 12 nt, Human
uugguccugcug

SEQ ID NO: 2734209 - RNA, 22 nt, Human
uuggucccccuuccauggacuu

SEQ ID NO: 2734210 - RNA, 16 nt, Human
uuggucccccuuccau

SEQ ID NO: 2734211 - RNA, 12 nt, Human
uuggaaaucuuu

SEQ ID NO: 2734212 - RNA, 15 nt, Human
uuggaaaucuuuaaa

SEQ ID NO: 2734213 - RNA, 23 nt, Human
uuggaaagaguaggaagacuuug

SEQ ID NO: 2734214 - RNA, 17 nt, Human
uuggcaaaaaggcagga

SEQ ID NO: 2734215 - RNA, 14 nt, Human
uuggauuguccccg

SEQ ID NO: 2734216 - RNA, 19 nt, Human
uuggaaggaacguccccug

SEQ ID NO: 2734217 - RNA, 11 nt, Human
uuggaaggaac

SEQ ID NO: 2734218 - RNA, 21 nt, Human
uuggaccaaaaaccaguauug

SEQ ID NO: 2734219 - RNA, 23 nt, Human
uugcccacgcuggagugcaguga

SEQ ID NO: 2734220 - RNA, 11 nt, Human
uugcccaggca

SEQ ID NO: 2734221 - RNA, 13 nt, Human
uugccagucaccc

SEQ ID NO: 2734222 - RNA, 18 nt, Human
uugccagucaccccggcc

SEQ ID NO: 2734223 - RNA, 11 nt, Human
uugccucugcc

SEQ ID NO: 2734224 - RNA, 14 nt, Human
uugccucugccucu

SEQ ID NO: 2734225 - RNA, 16 nt, Human
uugccucugccucuga

SEQ ID NO: 2734226 - RNA, 18 nt, Human
uugccucugccucugaca

SEQ ID NO: 2734227 - RNA, 22 nt, Human
uugcugauggugcaaugaccuu

SEQ ID NO: 2734228 - RNA, 19 nt, Human
uugcugauggugcaaugac

SEQ ID NO: 2734229 - RNA, 20 nt, Human
uugcugauggugcaaugacc

SEQ ID NO: 2734230 - RNA, 14 nt, Human
uucugagcauuuaa

SEQ ID NO: 2734231 - RNA, 15 nt, Human
uucugagaaagacua

SEQ ID NO: 2734232 - RNA, 17 nt, Human
uucuguccgagcuuuga

SEQ ID NO: 2734233 - RNA, 21 nt, Human
uucuguccgagcuuugaaaau

SEQ ID NO: 2734234 - RNA, 17 nt, Human
uucuguccuacucugug

SEQ ID NO: 2734235 - RNA, 23 nt, Human
uucuguggguuucuaaagcugcc

SEQ ID NO: 2734236 - RNA, 15 nt, Human
uucuuauuucauuuc

SEQ ID NO: 2734237 - RNA, 23 nt, Human
uucuuauuuaaugaaagacugua

SEQ ID NO: 2734238 - RNA, 19 nt, Human
uucuuauuuaaugaaagac

SEQ ID NO: 2734239 - RNA, 16 nt, Human
uucuugguuuguaaau

SEQ ID NO: 2734240 - RNA, 13 nt, Human
uucuugguuugua

SEQ ID NO: 2734241 - RNA, 23 nt, Human
uucuugguuuguaaauuaacuuu

SEQ ID NO: 2734242 - RNA, 18 nt, Human
uucuugguuuguaaauua

SEQ ID NO: 2734243 - RNA, 17 nt, Human
uucuugguuuguaaauu

SEQ ID NO: 2734244 - RNA, 23 nt, Human
uugaaaagacuccaaagaaaugu

SEQ ID NO: 2734245 - RNA, 22 nt, Human
uugaaaagacuccaaagaaaug

SEQ ID NO: 2734246 - RNA, 18 nt, Human
uugaaaagacuccaaaga

SEQ ID NO: 2734247 - RNA, 16 nt, Human
uugaaaagacuccaaa

SEQ ID NO: 2734248 - RNA, 23 nt, Human
uugaaacugagaugugaacacau

SEQ ID NO: 2734249 - RNA, 21 nt, Human
uugaaacggaugauuucuaug

SEQ ID NO: 2734250 - RNA, 20 nt, Human
uugaaacggaugauuucuau

SEQ ID NO: 2734251 - RNA, 22 nt, Human
uugaaacggaugauuucuaugc

SEQ ID NO: 2734252 - RNA, 18 nt, Human
uucuuuauaauucuacuu

SEQ ID NO: 2734253 - RNA, 19 nt, Human
uugaaaacacuguucucug

SEQ ID NO: 2734254 - RNA, 21 nt, Human
uugaaaacacuguucucugcc

SEQ ID NO: 2734255 - RNA, 20 nt, Human
uugaacuuugaccucugcag

SEQ ID NO: 2734256 - RNA, 22 nt, Human
uugaacuuugaccucugcagca

SEQ ID NO: 2734257 - RNA, 19 nt, Human
uugaacucuucaaucucuu

SEQ ID NO: 2734258 - RNA, 16 nt, Human
uugaacugauaaagau

SEQ ID NO: 2734259 - RNA, 21 nt, Human
uugaaucucauaauuuauaca

SEQ ID NO: 2734260 - RNA, 15 nt, Human
uugaaucucauaauu

SEQ ID NO: 2734261 - RNA, 19 nt, Human
uugaagacuuuucuuucag

SEQ ID NO: 2734262 - RNA, 17 nt, Human
uugaagacagagcuaca

SEQ ID NO: 2734263 - RNA, 15 nt, Human
uugaggacacugaua

SEQ ID NO: 2734264 - RNA, 14 nt, Human
uugaggacacugau

SEQ ID NO: 2734265 - RNA, 19 nt, Human
uugauagcacagacccugc

SEQ ID NO: 2734266 - RNA, 20 nt, Human
uugauagcacagacccugcc

SEQ ID NO: 2734267 - RNA, 20 nt, Human
uugacgccaucccagcccca

SEQ ID NO: 2734268 - RNA, 22 nt, Human
uugaccugaggcccuucucucc

SEQ ID NO: 2734269 - RNA, 12 nt, Human
uugaccugaggc

SEQ ID NO: 2734270 - RNA, 19 nt, Human
uugaccugaggcccuucuc

SEQ ID NO: 2734271 - RNA, 15 nt, Human
uugacgccaucccag

SEQ ID NO: 2734272 - RNA, 22 nt, Human
uugacgccaucccagccccaau

SEQ ID NO: 2734273 - RNA, 14 nt, Human
uugacgccauccca

SEQ ID NO: 2734274 - RNA, 15 nt, Human
uugaccucaggugau

SEQ ID NO: 2734275 - RNA, 20 nt, Human
uugaccgugaggccagagac

SEQ ID NO: 2734276 - RNA, 21 nt, Human
uugaccgugaggccagagaca

SEQ ID NO: 2734277 - RNA, 18 nt, Human
uugcauagauucccugag

SEQ ID NO: 2734278 - RNA, 16 nt, Human
uugcagacaggcaagc

SEQ ID NO: 2734279 - RNA, 22 nt, Human
uugcagacaggcaagcaccucc

SEQ ID NO: 2734280 - RNA, 12 nt, Human
uugaugaagaag

SEQ ID NO: 2734281 - RNA, 21 nt, Human
uugauagcacagacccugccc

SEQ ID NO: 2734282 - RNA, 14 nt, Human
uugcaacaggcugg

SEQ ID NO: 2734283 - RNA, 17 nt, Human
uugcaacaggcugggcu

SEQ ID NO: 2734284 - RNA, 18 nt, Human
uugauuuccguuaaaaua

SEQ ID NO: 2734285 - RNA, 21 nt, Human
uucagagcugcccucuccugg

SEQ ID NO: 2734286 - RNA, 22 nt, Human
uucagagcugcccucuccuggg

SEQ ID NO: 2734287 - RNA, 23 nt, Human
uucagagcugcccucuccugggc

SEQ ID NO: 2734288 - RNA, 11 nt, Human
uucacugauuu

SEQ ID NO: 2734289 - RNA, 15 nt, Human
uucagagacuccugc

SEQ ID NO: 2734290 - RNA, 14 nt, Human
uucacucuccuugg

SEQ ID NO: 2734291 - RNA, 17 nt, Human
uucagcucugcaagaau

SEQ ID NO: 2734292 - RNA, 24 nt, Human
uucagcucugcaagaauugaagca

SEQ ID NO: 2734293 - RNA, 23 nt, Human
uucagcuccagcucaccagcccc

SEQ ID NO: 2734294 - RNA, 17 nt, Human
uucagcugacuuuucug

SEQ ID NO: 2734295 - RNA, 16 nt, Human
uucaggaagcucaggg

SEQ ID NO: 2734296 - RNA, 15 nt, Human
uucaggaagcucagg

SEQ ID NO: 2734297 - RNA, 20 nt, Human
uucaggaagcucagggccug

SEQ ID NO: 2734298 - RNA, 17 nt, Human
uucaggaagcucagggc

SEQ ID NO: 2734299 - RNA, 19 nt, Human
uucaggaagcucagggccu

SEQ ID NO: 2734300 - RNA, 18 nt, Human
uucaauucucauuuguca

SEQ ID NO: 2734301 - RNA, 19 nt, Human
uucaaugccccugaauuua

SEQ ID NO: 2734302 - RNA, 13 nt, Human
uucaaagauauuu

SEQ ID NO: 2734303 - RNA, 18 nt, Human
uuacuaaaauggacugug

SEQ ID NO: 2734304 - RNA, 17 nt, Human
uuacuaaaauggacugu

SEQ ID NO: 2734305 - RNA, 16 nt, Human
uuacuaaaauggacug

SEQ ID NO: 2734306 - RNA, 15 nt, Human
uuacuaaaauggacu

SEQ ID NO: 2734307 - RNA, 13 nt, Human
uuacgugaguccu

SEQ ID NO: 2734308 - RNA, 14 nt, Human
uuacgugaguccug

SEQ ID NO: 2734309 - RNA, 21 nt, Human
uuccauccuagucacuaccuu

SEQ ID NO: 2734310 - RNA, 17 nt, Human
uuccaugaguccccugu

SEQ ID NO: 2734311 - RNA, 19 nt, Human
uucagugccuuauggaaca

SEQ ID NO: 2734312 - RNA, 21 nt, Human
uucagugccuuauggaacacu

SEQ ID NO: 2734313 - RNA, 13 nt, Human
uucauaaugacuu

SEQ ID NO: 2734314 - RNA, 23 nt, Human
uucauaaugacuuaagcacacuu

SEQ ID NO: 2734315 - RNA, 19 nt, Human
uucauuuaggugaggaagc

SEQ ID NO: 2734316 - RNA, 20 nt, Human
uucaucuuccaacucaaacu

SEQ ID NO: 2734317 - RNA, 11 nt, Human
uucaucuugaa

SEQ ID NO: 2734318 - RNA, 17 nt, Human
uucaucugacuaugaca

SEQ ID NO: 2734319 - RNA, 18 nt, Human
uucaugaaagauucaaug

SEQ ID NO: 2734320 - RNA, 12 nt, Human
uucaucuugaau

SEQ ID NO: 2734321 - RNA, 20 nt, Human
uucaucugacuaugacauaa

SEQ ID NO: 2734322 - RNA, 18 nt, Human
uucuaaaggcuaccuuug

SEQ ID NO: 2734323 - RNA, 17 nt, Human
uucuaaaggcuaccuuu

SEQ ID NO: 2734324 - RNA, 16 nt, Human
uucuaaaggcuaccuu

SEQ ID NO: 2734325 - RNA, 19 nt, Human
uuccuucauucaacccacc

SEQ ID NO: 2734326 - RNA, 23 nt, Human
uuccuucagugccuuauggaaca

SEQ ID NO: 2734327 - RNA, 16 nt, Human
uuccuucagugccuua

SEQ ID NO: 2734328 - RNA, 19 nt, Human
uuccuucagugccuuaugg

SEQ ID NO: 2734329 - RNA, 15 nt, Human
uuccuucagugccuu

SEQ ID NO: 2734330 - RNA, 17 nt, Human
uuccuucugugaaagua

SEQ ID NO: 2734331 - RNA, 20 nt, Human
uuccuucugugaaaguacau

SEQ ID NO: 2734332 - RNA, 12 nt, Human
uuccuagugaaa

SEQ ID NO: 2734333 - RNA, 23 nt, Human
uuccucauaguaugguggcuggg

SEQ ID NO: 2734334 - RNA, 21 nt, Human
uuccucccucccucuuucccu

SEQ ID NO: 2734335 - RNA, 19 nt, Human
uuccucccucccucuuucc

SEQ ID NO: 2734336 - RNA, 12 nt, Human
uuccucccuccc

SEQ ID NO: 2734337 - RNA, 22 nt, Human
uuccucccucccucuuucccuc

SEQ ID NO: 2734338 - RNA, 18 nt, Human
uucccuugaugaagaagu

SEQ ID NO: 2734339 - RNA, 19 nt, Human
uucccuuugacgccauccc

SEQ ID NO: 2734340 - RNA, 22 nt, Human
uuccccacuugagaauuacccu

SEQ ID NO: 2734341 - RNA, 23 nt, Human
uucucuccucuccccaugauguu

SEQ ID NO: 2734342 - RNA, 22 nt, Human
uucucuccuguaccucuugagc

SEQ ID NO: 2734343 - RNA, 18 nt, Human
uucucuccagccccugga

SEQ ID NO: 2734344 - RNA, 11 nt, Human
uucuccaggcu

SEQ ID NO: 2734345 - RNA, 13 nt, Human
uucuccacccugc

SEQ ID NO: 2734346 - RNA, 16 nt, Human
uucuccaagcaggaca

SEQ ID NO: 2734347 - RNA, 21 nt, Human
uucugacccaugcugcccugu

SEQ ID NO: 2734348 - RNA, 16 nt, Human
uucugacccaugcugc

SEQ ID NO: 2734349 - RNA, 18 nt, Human
uucugacccaugcugccc

SEQ ID NO: 2734350 - RNA, 20 nt, Human
uucugacccaugcugcccug

SEQ ID NO: 2734351 - RNA, 17 nt, Human
uucucugauacagaaaa

SEQ ID NO: 2734352 - RNA, 14 nt, Human
uucucugauacaga

SEQ ID NO: 2734353 - RNA, 16 nt, Human
uucucugauacagaaa

SEQ ID NO: 2734354 - RNA, 15 nt, Human
uucucugauacagaa

SEQ ID NO: 2734355 - RNA, 17 nt, Human
uucuaugcugaguuugu

SEQ ID NO: 2734356 - RNA, 14 nt, Human
uucuauauuuucau

SEQ ID NO: 2734357 - RNA, 11 nt, Human
uucuauauuuu

SEQ ID NO: 2734358 - RNA, 17 nt, Human
uucuaugacacaugcaa

SEQ ID NO: 2734359 - RNA, 16 nt, Human
uucuaugacacaugca

SEQ ID NO: 2734360 - RNA, 21 nt, Human
uucuauauuuucauucuccua

SEQ ID NO: 2734361 - RNA, 18 nt, Human
uucuauauuuucauucuc

SEQ ID NO: 2734362 - RNA, 16 nt, Human
uucuauauuuucauuc

SEQ ID NO: 2734363 - RNA, 15 nt, Human
uucuauauuuucauu

SEQ ID NO: 2734364 - RNA, 14 nt, Human
uucuauuguuucuu

SEQ ID NO: 2734365 - RNA, 21 nt, Human
uuucagauaaucacaauacau

SEQ ID NO: 2734366 - RNA, 15 nt, Human
uuucagcagcugcag

SEQ ID NO: 2734367 - RNA, 15 nt, Human
uuucagauaaucaca

SEQ ID NO: 2734368 - RNA, 19 nt, Human
uuucaauaggaaaaacuga

SEQ ID NO: 2734369 - RNA, 20 nt, Human
uuucaauaggaaaaacugau

SEQ ID NO: 2734370 - RNA, 22 nt, Human
uuucaauaggaaaaacugauuu

SEQ ID NO: 2734371 - RNA, 13 nt, Human
uuuccaggaaggc

SEQ ID NO: 2734372 - RNA, 14 nt, Human
uuuccaaaauaauu

SEQ ID NO: 2734373 - RNA, 15 nt, Human
uuuccaaaguacacu

SEQ ID NO: 2734374 - RNA, 12 nt, Human
uuuccaaaguac

SEQ ID NO: 2734375 - RNA, 22 nt, Human
uuucauugcugggcuugucugu

SEQ ID NO: 2734376 - RNA, 15 nt, Human
uuucagccaagaauu

SEQ ID NO: 2734377 - RNA, 15 nt, Human
uuucugagaaagacu

SEQ ID NO: 2734378 - RNA, 14 nt, Human
uuucucuuucguua

SEQ ID NO: 2734379 - RNA, 22 nt, Human
uuucugagaaagacuauucaaa

SEQ ID NO: 2734380 - RNA, 15 nt, Human
uuucuagccagagga

SEQ ID NO: 2734381 - RNA, 16 nt, Human
uuucuaggacugaauu

SEQ ID NO: 2734382 - RNA, 21 nt, Human
uuuccucuuuggucuacacug

SEQ ID NO: 2734383 - RNA, 14 nt, Human
uuucuaaaggcuac

SEQ ID NO: 2734384 - RNA, 14 nt, Human
uuucuaaagcugcc

SEQ ID NO: 2734385 - RNA, 17 nt, Human
uuucuaaagcugccagc

SEQ ID NO: 2734386 - RNA, 12 nt, Human
uuuagaaacaca

SEQ ID NO: 2734387 - RNA, 20 nt, Human
uuuacauuguaaauaguauu

SEQ ID NO: 2734388 - RNA, 15 nt, Human
uuuacauuguaaaua

SEQ ID NO: 2734389 - RNA, 15 nt, Human
uuuacuuuguguuca

SEQ ID NO: 2734390 - RNA, 22 nt, Human
uuuacauggcuggagcuagaau

SEQ ID NO: 2734391 - RNA, 13 nt, Human
uuuacauuguaaa

SEQ ID NO: 2734392 - RNA, 20 nt, Human
uuuagaaacacaacuauauu

SEQ ID NO: 2734393 - RNA, 17 nt, Human
uuuacauggcuggagcu

SEQ ID NO: 2734394 - RNA, 19 nt, Human
uuuauuuaguuccuugagu

SEQ ID NO: 2734395 - RNA, 14 nt, Human
uuuauugucaaagu

SEQ ID NO: 2734396 - RNA, 16 nt, Human
uuuauugucaaagugg

SEQ ID NO: 2734397 - RNA, 21 nt, Human
uuuauuggcuuuucugaucca

SEQ ID NO: 2734398 - RNA, 17 nt, Human
uuuauuggcuuuucuga

SEQ ID NO: 2734399 - RNA, 13 nt, Human
uuuaugauccagc

SEQ ID NO: 2734400 - RNA, 21 nt, Human
uuuaucgucacugcuuaacuu

SEQ ID NO: 2734401 - RNA, 16 nt, Human
uuuauaaacuuuaccu

SEQ ID NO: 2734402 - RNA, 16 nt, Human
uuuaucgucacugcuu

SEQ ID NO: 2734403 - RNA, 14 nt, Human
uuuauaaacuuuac

SEQ ID NO: 2734404 - RNA, 21 nt, Human
uuuguauaaaauaauuuuuau

SEQ ID NO: 2734405 - RNA, 22 nt, Human
uuuguaaauuaacuuuuauaaa

SEQ ID NO: 2734406 - RNA, 11 nt, Human
uuuguauagaa

SEQ ID NO: 2734407 - RNA, 19 nt, Human
uuuggugguuucagaaaug

SEQ ID NO: 2734408 - RNA, 15 nt, Human
uuuguaaauuaacuu

SEQ ID NO: 2734409 - RNA, 17 nt, Human
uuuguaaauuaacuuuu

SEQ ID NO: 2734410 - RNA, 16 nt, Human
uuuguaaauuaacuuu

SEQ ID NO: 2734411 - RNA, 13 nt, Human
uuuguccccaccg

SEQ ID NO: 2734412 - RNA, 21 nt, Human
uuuguccccaccgcagacagg

SEQ ID NO: 2734413 - RNA, 12 nt, Human
uuuguguuagag

SEQ ID NO: 2734414 - RNA, 16 nt, Human
uuuguugucagcugaa

SEQ ID NO: 2734415 - RNA, 14 nt, Human
uuuguuguuuguuu

SEQ ID NO: 2734416 - RNA, 12 nt, Human
uuuguuguuugu

SEQ ID NO: 2734417 - RNA, 13 nt, Human
uuuguucauacau

SEQ ID NO: 2734418 - RNA, 16 nt, Human
uuuguucauacauauu

SEQ ID NO: 2734419 - RNA, 21 nt, Human
uuugcauagauucccugagca

SEQ ID NO: 2734420 - RNA, 23 nt, Human
uuuggaacaagaugguucuagca

SEQ ID NO: 2734421 - RNA, 18 nt, Human
uuugccauguuggccagg

SEQ ID NO: 2734422 - RNA, 16 nt, Human
uuuggaaaucuuuaaa

SEQ ID NO: 2734423 - RNA, 14 nt, Human
uuugcagacaggca

SEQ ID NO: 2734424 - RNA, 22 nt, Human
uuugaggucuguucuuuccaaa

SEQ ID NO: 2734425 - RNA, 17 nt, Human
uuugaggucuguucuuu

SEQ ID NO: 2734426 - RNA, 15 nt, Human
uuugagcagggcuca

SEQ ID NO: 2734427 - RNA, 10 nt, Human
uuuuauauuu

SEQ ID NO: 2734428 - RNA, 18 nt, Human
uuuuaucgucacugcuua

SEQ ID NO: 2734429 - RNA, 15 nt, Human
uuuuauaugcuucug

SEQ ID NO: 2734430 - RNA, 20 nt, Human
uuuuauaugcuucuguuuua

SEQ ID NO: 2734431 - RNA, 19 nt, Human
uuuguuguuuguuuagucu

SEQ ID NO: 2734432 - RNA, 22 nt, Human
uuuuacauaaauuuaguauuuu

SEQ ID NO: 2734433 - RNA, 17 nt, Human
uuuuaauuugguuuuca

SEQ ID NO: 2734434 - RNA, 21 nt, Human
uuuuaauuugguuuucacauu

SEQ ID NO: 2734435 - RNA, 13 nt, Human
uuuuccugaaaac

SEQ ID NO: 2734436 - RNA, 16 nt, Human
uuuucagaaaauauua

SEQ ID NO: 2734437 - RNA, 18 nt, Human
uuuuccaugaguccccug

SEQ ID NO: 2734438 - RNA, 19 nt, Human
uuuuccaugaguccccugu

SEQ ID NO: 2734439 - RNA, 15 nt, Human
uuuuccuucagugcc

SEQ ID NO: 2734440 - RNA, 17 nt, Human
uuuucuugcaugaggcu

SEQ ID NO: 2734441 - RNA, 14 nt, Human
uuuucuucucccuc

SEQ ID NO: 2734442 - RNA, 15 nt, Human
uuuuaugauccagca

SEQ ID NO: 2734443 - RNA, 13 nt, Human
uuuuaugauccag

SEQ ID NO: 2734444 - RNA, 15 nt, Human
uuuucagaaaauauu

SEQ ID NO: 2734445 - RNA, 13 nt, Human
uuuucacauaucu

SEQ ID NO: 2734446 - RNA, 16 nt, Human
uuuucacauaucuagu

SEQ ID NO: 2734447 - RNA, 15 nt, Human
uuuucacaguucucu

SEQ ID NO: 2734448 - RNA, 12 nt, Human
uuuuuucugaaa

SEQ ID NO: 2734449 - RNA, 17 nt, Human
uuuuuuccuucagugcc

SEQ ID NO: 2734450 - RNA, 12 nt, Human
uuuuuuacuaau

SEQ ID NO: 2734451 - RNA, 13 nt, Human
auaauguuucaaa

SEQ ID NO: 2734452 - RNA, 18 nt, Human
auaaggguaucuggugac

SEQ ID NO: 2734453 - RNA, 18 nt, Human
auaauguuucaaacauau

SEQ ID NO: 2734454 - RNA, 22 nt, Human
auacacuuacacuuuaugcaca

SEQ ID NO: 2734455 - RNA, 13 nt, Human
auacacuuacacu

SEQ ID NO: 2734456 - RNA, 17 nt, Human
auacaaugcugugcccu

SEQ ID NO: 2734457 - RNA, 14 nt, Human
auacaaugcugugc

SEQ ID NO: 2734458 - RNA, 13 nt, Human
auacccaccccca

SEQ ID NO: 2734459 - RNA, 14 nt, Human
auacccacccccac

SEQ ID NO: 2734460 - RNA, 16 nt, Human
auacccacccccaccc

SEQ ID NO: 2734461 - RNA, 17 nt, Human
auacccacccccaccca

SEQ ID NO: 2734462 - RNA, 13 nt, Human
auacagaaaaguu

SEQ ID NO: 2734463 - RNA, 17 nt, Human
auacccagaaaguuauu

SEQ ID NO: 2734464 - RNA, 13 nt, Human
auaccuguccccc

SEQ ID NO: 2734465 - RNA, 14 nt, Human
auaccugucccccu

SEQ ID NO: 2734466 - RNA, 15 nt, Human
auaccugucccccug

SEQ ID NO: 2734467 - RNA, 16 nt, Human
auaccugucccccuga

SEQ ID NO: 2734468 - RNA, 14 nt, Human
auaacaaugaaagu

SEQ ID NO: 2734469 - RNA, 15 nt, Human
auaacaaugcuguau

SEQ ID NO: 2734470 - RNA, 17 nt, Human
auaacaaugcuguauuu

SEQ ID NO: 2734471 - RNA, 19 nt, Human
auaacaaugcuguauuuua

SEQ ID NO: 2734472 - RNA, 20 nt, Human
auaacaaugcuguauuuuaa

SEQ ID NO: 2734473 - RNA, 21 nt, Human
auaacaaugcuguauuuuaaa

SEQ ID NO: 2734474 - RNA, 18 nt, Human
auaacauguaauuaagua

SEQ ID NO: 2734475 - RNA, 13 nt, Human
auaacauguaauu

SEQ ID NO: 2734476 - RNA, 12 nt, Human
auaacauguaau

SEQ ID NO: 2734477 - RNA, 20 nt, Human
auaacauguaauuaaguacu

SEQ ID NO: 2734478 - RNA, 20 nt, Human
aguuugagaucagccugggc

SEQ ID NO: 2734479 - RNA, 16 nt, Human
aguuugauuaaauucu

SEQ ID NO: 2734480 - RNA, 18 nt, Human
aguuugagaucagccugg

SEQ ID NO: 2734481 - RNA, 19 nt, Human
aguuugagaucagccuggg

SEQ ID NO: 2734482 - RNA, 22 nt, Human
aguuugauuaaauucuugcaaa

SEQ ID NO: 2734483 - RNA, 20 nt, Human
aguuugauuaaauucuugca

SEQ ID NO: 2734484 - RNA, 18 nt, Human
aguuugauuaaauucuug

SEQ ID NO: 2734485 - RNA, 17 nt, Human
aguuugauuaaauucuu

SEQ ID NO: 2734486 - RNA, 22 nt, Human
aguuguuacauuuuuaagugcu

SEQ ID NO: 2734487 - RNA, 20 nt, Human
aguuguuacauuuuuaagug

SEQ ID NO: 2734488 - RNA, 19 nt, Human
aguuguuacauuuuuaagu

SEQ ID NO: 2734489 - RNA, 22 nt, Human
auaaaaagccugcaauuucaua

SEQ ID NO: 2734490 - RNA, 23 nt, Human
aguuugauuaaauucuugcaaag

SEQ ID NO: 2734491 - RNA, 20 nt, Human
auaaaaagccugcaauuuca

SEQ ID NO: 2734492 - RNA, 13 nt, Human
auauuauguuaaa

SEQ ID NO: 2734493 - RNA, 17 nt, Human
auauuauguguuuccau

SEQ ID NO: 2734494 - RNA, 20 nt, Human
auaugcucugcauguuacau

SEQ ID NO: 2734495 - RNA, 22 nt, Human
auaugcacacauuuuuuaaaug

SEQ ID NO: 2734496 - RNA, 17 nt, Human
auaugcucugcauguua

SEQ ID NO: 2734497 - RNA, 16 nt, Human
auaugcucugcauguu

SEQ ID NO: 2734498 - RNA, 14 nt, Human
auauuauguuaaaa

SEQ ID NO: 2734499 - RNA, 17 nt, Human
auauucaggaagcucag

SEQ ID NO: 2734500 - RNA, 19 nt, Human
auauucaggaagcucaggg

SEQ ID NO: 2734501 - RNA, 18 nt, Human
auauauuuuuuucugaaa

SEQ ID NO: 2734502 - RNA, 20 nt, Human
auauauuuuuauauuuacua

SEQ ID NO: 2734503 - RNA, 19 nt, Human
auauauuuuuauauuuacu

SEQ ID NO: 2734504 - RNA, 18 nt, Human
auauauuuuuauauuuac

SEQ ID NO: 2734505 - RNA, 15 nt, Human
auagcacagacccug

SEQ ID NO: 2734506 - RNA, 17 nt, Human
auagcacagacccugcc

SEQ ID NO: 2734507 - RNA, 18 nt, Human
auagcacagacccugccc

SEQ ID NO: 2734508 - RNA, 18 nt, Human
auagguuuggacaaaaug

SEQ ID NO: 2734509 - RNA, 24 nt, Human
auagguuuggacaaaauggaauac

SEQ ID NO: 2734510 - RNA, 15 nt, Human
auagccuaggugaca

SEQ ID NO: 2734511 - RNA, 17 nt, Human
auagccuaggugacaga

SEQ ID NO: 2734512 - RNA, 11 nt, Human
aguccaagcau

SEQ ID NO: 2734513 - RNA, 19 nt, Human
aguccucuuuucugagagg

SEQ ID NO: 2734514 - RNA, 22 nt, Human
aguccucuuuucugagaggacu

SEQ ID NO: 2734515 - RNA, 20 nt, Human
aguccuuaccagcagagcac

SEQ ID NO: 2734516 - RNA, 20 nt, Human
agugaauucuugaaggaaaa

SEQ ID NO: 2734517 - RNA, 17 nt, Human
agucugaaggcuggguu

SEQ ID NO: 2734518 - RNA, 19 nt, Human
aguccuuaccagcagagca

SEQ ID NO: 2734519 - RNA, 21 nt, Human
aguaugaggcauuuguuugaa

SEQ ID NO: 2734520 - RNA, 20 nt, Human
aguaugaggcauuuguuuga

SEQ ID NO: 2734521 - RNA, 18 nt, Human
aguauuuuugacagaaua

SEQ ID NO: 2734522 - RNA, 16 nt, Human
aguauuuuugacagaa

SEQ ID NO: 2734523 - RNA, 17 nt, Human
aguauuuuugacagaau

SEQ ID NO: 2734524 - RNA, 13 nt, Human
aguauuuuugaca

SEQ ID NO: 2734525 - RNA, 17 nt, Human
aguauuuuguuucagug

SEQ ID NO: 2734526 - RNA, 17 nt, Human
aguaugaggcauuuguu

SEQ ID NO: 2734527 - RNA, 14 nt, Human
aguauuuuguuuca

SEQ ID NO: 2734528 - RNA, 23 nt, Human
aguaugaggcauuuguuugaacu

SEQ ID NO: 2734529 - RNA, 22 nt, Human
agucacacaguauuacuucugc

SEQ ID NO: 2734530 - RNA, 18 nt, Human
aguacguugugcauuugg

SEQ ID NO: 2734531 - RNA, 17 nt, Human
aguacguugugcauuug

SEQ ID NO: 2734532 - RNA, 16 nt, Human
aguacguugugcauuu

SEQ ID NO: 2734533 - RNA, 14 nt, Human
aguacuauaauuua

SEQ ID NO: 2734534 - RNA, 19 nt, Human
aguacuacaguccucccau

SEQ ID NO: 2734535 - RNA, 22 nt, Human
aguacuacaguccucccaucuc

SEQ ID NO: 2734536 - RNA, 14 nt, Human
aguacuauguauca

SEQ ID NO: 2734537 - RNA, 12 nt, Human
aguacuauguau

SEQ ID NO: 2734538 - RNA, 17 nt, Human
aguacuucuccacccug

SEQ ID NO: 2734539 - RNA, 12 nt, Human
aguacuucuuuu

SEQ ID NO: 2734540 - RNA, 22 nt, Human
aguacuucuccacccugcucuc

SEQ ID NO: 2734541 - RNA, 14 nt, Human
aguacguugugcau

SEQ ID NO: 2734542 - RNA, 15 nt, Human
aguacguugugcauu

SEQ ID NO: 2734543 - RNA, 16 nt, Human
aggucuguucuuucca

SEQ ID NO: 2734544 - RNA, 15 nt, Human
aggucuguucuuucc

SEQ ID NO: 2734545 - RNA, 13 nt, Human
aggucuguucuuu

SEQ ID NO: 2734546 - RNA, 19 nt, Human
aguaacaaugaagauaaaa

SEQ ID NO: 2734547 - RNA, 23 nt, Human
aguaaaugcuagguuaauuccaa

SEQ ID NO: 2734548 - RNA, 11 nt, Human
aguaaaugcua

SEQ ID NO: 2734549 - RNA, 22 nt, Human
aguaaaugcuagguuaauucca

SEQ ID NO: 2734550 - RNA, 14 nt, Human
agugauucuccugc

SEQ ID NO: 2734551 - RNA, 18 nt, Human
agugccuuacacaauggu

SEQ ID NO: 2734552 - RNA, 15 nt, Human
agugauucuccugcc

SEQ ID NO: 2734553 - RNA, 17 nt, Human
agugauucuccugccuc

SEQ ID NO: 2734554 - RNA, 14 nt, Human
agugauccucccac

SEQ ID NO: 2734555 - RNA, 15 nt, Human
agugauccucccacc

SEQ ID NO: 2734556 - RNA, 18 nt, Human
agugauccucccaccuca

SEQ ID NO: 2734557 - RNA, 23 nt, Human
agugauccucccaccucagccuc

SEQ ID NO: 2734558 - RNA, 24 nt, Human
agugauccucccaccucagccucc

SEQ ID NO: 2734559 - RNA, 16 nt, Human
agugccuuauggaaca

SEQ ID NO: 2734560 - RNA, 10 nt, Human
agugccuuau

SEQ ID NO: 2734561 - RNA, 13 nt, Human
agugccuuaugga

SEQ ID NO: 2734562 - RNA, 14 nt, Human
agugccuuauggaa

SEQ ID NO: 2734563 - RNA, 15 nt, Human
agugccuuauggaac

SEQ ID NO: 2734564 - RNA, 23 nt, Human
aguucagagcugcccucuccugg

SEQ ID NO: 2734565 - RNA, 21 nt, Human
aguucagagcugcccucuccu

SEQ ID NO: 2734566 - RNA, 22 nt, Human
aguucagagcugcccucuccug

SEQ ID NO: 2734567 - RNA, 20 nt, Human
aguucagagcugcccucucc

SEQ ID NO: 2734568 - RNA, 19 nt, Human
aguucagagcugcccucuc

SEQ ID NO: 2734569 - RNA, 18 nt, Human
aguucagguaacaggcag

SEQ ID NO: 2734570 - RNA, 13 nt, Human
aguucaucuugaa

SEQ ID NO: 2734571 - RNA, 15 nt, Human
aguucaucuugaauu

SEQ ID NO: 2734572 - RNA, 19 nt, Human
aguucaucuugaauuguaa

SEQ ID NO: 2734573 - RNA, 18 nt, Human
aguugaaaagacuccaaa

SEQ ID NO: 2734574 - RNA, 14 nt, Human
aguugaaaagacuc

SEQ ID NO: 2734575 - RNA, 20 nt, Human
aguugaaaagacuccaaaga

SEQ ID NO: 2734576 - RNA, 19 nt, Human
aguugaaaagacuccaaag

SEQ ID NO: 2734577 - RNA, 16 nt, Human
aguugauacuacaguu

SEQ ID NO: 2734578 - RNA, 20 nt, Human
augaaguccaagcauuuaga

SEQ ID NO: 2734579 - RNA, 23 nt, Human
augaaguccaagcauuuagaugu

SEQ ID NO: 2734580 - RNA, 22 nt, Human
augaggcauuuguuugaacuga

SEQ ID NO: 2734581 - RNA, 21 nt, Human
augaggcauuuguuugaacug

SEQ ID NO: 2734582 - RNA, 14 nt, Human
augaggcauuuguu

SEQ ID NO: 2734583 - RNA, 13 nt, Human
augaggcauuugu

SEQ ID NO: 2734584 - RNA, 16 nt, Human
augaaaacacauuuuu

SEQ ID NO: 2734585 - RNA, 15 nt, Human
augaaaacacauuuu

SEQ ID NO: 2734586 - RNA, 14 nt, Human
augaaaacacauuu

SEQ ID NO: 2734587 - RNA, 14 nt, Human
aucuaguaugaaau

SEQ ID NO: 2734588 - RNA, 19 nt, Human
aucuaguaugaaauuauau

SEQ ID NO: 2734589 - RNA, 15 nt, Human
aucuaguaugaaauu

SEQ ID NO: 2734590 - RNA, 16 nt, Human
aucuaguaugaaauua

SEQ ID NO: 2734591 - RNA, 17 nt, Human
aucuaguaugaaauuau

SEQ ID NO: 2734592 - RNA, 18 nt, Human
aucuaguaugaaauuaua

SEQ ID NO: 2734593 - RNA, 20 nt, Human
aucuccgucaacucauauuu

SEQ ID NO: 2734594 - RNA, 19 nt, Human
auccucaguuuuugugaaa

SEQ ID NO: 2734595 - RNA, 19 nt, Human
aucccaugagccucagcau

SEQ ID NO: 2734596 - RNA, 20 nt, Human
aucccauuauucaaaguugc

SEQ ID NO: 2734597 - RNA, 15 nt, Human
aucccauuauucaaa

SEQ ID NO: 2734598 - RNA, 14 nt, Human
aucccauuauucaa

SEQ ID NO: 2734599 - RNA, 19 nt, Human
auccagacccggcugcgug

SEQ ID NO: 2734600 - RNA, 17 nt, Human
auccucauacccacccc

SEQ ID NO: 2734601 - RNA, 14 nt, Human
aucaaauaugcaaa

SEQ ID NO: 2734602 - RNA, 13 nt, Human
aucacagccucug

SEQ ID NO: 2734603 - RNA, 13 nt, Human
aucaccagacagg

SEQ ID NO: 2734604 - RNA, 20 nt, Human
aucaccaacgucugugccau

SEQ ID NO: 2734605 - RNA, 20 nt, Human
aucaaagagguuuuaaaaaa

SEQ ID NO: 2734606 - RNA, 23 nt, Human
aucaaagagguuuuaaaaaaauc

SEQ ID NO: 2734607 - RNA, 17 nt, Human
aucaugaauuaguuuua

SEQ ID NO: 2734608 - RNA, 14 nt, Human
aucaugucuggcua

SEQ ID NO: 2734609 - RNA, 13 nt, Human
aucagcuuauugu

SEQ ID NO: 2734610 - RNA, 22 nt, Human
aucagcuugcccuguuaaaaga

SEQ ID NO: 2734611 - RNA, 17 nt, Human
auguuccuagugaaaga

SEQ ID NO: 2734612 - RNA, 16 nt, Human
auguucucucuucucc

SEQ ID NO: 2734613 - RNA, 17 nt, Human
auguucucucuucucca

SEQ ID NO: 2734614 - RNA, 13 nt, Human
auguucucugagg

SEQ ID NO: 2734615 - RNA, 15 nt, Human
auguucugggacaca

SEQ ID NO: 2734616 - RNA, 17 nt, Human
auguucucugaggacac

SEQ ID NO: 2734617 - RNA, 14 nt, Human
auguucugggacac

SEQ ID NO: 2734618 - RNA, 14 nt, Human
auguuugccucugc

SEQ ID NO: 2734619 - RNA, 15 nt, Human
auguuugccucugcc

SEQ ID NO: 2734620 - RNA, 17 nt, Human
auguuugccucugccuc

SEQ ID NO: 2734621 - RNA, 16 nt, Human
auguuccuagugaaag

SEQ ID NO: 2734622 - RNA, 15 nt, Human
auguuccuagugaaa

SEQ ID NO: 2734623 - RNA, 13 nt, Human
auguguaaguauu

SEQ ID NO: 2734624 - RNA, 15 nt, Human
auguguaaaauguga

SEQ ID NO: 2734625 - RNA, 17 nt, Human
auguguaagacaaaaag

SEQ ID NO: 2734626 - RNA, 19 nt, Human
auguguaagacaaaaagcu

SEQ ID NO: 2734627 - RNA, 15 nt, Human
augugaacacaucag

SEQ ID NO: 2734628 - RNA, 19 nt, Human
augucacaggcagguccag

SEQ ID NO: 2734629 - RNA, 16 nt, Human
augucaaucagccuag

SEQ ID NO: 2734630 - RNA, 21 nt, Human
augucaaucagccuaguugau

SEQ ID NO: 2734631 - RNA, 13 nt, Human
augucacaggcag

SEQ ID NO: 2734632 - RNA, 18 nt, Human
augguccgugcuaaggac

SEQ ID NO: 2734633 - RNA, 15 nt, Human
augguccgugcuaag

SEQ ID NO: 2734634 - RNA, 23 nt, Human
auguaauuaaguacuauguauca

SEQ ID NO: 2734635 - RNA, 20 nt, Human
augggugcuuggaggaagga

SEQ ID NO: 2734636 - RNA, 21 nt, Human
augggugcuuggaggaaggaa

SEQ ID NO: 2734637 - RNA, 23 nt, Human
augggugcuuggaggaaggaaac

SEQ ID NO: 2734638 - RNA, 16 nt, Human
augaucuuuaaaauac

SEQ ID NO: 2734639 - RNA, 17 nt, Human
augaucuuugcagacag

SEQ ID NO: 2734640 - RNA, 18 nt, Human
augaucuuugcagacagg

SEQ ID NO: 2734641 - RNA, 19 nt, Human
augaucuuugcagacaggc

SEQ ID NO: 2734642 - RNA, 21 nt, Human
augaucuuugcagacaggcaa

SEQ ID NO: 2734643 - RNA, 21 nt, Human
augaugaucuuuaaaauacac

SEQ ID NO: 2734644 - RNA, 18 nt, Human
augaugaucuuuaaaaua

SEQ ID NO: 2734645 - RNA, 15 nt, Human
augaugauccuaggc

SEQ ID NO: 2734646 - RNA, 18 nt, Human
augaugaaaugaggucag

SEQ ID NO: 2734647 - RNA, 23 nt, Human
augaugaaaugaggucagagccu

SEQ ID NO: 2734648 - RNA, 18 nt, Human
augcacaaacagaggccg

SEQ ID NO: 2734649 - RNA, 22 nt, Human
augcacagaguuguuacauuuu

SEQ ID NO: 2734650 - RNA, 21 nt, Human
augcacagaguuguuacauuu

SEQ ID NO: 2734651 - RNA, 19 nt, Human
augcacagaguuguuacau

SEQ ID NO: 2734652 - RNA, 15 nt, Human
augcacacauuuuuu

SEQ ID NO: 2734653 - RNA, 14 nt, Human
augcacacauuuuu

SEQ ID NO: 2734654 - RNA, 13 nt, Human
augcacacauuuu

SEQ ID NO: 2734655 - RNA, 20 nt, Human
augccuggauggggcugcac

SEQ ID NO: 2734656 - RNA, 19 nt, Human
augccuggauggggcugca

SEQ ID NO: 2734657 - RNA, 20 nt, Human
augcugaguuugugcuggug

SEQ ID NO: 2734658 - RNA, 16 nt, Human
augcugcccugugagu

SEQ ID NO: 2734659 - RNA, 13 nt, Human
augcugcccugug

SEQ ID NO: 2734660 - RNA, 12 nt, Human
augcugcccugu

SEQ ID NO: 2734661 - RNA, 14 nt, Human
augcugcccuguga

SEQ ID NO: 2734662 - RNA, 15 nt, Human
augcugcccugugag

SEQ ID NO: 2734663 - RNA, 15 nt, Human
augcuuguacauaau

SEQ ID NO: 2734664 - RNA, 16 nt, Human
augcuuguacauaaug

SEQ ID NO: 2734665 - RNA, 18 nt, Human
auggcuuuguauagaacc

SEQ ID NO: 2734666 - RNA, 18 nt, Human
auggcuggagcuagaauu

SEQ ID NO: 2734667 - RNA, 17 nt, Human
auggcuuuugugcauua

SEQ ID NO: 2734668 - RNA, 16 nt, Human
auggcuuuugugcauu

SEQ ID NO: 2734669 - RNA, 18 nt, Human
auggcuuuugugcauuau

SEQ ID NO: 2734670 - RNA, 19 nt, Human
auggcuuuguauagaaccu

SEQ ID NO: 2734671 - RNA, 19 nt, Human
agcgagcccugguggcagu

SEQ ID NO: 2734672 - RNA, 13 nt, Human
agcgagcccuggu

SEQ ID NO: 2734673 - RNA, 12 nt, Human
agccugggaggu

SEQ ID NO: 2734674 - RNA, 12 nt, Human
agcucagagagg

SEQ ID NO: 2734675 - RNA, 14 nt, Human
agcucagagagggu

SEQ ID NO: 2734676 - RNA, 18 nt, Human
agcucagagaggguggga

SEQ ID NO: 2734677 - RNA, 19 nt, Human
agcucaccagccccagugc

SEQ ID NO: 2734678 - RNA, 20 nt, Human
agcucaccagccccagugcc

SEQ ID NO: 2734679 - RNA, 12 nt, Human
agcucaccucuc

SEQ ID NO: 2734680 - RNA, 15 nt, Human
agcucaccagcccca

SEQ ID NO: 2734681 - RNA, 15 nt, Human
agcucaccucucccu

SEQ ID NO: 2734682 - RNA, 18 nt, Human
agcucaccucucccuugg

SEQ ID NO: 2734683 - RNA, 19 nt, Human
agcucaccucucccuugga

SEQ ID NO: 2734684 - RNA, 16 nt, Human
agcucaccagccccag

SEQ ID NO: 2734685 - RNA, 23 nt, Human
agcuaauguaauaacugugaagu

SEQ ID NO: 2734686 - RNA, 19 nt, Human
agcuccccucggagaagag

SEQ ID NO: 2734687 - RNA, 17 nt, Human
agcuccccucggagaag

SEQ ID NO: 2734688 - RNA, 20 nt, Human
agcuccccucggagaagagc

SEQ ID NO: 2734689 - RNA, 15 nt, Human
agcugaaccugggua

SEQ ID NO: 2734690 - RNA, 16 nt, Human
agcugguugagguuuc

SEQ ID NO: 2734691 - RNA, 22 nt, Human
agcugguuuuuagcggagacgg

SEQ ID NO: 2734692 - RNA, 18 nt, Human
agcuggucccacucaguc

SEQ ID NO: 2734693 - RNA, 13 nt, Human
agcugcugacagu

SEQ ID NO: 2734694 - RNA, 14 nt, Human
agcugcugacagug

SEQ ID NO: 2734695 - RNA, 16 nt, Human
agcuggucccacucag

SEQ ID NO: 2734696 - RNA, 17 nt, Human
agcuggucccacucagu

SEQ ID NO: 2734697 - RNA, 12 nt, Human
agcugcugacag

SEQ ID NO: 2734698 - RNA, 19 nt, Human
agcugcgguccacccagga

SEQ ID NO: 2734699 - RNA, 20 nt, Human
agcugcgguccacccaggag

SEQ ID NO: 2734700 - RNA, 13 nt, Human
agcugcgguccac

SEQ ID NO: 2734701 - RNA, 16 nt, Human
agcugcgguccaccca

SEQ ID NO: 2734702 - RNA, 17 nt, Human
agcugcgguccacccag

SEQ ID NO: 2734703 - RNA, 18 nt, Human
agcugcgguccacccagg

SEQ ID NO: 2734704 - RNA, 18 nt, Human
agcuucauuuccuguguc

SEQ ID NO: 2734705 - RNA, 23 nt, Human
agcuuuguuuguugucagcugaa

SEQ ID NO: 2734706 - RNA, 22 nt, Human
agcuuuguuuguugucagcuga

SEQ ID NO: 2734707 - RNA, 19 nt, Human
agcuucauuuccugugucu

SEQ ID NO: 2734708 - RNA, 22 nt, Human
aggaauaccugucccccugaca

SEQ ID NO: 2734709 - RNA, 15 nt, Human
aggaauaccuguccc

SEQ ID NO: 2734710 - RNA, 18 nt, Human
aggaauaccugucccccu

SEQ ID NO: 2734711 - RNA, 20 nt, Human
aggaacaaggcaaggcuguc

SEQ ID NO: 2734712 - RNA, 21 nt, Human
aggaacuuaaauaaugugaaa

SEQ ID NO: 2734713 - RNA, 12 nt, Human
aggaacaaggca

SEQ ID NO: 2734714 - RNA, 13 nt, Human
aggaacaaggcaa

SEQ ID NO: 2734715 - RNA, 16 nt, Human
aggaacaaggcaaggc

SEQ ID NO: 2734716 - RNA, 17 nt, Human
aggaacaaggcaaggcu

SEQ ID NO: 2734717 - RNA, 19 nt, Human
aggaacaaggcaaggcugu

SEQ ID NO: 2734718 - RNA, 15 nt, Human
aggagaggagagggg

SEQ ID NO: 2734719 - RNA, 15 nt, Human
agggauuagggagag

SEQ ID NO: 2734720 - RNA, 14 nt, Human
agggccugcaaggg

SEQ ID NO: 2734721 - RNA, 15 nt, Human
agggccugcaaggga

SEQ ID NO: 2734722 - RNA, 12 nt, Human
agggccuggccu

SEQ ID NO: 2734723 - RNA, 13 nt, Human
agggccuggccug

SEQ ID NO: 2734724 - RNA, 16 nt, Human
agggauacccauccca

SEQ ID NO: 2734725 - RNA, 22 nt, Human
aggggcccaaauucuuucagug

SEQ ID NO: 2734726 - RNA, 14 nt, Human
agggccuggccuga

SEQ ID NO: 2734727 - RNA, 16 nt, Human
agggucccugguggca

SEQ ID NO: 2734728 - RNA, 17 nt, Human
agggucccugguggcag

SEQ ID NO: 2734729 - RNA, 20 nt, Human
agggucccugguggcagcuc

SEQ ID NO: 2734730 - RNA, 22 nt, Human
agggucccugguggcagcucac

SEQ ID NO: 2734731 - RNA, 13 nt, Human
aggguauuccaga

SEQ ID NO: 2734732 - RNA, 21 nt, Human
aggguaucuggugacuuuccu

SEQ ID NO: 2734733 - RNA, 12 nt, Human
agggucccuggu

SEQ ID NO: 2734734 - RNA, 14 nt, Human
agggucccuggugg

SEQ ID NO: 2734735 - RNA, 14 nt, Human
agguacucuccugg

SEQ ID NO: 2734736 - RNA, 13 nt, Human
agguacucuccug

SEQ ID NO: 2734737 - RNA, 22 nt, Human
agguacgaaaagaggggaagag

SEQ ID NO: 2734738 - RNA, 16 nt, Human
agguaacaggcagaua

SEQ ID NO: 2734739 - RNA, 13 nt, Human
agguaacaggcag

SEQ ID NO: 2734740 - RNA, 14 nt, Human
agguaacaggcaga

SEQ ID NO: 2734741 - RNA, 22 nt, Human
aggguuuugccauguuggccag

SEQ ID NO: 2734742 - RNA, 23 nt, Human
aggguuuugccauguuggccagg

SEQ ID NO: 2734743 - RNA, 20 nt, Human
agggucucacuauguugccc

SEQ ID NO: 2734744 - RNA, 15 nt, Human
agggacccuccacca

SEQ ID NO: 2734745 - RNA, 18 nt, Human
aggcuuagucacugagac

SEQ ID NO: 2734746 - RNA, 22 nt, Human
aggcuguaucccaugagccuca

SEQ ID NO: 2734747 - RNA, 17 nt, Human
aggcuuagucacugaga

SEQ ID NO: 2734748 - RNA, 20 nt, Human
aggcuguaucccaugagccu

SEQ ID NO: 2734749 - RNA, 21 nt, Human
aggcuguaucccaugagccuc

SEQ ID NO: 2734750 - RNA, 18 nt, Human
aggcuggguucugauccu

SEQ ID NO: 2734751 - RNA, 15 nt, Human
aggcuaccuuuguau

SEQ ID NO: 2734752 - RNA, 14 nt, Human
aggcuaccuuugua

SEQ ID NO: 2734753 - RNA, 13 nt, Human
aggcuaccuuugu

SEQ ID NO: 2734754 - RNA, 21 nt, Human
aggccaugggcacugugggua

SEQ ID NO: 2734755 - RNA, 21 nt, Human
aggcccucugcccacucccug

SEQ ID NO: 2734756 - RNA, 22 nt, Human
aggcccucugcccacucccugc

SEQ ID NO: 2734757 - RNA, 23 nt, Human
aggcccucugcccacucccugca

SEQ ID NO: 2734758 - RNA, 12 nt, Human
aggcccuucucu

SEQ ID NO: 2734759 - RNA, 15 nt, Human
aggcccuucucucca

SEQ ID NO: 2734760 - RNA, 19 nt, Human
aggcccuucucuccagccc

SEQ ID NO: 2734761 - RNA, 15 nt, Human
aggccaggcccucug

SEQ ID NO: 2734762 - RNA, 13 nt, Human
aggccaggcccuc

SEQ ID NO: 2734763 - RNA, 14 nt, Human
aggccaggcccucu

SEQ ID NO: 2734764 - RNA, 23 nt, Human
aggccagcugcuugggcuucauc

SEQ ID NO: 2734765 - RNA, 19 nt, Human
aggcauuccccaggaggcc

SEQ ID NO: 2734766 - RNA, 20 nt, Human
aggcauuccccaggaggcca

SEQ ID NO: 2734767 - RNA, 15 nt, Human
aggcaugguggccca

SEQ ID NO: 2734768 - RNA, 17 nt, Human
aggcaugugaugagagg

SEQ ID NO: 2734769 - RNA, 17 nt, Human
aggcauguucucugagg

SEQ ID NO: 2734770 - RNA, 21 nt, Human
aggcaugugaugagaggaaau

SEQ ID NO: 2734771 - RNA, 19 nt, Human
aggcaugugaugagaggaa

SEQ ID NO: 2734772 - RNA, 20 nt, Human
aggcaugugaugagaggaaa

SEQ ID NO: 2734773 - RNA, 18 nt, Human
aggcauguucucugagga

SEQ ID NO: 2734774 - RNA, 19 nt, Human
aggcauguucucugaggac

SEQ ID NO: 2734775 - RNA, 18 nt, Human
aggcauuccccaggaggc

SEQ ID NO: 2734776 - RNA, 17 nt, Human
aggcauuccccaggagg

SEQ ID NO: 2734777 - RNA, 23 nt, Human
agaggacuuuucuuuguggcuuc

SEQ ID NO: 2734778 - RNA, 14 nt, Human
agaggacuuuucuu

SEQ ID NO: 2734779 - RNA, 21 nt, Human
agaggacuuuucuuuguggcu

SEQ ID NO: 2734780 - RNA, 22 nt, Human
agaggacuuuucuuuguggcuu

SEQ ID NO: 2734781 - RNA, 17 nt, Human
agaggggguggccuccc

SEQ ID NO: 2734782 - RNA, 19 nt, Human
agaggggguggccucccaa

SEQ ID NO: 2734783 - RNA, 13 nt, Human
agagggccugcaa

SEQ ID NO: 2734784 - RNA, 16 nt, Human
agagggccugcaaggg

SEQ ID NO: 2734785 - RNA, 20 nt, Human
agacugaguacguugugcau

SEQ ID NO: 2734786 - RNA, 22 nt, Human
agacugaguacguugugcauuu

SEQ ID NO: 2734787 - RNA, 18 nt, Human
agacucugucucaaaaaa

SEQ ID NO: 2734788 - RNA, 13 nt, Human
agacucugucuca

SEQ ID NO: 2734789 - RNA, 16 nt, Human
agacgcugugcugccc

SEQ ID NO: 2734790 - RNA, 16 nt, Human
agagagaccacuuuuc

SEQ ID NO: 2734791 - RNA, 13 nt, Human
agagcccaccuug

SEQ ID NO: 2734792 - RNA, 13 nt, Human
agagccagggucu

SEQ ID NO: 2734793 - RNA, 15 nt, Human
agaccacguuucuaa

SEQ ID NO: 2734794 - RNA, 21 nt, Human
agacagagucucacuguugcc

SEQ ID NO: 2734795 - RNA, 20 nt, Human
agacaaugacuuacuguaca

SEQ ID NO: 2734796 - RNA, 13 nt, Human
agacagagcuaca

SEQ ID NO: 2734797 - RNA, 11 nt, Human
agacagagucu

SEQ ID NO: 2734798 - RNA, 19 nt, Human
agacagagucucacuguug

SEQ ID NO: 2734799 - RNA, 20 nt, Human
agacagagucucacuguugc

SEQ ID NO: 2734800 - RNA, 15 nt, Human
agacagagcuacaca

SEQ ID NO: 2734801 - RNA, 22 nt, Human
agacaaugacuuacuguacaug

SEQ ID NO: 2734802 - RNA, 21 nt, Human
agacaaugacuuacuguacau

SEQ ID NO: 2734803 - RNA, 17 nt, Human
agaaugagagacacacu

SEQ ID NO: 2734804 - RNA, 22 nt, Human
agaaugagagacacacugaaga

SEQ ID NO: 2734805 - RNA, 17 nt, Human
agaaugauuaugaauua

SEQ ID NO: 2734806 - RNA, 19 nt, Human
agaaugcacaaacagaggc

SEQ ID NO: 2734807 - RNA, 22 nt, Human
agaaugcacaaacagaggccgc

SEQ ID NO: 2734808 - RNA, 22 nt, Human
agaagucacauuccugaacagg

SEQ ID NO: 2734809 - RNA, 18 nt, Human
agaaugaaagggcccaga

SEQ ID NO: 2734810 - RNA, 18 nt, Human
agaagacugcauuauauu

SEQ ID NO: 2734811 - RNA, 21 nt, Human
agaagagcuguucacagccag

SEQ ID NO: 2734812 - RNA, 22 nt, Human
agaagagcuguucacagccaga

SEQ ID NO: 2734813 - RNA, 21 nt, Human
agaagagauugugguuucauu

SEQ ID NO: 2734814 - RNA, 21 nt, Human
acuuuccucuuuggucuacac

SEQ ID NO: 2734815 - RNA, 13 nt, Human
agaagacacugau

SEQ ID NO: 2734816 - RNA, 21 nt, Human
agaagacacugaugggcaacc

SEQ ID NO: 2734817 - RNA, 18 nt, Human
agaagucacauuccugaa

SEQ ID NO: 2734818 - RNA, 21 nt, Human
agaagucacauuccugaacag

SEQ ID NO: 2734819 - RNA, 20 nt, Human
agaagucacauuccugaaca

SEQ ID NO: 2734820 - RNA, 14 nt, Human
agaaguaacuuacu

SEQ ID NO: 2734821 - RNA, 14 nt, Human
agaugguucuagca

SEQ ID NO: 2734822 - RNA, 14 nt, Human
agaugagugagcau

SEQ ID NO: 2734823 - RNA, 19 nt, Human
agaucugccuaaggacuuc

SEQ ID NO: 2734824 - RNA, 24 nt, Human
agcaaaauuuuuucucuaggaaau

SEQ ID NO: 2734825 - RNA, 18 nt, Human
agcaaaagaugcuucuca

SEQ ID NO: 2734826 - RNA, 19 nt, Human
agauucuuuccugaggcug

SEQ ID NO: 2734827 - RNA, 21 nt, Human
agauucuuuccugaggcuggg

SEQ ID NO: 2734828 - RNA, 23 nt, Human
agauugcaacaggcugggcuuca

SEQ ID NO: 2734829 - RNA, 20 nt, Human
agauugcaacaggcugggcu

SEQ ID NO: 2734830 - RNA, 21 nt, Human
agauugcaacaggcugggcuu

SEQ ID NO: 2734831 - RNA, 23 nt, Human
agcaaagcugaugacaacuuccc

SEQ ID NO: 2734832 - RNA, 21 nt, Human
agcaaagcugaugacaacuuc

SEQ ID NO: 2734833 - RNA, 20 nt, Human
agcaaaggagauuggaagga

SEQ ID NO: 2734834 - RNA, 21 nt, Human
agcacgauuucuguuuagaua

SEQ ID NO: 2734835 - RNA, 19 nt, Human
agcacgauuucuguuuaga

SEQ ID NO: 2734836 - RNA, 17 nt, Human
agcacgauuucuguuua

SEQ ID NO: 2734837 - RNA, 16 nt, Human
agcacagacccugccc

SEQ ID NO: 2734838 - RNA, 12 nt, Human
agcacagacccu

SEQ ID NO: 2734839 - RNA, 14 nt, Human
agcacagacccugc

SEQ ID NO: 2734840 - RNA, 15 nt, Human
agcacagacccugcc

SEQ ID NO: 2734841 - RNA, 14 nt, Human
agcauccuggcacc

SEQ ID NO: 2734842 - RNA, 17 nt, Human
agcauccuggcacccgg

SEQ ID NO: 2734843 - RNA, 16 nt, Human
agccaaagcuaggccu

SEQ ID NO: 2734844 - RNA, 18 nt, Human
agccaaagcuaggccugg

SEQ ID NO: 2734845 - RNA, 14 nt, Human
agccagcaggcucu

SEQ ID NO: 2734846 - RNA, 17 nt, Human
agccagaggagagagga

SEQ ID NO: 2734847 - RNA, 18 nt, Human
agccagaggagagaggac

SEQ ID NO: 2734848 - RNA, 13 nt, Human
agccagaggagag

SEQ ID NO: 2734849 - RNA, 15 nt, Human
agccagaggagagag

SEQ ID NO: 2734850 - RNA, 15 nt, Human
agcccaccccucaac

SEQ ID NO: 2734851 - RNA, 16 nt, Human
agcccaccuuggcuca

SEQ ID NO: 2734852 - RNA, 14 nt, Human
agcccaccuuggcu

SEQ ID NO: 2734853 - RNA, 16 nt, Human
agccagcaggcucuca

SEQ ID NO: 2734854 - RNA, 23 nt, Human
agcccacgcccccacuggugaca

SEQ ID NO: 2734855 - RNA, 14 nt, Human
agcccacgccccca

SEQ ID NO: 2734856 - RNA, 20 nt, Human
agcccacgcccccacuggug

SEQ ID NO: 2734857 - RNA, 15 nt, Human
agcccacgcccccac

SEQ ID NO: 2734858 - RNA, 13 nt, Human
agcauccuggcac

SEQ ID NO: 2734859 - RNA, 17 nt, Human
agcccgggcucugccuc

SEQ ID NO: 2734860 - RNA, 18 nt, Human
agcccgggcucugccucc

SEQ ID NO: 2734861 - RNA, 20 nt, Human
agcccgggcucugccuccca

SEQ ID NO: 2734862 - RNA, 21 nt, Human
agcccgggcucugccucccau

SEQ ID NO: 2734863 - RNA, 15 nt, Human
agccccauccucugu

SEQ ID NO: 2734864 - RNA, 17 nt, Human
agccccauccucuguac

SEQ ID NO: 2734865 - RNA, 23 nt, Human
agccccauccucuguacagagcc

SEQ ID NO: 2734866 - RNA, 17 nt, Human
agccccauucugccugc

SEQ ID NO: 2734867 - RNA, 18 nt, Human
agccccauucugccugcc

SEQ ID NO: 2734868 - RNA, 19 nt, Human
agccccauucugccugccc

SEQ ID NO: 2734869 - RNA, 17 nt, Human
aagggauggcaagaugu

SEQ ID NO: 2734870 - RNA, 14 nt, Human
aagggauggcaaga

SEQ ID NO: 2734871 - RNA, 20 nt, Human
aagggacuuggaagcuccgc

SEQ ID NO: 2734872 - RNA, 18 nt, Human
aagggacgcuacccggga

SEQ ID NO: 2734873 - RNA, 19 nt, Human
aagccagauuuuccugaaa

SEQ ID NO: 2734874 - RNA, 21 nt, Human
aagccaccaacauacucccau

SEQ ID NO: 2734875 - RNA, 15 nt, Human
aagccagcaggcucu

SEQ ID NO: 2734876 - RNA, 18 nt, Human
aagccagcaggcucucag

SEQ ID NO: 2734877 - RNA, 15 nt, Human
aagcgauucuucugc

SEQ ID NO: 2734878 - RNA, 14 nt, Human
aagcgauucuucug

SEQ ID NO: 2734879 - RNA, 16 nt, Human
aagcgugagccacugc

SEQ ID NO: 2734880 - RNA, 16 nt, Human
aagcgauucuucugcu

SEQ ID NO: 2734881 - RNA, 23 nt, Human
aaggaaugauuaauuaaaacaca

SEQ ID NO: 2734882 - RNA, 16 nt, Human
aagcugcugacagugu

SEQ ID NO: 2734883 - RNA, 21 nt, Human
aagcgugagccacugcaccgg

SEQ ID NO: 2734884 - RNA, 17 nt, Human
aagcgugagccacugca

SEQ ID NO: 2734885 - RNA, 20 nt, Human
aagcgugagccacugcaccg

SEQ ID NO: 2734886 - RNA, 14 nt, Human
aagcugcugacagu

SEQ ID NO: 2734887 - RNA, 22 nt, Human
aagcugccagccgagauagcca

SEQ ID NO: 2734888 - RNA, 11 nt, Human
aagcugccagc

SEQ ID NO: 2734889 - RNA, 12 nt, Human
aagcugccagcc

SEQ ID NO: 2734890 - RNA, 23 nt, Human
aagacagugaaagaaaauaacaa

SEQ ID NO: 2734891 - RNA, 16 nt, Human
aagacuuuggaaagag

SEQ ID NO: 2734892 - RNA, 21 nt, Human
aagacauucuuccaaaaagau

SEQ ID NO: 2734893 - RNA, 15 nt, Human
aagagaacuuccaga

SEQ ID NO: 2734894 - RNA, 21 nt, Human
aagcagaggaaggagaggaga

SEQ ID NO: 2734895 - RNA, 19 nt, Human
aagccaccaacauacuccc

SEQ ID NO: 2734896 - RNA, 13 nt, Human
aagauuuucagaa

SEQ ID NO: 2734897 - RNA, 19 nt, Human
aagauuuugaaauuuuuau

SEQ ID NO: 2734898 - RNA, 20 nt, Human
aagauacugaaauaaacguc

SEQ ID NO: 2734899 - RNA, 16 nt, Human
aagauacugaaauaaa

SEQ ID NO: 2734900 - RNA, 14 nt, Human
aagauacugaaaua

SEQ ID NO: 2734901 - RNA, 20 nt, Human
aagauucauauuuacuucuu

SEQ ID NO: 2734902 - RNA, 21 nt, Human
aagauucaaugccccugaauu

SEQ ID NO: 2734903 - RNA, 20 nt, Human
aagauucaaugccccugaau

SEQ ID NO: 2734904 - RNA, 22 nt, Human
aaguugauaugccuuuucccaa

SEQ ID NO: 2734905 - RNA, 13 nt, Human
aagugcugcauuu

SEQ ID NO: 2734906 - RNA, 14 nt, Human
aagugcugcauuua

SEQ ID NO: 2734907 - RNA, 17 nt, Human
aauaaaccucaaaaugu

SEQ ID NO: 2734908 - RNA, 20 nt, Human
aauaaaccucaaaaugucua

SEQ ID NO: 2734909 - RNA, 15 nt, Human
aauaaacgucuuaaa

SEQ ID NO: 2734910 - RNA, 14 nt, Human
aauaauaaauauuu

SEQ ID NO: 2734911 - RNA, 14 nt, Human
aauaauguuucaaa

SEQ ID NO: 2734912 - RNA, 19 nt, Human
aauaauguuucaaacauau

SEQ ID NO: 2734913 - RNA, 12 nt, Human
aauaauguuuca

SEQ ID NO: 2734914 - RNA, 16 nt, Human
aauauaggaacuuaaa

SEQ ID NO: 2734915 - RNA, 12 nt, Human
aauauuaaagcc

SEQ ID NO: 2734916 - RNA, 13 nt, Human
aauauuaaagcca

SEQ ID NO: 2734917 - RNA, 15 nt, Human
aauauuaaagccaug

SEQ ID NO: 2734918 - RNA, 14 nt, Human
aauauuaaagccau

SEQ ID NO: 2734919 - RNA, 20 nt, Human
aauauuaaagccauguuuau

SEQ ID NO: 2734920 - RNA, 19 nt, Human
aauauuaaagccauguuua

SEQ ID NO: 2734921 - RNA, 18 nt, Human
aauauuaaagccauguuu

SEQ ID NO: 2734922 - RNA, 16 nt, Human
aauauuaaagccaugu

SEQ ID NO: 2734923 - RNA, 21 nt, Human
aauaccugucccccugacaac

SEQ ID NO: 2734924 - RNA, 20 nt, Human
aauacgugggcauucaaaug

SEQ ID NO: 2734925 - RNA, 19 nt, Human
aauacgugggcauucaaau

SEQ ID NO: 2734926 - RNA, 22 nt, Human
aaucaaauaugcaaagcacuga

SEQ ID NO: 2734927 - RNA, 16 nt, Human
aaucaaauaugcaaag

SEQ ID NO: 2734928 - RNA, 15 nt, Human
aaucaaauaugcaaa

SEQ ID NO: 2734929 - RNA, 22 nt, Human
aaucauuucugcaucagcugcu

SEQ ID NO: 2734930 - RNA, 14 nt, Human
aaugauaacuggaa

SEQ ID NO: 2734931 - RNA, 15 nt, Human
aaugauaacuggaaa

SEQ ID NO: 2734932 - RNA, 16 nt, Human
aaugauaacuggaaac

SEQ ID NO: 2734933 - RNA, 15 nt, Human
aaugauagcuacugu

SEQ ID NO: 2734934 - RNA, 12 nt, Human
aaugauuaauua

SEQ ID NO: 2734935 - RNA, 13 nt, Human
aaugauuaauuaa

SEQ ID NO: 2734936 - RNA, 17 nt, Human
aauccauacauuugugu

SEQ ID NO: 2734937 - RNA, 16 nt, Human
aauccauacauuugug

SEQ ID NO: 2734938 - RNA, 15 nt, Human
aauccaaugaaauga

SEQ ID NO: 2734939 - RNA, 18 nt, Human
aaucuccaaaauaaaacu

SEQ ID NO: 2734940 - RNA, 23 nt, Human
aaugcgugcauaccacuuuuguu

SEQ ID NO: 2734941 - RNA, 21 nt, Human
aaugcgugcauaccacuuuug

SEQ ID NO: 2734942 - RNA, 17 nt, Human
aaugggggugcauuuga

SEQ ID NO: 2734943 - RNA, 15 nt, Human
aaugggggugcauuu

SEQ ID NO: 2734944 - RNA, 15 nt, Human
aaugucacaggcagg

SEQ ID NO: 2734945 - RNA, 20 nt, Human
aaugguccgugcuaaggacu

SEQ ID NO: 2734946 - RNA, 13 nt, Human
aaugggacacuaa

SEQ ID NO: 2734947 - RNA, 14 nt, Human
aaugggagcucaug

SEQ ID NO: 2734948 - RNA, 23 nt, Human
aaugcucuuuacuucauggacuu

SEQ ID NO: 2734949 - RNA, 23 nt, Human
aacugagaugugaacacaucagc

SEQ ID NO: 2734950 - RNA, 18 nt, Human
aacucauauuuucaugcu

SEQ ID NO: 2734951 - RNA, 16 nt, Human
aacucauauuuucaug

SEQ ID NO: 2734952 - RNA, 15 nt, Human
aacucauauuuucau

SEQ ID NO: 2734953 - RNA, 17 nt, Human
aacucaaacucuuaaaa

SEQ ID NO: 2734954 - RNA, 15 nt, Human
aacucaccccagccc

SEQ ID NO: 2734955 - RNA, 18 nt, Human
aacucaccccagccccaa

SEQ ID NO: 2734956 - RNA, 16 nt, Human
aacucaccccagcccc

SEQ ID NO: 2734957 - RNA, 17 nt, Human
aacucaccccagcccca

SEQ ID NO: 2734958 - RNA, 17 nt, Human
aacgcguugaaauugua

SEQ ID NO: 2734959 - RNA, 15 nt, Human
aacgcguugaaauug

SEQ ID NO: 2734960 - RNA, 14 nt, Human
aacgcguugaaauu

SEQ ID NO: 2734961 - RNA, 13 nt, Human
aacgcguugaaau

SEQ ID NO: 2734962 - RNA, 16 nt, Human
aacagcuaaugggaca

SEQ ID NO: 2734963 - RNA, 13 nt, Human
aacccuucagugc

SEQ ID NO: 2734964 - RNA, 19 nt, Human
aaccaguguuguggauuua

SEQ ID NO: 2734965 - RNA, 17 nt, Human
aaccaguguuguggauu

SEQ ID NO: 2734966 - RNA, 14 nt, Human
aaccaguauuguac

SEQ ID NO: 2734967 - RNA, 13 nt, Human
aaccaguauugua

SEQ ID NO: 2734968 - RNA, 11 nt, Human
aaccaguauug

SEQ ID NO: 2734969 - RNA, 22 nt, Human
aacaugcuacacacugcauguu

SEQ ID NO: 2734970 - RNA, 15 nt, Human
aacauggaaguacua

SEQ ID NO: 2734971 - RNA, 14 nt, Human
aaaucuuaacuuga

SEQ ID NO: 2734972 - RNA, 20 nt, Human
aaaugcuagguuaauuccaa

SEQ ID NO: 2734973 - RNA, 18 nt, Human
aaaucugcuuuuuaaaga

SEQ ID NO: 2734974 - RNA, 21 nt, Human
aaaucugugaacuugaaauuu

SEQ ID NO: 2734975 - RNA, 19 nt, Human
aaaucugugaacuugaaau

SEQ ID NO: 2734976 - RNA, 20 nt, Human
aaaucugugaacuugaaauu

SEQ ID NO: 2734977 - RNA, 19 nt, Human
aaaucuccaaaauaaaacu

SEQ ID NO: 2734978 - RNA, 22 nt, Human
aaaucuccaaaauaaaacuuuu

SEQ ID NO: 2734979 - RNA, 14 nt, Human
aaauggacguguua

SEQ ID NO: 2734980 - RNA, 17 nt, Human
aaauggaauacucuuau

SEQ ID NO: 2734981 - RNA, 15 nt, Human
aaauggacguguuau

SEQ ID NO: 2734982 - RNA, 17 nt, Human
aaauggacguguuauga

SEQ ID NO: 2734983 - RNA, 14 nt, Human
aaauuaacuuuuau

SEQ ID NO: 2734984 - RNA, 13 nt, Human
aaauuaacuuuua

SEQ ID NO: 2734985 - RNA, 12 nt, Human
aaauuaacuuuu

SEQ ID NO: 2734986 - RNA, 23 nt, Human
aaauuggggauucuuaaaguuga

SEQ ID NO: 2734987 - RNA, 14 nt, Human
aaauugauguguuu

SEQ ID NO: 2734988 - RNA, 17 nt, Human
aaauuggggauucuuaa

SEQ ID NO: 2734989 - RNA, 22 nt, Human
aaauuggggauucuuaaaguug

SEQ ID NO: 2734990 - RNA, 20 nt, Human
aaauuggggauucuuaaagu

SEQ ID NO: 2734991 - RNA, 19 nt, Human
aaauuggggauucuuaaag

SEQ ID NO: 2734992 - RNA, 18 nt, Human
aaauuggggauucuuaaa

SEQ ID NO: 2734993 - RNA, 12 nt, Human
aacacaucagcu

SEQ ID NO: 2734994 - RNA, 19 nt, Human
aacaccucugcacaagcug

SEQ ID NO: 2734995 - RNA, 22 nt, Human
aacaaaccuguuucugcagcca

SEQ ID NO: 2734996 - RNA, 21 nt, Human
aacacauacaggaagguagaa

SEQ ID NO: 2734997 - RNA, 19 nt, Human
aaaauccauacauuugugu

SEQ ID NO: 2734998 - RNA, 15 nt, Human
aaaauuagccaagug

SEQ ID NO: 2734999 - RNA, 23 nt, Human
aaaaguuuaauauuaaagccaug

SEQ ID NO: 2735000 - RNA, 22 nt, Human
aaaaguuuaauauuaaagccau

SEQ ID NO: 2735001 - RNA, 21 nt, Human
aaaaguuuaauauuaaagcca

SEQ ID NO: 2735002 - RNA, 20 nt, Human
aaaaguuuaauauuaaagcc

SEQ ID NO: 2735003 - RNA, 17 nt, Human
aaacagcuaaugggaca

SEQ ID NO: 2735004 - RNA, 20 nt, Human
aaaauuauuuuguucauaca

SEQ ID NO: 2735005 - RNA, 16 nt, Human
aaaauuauuuuguuca

SEQ ID NO: 2735006 - RNA, 18 nt, Human
aaaauuauuuuguucaua

SEQ ID NO: 2735007 - RNA, 13 nt, Human
aaagaaacauuug

SEQ ID NO: 2735008 - RNA, 13 nt, Human
aaacugauuuuuu

SEQ ID NO: 2735009 - RNA, 19 nt, Human
aaacugauuuuuuuuuccu

SEQ ID NO: 2735010 - RNA, 20 nt, Human
aaacugauuuuuuuuuccuu

SEQ ID NO: 2735011 - RNA, 19 nt, Human
aaacccuugccaugugcua

SEQ ID NO: 2735012 - RNA, 14 nt, Human
aaacccuucagugc

SEQ ID NO: 2735013 - RNA, 17 nt, Human
aaaccucaaaaugucua

SEQ ID NO: 2735014 - RNA, 22 nt, Human
aaaccucaaaaugucuaagaua

SEQ ID NO: 2735015 - RNA, 17 nt, Human
aaacucuugaccucagg

SEQ ID NO: 2735016 - RNA, 17 nt, Human
aaaccccaucucuacaa

SEQ ID NO: 2735017 - RNA, 18 nt, Human
aaacccagcucuggucca

SEQ ID NO: 2735018 - RNA, 15 nt, Human
aaagauacaguuacu

SEQ ID NO: 2735019 - RNA, 20 nt, Human
aaagcauuguaaaugugcuu

SEQ ID NO: 2735020 - RNA, 19 nt, Human
aaagcauuguaaaugugcu

SEQ ID NO: 2735021 - RNA, 15 nt, Human
aaagccaaagcuagg

SEQ ID NO: 2735022 - RNA, 21 nt, Human
aaaggcuccaggagcagccac

SEQ ID NO: 2735023 - RNA, 22 nt, Human
aaaggcuccaggagcagccaca

SEQ ID NO: 2735024 - RNA, 14 nt, Human
aaaggcuccaggag

SEQ ID NO: 2735025 - RNA, 14 nt, Human
aaaggcuaccuuug

SEQ ID NO: 2735026 - RNA, 17 nt, Human
aaaggcuaccuuuguau

SEQ ID NO: 2735027 - RNA, 11 nt, Human
aaauaaauuau

SEQ ID NO: 2735028 - RNA, 19 nt, Human
aaauaaaccucaaaauguc

SEQ ID NO: 2735029 - RNA, 16 nt, Human
aaauaaacgucuuaaa

SEQ ID NO: 2735030 - RNA, 15 nt, Human
aaauaaacgucuuaa

SEQ ID NO: 2735031 - RNA, 20 nt, Human
aaauaaaaauauuguguugu

SEQ ID NO: 2735032 - RNA, 16 nt, Human
acagaagcuccaggua

SEQ ID NO: 2735033 - RNA, 14 nt, Human
acagacaaagcgug

SEQ ID NO: 2735034 - RNA, 13 nt, Human
acagaggcagccc

SEQ ID NO: 2735035 - RNA, 23 nt, Human
acagaggcagccccauucugccu

SEQ ID NO: 2735036 - RNA, 17 nt, Human
acagaggccaugggccu

SEQ ID NO: 2735037 - RNA, 21 nt, Human
acagaggccaugggccuccug

SEQ ID NO: 2735038 - RNA, 23 nt, Human
acagaggccaugggccuccugug

SEQ ID NO: 2735039 - RNA, 17 nt, Human
acacugugcugagucug

SEQ ID NO: 2735040 - RNA, 22 nt, Human
acacugugcugagucugaaggc

SEQ ID NO: 2735041 - RNA, 13 nt, Human
acaauuuauuaug

SEQ ID NO: 2735042 - RNA, 14 nt, Human
acaauuuauuaugg

SEQ ID NO: 2735043 - RNA, 18 nt, Human
acaauuuuguuucuguac

SEQ ID NO: 2735044 - RNA, 20 nt, Human
acaauuuuguuucuguacuu

SEQ ID NO: 2735045 - RNA, 16 nt, Human
acaaggauugcuacug

SEQ ID NO: 2735046 - RNA, 20 nt, Human
acaaggaugaucuaggaaga

SEQ ID NO: 2735047 - RNA, 19 nt, Human
acacagcucuucuccaggc

SEQ ID NO: 2735048 - RNA, 19 nt, Human
acacaaaaguuucucuuuu

SEQ ID NO: 2735049 - RNA, 14 nt, Human
acacauuuuuuaaa

SEQ ID NO: 2735050 - RNA, 20 nt, Human
acacagcucuucuccaggcu

SEQ ID NO: 2735051 - RNA, 21 nt, Human
acacagcucuucuccaggcug

SEQ ID NO: 2735052 - RNA, 20 nt, Human
acaccacuacauucuguuaa

SEQ ID NO: 2735053 - RNA, 17 nt, Human
acaccacuacauucugu

SEQ ID NO: 2735054 - RNA, 12 nt, Human
acacgaauauug

SEQ ID NO: 2735055 - RNA, 14 nt, Human
acacgaauauugcu

SEQ ID NO: 2735056 - RNA, 15 nt, Human
acaccacuacauucu

SEQ ID NO: 2735057 - RNA, 19 nt, Human
acacauuuuuuaaaugcac

SEQ ID NO: 2735058 - RNA, 14 nt, Human
acaccacuacauuc

SEQ ID NO: 2735059 - RNA, 18 nt, Human
acacauuuuuuaaaugca

SEQ ID NO: 2735060 - RNA, 16 nt, Human
acacauuuuuuaaaug

SEQ ID NO: 2735061 - RNA, 15 nt, Human
acacgaauauugcug

SEQ ID NO: 2735062 - RNA, 21 nt, Human
acacgaauauugcugauggug

SEQ ID NO: 2735063 - RNA, 21 nt, Human
acaaggaugaauuaaguuuuu

SEQ ID NO: 2735064 - RNA, 13 nt, Human
acaaaauggaaua

SEQ ID NO: 2735065 - RNA, 14 nt, Human
acaaaauggaauac

SEQ ID NO: 2735066 - RNA, 13 nt, Human
acaaaaugaaacg

SEQ ID NO: 2735067 - RNA, 22 nt, Human
acaaaaugaaacgcaaccacca

SEQ ID NO: 2735068 - RNA, 13 nt, Human
aauuuugugaagc

SEQ ID NO: 2735069 - RNA, 17 nt, Human
aauuuugugaagcaaaa

SEQ ID NO: 2735070 - RNA, 18 nt, Human
aauuuugugaagcaaaau

SEQ ID NO: 2735071 - RNA, 16 nt, Human
aauuuugugcccccau

SEQ ID NO: 2735072 - RNA, 12 nt, Human
aauuuuggaauu

SEQ ID NO: 2735073 - RNA, 11 nt, Human
aauuuuggaau

SEQ ID NO: 2735074 - RNA, 14 nt, Human
aauuuugauguuuu

SEQ ID NO: 2735075 - RNA, 17 nt, Human
aauuuccugggagcuuu

SEQ ID NO: 2735076 - RNA, 21 nt, Human
aauuuccugggagcuuuugua

SEQ ID NO: 2735077 - RNA, 18 nt, Human
aauuuccugggagcuuuu

SEQ ID NO: 2735078 - RNA, 23 nt, Human
aauuuauuggcuuuucugaucca

SEQ ID NO: 2735079 - RNA, 20 nt, Human
aauuuauuuaugggauccug

SEQ ID NO: 2735080 - RNA, 21 nt, Human
aauuuauuggcuuuucugauc

SEQ ID NO: 2735081 - RNA, 20 nt, Human
aauuuauuggcuuuucugau

SEQ ID NO: 2735082 - RNA, 19 nt, Human
aauuuauuggcuuuucuga

SEQ ID NO: 2735083 - RNA, 17 nt, Human
aauuuauuggcuuuucu

SEQ ID NO: 2735084 - RNA, 17 nt, Human
aauuuauuauggcacau

SEQ ID NO: 2735085 - RNA, 12 nt, Human
aauuguaaggaa

SEQ ID NO: 2735086 - RNA, 16 nt, Human
aauuguaaggaaugau

SEQ ID NO: 2735087 - RNA, 20 nt, Human
aauuggggauucuuaaaguu

SEQ ID NO: 2735088 - RNA, 17 nt, Human
aauuggggauucuuaaa

SEQ ID NO: 2735089 - RNA, 21 nt, Human
aaugguccgugcuaaggacuu

SEQ ID NO: 2735090 - RNA, 15 nt, Human
aauuggggauucuua

SEQ ID NO: 2735091 - RNA, 16 nt, Human
aauuggggauucuuaa

SEQ ID NO: 2735092 - RNA, 16 nt, Human
aaugucacaggcaggu

SEQ ID NO: 2735093 - RNA, 19 nt, Human
aaugucacaggcaggucca

SEQ ID NO: 2735094 - RNA, 23 nt, Human
acagugagucgaggacagggagg

SEQ ID NO: 2735095 - RNA, 19 nt, Human
acaguggggaaugaagaua

SEQ ID NO: 2735096 - RNA, 15 nt, Human
acaguggggaaugaa

SEQ ID NO: 2735097 - RNA, 20 nt, Human
acaggcaagcaccuccugcc

SEQ ID NO: 2735098 - RNA, 23 nt, Human
acaggcaagcaccuccugccucg

SEQ ID NO: 2735099 - RNA, 13 nt, Human
acagcucuguccu

SEQ ID NO: 2735100 - RNA, 16 nt, Human
acagcucuguccuggg

SEQ ID NO: 2735101 - RNA, 17 nt, Human
acagcucuguccuggga

SEQ ID NO: 2735102 - RNA, 15 nt, Human
acagcuccuucuguc

SEQ ID NO: 2735103 - RNA, 19 nt, Human
acagaggggguggccuccc

SEQ ID NO: 2735104 - RNA, 17 nt, Human
acagaggggguggccuc

SEQ ID NO: 2735105 - RNA, 18 nt, Human
acagaggggguggccucc

SEQ ID NO: 2735106 - RNA, 16 nt, Human
acagcuccuucugucc

SEQ ID NO: 2735107 - RNA, 18 nt, Human
acagcuccuucuguccua

SEQ ID NO: 2735108 - RNA, 23 nt, Human
acagcuccuucuguccuacucug

SEQ ID NO: 2735109 - RNA, 14 nt, Human
acagcucuguccug

SEQ ID NO: 2735110 - RNA, 14 nt, Human
acaggcaaugcugg

SEQ ID NO: 2735111 - RNA, 19 nt, Human
acaggcaagcaccuccugc

SEQ ID NO: 2735112 - RNA, 22 nt, Human
acagugagucgaggacagggag

SEQ ID NO: 2735113 - RNA, 19 nt, Human
acaggugugaaccaccaca

SEQ ID NO: 2735114 - RNA, 22 nt, Human
acaggugugagucaccaagccc

SEQ ID NO: 2735115 - RNA, 23 nt, Human
acaggugugagucaccaagccca

SEQ ID NO: 2735116 - RNA, 20 nt, Human
acaucccuuaccugggaaag

SEQ ID NO: 2735117 - RNA, 16 nt, Human
acaugcaaggucauuu

SEQ ID NO: 2735118 - RNA, 17 nt, Human
acaugcaaggucauuuu

SEQ ID NO: 2735119 - RNA, 18 nt, Human
acaugcaaggucauuuuu

SEQ ID NO: 2735120 - RNA, 15 nt, Human
acaugccucucucag

SEQ ID NO: 2735121 - RNA, 16 nt, Human
acaugccucucucagg

SEQ ID NO: 2735122 - RNA, 17 nt, Human
acaugccucucucaggc

SEQ ID NO: 2735123 - RNA, 18 nt, Human
acaugccucucucaggcc

SEQ ID NO: 2735124 - RNA, 15 nt, Human
acauaagauaaaugu

SEQ ID NO: 2735125 - RNA, 15 nt, Human
acauaaguaauucaa

SEQ ID NO: 2735126 - RNA, 19 nt, Human
acauaauuaaauuuugagu

SEQ ID NO: 2735127 - RNA, 16 nt, Human
acauaagauaaaugug

SEQ ID NO: 2735128 - RNA, 20 nt, Human
accagccccagugcccacag

SEQ ID NO: 2735129 - RNA, 18 nt, Human
accagccccagugcccac

SEQ ID NO: 2735130 - RNA, 19 nt, Human
accagccccagugcccaca

SEQ ID NO: 2735131 - RNA, 16 nt, Human
accagccccagugccc

SEQ ID NO: 2735132 - RNA, 17 nt, Human
accagccccagugccca

SEQ ID NO: 2735133 - RNA, 14 nt, Human
accagcagaaaugc

SEQ ID NO: 2735134 - RNA, 12 nt, Human
accagcagagca

SEQ ID NO: 2735135 - RNA, 13 nt, Human
accagcagagcac

SEQ ID NO: 2735136 - RNA, 23 nt, Human
acaugucuuuucuugcaugaggc

SEQ ID NO: 2735137 - RNA, 19 nt, Human
acaugccucucucaggcca

SEQ ID NO: 2735138 - RNA, 15 nt, Human
accaucaagccacca

SEQ ID NO: 2735139 - RNA, 12 nt, Human
accaucauugaa

SEQ ID NO: 2735140 - RNA, 15 nt, Human
accaucauugaaauc

SEQ ID NO: 2735141 - RNA, 23 nt, Human
accaucauugaaaucuuuuugcu

SEQ ID NO: 2735142 - RNA, 14 nt, Human
accaucaagccacc

SEQ ID NO: 2735143 - RNA, 13 nt, Human
acccaugcugccc

SEQ ID NO: 2735144 - RNA, 15 nt, Human
acccacccuccuuuc

SEQ ID NO: 2735145 - RNA, 15 nt, Human
acccacccccaccca

SEQ ID NO: 2735146 - RNA, 17 nt, Human
acccacccccacccaag

SEQ ID NO: 2735147 - RNA, 19 nt, Human
acggacacucaaaagcugg

SEQ ID NO: 2735148 - RNA, 15 nt, Human
acggaauaguuggcu

SEQ ID NO: 2735149 - RNA, 15 nt, Human
acggaagagccuugc

SEQ ID NO: 2735150 - RNA, 16 nt, Human
acggaagagccuugcg

SEQ ID NO: 2735151 - RNA, 19 nt, Human
acgcuggagugcagugagc

SEQ ID NO: 2735152 - RNA, 18 nt, Human
acgcuggagugcagugag

SEQ ID NO: 2735153 - RNA, 15 nt, Human
acuaauagacaauuu

SEQ ID NO: 2735154 - RNA, 15 nt, Human
acgucugacaggcaa

SEQ ID NO: 2735155 - RNA, 23 nt, Human
acgucugacaggcaaugcuggcu

SEQ ID NO: 2735156 - RNA, 11 nt, Human
accugugucuc

SEQ ID NO: 2735157 - RNA, 19 nt, Human
acuaguauuucuaugaaau

SEQ ID NO: 2735158 - RNA, 18 nt, Human
acuaguauuucuaugaaa

SEQ ID NO: 2735159 - RNA, 16 nt, Human
acuauuguuagucucu

SEQ ID NO: 2735160 - RNA, 17 nt, Human
acuagggaagauaauau

SEQ ID NO: 2735161 - RNA, 17 nt, Human
accucugccucagaaaa

SEQ ID NO: 2735162 - RNA, 18 nt, Human
accucugccucagaaaac

SEQ ID NO: 2735163 - RNA, 21 nt, Human
accucuugagccuugaacuuu

SEQ ID NO: 2735164 - RNA, 20 nt, Human
accucuugagccuugaacuu

SEQ ID NO: 2735165 - RNA, 19 nt, Human
accucuugagccuugaacu

SEQ ID NO: 2735166 - RNA, 17 nt, Human
accucuugagccuugaa

SEQ ID NO: 2735167 - RNA, 22 nt, Human
accugucuugccuuuuucauua

SEQ ID NO: 2735168 - RNA, 21 nt, Human
accugucuugccuuuuucauu

SEQ ID NO: 2735169 - RNA, 19 nt, Human
accugucuugccuuuuuca

SEQ ID NO: 2735170 - RNA, 18 nt, Human
accugccagggacagagg

SEQ ID NO: 2735171 - RNA, 15 nt, Human
accugccagggacag

SEQ ID NO: 2735172 - RNA, 16 nt, Human
accugccagggacaga

SEQ ID NO: 2735173 - RNA, 11 nt, Human
accugccaggg

SEQ ID NO: 2735174 - RNA, 12 nt, Human
accugccaggga

SEQ ID NO: 2735175 - RNA, 13 nt, Human
accugccagggac

SEQ ID NO: 2735176 - RNA, 15 nt, Human
accgggccacagaga

SEQ ID NO: 2735177 - RNA, 19 nt, Human
accgggccacagagaaagu

SEQ ID NO: 2735178 - RNA, 14 nt, Human
accgugaggccaga

SEQ ID NO: 2735179 - RNA, 14 nt, Human
accggcuggccugg

SEQ ID NO: 2735180 - RNA, 15 nt, Human
accggcuggccuggc

SEQ ID NO: 2735181 - RNA, 20 nt, Human
accgggcacucagaagacac

SEQ ID NO: 2735182 - RNA, 19 nt, Human
accggcuggccuggccccu

SEQ ID NO: 2735183 - RNA, 17 nt, Human
accggcuggccuggccc

SEQ ID NO: 2735184 - RNA, 18 nt, Human
accggcuggccuggcccc

SEQ ID NO: 2735185 - RNA, 17 nt, Human
acccuguuaccauuuug

SEQ ID NO: 2735186 - RNA, 14 nt, Human
acccaugcugcccu

SEQ ID NO: 2735187 - RNA, 15 nt, Human
acccaugcugcccug

SEQ ID NO: 2735188 - RNA, 16 nt, Human
accccacacacgccag

SEQ ID NO: 2735189 - RNA, 22 nt, Human
acccugugauggggcccugccu

SEQ ID NO: 2735190 - RNA, 18 nt, Human
accucaggugagaagcag

SEQ ID NO: 2735191 - RNA, 14 nt, Human
accucaggccuggg

SEQ ID NO: 2735192 - RNA, 22 nt, Human
accucaggccugggggcugggc

SEQ ID NO: 2735193 - RNA, 16 nt, Human
accgugaggccagaga

SEQ ID NO: 2735194 - RNA, 17 nt, Human
accgugaggccagagac

SEQ ID NO: 2735195 - RNA, 12 nt, Human
accucaggccug

SEQ ID NO: 2735196 - RNA, 13 nt, Human
accucaggccugg

SEQ ID NO: 2735197 - RNA, 14 nt, Human
acucuuaagaagac

SEQ ID NO: 2735198 - RNA, 15 nt, Human
acucuuaagaagacu

SEQ ID NO: 2735199 - RNA, 20 nt, Human
acucuuaagaagacugcauu

SEQ ID NO: 2735200 - RNA, 21 nt, Human
acucugugucagguggggcag

SEQ ID NO: 2735201 - RNA, 19 nt, Human
acucugugucagguggggc

SEQ ID NO: 2735202 - RNA, 19 nt, Human
acucugucucaaaaaaaca

SEQ ID NO: 2735203 - RNA, 22 nt, Human
acugauggcuaauguacugcau

SEQ ID NO: 2735204 - RNA, 12 nt, Human
acugaugggcaa

SEQ ID NO: 2735205 - RNA, 22 nt, Human
acugaugggcaacccccagccu

SEQ ID NO: 2735206 - RNA, 13 nt, Human
acugaucucucgu

SEQ ID NO: 2735207 - RNA, 22 nt, Human
acugacauuguuggccaaagcc

SEQ ID NO: 2735208 - RNA, 23 nt, Human
acugacauuguuggccaaagcca

SEQ ID NO: 2735209 - RNA, 23 nt, Human
acugauuuuuuuuuccuucagug

SEQ ID NO: 2735210 - RNA, 21 nt, Human
acugauuuuuuuuuccuucag

SEQ ID NO: 2735211 - RNA, 22 nt, Human
acugauuuuuuuuuccuucagu

SEQ ID NO: 2735212 - RNA, 22 nt, Human
acugauucuucagcaaaaauau

SEQ ID NO: 2735213 - RNA, 15 nt, Human
acugauucuucagca

SEQ ID NO: 2735214 - RNA, 13 nt, Human
acugauucuucag

SEQ ID NO: 2735215 - RNA, 12 nt, Human
acugauucuuca

SEQ ID NO: 2735216 - RNA, 22 nt, Human
acugcccggcaggguccuagaa

SEQ ID NO: 2735217 - RNA, 14 nt, Human
acugcuuuuggucu

SEQ ID NO: 2735218 - RNA, 15 nt, Human
acugcuuuuggucug

SEQ ID NO: 2735219 - RNA, 16 nt, Human
acugcuuuuggucugu

SEQ ID NO: 2735220 - RNA, 20 nt, Human
acugcuuuuggucuguguga

SEQ ID NO: 2735221 - RNA, 15 nt, Human
acugcccggcagggu

SEQ ID NO: 2735222 - RNA, 19 nt, Human
acuucaaauccuugaagau

SEQ ID NO: 2735223 - RNA, 14 nt, Human
acuuaaauaaugug

SEQ ID NO: 2735224 - RNA, 20 nt, Human
acuucaaauccuugaagauu

SEQ ID NO: 2735225 - RNA, 17 nt, Human
acuucagcgguuuauau

SEQ ID NO: 2735226 - RNA, 18 nt, Human
acuucagcgguuuauaua

SEQ ID NO: 2735227 - RNA, 19 nt, Human
acuucagcgguuuauauaa

SEQ ID NO: 2735228 - RNA, 20 nt, Human
acuucugccauauucuguug

SEQ ID NO: 2735229 - RNA, 18 nt, Human
acuucuuauacauuugau

SEQ ID NO: 2735230 - RNA, 17 nt, Human
acuucuuauacauuuga

SEQ ID NO: 2735231 - RNA, 15 nt, Human
gcugaggugggagga

SEQ ID NO: 2735232 - RNA, 16 nt, Human
gcugcacccucaggca

SEQ ID NO: 2735233 - RNA, 13 nt, Human
gcugcacccucag

SEQ ID NO: 2735234 - RNA, 15 nt, Human
gcugcacccucaggc

SEQ ID NO: 2735235 - RNA, 12 nt, Human
gcugccauccag

SEQ ID NO: 2735236 - RNA, 13 nt, Human
gcugccauccagg

SEQ ID NO: 2735237 - RNA, 18 nt, Human
gcugcugaaggcucgagc

SEQ ID NO: 2735238 - RNA, 12 nt, Human
gcugcugacagu

SEQ ID NO: 2735239 - RNA, 17 nt, Human
gcugccauccagguuca

SEQ ID NO: 2735240 - RNA, 13 nt, Human
gcugccccuggca

SEQ ID NO: 2735241 - RNA, 15 nt, Human
gcugccccuggcagc

SEQ ID NO: 2735242 - RNA, 16 nt, Human
gcugccccuggcagcc

SEQ ID NO: 2735243 - RNA, 20 nt, Human
gcucucaggccagcugcuug

SEQ ID NO: 2735244 - RNA, 19 nt, Human
gcucucaggccagcugcuu

SEQ ID NO: 2735245 - RNA, 17 nt, Human
gcucucaggccagcugc

SEQ ID NO: 2735246 - RNA, 18 nt, Human
gcucucaggccagcugcu

SEQ ID NO: 2735247 - RNA, 19 nt, Human
gcucuacugaggugcuaug

SEQ ID NO: 2735248 - RNA, 16 nt, Human
gcuccucuccccagca

SEQ ID NO: 2735249 - RNA, 19 nt, Human
gcuccucuccccagcaagu

SEQ ID NO: 2735250 - RNA, 18 nt, Human
gcucucaaguuaucaggg

SEQ ID NO: 2735251 - RNA, 9 nt, Human
gcuccagac

SEQ ID NO: 2735252 - RNA, 23 nt, Human
gcuccagacacauguccaagaag

SEQ ID NO: 2735253 - RNA, 18 nt, Human
gcuccagacacaugucca

SEQ ID NO: 2735254 - RNA, 21 nt, Human
gcuccagacacauguccaaga

SEQ ID NO: 2735255 - RNA, 13 nt, Human
gcuccagcucacc

SEQ ID NO: 2735256 - RNA, 14 nt, Human
gcuccagcucacca

SEQ ID NO: 2735257 - RNA, 17 nt, Human
gcuccagcucaccagcc

SEQ ID NO: 2735258 - RNA, 23 nt, Human
gcucccaggcauuccccaggagg

SEQ ID NO: 2735259 - RNA, 15 nt, Human
gcuccucuccccagc

SEQ ID NO: 2735260 - RNA, 20 nt, Human
gcucugaucauccacugugc

SEQ ID NO: 2735261 - RNA, 21 nt, Human
gcucugaucauccacugugcc

SEQ ID NO: 2735262 - RNA, 22 nt, Human
gcucugaucauccacugugcca

SEQ ID NO: 2735263 - RNA, 16 nt, Human
gcugaaacaacaaaua

SEQ ID NO: 2735264 - RNA, 23 nt, Human
gcucugguccauagagagcaaga

SEQ ID NO: 2735265 - RNA, 13 nt, Human
gcugacagacaca

SEQ ID NO: 2735266 - RNA, 23 nt, Human
gcugaaggcucgagcaugccugg

SEQ ID NO: 2735267 - RNA, 17 nt, Human
gcugaauacagaggcaa

SEQ ID NO: 2735268 - RNA, 17 nt, Human
ggaagacuucaucccuc

SEQ ID NO: 2735269 - RNA, 20 nt, Human
ggaagacuucaucccucugg

SEQ ID NO: 2735270 - RNA, 14 nt, Human
ggaaaugggcagag

SEQ ID NO: 2735271 - RNA, 13 nt, Human
ggaaaucuuuaaa

SEQ ID NO: 2735272 - RNA, 16 nt, Human
ggaaaugggcagagca

SEQ ID NO: 2735273 - RNA, 17 nt, Human
ggaaaugggcagagcag

SEQ ID NO: 2735274 - RNA, 18 nt, Human
ggaaaugggcagagcaga

SEQ ID NO: 2735275 - RNA, 22 nt, Human
ggaaaugggcagagcagagacc

SEQ ID NO: 2735276 - RNA, 15 nt, Human
ggaacaaggcaaggc

SEQ ID NO: 2735277 - RNA, 17 nt, Human
ggaacaaggcaaggcug

SEQ ID NO: 2735278 - RNA, 21 nt, Human
ggaacaaggcaaggcugucaa

SEQ ID NO: 2735279 - RNA, 23 nt, Human
ggaacaaggcaaggcugucaauu

SEQ ID NO: 2735280 - RNA, 19 nt, Human
ggaacacuccuucacagau

SEQ ID NO: 2735281 - RNA, 15 nt, Human
ggaacacuccuucac

SEQ ID NO: 2735282 - RNA, 14 nt, Human
ggaagacaauguga

SEQ ID NO: 2735283 - RNA, 16 nt, Human
ggaagacaaugugaaa

SEQ ID NO: 2735284 - RNA, 14 nt, Human
gcuuugaucccuuc

SEQ ID NO: 2735285 - RNA, 17 nt, Human
gcuuugaucccuucuua

SEQ ID NO: 2735286 - RNA, 11 nt, Human
gcuuuucugau

SEQ ID NO: 2735287 - RNA, 16 nt, Human
gcuuuucugauccagu

SEQ ID NO: 2735288 - RNA, 15 nt, Human
gcuuuucugauccag

SEQ ID NO: 2735289 - RNA, 12 nt, Human
gcuuuucugauc

SEQ ID NO: 2735290 - RNA, 15 nt, Human
gcuuuuggucugugu

SEQ ID NO: 2735291 - RNA, 18 nt, Human
gcuuuugucuaugggacu

SEQ ID NO: 2735292 - RNA, 12 nt, Human
gcuuuugugcau

SEQ ID NO: 2735293 - RNA, 22 nt, Human
gcuuuuuucucugauacagaaa

SEQ ID NO: 2735294 - RNA, 18 nt, Human
ggaaaauuuuaaaaauac

SEQ ID NO: 2735295 - RNA, 16 nt, Human
ggaaacccagcucugg

SEQ ID NO: 2735296 - RNA, 13 nt, Human
gcuguauuuuaaa

SEQ ID NO: 2735297 - RNA, 12 nt, Human
gcuguauuuuaa

SEQ ID NO: 2735298 - RNA, 23 nt, Human
gcugguucaggguuggccccugc

SEQ ID NO: 2735299 - RNA, 14 nt, Human
gcuguuggcugggg

SEQ ID NO: 2735300 - RNA, 13 nt, Human
gcuguuggcuggg

SEQ ID NO: 2735301 - RNA, 15 nt, Human
gcuucaguggcagcu

SEQ ID NO: 2735302 - RNA, 14 nt, Human
gcuucaguggcagc

SEQ ID NO: 2735303 - RNA, 14 nt, Human
gcuucaaggauccu

SEQ ID NO: 2735304 - RNA, 22 nt, Human
gcuuccagugaggcucugcccu

SEQ ID NO: 2735305 - RNA, 19 nt, Human
gcuuccuggcaauagucaa

SEQ ID NO: 2735306 - RNA, 23 nt, Human
gcuuccagugaggcucugcccuu

SEQ ID NO: 2735307 - RNA, 20 nt, Human
gcuugaccgugaggccagag

SEQ ID NO: 2735308 - RNA, 12 nt, Human
gcuucuucagag

SEQ ID NO: 2735309 - RNA, 15 nt, Human
gcuucuucagagacu

SEQ ID NO: 2735310 - RNA, 18 nt, Human
gcuuguaaauagcucagg

SEQ ID NO: 2735311 - RNA, 19 nt, Human
gcuuguaaauagcucaggu

SEQ ID NO: 2735312 - RNA, 17 nt, Human
gcuuguaaauagcucag

SEQ ID NO: 2735313 - RNA, 22 nt, Human
gcuugaccuuuaagagaaauga

SEQ ID NO: 2735314 - RNA, 23 nt, Human
gcuugaccgugaggccagagaca

SEQ ID NO: 2735315 - RNA, 18 nt, Human
gcuugaccuuuaagagaa

SEQ ID NO: 2735316 - RNA, 13 nt, Human
gccugcuccagcu

SEQ ID NO: 2735317 - RNA, 17 nt, Human
gccugcuaauuccccag

SEQ ID NO: 2735318 - RNA, 23 nt, Human
gccugcuaauuccccagauugca

SEQ ID NO: 2735319 - RNA, 19 nt, Human
gccuccuuugugaggaagc

SEQ ID NO: 2735320 - RNA, 20 nt, Human
gccuccuuugugaggaagcc

SEQ ID NO: 2735321 - RNA, 21 nt, Human
gccuccuuugugaggaagccg

SEQ ID NO: 2735322 - RNA, 13 nt, Human
gcgauucuucugc

SEQ ID NO: 2735323 - RNA, 14 nt, Human
gcgauucuucugcu

SEQ ID NO: 2735324 - RNA, 18 nt, Human
gcguugaaauuguaauua

SEQ ID NO: 2735325 - RNA, 20 nt, Human
gcgugguggacaugcacagc

SEQ ID NO: 2735326 - RNA, 14 nt, Human
gcgugcacacacca

SEQ ID NO: 2735327 - RNA, 18 nt, Human
gcgugcacacaccagagc

SEQ ID NO: 2735328 - RNA, 17 nt, Human
gcuacaaaaacacagca

SEQ ID NO: 2735329 - RNA, 19 nt, Human
gcuacaaaaacacagcaag

SEQ ID NO: 2735330 - RNA, 18 nt, Human
gcuacaaaaacacagcaa

SEQ ID NO: 2735331 - RNA, 16 nt, Human
gcuaauuuuucauuuu

SEQ ID NO: 2735332 - RNA, 24 nt, Human
gcguugaaauuguaauuauaucug

SEQ ID NO: 2735333 - RNA, 23 nt, Human
gcguugaaauuguaauuauaucu

SEQ ID NO: 2735334 - RNA, 17 nt, Human
gcguuucuaugacacau

SEQ ID NO: 2735335 - RNA, 15 nt, Human
gcuacugucagcucc

SEQ ID NO: 2735336 - RNA, 19 nt, Human
gcuacuguccuacccaccc

SEQ ID NO: 2735337 - RNA, 20 nt, Human
gcuacuguccuacccacccu

SEQ ID NO: 2735338 - RNA, 17 nt, Human
gcccaggccccugccac

SEQ ID NO: 2735339 - RNA, 22 nt, Human
gccaugugcuaguaauuggaaa

SEQ ID NO: 2735340 - RNA, 14 nt, Human
gccaugugccaggu

SEQ ID NO: 2735341 - RNA, 24 nt, Human
gccaucaauaaaaaauuaugacau

SEQ ID NO: 2735342 - RNA, 13 nt, Human
gcccaggcagguc

SEQ ID NO: 2735343 - RNA, 12 nt, Human
gcccaggcaggu

SEQ ID NO: 2735344 - RNA, 14 nt, Human
gcccaggcaggucu

SEQ ID NO: 2735345 - RNA, 16 nt, Human
gcccaggcaggucuug

SEQ ID NO: 2735346 - RNA, 15 nt, Human
gcccaggccccugcc

SEQ ID NO: 2735347 - RNA, 13 nt, Human
gcccaggccccug

SEQ ID NO: 2735348 - RNA, 15 nt, Human
gccccuggaugcagc

SEQ ID NO: 2735349 - RNA, 15 nt, Human
gccccugcccggcug

SEQ ID NO: 2735350 - RNA, 21 nt, Human
gccccugcugguucaggguug

SEQ ID NO: 2735351 - RNA, 22 nt, Human
gccccugcugguucaggguugg

SEQ ID NO: 2735352 - RNA, 22 nt, Human
gccaguuauggcuauaggugcu

SEQ ID NO: 2735353 - RNA, 13 nt, Human
gccaguugguccc

SEQ ID NO: 2735354 - RNA, 13 nt, Human
gccagugugacaa

SEQ ID NO: 2735355 - RNA, 22 nt, Human
gccaguuggucccccuuccaug

SEQ ID NO: 2735356 - RNA, 23 nt, Human
gccaguuggucccccuuccaugg

SEQ ID NO: 2735357 - RNA, 16 nt, Human
gccaguuggucccccu

SEQ ID NO: 2735358 - RNA, 18 nt, Human
gccaguuggucccccuuc

SEQ ID NO: 2735359 - RNA, 20 nt, Human
gccaguuggucccccuucca

SEQ ID NO: 2735360 - RNA, 21 nt, Human
gccaguuggucccccuuccau

SEQ ID NO: 2735361 - RNA, 13 nt, Human
gccagcaguucag

SEQ ID NO: 2735362 - RNA, 14 nt, Human
gccagcaguucaga

SEQ ID NO: 2735363 - RNA, 19 nt, Human
gccagcaguucagagcugc

SEQ ID NO: 2735364 - RNA, 20 nt, Human
gccagcaguucagagcugcc

SEQ ID NO: 2735365 - RNA, 21 nt, Human
gccagcaguucagagcugccc

SEQ ID NO: 2735366 - RNA, 13 nt, Human
gccaggcccucug

SEQ ID NO: 2735367 - RNA, 14 nt, Human
gccaggcccucugc

SEQ ID NO: 2735368 - RNA, 13 nt, Human
gccaggccacaag

SEQ ID NO: 2735369 - RNA, 18 nt, Human
gccaggccacaagacccu

SEQ ID NO: 2735370 - RNA, 22 nt, Human
gccaggccagagggagugacag

SEQ ID NO: 2735371 - RNA, 15 nt, Human
gccaggccagaggga

SEQ ID NO: 2735372 - RNA, 21 nt, Human
gccaggccacaagacccuugu

SEQ ID NO: 2735373 - RNA, 14 nt, Human
ggaggugaccccag

SEQ ID NO: 2735374 - RNA, 20 nt, Human
ggaggucaaggcugcaguga

SEQ ID NO: 2735375 - RNA, 16 nt, Human
ggaggggggagguggg

SEQ ID NO: 2735376 - RNA, 21 nt, Human
ggagcugccuguucagcucca

SEQ ID NO: 2735377 - RNA, 12 nt, Human
ggagcugccugu

SEQ ID NO: 2735378 - RNA, 16 nt, Human
ggagccccgaggccuu

SEQ ID NO: 2735379 - RNA, 22 nt, Human
ggagccccgaggccuucucuga

SEQ ID NO: 2735380 - RNA, 19 nt, Human
ggaggaaggaaacccagcu

SEQ ID NO: 2735381 - RNA, 20 nt, Human
ggaggaaggaaacccagcuc

SEQ ID NO: 2735382 - RNA, 23 nt, Human
ggaggaaggaaacccagcucugg

SEQ ID NO: 2735383 - RNA, 12 nt, Human
ggaggccagccu

SEQ ID NO: 2735384 - RNA, 11 nt, Human
ggaggccagcc

SEQ ID NO: 2735385 - RNA, 20 nt, Human
ggaggccaaggugggaggau

SEQ ID NO: 2735386 - RNA, 24 nt, Human
ggcacagaaaauggaagacagcuc

SEQ ID NO: 2735387 - RNA, 16 nt, Human
ggauguucugggacac

SEQ ID NO: 2735388 - RNA, 13 nt, Human
ggauguucuggga

SEQ ID NO: 2735389 - RNA, 15 nt, Human
ggauguucugggaca

SEQ ID NO: 2735390 - RNA, 15 nt, Human
ggagugcagugagcc

SEQ ID NO: 2735391 - RNA, 12 nt, Human
ggauggcaagau

SEQ ID NO: 2735392 - RNA, 18 nt, Human
ggauggauuuccagccaa

SEQ ID NO: 2735393 - RNA, 16 nt, Human
ggauggggcugcaccg

SEQ ID NO: 2735394 - RNA, 22 nt, Human
ggaucuucaucugacuaugaca

SEQ ID NO: 2735395 - RNA, 15 nt, Human
ggauccuccaggugc

SEQ ID NO: 2735396 - RNA, 14 nt, Human
ggauccuccaggug

SEQ ID NO: 2735397 - RNA, 13 nt, Human
ggauccugagcca

SEQ ID NO: 2735398 - RNA, 14 nt, Human
ggauccugagccag

SEQ ID NO: 2735399 - RNA, 15 nt, Human
ggaguucugguuccu

SEQ ID NO: 2735400 - RNA, 14 nt, Human
ggaguggccacaga

SEQ ID NO: 2735401 - RNA, 12 nt, Human
ggauaaaugcca

SEQ ID NO: 2735402 - RNA, 22 nt, Human
ggauaauaaggaaaaguuuaau

SEQ ID NO: 2735403 - RNA, 18 nt, Human
ggcccuucucuccagccc

SEQ ID NO: 2735404 - RNA, 14 nt, Human
ggcccuuccuuuuc

SEQ ID NO: 2735405 - RNA, 16 nt, Human
ggcccuucucuccagc

SEQ ID NO: 2735406 - RNA, 17 nt, Human
ggcccuucucuccagcc

SEQ ID NO: 2735407 - RNA, 16 nt, Human
ggccagugugacaagg

SEQ ID NO: 2735408 - RNA, 21 nt, Human
ggccaaacucaccugccccuc

SEQ ID NO: 2735409 - RNA, 17 nt, Human
ggccaaacucaccugcc

SEQ ID NO: 2735410 - RNA, 16 nt, Human
ggccaggcuggucuca

SEQ ID NO: 2735411 - RNA, 18 nt, Human
ggccaggcuggucucaaa

SEQ ID NO: 2735412 - RNA, 12 nt, Human
ggccaggcuggu

SEQ ID NO: 2735413 - RNA, 14 nt, Human
ggccaggcuggucu

SEQ ID NO: 2735414 - RNA, 18 nt, Human
ggcagugggagcugccug

SEQ ID NO: 2735415 - RNA, 19 nt, Human
ggcagugggagcugccugu

SEQ ID NO: 2735416 - RNA, 15 nt, Human
ggcauauuuuucaca

SEQ ID NO: 2735417 - RNA, 17 nt, Human
ggcauauuuuucacaua

SEQ ID NO: 2735418 - RNA, 18 nt, Human
ggcauccaguaucuugaa

SEQ ID NO: 2735419 - RNA, 15 nt, Human
ggcaccagcagccug

SEQ ID NO: 2735420 - RNA, 16 nt, Human
ggcaccagcagccugg

SEQ ID NO: 2735421 - RNA, 22 nt, Human
ggcacugcuuccagugaggcuc

SEQ ID NO: 2735422 - RNA, 24 nt, Human
ggcacugcuuccagugaggcucug

SEQ ID NO: 2735423 - RNA, 17 nt, Human
ggcagugggagcugccu

SEQ ID NO: 2735424 - RNA, 23 nt, Human
ggcucagcggggacagcuccuuc

SEQ ID NO: 2735425 - RNA, 21 nt, Human
ggcucagcggggacagcuccu

SEQ ID NO: 2735426 - RNA, 22 nt, Human
ggcucagcggggacagcuccuu

SEQ ID NO: 2735427 - RNA, 23 nt, Human
ggcucagcaaaagaugcuucuca

SEQ ID NO: 2735428 - RNA, 19 nt, Human
ggcucagcaaaagaugcuu

SEQ ID NO: 2735429 - RNA, 19 nt, Human
ggcgugcaguggugcgauc

SEQ ID NO: 2735430 - RNA, 14 nt, Human
ggcgugcaguggug

SEQ ID NO: 2735431 - RNA, 16 nt, Human
ggcucacugcagccuc

SEQ ID NO: 2735432 - RNA, 17 nt, Human
ggcucacugcagccuca

SEQ ID NO: 2735433 - RNA, 12 nt, Human
ggccugagcugg

SEQ ID NO: 2735434 - RNA, 15 nt, Human
ggccugagcugggau

SEQ ID NO: 2735435 - RNA, 12 nt, Human
ggccuucucuga

SEQ ID NO: 2735436 - RNA, 21 nt, Human
ggccugugucuaguuguuuga

SEQ ID NO: 2735437 - RNA, 21 nt, Human
ggccuggccagaugcaccagc

SEQ ID NO: 2735438 - RNA, 15 nt, Human
ggccuucucugaagg

SEQ ID NO: 2735439 - RNA, 16 nt, Human
ggccuucucugaagga

SEQ ID NO: 2735440 - RNA, 13 nt, Human
ggccuuuggcuuc

SEQ ID NO: 2735441 - RNA, 14 nt, Human
ggccuuuggcuuca

SEQ ID NO: 2735442 - RNA, 20 nt, Human
gggacauuugcucauggaau

SEQ ID NO: 2735443 - RNA, 21 nt, Human
gggacauuugcucauggaauu

SEQ ID NO: 2735444 - RNA, 19 nt, Human
gggacauuugcucauggaa

SEQ ID NO: 2735445 - RNA, 21 nt, Human
gggacagcuccuucuguccua

SEQ ID NO: 2735446 - RNA, 19 nt, Human
aaaaauauauuuaaugaua

SEQ ID NO: 2735447 - RNA, 13 nt, Human
aaaaauauauuua

SEQ ID NO: 2735448 - RNA, 15 nt, Human
aaaaauauauuuaau

SEQ ID NO: 2735449 - RNA, 14 nt, Human
aaaaauauuuuaug

SEQ ID NO: 2735450 - RNA, 13 nt, Human
gggaaggauacaa

SEQ ID NO: 2735451 - RNA, 16 nt, Human
gggacagcuccuucug

SEQ ID NO: 2735452 - RNA, 23 nt, Human
gggacagaggggguggccuccca

SEQ ID NO: 2735453 - RNA, 13 nt, Human
gggacagaggggg

SEQ ID NO: 2735454 - RNA, 22 nt, Human
gggacagaggggguggccuccc

SEQ ID NO: 2735455 - RNA, 12 nt, Human
aaaaccacagca

SEQ ID NO: 2735456 - RNA, 21 nt, Human
aaaaccaauguucucucuucu

SEQ ID NO: 2735457 - RNA, 15 nt, Human
aaaacaugcuacaca

SEQ ID NO: 2735458 - RNA, 22 nt, Human
aaaaauggaacauaaaauacaa

SEQ ID NO: 2735459 - RNA, 14 nt, Human
aaaaaucucaaauu

SEQ ID NO: 2735460 - RNA, 13 nt, Human
aaaacucauuuuu

SEQ ID NO: 2735461 - RNA, 20 nt, Human
aaaacugcugacuguuuucu

SEQ ID NO: 2735462 - RNA, 22 nt, Human
aaaacugcugacuguuuucucu

SEQ ID NO: 2735463 - RNA, 17 nt, Human
aaaagaugaaaauauuu

SEQ ID NO: 2735464 - RNA, 13 nt, Human
aaaagaugcuucu

SEQ ID NO: 2735465 - RNA, 23 nt, Human
aaaacugcugacuguuuucucuu

SEQ ID NO: 2735466 - RNA, 14 nt, Human
aaaaccacagcagu

SEQ ID NO: 2735467 - RNA, 13 nt, Human
aaaaccacagcag

SEQ ID NO: 2735468 - RNA, 15 nt, Human
gggauuacaggugug

SEQ ID NO: 2735469 - RNA, 16 nt, Human
gggcaacccccagccu

SEQ ID NO: 2735470 - RNA, 18 nt, Human
gggcaacccccagccugc

SEQ ID NO: 2735471 - RNA, 16 nt, Human
gggcagagcagagacc

SEQ ID NO: 2735472 - RNA, 12 nt, Human
gggcagagcaga

SEQ ID NO: 2735473 - RNA, 17 nt, Human
gggcagagcagagacca

SEQ ID NO: 2735474 - RNA, 22 nt, Human
gggcagagcagagaccaucccu

SEQ ID NO: 2735475 - RNA, 14 nt, Human
gggcagaggaaagc

SEQ ID NO: 2735476 - RNA, 19 nt, Human
aaaagguaugcaaucaaau

SEQ ID NO: 2735477 - RNA, 17 nt, Human
gggaggucgaggcagga

SEQ ID NO: 2735478 - RNA, 18 nt, Human
gggagggcuccagacaca

SEQ ID NO: 2735479 - RNA, 18 nt, Human
gggaggucgaggcaggag

SEQ ID NO: 2735480 - RNA, 19 nt, Human
gggaggucgaggcaggagg

SEQ ID NO: 2735481 - RNA, 14 nt, Human
gggagggcuccaga

SEQ ID NO: 2735482 - RNA, 15 nt, Human
gggagggcuccagac

SEQ ID NO: 2735483 - RNA, 17 nt, Human
gggagggcuccagacac

SEQ ID NO: 2735484 - RNA, 15 nt, Human
gggaggucgaggcag

SEQ ID NO: 2735485 - RNA, 19 nt, Human
gggaggccaaggugggagg

SEQ ID NO: 2735486 - RNA, 19 nt, Human
aaaaguauguuagugcaaa

SEQ ID NO: 2735487 - RNA, 14 nt, Human
aaaaugagccuggc

SEQ ID NO: 2735488 - RNA, 21 nt, Human
aaaaugagccuggcaagaaug

SEQ ID NO: 2735489 - RNA, 11 nt, Human
gggccaggagc

SEQ ID NO: 2735490 - RNA, 15 nt, Human
gggcgggaggauguu

SEQ ID NO: 2735491 - RNA, 15 nt, Human
gggccuccugugugu

SEQ ID NO: 2735492 - RNA, 13 nt, Human
gggccuccugugu

SEQ ID NO: 2735493 - RNA, 19 nt, Human
gggccucuuaugggcuggg

SEQ ID NO: 2735494 - RNA, 20 nt, Human
gggccucuuaugggcugggu

SEQ ID NO: 2735495 - RNA, 14 nt, Human
gggccaguuggucc

SEQ ID NO: 2735496 - RNA, 18 nt, Human
gggccaguuggucccccu

SEQ ID NO: 2735497 - RNA, 22 nt, Human
gggccaguuggucccccuucca

SEQ ID NO: 2735498 - RNA, 23 nt, Human
gggccaguuggucccccuuccau

SEQ ID NO: 2735499 - RNA, 20 nt, Human
aaacagucucaggaaaucaa

SEQ ID NO: 2735500 - RNA, 20 nt, Human
aaacaagcacuaaacaaaga

SEQ ID NO: 2735501 - RNA, 12 nt, Human
aaacacauuuuu

SEQ ID NO: 2735502 - RNA, 16 nt, Human
aaacacauuuuucuua

SEQ ID NO: 2735503 - RNA, 18 nt, Human
aaacaagaccacguuucu

SEQ ID NO: 2735504 - RNA, 20 nt, Human
aaacaagaccacguuucuaa

SEQ ID NO: 2735505 - RNA, 12 nt, Human
ggggacagcucc

SEQ ID NO: 2735506 - RNA, 14 nt, Human
ggggacagcuccuu

SEQ ID NO: 2735507 - RNA, 20 nt, Human
ggggacagcuccuucugucc

SEQ ID NO: 2735508 - RNA, 22 nt, Human
aaaauuuuuucucuaggaaaua

SEQ ID NO: 2735509 - RNA, 12 nt, Human
aaaaugugaagu

SEQ ID NO: 2735510 - RNA, 22 nt, Human
gggcuggguucuacccaggugc

SEQ ID NO: 2735511 - RNA, 18 nt, Human
gggcugcaugcgggcuuc

SEQ ID NO: 2735512 - RNA, 21 nt, Human
gggcugcaugcgggcuuccuc

SEQ ID NO: 2735513 - RNA, 10 nt, Human
gggcucagca

SEQ ID NO: 2735514 - RNA, 18 nt, Human
gggcucagcaaaagaugc

SEQ ID NO: 2735515 - RNA, 22 nt, Human
gggcugcaccggcuggccuggc

SEQ ID NO: 2735516 - RNA, 20 nt, Human
gggcuggguucuacccaggu

SEQ ID NO: 2735517 - RNA, 15 nt, Human
aaauaauuuuuauau

SEQ ID NO: 2735518 - RNA, 13 nt, Human
aaauaaugugaaa

SEQ ID NO: 2735519 - RNA, 18 nt, Human
aaauaauuuuuauauuug

SEQ ID NO: 2735520 - RNA, 20 nt, Human
aaauaauuuuuauauuugaa

SEQ ID NO: 2735521 - RNA, 12 nt, Human
aaauaaugugaa

SEQ ID NO: 2735522 - RNA, 12 nt, Human
guaaaaugugaa

SEQ ID NO: 2735523 - RNA, 19 nt, Human
guaaaaugugaagugaaug

SEQ ID NO: 2735524 - RNA, 20 nt, Human
guaaaaugugaagugaauga

SEQ ID NO: 2735525 - RNA, 22 nt, Human
guaaaaugugaagugaaugaaa

SEQ ID NO: 2735526 - RNA, 17 nt, Human
guaacaaugaagauaaa

SEQ ID NO: 2735527 - RNA, 21 nt, Human
aaaguuucucuuuucaaaaca

SEQ ID NO: 2735528 - RNA, 23 nt, Human
aaaguuucucuuuucaaaacauu

SEQ ID NO: 2735529 - RNA, 13 nt, Human
aaaguugaauuua

SEQ ID NO: 2735530 - RNA, 12 nt, Human
aaaguugaauuu

SEQ ID NO: 2735531 - RNA, 16 nt, Human
aaaguugaauuuuaca

SEQ ID NO: 2735532 - RNA, 22 nt, Human
aaaguugaauuuauuggcuuuu

SEQ ID NO: 2735533 - RNA, 16 nt, Human
aaaguugaauuuauug

SEQ ID NO: 2735534 - RNA, 19 nt, Human
aaaguuuaauauuaaagcc

SEQ ID NO: 2735535 - RNA, 16 nt, Human
aaaguuuaauauuaaa

SEQ ID NO: 2735536 - RNA, 22 nt, Human
aaaguuuaauauuaaagccaug

SEQ ID NO: 2735537 - RNA, 21 nt, Human
aaaguuuaauauuaaagccau

SEQ ID NO: 2735538 - RNA, 20 nt, Human
aaaguuuaauauuaaagcca

SEQ ID NO: 2735539 - RNA, 20 nt, Human
gguuuggacaaaauggaaua

SEQ ID NO: 2735540 - RNA, 12 nt, Human
aaaguggugaga

SEQ ID NO: 2735541 - RNA, 23 nt, Human
aaaguuauugauaaguucauaca

SEQ ID NO: 2735542 - RNA, 14 nt, Human
gguuucagaaaugu

SEQ ID NO: 2735543 - RNA, 13 nt, Human
gguuucagaaaug

SEQ ID NO: 2735544 - RNA, 12 nt, Human
gguuucagaaau

SEQ ID NO: 2735545 - RNA, 21 nt, Human
gguucccuuugacgccauccc

SEQ ID NO: 2735546 - RNA, 22 nt, Human
gguucccuuugacgccauccca

SEQ ID NO: 2735547 - RNA, 22 nt, Human
gguucaggguuggccccugccc

SEQ ID NO: 2735548 - RNA, 18 nt, Human
gguucaggguuggccccu

SEQ ID NO: 2735549 - RNA, 21 nt, Human
gguucaggguuggccccugcc

SEQ ID NO: 2735550 - RNA, 12 nt, Human
gguucagcuugu

SEQ ID NO: 2735551 - RNA, 12 nt, Human
gguguggaagag

SEQ ID NO: 2735552 - RNA, 21 nt, Human
ggugugcggccuuuggcuuca

SEQ ID NO: 2735553 - RNA, 13 nt, Human
ggugugcucugau

SEQ ID NO: 2735554 - RNA, 16 nt, Human
ggugugacugaauuuc

SEQ ID NO: 2735555 - RNA, 18 nt, Human
ggugugagucaccaagcc

SEQ ID NO: 2735556 - RNA, 13 nt, Human
ggugucgggcaug

SEQ ID NO: 2735557 - RNA, 16 nt, Human
ggugucgggcaugaca

SEQ ID NO: 2735558 - RNA, 15 nt, Human
gguggggucacucug

SEQ ID NO: 2735559 - RNA, 23 nt, Human
gguggggucacucuggcagcuca

SEQ ID NO: 2735560 - RNA, 20 nt, Human
ggugggaggauugcuugagc

SEQ ID NO: 2735561 - RNA, 14 nt, Human
ggugggauccucca

SEQ ID NO: 2735562 - RNA, 15 nt, Human
ggugggauccuccag

SEQ ID NO: 2735563 - RNA, 13 nt, Human
gguggggcagcuu

SEQ ID NO: 2735564 - RNA, 17 nt, Human
gguggggcagcuugagg

SEQ ID NO: 2735565 - RNA, 19 nt, Human
ggugggauccuccaggugc

SEQ ID NO: 2735566 - RNA, 15 nt, Human
aaagcagcguuucua

SEQ ID NO: 2735567 - RNA, 21 nt, Human
gguggaugccugguggcagcu

SEQ ID NO: 2735568 - RNA, 14 nt, Human
gguggaugccuggu

SEQ ID NO: 2735569 - RNA, 22 nt, Human
aaagcagcguuucuaugacaca

SEQ ID NO: 2735570 - RNA, 18 nt, Human
aaagcagcguuucuauga

SEQ ID NO: 2735571 - RNA, 16 nt, Human
aaagcagcguuucuau

SEQ ID NO: 2735572 - RNA, 21 nt, Human
ggugcauuugaggucuguucu

SEQ ID NO: 2735573 - RNA, 18 nt, Human
ggugcaaugaccuuucaa

SEQ ID NO: 2735574 - RNA, 19 nt, Human
ggugcaaugaccuuucaau

SEQ ID NO: 2735575 - RNA, 20 nt, Human
ggugcaaugaccuuucaaua

SEQ ID NO: 2735576 - RNA, 15 nt, Human
aaagacuauucaaac

SEQ ID NO: 2735577 - RNA, 13 nt, Human
aaagauuuucaga

SEQ ID NO: 2735578 - RNA, 13 nt, Human
aaagcaaaggaga

SEQ ID NO: 2735579 - RNA, 21 nt, Human
gguccugcugcaguugccagu

SEQ ID NO: 2735580 - RNA, 23 nt, Human
gguccugcugcaguugccaguca

SEQ ID NO: 2735581 - RNA, 13 nt, Human
ggucggaaaacau

SEQ ID NO: 2735582 - RNA, 14 nt, Human
gguccugcugcagu

SEQ ID NO: 2735583 - RNA, 14 nt, Human
ggucggaaaacaug

SEQ ID NO: 2735584 - RNA, 17 nt, Human
ggucuacacugugcuga

SEQ ID NO: 2735585 - RNA, 14 nt, Human
aaagacuauucaaa

SEQ ID NO: 2735586 - RNA, 17 nt, Human
aaagacuaucuaaaugu

SEQ ID NO: 2735587 - RNA, 12 nt, Human
aaacuuuacuau

SEQ ID NO: 2735588 - RNA, 15 nt, Human
gguccauagagagca

SEQ ID NO: 2735589 - RNA, 22 nt, Human
aaacuuuaccuuuuuuauacau

SEQ ID NO: 2735590 - RNA, 17 nt, Human
aaacuuuaccuuuuuua

SEQ ID NO: 2735591 - RNA, 14 nt, Human
gguaugcaaucaaa

SEQ ID NO: 2735592 - RNA, 22 nt, Human
gguaugaucacggcucacugca

SEQ ID NO: 2735593 - RNA, 17 nt, Human
gguccacccaggagccc

SEQ ID NO: 2735594 - RNA, 12 nt, Human
gguccacccagg

SEQ ID NO: 2735595 - RNA, 13 nt, Human
gguccacccagga

SEQ ID NO: 2735596 - RNA, 15 nt, Human
gguccacccaggagc

SEQ ID NO: 2735597 - RNA, 16 nt, Human
gguccacccaggagcc

SEQ ID NO: 2735598 - RNA, 13 nt, Human
gguaacaggcaga

SEQ ID NO: 2735599 - RNA, 14 nt, Human
gguaacaggcagau

SEQ ID NO: 2735600 - RNA, 20 nt, Human
gguaacaggcagauacagga

SEQ ID NO: 2735601 - RNA, 17 nt, Human
ggguuucuaaagcugcc

SEQ ID NO: 2735602 - RNA, 15 nt, Human
ggguggcaccagcag

SEQ ID NO: 2735603 - RNA, 17 nt, Human
ggguggaugccuggugg

SEQ ID NO: 2735604 - RNA, 13 nt, Human
ggguggaugccug

SEQ ID NO: 2735605 - RNA, 20 nt, Human
ggguggggaccucaggccug

SEQ ID NO: 2735606 - RNA, 19 nt, Human
gggugggacacccugugau

SEQ ID NO: 2735607 - RNA, 17 nt, Human
ggguguggcgcagcaua

SEQ ID NO: 2735608 - RNA, 12 nt, Human
ggguggugaccu

SEQ ID NO: 2735609 - RNA, 14 nt, Human
gaagcucagggccu

SEQ ID NO: 2735610 - RNA, 15 nt, Human
gaagcucagggccug

SEQ ID NO: 2735611 - RNA, 23 nt, Human
gaagcucagggccuggcucaggu

SEQ ID NO: 2735612 - RNA, 20 nt, Human
gaagcucagggccuggcuca

SEQ ID NO: 2735613 - RNA, 21 nt, Human
gaagcucagggccuggcucag

SEQ ID NO: 2735614 - RNA, 16 nt, Human
gaagcucagggccugg

SEQ ID NO: 2735615 - RNA, 17 nt, Human
gaagcucagggccuggc

SEQ ID NO: 2735616 - RNA, 18 nt, Human
gaagcucagggccuggcu

SEQ ID NO: 2735617 - RNA, 19 nt, Human
gaagcucagggccuggcuc

SEQ ID NO: 2735618 - RNA, 16 nt, Human
gaaggcucgagcaugc

SEQ ID NO: 2735619 - RNA, 17 nt, Human
gaaggcucgagcaugcc

SEQ ID NO: 2735620 - RNA, 18 nt, Human
gaagucuuuguacagaca

SEQ ID NO: 2735621 - RNA, 19 nt, Human
gaagucuuuguacagacaa

SEQ ID NO: 2735622 - RNA, 20 nt, Human
gaagucuuuguacagacaac

SEQ ID NO: 2735623 - RNA, 22 nt, Human
gaaugagagacacacugaagaa

SEQ ID NO: 2735624 - RNA, 23 nt, Human
gaaugagagacacacugaagaag

SEQ ID NO: 2735625 - RNA, 20 nt, Human
gaaugagagacacacugaag

SEQ ID NO: 2735626 - RNA, 11 nt, Human
gaaugaauguc

SEQ ID NO: 2735627 - RNA, 14 nt, Human
gaaugaaugucagu

SEQ ID NO: 2735628 - RNA, 18 nt, Human
gaaugaaugucaguguga

SEQ ID NO: 2735629 - RNA, 22 nt, Human
gaaugaaugucagugugacuga

SEQ ID NO: 2735630 - RNA, 13 nt, Human
gacacacugaaga

SEQ ID NO: 2735631 - RNA, 12 nt, Human
gacacacaugaa

SEQ ID NO: 2735632 - RNA, 21 nt, Human
gacacacagcucuguccuggg

SEQ ID NO: 2735633 - RNA, 11 nt, Human
gaauuaguuuu

SEQ ID NO: 2735634 - RNA, 12 nt, Human
gaauuaugaaac

SEQ ID NO: 2735635 - RNA, 19 nt, Human
gaauuuuggcugugucucc

SEQ ID NO: 2735636 - RNA, 13 nt, Human
gaauuuuguguua

SEQ ID NO: 2735637 - RNA, 21 nt, Human
gaauuuugugcccccauguaa

SEQ ID NO: 2735638 - RNA, 20 nt, Human
gaauuuugugcccccaugua

SEQ ID NO: 2735639 - RNA, 23 nt, Human
gaauuuuggcugugucucccuuc

SEQ ID NO: 2735640 - RNA, 14 nt, Human
gacaaaaagcuacu

SEQ ID NO: 2735641 - RNA, 22 nt, Human
gaauuuuguguuagagauuuuu

SEQ ID NO: 2735642 - RNA, 16 nt, Human
gaauuuuguguuagag

SEQ ID NO: 2735643 - RNA, 15 nt, Human
gacaaaauggaauac

SEQ ID NO: 2735644 - RNA, 14 nt, Human
gacacacagcucug

SEQ ID NO: 2735645 - RNA, 13 nt, Human
gacacacagcucu

SEQ ID NO: 2735646 - RNA, 15 nt, Human
gacacacagcucugu

SEQ ID NO: 2735647 - RNA, 17 nt, Human
gacacacagcucugucc

SEQ ID NO: 2735648 - RNA, 18 nt, Human
gacacacagcucuguccu

SEQ ID NO: 2735649 - RNA, 19 nt, Human
gacacacagcucuguccug

SEQ ID NO: 2735650 - RNA, 13 nt, Human
gacacugaugggc

SEQ ID NO: 2735651 - RNA, 15 nt, Human
gacacugaugggcaa

SEQ ID NO: 2735652 - RNA, 16 nt, Human
gacagaauauguuuca

SEQ ID NO: 2735653 - RNA, 12 nt, Human
gacagacacagg

SEQ ID NO: 2735654 - RNA, 21 nt, Human
gacagcccgggcucugccucc

SEQ ID NO: 2735655 - RNA, 22 nt, Human
gacagcccgggcucugccuccc

SEQ ID NO: 2735656 - RNA, 23 nt, Human
gacagcccgggcucugccuccca

SEQ ID NO: 2735657 - RNA, 17 nt, Human
gacagucaccucaugga

SEQ ID NO: 2735658 - RNA, 14 nt, Human
gacagugaaagaaa

SEQ ID NO: 2735659 - RNA, 20 nt, Human
gacaggguuuugccauguug

SEQ ID NO: 2735660 - RNA, 22 nt, Human
gacaggguuuugccauguuggc

SEQ ID NO: 2735661 - RNA, 11 nt, Human
gacagcuccuu

SEQ ID NO: 2735662 - RNA, 14 nt, Human
gagcagggcucagc

SEQ ID NO: 2735663 - RNA, 12 nt, Human
gagcaucaggcc

SEQ ID NO: 2735664 - RNA, 22 nt, Human
gagcaugccuggauggggcugc

SEQ ID NO: 2735665 - RNA, 18 nt, Human
gagcugggugucaagagg

SEQ ID NO: 2735666 - RNA, 18 nt, Human
gagcggagaaaggaaggg

SEQ ID NO: 2735667 - RNA, 21 nt, Human
gagcggagaaaggaagggcug

SEQ ID NO: 2735668 - RNA, 20 nt, Human
gagcugccuguucagcucca

SEQ ID NO: 2735669 - RNA, 21 nt, Human
gagcugccuguucagcuccag

SEQ ID NO: 2735670 - RNA, 22 nt, Human
gagcugccuguucagcuccagc

SEQ ID NO: 2735671 - RNA, 19 nt, Human
gagccuugaacuuugaccu

SEQ ID NO: 2735672 - RNA, 22 nt, Human
gagccuugaacuuugaccucug

SEQ ID NO: 2735673 - RNA, 14 nt, Human
gagccuuccagggg

SEQ ID NO: 2735674 - RNA, 15 nt, Human
gagccuuccaggggu

SEQ ID NO: 2735675 - RNA, 16 nt, Human
gagccuuccaggggug

SEQ ID NO: 2735676 - RNA, 17 nt, Human
gagccuuccaggggugg

SEQ ID NO: 2735677 - RNA, 13 nt, Human
gagauuuacaacu

SEQ ID NO: 2735678 - RNA, 18 nt, Human
gagauugcaccacugcac

SEQ ID NO: 2735679 - RNA, 22 nt, Human
gagaggcauccaguaucuugaa

SEQ ID NO: 2735680 - RNA, 21 nt, Human
gagaugaugccaugggcccuc

SEQ ID NO: 2735681 - RNA, 14 nt, Human
gagaggcauccagu

SEQ ID NO: 2735682 - RNA, 17 nt, Human
gagacuccugcaggcag

SEQ ID NO: 2735683 - RNA, 15 nt, Human
gagacuccugcaggc

SEQ ID NO: 2735684 - RNA, 16 nt, Human
gagacuccugcaggca

SEQ ID NO: 2735685 - RNA, 22 nt, Human
gacuauucaaacagucucagga

SEQ ID NO: 2735686 - RNA, 13 nt, Human
gacuaugacauaa

SEQ ID NO: 2735687 - RNA, 22 nt, Human
gacuaucuaaauguugaaagau

SEQ ID NO: 2735688 - RNA, 17 nt, Human
gacucuuaagaagacug

SEQ ID NO: 2735689 - RNA, 15 nt, Human
gacucuuaagaagac

SEQ ID NO: 2735690 - RNA, 16 nt, Human
gacucuuaagaagacu

SEQ ID NO: 2735691 - RNA, 12 nt, Human
gacucugucuca

SEQ ID NO: 2735692 - RNA, 21 nt, Human
gacuuuucuuuguggcuuccu

SEQ ID NO: 2735693 - RNA, 23 nt, Human
gacuuuucuuucagccaagaauu

SEQ ID NO: 2735694 - RNA, 18 nt, Human
gacuggugacugauucuu

SEQ ID NO: 2735695 - RNA, 15 nt, Human
gacuggugacugauu

SEQ ID NO: 2735696 - RNA, 12 nt, Human
gacuggugacug

SEQ ID NO: 2735697 - RNA, 16 nt, Human
gagaagcggcuggcag

SEQ ID NO: 2735698 - RNA, 13 nt, Human
gagaagcggcugg

SEQ ID NO: 2735699 - RNA, 15 nt, Human
gagaagcggcuggca

SEQ ID NO: 2735700 - RNA, 12 nt, Human
gagaaggaagcc

SEQ ID NO: 2735701 - RNA, 22 nt, Human
gagacguuuuuggaagaguagu

SEQ ID NO: 2735702 - RNA, 12 nt, Human
gcacugacauug

SEQ ID NO: 2735703 - RNA, 12 nt, Human
gcacugacagau

SEQ ID NO: 2735704 - RNA, 17 nt, Human
gcacugacagauuucca

SEQ ID NO: 2735705 - RNA, 19 nt, Human
gcagagcagagaccauccc

SEQ ID NO: 2735706 - RNA, 20 nt, Human
gcagagcagagaccaucccu

SEQ ID NO: 2735707 - RNA, 24 nt, Human
gcagagcaccuuagacagucccug

SEQ ID NO: 2735708 - RNA, 12 nt, Human
gcagagcagaga

SEQ ID NO: 2735709 - RNA, 14 nt, Human
gcagagcagagacc

SEQ ID NO: 2735710 - RNA, 15 nt, Human
gcagagcagagacca

SEQ ID NO: 2735711 - RNA, 19 nt, Human
gcagagcaccuuagacagu

SEQ ID NO: 2735712 - RNA, 22 nt, Human
gcagagcaccuuagacaguccc

SEQ ID NO: 2735713 - RNA, 23 nt, Human
gcagagcaccuuagacagucccu

SEQ ID NO: 2735714 - RNA, 14 nt, Human
gcacaagcugcacc

SEQ ID NO: 2735715 - RNA, 23 nt, Human
gcacaagcuccaagcucccaggc

SEQ ID NO: 2735716 - RNA, 21 nt, Human
gcacaagcuccaagcucccag

SEQ ID NO: 2735717 - RNA, 22 nt, Human
gcacaagcuccaagcucccagg

SEQ ID NO: 2735718 - RNA, 21 nt, Human
gcaauaaagcagcguuucuau

SEQ ID NO: 2735719 - RNA, 13 nt, Human
gcaagugagagcu

SEQ ID NO: 2735720 - RNA, 18 nt, Human
gcacaguuuucugagaaa

SEQ ID NO: 2735721 - RNA, 17 nt, Human
gcacaguuuucugagaa

SEQ ID NO: 2735722 - RNA, 14 nt, Human
gcacaguuuucuga

SEQ ID NO: 2735723 - RNA, 13 nt, Human
gcacaugccucuc

SEQ ID NO: 2735724 - RNA, 21 nt, Human
gcacaucagcacgauuucugu

SEQ ID NO: 2735725 - RNA, 20 nt, Human
gcacaucagcacgauuucug

SEQ ID NO: 2735726 - RNA, 19 nt, Human
gcacaucagcacgauuucu

SEQ ID NO: 2735727 - RNA, 18 nt, Human
gcaccggcuggccuggcc

SEQ ID NO: 2735728 - RNA, 21 nt, Human
gcaccggcuggccuggccccu

SEQ ID NO: 2735729 - RNA, 23 nt, Human
gcaccggcuggccuggccccuca

SEQ ID NO: 2735730 - RNA, 19 nt, Human
gcaccggcuggccuggccc

SEQ ID NO: 2735731 - RNA, 20 nt, Human
gcacaugccucucucaggcc

SEQ ID NO: 2735732 - RNA, 21 nt, Human
gcacaugccucucucaggcca

SEQ ID NO: 2735733 - RNA, 14 nt, Human
gcacaugccucucu

SEQ ID NO: 2735734 - RNA, 17 nt, Human
gcacaugccucucucag

SEQ ID NO: 2735735 - RNA, 18 nt, Human
gcacaugccucucucagg

SEQ ID NO: 2735736 - RNA, 19 nt, Human
gcacaugccucucucaggc

SEQ ID NO: 2735737 - RNA, 16 nt, Human
gcagccaggccacaag

SEQ ID NO: 2735738 - RNA, 13 nt, Human
gcagccaggccac

SEQ ID NO: 2735739 - RNA, 14 nt, Human
gcagccaggccaca

SEQ ID NO: 2735740 - RNA, 16 nt, Human
gcagccacauuccuga

SEQ ID NO: 2735741 - RNA, 12 nt, Human
gcagccaggcca

SEQ ID NO: 2735742 - RNA, 14 nt, Human
gcagccacuauugu

SEQ ID NO: 2735743 - RNA, 11 nt, Human
gcagcugccuc

SEQ ID NO: 2735744 - RNA, 12 nt, Human
gcagcugccucc

SEQ ID NO: 2735745 - RNA, 13 nt, Human
gcagcugccuccc

SEQ ID NO: 2735746 - RNA, 15 nt, Human
gcagcugccuccccu

SEQ ID NO: 2735747 - RNA, 16 nt, Human
gcagcugccuccccuc

SEQ ID NO: 2735748 - RNA, 17 nt, Human
gcagcugccuccccucc

SEQ ID NO: 2735749 - RNA, 18 nt, Human
gcagcugccuccccuccu

SEQ ID NO: 2735750 - RNA, 22 nt, Human
gcagcugccuccccuccucugc

SEQ ID NO: 2735751 - RNA, 17 nt, Human
gcagcugcgguccaccc

SEQ ID NO: 2735752 - RNA, 19 nt, Human
gcagcugcgguccacccag

SEQ ID NO: 2735753 - RNA, 20 nt, Human
gcaggcucucaggccagcug

SEQ ID NO: 2735754 - RNA, 22 nt, Human
gcaggcucucaggccagcugcu

SEQ ID NO: 2735755 - RNA, 18 nt, Human
gcaggcucucaggccagc

SEQ ID NO: 2735756 - RNA, 23 nt, Human
gcaggcucucaggccagcugcuu

SEQ ID NO: 2735757 - RNA, 13 nt, Human
gcagggaaacagc

SEQ ID NO: 2735758 - RNA, 14 nt, Human
gcauacguacacau

SEQ ID NO: 2735759 - RNA, 15 nt, Human
gcauaacauaaaucu

SEQ ID NO: 2735760 - RNA, 23 nt, Human
gcauaacauaaaucugugaacuu

SEQ ID NO: 2735761 - RNA, 21 nt, Human
gcauaacauaaaucugugaac

SEQ ID NO: 2735762 - RNA, 20 nt, Human
gcauaccacuuuuguucuug

SEQ ID NO: 2735763 - RNA, 17 nt, Human
gcauaccacuuuuguuc

SEQ ID NO: 2735764 - RNA, 17 nt, Human
gaucucuugagccuggg

SEQ ID NO: 2735765 - RNA, 12 nt, Human
gaucucuugagc

SEQ ID NO: 2735766 - RNA, 16 nt, Human
gaucucuugagccugg

SEQ ID NO: 2735767 - RNA, 15 nt, Human
gauauuuuuuucuuu

SEQ ID NO: 2735768 - RNA, 15 nt, Human
gauauuuugcuuugu

SEQ ID NO: 2735769 - RNA, 16 nt, Human
gauauuuugcuuugug

SEQ ID NO: 2735770 - RNA, 22 nt, Human
gauccaguuuuguuuggaccaa

SEQ ID NO: 2735771 - RNA, 17 nt, Human
gauccaguuuuguuugg

SEQ ID NO: 2735772 - RNA, 11 nt, Human
gauccaguuuu

SEQ ID NO: 2735773 - RNA, 16 nt, Human
gaugagaggaaaucac

SEQ ID NO: 2735774 - RNA, 20 nt, Human
gaugaucuuugcagacaggc

SEQ ID NO: 2735775 - RNA, 21 nt, Human
gaugaucuuugcagacaggca

SEQ ID NO: 2735776 - RNA, 14 nt, Human
gaugaucuuugcag

SEQ ID NO: 2735777 - RNA, 14 nt, Human
gauuagaauucugu

SEQ ID NO: 2735778 - RNA, 23 nt, Human
gauuagaauucuguauagauuag

SEQ ID NO: 2735779 - RNA, 15 nt, Human
gauuagaauucugua

SEQ ID NO: 2735780 - RNA, 16 nt, Human
gaugugaacacaucag

SEQ ID NO: 2735781 - RNA, 14 nt, Human
gaugugaacacauc

SEQ ID NO: 2735782 - RNA, 20 nt, Human
gauuacaggugugaaccacc

SEQ ID NO: 2735783 - RNA, 17 nt, Human
gauuagggagagaagau

SEQ ID NO: 2735784 - RNA, 18 nt, Human
gauuagagaguguugaaa

SEQ ID NO: 2735785 - RNA, 14 nt, Human
gauuagagaguguu

SEQ ID NO: 2735786 - RNA, 16 nt, Human
gauuauucacugauuu

SEQ ID NO: 2735787 - RNA, 15 nt, Human
gauuauucacugauu

SEQ ID NO: 2735788 - RNA, 13 nt, Human
gauuauucacuga

SEQ ID NO: 2735789 - RNA, 13 nt, Human
gauacccauccca

SEQ ID NO: 2735790 - RNA, 14 nt, Human
gauacccaucccau

SEQ ID NO: 2735791 - RNA, 16 nt, Human
gauacuacaguuuguu

SEQ ID NO: 2735792 - RNA, 11 nt, Human
gauacuacagu

SEQ ID NO: 2735793 - RNA, 14 nt, Human
gauaugugaacagu

SEQ ID NO: 2735794 - RNA, 13 nt, Human
gauaugugaacag

SEQ ID NO: 2735795 - RNA, 20 nt, Human
gaguuugggguaugggagag

SEQ ID NO: 2735796 - RNA, 18 nt, Human
gagugccuuacacaaugg

SEQ ID NO: 2735797 - RNA, 20 nt, Human
gaguuguuacauuuuuaagu

SEQ ID NO: 2735798 - RNA, 16 nt, Human
gaguuguuacauuuuu

SEQ ID NO: 2735799 - RNA, 16 nt, Human
gaguuuagcuggaaaa

SEQ ID NO: 2735800 - RNA, 13 nt, Human
gagucaccaagcc

SEQ ID NO: 2735801 - RNA, 14 nt, Human
gagucaccaagccc

SEQ ID NO: 2735802 - RNA, 16 nt, Human
gagucccaccuuggcu

SEQ ID NO: 2735803 - RNA, 20 nt, Human
gagucccaccuuggcugcag

SEQ ID NO: 2735804 - RNA, 11 nt, Human
gagugcaguga

SEQ ID NO: 2735805 - RNA, 12 nt, Human
gagugcagugag

SEQ ID NO: 2735806 - RNA, 24 nt, Human
gagugagcacuaaggugugcucug

SEQ ID NO: 2735807 - RNA, 21 nt, Human
gagucccaccuuggcugcagg

SEQ ID NO: 2735808 - RNA, 13 nt, Human
gagucccaccuug

SEQ ID NO: 2735809 - RNA, 12 nt, Human
gagugagcuggu

SEQ ID NO: 2735810 - RNA, 11 nt, Human
gaggugggagg

SEQ ID NO: 2735811 - RNA, 12 nt, Human
gaggugggaucc

SEQ ID NO: 2735812 - RNA, 14 nt, Human
gaggucuguucuuu

SEQ ID NO: 2735813 - RNA, 13 nt, Human
gaggucuguucuu

SEQ ID NO: 2735814 - RNA, 23 nt, Human
cuuucagccaagaauucuuaaau

SEQ ID NO: 2735815 - RNA, 20 nt, Human
cuuucagccaagaauucuua

SEQ ID NO: 2735816 - RNA, 23 nt, Human
cuuucaauaggaaaaacugauuu

SEQ ID NO: 2735817 - RNA, 22 nt, Human
cuuuccugaggcugggcucccu

SEQ ID NO: 2735818 - RNA, 13 nt, Human
cuuuuauaaacuu

SEQ ID NO: 2735819 - RNA, 20 nt, Human
cuuuguauagaaccucuuug

SEQ ID NO: 2735820 - RNA, 11 nt, Human
cuuuguauaga

SEQ ID NO: 2735821 - RNA, 17 nt, Human
cuuugggccuggcuccc

SEQ ID NO: 2735822 - RNA, 16 nt, Human
cuuucuagccagagga

SEQ ID NO: 2735823 - RNA, 17 nt, Human
cuuucuacccagcgagc

SEQ ID NO: 2735824 - RNA, 15 nt, Human
cuuucuagccagagg

SEQ ID NO: 2735825 - RNA, 18 nt, Human
gaaaagaaaaaugagccu

SEQ ID NO: 2735826 - RNA, 21 nt, Human
gaaaauggaagacagcucuua

SEQ ID NO: 2735827 - RNA, 14 nt, Human
gaaaaacugauuuu

SEQ ID NO: 2735828 - RNA, 15 nt, Human
gaaaauguaugugua

SEQ ID NO: 2735829 - RNA, 19 nt, Human
gaaaauggacguguuauga

SEQ ID NO: 2735830 - RNA, 23 nt, Human
gaaaauggacguguuaugacucc

SEQ ID NO: 2735831 - RNA, 18 nt, Human
cuuuugucuaugggacuc

SEQ ID NO: 2735832 - RNA, 18 nt, Human
cuuuuggaagguauuuaa

SEQ ID NO: 2735833 - RNA, 23 nt, Human
cuuuugcccacacuugggagcaa

SEQ ID NO: 2735834 - RNA, 23 nt, Human
cuuuuuuggcugcugaaggcucg

SEQ ID NO: 2735835 - RNA, 13 nt, Human
cuuuugugcauua

SEQ ID NO: 2735836 - RNA, 12 nt, Human
cuuuugugcauu

SEQ ID NO: 2735837 - RNA, 17 nt, Human
gaaagacuauucaaaca

SEQ ID NO: 2735838 - RNA, 21 nt, Human
gaaaggcuccaggagcagcca

SEQ ID NO: 2735839 - RNA, 20 nt, Human
gaaaggcuccaggagcagcc

SEQ ID NO: 2735840 - RNA, 22 nt, Human
gaaaggcuccaggagcagccac

SEQ ID NO: 2735841 - RNA, 15 nt, Human
gaaagacuauucaaa

SEQ ID NO: 2735842 - RNA, 14 nt, Human
gaaagacuauucaa

SEQ ID NO: 2735843 - RNA, 20 nt, Human
gaaagacuaucuaaauguug

SEQ ID NO: 2735844 - RNA, 15 nt, Human
gaaacuuuuggaagg

SEQ ID NO: 2735845 - RNA, 13 nt, Human
gaaacuuuuggaa

SEQ ID NO: 2735846 - RNA, 17 nt, Human
gaaauauuuauuuuaau

SEQ ID NO: 2735847 - RNA, 19 nt, Human
gaaagggacuuggaagcuc

SEQ ID NO: 2735848 - RNA, 20 nt, Human
gaaagggacgcuacccggga

SEQ ID NO: 2735849 - RNA, 22 nt, Human
gaaagggacuuggaagcuccgc

SEQ ID NO: 2735850 - RNA, 17 nt, Human
gaaaucaaauaugcaaa

SEQ ID NO: 2735851 - RNA, 18 nt, Human
gaaaucaaauaugcaaag

SEQ ID NO: 2735852 - RNA, 18 nt, Human
gaaauauuuauuuuaaua

SEQ ID NO: 2735853 - RNA, 22 nt, Human
gaaauauuuauuuuaauaaugu

SEQ ID NO: 2735854 - RNA, 20 nt, Human
gaaaucaaauaugcaaagca

SEQ ID NO: 2735855 - RNA, 19 nt, Human
gaaaucaaauaugcaaagc

SEQ ID NO: 2735856 - RNA, 19 nt, Human
gaaaucaccgaaaacgugg

SEQ ID NO: 2735857 - RNA, 12 nt, Human
cugugcugaguc

SEQ ID NO: 2735858 - RNA, 14 nt, Human
cugugcugagucug

SEQ ID NO: 2735859 - RNA, 19 nt, Human
cugugcugagucugaaggc

SEQ ID NO: 2735860 - RNA, 13 nt, Human
cuuauggaacacu

SEQ ID NO: 2735861 - RNA, 16 nt, Human
cuuauggaacacucug

SEQ ID NO: 2735862 - RNA, 17 nt, Human
cuuauggaacacucuga

SEQ ID NO: 2735863 - RNA, 19 nt, Human
cuuauggaacacucugaga

SEQ ID NO: 2735864 - RNA, 20 nt, Human
cuuauggaacacucugagac

SEQ ID NO: 2735865 - RNA, 15 nt, Human
cuucacggaagagcc

SEQ ID NO: 2735866 - RNA, 19 nt, Human
cuucacggaagagccuugc

SEQ ID NO: 2735867 - RNA, 20 nt, Human
cuuauuguagcauccuggaa

SEQ ID NO: 2735868 - RNA, 22 nt, Human
cuucaccuuuguccccaccgca

SEQ ID NO: 2735869 - RNA, 21 nt, Human
cuucaccuuuguccccaccgc

SEQ ID NO: 2735870 - RNA, 23 nt, Human
cuuauuguagcauccuggaauau

SEQ ID NO: 2735871 - RNA, 21 nt, Human
cuucccaccucucucacuccu

SEQ ID NO: 2735872 - RNA, 23 nt, Human
cuucccaccucucucacuccuug

SEQ ID NO: 2735873 - RNA, 11 nt, Human
cuucccaccuc

SEQ ID NO: 2735874 - RNA, 15 nt, Human
cuucacuguaaaaua

SEQ ID NO: 2735875 - RNA, 17 nt, Human
cuucagagacuccugca

SEQ ID NO: 2735876 - RNA, 20 nt, Human
cuucagagacuccugcaggc

SEQ ID NO: 2735877 - RNA, 18 nt, Human
cuucagagacuccugcag

SEQ ID NO: 2735878 - RNA, 19 nt, Human
cuucagagacuccugcagg

SEQ ID NO: 2735879 - RNA, 19 nt, Human
cuucaucugacuaugacau

SEQ ID NO: 2735880 - RNA, 21 nt, Human
cuucaucugacuaugacauaa

SEQ ID NO: 2735881 - RNA, 20 nt, Human
cuucaugcauagguuuagca

SEQ ID NO: 2735882 - RNA, 21 nt, Human
cuuccagugaggcucugcccu

SEQ ID NO: 2735883 - RNA, 22 nt, Human
cuuccagugaggcucugcccuu

SEQ ID NO: 2735884 - RNA, 23 nt, Human
cuuccagugaggcucugcccuug

SEQ ID NO: 2735885 - RNA, 23 nt, Human
cuucugacccaugcugcccugug

SEQ ID NO: 2735886 - RNA, 20 nt, Human
cuucugacccaugcugcccu

SEQ ID NO: 2735887 - RNA, 21 nt, Human
cuucugacccaugcugcccug

SEQ ID NO: 2735888 - RNA, 22 nt, Human
cuucugacccaugcugcccugu

SEQ ID NO: 2735889 - RNA, 23 nt, Human
cuucuucagagacuccugcaggc

SEQ ID NO: 2735890 - RNA, 18 nt, Human
cuuccucccucccucuuu

SEQ ID NO: 2735891 - RNA, 23 nt, Human
cuucuaaguaaaaccacagcagu

SEQ ID NO: 2735892 - RNA, 22 nt, Human
cuucuaaguaaaaccacagcag

SEQ ID NO: 2735893 - RNA, 17 nt, Human
cuuccugcaacaccuug

SEQ ID NO: 2735894 - RNA, 16 nt, Human
cuugaagacuuuucuu

SEQ ID NO: 2735895 - RNA, 12 nt, Human
cuugaugaagaa

SEQ ID NO: 2735896 - RNA, 18 nt, Human
cuugaauuguaaggaaug

SEQ ID NO: 2735897 - RNA, 19 nt, Human
cuugaauuguaaggaauga

SEQ ID NO: 2735898 - RNA, 14 nt, Human
cuugacagggcaca

SEQ ID NO: 2735899 - RNA, 15 nt, Human
cuugacagggcacac

SEQ ID NO: 2735900 - RNA, 13 nt, Human
cuugacagggcac

SEQ ID NO: 2735901 - RNA, 20 nt, Human
cuuggcgcugccccuggcag

SEQ ID NO: 2735902 - RNA, 12 nt, Human
cuuggcgcugcc

SEQ ID NO: 2735903 - RNA, 14 nt, Human
cuuggcgcugcccc

SEQ ID NO: 2735904 - RNA, 17 nt, Human
cuuggcgcugccccugg

SEQ ID NO: 2735905 - RNA, 13 nt, Human
cuugaugaagaag

SEQ ID NO: 2735906 - RNA, 23 nt, Human
cuugccuuuuucauuauuuuauu

SEQ ID NO: 2735907 - RNA, 22 nt, Human
cuugccuuuuucauuauuuuau

SEQ ID NO: 2735908 - RNA, 20 nt, Human
cuugccuuuuucauuauuuu

SEQ ID NO: 2735909 - RNA, 15 nt, Human
cuugccuuuuucauu

SEQ ID NO: 2735910 - RNA, 14 nt, Human
cuugccuuuuucau

SEQ ID NO: 2735911 - RNA, 10 nt, Human
cugggacagg

SEQ ID NO: 2735912 - RNA, 12 nt, Human
cugggacacagu

SEQ ID NO: 2735913 - RNA, 13 nt, Human
cugggacacaguu

SEQ ID NO: 2735914 - RNA, 17 nt, Human
cuggccccucagggucc

SEQ ID NO: 2735915 - RNA, 18 nt, Human
cuggccccucaggguccc

SEQ ID NO: 2735916 - RNA, 20 nt, Human
cuggccccucagggucccug

SEQ ID NO: 2735917 - RNA, 21 nt, Human
cuggccccucagggucccugg

SEQ ID NO: 2735918 - RNA, 13 nt, Human
cuggccccucagg

SEQ ID NO: 2735919 - RNA, 15 nt, Human
cuggcagcucagaga

SEQ ID NO: 2735920 - RNA, 12 nt, Human
cuggcagcucag

SEQ ID NO: 2735921 - RNA, 13 nt, Human
cuggcagcucaga

SEQ ID NO: 2735922 - RNA, 14 nt, Human
cuggcagcucagag

SEQ ID NO: 2735923 - RNA, 23 nt, Human
cuggugacuuuccucuuuggucu

SEQ ID NO: 2735924 - RNA, 23 nt, Human
cuggguggcaccagcagccugga

SEQ ID NO: 2735925 - RNA, 22 nt, Human
cuggguggcaccagcagccugg

SEQ ID NO: 2735926 - RNA, 16 nt, Human
cuggguguggcgcagc

SEQ ID NO: 2735927 - RNA, 17 nt, Human
cuggguguggcgcagca

SEQ ID NO: 2735928 - RNA, 14 nt, Human
cuggguucacugca

SEQ ID NO: 2735929 - RNA, 15 nt, Human
cuggugacuuuccuc

SEQ ID NO: 2735930 - RNA, 20 nt, Human
cuggugacuuuccucuuugg

SEQ ID NO: 2735931 - RNA, 21 nt, Human
cuggugacuuuccucuuuggu

SEQ ID NO: 2735932 - RNA, 17 nt, Human
cugggcagaaggaagac

SEQ ID NO: 2735933 - RNA, 16 nt, Human
cugggcagcugccucc

SEQ ID NO: 2735934 - RNA, 19 nt, Human
cugggcagcugccuccccu

SEQ ID NO: 2735935 - RNA, 16 nt, Human
cugggcagaaggaaga

SEQ ID NO: 2735936 - RNA, 18 nt, Human
cugggcagaaggaagacu

SEQ ID NO: 2735937 - RNA, 20 nt, Human
cugggcagcugccuccccuc

SEQ ID NO: 2735938 - RNA, 21 nt, Human
cugggcagcugccuccccucc

SEQ ID NO: 2735939 - RNA, 22 nt, Human
cugggcagcugccuccccuccu

SEQ ID NO: 2735940 - RNA, 23 nt, Human
cugucagcuccccucggagaaga

SEQ ID NO: 2735941 - RNA, 16 nt, Human
cugucauuugagcagg

SEQ ID NO: 2735942 - RNA, 17 nt, Human
cugucauuugagcaggg

SEQ ID NO: 2735943 - RNA, 18 nt, Human
cugucauuugagcagggc

SEQ ID NO: 2735944 - RNA, 21 nt, Human
cugucagcuccccucggagaa

SEQ ID NO: 2735945 - RNA, 18 nt, Human
cugucagccauuccuguu

SEQ ID NO: 2735946 - RNA, 18 nt, Human
cuguaggaagguuaaugu

SEQ ID NO: 2735947 - RNA, 21 nt, Human
cuguaggaagguuaauguuca

SEQ ID NO: 2735948 - RNA, 15 nt, Human
cuguacuuuuuggca

SEQ ID NO: 2735949 - RNA, 14 nt, Human
cuguacuuuuuggc

SEQ ID NO: 2735950 - RNA, 13 nt, Human
cugucgcccaguc

SEQ ID NO: 2735951 - RNA, 14 nt, Human
cugugcucuggaca

SEQ ID NO: 2735952 - RNA, 15 nt, Human
cugugaagagaacca

SEQ ID NO: 2735953 - RNA, 18 nt, Human
cugugaacuugaaauuug

SEQ ID NO: 2735954 - RNA, 15 nt, Human
cugccucgaacuggc

SEQ ID NO: 2735955 - RNA, 17 nt, Human
cugccucgaacuggcug

SEQ ID NO: 2735956 - RNA, 18 nt, Human
cugccucgaacuggcugc

SEQ ID NO: 2735957 - RNA, 22 nt, Human
cugccugggaucccucauccuc

SEQ ID NO: 2735958 - RNA, 23 nt, Human
cugccugggaucccucauccuca

SEQ ID NO: 2735959 - RNA, 14 nt, Human
cugccuguucagcu

SEQ ID NO: 2735960 - RNA, 15 nt, Human
cugccuguucagcuc

SEQ ID NO: 2735961 - RNA, 15 nt, Human
cugcuacagagcaga

SEQ ID NO: 2735962 - RNA, 16 nt, Human
cugcuaauuccccaga

SEQ ID NO: 2735963 - RNA, 16 nt, Human
cugccuguugggccag

SEQ ID NO: 2735964 - RNA, 14 nt, Human
cugccuguugggcc

SEQ ID NO: 2735965 - RNA, 18 nt, Human
cugccuguugggccagga

SEQ ID NO: 2735966 - RNA, 19 nt, Human
cugccuguugggccaggag

SEQ ID NO: 2735967 - RNA, 14 nt, Human
cugcccugugggcc

SEQ ID NO: 2735968 - RNA, 21 nt, Human
cugcugacagacacaggcccg

SEQ ID NO: 2735969 - RNA, 23 nt, Human
cugcugacagacacaggcccggc

SEQ ID NO: 2735970 - RNA, 15 nt, Human
cugcugacagacaca

SEQ ID NO: 2735971 - RNA, 18 nt, Human
cugcugacagacacaggc

SEQ ID NO: 2735972 - RNA, 19 nt, Human
cugcugacagacacaggcc

SEQ ID NO: 2735973 - RNA, 20 nt, Human
cugcugacagacacaggccc

SEQ ID NO: 2735974 - RNA, 13 nt, Human
cugcuuaacuuca

SEQ ID NO: 2735975 - RNA, 13 nt, Human
cugcuucagccuc

SEQ ID NO: 2735976 - RNA, 17 nt, Human
cugcuuaacuucacaua

SEQ ID NO: 2735977 - RNA, 15 nt, Human
cugcuuaacuucaca

SEQ ID NO: 2735978 - RNA, 22 nt, Human
cugcuuuuuaaagaaugcucuu

SEQ ID NO: 2735979 - RNA, 14 nt, Human
cugcuucagccucc

SEQ ID NO: 2735980 - RNA, 16 nt, Human
cugcuucagccucccg

SEQ ID NO: 2735981 - RNA, 21 nt, Human
cuggaaaucaggguuaguauu

SEQ ID NO: 2735982 - RNA, 16 nt, Human
cuggaaauauuaagaa

SEQ ID NO: 2735983 - RNA, 17 nt, Human
cuggaacacuaaugagg

SEQ ID NO: 2735984 - RNA, 17 nt, Human
cugagacucgcgacaau

SEQ ID NO: 2735985 - RNA, 19 nt, Human
cugagacucgcgacaaugc

SEQ ID NO: 2735986 - RNA, 20 nt, Human
cugagacucgcgacaaugca

SEQ ID NO: 2735987 - RNA, 12 nt, Human
cugccauccagg

SEQ ID NO: 2735988 - RNA, 11 nt, Human
cugccagggac

SEQ ID NO: 2735989 - RNA, 12 nt, Human
cugccagggaca

SEQ ID NO: 2735990 - RNA, 15 nt, Human
cugccagggacagag

SEQ ID NO: 2735991 - RNA, 20 nt, Human
cugccauauucuguuggcca

SEQ ID NO: 2735992 - RNA, 21 nt, Human
cugccauauucuguuggccag

SEQ ID NO: 2735993 - RNA, 22 nt, Human
cugccauauucuguuggccagu

SEQ ID NO: 2735994 - RNA, 23 nt, Human
cugccauauucuguuggccagug

SEQ ID NO: 2735995 - RNA, 12 nt, Human
cugcccugugag

SEQ ID NO: 2735996 - RNA, 13 nt, Human
cugcccugugagu

SEQ ID NO: 2735997 - RNA, 15 nt, Human
cugcccugugggccc

SEQ ID NO: 2735998 - RNA, 16 nt, Human
cugcccugugggcccc

SEQ ID NO: 2735999 - RNA, 18 nt, Human
cugcccugugggccccca

SEQ ID NO: 2736000 - RNA, 14 nt, Human
cugccccucaacuc

SEQ ID NO: 2736001 - RNA, 22 nt, Human
cugccccucaacucuccuccag

SEQ ID NO: 2736002 - RNA, 15 nt, Human
cugccaaugggagcu

SEQ ID NO: 2736003 - RNA, 17 nt, Human
cugccaaugggagcuca

SEQ ID NO: 2736004 - RNA, 22 nt, Human
cugcauuuaaaagauacaguua

SEQ ID NO: 2736005 - RNA, 20 nt, Human
cugcauuuaaaagauacagu

SEQ ID NO: 2736006 - RNA, 13 nt, Human
cugcauguuacau

SEQ ID NO: 2736007 - RNA, 15 nt, Human
cugcauguuugugau

SEQ ID NO: 2736008 - RNA, 23 nt, Human
caacacgagcaggcuacugucag

SEQ ID NO: 2736009 - RNA, 20 nt, Human
caacaccucugcacaagcug

SEQ ID NO: 2736010 - RNA, 20 nt, Human
caaauggaaaugggcagagc

SEQ ID NO: 2736011 - RNA, 21 nt, Human
caaauggaaaugggcagagca

SEQ ID NO: 2736012 - RNA, 22 nt, Human
caaagcacugacuucuaaguaa

SEQ ID NO: 2736013 - RNA, 20 nt, Human
caaagcacugacuucuaagu

SEQ ID NO: 2736014 - RNA, 23 nt, Human
caaagauauuuugcuuugugauu

SEQ ID NO: 2736015 - RNA, 22 nt, Human
caaagauauuuugcuuugugau

SEQ ID NO: 2736016 - RNA, 21 nt, Human
caaaguagaagucuuagaugu

SEQ ID NO: 2736017 - RNA, 14 nt, Human
caaaguagaagucu

SEQ ID NO: 2736018 - RNA, 15 nt, Human
caaagcagugcaugc

SEQ ID NO: 2736019 - RNA, 17 nt, Human
caaagcagugcaugcug

SEQ ID NO: 2736020 - RNA, 22 nt, Human
caaaguacacuguuucaaacuu

SEQ ID NO: 2736021 - RNA, 16 nt, Human
caaaagaugcuucuca

SEQ ID NO: 2736022 - RNA, 18 nt, Human
caaaagaugcuucucacu

SEQ ID NO: 2736023 - RNA, 23 nt, Human
auuuuuuuuuccuucagugccuu

SEQ ID NO: 2736024 - RNA, 21 nt, Human
caaaccaucauugaaaucuuu

SEQ ID NO: 2736025 - RNA, 19 nt, Human
caaaccaucauugaaaucu

SEQ ID NO: 2736026 - RNA, 20 nt, Human
caaagauauuuugcuuugug

SEQ ID NO: 2736027 - RNA, 18 nt, Human
caaagauauuuugcuuug

SEQ ID NO: 2736028 - RNA, 14 nt, Human
auuugcucauggaa

SEQ ID NO: 2736029 - RNA, 17 nt, Human
auuugcucauggaauug

SEQ ID NO: 2736030 - RNA, 13 nt, Human
auuugcuccuuuc

SEQ ID NO: 2736031 - RNA, 20 nt, Human
auuugugauacaaugcugug

SEQ ID NO: 2736032 - RNA, 13 nt, Human
auuuggaaaucuu

SEQ ID NO: 2736033 - RNA, 17 nt, Human
auuugugauacaaugcu

SEQ ID NO: 2736034 - RNA, 15 nt, Human
auuugugauacaaug

SEQ ID NO: 2736035 - RNA, 12 nt, Human
auuuggaaaucu

SEQ ID NO: 2736036 - RNA, 11 nt, Human
auuuggaaauc

SEQ ID NO: 2736037 - RNA, 19 nt, Human
auuuuauagcuacuaauuu

SEQ ID NO: 2736038 - RNA, 20 nt, Human
auuuguuugaacugauaaag

SEQ ID NO: 2736039 - RNA, 17 nt, Human
auuuuauagcuacuaau

SEQ ID NO: 2736040 - RNA, 14 nt, Human
auuuuaugauccag

SEQ ID NO: 2736041 - RNA, 16 nt, Human
auuuuaugauccagca

SEQ ID NO: 2736042 - RNA, 15 nt, Human
auuuuaugauccagc

SEQ ID NO: 2736043 - RNA, 23 nt, Human
auuuguuugaacugauaaagaug

SEQ ID NO: 2736044 - RNA, 22 nt, Human
auuuguuugaacugauaaagau

SEQ ID NO: 2736045 - RNA, 14 nt, Human
auuaugaauuacau

SEQ ID NO: 2736046 - RNA, 17 nt, Human
auuaugaauuacauuug

SEQ ID NO: 2736047 - RNA, 18 nt, Human
auuaugaaacuuuuggaa

SEQ ID NO: 2736048 - RNA, 21 nt, Human
auuaugaaacuuguguaaaua

SEQ ID NO: 2736049 - RNA, 20 nt, Human
auuaugaaacuuguguaaau

SEQ ID NO: 2736050 - RNA, 18 nt, Human
auuaugaaacuuguguaa

SEQ ID NO: 2736051 - RNA, 21 nt, Human
auuaggugugacugaauuucu

SEQ ID NO: 2736052 - RNA, 15 nt, Human
auuaugaaacuugug

SEQ ID NO: 2736053 - RNA, 14 nt, Human
auuaugaaacuugu

SEQ ID NO: 2736054 - RNA, 16 nt, Human
auuagggagagaagau

SEQ ID NO: 2736055 - RNA, 18 nt, Human
auuaggugugacugaauu

SEQ ID NO: 2736056 - RNA, 16 nt, Human
auuaggugugacugaa

SEQ ID NO: 2736057 - RNA, 16 nt, Human
auucaaauguauuaca

SEQ ID NO: 2736058 - RNA, 20 nt, Human
auucaaugccccugaauuua

SEQ ID NO: 2736059 - RNA, 18 nt, Human
auucaaugccccugaauu

SEQ ID NO: 2736060 - RNA, 18 nt, Human
auuaugaauuacauuugu

SEQ ID NO: 2736061 - RNA, 17 nt, Human
auucaaaguugccuaaa

SEQ ID NO: 2736062 - RNA, 23 nt, Human
auuaugcaugaaguaauaugcac

SEQ ID NO: 2736063 - RNA, 22 nt, Human
auucaaaguugccuaaauccau

SEQ ID NO: 2736064 - RNA, 21 nt, Human
auucaaaguugccuaaaucca

SEQ ID NO: 2736065 - RNA, 20 nt, Human
auucaaaguugccuaaaucc

SEQ ID NO: 2736066 - RNA, 18 nt, Human
auucaaaguugccuaaau

SEQ ID NO: 2736067 - RNA, 19 nt, Human
auucauaaugacuuaagca

SEQ ID NO: 2736068 - RNA, 14 nt, Human
auucauaaugacuu

SEQ ID NO: 2736069 - RNA, 15 nt, Human
auucauaaugacuua

SEQ ID NO: 2736070 - RNA, 19 nt, Human
auuacaguggggaaugaag

SEQ ID NO: 2736071 - RNA, 16 nt, Human
auuacaguauaauuaa

SEQ ID NO: 2736072 - RNA, 15 nt, Human
auuacaguauaauua

SEQ ID NO: 2736073 - RNA, 14 nt, Human
auuacaguauaauu

SEQ ID NO: 2736074 - RNA, 12 nt, Human
auuacaguauaa

SEQ ID NO: 2736075 - RNA, 17 nt, Human
auuacaggaaguacugg

SEQ ID NO: 2736076 - RNA, 16 nt, Human
auuacaggugugaacc

SEQ ID NO: 2736077 - RNA, 23 nt, Human
auuguaauaggcguaacuaauuu

SEQ ID NO: 2736078 - RNA, 14 nt, Human
auuguaaauaguau

SEQ ID NO: 2736079 - RNA, 13 nt, Human
auuguaauuauau

SEQ ID NO: 2736080 - RNA, 18 nt, Human
auugcuugagcucaggag

SEQ ID NO: 2736081 - RNA, 14 nt, Human
auuguaauuauauc

SEQ ID NO: 2736082 - RNA, 21 nt, Human
auugugucucuugguccugcu

SEQ ID NO: 2736083 - RNA, 23 nt, Human
auugugucucuugguccugcugc

SEQ ID NO: 2736084 - RNA, 16 nt, Human
auuguuagucucuuga

SEQ ID NO: 2736085 - RNA, 23 nt, Human
auugcugauggugcaaugaccuu

SEQ ID NO: 2736086 - RNA, 12 nt, Human
auugcugcuuga

SEQ ID NO: 2736087 - RNA, 14 nt, Human
auugcuugagcuca

SEQ ID NO: 2736088 - RNA, 15 nt, Human
auugcugauggugca

SEQ ID NO: 2736089 - RNA, 16 nt, Human
auugcugauggugcaa

SEQ ID NO: 2736090 - RNA, 18 nt, Human
auugcugauggugcaaug

SEQ ID NO: 2736091 - RNA, 19 nt, Human
auugcugauggugcaauga

SEQ ID NO: 2736092 - RNA, 11 nt, Human
auucuucugcu

SEQ ID NO: 2736093 - RNA, 12 nt, Human
auucuucugcuu

SEQ ID NO: 2736094 - RNA, 14 nt, Human
auucuucugcuuca

SEQ ID NO: 2736095 - RNA, 15 nt, Human
auucuugaaggaaaa

SEQ ID NO: 2736096 - RNA, 18 nt, Human
auucuugaaggaaaauga

SEQ ID NO: 2736097 - RNA, 11 nt, Human
auucuuuccug

SEQ ID NO: 2736098 - RNA, 13 nt, Human
auucuuuccugag

SEQ ID NO: 2736099 - RNA, 17 nt, Human
auugauaugcuuauaca

SEQ ID NO: 2736100 - RNA, 15 nt, Human
auugcuacuguccua

SEQ ID NO: 2736101 - RNA, 20 nt, Human
auugcuacuguccuacccac

SEQ ID NO: 2736102 - RNA, 22 nt, Human
auugcuacuguccuacccaccc

SEQ ID NO: 2736103 - RNA, 22 nt, Human
auugauaaguucauacauugua

SEQ ID NO: 2736104 - RNA, 21 nt, Human
auugauaagaaccuuuugagu

SEQ ID NO: 2736105 - RNA, 17 nt, Human
cacagccucuuagaugc

SEQ ID NO: 2736106 - RNA, 21 nt, Human
cacagccucuuagaugcaguu

SEQ ID NO: 2736107 - RNA, 19 nt, Human
cacaggggaaaagaggagu

SEQ ID NO: 2736108 - RNA, 17 nt, Human
cacaggggaaaagagga

SEQ ID NO: 2736109 - RNA, 18 nt, Human
cacaggggaaaagaggag

SEQ ID NO: 2736110 - RNA, 20 nt, Human
cacaguauuacuucugcuac

SEQ ID NO: 2736111 - RNA, 21 nt, Human
cacaguauuacuucugcuaca

SEQ ID NO: 2736112 - RNA, 17 nt, Human
cacacaugaaguccaag

SEQ ID NO: 2736113 - RNA, 22 nt, Human
cacacaugaaguccaagcauuu

SEQ ID NO: 2736114 - RNA, 20 nt, Human
cacacaugagcaucaggcca

SEQ ID NO: 2736115 - RNA, 15 nt, Human
cacacauacacacac

SEQ ID NO: 2736116 - RNA, 21 nt, Human
cacacagugagucgaggacag

SEQ ID NO: 2736117 - RNA, 23 nt, Human
cacacagugagucgaggacaggg

SEQ ID NO: 2736118 - RNA, 16 nt, Human
cacacagcucuguccu

SEQ ID NO: 2736119 - RNA, 18 nt, Human
cacacagugagucgagga

SEQ ID NO: 2736120 - RNA, 20 nt, Human
cacacaguauuacuucugcu

SEQ ID NO: 2736121 - RNA, 23 nt, Human
cacacaguauuacuucugcuaca

SEQ ID NO: 2736122 - RNA, 11 nt, Human
cacagccucug

SEQ ID NO: 2736123 - RNA, 13 nt, Human
cacagacccugcc

SEQ ID NO: 2736124 - RNA, 21 nt, Human
cacagacauacuaaccagcag

SEQ ID NO: 2736125 - RNA, 19 nt, Human
cacagacauacuaaccagc

SEQ ID NO: 2736126 - RNA, 18 nt, Human
cacagacauacuaaccag

SEQ ID NO: 2736127 - RNA, 23 nt, Human
cacagaaaauggaagacagcucu

SEQ ID NO: 2736128 - RNA, 19 nt, Human
cacagaaaauucuucucca

SEQ ID NO: 2736129 - RNA, 21 nt, Human
cacacaugagcaucaggccag

SEQ ID NO: 2736130 - RNA, 22 nt, Human
cacacaugagcaucaggccagg

SEQ ID NO: 2736131 - RNA, 18 nt, Human
cacagaaaauggaagaca

SEQ ID NO: 2736132 - RNA, 19 nt, Human
cacagaaaauggaagacag

SEQ ID NO: 2736133 - RNA, 20 nt, Human
cacagaaaauggaagacagc

SEQ ID NO: 2736134 - RNA, 22 nt, Human
cacagaaaauggaagacagcuc

SEQ ID NO: 2736135 - RNA, 18 nt, Human
cacaagacugcacaucaa

SEQ ID NO: 2736136 - RNA, 14 nt, Human
cacaagagcccagg

SEQ ID NO: 2736137 - RNA, 16 nt, Human
cacaagagcccaggcc

SEQ ID NO: 2736138 - RNA, 13 nt, Human
cacaagcuccaag

SEQ ID NO: 2736139 - RNA, 14 nt, Human
cacaagcuccaagc

SEQ ID NO: 2736140 - RNA, 15 nt, Human
cacaagcuccaagcu

SEQ ID NO: 2736141 - RNA, 17 nt, Human
cacaagcugcacccuca

SEQ ID NO: 2736142 - RNA, 23 nt, Human
cacaagcugcacccucaggcagg

SEQ ID NO: 2736143 - RNA, 17 nt, Human
cacaagcuccaagcucc

SEQ ID NO: 2736144 - RNA, 23 nt, Human
cacaagcuccaagcucccaggca

SEQ ID NO: 2736145 - RNA, 15 nt, Human
caaugcuguauuuua

SEQ ID NO: 2736146 - RNA, 16 nt, Human
caaugcuguauuuuaa

SEQ ID NO: 2736147 - RNA, 17 nt, Human
caaugcuguauuuuaaa

SEQ ID NO: 2736148 - RNA, 15 nt, Human
caauucuugccaaau

SEQ ID NO: 2736149 - RNA, 11 nt, Human
caauggcagcc

SEQ ID NO: 2736150 - RNA, 12 nt, Human
caauggcagccu

SEQ ID NO: 2736151 - RNA, 17 nt, Human
cacacagcucuguccug

SEQ ID NO: 2736152 - RNA, 20 nt, Human
cacacagcucuguccuggga

SEQ ID NO: 2736153 - RNA, 14 nt, Human
caaguccaagcaua

SEQ ID NO: 2736154 - RNA, 13 nt, Human
caagucaagugaa

SEQ ID NO: 2736155 - RNA, 17 nt, Human
caagucaagugaaaaag

SEQ ID NO: 2736156 - RNA, 17 nt, Human
caaggccaaaggaagca

SEQ ID NO: 2736157 - RNA, 18 nt, Human
caaggccaaaggaagcac

SEQ ID NO: 2736158 - RNA, 15 nt, Human
caaggccaaaggaag

SEQ ID NO: 2736159 - RNA, 16 nt, Human
caaggccaaaggaagc

SEQ ID NO: 2736160 - RNA, 13 nt, Human
caagcucugcucc

SEQ ID NO: 2736161 - RNA, 12 nt, Human
caagcuccaagc

SEQ ID NO: 2736162 - RNA, 13 nt, Human
caagcugcacccu

SEQ ID NO: 2736163 - RNA, 14 nt, Human
caagcucugcuccu

SEQ ID NO: 2736164 - RNA, 14 nt, Human
caagcugcacccuc

SEQ ID NO: 2736165 - RNA, 18 nt, Human
caagcugcacccucaggc

SEQ ID NO: 2736166 - RNA, 20 nt, Human
caagcugcacccucaggcag

SEQ ID NO: 2736167 - RNA, 19 nt, Human
caauaaagcagcguuucua

SEQ ID NO: 2736168 - RNA, 21 nt, Human
cacuagggcagggacaggaua

SEQ ID NO: 2736169 - RNA, 20 nt, Human
cacuagggcagggacaggau

SEQ ID NO: 2736170 - RNA, 16 nt, Human
cacuccagccugggug

SEQ ID NO: 2736171 - RNA, 14 nt, Human
cacuccccugcugg

SEQ ID NO: 2736172 - RNA, 12 nt, Human
cacuccccugcu

SEQ ID NO: 2736173 - RNA, 13 nt, Human
cacuccccugcug

SEQ ID NO: 2736174 - RNA, 11 nt, Human
cacugacagau

SEQ ID NO: 2736175 - RNA, 12 nt, Human
cacugcagccuc

SEQ ID NO: 2736176 - RNA, 20 nt, Human
cacugcacuccagccugggu

SEQ ID NO: 2736177 - RNA, 15 nt, Human
cacugcacuccagcc

SEQ ID NO: 2736178 - RNA, 16 nt, Human
cacugcacuccagccu

SEQ ID NO: 2736179 - RNA, 18 nt, Human
cacugcacuccagccugg

SEQ ID NO: 2736180 - RNA, 19 nt, Human
cacugcacuccagccuggg

SEQ ID NO: 2736181 - RNA, 19 nt, Human
cacugcacuauagccuagg

SEQ ID NO: 2736182 - RNA, 13 nt, Human
cacugcagccuca

SEQ ID NO: 2736183 - RNA, 16 nt, Human
cacugcauguuuguga

SEQ ID NO: 2736184 - RNA, 22 nt, Human
cacuuguguuuugcaagccaga

SEQ ID NO: 2736185 - RNA, 19 nt, Human
cacuuguguuuugcaagcc

SEQ ID NO: 2736186 - RNA, 16 nt, Human
cacuugucaauaaaau

SEQ ID NO: 2736187 - RNA, 18 nt, Human
cacuuacacuuuaugcac

SEQ ID NO: 2736188 - RNA, 16 nt, Human
cacuuacacuuuaugc

SEQ ID NO: 2736189 - RNA, 17 nt, Human
caccugccuguugggcc

SEQ ID NO: 2736190 - RNA, 19 nt, Human
caccugccuguugggccag

SEQ ID NO: 2736191 - RNA, 24 nt, Human
caccugccuguugggccaggagcc

SEQ ID NO: 2736192 - RNA, 14 nt, Human
caccuuggcugcag

SEQ ID NO: 2736193 - RNA, 14 nt, Human
caccuuggcucaag

SEQ ID NO: 2736194 - RNA, 15 nt, Human
caccuuggcucaagu

SEQ ID NO: 2736195 - RNA, 13 nt, Human
caccuuggcugca

SEQ ID NO: 2736196 - RNA, 14 nt, Human
caccucagccuccc

SEQ ID NO: 2736197 - RNA, 13 nt, Human
caccucagccucc

SEQ ID NO: 2736198 - RNA, 14 nt, Human
caccugccccucaa

SEQ ID NO: 2736199 - RNA, 15 nt, Human
caccugccccucaac

SEQ ID NO: 2736200 - RNA, 16 nt, Human
caccugccccucaacu

SEQ ID NO: 2736201 - RNA, 17 nt, Human
cacccugaaagcccuga

SEQ ID NO: 2736202 - RNA, 15 nt, Human
cacccuggggagaaa

SEQ ID NO: 2736203 - RNA, 16 nt, Human
cacccuggggagaaag

SEQ ID NO: 2736204 - RNA, 14 nt, Human
cacccucaggcagg

SEQ ID NO: 2736205 - RNA, 11 nt, Human
caccccagccc

SEQ ID NO: 2736206 - RNA, 16 nt, Human
caugaauuaguuuuau

SEQ ID NO: 2736207 - RNA, 14 nt, Human
caugacacgaauau

SEQ ID NO: 2736208 - RNA, 17 nt, Human
caugacacgaauauugc

SEQ ID NO: 2736209 - RNA, 18 nt, Human
caugacacgaauauugcu

SEQ ID NO: 2736210 - RNA, 22 nt, Human
caugcaaggucauuuuuuuuaa

SEQ ID NO: 2736211 - RNA, 18 nt, Human
caugcaaggucauuuuuu

SEQ ID NO: 2736212 - RNA, 17 nt, Human
caugcaaggucauuuuu

SEQ ID NO: 2736213 - RNA, 16 nt, Human
caugcugcccugugag

SEQ ID NO: 2736214 - RNA, 18 nt, Human
caugcugcccugugagua

SEQ ID NO: 2736215 - RNA, 20 nt, Human
caucagcuugcccuguuaaa

SEQ ID NO: 2736216 - RNA, 13 nt, Human
caucaggccaggc

SEQ ID NO: 2736217 - RNA, 13 nt, Human
caucagcugcuga

SEQ ID NO: 2736218 - RNA, 15 nt, Human
caucagcugcugaaa

SEQ ID NO: 2736219 - RNA, 18 nt, Human
caucagcugcugaaacaa

SEQ ID NO: 2736220 - RNA, 17 nt, Human
caucagcugcugaaaca

SEQ ID NO: 2736221 - RNA, 18 nt, Human
caucagcacgauuucugu

SEQ ID NO: 2736222 - RNA, 17 nt, Human
caucagcacgauuucug

SEQ ID NO: 2736223 - RNA, 23 nt, Human
cauccuggcacccggccccugcu

SEQ ID NO: 2736224 - RNA, 16 nt, Human
caucccagccccaaug

SEQ ID NO: 2736225 - RNA, 13 nt, Human
caucccagcccca

SEQ ID NO: 2736226 - RNA, 14 nt, Human
caucccagccccaa

SEQ ID NO: 2736227 - RNA, 20 nt, Human
caucaggccaggcccucugc

SEQ ID NO: 2736228 - RNA, 21 nt, Human
caucaggccaggcccucugcc

SEQ ID NO: 2736229 - RNA, 22 nt, Human
caucaggccaggcccucugccc

SEQ ID NO: 2736230 - RNA, 23 nt, Human
caucaggccaggcccucugccca

SEQ ID NO: 2736231 - RNA, 21 nt, Human
caucuuagguuggcaaaaagg

SEQ ID NO: 2736232 - RNA, 22 nt, Human
caucuuagguuggcaaaaaggc

SEQ ID NO: 2736233 - RNA, 18 nt, Human
caucugugaaaggaaaga

SEQ ID NO: 2736234 - RNA, 19 nt, Human
caucugugaaaggaaagag

SEQ ID NO: 2736235 - RNA, 18 nt, Human
cauagauucccugagcag

SEQ ID NO: 2736236 - RNA, 17 nt, Human
cauagauucccugagca

SEQ ID NO: 2736237 - RNA, 21 nt, Human
cauaaugcgugcauaccacuu

SEQ ID NO: 2736238 - RNA, 15 nt, Human
cauacaauuccaaac

SEQ ID NO: 2736239 - RNA, 16 nt, Human
cauauuaccacagaca

SEQ ID NO: 2736240 - RNA, 17 nt, Human
cauauuaccacagacau

SEQ ID NO: 2736241 - RNA, 21 nt, Human
cauauuaccacagacauacua

SEQ ID NO: 2736242 - RNA, 20 nt, Human
cauauuaccacagacauacu

SEQ ID NO: 2736243 - RNA, 17 nt, Human
cauaaugcgugcauacc

SEQ ID NO: 2736244 - RNA, 14 nt, Human
cauaaugcgugcau

SEQ ID NO: 2736245 - RNA, 18 nt, Human
cagucaccccggccaccu

SEQ ID NO: 2736246 - RNA, 12 nt, Human
cauuaucuagau

SEQ ID NO: 2736247 - RNA, 17 nt, Human
cauuaucuagauacugu

SEQ ID NO: 2736248 - RNA, 16 nt, Human
cauuaucuagauacug

SEQ ID NO: 2736249 - RNA, 15 nt, Human
cauguucucugagga

SEQ ID NO: 2736250 - RNA, 22 nt, Human
cauggccucuucagaucucuaa

SEQ ID NO: 2736251 - RNA, 17 nt, Human
cauggcugccaauggga

SEQ ID NO: 2736252 - RNA, 22 nt, Human
cauggcuggagcuagaauuuga

SEQ ID NO: 2736253 - RNA, 22 nt, Human
cauggcugccaaugggagcuca

SEQ ID NO: 2736254 - RNA, 16 nt, Human
cauucuccuuguguua

SEQ ID NO: 2736255 - RNA, 21 nt, Human
cauucuccuaucaccugucuu

SEQ ID NO: 2736256 - RNA, 18 nt, Human
cauuaucuagauacugua

SEQ ID NO: 2736257 - RNA, 21 nt, Human
cauuuggugguuucagaaaug

SEQ ID NO: 2736258 - RNA, 23 nt, Human
cauuuggugguuucagaaaugug

SEQ ID NO: 2736259 - RNA, 22 nt, Human
cauuuggugguuucagaaaugu

SEQ ID NO: 2736260 - RNA, 23 nt, Human
cauuuuucuuagggaaggauaca

SEQ ID NO: 2736261 - RNA, 17 nt, Human
ccaaaacucuccucugc

SEQ ID NO: 2736262 - RNA, 19 nt, Human
ccaaaaagauuuucagaaa

SEQ ID NO: 2736263 - RNA, 17 nt, Human
ccaaaaaaugcuugcuu

SEQ ID NO: 2736264 - RNA, 20 nt, Human
ccaaaaaccaguauuguaca

SEQ ID NO: 2736265 - RNA, 19 nt, Human
ccaaaaaccaguauuguac

SEQ ID NO: 2736266 - RNA, 16 nt, Human
ccaaaaaccaguauug

SEQ ID NO: 2736267 - RNA, 16 nt, Human
cauuuauucugcucac

SEQ ID NO: 2736268 - RNA, 18 nt, Human
cauugcugggcuugucug

SEQ ID NO: 2736269 - RNA, 14 nt, Human
cauugcggacagcc

SEQ ID NO: 2736270 - RNA, 15 nt, Human
cauugcggacagcca

SEQ ID NO: 2736271 - RNA, 17 nt, Human
cauugcggacagccacg

SEQ ID NO: 2736272 - RNA, 21 nt, Human
cauugcggacagccacggcca

SEQ ID NO: 2736273 - RNA, 12 nt, Human
ccaaauuaagag

SEQ ID NO: 2736274 - RNA, 16 nt, Human
ccaacgucugugccau

SEQ ID NO: 2736275 - RNA, 20 nt, Human
ccaauguucucucuucucca

SEQ ID NO: 2736276 - RNA, 20 nt, Human
ccaagcuggucccacucagu

SEQ ID NO: 2736277 - RNA, 23 nt, Human
ccaaugcacuuuguucuggcucu

SEQ ID NO: 2736278 - RNA, 20 nt, Human
ccaaugcacuuuguucuggc

SEQ ID NO: 2736279 - RNA, 22 nt, Human
ccaaugcacuuuguucuggcuc

SEQ ID NO: 2736280 - RNA, 16 nt, Human
ccaccaucaagccacc

SEQ ID NO: 2736281 - RNA, 17 nt, Human
ccaccaucaagccacca

SEQ ID NO: 2736282 - RNA, 13 nt, Human
ccaccuuggcuca

SEQ ID NO: 2736283 - RNA, 14 nt, Human
ccaccuuggcucaa

SEQ ID NO: 2736284 - RNA, 15 nt, Human
ccaccuuggcucaag

SEQ ID NO: 2736285 - RNA, 18 nt, Human
ccaccgcagacaggacca

SEQ ID NO: 2736286 - RNA, 13 nt, Human
ccacccugcucuc

SEQ ID NO: 2736287 - RNA, 20 nt, Human
ccaccaucaagccaccaaca

SEQ ID NO: 2736288 - RNA, 14 nt, Human
ccaccgcagacagg

SEQ ID NO: 2736289 - RNA, 17 nt, Human
ccaccgcagacaggacc

SEQ ID NO: 2736290 - RNA, 23 nt, Human
caggacagcccuucuuuccacag

SEQ ID NO: 2736291 - RNA, 24 nt, Human
caggacagcccuucuuuccacaga

SEQ ID NO: 2736292 - RNA, 13 nt, Human
caggaccucaggu

SEQ ID NO: 2736293 - RNA, 13 nt, Human
caggaccagggau

SEQ ID NO: 2736294 - RNA, 13 nt, Human
caggccagcugcu

SEQ ID NO: 2736295 - RNA, 15 nt, Human
caggccagcugcuug

SEQ ID NO: 2736296 - RNA, 21 nt, Human
caggcaaugcuggcuguuggc

SEQ ID NO: 2736297 - RNA, 19 nt, Human
caggcaaugcuggcuguug

SEQ ID NO: 2736298 - RNA, 20 nt, Human
caggcaaugcuggcuguugg

SEQ ID NO: 2736299 - RNA, 12 nt, Human
caggaggccagc

SEQ ID NO: 2736300 - RNA, 13 nt, Human
caggaggccagcc

SEQ ID NO: 2736301 - RNA, 13 nt, Human
caggccaggcccu

SEQ ID NO: 2736302 - RNA, 14 nt, Human
caggccaggcccuc

SEQ ID NO: 2736303 - RNA, 15 nt, Human
caggccaggcccucu

SEQ ID NO: 2736304 - RNA, 16 nt, Human
caggccaggcccucug

SEQ ID NO: 2736305 - RNA, 21 nt, Human
caggaaaucaaauaugcaaag

SEQ ID NO: 2736306 - RNA, 19 nt, Human
caggaaaucaaauaugcaa

SEQ ID NO: 2736307 - RNA, 15 nt, Human
cagcuguucagcugg

SEQ ID NO: 2736308 - RNA, 16 nt, Human
cagcuguucagcuggu

SEQ ID NO: 2736309 - RNA, 23 nt, Human
caggaaaggcuccaggagcagcc

SEQ ID NO: 2736310 - RNA, 21 nt, Human
caggaaaggcuccaggagcag

SEQ ID NO: 2736311 - RNA, 22 nt, Human
caggaaaggcuccaggagcagc

SEQ ID NO: 2736312 - RNA, 19 nt, Human
caggaaaagcugcugacag

SEQ ID NO: 2736313 - RNA, 20 nt, Human
caggaaaagcugcugacagu

SEQ ID NO: 2736314 - RNA, 14 nt, Human
caggcugggcuuca

SEQ ID NO: 2736315 - RNA, 16 nt, Human
cagggagggcuucugc

SEQ ID NO: 2736316 - RNA, 20 nt, Human
cagggcucagcggggacagc

SEQ ID NO: 2736317 - RNA, 12 nt, Human
cagggcucagcg

SEQ ID NO: 2736318 - RNA, 15 nt, Human
cagggcucagcgggg

SEQ ID NO: 2736319 - RNA, 19 nt, Human
caggcugggagagccuucc

SEQ ID NO: 2736320 - RNA, 16 nt, Human
caggcugggagagccu

SEQ ID NO: 2736321 - RNA, 18 nt, Human
caggcugggagagccuuc

SEQ ID NO: 2736322 - RNA, 17 nt, Human
caggcuggcgugcagug

SEQ ID NO: 2736323 - RNA, 23 nt, Human
caggccugggggcugggcagagg

SEQ ID NO: 2736324 - RNA, 18 nt, Human
caggcuggcgugcagugg

SEQ ID NO: 2736325 - RNA, 19 nt, Human
caggcuggcgugcaguggu

SEQ ID NO: 2736326 - RNA, 20 nt, Human
caggccugggggcugggcag

SEQ ID NO: 2736327 - RNA, 22 nt, Human
caggccugggggcugggcagag

SEQ ID NO: 2736328 - RNA, 15 nt, Human
caggguuggccccug

SEQ ID NO: 2736329 - RNA, 16 nt, Human
caggguuggccccugc

SEQ ID NO: 2736330 - RNA, 21 nt, Human
cagggucucuaccauccccug

SEQ ID NO: 2736331 - RNA, 23 nt, Human
cagggucucacucugucgcccag

SEQ ID NO: 2736332 - RNA, 19 nt, Human
caguaaaugggggugcauu

SEQ ID NO: 2736333 - RNA, 19 nt, Human
caguauuacuucugcuaca

SEQ ID NO: 2736334 - RNA, 18 nt, Human
caguaaaugggggugcau

SEQ ID NO: 2736335 - RNA, 22 nt, Human
caguauuguacaaaguauuaag

SEQ ID NO: 2736336 - RNA, 14 nt, Human
cagucaccccggcc

SEQ ID NO: 2736337 - RNA, 16 nt, Human
cagucaccccggccac

SEQ ID NO: 2736338 - RNA, 17 nt, Human
cagucaccccggccacc

SEQ ID NO: 2736339 - RNA, 23 nt, Human
cagguuuuuggucugacccacug

SEQ ID NO: 2736340 - RNA, 13 nt, Human
caggugcugccau

SEQ ID NO: 2736341 - RNA, 14 nt, Human
caggugcugccauc

SEQ ID NO: 2736342 - RNA, 14 nt, Human
caggguuggccccu

SEQ ID NO: 2736343 - RNA, 17 nt, Human
caggguuggccccugcc

SEQ ID NO: 2736344 - RNA, 21 nt, Human
caggguuggccccugcccggc

SEQ ID NO: 2736345 - RNA, 23 nt, Human
cagccgccaugcuccuggcccac

SEQ ID NO: 2736346 - RNA, 13 nt, Human
cagcccuuagcag

SEQ ID NO: 2736347 - RNA, 14 nt, Human
cagcguuucuauga

SEQ ID NO: 2736348 - RNA, 16 nt, Human
cagcguuucuaugaca

SEQ ID NO: 2736349 - RNA, 23 nt, Human
cagccccauucugccugcccagg

SEQ ID NO: 2736350 - RNA, 24 nt, Human
cagccccauucugccugcccaggc

SEQ ID NO: 2736351 - RNA, 19 nt, Human
cagccccauucugccugcc

SEQ ID NO: 2736352 - RNA, 20 nt, Human
cagccccauucugccugccc

SEQ ID NO: 2736353 - RNA, 22 nt, Human
cagccccauucugccugcccag

SEQ ID NO: 2736354 - RNA, 18 nt, Human
cagcaguucagagcugcc

SEQ ID NO: 2736355 - RNA, 19 nt, Human
cagcaguucagagcugccc

SEQ ID NO: 2736356 - RNA, 20 nt, Human
cagcaguucagagcugcccu

SEQ ID NO: 2736357 - RNA, 21 nt, Human
cagcaguucagagcugcccuc

SEQ ID NO: 2736358 - RNA, 22 nt, Human
cagcaguucagagcugcccucu

SEQ ID NO: 2736359 - RNA, 17 nt, Human
cagcauagaaguaacuu

SEQ ID NO: 2736360 - RNA, 20 nt, Human
cagccagacuggcacaguuu

SEQ ID NO: 2736361 - RNA, 18 nt, Human
cagcauauucaggaagcu

SEQ ID NO: 2736362 - RNA, 16 nt, Human
cagcauauucaggaag

SEQ ID NO: 2736363 - RNA, 17 nt, Human
cagcauauucaggaagc

SEQ ID NO: 2736364 - RNA, 21 nt, Human
cagauugcaacaggcugggcu

SEQ ID NO: 2736365 - RNA, 13 nt, Human
cagauuucacucu

SEQ ID NO: 2736366 - RNA, 15 nt, Human
cagauuucacucucc

SEQ ID NO: 2736367 - RNA, 16 nt, Human
cagauuucacucuccu

SEQ ID NO: 2736368 - RNA, 19 nt, Human
cagauuugaacucuucaau

SEQ ID NO: 2736369 - RNA, 18 nt, Human
cagauuucacucuccuug

SEQ ID NO: 2736370 - RNA, 23 nt, Human
cagauacaggaaaagcugcugac

SEQ ID NO: 2736371 - RNA, 13 nt, Human
cagauacuggauu

SEQ ID NO: 2736372 - RNA, 21 nt, Human
cagagacuccugcaggcagcc

SEQ ID NO: 2736373 - RNA, 22 nt, Human
cagagacuccugcaggcagcca

SEQ ID NO: 2736374 - RNA, 20 nt, Human
cagagacuccugcaggcagc

SEQ ID NO: 2736375 - RNA, 13 nt, Human
cagagaggguggg

SEQ ID NO: 2736376 - RNA, 16 nt, Human
cagagagggugggagu

SEQ ID NO: 2736377 - RNA, 14 nt, Human
cagagccugcaguu

SEQ ID NO: 2736378 - RNA, 20 nt, Human
cagagagggugggagugggc

SEQ ID NO: 2736379 - RNA, 22 nt, Human
cagagagggugggagugggccc

SEQ ID NO: 2736380 - RNA, 17 nt, Human
cagagcuacacagggga

SEQ ID NO: 2736381 - RNA, 22 nt, Human
cagagcuacacaggggaaaaga

SEQ ID NO: 2736382 - RNA, 13 nt, Human
cccaggcuggcgu

SEQ ID NO: 2736383 - RNA, 17 nt, Human
cccaggcuggcgugcag

SEQ ID NO: 2736384 - RNA, 13 nt, Human
cccauccucugua

SEQ ID NO: 2736385 - RNA, 16 nt, Human
cccagccagcaguuca

SEQ ID NO: 2736386 - RNA, 17 nt, Human
cccagccagcaguucag

SEQ ID NO: 2736387 - RNA, 20 nt, Human
cccagccagcaguucagagc

SEQ ID NO: 2736388 - RNA, 23 nt, Human
cccagcucugguccauagagagc

SEQ ID NO: 2736389 - RNA, 22 nt, Human
cccagcuuaaaggggcuagagu

SEQ ID NO: 2736390 - RNA, 17 nt, Human
cccacccccacccaagg

SEQ ID NO: 2736391 - RNA, 18 nt, Human
cccacccaagggccuggc

SEQ ID NO: 2736392 - RNA, 12 nt, Human
cccacccccacc

SEQ ID NO: 2736393 - RNA, 15 nt, Human
cccacccccacccaa

SEQ ID NO: 2736394 - RNA, 18 nt, Human
cccacccugaaagcccug

SEQ ID NO: 2736395 - RNA, 20 nt, Human
cccacccaagggccuggccu

SEQ ID NO: 2736396 - RNA, 21 nt, Human
cccacccaagggccuggccug

SEQ ID NO: 2736397 - RNA, 22 nt, Human
cccacccaagggccuggccuga

SEQ ID NO: 2736398 - RNA, 19 nt, Human
cccacugcuuuuggucugu

SEQ ID NO: 2736399 - RNA, 12 nt, Human
cccacugcucug

SEQ ID NO: 2736400 - RNA, 13 nt, Human
cccacugcucugg

SEQ ID NO: 2736401 - RNA, 22 nt, Human
ccccaaaacucuccucugcugc

SEQ ID NO: 2736402 - RNA, 21 nt, Human
ccccaaaacucuccucugcug

SEQ ID NO: 2736403 - RNA, 23 nt, Human
ccccaaaacucuccucugcugcu

SEQ ID NO: 2736404 - RNA, 23 nt, Human
ccccgacccuugccgucuaccug

SEQ ID NO: 2736405 - RNA, 22 nt, Human
cccccaaauggaaaugggcaga

SEQ ID NO: 2736406 - RNA, 22 nt, Human
ccccagcaagugagagcugggu

SEQ ID NO: 2736407 - RNA, 21 nt, Human
ccccagcaagugagagcuggg

SEQ ID NO: 2736408 - RNA, 23 nt, Human
ccccgaggccuucucugaaggac

SEQ ID NO: 2736409 - RNA, 18 nt, Human
cccuauuagagaagagau

SEQ ID NO: 2736410 - RNA, 17 nt, Human
cccggccaccugcggug

SEQ ID NO: 2736411 - RNA, 22 nt, Human
cccgggaagggggcugggacau

SEQ ID NO: 2736412 - RNA, 11 nt, Human
cccggcuccag

SEQ ID NO: 2736413 - RNA, 12 nt, Human
cccggcuccagg

SEQ ID NO: 2736414 - RNA, 13 nt, Human
cccggccaccugc

SEQ ID NO: 2736415 - RNA, 14 nt, Human
cccggccaccugcg

SEQ ID NO: 2736416 - RNA, 13 nt, Human
cccggcuccaggc

SEQ ID NO: 2736417 - RNA, 14 nt, Human
cccggcuccaggcu

SEQ ID NO: 2736418 - RNA, 15 nt, Human
cccggcuccaggcuc

SEQ ID NO: 2736419 - RNA, 16 nt, Human
cccggcuccaggcucc

SEQ ID NO: 2736420 - RNA, 14 nt, Human
cccgaauagcuggg

SEQ ID NO: 2736421 - RNA, 15 nt, Human
ccagauccuggaaau

SEQ ID NO: 2736422 - RNA, 20 nt, Human
ccagagggccugcaagggag

SEQ ID NO: 2736423 - RNA, 16 nt, Human
ccaccuuggcucaagu

SEQ ID NO: 2736424 - RNA, 17 nt, Human
ccagagggccugcaagg

SEQ ID NO: 2736425 - RNA, 18 nt, Human
ccagagggccugcaaggg

SEQ ID NO: 2736426 - RNA, 19 nt, Human
ccagagggccugcaaggga

SEQ ID NO: 2736427 - RNA, 18 nt, Human
ccagaugcaccagcccuu

SEQ ID NO: 2736428 - RNA, 17 nt, Human
ccagaugcaccagcccu

SEQ ID NO: 2736429 - RNA, 15 nt, Human
ccagaugcaccagcc

SEQ ID NO: 2736430 - RNA, 16 nt, Human
ccagcagauuauucac

SEQ ID NO: 2736431 - RNA, 22 nt, Human
ccagcagauuauucacugauuu

SEQ ID NO: 2736432 - RNA, 21 nt, Human
ccagcagauuauucacugauu

SEQ ID NO: 2736433 - RNA, 13 nt, Human
ccagcaggcucuc

SEQ ID NO: 2736434 - RNA, 15 nt, Human
ccagcaggcucucag

SEQ ID NO: 2736435 - RNA, 16 nt, Human
ccaggaaaggcuccag

SEQ ID NO: 2736436 - RNA, 14 nt, Human
ccaggaaaggcucc

SEQ ID NO: 2736437 - RNA, 15 nt, Human
ccaggaaaggcucca

SEQ ID NO: 2736438 - RNA, 12 nt, Human
ccaggaagccag

SEQ ID NO: 2736439 - RNA, 13 nt, Human
ccaggaagccagc

SEQ ID NO: 2736440 - RNA, 19 nt, Human
ccagcuuaaaggggcuaga

SEQ ID NO: 2736441 - RNA, 17 nt, Human
ccagcuguucagcuggu

SEQ ID NO: 2736442 - RNA, 16 nt, Human
ccagcuguucagcugg

SEQ ID NO: 2736443 - RNA, 22 nt, Human
ccagcucaccagccccagugcc

SEQ ID NO: 2736444 - RNA, 15 nt, Human
ccagcucaccagccc

SEQ ID NO: 2736445 - RNA, 16 nt, Human
ccagcucaccagcccc

SEQ ID NO: 2736446 - RNA, 11 nt, Human
ccagccccugg

SEQ ID NO: 2736447 - RNA, 12 nt, Human
ccagccccugga

SEQ ID NO: 2736448 - RNA, 19 nt, Human
ccaggcuggcgugcagugg

SEQ ID NO: 2736449 - RNA, 17 nt, Human
ccaggcuggcgugcagu

SEQ ID NO: 2736450 - RNA, 18 nt, Human
ccaggcuggcgugcagug

SEQ ID NO: 2736451 - RNA, 16 nt, Human
ccaggcuggcgugcag

SEQ ID NO: 2736452 - RNA, 20 nt, Human
ccaggcuccuuuagcgccca

SEQ ID NO: 2736453 - RNA, 21 nt, Human
ccaggcuccuuuagcgcccag

SEQ ID NO: 2736454 - RNA, 23 nt, Human
ccaggggugggacacccugugau

SEQ ID NO: 2736455 - RNA, 19 nt, Human
ccaggggugggacacccug

SEQ ID NO: 2736456 - RNA, 14 nt, Human
ccaggggugggaca

SEQ ID NO: 2736457 - RNA, 17 nt, Human
ccaggggugggacaccc

SEQ ID NO: 2736458 - RNA, 20 nt, Human
ccaggggaaaaucagccugc

SEQ ID NO: 2736459 - RNA, 13 nt, Human
ccaggggugggac

SEQ ID NO: 2736460 - RNA, 19 nt, Human
ccaggggaaaaucagccug

SEQ ID NO: 2736461 - RNA, 17 nt, Human
ccaguuggguggaugcc

SEQ ID NO: 2736462 - RNA, 19 nt, Human
ccaguuggguggaugccug

SEQ ID NO: 2736463 - RNA, 20 nt, Human
ccaguuggguggaugccugg

SEQ ID NO: 2736464 - RNA, 20 nt, Human
ccauggucggaaaacaugcu

SEQ ID NO: 2736465 - RNA, 21 nt, Human
ccaugagccucagcauccugg

SEQ ID NO: 2736466 - RNA, 23 nt, Human
ccaugagccucagcauccuggca

SEQ ID NO: 2736467 - RNA, 14 nt, Human
ccaucccugaaggc

SEQ ID NO: 2736468 - RNA, 15 nt, Human
ccaucccugaaggcc

SEQ ID NO: 2736469 - RNA, 17 nt, Human
ccaucccugaaggcccc

SEQ ID NO: 2736470 - RNA, 20 nt, Human
ccaucccugaaggccccgcc

SEQ ID NO: 2736471 - RNA, 14 nt, Human
ccaucccagcccca

SEQ ID NO: 2736472 - RNA, 13 nt, Human
ccaucccagcccc

SEQ ID NO: 2736473 - RNA, 15 nt, Human
ccaucccagccccaa

SEQ ID NO: 2736474 - RNA, 23 nt, Human
ccaguuggucccccuuccaugga

SEQ ID NO: 2736475 - RNA, 13 nt, Human
ccucugcuugcca

SEQ ID NO: 2736476 - RNA, 22 nt, Human
ccucugccugaagucacacagu

SEQ ID NO: 2736477 - RNA, 13 nt, Human
ccucugcugcugg

SEQ ID NO: 2736478 - RNA, 14 nt, Human
ccucugcugcuggc

SEQ ID NO: 2736479 - RNA, 15 nt, Human
ccucugcugcuggcu

SEQ ID NO: 2736480 - RNA, 16 nt, Human
ccucugcugcuggcug

SEQ ID NO: 2736481 - RNA, 17 nt, Human
ccucugcugcuggcugg

SEQ ID NO: 2736482 - RNA, 18 nt, Human
ccucugcugcuggcuggu

SEQ ID NO: 2736483 - RNA, 14 nt, Human
ccucucucaggcca

SEQ ID NO: 2736484 - RNA, 13 nt, Human
ccucucucacucc

SEQ ID NO: 2736485 - RNA, 14 nt, Human
ccucucucacuccu

SEQ ID NO: 2736486 - RNA, 15 nt, Human
ccucucucacuccuu

SEQ ID NO: 2736487 - RNA, 17 nt, Human
ccucucucacuccuuga

SEQ ID NO: 2736488 - RNA, 12 nt, Human
ccucucucaggc

SEQ ID NO: 2736489 - RNA, 19 nt, Human
ccugcacuugcagacucua

SEQ ID NO: 2736490 - RNA, 22 nt, Human
ccugcacuugcagacucuacag

SEQ ID NO: 2736491 - RNA, 19 nt, Human
ccucuugagccuugaacuu

SEQ ID NO: 2736492 - RNA, 13 nt, Human
ccucuugagccuu

SEQ ID NO: 2736493 - RNA, 13 nt, Human
ccucuuggguuca

SEQ ID NO: 2736494 - RNA, 15 nt, Human
ccuggaguucugguu

SEQ ID NO: 2736495 - RNA, 16 nt, Human
ccuggaguucugguuc

SEQ ID NO: 2736496 - RNA, 17 nt, Human
ccuggaguucugguucc

SEQ ID NO: 2736497 - RNA, 13 nt, Human
ccuggaugcagcc

SEQ ID NO: 2736498 - RNA, 19 nt, Human
ccuggaugcagccucacag

SEQ ID NO: 2736499 - RNA, 14 nt, Human
ccuggaugcagccu

SEQ ID NO: 2736500 - RNA, 17 nt, Human
ccuggaugcagccucac

SEQ ID NO: 2736501 - RNA, 14 nt, Human
ccugcugggugugg

SEQ ID NO: 2736502 - RNA, 20 nt, Human
ccugcuggguguggcgcagc

SEQ ID NO: 2736503 - RNA, 12 nt, Human
ccugcugggugu

SEQ ID NO: 2736504 - RNA, 14 nt, Human
ccugcccaggcccc

SEQ ID NO: 2736505 - RNA, 15 nt, Human
ccugcccaggccccu

SEQ ID NO: 2736506 - RNA, 16 nt, Human
ccugcccaggccccug

SEQ ID NO: 2736507 - RNA, 12 nt, Human
ccuggccucugc

SEQ ID NO: 2736508 - RNA, 16 nt, Human
ccuggccucugcacuc

SEQ ID NO: 2736509 - RNA, 13 nt, Human
ccuggccugagcu

SEQ ID NO: 2736510 - RNA, 14 nt, Human
ccuggccucugcac

SEQ ID NO: 2736511 - RNA, 15 nt, Human
ccuggccucugcacu

SEQ ID NO: 2736512 - RNA, 23 nt, Human
ccucagccucccaaagugcuggg

SEQ ID NO: 2736513 - RNA, 22 nt, Human
ccucagccucccgaauagcugg

SEQ ID NO: 2736514 - RNA, 13 nt, Human
ccucauguucuua

SEQ ID NO: 2736515 - RNA, 19 nt, Human
ccucauguucuuaauucuu

SEQ ID NO: 2736516 - RNA, 18 nt, Human
ccucauuagcauuuugcu

SEQ ID NO: 2736517 - RNA, 22 nt, Human
ccucccaaggggcccaaauucu

SEQ ID NO: 2736518 - RNA, 16 nt, Human
ccucaaccuccugggc

SEQ ID NO: 2736519 - RNA, 11 nt, Human
ccucagccucc

SEQ ID NO: 2736520 - RNA, 22 nt, Human
ccucagccucccaaagugcugg

SEQ ID NO: 2736521 - RNA, 15 nt, Human
ccucaacucuccucc

SEQ ID NO: 2736522 - RNA, 15 nt, Human
ccucaagagaaggca

SEQ ID NO: 2736523 - RNA, 16 nt, Human
ccguagguuauuuuca

SEQ ID NO: 2736524 - RNA, 21 nt, Human
cccuucugacccaugcugccc

SEQ ID NO: 2736525 - RNA, 22 nt, Human
cccuucugacccaugcugcccu

SEQ ID NO: 2736526 - RNA, 23 nt, Human
cccuucugacccaugcugcccug

SEQ ID NO: 2736527 - RNA, 16 nt, Human
cccuucuaccuuccug

SEQ ID NO: 2736528 - RNA, 16 nt, Human
cccuucgcuccugugu

SEQ ID NO: 2736529 - RNA, 18 nt, Human
cccuucgcuccugugucu

SEQ ID NO: 2736530 - RNA, 17 nt, Human
cccuucuuuccacagaa

SEQ ID NO: 2736531 - RNA, 20 nt, Human
ccgaauagcugggacuacag

SEQ ID NO: 2736532 - RNA, 16 nt, Human
ccgacccuugccgucu

SEQ ID NO: 2736533 - RNA, 17 nt, Human
ccgccaaggcuggggga

SEQ ID NO: 2736534 - RNA, 16 nt, Human
ccgccaugcuccuggc

SEQ ID NO: 2736535 - RNA, 20 nt, Human
ccgcccaggcuuagucacug

SEQ ID NO: 2736536 - RNA, 13 nt, Human
cccugcccugugg

SEQ ID NO: 2736537 - RNA, 12 nt, Human
cccugcccugug

SEQ ID NO: 2736538 - RNA, 11 nt, Human
cccugcccugu

SEQ ID NO: 2736539 - RNA, 14 nt, Human
cccugcccuguggg

SEQ ID NO: 2736540 - RNA, 15 nt, Human
cccugcccugugggc

SEQ ID NO: 2736541 - RNA, 16 nt, Human
cccugcccugugggcc

SEQ ID NO: 2736542 - RNA, 20 nt, Human
cccugcccugugggccccca

SEQ ID NO: 2736543 - RNA, 21 nt, Human
cccugcccugugggcccccaa

SEQ ID NO: 2736544 - RNA, 12 nt, Human
cccuggcagccc

SEQ ID NO: 2736545 - RNA, 13 nt, Human
cccuggcagcccc

SEQ ID NO: 2736546 - RNA, 14 nt, Human
cccuggcagccccu

SEQ ID NO: 2736547 - RNA, 16 nt, Human
cccuggcagccccugu

SEQ ID NO: 2736548 - RNA, 18 nt, Human
ccuuuuuuauacauaaac

SEQ ID NO: 2736549 - RNA, 17 nt, Human
ccuuuuuuauacauaaa

SEQ ID NO: 2736550 - RNA, 23 nt, Human
cgaccagacaccuugacagggca

SEQ ID NO: 2736551 - RNA, 12 nt, Human
ccuuuuuuauac

SEQ ID NO: 2736552 - RNA, 17 nt, Human
ccuuuuucauuauuuua

SEQ ID NO: 2736553 - RNA, 15 nt, Human
ccuuuuucauuauuu

SEQ ID NO: 2736554 - RNA, 14 nt, Human
ccuuuagcgcccag

SEQ ID NO: 2736555 - RNA, 20 nt, Human
ccuuuagcgcccaguugggu

SEQ ID NO: 2736556 - RNA, 20 nt, Human
ccuuuucgcaggauucuucc

SEQ ID NO: 2736557 - RNA, 20 nt, Human
ccuugccgucuaccugaggg

SEQ ID NO: 2736558 - RNA, 17 nt, Human
ccuugccgucuaccuga

SEQ ID NO: 2736559 - RNA, 20 nt, Human
ccuggccugagcugggauga

SEQ ID NO: 2736560 - RNA, 14 nt, Human
ccuggccugagcug

SEQ ID NO: 2736561 - RNA, 15 nt, Human
ccuggccugagcugg

SEQ ID NO: 2736562 - RNA, 12 nt, Human
ccuucugaccca

SEQ ID NO: 2736563 - RNA, 16 nt, Human
ccuucugacccaugcu

SEQ ID NO: 2736564 - RNA, 17 nt, Human
ccuucugacccaugcug

SEQ ID NO: 2736565 - RNA, 20 nt, Human
ccuucugacccaugcugccc

SEQ ID NO: 2736566 - RNA, 22 nt, Human
ccuucuggaauaaggagaauga

SEQ ID NO: 2736567 - RNA, 23 nt, Human
ccuucugacccaugcugcccugu

SEQ ID NO: 2736568 - RNA, 21 nt, Human
ccuucugacccaugcugcccu

SEQ ID NO: 2736569 - RNA, 22 nt, Human
ccuucugacccaugcugcccug

SEQ ID NO: 2736570 - RNA, 14 nt, Human
cggagucccaccuu

SEQ ID NO: 2736571 - RNA, 19 nt, Human
cggcucacugcagccucaa

SEQ ID NO: 2736572 - RNA, 18 nt, Human
cggcucacugcagccuca

SEQ ID NO: 2736573 - RNA, 14 nt, Human
cgccuacaggagug

SEQ ID NO: 2736574 - RNA, 12 nt, Human
cgccaaggcugg

SEQ ID NO: 2736575 - RNA, 13 nt, Human
cgccaaggcuggg

SEQ ID NO: 2736576 - RNA, 16 nt, Human
cgccaaggcuggggga

SEQ ID NO: 2736577 - RNA, 17 nt, Human
cgaguuacagacaaagc

SEQ ID NO: 2736578 - RNA, 18 nt, Human
cgaguuacagacaaagcg

SEQ ID NO: 2736579 - RNA, 13 nt, Human
cgaguagcuggga

SEQ ID NO: 2736580 - RNA, 14 nt, Human
cgaguagcugggac

SEQ ID NO: 2736581 - RNA, 15 nt, Human
cgaguagcugggacu

SEQ ID NO: 2736582 - RNA, 16 nt, Human
cgaguagcugggacua

SEQ ID NO: 2736583 - RNA, 22 nt, Human
cuacauaaguaauucaagaaaa

SEQ ID NO: 2736584 - RNA, 18 nt, Human
cuacauacaauuccaaac

SEQ ID NO: 2736585 - RNA, 23 nt, Human
cuacauaaguaauucaagaaaac

SEQ ID NO: 2736586 - RNA, 13 nt, Human
cuacaguugaaaa

SEQ ID NO: 2736587 - RNA, 15 nt, Human
cuacaguccucccau

SEQ ID NO: 2736588 - RNA, 16 nt, Human
cuacaguccucccauc

SEQ ID NO: 2736589 - RNA, 17 nt, Human
cuacaguccucccaucu

SEQ ID NO: 2736590 - RNA, 18 nt, Human
cuacaguccucccaucuc

SEQ ID NO: 2736591 - RNA, 18 nt, Human
cuaagugaggaugaaaaa

SEQ ID NO: 2736592 - RNA, 20 nt, Human
cuaagugauccucccaccuc

SEQ ID NO: 2736593 - RNA, 22 nt, Human
cuaagugauccucccaccucag

SEQ ID NO: 2736594 - RNA, 13 nt, Human
cuaaacuuuucug

SEQ ID NO: 2736595 - RNA, 16 nt, Human
cuaacuucaccauauu

SEQ ID NO: 2736596 - RNA, 16 nt, Human
cuaacuuuccuucauu

SEQ ID NO: 2736597 - RNA, 15 nt, Human
cuaacuucaccauau

SEQ ID NO: 2736598 - RNA, 12 nt, Human
cuagcagcaggg

SEQ ID NO: 2736599 - RNA, 22 nt, Human
cuagcagcagggagggcuucug

SEQ ID NO: 2736600 - RNA, 17 nt, Human
cuagcauggcugccaau

SEQ ID NO: 2736601 - RNA, 23 nt, Human
cuagcagcagggagggcuucugc

SEQ ID NO: 2736602 - RNA, 19 nt, Human
cuagaaauuccccacccug

SEQ ID NO: 2736603 - RNA, 11 nt, Human
cuaccugaggg

SEQ ID NO: 2736604 - RNA, 14 nt, Human
cuaccugaggggcc

SEQ ID NO: 2736605 - RNA, 23 nt, Human
cuaguugaucagcuuauugucua

SEQ ID NO: 2736606 - RNA, 22 nt, Human
cuaguuccaccaucaagccacc

SEQ ID NO: 2736607 - RNA, 14 nt, Human
cuaguuccaccauc

SEQ ID NO: 2736608 - RNA, 18 nt, Human
cuaguuccaccaucaagc

SEQ ID NO: 2736609 - RNA, 20 nt, Human
cuaguuccaccaucaagcca

SEQ ID NO: 2736610 - RNA, 21 nt, Human
cuagggaaaaaccagcgugug

SEQ ID NO: 2736611 - RNA, 19 nt, Human
cuagggaaaaaccagcgug

SEQ ID NO: 2736612 - RNA, 12 nt, Human
cucccaccucag

SEQ ID NO: 2736613 - RNA, 14 nt, Human
cucccugcaauaaa

SEQ ID NO: 2736614 - RNA, 16 nt, Human
cucccugcaauaaaau

SEQ ID NO: 2736615 - RNA, 19 nt, Human
cuccgcuuucuacccagcg

SEQ ID NO: 2736616 - RNA, 11 nt, Human
cuccaggugca

SEQ ID NO: 2736617 - RNA, 22 nt, Human
cuccacuuucuagccagaggag

SEQ ID NO: 2736618 - RNA, 20 nt, Human
cuccacuuucuagccagagg

SEQ ID NO: 2736619 - RNA, 16 nt, Human
cuccaagaccuucucc

SEQ ID NO: 2736620 - RNA, 17 nt, Human
cuccaagaccuucuccu

SEQ ID NO: 2736621 - RNA, 18 nt, Human
cuccaagaccuucuccuu

SEQ ID NO: 2736622 - RNA, 15 nt, Human
cuccagaauuuccca

SEQ ID NO: 2736623 - RNA, 18 nt, Human
cuccagaauuucccaaag

SEQ ID NO: 2736624 - RNA, 19 nt, Human
cuccagacacauguccaag

SEQ ID NO: 2736625 - RNA, 17 nt, Human
cuccagacacaugucca

SEQ ID NO: 2736626 - RNA, 13 nt, Human
cucagugccacua

SEQ ID NO: 2736627 - RNA, 18 nt, Human
cucagucuggcccuuccu

SEQ ID NO: 2736628 - RNA, 17 nt, Human
cucagucuggcccuucc

SEQ ID NO: 2736629 - RNA, 19 nt, Human
cucauguucuuaauucuua

SEQ ID NO: 2736630 - RNA, 18 nt, Human
cucauguucuuaauucuu

SEQ ID NO: 2736631 - RNA, 14 nt, Human
cucauguucuuaau

SEQ ID NO: 2736632 - RNA, 12 nt, Human
cucauguucuua

SEQ ID NO: 2736633 - RNA, 13 nt, Human
cucaggccagcug

SEQ ID NO: 2736634 - RNA, 14 nt, Human
cucaggccagcugc

SEQ ID NO: 2736635 - RNA, 20 nt, Human
cucaggccagcugcuugggc

SEQ ID NO: 2736636 - RNA, 21 nt, Human
cucaggccagcugcuugggcu

SEQ ID NO: 2736637 - RNA, 22 nt, Human
cucaggccagcugcuugggcuu

SEQ ID NO: 2736638 - RNA, 23 nt, Human
cucagccucccgaauagcuggga

SEQ ID NO: 2736639 - RNA, 22 nt, Human
cucagccucccaaagugcuggg

SEQ ID NO: 2736640 - RNA, 13 nt, Human
cucagccucccga

SEQ ID NO: 2736641 - RNA, 21 nt, Human
cucagccucccaaagugcugg

SEQ ID NO: 2736642 - RNA, 14 nt, Human
cucagccucccaaa

SEQ ID NO: 2736643 - RNA, 16 nt, Human
cucagccucccaaagu

SEQ ID NO: 2736644 - RNA, 13 nt, Human
cucagccucccaa

SEQ ID NO: 2736645 - RNA, 13 nt, Human
cucaggccugggg

SEQ ID NO: 2736646 - RNA, 14 nt, Human
cucaggccuggggg

SEQ ID NO: 2736647 - RNA, 20 nt, Human
cucaggccugggggcugggc

SEQ ID NO: 2736648 - RNA, 21 nt, Human
cucaggccugggggcugggca

SEQ ID NO: 2736649 - RNA, 15 nt, Human
cucugaaggacauug

SEQ ID NO: 2736650 - RNA, 21 nt, Human
cucuccgaccagacaccuuga

SEQ ID NO: 2736651 - RNA, 12 nt, Human
cucucacuccuu

SEQ ID NO: 2736652 - RNA, 14 nt, Human
cucucacuccuuga

SEQ ID NO: 2736653 - RNA, 19 nt, Human
cucucagauuguaccauug

SEQ ID NO: 2736654 - RNA, 21 nt, Human
cucucacuuguuuuauuuaac

SEQ ID NO: 2736655 - RNA, 15 nt, Human
cucucacuccuugaa

SEQ ID NO: 2736656 - RNA, 15 nt, Human
cucuuagaugcaguu

SEQ ID NO: 2736657 - RNA, 17 nt, Human
cucuguacagagcccac

SEQ ID NO: 2736658 - RNA, 21 nt, Human
cucuguacagagcccacgccc

SEQ ID NO: 2736659 - RNA, 15 nt, Human
cucugguuaucuaau

SEQ ID NO: 2736660 - RNA, 19 nt, Human
cucugguccauagagagca

SEQ ID NO: 2736661 - RNA, 16 nt, Human
cucugguccauagaga

SEQ ID NO: 2736662 - RNA, 18 nt, Human
cucugguccauagagagc

SEQ ID NO: 2736663 - RNA, 17 nt, Human
cucugcugacagacaca

SEQ ID NO: 2736664 - RNA, 18 nt, Human
cucugcugacagacacag

SEQ ID NO: 2736665 - RNA, 19 nt, Human
cucugcugacagacacagg

SEQ ID NO: 2736666 - RNA, 15 nt, Human
cucugguccauagag

SEQ ID NO: 2736667 - RNA, 23 nt, Human
cucugcagcaauaaagcagcguu

SEQ ID NO: 2736668 - RNA, 19 nt, Human
cucugcagcaauaaagcag

SEQ ID NO: 2736669 - RNA, 18 nt, Human
cucugcagcaauaaagca

SEQ ID NO: 2736670 - RNA, 13 nt, Human
cucugcagcaaua

SEQ ID NO: 2736671 - RNA, 20 nt, Human
cucuuagaugcaguucugaa

SEQ ID NO: 2736672 - RNA, 16 nt, Human
cugaaaauguaugugu

SEQ ID NO: 2736673 - RNA, 19 nt, Human
cugaaggacauugcggaca

SEQ ID NO: 2736674 - RNA, 20 nt, Human
cugaaggacauugcggacag

SEQ ID NO: 2736675 - RNA, 21 nt, Human
cugaaggacauugcggacagc

SEQ ID NO: 2736676 - RNA, 13 nt, Human
cugaaggccccgc

SEQ ID NO: 2736677 - RNA, 14 nt, Human
cugaaggccccgcc

SEQ ID NO: 2736678 - RNA, 17 nt, Human
cugaaggccccgcccag

SEQ ID NO: 2736679 - RNA, 15 nt, Human
cugacagacacaggc

SEQ ID NO: 2736680 - RNA, 12 nt, Human
cugacagacaca

SEQ ID NO: 2736681 - RNA, 14 nt, Human
cugacagacacagg

SEQ ID NO: 2736682 - RNA, 23 nt, Human
cugacccugcuucaaauauuucc

SEQ ID NO: 2736683 - RNA, 18 nt, Human
cugacccaugcugcccug

SEQ ID NO: 2736684 - RNA, 17 nt, Human
cugacccaugcugcccu

SEQ ID NO: 2736685 - RNA, 19 nt, Human
cugacccaugcugcccugu

SEQ ID NO: 2736686 - RNA, 20 nt, Human
cugacccaugcugcccugug

SEQ ID NO: 2736687 - RNA, 12 nt, Human
aacuccuggccu

SEQ ID NO: 2736688 - RNA, 16 nt, Human
aacucuccucugcugc

SEQ ID NO: 2736689 - RNA, 15 nt, Human
aacucuccuccagag

SEQ ID NO: 2736690 - RNA, 18 nt, Human
aacucuccuccagaguca

SEQ ID NO: 2736691 - RNA, 22 nt, Human
gugaaccaccacacccagccca

SEQ ID NO: 2736692 - RNA, 23 nt, Human
gugaaccaccacacccagcccac

SEQ ID NO: 2736693 - RNA, 21 nt, Human
aacuagaguuuagcuggaaaa

SEQ ID NO: 2736694 - RNA, 23 nt, Human
aacuaucucauuuccaagcaagu

SEQ ID NO: 2736695 - RNA, 12 nt, Human
aaccugugucuc

SEQ ID NO: 2736696 - RNA, 16 nt, Human
gucuuucacauuuaaa

SEQ ID NO: 2736697 - RNA, 18 nt, Human
gucuuuggacccugaggc

SEQ ID NO: 2736698 - RNA, 14 nt, Human
gucuggcccuuccu

SEQ ID NO: 2736699 - RNA, 16 nt, Human
aaccucuuugucuaca

SEQ ID NO: 2736700 - RNA, 12 nt, Human
aaccucuaaauu

SEQ ID NO: 2736701 - RNA, 10 nt, Human
aacccagcuc

SEQ ID NO: 2736702 - RNA, 18 nt, Human
aacccaaguccaagcaua

SEQ ID NO: 2736703 - RNA, 12 nt, Human
aaccaucauuga

SEQ ID NO: 2736704 - RNA, 21 nt, Human
aaccaccacacccagcccacu

SEQ ID NO: 2736705 - RNA, 17 nt, Human
aaccaucauugaaaucu

SEQ ID NO: 2736706 - RNA, 18 nt, Human
aaccaucauugaaaucuu

SEQ ID NO: 2736707 - RNA, 15 nt, Human
aaccaagucaaguga

SEQ ID NO: 2736708 - RNA, 19 nt, Human
aaccaccacacccagccca

SEQ ID NO: 2736709 - RNA, 21 nt, Human
aacuucagcgguuuauauaag

SEQ ID NO: 2736710 - RNA, 18 nt, Human
aacuuccagauccuggaa

SEQ ID NO: 2736711 - RNA, 18 nt, Human
aacuucccagugaauucu

SEQ ID NO: 2736712 - RNA, 13 nt, Human
aacuuccaauuua

SEQ ID NO: 2736713 - RNA, 17 nt, Human
gugaugggaaagcauug

SEQ ID NO: 2736714 - RNA, 22 nt, Human
gugaugcgcaugucacggaggg

SEQ ID NO: 2736715 - RNA, 14 nt, Human
gugauggggcccug

SEQ ID NO: 2736716 - RNA, 16 nt, Human
gugauggggcccugcc

SEQ ID NO: 2736717 - RNA, 17 nt, Human
gugauggggcccugccu

SEQ ID NO: 2736718 - RNA, 18 nt, Human
gugauggggcccugccuc

SEQ ID NO: 2736719 - RNA, 16 nt, Human
gugaugagaggaaauc

SEQ ID NO: 2736720 - RNA, 14 nt, Human
gugaugagaggaaa

SEQ ID NO: 2736721 - RNA, 22 nt, Human
gugcaugcugucccuuacguga

SEQ ID NO: 2736722 - RNA, 21 nt, Human
gugcacacaccagagcccacc

SEQ ID NO: 2736723 - RNA, 19 nt, Human
gugauggggcccugccucc

SEQ ID NO: 2736724 - RNA, 22 nt, Human
gugcaaugaccuuucaauagga

SEQ ID NO: 2736725 - RNA, 23 nt, Human
gugcauuaucuagauacuguauc

SEQ ID NO: 2736726 - RNA, 19 nt, Human
gugcauguguguucaugca

SEQ ID NO: 2736727 - RNA, 19 nt, Human
gugcauuaucuagauacug

SEQ ID NO: 2736728 - RNA, 15 nt, Human
gugcauuaucuagau

SEQ ID NO: 2736729 - RNA, 17 nt, Human
aacugggacaggggaga

SEQ ID NO: 2736730 - RNA, 16 nt, Human
aacuggguacuugugg

SEQ ID NO: 2736731 - RNA, 21 nt, Human
aacuggguacuuguggacaca

SEQ ID NO: 2736732 - RNA, 22 nt, Human
aacugggggagggugaagugaa

SEQ ID NO: 2736733 - RNA, 21 nt, Human
aacugggggagggugaaguga

SEQ ID NO: 2736734 - RNA, 19 nt, Human
aacuggacugguucaaaug

SEQ ID NO: 2736735 - RNA, 15 nt, Human
aacuggauuaaacuu

SEQ ID NO: 2736736 - RNA, 16 nt, Human
aacuggauuaaacuua

SEQ ID NO: 2736737 - RNA, 11 nt, Human
aacuggcugca

SEQ ID NO: 2736738 - RNA, 19 nt, Human
aacugcacugucaagauga

SEQ ID NO: 2736739 - RNA, 15 nt, Human
aacugcugacuguuu

SEQ ID NO: 2736740 - RNA, 23 nt, Human
aacugcugacuguuuucucuuga

SEQ ID NO: 2736741 - RNA, 20 nt, Human
aacugcugacuguuuucucu

SEQ ID NO: 2736742 - RNA, 21 nt, Human
aacugcugacuguuuucucuu

SEQ ID NO: 2736743 - RNA, 12 nt, Human
aacugaaaucau

SEQ ID NO: 2736744 - RNA, 21 nt, Human
aacucuucaaucucuugcacu

SEQ ID NO: 2736745 - RNA, 15 nt, Human
gugagucgaggacag

SEQ ID NO: 2736746 - RNA, 22 nt, Human
gugagucgaggacagggaggug

SEQ ID NO: 2736747 - RNA, 17 nt, Human
gugaacuugggccacug

SEQ ID NO: 2736748 - RNA, 19 nt, Human
gugaacuugggccacugug

SEQ ID NO: 2736749 - RNA, 15 nt, Human
gugaacuugaaauuu

SEQ ID NO: 2736750 - RNA, 14 nt, Human
gugaacuugaaauu

SEQ ID NO: 2736751 - RNA, 17 nt, Human
gugaggccagagacaca

SEQ ID NO: 2736752 - RNA, 22 nt, Human
gugaggccagagacacaagccu

SEQ ID NO: 2736753 - RNA, 20 nt, Human
aaauuuuuucucuaggaaau

SEQ ID NO: 2736754 - RNA, 23 nt, Human
aaauuuugauguuuuaaggaugc

SEQ ID NO: 2736755 - RNA, 18 nt, Human
aaauuuugauguuuuaag

SEQ ID NO: 2736756 - RNA, 20 nt, Human
aacaagaccacguuucuaaa

SEQ ID NO: 2736757 - RNA, 19 nt, Human
aacaagaugguucuagcau

SEQ ID NO: 2736758 - RNA, 15 nt, Human
aacaaggcaaggcug

SEQ ID NO: 2736759 - RNA, 16 nt, Human
aacaaggcaaggcugu

SEQ ID NO: 2736760 - RNA, 12 nt, Human
aacaauaaaaga

SEQ ID NO: 2736761 - RNA, 14 nt, Human
aacaaugcuguauu

SEQ ID NO: 2736762 - RNA, 15 nt, Human
aacaaugcuguauuu

SEQ ID NO: 2736763 - RNA, 18 nt, Human
aacaaggcaaggcuguca

SEQ ID NO: 2736764 - RNA, 21 nt, Human
aacaaggcaaggcugucaauu

SEQ ID NO: 2736765 - RNA, 15 nt, Human
aacacaacuauauug

SEQ ID NO: 2736766 - RNA, 16 nt, Human
aacacaacuauauugu

SEQ ID NO: 2736767 - RNA, 17 nt, Human
aacaaugcuguauuuua

SEQ ID NO: 2736768 - RNA, 22 nt, Human
aacaaugcuguauuuuaaaaga

SEQ ID NO: 2736769 - RNA, 15 nt, Human
gucagugugacugau

SEQ ID NO: 2736770 - RNA, 18 nt, Human
aaauuuguuauaaugaau

SEQ ID NO: 2736771 - RNA, 22 nt, Human
gucacacaguauuacuucugcu

SEQ ID NO: 2736772 - RNA, 21 nt, Human
gucacacaguauuacuucugc

SEQ ID NO: 2736773 - RNA, 23 nt, Human
gucagaaguuucugccgcagccc

SEQ ID NO: 2736774 - RNA, 15 nt, Human
aacacagcaagggug

SEQ ID NO: 2736775 - RNA, 21 nt, Human
gucauuuuuuuuaagaaaaag

SEQ ID NO: 2736776 - RNA, 19 nt, Human
gucauuuuuuuuaagaaaa

SEQ ID NO: 2736777 - RNA, 13 nt, Human
guccaagaagccc

SEQ ID NO: 2736778 - RNA, 15 nt, Human
guccaagaagcccag

SEQ ID NO: 2736779 - RNA, 16 nt, Human
guccaagaagcccagg

SEQ ID NO: 2736780 - RNA, 20 nt, Human
guccaagaagcccaggaaag

SEQ ID NO: 2736781 - RNA, 17 nt, Human
guccaagaagcccagga

SEQ ID NO: 2736782 - RNA, 18 nt, Human
guccaagaagcccaggaa

SEQ ID NO: 2736783 - RNA, 13 nt, Human
guccauagagagc

SEQ ID NO: 2736784 - RNA, 14 nt, Human
guccauagagagca

SEQ ID NO: 2736785 - RNA, 21 nt, Human
gucccaccccacacacgccag

SEQ ID NO: 2736786 - RNA, 14 nt, Human
gucccaccuuggcu

SEQ ID NO: 2736787 - RNA, 15 nt, Human
gucccaccuuggcug

SEQ ID NO: 2736788 - RNA, 16 nt, Human
gucccaccuuggcugc

SEQ ID NO: 2736789 - RNA, 13 nt, Human
aacagauaaucag

SEQ ID NO: 2736790 - RNA, 11 nt, Human
aacagaaaugu

SEQ ID NO: 2736791 - RNA, 14 nt, Human
gucccccuuccaug

SEQ ID NO: 2736792 - RNA, 18 nt, Human
gucccccugacaacacuc

SEQ ID NO: 2736793 - RNA, 16 nt, Human
gucccccuuccaugga

SEQ ID NO: 2736794 - RNA, 18 nt, Human
gucccccuuccauggacu

SEQ ID NO: 2736795 - RNA, 16 nt, Human
guccuacccacccucc

SEQ ID NO: 2736796 - RNA, 15 nt, Human
guccuacccacccuc

SEQ ID NO: 2736797 - RNA, 12 nt, Human
guccuacucugu

SEQ ID NO: 2736798 - RNA, 14 nt, Human
aacagaaauguaca

SEQ ID NO: 2736799 - RNA, 13 nt, Human
aacagaaauguac

SEQ ID NO: 2736800 - RNA, 12 nt, Human
aacagaaaugua

SEQ ID NO: 2736801 - RNA, 18 nt, Human
guauguacuucaugcugu

SEQ ID NO: 2736802 - RNA, 15 nt, Human
aaauguauuacagug

SEQ ID NO: 2736803 - RNA, 24 nt, Human
aaaugucuaguuguaacaccauga

SEQ ID NO: 2736804 - RNA, 19 nt, Human
aaaugucuaguuguaacac

SEQ ID NO: 2736805 - RNA, 16 nt, Human
gucaaauugugugaaa

SEQ ID NO: 2736806 - RNA, 22 nt, Human
guauuuuguuuuugucuuaaaa

SEQ ID NO: 2736807 - RNA, 16 nt, Human
guauuuuugacagaau

SEQ ID NO: 2736808 - RNA, 12 nt, Human
guauuuuugaca

SEQ ID NO: 2736809 - RNA, 15 nt, Human
guauuuuugacagaa

SEQ ID NO: 2736810 - RNA, 14 nt, Human
aaauuguaauuaua

SEQ ID NO: 2736811 - RNA, 15 nt, Human
aaauuguaauuauau

SEQ ID NO: 2736812 - RNA, 14 nt, Human
aaauggguuuuacu

SEQ ID NO: 2736813 - RNA, 15 nt, Human
aaauggguuuuacug

SEQ ID NO: 2736814 - RNA, 22 nt, Human
guaacaggaaaauuuuaaaaau

SEQ ID NO: 2736815 - RNA, 12 nt, Human
guaacaggcaga

SEQ ID NO: 2736816 - RNA, 19 nt, Human
aaaugggggugcauuugag

SEQ ID NO: 2736817 - RNA, 20 nt, Human
guaguguuggagaagaacug

SEQ ID NO: 2736818 - RNA, 17 nt, Human
guaguguuggagaagaa

SEQ ID NO: 2736819 - RNA, 16 nt, Human
aaauguaagggaaacu

SEQ ID NO: 2736820 - RNA, 16 nt, Human
guaucaggugcugcca

SEQ ID NO: 2736821 - RNA, 18 nt, Human
guaucaggugcugccauc

SEQ ID NO: 2736822 - RNA, 15 nt, Human
guauaaaauaauuuu

SEQ ID NO: 2736823 - RNA, 21 nt, Human
guauaaaauaauuuuuauauu

SEQ ID NO: 2736824 - RNA, 19 nt, Human
guaucccaugagccucagc

SEQ ID NO: 2736825 - RNA, 22 nt, Human
guaucaggugcugccauccagg

SEQ ID NO: 2736826 - RNA, 15 nt, Human
guaugguggcugggu

SEQ ID NO: 2736827 - RNA, 16 nt, Human
guaugguggcuggguu

SEQ ID NO: 2736828 - RNA, 14 nt, Human
guaugguggcuggg

SEQ ID NO: 2736829 - RNA, 13 nt, Human
aagguacuucaaa

SEQ ID NO: 2736830 - RNA, 16 nt, Human
aagggugaaaauuauu

SEQ ID NO: 2736831 - RNA, 19 nt, Human
aagggugaugggaaagcau

SEQ ID NO: 2736832 - RNA, 15 nt, Human
aagggugaaaauuau

SEQ ID NO: 2736833 - RNA, 14 nt, Human
aagguacuucaaau

SEQ ID NO: 2736834 - RNA, 20 nt, Human
aagguagaaauaucugaaaa

SEQ ID NO: 2736835 - RNA, 22 nt, Human
aaggggcccaaauucuuucagu

SEQ ID NO: 2736836 - RNA, 17 nt, Human
aaggggcaguggugguu

SEQ ID NO: 2736837 - RNA, 12 nt, Human
aaggucauuuuu

SEQ ID NO: 2736838 - RNA, 18 nt, Human
aagguauuuaauagguuu

SEQ ID NO: 2736839 - RNA, 22 nt, Human
guuucuaugacacaugcaaggu

SEQ ID NO: 2736840 - RNA, 19 nt, Human
guuucuauguguagggcgg

SEQ ID NO: 2736841 - RNA, 18 nt, Human
guuucugaaagggacgcu

SEQ ID NO: 2736842 - RNA, 22 nt, Human
aaggcucgagcaugccuggaug

SEQ ID NO: 2736843 - RNA, 19 nt, Human
aaggcucgagcaugccugg

SEQ ID NO: 2736844 - RNA, 20 nt, Human
aaggcucgagcaugccugga

SEQ ID NO: 2736845 - RNA, 19 nt, Human
aaggcuccaggagcagcca

SEQ ID NO: 2736846 - RNA, 22 nt, Human
aaggcuccaggagcagccacau

SEQ ID NO: 2736847 - RNA, 16 nt, Human
aaggcucgagcaugcc

SEQ ID NO: 2736848 - RNA, 18 nt, Human
aaggcucgagcaugccug

SEQ ID NO: 2736849 - RNA, 13 nt, Human
guuucaaacuuua

SEQ ID NO: 2736850 - RNA, 16 nt, Human
guuucaaacuuuacua

SEQ ID NO: 2736851 - RNA, 14 nt, Human
guuucaaacuuuac

SEQ ID NO: 2736852 - RNA, 16 nt, Human
aaggcuccaggagcag

SEQ ID NO: 2736853 - RNA, 18 nt, Human
aaggcuccaggagcagcc

SEQ ID NO: 2736854 - RNA, 15 nt, Human
aaggcuccaggagca

SEQ ID NO: 2736855 - RNA, 12 nt, Human
guuucaaacuuu

SEQ ID NO: 2736856 - RNA, 19 nt, Human
guuuaauauuaaagccaug

SEQ ID NO: 2736857 - RNA, 20 nt, Human
guuuaauauuaaagccaugu

SEQ ID NO: 2736858 - RNA, 15 nt, Human
guugggcugguguca

SEQ ID NO: 2736859 - RNA, 13 nt, Human
guugggcuggugu

SEQ ID NO: 2736860 - RNA, 15 nt, Human
guugggccaggagcc

SEQ ID NO: 2736861 - RNA, 17 nt, Human
guugggccaggagccuc

SEQ ID NO: 2736862 - RNA, 13 nt, Human
guuuauugucaaa

SEQ ID NO: 2736863 - RNA, 15 nt, Human
aaggaaagagggagg

SEQ ID NO: 2736864 - RNA, 16 nt, Human
aaggaagcacaugccu

SEQ ID NO: 2736865 - RNA, 17 nt, Human
aaggaauaccugucccc

SEQ ID NO: 2736866 - RNA, 14 nt, Human
aaggaagacuucau

SEQ ID NO: 2736867 - RNA, 15 nt, Human
aaggaagacuucauc

SEQ ID NO: 2736868 - RNA, 13 nt, Human
aaggaagcacaug

SEQ ID NO: 2736869 - RNA, 18 nt, Human
aaggaggaagagaaaaaa

SEQ ID NO: 2736870 - RNA, 20 nt, Human
aaggaggggauagagagaga

SEQ ID NO: 2736871 - RNA, 18 nt, Human
aaggaauaccuguccccc

SEQ ID NO: 2736872 - RNA, 11 nt, Human
aaggagagcua

SEQ ID NO: 2736873 - RNA, 14 nt, Human
aaggagauuuacaa

SEQ ID NO: 2736874 - RNA, 21 nt, Human
aaggauacaaaagcaugugag

SEQ ID NO: 2736875 - RNA, 13 nt, Human
aaggauacaaaag

SEQ ID NO: 2736876 - RNA, 16 nt, Human
aaggccaaaggaagca

SEQ ID NO: 2736877 - RNA, 22 nt, Human
guugccuaaauccauuuggaaa

SEQ ID NO: 2736878 - RNA, 17 nt, Human
guugccuaaauccauuu

SEQ ID NO: 2736879 - RNA, 23 nt, Human
guugcccaggcaggucuugaacu

SEQ ID NO: 2736880 - RNA, 12 nt, Human
guugcccaggcu

SEQ ID NO: 2736881 - RNA, 13 nt, Human
guugcccaggcug

SEQ ID NO: 2736882 - RNA, 22 nt, Human
aagucuuauauauuguagauaa

SEQ ID NO: 2736883 - RNA, 16 nt, Human
aagucuuucacauuua

SEQ ID NO: 2736884 - RNA, 21 nt, Human
aagugaaaaaggaggaagaga

SEQ ID NO: 2736885 - RNA, 19 nt, Human
aagugaagacaaugacuua

SEQ ID NO: 2736886 - RNA, 17 nt, Human
aagugaagacaaugacu

SEQ ID NO: 2736887 - RNA, 15 nt, Human
aagugagagcugggu

SEQ ID NO: 2736888 - RNA, 14 nt, Human
aagugagagcuggg

SEQ ID NO: 2736889 - RNA, 12 nt, Human
aagugagagagg

SEQ ID NO: 2736890 - RNA, 13 nt, Human
aaguauuagaaua

SEQ ID NO: 2736891 - RNA, 17 nt, Human
aaguauuaagcauauau

SEQ ID NO: 2736892 - RNA, 16 nt, Human
aaguauuaagcauaua

SEQ ID NO: 2736893 - RNA, 18 nt, Human
aaguauuaagcauauauu

SEQ ID NO: 2736894 - RNA, 15 nt, Human
aaguauuaagcauau

SEQ ID NO: 2736895 - RNA, 14 nt, Human
aaguauuaagcaua

SEQ ID NO: 2736896 - RNA, 23 nt, Human
aaguacacuguuucaaacuuuac

SEQ ID NO: 2736897 - RNA, 20 nt, Human
aaguacacuguuucaaacuu

SEQ ID NO: 2736898 - RNA, 19 nt, Human
aaguacacuguuucaaacu

SEQ ID NO: 2736899 - RNA, 14 nt, Human
aaguaaugauaacu

SEQ ID NO: 2736900 - RNA, 19 nt, Human
aaguaaugauaacuggaaa

SEQ ID NO: 2736901 - RNA, 18 nt, Human
aaguacacuguuucaaac

SEQ ID NO: 2736902 - RNA, 13 nt, Human
aaguacacuguuu

SEQ ID NO: 2736903 - RNA, 14 nt, Human
guuucugccgcagc

SEQ ID NO: 2736904 - RNA, 15 nt, Human
guuucugccgcagcc

SEQ ID NO: 2736905 - RNA, 16 nt, Human
guuuugccauguuggc

SEQ ID NO: 2736906 - RNA, 20 nt, Human
guuuugccauguuggccagg

SEQ ID NO: 2736907 - RNA, 21 nt, Human
guuuugccauguuggccaggc

SEQ ID NO: 2736908 - RNA, 22 nt, Human
guuuugccauguuggccaggcu

SEQ ID NO: 2736909 - RNA, 12 nt, Human
uaaaagaaugau

SEQ ID NO: 2736910 - RNA, 23 nt, Human
uaaaagaauauuuuaacuuccuu

SEQ ID NO: 2736911 - RNA, 16 nt, Human
uaaaagaauauuuuaa

SEQ ID NO: 2736912 - RNA, 22 nt, Human
uaaaacuugauguguuaucucu

SEQ ID NO: 2736913 - RNA, 20 nt, Human
uaaaacuugauguguuaucu

SEQ ID NO: 2736914 - RNA, 21 nt, Human
uaaaaaucucaaauuucuaaa

SEQ ID NO: 2736915 - RNA, 20 nt, Human
uaaaaaucucaaauuucuaa

SEQ ID NO: 2736916 - RNA, 19 nt, Human
uaaaaaucucaaauuucua

SEQ ID NO: 2736917 - RNA, 15 nt, Human
uaaaaaucucaaauu

SEQ ID NO: 2736918 - RNA, 17 nt, Human
uaaaaaucucaaauuuc

SEQ ID NO: 2736919 - RNA, 16 nt, Human
uaaaaaucucaaauuu

SEQ ID NO: 2736920 - RNA, 15 nt, Human
uaaaaaguggaaaaa

SEQ ID NO: 2736921 - RNA, 15 nt, Human
guuuuucuucucccu

SEQ ID NO: 2736922 - RNA, 20 nt, Human
uaaaagacagugaaagaaaa

SEQ ID NO: 2736923 - RNA, 20 nt, Human
uaaaauaauuuuuauauuug

SEQ ID NO: 2736924 - RNA, 22 nt, Human
uaaaauaccagccaguaaaugg

SEQ ID NO: 2736925 - RNA, 21 nt, Human
uaaaauaccagccaguaaaug

SEQ ID NO: 2736926 - RNA, 16 nt, Human
aagugaggaugaaaaa

SEQ ID NO: 2736927 - RNA, 19 nt, Human
aagugauucuccugccuca

SEQ ID NO: 2736928 - RNA, 15 nt, Human
aagugauucuccugc

SEQ ID NO: 2736929 - RNA, 16 nt, Human
aagugauucuccugcc

SEQ ID NO: 2736930 - RNA, 17 nt, Human
aagugauucuccugccu

SEQ ID NO: 2736931 - RNA, 18 nt, Human
aagugauucuccugccuc

SEQ ID NO: 2736932 - RNA, 16 nt, Human
gugucagcauagaagu

SEQ ID NO: 2736933 - RNA, 20 nt, Human
gugucaagagggucugagga

SEQ ID NO: 2736934 - RNA, 23 nt, Human
guguauuuuuuuacuaauagaca

SEQ ID NO: 2736935 - RNA, 17 nt, Human
guguauuuuuuuacuaa

SEQ ID NO: 2736936 - RNA, 22 nt, Human
gugugacaaggauugcuacugu

SEQ ID NO: 2736937 - RNA, 20 nt, Human
gugucagguggggcagcuug

SEQ ID NO: 2736938 - RNA, 16 nt, Human
gugugguagagugugc

SEQ ID NO: 2736939 - RNA, 14 nt, Human
aagaugaaaauauu

SEQ ID NO: 2736940 - RNA, 13 nt, Human
aagaugaaaauau

SEQ ID NO: 2736941 - RNA, 13 nt, Human
aagaguaggaaga

SEQ ID NO: 2736942 - RNA, 14 nt, Human
aagaguaggaagac

SEQ ID NO: 2736943 - RNA, 19 nt, Human
aagaugcuucucacugcca

SEQ ID NO: 2736944 - RNA, 17 nt, Human
aagaugcuucucacugc

SEQ ID NO: 2736945 - RNA, 16 nt, Human
aagaugcuucucacug

SEQ ID NO: 2736946 - RNA, 17 nt, Human
guggggucacucuggca

SEQ ID NO: 2736947 - RNA, 20 nt, Human
guggggucacucuggcagcu

SEQ ID NO: 2736948 - RNA, 21 nt, Human
guggggucacucuggcagcuc

SEQ ID NO: 2736949 - RNA, 22 nt, Human
guggggucacucuggcagcuca

SEQ ID NO: 2736950 - RNA, 12 nt, Human
aagaguaggaag

SEQ ID NO: 2736951 - RNA, 23 nt, Human
aagagggagggagggcuccagac

SEQ ID NO: 2736952 - RNA, 16 nt, Human
aagacugcacaucaaa

SEQ ID NO: 2736953 - RNA, 17 nt, Human
aagacugcauuauauuu

SEQ ID NO: 2736954 - RNA, 22 nt, Human
aagacugaguacguugugcauu

SEQ ID NO: 2736955 - RNA, 23 nt, Human
aagacugaguacguugugcauuu

SEQ ID NO: 2736956 - RNA, 16 nt, Human
aagacuuuggaaagac

SEQ ID NO: 2736957 - RNA, 13 nt, Human
aagacgcugugcu

SEQ ID NO: 2736958 - RNA, 21 nt, Human
aagaccuuuggagcaaagcug

SEQ ID NO: 2736959 - RNA, 23 nt, Human
aagaccuugcuuaugauugcaga

SEQ ID NO: 2736960 - RNA, 15 nt, Human
aagacgcugugcugc

SEQ ID NO: 2736961 - RNA, 17 nt, Human
aagacgcugugcugccc

SEQ ID NO: 2736962 - RNA, 18 nt, Human
aagacgcugugcugcccu

SEQ ID NO: 2736963 - RNA, 19 nt, Human
aagacgcugugcugcccug

SEQ ID NO: 2736964 - RNA, 15 nt, Human
aagaccuucuccuuc

SEQ ID NO: 2736965 - RNA, 18 nt, Human
aagaccuucuccuucacc

SEQ ID NO: 2736966 - RNA, 19 nt, Human
aagaccuucuccuucaccu

SEQ ID NO: 2736967 - RNA, 21 nt, Human
guggccucccaacucacccca

SEQ ID NO: 2736968 - RNA, 22 nt, Human
guggccucccaacucaccccag

SEQ ID NO: 2736969 - RNA, 15 nt, Human
gugggagcugccugu

SEQ ID NO: 2736970 - RNA, 18 nt, Human
gugggagcugccuguuca

SEQ ID NO: 2736971 - RNA, 15 nt, Human
guggggucacucugg

SEQ ID NO: 2736972 - RNA, 13 nt, Human
gugggacacccug

SEQ ID NO: 2736973 - RNA, 14 nt, Human
gugggagcugccug

SEQ ID NO: 2736974 - RNA, 15 nt, Human
gugggacacccugug

SEQ ID NO: 2736975 - RNA, 20 nt, Human
guuauuauauuuacaaaugg

SEQ ID NO: 2736976 - RNA, 23 nt, Human
guuauuuuuauuuauuuaaauuu

SEQ ID NO: 2736977 - RNA, 18 nt, Human
guuauugauaaguucaua

SEQ ID NO: 2736978 - RNA, 18 nt, Human
guucaagcgauucuucug

SEQ ID NO: 2736979 - RNA, 20 nt, Human
guucaaagauauuuugcuuu

SEQ ID NO: 2736980 - RNA, 22 nt, Human
guucaaagauauuuugcuuugu

SEQ ID NO: 2736981 - RNA, 21 nt, Human
guucaaagauauuuugcuuug

SEQ ID NO: 2736982 - RNA, 18 nt, Human
guuaagagaaaugagcuu

SEQ ID NO: 2736983 - RNA, 11 nt, Human
guuaagagaaa

SEQ ID NO: 2736984 - RNA, 12 nt, Human
guuaagagaaau

SEQ ID NO: 2736985 - RNA, 19 nt, Human
guuaggcauugugggaagg

SEQ ID NO: 2736986 - RNA, 20 nt, Human
guuaggcauugugggaaggg

SEQ ID NO: 2736987 - RNA, 13 nt, Human
aagcuccagguag

SEQ ID NO: 2736988 - RNA, 14 nt, Human
aagcuccagguaga

SEQ ID NO: 2736989 - RNA, 17 nt, Human
aagcuccaagcucccag

SEQ ID NO: 2736990 - RNA, 18 nt, Human
aagcuccaagcucccagg

SEQ ID NO: 2736991 - RNA, 20 nt, Human
aagcucagggccuggcucag

SEQ ID NO: 2736992 - RNA, 18 nt, Human
aagcucagggccuggcuc

SEQ ID NO: 2736993 - RNA, 19 nt, Human
aagcucagggccuggcuca

SEQ ID NO: 2736994 - RNA, 20 nt, Human
aagcucacagaccuuugaac

SEQ ID NO: 2736995 - RNA, 12 nt, Human
aagcucagggcc

SEQ ID NO: 2736996 - RNA, 13 nt, Human
aagcucagggccu

SEQ ID NO: 2736997 - RNA, 16 nt, Human
aagcucagggccuggc

SEQ ID NO: 2736998 - RNA, 17 nt, Human
aagcucagggccuggcu

SEQ ID NO: 2736999 - RNA, 13 nt, Human
guucagcuccagc

SEQ ID NO: 2737000 - RNA, 22 nt, Human
aagcuagacgagcaggcuucuu

SEQ ID NO: 2737001 - RNA, 17 nt, Human
aagccugcaauuucaua

SEQ ID NO: 2737002 - RNA, 22 nt, Human
aagccugcaauuucauaugcug

SEQ ID NO: 2737003 - RNA, 12 nt, Human
aagcuaggccug

SEQ ID NO: 2737004 - RNA, 16 nt, Human
aagcauuuagauguau

SEQ ID NO: 2737005 - RNA, 16 nt, Human
aagcauuuacuuugug

SEQ ID NO: 2737006 - RNA, 13 nt, Human
aagcauuguaaau

SEQ ID NO: 2737007 - RNA, 20 nt, Human
aagcagugcaugcugucccu

SEQ ID NO: 2737008 - RNA, 14 nt, Human
aagcagugcaugcu

SEQ ID NO: 2737009 - RNA, 15 nt, Human
aagcagugcaugcug

SEQ ID NO: 2737010 - RNA, 12 nt, Human
aagcagugcaug

SEQ ID NO: 2737011 - RNA, 21 nt, Human
gugugugcgccuacaggagug

SEQ ID NO: 2737012 - RNA, 22 nt, Human
aagccaaagcuaggccuggcca

SEQ ID NO: 2737013 - RNA, 14 nt, Human
aagcccaggaaagg

SEQ ID NO: 2737014 - RNA, 17 nt, Human
aagcccaggaaaggcuc

SEQ ID NO: 2737015 - RNA, 19 nt, Human
aagcccaggaaaggcucca

SEQ ID NO: 2737016 - RNA, 22 nt, Human
aagcccaggaaaggcuccagga

SEQ ID NO: 2737017 - RNA, 19 nt, Human
aagcccugagcuuucugcu

SEQ ID NO: 2737018 - RNA, 20 nt, Human
aagccgcuggggccaguugg

SEQ ID NO: 2737019 - RNA, 16 nt, Human
uaaaugugcuuuuaaa

SEQ ID NO: 2737020 - RNA, 20 nt, Human
uaaauuaacuuuuauaaacu

SEQ ID NO: 2737021 - RNA, 19 nt, Human
uaaauuaacuuuuauaaac

SEQ ID NO: 2737022 - RNA, 18 nt, Human
uaaaugaaaaucgugaca

SEQ ID NO: 2737023 - RNA, 21 nt, Human
aaguguauuuuuuuacuaaua

SEQ ID NO: 2737024 - RNA, 18 nt, Human
aaguguauuuuuuuacua

SEQ ID NO: 2737025 - RNA, 21 nt, Human
aauacaccacuacauucuguu

SEQ ID NO: 2737026 - RNA, 13 nt, Human
aauacagaggcaa

SEQ ID NO: 2737027 - RNA, 17 nt, Human
uaacaaugaagauaaaa

SEQ ID NO: 2737028 - RNA, 21 nt, Human
uaaauuaacuuuuauaaacuu

SEQ ID NO: 2737029 - RNA, 23 nt, Human
aauacaucccuuaccugggaaag

SEQ ID NO: 2737030 - RNA, 23 nt, Human
aauaccacaggaaccacaagacu

SEQ ID NO: 2737031 - RNA, 18 nt, Human
aauaccaugccauuuaaa

SEQ ID NO: 2737032 - RNA, 19 nt, Human
aauaccagccaguaaaugg

SEQ ID NO: 2737033 - RNA, 17 nt, Human
aauaccagccaguaaau

SEQ ID NO: 2737034 - RNA, 19 nt, Human
aauaccugucccccugaca

SEQ ID NO: 2737035 - RNA, 15 nt, Human
aauaccugucccccu

SEQ ID NO: 2737036 - RNA, 18 nt, Human
aauaccugucccccugac

SEQ ID NO: 2737037 - RNA, 20 nt, Human
aauagagcaaaauugaugug

SEQ ID NO: 2737038 - RNA, 22 nt, Human
aauagagcaaaauugauguguu

SEQ ID NO: 2737039 - RNA, 19 nt, Human
aauagucaaauugugugaa

SEQ ID NO: 2737040 - RNA, 21 nt, Human
aauagcuagacuggugacuga

SEQ ID NO: 2737041 - RNA, 20 nt, Human
aauagcuagacuggugacug

SEQ ID NO: 2737042 - RNA, 14 nt, Human
aauagcuagacugg

SEQ ID NO: 2737043 - RNA, 14 nt, Human
aauauauuuaauga

SEQ ID NO: 2737044 - RNA, 21 nt, Human
aauaguucagguaacaggcag

SEQ ID NO: 2737045 - RNA, 15 nt, Human
uaacauguuaaacca

SEQ ID NO: 2737046 - RNA, 12 nt, Human
uaacauguuaaa

SEQ ID NO: 2737047 - RNA, 17 nt, Human
uaacauguaauuaagua

SEQ ID NO: 2737048 - RNA, 19 nt, Human
uaacauguaauuaaguacu

SEQ ID NO: 2737049 - RNA, 21 nt, Human
uaacuuccuuggacucauuuu

SEQ ID NO: 2737050 - RNA, 16 nt, Human
uaacuugucuuuggac

SEQ ID NO: 2737051 - RNA, 20 nt, Human
uaacuugucuuuggacccug

SEQ ID NO: 2737052 - RNA, 23 nt, Human
uaagacaaaaagcuacuuauugu

SEQ ID NO: 2737053 - RNA, 20 nt, Human
aauccucaguuuuugugaaa

SEQ ID NO: 2737054 - RNA, 21 nt, Human
aaucccauuauucaaaguugc

SEQ ID NO: 2737055 - RNA, 14 nt, Human
aaucagugugucua

SEQ ID NO: 2737056 - RNA, 17 nt, Human
aaucagugugucuaaau

SEQ ID NO: 2737057 - RNA, 18 nt, Human
aaucagugugucuaaauu

SEQ ID NO: 2737058 - RNA, 22 nt, Human
aaucagugugucuaaauuugaa

SEQ ID NO: 2737059 - RNA, 17 nt, Human
aaucccauuuaaaaaaa

SEQ ID NO: 2737060 - RNA, 16 nt, Human
aaucccauuauucaaa

SEQ ID NO: 2737061 - RNA, 14 nt, Human
aaucccauuauuca

SEQ ID NO: 2737062 - RNA, 20 nt, Human
uaaguaaugauaacuggaaa

SEQ ID NO: 2737063 - RNA, 16 nt, Human
uaaguaauucaagaaa

SEQ ID NO: 2737064 - RNA, 19 nt, Human
uaaguaaaaccacagcagu

SEQ ID NO: 2737065 - RNA, 18 nt, Human
uaaguaaaaccacagcag

SEQ ID NO: 2737066 - RNA, 17 nt, Human
uaaguaaaaccacagca

SEQ ID NO: 2737067 - RNA, 16 nt, Human
uaaguaaaaccacagc

SEQ ID NO: 2737068 - RNA, 15 nt, Human
uaaguaaaaccacag

SEQ ID NO: 2737069 - RNA, 13 nt, Human
uaaguaaaaccac

SEQ ID NO: 2737070 - RNA, 18 nt, Human
uaagguuaccuuuguucc

SEQ ID NO: 2737071 - RNA, 19 nt, Human
uaaggacuuguuagaucua

SEQ ID NO: 2737072 - RNA, 16 nt, Human
uaaggacuuguuagau

SEQ ID NO: 2737073 - RNA, 15 nt, Human
uaaggacuuguuaga

SEQ ID NO: 2737074 - RNA, 13 nt, Human
uaaggacuuguua

SEQ ID NO: 2737075 - RNA, 21 nt, Human
uaaguauucuuauuuaaugaa

SEQ ID NO: 2737076 - RNA, 14 nt, Human
uaagauucauauuu

SEQ ID NO: 2737077 - RNA, 21 nt, Human
uaagcuauucaguaauaacuc

SEQ ID NO: 2737078 - RNA, 13 nt, Human
uaagcauauauuu

SEQ ID NO: 2737079 - RNA, 14 nt, Human
uaagcuauucagua

SEQ ID NO: 2737080 - RNA, 22 nt, Human
uaagcagauggaaugcuguguu

SEQ ID NO: 2737081 - RNA, 22 nt, Human
uaaggacuucuuuaauuuugga

SEQ ID NO: 2737082 - RNA, 16 nt, Human
uaaggacuucuuuaau

SEQ ID NO: 2737083 - RNA, 15 nt, Human
uaaggacuucuuuaa

SEQ ID NO: 2737084 - RNA, 14 nt, Human
uaaggacuucuuua

SEQ ID NO: 2737085 - RNA, 17 nt, Human
uaaggaauaccuguccc

SEQ ID NO: 2737086 - RNA, 18 nt, Human
uaaggaauaccugucccc

SEQ ID NO: 2737087 - RNA, 13 nt, Human
uaaggaagacaau

SEQ ID NO: 2737088 - RNA, 9 nt, Human
uaaggaaua

SEQ ID NO: 2737089 - RNA, 19 nt, Human
uaaggaaaaguuuaauauu

SEQ ID NO: 2737090 - RNA, 17 nt, Human
uaaggaaaaguuuaaua

SEQ ID NO: 2737091 - RNA, 21 nt, Human
uaaggaaaaguuuaauauuaa

SEQ ID NO: 2737092 - RNA, 16 nt, Human
aaucagccuaguugau

SEQ ID NO: 2737093 - RNA, 11 nt, Human
aaucagccugc

SEQ ID NO: 2737094 - RNA, 19 nt, Human
aaucagccugcuccagcug

SEQ ID NO: 2737095 - RNA, 13 nt, Human
aaucagccugcuc

SEQ ID NO: 2737096 - RNA, 18 nt, Human
aaucagccugcuccagcu

SEQ ID NO: 2737097 - RNA, 15 nt, Human
aauauuuauuuuaau

SEQ ID NO: 2737098 - RNA, 18 nt, Human
uaauuuuuuugagacaga

SEQ ID NO: 2737099 - RNA, 16 nt, Human
uacaaugcugugcccu

SEQ ID NO: 2737100 - RNA, 14 nt, Human
uacaaugcugugcc

SEQ ID NO: 2737101 - RNA, 13 nt, Human
uacaaugcugugc

SEQ ID NO: 2737102 - RNA, 22 nt, Human
aaugcuguauuuuaaaagaaug

SEQ ID NO: 2737103 - RNA, 13 nt, Human
aauggaagacagc

SEQ ID NO: 2737104 - RNA, 20 nt, Human
aaugcuguauuuuaaaagaa

SEQ ID NO: 2737105 - RNA, 21 nt, Human
aaugcuguauuuuaaaagaau

SEQ ID NO: 2737106 - RNA, 22 nt, Human
aaugcuggcuguuggcuggggg

SEQ ID NO: 2737107 - RNA, 21 nt, Human
aaugcuggcuguuggcugggg

SEQ ID NO: 2737108 - RNA, 20 nt, Human
aauguaagggaaacugccag

SEQ ID NO: 2737109 - RNA, 16 nt, Human
aaugguuuucaaaaua

SEQ ID NO: 2737110 - RNA, 16 nt, Human
aaugguuuucuugugu

SEQ ID NO: 2737111 - RNA, 14 nt, Human
aaugguuuucaaaa

SEQ ID NO: 2737112 - RNA, 16 nt, Human
aauggaagacagcucu

SEQ ID NO: 2737113 - RNA, 23 nt, Human
uacagagcagacaguuaagagaa

SEQ ID NO: 2737114 - RNA, 19 nt, Human
uacagagcccacgccccca

SEQ ID NO: 2737115 - RNA, 22 nt, Human
uacagagcccacgcccccacug

SEQ ID NO: 2737116 - RNA, 14 nt, Human
uacaccauuaugug

SEQ ID NO: 2737117 - RNA, 13 nt, Human
uacagacaaagcg

SEQ ID NO: 2737118 - RNA, 14 nt, Human
uacagacaaagcgu

SEQ ID NO: 2737119 - RNA, 15 nt, Human
uacagacaaagcgug

SEQ ID NO: 2737120 - RNA, 22 nt, Human
uaauuccguagguuauuuucag

SEQ ID NO: 2737121 - RNA, 18 nt, Human
uaauuuuuauauuugaaa

SEQ ID NO: 2737122 - RNA, 16 nt, Human
uaauuuauacagguca

SEQ ID NO: 2737123 - RNA, 19 nt, Human
uaauuuuuauauuugaaau

SEQ ID NO: 2737124 - RNA, 21 nt, Human
uaauuuuuauauuugaaauau

SEQ ID NO: 2737125 - RNA, 11 nt, Human
aaugcaaacca

SEQ ID NO: 2737126 - RNA, 12 nt, Human
aaugcaaaccau

SEQ ID NO: 2737127 - RNA, 13 nt, Human
aaugcaccuggaa

SEQ ID NO: 2737128 - RNA, 23 nt, Human
uaauuauaucugaggaauucugu

SEQ ID NO: 2737129 - RNA, 22 nt, Human
uaauuauaucugaggaauucug

SEQ ID NO: 2737130 - RNA, 21 nt, Human
uaauuauaucugaggaauucu

SEQ ID NO: 2737131 - RNA, 19 nt, Human
uaauuauaucugaggaauu

SEQ ID NO: 2737132 - RNA, 19 nt, Human
uaauuauaugcuauuucua

SEQ ID NO: 2737133 - RNA, 18 nt, Human
uaauuauaugcuauuucu

SEQ ID NO: 2737134 - RNA, 14 nt, Human
uaauuauaugcuau

SEQ ID NO: 2737135 - RNA, 22 nt, Human
aaugagagacacacugaagaag

SEQ ID NO: 2737136 - RNA, 11 nt, Human
aaugagccugg

SEQ ID NO: 2737137 - RNA, 20 nt, Human
aaugacucagaauauugcuu

SEQ ID NO: 2737138 - RNA, 21 nt, Human
aaugaccuuucaauaggaaaa

SEQ ID NO: 2737139 - RNA, 20 nt, Human
aaugaccuuucaauaggaaa

SEQ ID NO: 2737140 - RNA, 23 nt, Human
aaugauuaugaauuacauuugua

SEQ ID NO: 2737141 - RNA, 12 nt, Human
aaugagccuggc

SEQ ID NO: 2737142 - RNA, 13 nt, Human
aaugagccuggca

SEQ ID NO: 2737143 - RNA, 16 nt, Human
aaugaggucagagccu

SEQ ID NO: 2737144 - RNA, 18 nt, Human
aaugaggucagagccugc

SEQ ID NO: 2737145 - RNA, 13 nt, Human
aauuaacuuuuau

SEQ ID NO: 2737146 - RNA, 12 nt, Human
aauuaacuuuua

SEQ ID NO: 2737147 - RNA, 17 nt, Human
aauuaaguacuauguau

SEQ ID NO: 2737148 - RNA, 16 nt, Human
aauuaaguacuaugua

SEQ ID NO: 2737149 - RNA, 16 nt, Human
aauuaacuuuuauaaa

SEQ ID NO: 2737150 - RNA, 15 nt, Human
aauuaacuuuuauaa

SEQ ID NO: 2737151 - RNA, 21 nt, Human
aaugugcugaaugguuuucaa

SEQ ID NO: 2737152 - RNA, 16 nt, Human
uaccaugccauuuaaa

SEQ ID NO: 2737153 - RNA, 12 nt, Human
uaccagcagagc

SEQ ID NO: 2737154 - RNA, 18 nt, Human
uaccagccaguaaauggg

SEQ ID NO: 2737155 - RNA, 22 nt, Human
uaccagcagagcaccuuagaca

SEQ ID NO: 2737156 - RNA, 13 nt, Human
uaccagcagagca

SEQ ID NO: 2737157 - RNA, 14 nt, Human
uaccagcagagcac

SEQ ID NO: 2737158 - RNA, 12 nt, Human
uacauucuguua

SEQ ID NO: 2737159 - RNA, 14 nt, Human
aauuacauuuguau

SEQ ID NO: 2737160 - RNA, 13 nt, Human
aauuacauuugua

SEQ ID NO: 2737161 - RNA, 17 nt, Human
aauuacaggaaguacug

SEQ ID NO: 2737162 - RNA, 19 nt, Human
aauuacaggaaguacugga

SEQ ID NO: 2737163 - RNA, 20 nt, Human
aauuacaggaaguacuggag

SEQ ID NO: 2737164 - RNA, 16 nt, Human
uaccugccaggaagcc

SEQ ID NO: 2737165 - RNA, 16 nt, Human
uaccugaggggccucu

SEQ ID NO: 2737166 - RNA, 23 nt, Human
uacccgggaagggggcugggaca

SEQ ID NO: 2737167 - RNA, 22 nt, Human
uaccucuugagccuugaacuuu

SEQ ID NO: 2737168 - RNA, 23 nt, Human
uaccucuugagccuugaacuuug

SEQ ID NO: 2737169 - RNA, 13 nt, Human
uaccugaagucuu

SEQ ID NO: 2737170 - RNA, 14 nt, Human
uaccugaagucuuu

SEQ ID NO: 2737171 - RNA, 16 nt, Human
uaccugaagucuuugu

SEQ ID NO: 2737172 - RNA, 13 nt, Human
uaccugaggggcc

SEQ ID NO: 2737173 - RNA, 15 nt, Human
uaccugaggggccuc

SEQ ID NO: 2737174 - RNA, 21 nt, Human
aauuauuuauuaaaugcccag

SEQ ID NO: 2737175 - RNA, 17 nt, Human
aauucaguuguuagugu

SEQ ID NO: 2737176 - RNA, 22 nt, Human
aauucaguuguuagugugucuu

SEQ ID NO: 2737177 - RNA, 11 nt, Human
aauucaguugu

SEQ ID NO: 2737178 - RNA, 21 nt, Human
aauucagaaggaucuucaucu

SEQ ID NO: 2737179 - RNA, 12 nt, Human
aauucaagaaaa

SEQ ID NO: 2737180 - RNA, 20 nt, Human
aauucaagaaaacaacuuca

SEQ ID NO: 2737181 - RNA, 22 nt, Human
aauuauuuauuaaaugcccagc

SEQ ID NO: 2737182 - RNA, 17 nt, Human
acacucaaaucaagaaa

SEQ ID NO: 2737183 - RNA, 18 nt, Human
acacucaaaucaagaaac

SEQ ID NO: 2737184 - RNA, 13 nt, Human
acacucaaaucaa

SEQ ID NO: 2737185 - RNA, 21 nt, Human
acacucaaaagcugggcaggu

SEQ ID NO: 2737186 - RNA, 15 nt, Human
acacuaaugaggaaa

SEQ ID NO: 2737187 - RNA, 22 nt, Human
acacuaaugaggaaacugcacu

SEQ ID NO: 2737188 - RNA, 17 nt, Human
uagucacugagacagcc

SEQ ID NO: 2737189 - RNA, 20 nt, Human
uagucacugagacagcccgg

SEQ ID NO: 2737190 - RNA, 16 nt, Human
uauacaggucauauua

SEQ ID NO: 2737191 - RNA, 21 nt, Human
uauacaggucauauuaauaua

SEQ ID NO: 2737192 - RNA, 15 nt, Human
uauacaggucauauu

SEQ ID NO: 2737193 - RNA, 22 nt, Human
uauacacuuacacuuuaugcac

SEQ ID NO: 2737194 - RNA, 21 nt, Human
uauacacuuacacuuuaugca

SEQ ID NO: 2737195 - RNA, 18 nt, Human
uauaauuuaccugaaguc

SEQ ID NO: 2737196 - RNA, 16 nt, Human
uauaggugcuacaaaa

SEQ ID NO: 2737197 - RNA, 23 nt, Human
uauaggaacuuaaauaaugugaa

SEQ ID NO: 2737198 - RNA, 18 nt, Human
uauagauuagaauucugu

SEQ ID NO: 2737199 - RNA, 18 nt, Human
uauagccuaggugacaga

SEQ ID NO: 2737200 - RNA, 16 nt, Human
acacucaguuguucaa

SEQ ID NO: 2737201 - RNA, 16 nt, Human
acacucauugaccuga

SEQ ID NO: 2737202 - RNA, 17 nt, Human
uauauccuuucuaacaa

SEQ ID NO: 2737203 - RNA, 20 nt, Human
uauauccuuucuaacaaaaa

SEQ ID NO: 2737204 - RNA, 19 nt, Human
uauauauuuuuuucugaaa

SEQ ID NO: 2737205 - RNA, 19 nt, Human
acagacauacuaaccagca

SEQ ID NO: 2737206 - RNA, 18 nt, Human
acagacauacuaaccagc

SEQ ID NO: 2737207 - RNA, 21 nt, Human
acacuuacacuuuaugcacaa

SEQ ID NO: 2737208 - RNA, 18 nt, Human
acacuuacacuuuaugca

SEQ ID NO: 2737209 - RNA, 16 nt, Human
acacuuacacuuuaug

SEQ ID NO: 2737210 - RNA, 20 nt, Human
acacuguuucaaacuuuacu

SEQ ID NO: 2737211 - RNA, 18 nt, Human
acacuguuucaaacuuua

SEQ ID NO: 2737212 - RNA, 17 nt, Human
acacuguuucaaacuuu

SEQ ID NO: 2737213 - RNA, 16 nt, Human
acacuguuucaaacuu

SEQ ID NO: 2737214 - RNA, 17 nt, Human
acacucauugaccugag

SEQ ID NO: 2737215 - RNA, 14 nt, Human
acagaccuuugaac

SEQ ID NO: 2737216 - RNA, 22 nt, Human
uaucaaagggugaaaauuauuu

SEQ ID NO: 2737217 - RNA, 18 nt, Human
uaucaaagggugaaaauu

SEQ ID NO: 2737218 - RNA, 19 nt, Human
uaucaaagggugaaaauua

SEQ ID NO: 2737219 - RNA, 20 nt, Human
uaucacaaaucuuaacuuga

SEQ ID NO: 2737220 - RNA, 16 nt, Human
uaucacaaaucuuaac

SEQ ID NO: 2737221 - RNA, 14 nt, Human
uaucacaaaucuua

SEQ ID NO: 2737222 - RNA, 22 nt, Human
uaucacccagaagaaaauagug

SEQ ID NO: 2737223 - RNA, 19 nt, Human
uaucacccagaagaaaaua

SEQ ID NO: 2737224 - RNA, 19 nt, Human
uauccaacaucaacaucuu

SEQ ID NO: 2737225 - RNA, 17 nt, Human
uaucagaauucucagaa

SEQ ID NO: 2737226 - RNA, 14 nt, Human
acagcuguaugauu

SEQ ID NO: 2737227 - RNA, 19 nt, Human
acagcuguaugauucccag

SEQ ID NO: 2737228 - RNA, 20 nt, Human
acagcuguaugauucccagc

SEQ ID NO: 2737229 - RNA, 23 nt, Human
acagcuguaugauucccagccag

SEQ ID NO: 2737230 - RNA, 15 nt, Human
acagcuaaugggaca

SEQ ID NO: 2737231 - RNA, 16 nt, Human
acagcuaaugggacac

SEQ ID NO: 2737232 - RNA, 17 nt, Human
acagcuaaugggacacu

SEQ ID NO: 2737233 - RNA, 19 nt, Human
acagcuaaugggacacuaa

SEQ ID NO: 2737234 - RNA, 22 nt, Human
acagcuugaccgugaggccaga

SEQ ID NO: 2737235 - RNA, 23 nt, Human
acagcuugaccgugaggccagag

SEQ ID NO: 2737236 - RNA, 18 nt, Human
acaggaaaagcugcugac

SEQ ID NO: 2737237 - RNA, 19 nt, Human
acaggaaaagcugcugaca

SEQ ID NO: 2737238 - RNA, 20 nt, Human
acaggaaaagcugcugacag

SEQ ID NO: 2737239 - RNA, 21 nt, Human
acaggaaaagcugcugacagu

SEQ ID NO: 2737240 - RNA, 17 nt, Human
acagcuugaccgugagg

SEQ ID NO: 2737241 - RNA, 20 nt, Human
acagcuugaccgugaggcca

SEQ ID NO: 2737242 - RNA, 21 nt, Human
acagcuugaccgugaggccag

SEQ ID NO: 2737243 - RNA, 17 nt, Human
acagcuucauuuccugu

SEQ ID NO: 2737244 - RNA, 19 nt, Human
acagcuucauuuccugugu

SEQ ID NO: 2737245 - RNA, 21 nt, Human
acagcuucauuuccugugucu

SEQ ID NO: 2737246 - RNA, 20 nt, Human
acaggaaaauuuuaaaaaua

SEQ ID NO: 2737247 - RNA, 15 nt, Human
acaggcagauacagg

SEQ ID NO: 2737248 - RNA, 16 nt, Human
acaggcccggcuccag

SEQ ID NO: 2737249 - RNA, 17 nt, Human
acaggcccggcuccagg

SEQ ID NO: 2737250 - RNA, 18 nt, Human
acaggcccggcuccaggc

SEQ ID NO: 2737251 - RNA, 20 nt, Human
acaggcccggcuccaggcuc

SEQ ID NO: 2737252 - RNA, 21 nt, Human
acaggcccggcuccaggcucc

SEQ ID NO: 2737253 - RNA, 22 nt, Human
acaggcccggcuccaggcuccu

SEQ ID NO: 2737254 - RNA, 19 nt, Human
acagcccuucuuuccacag

SEQ ID NO: 2737255 - RNA, 21 nt, Human
uaugaaacuuguguaaauaca

SEQ ID NO: 2737256 - RNA, 19 nt, Human
uaugaaacuuguguaaaua

SEQ ID NO: 2737257 - RNA, 14 nt, Human
uaugaaacuugugu

SEQ ID NO: 2737258 - RNA, 21 nt, Human
uaugaggcauuuguuugaacu

SEQ ID NO: 2737259 - RNA, 15 nt, Human
uaugaggcauuuguu

SEQ ID NO: 2737260 - RNA, 14 nt, Human
uaugaggcauuugu

SEQ ID NO: 2737261 - RNA, 18 nt, Human
acagcaagggugauggga

SEQ ID NO: 2737262 - RNA, 15 nt, Human
acagcccgggcucug

SEQ ID NO: 2737263 - RNA, 16 nt, Human
acagcccgggcucugc

SEQ ID NO: 2737264 - RNA, 23 nt, Human
uaugcuauuucuauauuuucauu

SEQ ID NO: 2737265 - RNA, 22 nt, Human
uaugcuauuucuauauuuucau

SEQ ID NO: 2737266 - RNA, 18 nt, Human
uaugcuauuucuauauuu

SEQ ID NO: 2737267 - RNA, 16 nt, Human
uaugcuauuucuauau

SEQ ID NO: 2737268 - RNA, 15 nt, Human
uaugcuauuucuaua

SEQ ID NO: 2737269 - RNA, 14 nt, Human
uaugcuauuucuau

SEQ ID NO: 2737270 - RNA, 22 nt, Human
uaugcaugaaguaauaugcaca

SEQ ID NO: 2737271 - RNA, 16 nt, Human
uaugggacucaaugca

SEQ ID NO: 2737272 - RNA, 23 nt, Human
uaugggacucaaugcacugacau

SEQ ID NO: 2737273 - RNA, 20 nt, Human
uauggcccuggccuagcaua

SEQ ID NO: 2737274 - RNA, 21 nt, Human
uauggcccuggccuagcauac

SEQ ID NO: 2737275 - RNA, 23 nt, Human
uauggcuuuugugcauuaucuag

SEQ ID NO: 2737276 - RNA, 15 nt, Human
uagaaacacaacuau

SEQ ID NO: 2737277 - RNA, 17 nt, Human
aauuccaauuauaugag

SEQ ID NO: 2737278 - RNA, 13 nt, Human
uagacacacauga

SEQ ID NO: 2737279 - RNA, 18 nt, Human
uagacaauuuauuauggc

SEQ ID NO: 2737280 - RNA, 10 nt, Human
uagacagagu

SEQ ID NO: 2737281 - RNA, 16 nt, Human
uagacagucccugcca

SEQ ID NO: 2737282 - RNA, 22 nt, Human
uagaauuugauaugugaacagu

SEQ ID NO: 2737283 - RNA, 19 nt, Human
uagaauuugauaugugaac

SEQ ID NO: 2737284 - RNA, 20 nt, Human
uagaauuugauaugugaaca

SEQ ID NO: 2737285 - RNA, 17 nt, Human
uagacagucccugccaa

SEQ ID NO: 2737286 - RNA, 21 nt, Human
uagacagucccugccaaugga

SEQ ID NO: 2737287 - RNA, 16 nt, Human
aauuuggauugcuaau

SEQ ID NO: 2737288 - RNA, 18 nt, Human
aauuugggggaaaauuua

SEQ ID NO: 2737289 - RNA, 14 nt, Human
aauuugugauacaa

SEQ ID NO: 2737290 - RNA, 18 nt, Human
aauuugugauacaaugcu

SEQ ID NO: 2737291 - RNA, 17 nt, Human
aauuugugauacaaugc

SEQ ID NO: 2737292 - RNA, 13 nt, Human
acaaaaacacagc

SEQ ID NO: 2737293 - RNA, 20 nt, Human
aauuuuacauggcuggagcu

SEQ ID NO: 2737294 - RNA, 15 nt, Human
acaaaaacacagcaa

SEQ ID NO: 2737295 - RNA, 14 nt, Human
acaaaaacacagca

SEQ ID NO: 2737296 - RNA, 16 nt, Human
acaaaaagcuacuuau

SEQ ID NO: 2737297 - RNA, 18 nt, Human
acaaaguauuaagcauau

SEQ ID NO: 2737298 - RNA, 13 nt, Human
acaaaguauuaag

SEQ ID NO: 2737299 - RNA, 16 nt, Human
acaaaguauuaagcau

SEQ ID NO: 2737300 - RNA, 15 nt, Human
acaaaguauuaagca

SEQ ID NO: 2737301 - RNA, 22 nt, Human
uagagcggagaaaggaagggcu

SEQ ID NO: 2737302 - RNA, 14 nt, Human
uagagccagggucu

SEQ ID NO: 2737303 - RNA, 14 nt, Human
uagaggguguguaa

SEQ ID NO: 2737304 - RNA, 14 nt, Human
uagcacagacccug

SEQ ID NO: 2737305 - RNA, 15 nt, Human
uagcacagacccugc

SEQ ID NO: 2737306 - RNA, 20 nt, Human
uagcacagacccugcccugu

SEQ ID NO: 2737307 - RNA, 21 nt, Human
uagcacagacccugcccugug

SEQ ID NO: 2737308 - RNA, 12 nt, Human
uagccaaggcca

SEQ ID NO: 2737309 - RNA, 19 nt, Human
uagcacugacagauuucca

SEQ ID NO: 2737310 - RNA, 14 nt, Human
uagcacugacagau

SEQ ID NO: 2737311 - RNA, 24 nt, Human
uagcacagacccugcccugugggc

SEQ ID NO: 2737312 - RNA, 22 nt, Human
uagcacagacccugcccugugg

SEQ ID NO: 2737313 - RNA, 13 nt, Human
uagccaaggccaa

SEQ ID NO: 2737314 - RNA, 16 nt, Human
uaggaaaaacugauuu

SEQ ID NO: 2737315 - RNA, 17 nt, Human
uaggaaaaacugauuuu

SEQ ID NO: 2737316 - RNA, 13 nt, Human
uagggaagauaau

SEQ ID NO: 2737317 - RNA, 23 nt, Human
uagcuuuuuucucugauacagaa

SEQ ID NO: 2737318 - RNA, 13 nt, Human
uagcuuuuuucuc

SEQ ID NO: 2737319 - RNA, 13 nt, Human
uaggaaaaacuga

SEQ ID NO: 2737320 - RNA, 14 nt, Human
uaggaaaaacugau

SEQ ID NO: 2737321 - RNA, 17 nt, Human
uagcgcccaguugggug

SEQ ID NO: 2737322 - RNA, 14 nt, Human
uagcgcccaguugg

SEQ ID NO: 2737323 - RNA, 21 nt, Human
uagccuuagaagucacacagu

SEQ ID NO: 2737324 - RNA, 20 nt, Human
uagccuuagaagucacacag

SEQ ID NO: 2737325 - RNA, 13 nt, Human
acacaacuauauu

SEQ ID NO: 2737326 - RNA, 23 nt, Human
acaaugcaaaccaucauugaaau

SEQ ID NO: 2737327 - RNA, 19 nt, Human
acaaugcaaaccaucauug

SEQ ID NO: 2737328 - RNA, 21 nt, Human
acaaugcaaaccaucauugaa

SEQ ID NO: 2737329 - RNA, 22 nt, Human
acaaugacuuacuguacaugaa

SEQ ID NO: 2737330 - RNA, 19 nt, Human
acaaugacuuacuguacau

SEQ ID NO: 2737331 - RNA, 20 nt, Human
acaaugacuuacuguacaug

SEQ ID NO: 2737332 - RNA, 11 nt, Human
acaaugcaaac

SEQ ID NO: 2737333 - RNA, 16 nt, Human
acaaugcaaaccauca

SEQ ID NO: 2737334 - RNA, 17 nt, Human
acaaugcaaaccaucau

SEQ ID NO: 2737335 - RNA, 18 nt, Human
acaaugcaaaccaucauu

SEQ ID NO: 2737336 - RNA, 19 nt, Human
uaggguaagugagagaggg

SEQ ID NO: 2737337 - RNA, 17 nt, Human
uaggguuauaauaaugu

SEQ ID NO: 2737338 - RNA, 15 nt, Human
uaggguuauaauaau

SEQ ID NO: 2737339 - RNA, 14 nt, Human
uagucacugagaca

SEQ ID NO: 2737340 - RNA, 15 nt, Human
uaguagagacagggu

SEQ ID NO: 2737341 - RNA, 22 nt, Human
uaguagagacaggguuuugcca

SEQ ID NO: 2737342 - RNA, 14 nt, Human
uaguagagacaggg

SEQ ID NO: 2737343 - RNA, 22 nt, Human
uagguuuggacaaaauggaaua

SEQ ID NO: 2737344 - RNA, 23 nt, Human
acacaggcccggcuccaggcucc

SEQ ID NO: 2737345 - RNA, 24 nt, Human
acacaggcccggcuccaggcuccu

SEQ ID NO: 2737346 - RNA, 19 nt, Human
acacaggcccggcuccagg

SEQ ID NO: 2737347 - RNA, 20 nt, Human
acacaggcccggcuccaggc

SEQ ID NO: 2737348 - RNA, 21 nt, Human
acacaggcccggcuccaggcu

SEQ ID NO: 2737349 - RNA, 22 nt, Human
acacaggcccggcuccaggcuc

SEQ ID NO: 2737350 - RNA, 16 nt, Human
acacaggcccggcucc

SEQ ID NO: 2737351 - RNA, 17 nt, Human
acacaggcccggcucca

SEQ ID NO: 2737352 - RNA, 18 nt, Human
acacaggcccggcuccag

SEQ ID NO: 2737353 - RNA, 18 nt, Human
acuauucaaacagucuca

SEQ ID NO: 2737354 - RNA, 16 nt, Human
acuauucaaacagucu

SEQ ID NO: 2737355 - RNA, 14 nt, Human
acuauucaaacagu

SEQ ID NO: 2737356 - RNA, 13 nt, Human
acuauucaaacag

SEQ ID NO: 2737357 - RNA, 12 nt, Human
acuauguaucaa

SEQ ID NO: 2737358 - RNA, 22 nt, Human
acuaugacauaaaaacaacuuu

SEQ ID NO: 2737359 - RNA, 14 nt, Human
acuauaauguaagc

SEQ ID NO: 2737360 - RNA, 13 nt, Human
acuauaauguaag

SEQ ID NO: 2737361 - RNA, 12 nt, Human
acuauaauguaa

SEQ ID NO: 2737362 - RNA, 14 nt, Human
uccccuccucugcu

SEQ ID NO: 2737363 - RNA, 15 nt, Human
uccccuccucugcuu

SEQ ID NO: 2737364 - RNA, 18 nt, Human
uccccuccucugcuugcc

SEQ ID NO: 2737365 - RNA, 24 nt, Human
uccccuccucugcuugccaucccu

SEQ ID NO: 2737366 - RNA, 19 nt, Human
acucacauuuauucugcuc

SEQ ID NO: 2737367 - RNA, 20 nt, Human
acucacauuuauucugcuca

SEQ ID NO: 2737368 - RNA, 14 nt, Human
acucaaugcacuga

SEQ ID NO: 2737369 - RNA, 20 nt, Human
acuagaguuuagcuggaaaa

SEQ ID NO: 2737370 - RNA, 18 nt, Human
acuacggaauaguuggcu

SEQ ID NO: 2737371 - RNA, 13 nt, Human
acguacacacaca

SEQ ID NO: 2737372 - RNA, 12 nt, Human
acguacacauuu

SEQ ID NO: 2737373 - RNA, 14 nt, Human
acguacacauuuua

SEQ ID NO: 2737374 - RNA, 13 nt, Human
acguacacauuuu

SEQ ID NO: 2737375 - RNA, 21 nt, Human
acuccaaacugacucuuaaga

SEQ ID NO: 2737376 - RNA, 18 nt, Human
acucauugaccugaggcc

SEQ ID NO: 2737377 - RNA, 22 nt, Human
acucauugaccugaggcccuuc

SEQ ID NO: 2737378 - RNA, 12 nt, Human
acucaucuuagg

SEQ ID NO: 2737379 - RNA, 16 nt, Human
acucauugaccugagg

SEQ ID NO: 2737380 - RNA, 17 nt, Human
acucauugaccugaggc

SEQ ID NO: 2737381 - RNA, 21 nt, Human
acucaccugccccucaacucu

SEQ ID NO: 2737382 - RNA, 14 nt, Human
acucaccugccccu

SEQ ID NO: 2737383 - RNA, 19 nt, Human
acucaccugccccucaacu

SEQ ID NO: 2737384 - RNA, 14 nt, Human
acucagaagacacu

SEQ ID NO: 2737385 - RNA, 15 nt, Human
acucagaagacacug

SEQ ID NO: 2737386 - RNA, 16 nt, Human
acucagaagacacuga

SEQ ID NO: 2737387 - RNA, 17 nt, Human
acucagaagacacugau

SEQ ID NO: 2737388 - RNA, 14 nt, Human
acucagaauauugc

SEQ ID NO: 2737389 - RNA, 14 nt, Human
acucagaauucucu

SEQ ID NO: 2737390 - RNA, 22 nt, Human
acucagaauucucuaguuugau

SEQ ID NO: 2737391 - RNA, 21 nt, Human
acucagaauucucuaguuuga

SEQ ID NO: 2737392 - RNA, 18 nt, Human
acucagaagacacugaug

SEQ ID NO: 2737393 - RNA, 19 nt, Human
ucccuccaccucccugcaa

SEQ ID NO: 2737394 - RNA, 13 nt, Human
ucccucuuucccu

SEQ ID NO: 2737395 - RNA, 11 nt, Human
ucccucuuucc

SEQ ID NO: 2737396 - RNA, 15 nt, Human
ucccuccaccucccu

SEQ ID NO: 2737397 - RNA, 17 nt, Human
ucccuccaccucccugc

SEQ ID NO: 2737398 - RNA, 14 nt, Human
ucccuccaccuccc

SEQ ID NO: 2737399 - RNA, 20 nt, Human
ucccucagucuggcccuucc

SEQ ID NO: 2737400 - RNA, 18 nt, Human
ucccucagucuggcccuu

SEQ ID NO: 2737401 - RNA, 23 nt, Human
ucccugaaggccccgcccaggcu

SEQ ID NO: 2737402 - RNA, 17 nt, Human
acucaccccagccccaa

SEQ ID NO: 2737403 - RNA, 17 nt, Human
ucccugaaggccccgcc

SEQ ID NO: 2737404 - RNA, 18 nt, Human
ucccugaaggccccgccc

SEQ ID NO: 2737405 - RNA, 21 nt, Human
ucccugaaggccccgcccagg

SEQ ID NO: 2737406 - RNA, 22 nt, Human
ucccugaaggccccgcccaggc

SEQ ID NO: 2737407 - RNA, 14 nt, Human
acuccagaaaguga

SEQ ID NO: 2737408 - RNA, 16 nt, Human
uccgugcuaaggacuu

SEQ ID NO: 2737409 - RNA, 18 nt, Human
uccgugcuaaggacuugu

SEQ ID NO: 2737410 - RNA, 17 nt, Human
uccgugcuaaggacuug

SEQ ID NO: 2737411 - RNA, 23 nt, Human
uccgugcuaaggacuuguuagau

SEQ ID NO: 2737412 - RNA, 13 nt, Human
uccguuaaaauac

SEQ ID NO: 2737413 - RNA, 15 nt, Human
uccguuaaaauacca

SEQ ID NO: 2737414 - RNA, 16 nt, Human
acucgaguuacagaca

SEQ ID NO: 2737415 - RNA, 12 nt, Human
uccuacucugug

SEQ ID NO: 2737416 - RNA, 21 nt, Human
uccuagccugugccucuggga

SEQ ID NO: 2737417 - RNA, 15 nt, Human
acucgcgacaaugca

SEQ ID NO: 2737418 - RNA, 16 nt, Human
acucgcgacaaugcaa

SEQ ID NO: 2737419 - RNA, 16 nt, Human
acucuggcagcucaga

SEQ ID NO: 2737420 - RNA, 17 nt, Human
acucuggcagcucagag

SEQ ID NO: 2737421 - RNA, 21 nt, Human
acucuuauugcccacgcugga

SEQ ID NO: 2737422 - RNA, 19 nt, Human
acucuggcagcucagagag

SEQ ID NO: 2737423 - RNA, 20 nt, Human
acucuggcagcucagagagg

SEQ ID NO: 2737424 - RNA, 21 nt, Human
uccugaaaacccuugccaugu

SEQ ID NO: 2737425 - RNA, 22 nt, Human
uccugaaaacccuugccaugug

SEQ ID NO: 2737426 - RNA, 23 nt, Human
uccucuuuggucuacacugugcu

SEQ ID NO: 2737427 - RNA, 15 nt, Human
uccugaagaauugaa

SEQ ID NO: 2737428 - RNA, 19 nt, Human
acucuuucuauuguuucuu

SEQ ID NO: 2737429 - RNA, 13 nt, Human
acugaaacuuccc

SEQ ID NO: 2737430 - RNA, 17 nt, Human
uccucuccccaugaugu

SEQ ID NO: 2737431 - RNA, 21 nt, Human
uccucccaccucagccucccg

SEQ ID NO: 2737432 - RNA, 13 nt, Human
uccucccaccuca

SEQ ID NO: 2737433 - RNA, 14 nt, Human
uccucccaccucag

SEQ ID NO: 2737434 - RNA, 15 nt, Human
uccucccaccucagc

SEQ ID NO: 2737435 - RNA, 16 nt, Human
uccucccaccucagcc

SEQ ID NO: 2737436 - RNA, 18 nt, Human
uccucccaccucagccuc

SEQ ID NO: 2737437 - RNA, 20 nt, Human
uccucccaccucagccuccc

SEQ ID NO: 2737438 - RNA, 16 nt, Human
ucauaauaaguugcau

SEQ ID NO: 2737439 - RNA, 12 nt, Human
ucauaaugacuu

SEQ ID NO: 2737440 - RNA, 18 nt, Human
accugaagacucauucuu

SEQ ID NO: 2737441 - RNA, 19 nt, Human
accugaauuuuggcugugu

SEQ ID NO: 2737442 - RNA, 23 nt, Human
accugaggcccuucucuccagcc

SEQ ID NO: 2737443 - RNA, 14 nt, Human
accugaggggccuc

SEQ ID NO: 2737444 - RNA, 16 nt, Human
accugaggggccucuu

SEQ ID NO: 2737445 - RNA, 16 nt, Human
accugccaggaagcca

SEQ ID NO: 2737446 - RNA, 17 nt, Human
accugccaggaagccag

SEQ ID NO: 2737447 - RNA, 18 nt, Human
accugccaggaagccagc

SEQ ID NO: 2737448 - RNA, 16 nt, Human
ucauuugucacacacu

SEQ ID NO: 2737449 - RNA, 14 nt, Human
ucauuugucacaca

SEQ ID NO: 2737450 - RNA, 19 nt, Human
ucauuuuuaguagagacag

SEQ ID NO: 2737451 - RNA, 18 nt, Human
ucauuuuuuuuaagaaaa

SEQ ID NO: 2737452 - RNA, 17 nt, Human
ucauuuuuuuuaagaaa

SEQ ID NO: 2737453 - RNA, 19 nt, Human
uccaaaaagauuuucagaa

SEQ ID NO: 2737454 - RNA, 21 nt, Human
accugcgucucauacucaccu

SEQ ID NO: 2737455 - RNA, 16 nt, Human
accugcggugcuaucu

SEQ ID NO: 2737456 - RNA, 23 nt, Human
accugccuguugggccaggagcc

SEQ ID NO: 2737457 - RNA, 20 nt, Human
accuggaauauauaaccagu

SEQ ID NO: 2737458 - RNA, 20 nt, Human
uccaaaaagauuuucagaaa

SEQ ID NO: 2737459 - RNA, 20 nt, Human
uccacccaggagccccgagg

SEQ ID NO: 2737460 - RNA, 12 nt, Human
uccacccaccuc

SEQ ID NO: 2737461 - RNA, 18 nt, Human
uccaccaucaagccacca

SEQ ID NO: 2737462 - RNA, 13 nt, Human
uccacccaccuca

SEQ ID NO: 2737463 - RNA, 17 nt, Human
uccacccaggagccccg

SEQ ID NO: 2737464 - RNA, 12 nt, Human
accuggccucug

SEQ ID NO: 2737465 - RNA, 13 nt, Human
accuggccucugc

SEQ ID NO: 2737466 - RNA, 21 nt, Human
accuggguaacuagggaagau

SEQ ID NO: 2737467 - RNA, 14 nt, Human
accuucuccuucac

SEQ ID NO: 2737468 - RNA, 22 nt, Human
accuucuccuucaccuuugucc

SEQ ID NO: 2737469 - RNA, 16 nt, Human
accuugacagggcaca

SEQ ID NO: 2737470 - RNA, 13 nt, Human
accuuugucccca

SEQ ID NO: 2737471 - RNA, 18 nt, Human
accuuuuuuauacauaaa

SEQ ID NO: 2737472 - RNA, 17 nt, Human
accuuuuuuauacauaa

SEQ ID NO: 2737473 - RNA, 16 nt, Human
accuuuuuuauacaua

SEQ ID NO: 2737474 - RNA, 14 nt, Human
accuuuguccccac

SEQ ID NO: 2737475 - RNA, 15 nt, Human
accuuuguccccacc

SEQ ID NO: 2737476 - RNA, 16 nt, Human
accuuuguccccaccg

SEQ ID NO: 2737477 - RNA, 14 nt, Human
accuuuuuuauaca

SEQ ID NO: 2737478 - RNA, 19 nt, Human
acggagucccaccuuggcu

SEQ ID NO: 2737479 - RNA, 13 nt, Human
acggccaggccag

SEQ ID NO: 2737480 - RNA, 16 nt, Human
acggccaggccagagg

SEQ ID NO: 2737481 - RNA, 21 nt, Human
acggagucccaccuuggcugc

SEQ ID NO: 2737482 - RNA, 14 nt, Human
acggaugauuucua

SEQ ID NO: 2737483 - RNA, 15 nt, Human
acggaugauuucuau

SEQ ID NO: 2737484 - RNA, 18 nt, Human
acgcuacccgggaagggg

SEQ ID NO: 2737485 - RNA, 13 nt, Human
acgcuacccggga

SEQ ID NO: 2737486 - RNA, 17 nt, Human
acgcuacccgggaaggg

SEQ ID NO: 2737487 - RNA, 20 nt, Human
acgcguugaaauuguaauua

SEQ ID NO: 2737488 - RNA, 18 nt, Human
acgcguugaaauuguaau

SEQ ID NO: 2737489 - RNA, 14 nt, Human
acgcguugaaauug

SEQ ID NO: 2737490 - RNA, 13 nt, Human
acgcguugaaauu

SEQ ID NO: 2737491 - RNA, 14 nt, Human
acgcccccacuggu

SEQ ID NO: 2737492 - RNA, 20 nt, Human
acgcgugcacacaccagagc

SEQ ID NO: 2737493 - RNA, 23 nt, Human
acgcgugcacacaccagagccca

SEQ ID NO: 2737494 - RNA, 15 nt, Human
acgacugcccggcag

SEQ ID NO: 2737495 - RNA, 18 nt, Human
acgccaggggaaaaucag

SEQ ID NO: 2737496 - RNA, 18 nt, Human
acgccaucccagccccaa

SEQ ID NO: 2737497 - RNA, 16 nt, Human
acgccaucccagcccc

SEQ ID NO: 2737498 - RNA, 17 nt, Human
acgccaucccagcccca

SEQ ID NO: 2737499 - RNA, 23 nt, Human
acgccaggggaaaaucagccugc

SEQ ID NO: 2737500 - RNA, 11 nt, Human
acgccauccca

SEQ ID NO: 2737501 - RNA, 14 nt, Human
acgccaucccagcc

SEQ ID NO: 2737502 - RNA, 15 nt, Human
acgccaucccagccc

SEQ ID NO: 2737503 - RNA, 18 nt, Human
uccaggcugggagagccu

SEQ ID NO: 2737504 - RNA, 14 nt, Human
uccaggcugggaga

SEQ ID NO: 2737505 - RNA, 17 nt, Human
uccaggcugggagagcc

SEQ ID NO: 2737506 - RNA, 22 nt, Human
acgaagaguauuuuugacagaa

SEQ ID NO: 2737507 - RNA, 20 nt, Human
acgaagaguauuuuugacag

SEQ ID NO: 2737508 - RNA, 17 nt, Human
uccagugaggcucugcc

SEQ ID NO: 2737509 - RNA, 18 nt, Human
uccagugaggcucugccc

SEQ ID NO: 2737510 - RNA, 19 nt, Human
uccagugaggcucugcccu

SEQ ID NO: 2737511 - RNA, 20 nt, Human
uccagugaggcucugcccuu

SEQ ID NO: 2737512 - RNA, 14 nt, Human
acggcucacugcag

SEQ ID NO: 2737513 - RNA, 15 nt, Human
acggcucacugcagc

SEQ ID NO: 2737514 - RNA, 15 nt, Human
uccaugaguccccug

SEQ ID NO: 2737515 - RNA, 16 nt, Human
uccaugaguccccugu

SEQ ID NO: 2737516 - RNA, 17 nt, Human
uccaugaguccccuguu

SEQ ID NO: 2737517 - RNA, 12 nt, Human
uccauuuaauaa

SEQ ID NO: 2737518 - RNA, 11 nt, Human
ucccaccccac

SEQ ID NO: 2737519 - RNA, 14 nt, Human
ucccaccccacaca

SEQ ID NO: 2737520 - RNA, 14 nt, Human
ucccacaaaggaga

SEQ ID NO: 2737521 - RNA, 15 nt, Human
ucccaaagugcuggg

SEQ ID NO: 2737522 - RNA, 16 nt, Human
ucccaaagugcuggga

SEQ ID NO: 2737523 - RNA, 20 nt, Human
uccauuuggaaaucuuuaaa

SEQ ID NO: 2737524 - RNA, 19 nt, Human
uccauuuggaaaucuuuaa

SEQ ID NO: 2737525 - RNA, 12 nt, Human
uccauuuggaaa

SEQ ID NO: 2737526 - RNA, 17 nt, Human
uccauuuaauaauuaua

SEQ ID NO: 2737527 - RNA, 23 nt, Human
ucaauauuucagauaaucacaau

SEQ ID NO: 2737528 - RNA, 22 nt, Human
ucaauaggaaaaacugauuuuu

SEQ ID NO: 2737529 - RNA, 16 nt, Human
ucaagugauucuccug

SEQ ID NO: 2737530 - RNA, 17 nt, Human
ucaagugauucuccugc

SEQ ID NO: 2737531 - RNA, 17 nt, Human
ucaauaggaaaaacuga

SEQ ID NO: 2737532 - RNA, 18 nt, Human
ucaauaggaaaaacugau

SEQ ID NO: 2737533 - RNA, 19 nt, Human
ucaauaggaaaaacugauu

SEQ ID NO: 2737534 - RNA, 23 nt, Human
ucaaggauccugagccagauuuc

SEQ ID NO: 2737535 - RNA, 17 nt, Human
ucaagagggucugagga

SEQ ID NO: 2737536 - RNA, 23 nt, Human
acauuuuucuuagggaaggauac

SEQ ID NO: 2737537 - RNA, 13 nt, Human
acauuuuucuuag

SEQ ID NO: 2737538 - RNA, 18 nt, Human
acauuuuuaagugcugca

SEQ ID NO: 2737539 - RNA, 15 nt, Human
acauuuuuaagugcu

SEQ ID NO: 2737540 - RNA, 21 nt, Human
acauugcggacagccacggcc

SEQ ID NO: 2737541 - RNA, 22 nt, Human
acauugcggacagccacggcca

SEQ ID NO: 2737542 - RNA, 16 nt, Human
acauuggaaacaaguc

SEQ ID NO: 2737543 - RNA, 19 nt, Human
acauuguacgaagaguauu

SEQ ID NO: 2737544 - RNA, 17 nt, Human
acauuguaaauaguauu

SEQ ID NO: 2737545 - RNA, 19 nt, Human
acauuguaaauaguauuug

SEQ ID NO: 2737546 - RNA, 21 nt, Human
acauuguaaauaguauuugag

SEQ ID NO: 2737547 - RNA, 23 nt, Human
acauugguguuguacucaauuuu

SEQ ID NO: 2737548 - RNA, 22 nt, Human
acauugguguuguacucaauuu

SEQ ID NO: 2737549 - RNA, 16 nt, Human
acauugguguuguacu

SEQ ID NO: 2737550 - RNA, 14 nt, Human
acauugguguugua

SEQ ID NO: 2737551 - RNA, 16 nt, Human
ucacagaccuuugaac

SEQ ID NO: 2737552 - RNA, 23 nt, Human
ucacagccagacuggcacaguuu

SEQ ID NO: 2737553 - RNA, 17 nt, Human
ucacagccagacuggca

SEQ ID NO: 2737554 - RNA, 19 nt, Human
ucacagcuccaagaauuuc

SEQ ID NO: 2737555 - RNA, 14 nt, Human
ucacagaugggugc

SEQ ID NO: 2737556 - RNA, 15 nt, Human
ucacagaugggugcu

SEQ ID NO: 2737557 - RNA, 16 nt, Human
ucacauauugauuucc

SEQ ID NO: 2737558 - RNA, 20 nt, Human
ucacauauugauuuccguua

SEQ ID NO: 2737559 - RNA, 18 nt, Human
ucacauauugauuuccgu

SEQ ID NO: 2737560 - RNA, 17 nt, Human
ucacauuccugaacagg

SEQ ID NO: 2737561 - RNA, 13 nt, Human
ucacauuccugaa

SEQ ID NO: 2737562 - RNA, 17 nt, Human
ucaccagccccagugcc

SEQ ID NO: 2737563 - RNA, 16 nt, Human
ucaccagccccagugc

SEQ ID NO: 2737564 - RNA, 16 nt, Human
accacaagacugcaca

SEQ ID NO: 2737565 - RNA, 17 nt, Human
accacacagaggcugcc

SEQ ID NO: 2737566 - RNA, 15 nt, Human
accacacccagccca

SEQ ID NO: 2737567 - RNA, 16 nt, Human
accacacccagcccac

SEQ ID NO: 2737568 - RNA, 20 nt, Human
accacacccagcccacuucu

SEQ ID NO: 2737569 - RNA, 21 nt, Human
accacacccagcccacuucug

SEQ ID NO: 2737570 - RNA, 23 nt, Human
accacacccagcccacuucugcc

SEQ ID NO: 2737571 - RNA, 19 nt, Human
accaacacgagcaggcuac

SEQ ID NO: 2737572 - RNA, 14 nt, Human
accaacacgagcag

SEQ ID NO: 2737573 - RNA, 16 nt, Human
accaacauacucccau

SEQ ID NO: 2737574 - RNA, 20 nt, Human
accaaccacugcgaccacaa

SEQ ID NO: 2737575 - RNA, 19 nt, Human
accaaaucagcugcuacua

SEQ ID NO: 2737576 - RNA, 16 nt, Human
accaaaucagcugcua

SEQ ID NO: 2737577 - RNA, 13 nt, Human
accaaaaaccagu

SEQ ID NO: 2737578 - RNA, 12 nt, Human
accaaaaaccag

SEQ ID NO: 2737579 - RNA, 16 nt, Human
accaaauaaaaauauu

SEQ ID NO: 2737580 - RNA, 18 nt, Human
accaaauaaaaauauugu

SEQ ID NO: 2737581 - RNA, 18 nt, Human
uauuuuaaaagaaugauu

SEQ ID NO: 2737582 - RNA, 14 nt, Human
uauuuuaaaagaau

SEQ ID NO: 2737583 - RNA, 15 nt, Human
acaugaaaacacauu

SEQ ID NO: 2737584 - RNA, 14 nt, Human
uauguguaaaaugu

SEQ ID NO: 2737585 - RNA, 17 nt, Human
uauguguaaaaugugaa

SEQ ID NO: 2737586 - RNA, 15 nt, Human
acaucuugcucugcu

SEQ ID NO: 2737587 - RNA, 16 nt, Human
acaucuugcucugcug

SEQ ID NO: 2737588 - RNA, 14 nt, Human
acaucuugcucugc

SEQ ID NO: 2737589 - RNA, 19 nt, Human
acaucuuggucagauuuga

SEQ ID NO: 2737590 - RNA, 22 nt, Human
acaucuugcucugcugacagac

SEQ ID NO: 2737591 - RNA, 17 nt, Human
acaucuugcucugcuga

SEQ ID NO: 2737592 - RNA, 19 nt, Human
uauuuuaauaauguuucaa

SEQ ID NO: 2737593 - RNA, 22 nt, Human
uauuuuaauaauguuucaaaca

SEQ ID NO: 2737594 - RNA, 13 nt, Human
uauuuuacauaaa

SEQ ID NO: 2737595 - RNA, 15 nt, Human
uauuuugcuuuguga

SEQ ID NO: 2737596 - RNA, 13 nt, Human
uauuuugcuuugu

SEQ ID NO: 2737597 - RNA, 20 nt, Human
uauuuugcuuugugauuuuu

SEQ ID NO: 2737598 - RNA, 13 nt, Human
uauuuuuguagca

SEQ ID NO: 2737599 - RNA, 17 nt, Human
uauuuuuguagagccag

SEQ ID NO: 2737600 - RNA, 12 nt, Human
uauuuuucacau

SEQ ID NO: 2737601 - RNA, 13 nt, Human
uauuuuucacaua

SEQ ID NO: 2737602 - RNA, 15 nt, Human
uauuuuguucauaca

SEQ ID NO: 2737603 - RNA, 16 nt, Human
uauuuuguucauacau

SEQ ID NO: 2737604 - RNA, 21 nt, Human
ucaaacagucucaggaaauca

SEQ ID NO: 2737605 - RNA, 20 nt, Human
ucaaacagucucaggaaauc

SEQ ID NO: 2737606 - RNA, 13 nt, Human
ucaaacagucuca

SEQ ID NO: 2737607 - RNA, 16 nt, Human
ucaaaagcugggcagg

SEQ ID NO: 2737608 - RNA, 15 nt, Human
uauuuuuguagcacu

SEQ ID NO: 2737609 - RNA, 19 nt, Human
uauuuuuguagcacugaca

SEQ ID NO: 2737610 - RNA, 22 nt, Human
ucaaagauauuuugcuuuguga

SEQ ID NO: 2737611 - RNA, 20 nt, Human
ucaaagauauuuugcuuugu

SEQ ID NO: 2737612 - RNA, 13 nt, Human
ucaaagauauuuu

SEQ ID NO: 2737613 - RNA, 23 nt, Human
ucaaauacgugggcauucaaaug

SEQ ID NO: 2737614 - RNA, 20 nt, Human
ucaaauacgugggcauucaa

SEQ ID NO: 2737615 - RNA, 15 nt, Human
ucaaaguugccuaaa

SEQ ID NO: 2737616 - RNA, 22 nt, Human
ucaaauacgugggcauucaaau

SEQ ID NO: 2737617 - RNA, 21 nt, Human
ucaaauacgugggcauucaaa

SEQ ID NO: 2737618 - RNA, 13 nt, Human
acaugagcaucag

SEQ ID NO: 2737619 - RNA, 22 nt, Human
acaugaaaacacauuuuucuua

SEQ ID NO: 2737620 - RNA, 23 nt, Human
acaugaaaacacauuuuucuuag

SEQ ID NO: 2737621 - RNA, 19 nt, Human
acauggaguauaugucaag

SEQ ID NO: 2737622 - RNA, 15 nt, Human
acauggaguauaugu

SEQ ID NO: 2737623 - RNA, 23 nt, Human
acaugagcaucaggccaggcccu

SEQ ID NO: 2737624 - RNA, 18 nt, Human
acauggaauaacauguaa

SEQ ID NO: 2737625 - RNA, 14 nt, Human
acauggaaguacua

SEQ ID NO: 2737626 - RNA, 20 nt, Human
acauggaauaacauguaauu

SEQ ID NO: 2737627 - RNA, 21 nt, Human
acaugucuuuucuugcaugag

SEQ ID NO: 2737628 - RNA, 19 nt, Human
ucagugccuuauggaacac

SEQ ID NO: 2737629 - RNA, 20 nt, Human
ucagugccuuauggaacacu

SEQ ID NO: 2737630 - RNA, 22 nt, Human
ucagugccuuauggaacacucu

SEQ ID NO: 2737631 - RNA, 23 nt, Human
ucagugccuuauggaacacucug

SEQ ID NO: 2737632 - RNA, 14 nt, Human
ucaguggcagcugc

SEQ ID NO: 2737633 - RNA, 15 nt, Human
ucaguggcagcugcu

SEQ ID NO: 2737634 - RNA, 17 nt, Human
ucaguuguuaguguguc

SEQ ID NO: 2737635 - RNA, 16 nt, Human
ucaguggcagcugcuu

SEQ ID NO: 2737636 - RNA, 13 nt, Human
ucaguggcagcug

SEQ ID NO: 2737637 - RNA, 19 nt, Human
ucaguuguuagugugucuu

SEQ ID NO: 2737638 - RNA, 22 nt, Human
ucaggugucccugcacuugcag

SEQ ID NO: 2737639 - RNA, 13 nt, Human
ucaguaagccgug

SEQ ID NO: 2737640 - RNA, 13 nt, Human
ucaguaauaacuc

SEQ ID NO: 2737641 - RNA, 20 nt, Human
acccuugccgucuaccugag

SEQ ID NO: 2737642 - RNA, 20 nt, Human
accgaaaacguggcugcuuc

SEQ ID NO: 2737643 - RNA, 15 nt, Human
ucaggugucccugca

SEQ ID NO: 2737644 - RNA, 23 nt, Human
ucagguggggucacucuggcagc

SEQ ID NO: 2737645 - RNA, 17 nt, Human
ucaggugucccugcacu

SEQ ID NO: 2737646 - RNA, 18 nt, Human
ucaggugucccugcacuu

SEQ ID NO: 2737647 - RNA, 22 nt, Human
ucagguggggucacucuggcag

SEQ ID NO: 2737648 - RNA, 21 nt, Human
accgaacugauguaaguaaac

SEQ ID NO: 2737649 - RNA, 21 nt, Human
accgaaaacguggcugcuuca

SEQ ID NO: 2737650 - RNA, 22 nt, Human
accgaaaacguggcugcuucaa

SEQ ID NO: 2737651 - RNA, 19 nt, Human
acccgcuaagagggaggga

SEQ ID NO: 2737652 - RNA, 18 nt, Human
ucaggguuggccccugcc

SEQ ID NO: 2737653 - RNA, 19 nt, Human
ucaggguuggccccugccc

SEQ ID NO: 2737654 - RNA, 12 nt, Human
ucaggggugugc

SEQ ID NO: 2737655 - RNA, 19 nt, Human
ucaggggugugcggccuuu

SEQ ID NO: 2737656 - RNA, 23 nt, Human
ucaggggugugcggccuuuggcu

SEQ ID NO: 2737657 - RNA, 17 nt, Human
ucaggguuggccccugc

SEQ ID NO: 2737658 - RNA, 19 nt, Human
ucaggccaggcccucugcc

SEQ ID NO: 2737659 - RNA, 17 nt, Human
ucaggccaggcccucug

SEQ ID NO: 2737660 - RNA, 18 nt, Human
ucaggccaggcccucugc

SEQ ID NO: 2737661 - RNA, 17 nt, Human
ucaggcaggugggaugg

SEQ ID NO: 2737662 - RNA, 18 nt, Human
ucaggcaggugggaugga

SEQ ID NO: 2737663 - RNA, 13 nt, Human
acccccagccugc

SEQ ID NO: 2737664 - RNA, 12 nt, Human
acccccagccug

SEQ ID NO: 2737665 - RNA, 13 nt, Human
ucaggccagcugc

SEQ ID NO: 2737666 - RNA, 12 nt, Human
ucaggccaggcc

SEQ ID NO: 2737667 - RNA, 13 nt, Human
ucaggccaggccc

SEQ ID NO: 2737668 - RNA, 14 nt, Human
ucaggccaggcccu

SEQ ID NO: 2737669 - RNA, 15 nt, Human
ucaggccaggcccuc

SEQ ID NO: 2737670 - RNA, 16 nt, Human
ucaggccaggcccucu

SEQ ID NO: 2737671 - RNA, 21 nt, Human
acccuccuuucaccacaugug

SEQ ID NO: 2737672 - RNA, 19 nt, Human
acccgggaagggggcuggg

SEQ ID NO: 2737673 - RNA, 20 nt, Human
acccgggaagggggcuggga

SEQ ID NO: 2737674 - RNA, 17 nt, Human
acccucauguucuuaau

SEQ ID NO: 2737675 - RNA, 15 nt, Human
acccucauguucuua

SEQ ID NO: 2737676 - RNA, 14 nt, Human
acccucauguucuu

SEQ ID NO: 2737677 - RNA, 22 nt, Human
acccgggaagggggcugggaca

SEQ ID NO: 2737678 - RNA, 11 nt, Human
acccugaggcc

SEQ ID NO: 2737679 - RNA, 17 nt, Human
acccugaggcccagagg

SEQ ID NO: 2737680 - RNA, 13 nt, Human
acccugaggccca

SEQ ID NO: 2737681 - RNA, 19 nt, Human
acccugaggcccagagggc

SEQ ID NO: 2737682 - RNA, 21 nt, Human
acccugaggcccagagggccu

SEQ ID NO: 2737683 - RNA, 23 nt, Human
acccugaggcccagagggccugc

SEQ ID NO: 2737684 - RNA, 17 nt, Human
ucagagcugcccucucc

SEQ ID NO: 2737685 - RNA, 15 nt, Human
ucagagcugcccucu

SEQ ID NO: 2737686 - RNA, 16 nt, Human
ucagagcugcccucuc

SEQ ID NO: 2737687 - RNA, 16 nt, Human
ucagaucucuaacuuc

SEQ ID NO: 2737688 - RNA, 15 nt, Human
ucagaucucuaacuu

SEQ ID NO: 2737689 - RNA, 13 nt, Human
ucagaucugccua

SEQ ID NO: 2737690 - RNA, 20 nt, Human
ucagaucugccuaaggacuu

SEQ ID NO: 2737691 - RNA, 18 nt, Human
ucagaucugccuaaggac

SEQ ID NO: 2737692 - RNA, 15 nt, Human
ucagaucugccuaag

SEQ ID NO: 2737693 - RNA, 13 nt, Human
ucagagcugcccu

SEQ ID NO: 2737694 - RNA, 14 nt, Human
ucagagcugcccuc

SEQ ID NO: 2737695 - RNA, 23 nt, Human
ucagagacuccugcaggcagcca

SEQ ID NO: 2737696 - RNA, 15 nt, Human
acccagcccacuucu

SEQ ID NO: 2737697 - RNA, 23 nt, Human
ucagaaguuucugccgcagcccu

SEQ ID NO: 2737698 - RNA, 22 nt, Human
ucagagacuccugcaggcagcc

SEQ ID NO: 2737699 - RNA, 20 nt, Human
ucagaauucucagaaucuca

SEQ ID NO: 2737700 - RNA, 12 nt, Human
ucagaauucuca

SEQ ID NO: 2737701 - RNA, 10 nt, Human
ucagaauucu

SEQ ID NO: 2737702 - RNA, 13 nt, Human
acccagcgagccc

SEQ ID NO: 2737703 - RNA, 16 nt, Human
acccagcgagcccugg

SEQ ID NO: 2737704 - RNA, 17 nt, Human
acccagcgagcccuggu

SEQ ID NO: 2737705 - RNA, 13 nt, Human
acccaggagcccc

SEQ ID NO: 2737706 - RNA, 15 nt, Human
acccaggagccccga

SEQ ID NO: 2737707 - RNA, 11 nt, Human
acccaggugcu

SEQ ID NO: 2737708 - RNA, 23 nt, Human
acccaggugcuaggaacacuccu

SEQ ID NO: 2737709 - RNA, 13 nt, Human
accccagguuucu

SEQ ID NO: 2737710 - RNA, 20 nt, Human
acccacugcuuuuggucugu

SEQ ID NO: 2737711 - RNA, 22 nt, Human
accauuuugcugucccuuuucc

SEQ ID NO: 2737712 - RNA, 21 nt, Human
accauuuugggguacccacug

SEQ ID NO: 2737713 - RNA, 23 nt, Human
accauuuugcugucccuuuuccu

SEQ ID NO: 2737714 - RNA, 19 nt, Human
accauucuccaccugccag

SEQ ID NO: 2737715 - RNA, 20 nt, Human
accauucuccaccugccagg

SEQ ID NO: 2737716 - RNA, 21 nt, Human
accauucuccaccugccaggg

SEQ ID NO: 2737717 - RNA, 18 nt, Human
accaugggauaaaugcca

SEQ ID NO: 2737718 - RNA, 17 nt, Human
accaugggauaaaugcc

SEQ ID NO: 2737719 - RNA, 18 nt, Human
ucacugcaaccuccgccu

SEQ ID NO: 2737720 - RNA, 14 nt, Human
ucacuguugcccag

SEQ ID NO: 2737721 - RNA, 15 nt, Human
ucacuguugcccagg

SEQ ID NO: 2737722 - RNA, 22 nt, Human
ucaccagccccagugcccacag

SEQ ID NO: 2737723 - RNA, 19 nt, Human
ucacauuccugaacaggau

SEQ ID NO: 2737724 - RNA, 21 nt, Human
ucacuauguugcccaggcagg

SEQ ID NO: 2737725 - RNA, 23 nt, Human
ucacugagacagcccgggcucug

SEQ ID NO: 2737726 - RNA, 13 nt, Human
acuguggguagac

SEQ ID NO: 2737727 - RNA, 21 nt, Human
acuguuaauaguucagguaac

SEQ ID NO: 2737728 - RNA, 17 nt, Human
acuguuaauaguucagg

SEQ ID NO: 2737729 - RNA, 23 nt, Human
ucgucacugcuuaacuucacaua

SEQ ID NO: 2737730 - RNA, 17 nt, Human
ucuaccaaaaaucucaa

SEQ ID NO: 2737731 - RNA, 21 nt, Human
ucuacccucuuagaaaaacca

SEQ ID NO: 2737732 - RNA, 21 nt, Human
ucuaagauaguaacaaugaag

SEQ ID NO: 2737733 - RNA, 17 nt, Human
ucuaaagcugccagccg

SEQ ID NO: 2737734 - RNA, 16 nt, Human
ucuaaaggcuaccuuu

SEQ ID NO: 2737735 - RNA, 13 nt, Human
ucuaaaggcuacc

SEQ ID NO: 2737736 - RNA, 23 nt, Human
acugucagcuccccucggagaag

SEQ ID NO: 2737737 - RNA, 22 nt, Human
acugucagcuccccucggagaa

SEQ ID NO: 2737738 - RNA, 20 nt, Human
acuguaucaugacaaagacu

SEQ ID NO: 2737739 - RNA, 16 nt, Human
acuguaucaugacaaa

SEQ ID NO: 2737740 - RNA, 16 nt, Human
acuguacaugaaaaca

SEQ ID NO: 2737741 - RNA, 19 nt, Human
acuguacaugaaaacacau

SEQ ID NO: 2737742 - RNA, 22 nt, Human
acuguacaaaguagaagucuua

SEQ ID NO: 2737743 - RNA, 16 nt, Human
acuguacaaaguagaa

SEQ ID NO: 2737744 - RNA, 17 nt, Human
acuggguacuuguggac

SEQ ID NO: 2737745 - RNA, 18 nt, Human
acuggguacuuguggaca

SEQ ID NO: 2737746 - RNA, 14 nt, Human
acuguaucaugaca

SEQ ID NO: 2737747 - RNA, 21 nt, Human
acuguacaugaaaacacauuu

SEQ ID NO: 2737748 - RNA, 20 nt, Human
acuguacaugaaaacacauu

SEQ ID NO: 2737749 - RNA, 22 nt, Human
acugaagaagcaccaaucauga

SEQ ID NO: 2737750 - RNA, 14 nt, Human
ucgcuccugugucu

SEQ ID NO: 2737751 - RNA, 21 nt, Human
acugggcuuggggaccagagc

SEQ ID NO: 2737752 - RNA, 15 nt, Human
acuggguacuugugg

SEQ ID NO: 2737753 - RNA, 23 nt, Human
ucgcugugucagcauagaaguaa

SEQ ID NO: 2737754 - RNA, 19 nt, Human
acuugagaauuacccuuuu

SEQ ID NO: 2737755 - RNA, 14 nt, Human
acuugucuuuggac

SEQ ID NO: 2737756 - RNA, 14 nt, Human
acuuggaagcuccg

SEQ ID NO: 2737757 - RNA, 17 nt, Human
ucucaaaacugcacugu

SEQ ID NO: 2737758 - RNA, 16 nt, Human
ucucaaaaaaagaaaa

SEQ ID NO: 2737759 - RNA, 16 nt, Human
ucuauuguuucuuuca

SEQ ID NO: 2737760 - RNA, 21 nt, Human
acuucuaaguaaaaccacagc

SEQ ID NO: 2737761 - RNA, 18 nt, Human
acuucuccacccugcucu

SEQ ID NO: 2737762 - RNA, 13 nt, Human
acuucuaaguaaa

SEQ ID NO: 2737763 - RNA, 19 nt, Human
acuucuaaguaaaaccaca

SEQ ID NO: 2737764 - RNA, 18 nt, Human
acuucuaaguaaaaccac

SEQ ID NO: 2737765 - RNA, 17 nt, Human
acuucgggaggucgagg

SEQ ID NO: 2737766 - RNA, 20 nt, Human
acuucgggaggucgaggcag

SEQ ID NO: 2737767 - RNA, 22 nt, Human
acuucccuuucugcuuguguua

SEQ ID NO: 2737768 - RNA, 14 nt, Human
acuucccuuucugc

SEQ ID NO: 2737769 - RNA, 17 nt, Human
ucuagcauggcauauuu

SEQ ID NO: 2737770 - RNA, 18 nt, Human
ucuagcauggcauauuuu

SEQ ID NO: 2737771 - RNA, 24 nt, Human
ucuagauacuguaucaugacaaag

SEQ ID NO: 2737772 - RNA, 17 nt, Human
acuucccagugaauucu

SEQ ID NO: 2737773 - RNA, 13 nt, Human
ucuauaauuuaaa

SEQ ID NO: 2737774 - RNA, 12 nt, Human
ucuaguucacuc

SEQ ID NO: 2737775 - RNA, 22 nt, Human
ucuaguuugauuaaauucuugc

SEQ ID NO: 2737776 - RNA, 23 nt, Human
ucuaguuugauuaaauucuugca

SEQ ID NO: 2737777 - RNA, 19 nt, Human
ucuaguucacucuccauuu

SEQ ID NO: 2737778 - RNA, 16 nt, Human
ucuaguucacucucca

SEQ ID NO: 2737779 - RNA, 20 nt, Human
acuuccagauccuggaaauc

SEQ ID NO: 2737780 - RNA, 18 nt, Human
acuuccaauuuacauacu

SEQ ID NO: 2737781 - RNA, 17 nt, Human
acuuccacugccauccu

SEQ ID NO: 2737782 - RNA, 12 nt, Human
ucuaccugaggg

SEQ ID NO: 2737783 - RNA, 19 nt, Human
ucuaccugaggggccucuu

SEQ ID NO: 2737784 - RNA, 20 nt, Human
acuuagagguggggagcaga

SEQ ID NO: 2737785 - RNA, 15 nt, Human
acuuacuguacauga

SEQ ID NO: 2737786 - RNA, 14 nt, Human
acuuacuguacaug

SEQ ID NO: 2737787 - RNA, 13 nt, Human
acuuacuguacau

SEQ ID NO: 2737788 - RNA, 16 nt, Human
agaaagacuauucaaa

SEQ ID NO: 2737789 - RNA, 22 nt, Human
agaaagacuaucuaaauguuga

SEQ ID NO: 2737790 - RNA, 20 nt, Human
agaaagacuaucuaaauguu

SEQ ID NO: 2737791 - RNA, 20 nt, Human
ucugaaggguaauuauauag

SEQ ID NO: 2737792 - RNA, 18 nt, Human
ucugaaggcuggguucug

SEQ ID NO: 2737793 - RNA, 22 nt, Human
ucugaaggacauugcggacagc

SEQ ID NO: 2737794 - RNA, 15 nt, Human
agaaaugccuuaccc

SEQ ID NO: 2737795 - RNA, 16 nt, Human
agaaacacaacuauau

SEQ ID NO: 2737796 - RNA, 23 nt, Human
agaaacuuaagguuaccuuuguu

SEQ ID NO: 2737797 - RNA, 19 nt, Human
agaaaaaauauuuucccua

SEQ ID NO: 2737798 - RNA, 17 nt, Human
agaaaaaauauuuuccu

SEQ ID NO: 2737799 - RNA, 23 nt, Human
agaaaaaauauuuuccugccagg

SEQ ID NO: 2737800 - RNA, 18 nt, Human
agaaaaaugagccuggca

SEQ ID NO: 2737801 - RNA, 16 nt, Human
ucucuugguccugcug

SEQ ID NO: 2737802 - RNA, 17 nt, Human
ucucuugguccugcugc

SEQ ID NO: 2737803 - RNA, 18 nt, Human
ucucuugguccugcugca

SEQ ID NO: 2737804 - RNA, 23 nt, Human
acuuuggaaagaguaggaagacu

SEQ ID NO: 2737805 - RNA, 23 nt, Human
acuuuggaaagacuuuuccaacc

SEQ ID NO: 2737806 - RNA, 13 nt, Human
acuuuggaaagag

SEQ ID NO: 2737807 - RNA, 14 nt, Human
acuuuggaaagagu

SEQ ID NO: 2737808 - RNA, 14 nt, Human
acuuguggacacag

SEQ ID NO: 2737809 - RNA, 16 nt, Human
acuuuaaaaggagcca

SEQ ID NO: 2737810 - RNA, 22 nt, Human
acuuguuuuauuuaaccucuaa

SEQ ID NO: 2737811 - RNA, 23 nt, Human
acuuuaccuuuuuuauacauaaa

SEQ ID NO: 2737812 - RNA, 21 nt, Human
ucucucacuuguuuuauuuaa

SEQ ID NO: 2737813 - RNA, 22 nt, Human
ucucucacuuguuuuauuuaac

SEQ ID NO: 2737814 - RNA, 12 nt, Human
ucucucaggcca

SEQ ID NO: 2737815 - RNA, 21 nt, Human
ucucucaggccaaacucaccu

SEQ ID NO: 2737816 - RNA, 18 nt, Human
acuuuguguucaccuugu

SEQ ID NO: 2737817 - RNA, 22 nt, Human
acuuugugcugggguuaucuga

SEQ ID NO: 2737818 - RNA, 16 nt, Human
acuuuguguucaccuu

SEQ ID NO: 2737819 - RNA, 19 nt, Human
ucuccuguaccucuugagc

SEQ ID NO: 2737820 - RNA, 21 nt, Human
ucuccuuggugucgggcauga

SEQ ID NO: 2737821 - RNA, 23 nt, Human
ucuccuuggugucgggcaugaca

SEQ ID NO: 2737822 - RNA, 19 nt, Human
agaagcaccaaucaugaau

SEQ ID NO: 2737823 - RNA, 16 nt, Human
agaagcagaggaagga

SEQ ID NO: 2737824 - RNA, 23 nt, Human
ucugcccacucccugcaaccuga

SEQ ID NO: 2737825 - RNA, 23 nt, Human
agaagcccaggaaaggcuccagg

SEQ ID NO: 2737826 - RNA, 21 nt, Human
agaagccccacccugccucac

SEQ ID NO: 2737827 - RNA, 12 nt, Human
ucugcccuuggu

SEQ ID NO: 2737828 - RNA, 23 nt, Human
ucugcccuugguuaggcauugug

SEQ ID NO: 2737829 - RNA, 23 nt, Human
agaaccuuuugagugccuuacac

SEQ ID NO: 2737830 - RNA, 19 nt, Human
agaaccuuuugagugccuu

SEQ ID NO: 2737831 - RNA, 13 nt, Human
agaaguugauaug

SEQ ID NO: 2737832 - RNA, 22 nt, Human
agaaguuugagaucagccuggg

SEQ ID NO: 2737833 - RNA, 16 nt, Human
agaaggaucuucaucu

SEQ ID NO: 2737834 - RNA, 14 nt, Human
agaagcuccaggua

SEQ ID NO: 2737835 - RNA, 18 nt, Human
ucuggcagcucagagagg

SEQ ID NO: 2737836 - RNA, 21 nt, Human
ucuggcagcucagagagggug

SEQ ID NO: 2737837 - RNA, 16 nt, Human
ucuggcagcucagaga

SEQ ID NO: 2737838 - RNA, 17 nt, Human
ucuggcagcucagagag

SEQ ID NO: 2737839 - RNA, 20 nt, Human
ucuggcagaguugaagacag

SEQ ID NO: 2737840 - RNA, 23 nt, Human
ucuggcagaguugaagacagagc

SEQ ID NO: 2737841 - RNA, 22 nt, Human
ucugcuuugggguuuaucagaa

SEQ ID NO: 2737842 - RNA, 15 nt, Human
ugaauacuuuauaaa

SEQ ID NO: 2737843 - RNA, 22 nt, Human
ugaaggguaauuauauaguuac

SEQ ID NO: 2737844 - RNA, 14 nt, Human
ugaagucacacagu

SEQ ID NO: 2737845 - RNA, 17 nt, Human
agaguauuuuugacaga

SEQ ID NO: 2737846 - RNA, 18 nt, Human
agaguauuuuugacagaa

SEQ ID NO: 2737847 - RNA, 22 nt, Human
ugaauggcuuuguauagaaccu

SEQ ID NO: 2737848 - RNA, 19 nt, Human
ugaauggcuuuguauagaa

SEQ ID NO: 2737849 - RNA, 18 nt, Human
ugaauggcuuuguauaga

SEQ ID NO: 2737850 - RNA, 17 nt, Human
ugaauggcuuuguauag

SEQ ID NO: 2737851 - RNA, 11 nt, Human
ugaauggcuuu

SEQ ID NO: 2737852 - RNA, 15 nt, Human
ugaauggcuuuguau

SEQ ID NO: 2737853 - RNA, 12 nt, Human
ugaauggcuuug

SEQ ID NO: 2737854 - RNA, 16 nt, Human
agagggagggagggcu

SEQ ID NO: 2737855 - RNA, 23 nt, Human
ugaaaguacauuuggagacacaa

SEQ ID NO: 2737856 - RNA, 14 nt, Human
ugaaaguacauuug

SEQ ID NO: 2737857 - RNA, 15 nt, Human
agagguuaagguggg

SEQ ID NO: 2737858 - RNA, 16 nt, Human
agagguggggagcaga

SEQ ID NO: 2737859 - RNA, 15 nt, Human
agaguauuuuugaca

SEQ ID NO: 2737860 - RNA, 14 nt, Human
agaguauuuuugac

SEQ ID NO: 2737861 - RNA, 22 nt, Human
agauacaguuacucagaauucu

SEQ ID NO: 2737862 - RNA, 11 nt, Human
agauacuguau

SEQ ID NO: 2737863 - RNA, 14 nt, Human
agauacuggauugu

SEQ ID NO: 2737864 - RNA, 17 nt, Human
agauacuggauuguacu

SEQ ID NO: 2737865 - RNA, 18 nt, Human
agauaauauuaaggaaga

SEQ ID NO: 2737866 - RNA, 22 nt, Human
agauaauauuaaggaagacaau

SEQ ID NO: 2737867 - RNA, 20 nt, Human
agauacaggaaaagcugcug

SEQ ID NO: 2737868 - RNA, 13 nt, Human
agauacaguuacu

SEQ ID NO: 2737869 - RNA, 18 nt, Human
agaucaaaagguuaauaa

SEQ ID NO: 2737870 - RNA, 21 nt, Human
agauauuuugcuuugugauuu

SEQ ID NO: 2737871 - RNA, 20 nt, Human
agauauuuugcuuugugauu

SEQ ID NO: 2737872 - RNA, 16 nt, Human
agauacuguaucauga

SEQ ID NO: 2737873 - RNA, 15 nt, Human
agauacuguaucaug

SEQ ID NO: 2737874 - RNA, 18 nt, Human
agauaauacaccacuaca

SEQ ID NO: 2737875 - RNA, 20 nt, Human
agaguuguuacauuuuuaag

SEQ ID NO: 2737876 - RNA, 19 nt, Human
agaguuguuacauuuuuaa

SEQ ID NO: 2737877 - RNA, 17 nt, Human
agaguuguuacauuuuu

SEQ ID NO: 2737878 - RNA, 16 nt, Human
agaguuguuacauuuu

SEQ ID NO: 2737879 - RNA, 15 nt, Human
agagucacuggaaca

SEQ ID NO: 2737880 - RNA, 20 nt, Human
agaguauuuuugacagaaua

SEQ ID NO: 2737881 - RNA, 17 nt, Human
ugaauuuuguguuagag

SEQ ID NO: 2737882 - RNA, 21 nt, Human
ugaauuuuguguuagagauuu

SEQ ID NO: 2737883 - RNA, 23 nt, Human
ugaauuucuuuugccguuauuaa

SEQ ID NO: 2737884 - RNA, 19 nt, Human
ugacacacagcucuguccu

SEQ ID NO: 2737885 - RNA, 19 nt, Human
ugacaaagacugaguacgu

SEQ ID NO: 2737886 - RNA, 16 nt, Human
ugacacacagcucugu

SEQ ID NO: 2737887 - RNA, 18 nt, Human
ugacacacagcucugucc

SEQ ID NO: 2737888 - RNA, 20 nt, Human
ugacacaugcaaggucauuu

SEQ ID NO: 2737889 - RNA, 12 nt, Human
ugacacaugcaa

SEQ ID NO: 2737890 - RNA, 23 nt, Human
agcaacgcaggcccccaggugcc

SEQ ID NO: 2737891 - RNA, 23 nt, Human
agauuuuuuuguuguuuguuuag

SEQ ID NO: 2737892 - RNA, 19 nt, Human
agauuuuuuuguuguuugu

SEQ ID NO: 2737893 - RNA, 18 nt, Human
agauuuuuuuguuguuug

SEQ ID NO: 2737894 - RNA, 16 nt, Human
agauuuuuuuguuguu

SEQ ID NO: 2737895 - RNA, 15 nt, Human
agauuuuuuuguugu

SEQ ID NO: 2737896 - RNA, 13 nt, Human
agcaagacgcugu

SEQ ID NO: 2737897 - RNA, 16 nt, Human
agcaagacgcugugcu

SEQ ID NO: 2737898 - RNA, 23 nt, Human
agcaagacgcugugcugcccugc

SEQ ID NO: 2737899 - RNA, 17 nt, Human
agcaagacgcugugcug

SEQ ID NO: 2737900 - RNA, 20 nt, Human
agcaagacgcugugcugccc

SEQ ID NO: 2737901 - RNA, 21 nt, Human
agcaagacgcugugcugcccu

SEQ ID NO: 2737902 - RNA, 22 nt, Human
agcaagacgcugugcugcccug

SEQ ID NO: 2737903 - RNA, 15 nt, Human
agauucccugagcag

SEQ ID NO: 2737904 - RNA, 13 nt, Human
agauuggaaggaa

SEQ ID NO: 2737905 - RNA, 15 nt, Human
ugacuucuaaguaaa

SEQ ID NO: 2737906 - RNA, 19 nt, Human
ugacuuacuguacaugaaa

SEQ ID NO: 2737907 - RNA, 23 nt, Human
ugacuucuaaguaaaaccacagc

SEQ ID NO: 2737908 - RNA, 22 nt, Human
ugacuucuaaguaaaaccacag

SEQ ID NO: 2737909 - RNA, 24 nt, Human
ugacuucuaaguaaaaccacagca

SEQ ID NO: 2737910 - RNA, 19 nt, Human
agauucauauuuacuucuu

SEQ ID NO: 2737911 - RNA, 22 nt, Human
agauucauauuuacuucuuaua

SEQ ID NO: 2737912 - RNA, 21 nt, Human
agauuuugaaauuuuuauuaa

SEQ ID NO: 2737913 - RNA, 19 nt, Human
agauuuuauuauguaaauc

SEQ ID NO: 2737914 - RNA, 17 nt, Human
agauuugaacucuucaa

SEQ ID NO: 2737915 - RNA, 14 nt, Human
agauuuuauuaugu

SEQ ID NO: 2737916 - RNA, 18 nt, Human
agauuuuauuauguaaau

SEQ ID NO: 2737917 - RNA, 17 nt, Human
agauuuuauuauguaaa

SEQ ID NO: 2737918 - RNA, 16 nt, Human
agauuuuauuauguaa

SEQ ID NO: 2737919 - RNA, 15 nt, Human
agauuuuauuaugua

SEQ ID NO: 2737920 - RNA, 16 nt, Human
agaugcaguucugaag

SEQ ID NO: 2737921 - RNA, 16 nt, Human
agaugccgcauuugga

SEQ ID NO: 2737922 - RNA, 21 nt, Human
ugacccaugcugcccugugag

SEQ ID NO: 2737923 - RNA, 12 nt, Human
ugacccaugcug

SEQ ID NO: 2737924 - RNA, 16 nt, Human
ugacccaugcugcccu

SEQ ID NO: 2737925 - RNA, 14 nt, Human
ugacccaugcugcc

SEQ ID NO: 2737926 - RNA, 15 nt, Human
ugacccaugcugccc

SEQ ID NO: 2737927 - RNA, 18 nt, Human
agauggaaugcuguguua

SEQ ID NO: 2737928 - RNA, 13 nt, Human
agauggaaugcug

SEQ ID NO: 2737929 - RNA, 15 nt, Human
agauggaaugcugug

SEQ ID NO: 2737930 - RNA, 18 nt, Human
ugaccugaggcccuucuc

SEQ ID NO: 2737931 - RNA, 19 nt, Human
ugaccugaggcccuucucu

SEQ ID NO: 2737932 - RNA, 13 nt, Human
ugacuuacuguac

SEQ ID NO: 2737933 - RNA, 16 nt, Human
ugacuuacuguacaug

SEQ ID NO: 2737934 - RNA, 15 nt, Human
ugacuuacuguacau

SEQ ID NO: 2737935 - RNA, 14 nt, Human
agacuauucaaaca

SEQ ID NO: 2737936 - RNA, 12 nt, Human
agacuauucaaa

SEQ ID NO: 2737937 - RNA, 15 nt, Human
agacuauucaaacag

SEQ ID NO: 2737938 - RNA, 21 nt, Human
agaccuucuccuucaccuuug

SEQ ID NO: 2737939 - RNA, 23 nt, Human
agaccuucuccuucaccuuuguc

SEQ ID NO: 2737940 - RNA, 11 nt, Human
agaccuucucc

SEQ ID NO: 2737941 - RNA, 15 nt, Human
agaccuucuccuuca

SEQ ID NO: 2737942 - RNA, 18 nt, Human
agaccuucuccuucaccu

SEQ ID NO: 2737943 - RNA, 13 nt, Human
ucuugagccuggg

SEQ ID NO: 2737944 - RNA, 16 nt, Human
ucuugagccugggagg

SEQ ID NO: 2737945 - RNA, 20 nt, Human
ucuugagccuugaacuuuga

SEQ ID NO: 2737946 - RNA, 16 nt, Human
ucuugagccuugaacu

SEQ ID NO: 2737947 - RNA, 13 nt, Human
ucuugauucauaa

SEQ ID NO: 2737948 - RNA, 17 nt, Human
ucuuggucagauuugaa

SEQ ID NO: 2737949 - RNA, 14 nt, Human
ucuugguccugcug

SEQ ID NO: 2737950 - RNA, 19 nt, Human
ucuugcaauggcagccuug

SEQ ID NO: 2737951 - RNA, 18 nt, Human
ucuugcaauggcagccuu

SEQ ID NO: 2737952 - RNA, 22 nt, Human
ucuugcaauggcagccuuggca

SEQ ID NO: 2737953 - RNA, 17 nt, Human
ucuuuccugaggcuggg

SEQ ID NO: 2737954 - RNA, 15 nt, Human
ucuuuaacucauaaa

SEQ ID NO: 2737955 - RNA, 15 nt, Human
ucuugguccugcugc

SEQ ID NO: 2737956 - RNA, 17 nt, Human
ucuugguccugcugcag

SEQ ID NO: 2737957 - RNA, 19 nt, Human
ucuugguccugcugcaguu

SEQ ID NO: 2737958 - RNA, 15 nt, Human
ucuucacaacagauu

SEQ ID NO: 2737959 - RNA, 12 nt, Human
ucuucagagacu

SEQ ID NO: 2737960 - RNA, 17 nt, Human
ucuucagagacuccugc

SEQ ID NO: 2737961 - RNA, 18 nt, Human
ucuucagagacuccugca

SEQ ID NO: 2737962 - RNA, 21 nt, Human
ucuuccaggcugggagagccu

SEQ ID NO: 2737963 - RNA, 20 nt, Human
ucuucagagacuccugcagg

SEQ ID NO: 2737964 - RNA, 15 nt, Human
ucuuccaggcuggga

SEQ ID NO: 2737965 - RNA, 17 nt, Human
ucuuccaggcugggaga

SEQ ID NO: 2737966 - RNA, 20 nt, Human
ucuuccaggcugggagagcc

SEQ ID NO: 2737967 - RNA, 19 nt, Human
ucuucccuacaguugaaaa

SEQ ID NO: 2737968 - RNA, 22 nt, Human
ucuucccuacaguugaaaaaca

SEQ ID NO: 2737969 - RNA, 14 nt, Human
ucuuccucccuccc

SEQ ID NO: 2737970 - RNA, 15 nt, Human
ucuuccucccucccu

SEQ ID NO: 2737971 - RNA, 19 nt, Human
agacauacuaaccagcaga

SEQ ID NO: 2737972 - RNA, 19 nt, Human
agacauucuuccaaaaaga

SEQ ID NO: 2737973 - RNA, 12 nt, Human
ucuucugcuuca

SEQ ID NO: 2737974 - RNA, 19 nt, Human
ucuucugcuucagccuccc

SEQ ID NO: 2737975 - RNA, 21 nt, Human
ucuucugaacuuggcgcugcc

SEQ ID NO: 2737976 - RNA, 15 nt, Human
ucuucuguacgucug

SEQ ID NO: 2737977 - RNA, 20 nt, Human
ucuucuguggguuucuaaag

SEQ ID NO: 2737978 - RNA, 23 nt, Human
agagcaccuuagacagucccugc

SEQ ID NO: 2737979 - RNA, 22 nt, Human
agagcaccuuagacagucccug

SEQ ID NO: 2737980 - RNA, 21 nt, Human
agagcaccuuagacagucccu

SEQ ID NO: 2737981 - RNA, 20 nt, Human
agagcuagcagcagggaggg

SEQ ID NO: 2737982 - RNA, 13 nt, Human
agagccuuccagg

SEQ ID NO: 2737983 - RNA, 15 nt, Human
agagccuuccagggg

SEQ ID NO: 2737984 - RNA, 17 nt, Human
agagccuuccaggggug

SEQ ID NO: 2737985 - RNA, 22 nt, Human
agagccuuccaggggugggaca

SEQ ID NO: 2737986 - RNA, 14 nt, Human
agagcugccaccug

SEQ ID NO: 2737987 - RNA, 12 nt, Human
ugaaacuuuugg

SEQ ID NO: 2737988 - RNA, 15 nt, Human
ugaaagacuguacaa

SEQ ID NO: 2737989 - RNA, 13 nt, Human
ugaaagacuguac

SEQ ID NO: 2737990 - RNA, 15 nt, Human
agagacuccugcagg

SEQ ID NO: 2737991 - RNA, 17 nt, Human
agagacuccugcaggca

SEQ ID NO: 2737992 - RNA, 18 nt, Human
agagacuccugcaggcag

SEQ ID NO: 2737993 - RNA, 19 nt, Human
agagacuccugcaggcagc

SEQ ID NO: 2737994 - RNA, 20 nt, Human
agagacuccugcaggcagcc

SEQ ID NO: 2737995 - RNA, 21 nt, Human
agagacuccugcaggcagcca

SEQ ID NO: 2737996 - RNA, 22 nt, Human
agagacuccugcaggcagccag

SEQ ID NO: 2737997 - RNA, 20 nt, Human
agagcaaaauugauguguuu

SEQ ID NO: 2737998 - RNA, 19 nt, Human
agagcaagacgcugugcug

SEQ ID NO: 2737999 - RNA, 23 nt, Human
agagcaagacgcugugcugcccu

SEQ ID NO: 2738000 - RNA, 22 nt, Human
agagaucaaccccuucgcuccu

SEQ ID NO: 2738001 - RNA, 23 nt, Human
agagacuccugcaggcagccagg

SEQ ID NO: 2738002 - RNA, 14 nt, Human
agagagaaaauaaa

SEQ ID NO: 2738003 - RNA, 20 nt, Human
ugaaaagcuccauuuuuagu

SEQ ID NO: 2738004 - RNA, 20 nt, Human
ugaaaaaggaggaagagaaa

SEQ ID NO: 2738005 - RNA, 22 nt, Human
ugaaaaaggaggaagagaaaaa

SEQ ID NO: 2738006 - RNA, 16 nt, Human
ugaaaaucgugacaac

SEQ ID NO: 2738007 - RNA, 22 nt, Human
ugaaacugagaugugaacacau

SEQ ID NO: 2738008 - RNA, 19 nt, Human
ugaaacucguuaauuugua

SEQ ID NO: 2738009 - RNA, 23 nt, Human
ugaaacuuguguaaauacaauuu

SEQ ID NO: 2738010 - RNA, 17 nt, Human
ugaaacuuguguaaaua

SEQ ID NO: 2738011 - RNA, 20 nt, Human
ugaaacggaugauuucuaug

SEQ ID NO: 2738012 - RNA, 19 nt, Human
ugaaacggaugauuucuau

SEQ ID NO: 2738013 - RNA, 18 nt, Human
ugaaacggaugauuucua

SEQ ID NO: 2738014 - RNA, 17 nt, Human
ugaaacggaugauuucu

SEQ ID NO: 2738015 - RNA, 16 nt, Human
ugaaacgcaaccacca

SEQ ID NO: 2738016 - RNA, 15 nt, Human
ugaaacggaugauuu

SEQ ID NO: 2738017 - RNA, 17 nt, Human
ugaaaauguauguguaa

SEQ ID NO: 2738018 - RNA, 19 nt, Human
ugaaaaucgugacaacacu

SEQ ID NO: 2738019 - RNA, 21 nt, Human
ucuuucuggcuaugcauuuga

SEQ ID NO: 2738020 - RNA, 20 nt, Human
ucuuucuggcuaugcauuug

SEQ ID NO: 2738021 - RNA, 22 nt, Human
ucuuuggucuacacugugcuga

SEQ ID NO: 2738022 - RNA, 16 nt, Human
ugaaaaaggaggaaga

SEQ ID NO: 2738023 - RNA, 22 nt, Human
ugaaaaagaccuuuggagcaaa

SEQ ID NO: 2738024 - RNA, 12 nt, Human
ugauaugggucu

SEQ ID NO: 2738025 - RNA, 16 nt, Human
ugauaugugaacaguu

SEQ ID NO: 2738026 - RNA, 15 nt, Human
ugauaugugaacagu

SEQ ID NO: 2738027 - RNA, 22 nt, Human
agcauauucaggaagcucaggg

SEQ ID NO: 2738028 - RNA, 20 nt, Human
ugaucacggcucacugcagc

SEQ ID NO: 2738029 - RNA, 21 nt, Human
ugaucacggcucacugcagcc

SEQ ID NO: 2738030 - RNA, 13 nt, Human
agcaucaggccag

SEQ ID NO: 2738031 - RNA, 12 nt, Human
agcaucaggcca

SEQ ID NO: 2738032 - RNA, 18 nt, Human
ugaucacggcucacugca

SEQ ID NO: 2738033 - RNA, 19 nt, Human
ugaucacggcucacugcag

SEQ ID NO: 2738034 - RNA, 20 nt, Human
agcaugucgucaaagcugaa

SEQ ID NO: 2738035 - RNA, 17 nt, Human
agcaugucgucaaagcu

SEQ ID NO: 2738036 - RNA, 12 nt, Human
agcauggcugcc

SEQ ID NO: 2738037 - RNA, 14 nt, Human
agcaucaggccagg

SEQ ID NO: 2738038 - RNA, 16 nt, Human
agcaucaggccaggcc

SEQ ID NO: 2738039 - RNA, 17 nt, Human
agcaucaggccaggccc

SEQ ID NO: 2738040 - RNA, 18 nt, Human
agcaucaggccaggcccu

SEQ ID NO: 2738041 - RNA, 19 nt, Human
agcaucaggccaggcccuc

SEQ ID NO: 2738042 - RNA, 20 nt, Human
agcaucaggccaggcccucu

SEQ ID NO: 2738043 - RNA, 18 nt, Human
agcauggcauauuuuuca

SEQ ID NO: 2738044 - RNA, 19 nt, Human
agcauggcauauuuuucac

SEQ ID NO: 2738045 - RNA, 21 nt, Human
agcauggcauauuuuucacau

SEQ ID NO: 2738046 - RNA, 22 nt, Human
agcauggcauauuuuucacaua

SEQ ID NO: 2738047 - RNA, 18 nt, Human
agcauuguaaaugugcuu

SEQ ID NO: 2738048 - RNA, 17 nt, Human
agcauuguaaaugugcu

SEQ ID NO: 2738049 - RNA, 22 nt, Human
ugaguaacugauuuguaacaag

SEQ ID NO: 2738050 - RNA, 15 nt, Human
ugaguacuacagucc

SEQ ID NO: 2738051 - RNA, 14 nt, Human
agcauauucaggaa

SEQ ID NO: 2738052 - RNA, 14 nt, Human
ugaguacuacaguc

SEQ ID NO: 2738053 - RNA, 17 nt, Human
ugaguacuacaguccuc

SEQ ID NO: 2738054 - RNA, 21 nt, Human
ugaguacuacaguccucccau

SEQ ID NO: 2738055 - RNA, 22 nt, Human
ugaguacuacaguccucccauc

SEQ ID NO: 2738056 - RNA, 23 nt, Human
ugaguacuacaguccucccaucu

SEQ ID NO: 2738057 - RNA, 23 nt, Human
agcauaaauguugacaugggaca

SEQ ID NO: 2738058 - RNA, 15 nt, Human
agcauacguacacau

SEQ ID NO: 2738059 - RNA, 12 nt, Human
ugagaauuaccc

SEQ ID NO: 2738060 - RNA, 21 nt, Human
agcauacguacacauuuuauu

SEQ ID NO: 2738061 - RNA, 20 nt, Human
agcauacguacacauuuuau

SEQ ID NO: 2738062 - RNA, 19 nt, Human
agcauacguacacauuuua

SEQ ID NO: 2738063 - RNA, 18 nt, Human
agcauacguacacauuuu

SEQ ID NO: 2738064 - RNA, 17 nt, Human
agcauacguacacauuu

SEQ ID NO: 2738065 - RNA, 16 nt, Human
agcauacguacacauu

SEQ ID NO: 2738066 - RNA, 18 nt, Human
ugagugucuuaauuaaaa

SEQ ID NO: 2738067 - RNA, 23 nt, Human
ugagugggggaucacagccucug

SEQ ID NO: 2738068 - RNA, 21 nt, Human
ugagugggugaauaauacagu

SEQ ID NO: 2738069 - RNA, 14 nt, Human
ugagucaccaagcc

SEQ ID NO: 2738070 - RNA, 16 nt, Human
ugagucaccaagccca

SEQ ID NO: 2738071 - RNA, 17 nt, Human
ugagucaccaagcccag

SEQ ID NO: 2738072 - RNA, 17 nt, Human
ugagugccuuacacaau

SEQ ID NO: 2738073 - RNA, 20 nt, Human
ugagugccuuacacaauggu

SEQ ID NO: 2738074 - RNA, 19 nt, Human
ugauacgcaacauaauuaa

SEQ ID NO: 2738075 - RNA, 17 nt, Human
ugauacuacaguuuguu

SEQ ID NO: 2738076 - RNA, 14 nt, Human
ugauacuacaguuu

SEQ ID NO: 2738077 - RNA, 21 nt, Human
ugauacaaugcugugcccuaa

SEQ ID NO: 2738078 - RNA, 12 nt, Human
ugauacagaaaa

SEQ ID NO: 2738079 - RNA, 20 nt, Human
ugauacaaugcugugcccua

SEQ ID NO: 2738080 - RNA, 18 nt, Human
ugauacaaugcugugccc

SEQ ID NO: 2738081 - RNA, 17 nt, Human
ugaguucauacccuguu

SEQ ID NO: 2738082 - RNA, 20 nt, Human
ugauaagaaccuuuugagug

SEQ ID NO: 2738083 - RNA, 12 nt, Human
ugauaaguaaau

SEQ ID NO: 2738084 - RNA, 17 nt, Human
ugaugaagaaguugaua

SEQ ID NO: 2738085 - RNA, 22 nt, Human
ugauccaguuuuguuuggacca

SEQ ID NO: 2738086 - RNA, 15 nt, Human
agccacggccaggcc

SEQ ID NO: 2738087 - RNA, 21 nt, Human
ugauccagcagauuauucacu

SEQ ID NO: 2738088 - RNA, 22 nt, Human
ugauccagcagauuauucacug

SEQ ID NO: 2738089 - RNA, 14 nt, Human
agccacggccaggc

SEQ ID NO: 2738090 - RNA, 14 nt, Human
agccacauuccuga

SEQ ID NO: 2738091 - RNA, 18 nt, Human
agccacauuccugaugcu

SEQ ID NO: 2738092 - RNA, 19 nt, Human
agccaccaacauacuccca

SEQ ID NO: 2738093 - RNA, 20 nt, Human
agccaccaacauacucccau

SEQ ID NO: 2738094 - RNA, 23 nt, Human
agccaccaacauacucccaucug

SEQ ID NO: 2738095 - RNA, 15 nt, Human
ugauuaauuaaaaca

SEQ ID NO: 2738096 - RNA, 20 nt, Human
agccacugcaccgggccaca

SEQ ID NO: 2738097 - RNA, 13 nt, Human
agccacugcaccg

SEQ ID NO: 2738098 - RNA, 21 nt, Human
agccacugcaccgggccacag

SEQ ID NO: 2738099 - RNA, 22 nt, Human
agccacugcaccgggccacaga

SEQ ID NO: 2738100 - RNA, 17 nt, Human
ugaugaucuuuaaaaua

SEQ ID NO: 2738101 - RNA, 16 nt, Human
ugauggugcaaugacc

SEQ ID NO: 2738102 - RNA, 17 nt, Human
ugauggugcaaugaccu

SEQ ID NO: 2738103 - RNA, 23 nt, Human
ugauggugcaaugaccuuucaau

SEQ ID NO: 2738104 - RNA, 14 nt, Human
ugaugaucuuuaaa

SEQ ID NO: 2738105 - RNA, 20 nt, Human
ugaugauccuaggcauuugc

SEQ ID NO: 2738106 - RNA, 14 nt, Human
ugaugauccuaggc

SEQ ID NO: 2738107 - RNA, 23 nt, Human
ugauguuuuccaugaguccccug

SEQ ID NO: 2738108 - RNA, 18 nt, Human
ugauguuuuaaggaugcu

SEQ ID NO: 2738109 - RNA, 17 nt, Human
ugauguuuuaaggaugc

SEQ ID NO: 2738110 - RNA, 14 nt, Human
agccagacuggcac

SEQ ID NO: 2738111 - RNA, 19 nt, Human
agccagacuggcacaguuu

SEQ ID NO: 2738112 - RNA, 12 nt, Human
agccaggccaca

SEQ ID NO: 2738113 - RNA, 14 nt, Human
agccaggccacaag

SEQ ID NO: 2738114 - RNA, 22 nt, Human
agccaguaaaugggggugcauu

SEQ ID NO: 2738115 - RNA, 23 nt, Human
agccaguaaaugggggugcauuu

SEQ ID NO: 2738116 - RNA, 12 nt, Human
agccagggucuc

SEQ ID NO: 2738117 - RNA, 21 nt, Human
agccaggccacaagacccuug

SEQ ID NO: 2738118 - RNA, 22 nt, Human
agccaggccacaagacccuugu

SEQ ID NO: 2738119 - RNA, 13 nt, Human
ugauucagcucug

SEQ ID NO: 2738120 - RNA, 14 nt, Human
ugauucagcucugc

SEQ ID NO: 2738121 - RNA, 18 nt, Human
agcccaggaaaggcucca

SEQ ID NO: 2738122 - RNA, 24 nt, Human
agcccaggaaaggcuccaggagca

SEQ ID NO: 2738123 - RNA, 22 nt, Human
agcccaggaaaggcuccaggag

SEQ ID NO: 2738124 - RNA, 23 nt, Human
agcccaggaaaggcuccaggagc

SEQ ID NO: 2738125 - RNA, 15 nt, Human
ugauucccaagcucu

SEQ ID NO: 2738126 - RNA, 16 nt, Human
ugauucccaagcucug

SEQ ID NO: 2738127 - RNA, 18 nt, Human
ugauucccaagcucugcu

SEQ ID NO: 2738128 - RNA, 19 nt, Human
ugauucccaagcucugcuc

SEQ ID NO: 2738129 - RNA, 21 nt, Human
ugauucccaagcucugcuccu

SEQ ID NO: 2738130 - RNA, 22 nt, Human
agcccacuucugccauauucug

SEQ ID NO: 2738131 - RNA, 16 nt, Human
agccauguuuauuaca

SEQ ID NO: 2738132 - RNA, 14 nt, Human
agccauguuuauua

SEQ ID NO: 2738133 - RNA, 13 nt, Human
agccauguuuauu

SEQ ID NO: 2738134 - RNA, 19 nt, Human
agcccaggaaaggcuccag

SEQ ID NO: 2738135 - RNA, 20 nt, Human
agcccaggaaaggcuccagg

SEQ ID NO: 2738136 - RNA, 21 nt, Human
agcccaggaaaggcuccagga

SEQ ID NO: 2738137 - RNA, 23 nt, Human
ugcagccucaaccuccugggcua

SEQ ID NO: 2738138 - RNA, 16 nt, Human
ugcagccucacagucc

SEQ ID NO: 2738139 - RNA, 13 nt, Human
ugcagccucacag

SEQ ID NO: 2738140 - RNA, 15 nt, Human
ugcagccucacaguc

SEQ ID NO: 2738141 - RNA, 17 nt, Human
ugcauaaguuaacuucc

SEQ ID NO: 2738142 - RNA, 14 nt, Human
ugcauaaguuaacu

SEQ ID NO: 2738143 - RNA, 22 nt, Human
agccucagcauccuggcacccg

SEQ ID NO: 2738144 - RNA, 23 nt, Human
agccucagcauccuggcacccgg

SEQ ID NO: 2738145 - RNA, 16 nt, Human
agccucccaaagugcu

SEQ ID NO: 2738146 - RNA, 16 nt, Human
agccucagcauccugg

SEQ ID NO: 2738147 - RNA, 17 nt, Human
agccucagcauccuggc

SEQ ID NO: 2738148 - RNA, 19 nt, Human
agccucagcauccuggcac

SEQ ID NO: 2738149 - RNA, 20 nt, Human
agccucagcauccuggcacc

SEQ ID NO: 2738150 - RNA, 21 nt, Human
agccucagcauccuggcaccc

SEQ ID NO: 2738151 - RNA, 23 nt, Human
ugcacuauagccuaggugacaga

SEQ ID NO: 2738152 - RNA, 23 nt, Human
agcccuucuaccuuccugcaaca

SEQ ID NO: 2738153 - RNA, 20 nt, Human
agccccaaaacucuccucug

SEQ ID NO: 2738154 - RNA, 21 nt, Human
agccccaaaacucuccucugc

SEQ ID NO: 2738155 - RNA, 22 nt, Human
agccccaaaacucuccucugcu

SEQ ID NO: 2738156 - RNA, 20 nt, Human
ugauucuccugccucagccu

SEQ ID NO: 2738157 - RNA, 19 nt, Human
ugauucuccugccucagcc

SEQ ID NO: 2738158 - RNA, 15 nt, Human
ugauucuccugccuc

SEQ ID NO: 2738159 - RNA, 19 nt, Human
agccccuggaugcagccuc

SEQ ID NO: 2738160 - RNA, 17 nt, Human
agccccuggaugcagcc

SEQ ID NO: 2738161 - RNA, 18 nt, Human
agccccuggaugcagccu

SEQ ID NO: 2738162 - RNA, 17 nt, Human
agccccgaggccuucuc

SEQ ID NO: 2738163 - RNA, 22 nt, Human
agccccgaggccuucucugaag

SEQ ID NO: 2738164 - RNA, 16 nt, Human
agccccgaggccuucu

SEQ ID NO: 2738165 - RNA, 24 nt, Human
agccccaaaacucuccucugcugc

SEQ ID NO: 2738166 - RNA, 23 nt, Human
agccccauucugccugcccaggc

SEQ ID NO: 2738167 - RNA, 15 nt, Human
ugcacaagcugcacc

SEQ ID NO: 2738168 - RNA, 22 nt, Human
agcccugguggcagugggagcu

SEQ ID NO: 2738169 - RNA, 23 nt, Human
agcccugguggcagugggagcug

SEQ ID NO: 2738170 - RNA, 18 nt, Human
ugcacaagcugcacccuc

SEQ ID NO: 2738171 - RNA, 21 nt, Human
ugcacaagcugcacccucagg

SEQ ID NO: 2738172 - RNA, 22 nt, Human
ugcacacaccagagcccaccuu

SEQ ID NO: 2738173 - RNA, 20 nt, Human
agccccuucugacccaugcu

SEQ ID NO: 2738174 - RNA, 24 nt, Human
agccccuucugacccaugcugccc

SEQ ID NO: 2738175 - RNA, 21 nt, Human
agcccugguggcagugggagc

SEQ ID NO: 2738176 - RNA, 16 nt, Human
ugcacccucaggcagg

SEQ ID NO: 2738177 - RNA, 17 nt, Human
ugcacccucaggcaggu

SEQ ID NO: 2738178 - RNA, 14 nt, Human
ugcacgugugugca

SEQ ID NO: 2738179 - RNA, 15 nt, Human
ugcacgugugugcac

SEQ ID NO: 2738180 - RNA, 20 nt, Human
ugcacacauuuuuuaaaugc

SEQ ID NO: 2738181 - RNA, 10 nt, Human
ugcacacauu

SEQ ID NO: 2738182 - RNA, 16 nt, Human
agcuagaauuugauau

SEQ ID NO: 2738183 - RNA, 13 nt, Human
agcuagaauuuga

SEQ ID NO: 2738184 - RNA, 18 nt, Human
agcuagacgagcaggcuu

SEQ ID NO: 2738185 - RNA, 13 nt, Human
agcuagacuggug

SEQ ID NO: 2738186 - RNA, 21 nt, Human
agcuagacuggugacugauuc

SEQ ID NO: 2738187 - RNA, 17 nt, Human
agcuagacuggugacug

SEQ ID NO: 2738188 - RNA, 16 nt, Human
agcuagacuggugacu

SEQ ID NO: 2738189 - RNA, 14 nt, Human
agcuagacugguga

SEQ ID NO: 2738190 - RNA, 19 nt, Human
agcgugagccacugcaccg

SEQ ID NO: 2738191 - RNA, 15 nt, Human
agcgugcauaaguua

SEQ ID NO: 2738192 - RNA, 22 nt, Human
agcgugagccacugcaccgggc

SEQ ID NO: 2738193 - RNA, 21 nt, Human
agcucauucuccuuguguuac

SEQ ID NO: 2738194 - RNA, 20 nt, Human
agcucauucuccuuguguua

SEQ ID NO: 2738195 - RNA, 20 nt, Human
ugcccacaggaucagucuga

SEQ ID NO: 2738196 - RNA, 19 nt, Human
ugcccacaggaucagucug

SEQ ID NO: 2738197 - RNA, 16 nt, Human
ugcccacaggaucagu

SEQ ID NO: 2738198 - RNA, 21 nt, Human
ugcccagccccuucugaccca

SEQ ID NO: 2738199 - RNA, 20 nt, Human
ugcccagccccuucugaccc

SEQ ID NO: 2738200 - RNA, 12 nt, Human
agcuaggccugg

SEQ ID NO: 2738201 - RNA, 16 nt, Human
agcuaggccuggccag

SEQ ID NO: 2738202 - RNA, 14 nt, Human
agcuaggccuggcc

SEQ ID NO: 2738203 - RNA, 15 nt, Human
agcuaggccuggcca

SEQ ID NO: 2738204 - RNA, 18 nt, Human
agcucaggugucccugca

SEQ ID NO: 2738205 - RNA, 22 nt, Human
agcucaggugucccugcacuug

SEQ ID NO: 2738206 - RNA, 20 nt, Human
agcucaggugucccugcacu

SEQ ID NO: 2738207 - RNA, 21 nt, Human
agcucaggugucccugcacuu

SEQ ID NO: 2738208 - RNA, 20 nt, Human
agccuuggggcugaugcagu

SEQ ID NO: 2738209 - RNA, 11 nt, Human
agccuuccagg

SEQ ID NO: 2738210 - RNA, 14 nt, Human
agccuuccaggggu

SEQ ID NO: 2738211 - RNA, 16 nt, Human
agccuuccaggggugg

SEQ ID NO: 2738212 - RNA, 17 nt, Human
agccuuccagggguggg

SEQ ID NO: 2738213 - RNA, 20 nt, Human
ugcauuaucuagauacugua

SEQ ID NO: 2738214 - RNA, 18 nt, Human
agcggagacggaguccca

SEQ ID NO: 2738215 - RNA, 20 nt, Human
agcggagaaaggaagggcug

SEQ ID NO: 2738216 - RNA, 16 nt, Human
agcggagaaaggaagg

SEQ ID NO: 2738217 - RNA, 18 nt, Human
ugcauuaucuagauacug

SEQ ID NO: 2738218 - RNA, 22 nt, Human
ugcauuaucuagauacuguauc

SEQ ID NO: 2738219 - RNA, 21 nt, Human
ugcauuaucuagauacuguau

SEQ ID NO: 2738220 - RNA, 18 nt, Human
ugccaaugggagcucaug

SEQ ID NO: 2738221 - RNA, 21 nt, Human
agccugugccucugggacugg

SEQ ID NO: 2738222 - RNA, 22 nt, Human
agccuuagaagucacacaguau

SEQ ID NO: 2738223 - RNA, 22 nt, Human
agccugggugacagagcaagug

SEQ ID NO: 2738224 - RNA, 19 nt, Human
agccugcuccagcuguuca

SEQ ID NO: 2738225 - RNA, 22 nt, Human
agccugcuccagcuguucagcu

SEQ ID NO: 2738226 - RNA, 14 nt, Human
agccugcuccagcu

SEQ ID NO: 2738227 - RNA, 15 nt, Human
agccugcuccagcug

SEQ ID NO: 2738228 - RNA, 16 nt, Human
agccugcuccagcugu

SEQ ID NO: 2738229 - RNA, 17 nt, Human
agccugcuccagcuguu

SEQ ID NO: 2738230 - RNA, 12 nt, Human
ugcauaccacuu

SEQ ID NO: 2738231 - RNA, 14 nt, Human
uggagcucguggaa

SEQ ID NO: 2738232 - RNA, 15 nt, Human
aggcacccaccauca

SEQ ID NO: 2738233 - RNA, 14 nt, Human
aggcaaugcuggcu

SEQ ID NO: 2738234 - RNA, 20 nt, Human
aggcacccaccaucaugucu

SEQ ID NO: 2738235 - RNA, 21 nt, Human
aggcacccaccaucaugucug

SEQ ID NO: 2738236 - RNA, 22 nt, Human
aggcacccaccaucaugucugg

SEQ ID NO: 2738237 - RNA, 13 nt, Human
uggagaagaacug

SEQ ID NO: 2738238 - RNA, 14 nt, Human
uggagaagaacuga

SEQ ID NO: 2738239 - RNA, 13 nt, Human
uggagaagcggcu

SEQ ID NO: 2738240 - RNA, 22 nt, Human
uggagaagcggcuggcagccca

SEQ ID NO: 2738241 - RNA, 15 nt, Human
uggacccugaggccc

SEQ ID NO: 2738242 - RNA, 20 nt, Human
uggaccuugaacuggguacu

SEQ ID NO: 2738243 - RNA, 16 nt, Human
uggacuguggugacuu

SEQ ID NO: 2738244 - RNA, 15 nt, Human
uggacuguggugacu

SEQ ID NO: 2738245 - RNA, 22 nt, Human
uggacuguggugacuuuggaua

SEQ ID NO: 2738246 - RNA, 21 nt, Human
uggacuguggugacuuuggau

SEQ ID NO: 2738247 - RNA, 19 nt, Human
uggacuguggugacuuugg

SEQ ID NO: 2738248 - RNA, 17 nt, Human
uggacuguggugacuuu

SEQ ID NO: 2738249 - RNA, 23 nt, Human
uggacccuguggaugauaaaaca

SEQ ID NO: 2738250 - RNA, 21 nt, Human
uggacccugaggcccagaggg

SEQ ID NO: 2738251 - RNA, 19 nt, Human
uggacccugaggcccagag

SEQ ID NO: 2738252 - RNA, 20 nt, Human
uggacccugaggcccagagg

SEQ ID NO: 2738253 - RNA, 23 nt, Human
uggacacagcucuucuccaggcu

SEQ ID NO: 2738254 - RNA, 16 nt, Human
uggacccugaggccca

SEQ ID NO: 2738255 - RNA, 18 nt, Human
uggacccugaggcccaga

SEQ ID NO: 2738256 - RNA, 12 nt, Human
aggaucucuuga

SEQ ID NO: 2738257 - RNA, 19 nt, Human
aggaucucuugagccuggg

SEQ ID NO: 2738258 - RNA, 17 nt, Human
aggaucucuugagccug

SEQ ID NO: 2738259 - RNA, 18 nt, Human
aggaucucuugagccugg

SEQ ID NO: 2738260 - RNA, 21 nt, Human
uggacacagcucuucuccagg

SEQ ID NO: 2738261 - RNA, 22 nt, Human
uggacacagcucuucuccaggc

SEQ ID NO: 2738262 - RNA, 13 nt, Human
uggacacagcucu

SEQ ID NO: 2738263 - RNA, 14 nt, Human
uggacacagcucuu

SEQ ID NO: 2738264 - RNA, 13 nt, Human
uggaaaggcagcu

SEQ ID NO: 2738265 - RNA, 14 nt, Human
ugcuuuuggucugu

SEQ ID NO: 2738266 - RNA, 17 nt, Human
ugcuuuuggucugugug

SEQ ID NO: 2738267 - RNA, 12 nt, Human
ugcuuugugauu

SEQ ID NO: 2738268 - RNA, 16 nt, Human
ugcuuugugauuuuug

SEQ ID NO: 2738269 - RNA, 14 nt, Human
ugcuuugugauuuu

SEQ ID NO: 2738270 - RNA, 22 nt, Human
ugcuuguacauaaugcgugcau

SEQ ID NO: 2738271 - RNA, 16 nt, Human
ugcuuguacauaaugc

SEQ ID NO: 2738272 - RNA, 14 nt, Human
ugcuuguacauaau

SEQ ID NO: 2738273 - RNA, 21 nt, Human
ugcuugaggcaacucaucuua

SEQ ID NO: 2738274 - RNA, 13 nt, Human
ugcuuguacauaa

SEQ ID NO: 2738275 - RNA, 12 nt, Human
ugcuuguacaua

SEQ ID NO: 2738276 - RNA, 14 nt, Human
ugcuuggaggaagg

SEQ ID NO: 2738277 - RNA, 15 nt, Human
ugcuuggaggaagga

SEQ ID NO: 2738278 - RNA, 16 nt, Human
ugcuuggaggaaggaa

SEQ ID NO: 2738279 - RNA, 15 nt, Human
uggaaaucuuuaaaa

SEQ ID NO: 2738280 - RNA, 14 nt, Human
uggaaaucuuuaaa

SEQ ID NO: 2738281 - RNA, 17 nt, Human
uggaaaugggcagagca

SEQ ID NO: 2738282 - RNA, 18 nt, Human
uggaaaugggcagagcag

SEQ ID NO: 2738283 - RNA, 16 nt, Human
uggaagcacagcuuca

SEQ ID NO: 2738284 - RNA, 17 nt, Human
uggaagguauuuaauag

SEQ ID NO: 2738285 - RNA, 13 nt, Human
uggaagguauuua

SEQ ID NO: 2738286 - RNA, 13 nt, Human
aggauccugagcc

SEQ ID NO: 2738287 - RNA, 14 nt, Human
aggauccugagcca

SEQ ID NO: 2738288 - RNA, 19 nt, Human
uggcacaguuuucugagaa

SEQ ID NO: 2738289 - RNA, 13 nt, Human
uggcagccuuggc

SEQ ID NO: 2738290 - RNA, 18 nt, Human
uggcacaguuuucugaga

SEQ ID NO: 2738291 - RNA, 17 nt, Human
uggcagccuuggcaaac

SEQ ID NO: 2738292 - RNA, 15 nt, Human
uggcagcucaccucu

SEQ ID NO: 2738293 - RNA, 16 nt, Human
aggccacaagacccuu

SEQ ID NO: 2738294 - RNA, 19 nt, Human
uggcagcucaccucucccu

SEQ ID NO: 2738295 - RNA, 14 nt, Human
aggccagagggagu

SEQ ID NO: 2738296 - RNA, 19 nt, Human
aggccacaagacccuugug

SEQ ID NO: 2738297 - RNA, 17 nt, Human
aggccacaagacccuug

SEQ ID NO: 2738298 - RNA, 18 nt, Human
aggccacaagacccuugu

SEQ ID NO: 2738299 - RNA, 16 nt, Human
aggccccgcccaggcu

SEQ ID NO: 2738300 - RNA, 21 nt, Human
aggcccagagggccugcaagg

SEQ ID NO: 2738301 - RNA, 20 nt, Human
aggccagagggagugacaga

SEQ ID NO: 2738302 - RNA, 14 nt, Human
uggaguauauguca

SEQ ID NO: 2738303 - RNA, 13 nt, Human
uggauuguccccg

SEQ ID NO: 2738304 - RNA, 16 nt, Human
aggccaaggugggagg

SEQ ID NO: 2738305 - RNA, 18 nt, Human
aggcagccaggccacaag

SEQ ID NO: 2738306 - RNA, 16 nt, Human
aggcagccccauucug

SEQ ID NO: 2738307 - RNA, 17 nt, Human
aggcagccccauucugc

SEQ ID NO: 2738308 - RNA, 16 nt, Human
aggccaaaggaagcac

SEQ ID NO: 2738309 - RNA, 18 nt, Human
aggccaaaggaagcacau

SEQ ID NO: 2738310 - RNA, 19 nt, Human
aggccaaaggaagcacaug

SEQ ID NO: 2738311 - RNA, 15 nt, Human
aggccaaaggaagca

SEQ ID NO: 2738312 - RNA, 12 nt, Human
aggccuggggac

SEQ ID NO: 2738313 - RNA, 18 nt, Human
aggccugggggcugggca

SEQ ID NO: 2738314 - RNA, 20 nt, Human
aggccugggggcugggcaga

SEQ ID NO: 2738315 - RNA, 12 nt, Human
uggccuggcccc

SEQ ID NO: 2738316 - RNA, 18 nt, Human
uggccuggccccucaggg

SEQ ID NO: 2738317 - RNA, 21 nt, Human
uggccuggccccucagggucc

SEQ ID NO: 2738318 - RNA, 13 nt, Human
uggcccacgcacu

SEQ ID NO: 2738319 - RNA, 23 nt, Human
uggccgggcgcgguggcucacgc

SEQ ID NO: 2738320 - RNA, 13 nt, Human
uggccucuucaga

SEQ ID NO: 2738321 - RNA, 17 nt, Human
uggcauaacauaaaucu

SEQ ID NO: 2738322 - RNA, 16 nt, Human
uggcauauuuuucaca

SEQ ID NO: 2738323 - RNA, 17 nt, Human
uggcauauuuuucacau

SEQ ID NO: 2738324 - RNA, 17 nt, Human
aggccccgcccaggcuu

SEQ ID NO: 2738325 - RNA, 12 nt, Human
aggccccugcca

SEQ ID NO: 2738326 - RNA, 22 nt, Human
uggcauaacauaaaucugugaa

SEQ ID NO: 2738327 - RNA, 21 nt, Human
uggcauaacauaaaucuguga

SEQ ID NO: 2738328 - RNA, 21 nt, Human
uggccaaagccaaagcuaggc

SEQ ID NO: 2738329 - RNA, 23 nt, Human
uggccaaagccaaagcuaggccu

SEQ ID NO: 2738330 - RNA, 23 nt, Human
uggccagugugacaaggauugcu

SEQ ID NO: 2738331 - RNA, 19 nt, Human
agcuguucacagccagacu

SEQ ID NO: 2738332 - RNA, 16 nt, Human
agcuguucacagccag

SEQ ID NO: 2738333 - RNA, 13 nt, Human
agcuguucagcug

SEQ ID NO: 2738334 - RNA, 17 nt, Human
ugccuguucagcuccag

SEQ ID NO: 2738335 - RNA, 18 nt, Human
ugccuguucagcuccagc

SEQ ID NO: 2738336 - RNA, 20 nt, Human
ugccuguucagcuccagcuc

SEQ ID NO: 2738337 - RNA, 20 nt, Human
ugccuguugggccaggagcc

SEQ ID NO: 2738338 - RNA, 21 nt, Human
ugccuguucagcuccagcuca

SEQ ID NO: 2738339 - RNA, 19 nt, Human
ugccuguugggccaggagc

SEQ ID NO: 2738340 - RNA, 15 nt, Human
ugccuuauggaacac

SEQ ID NO: 2738341 - RNA, 16 nt, Human
ugccuuauggaacacu

SEQ ID NO: 2738342 - RNA, 19 nt, Human
agcugugcucuggacaggc

SEQ ID NO: 2738343 - RNA, 20 nt, Human
agcugugcucuggacaggca

SEQ ID NO: 2738344 - RNA, 21 nt, Human
agcugugcucuggacaggcau

SEQ ID NO: 2738345 - RNA, 23 nt, Human
agcugugcucuggacaggcaugu

SEQ ID NO: 2738346 - RNA, 22 nt, Human
agcugcccucuccugggcagcu

SEQ ID NO: 2738347 - RNA, 15 nt, Human
agcugccuccccucc

SEQ ID NO: 2738348 - RNA, 16 nt, Human
agcugccuccccuccu

SEQ ID NO: 2738349 - RNA, 20 nt, Human
agcugccuguucagcuccag

SEQ ID NO: 2738350 - RNA, 15 nt, Human
ugccuggauggggcu

SEQ ID NO: 2738351 - RNA, 14 nt, Human
ugccuggauggggc

SEQ ID NO: 2738352 - RNA, 21 nt, Human
agcugcuuuugucuaugggac

SEQ ID NO: 2738353 - RNA, 19 nt, Human
agcugccuguucagcucca

SEQ ID NO: 2738354 - RNA, 21 nt, Human
agcugcuugggcuucauccuc

SEQ ID NO: 2738355 - RNA, 21 nt, Human
agcugccuguucagcuccagc

SEQ ID NO: 2738356 - RNA, 22 nt, Human
agcugccuguucagcuccagcu

SEQ ID NO: 2738357 - RNA, 14 nt, Human
ugccugcccaggcc

SEQ ID NO: 2738358 - RNA, 15 nt, Human
ugccugcccaggccc

SEQ ID NO: 2738359 - RNA, 24 nt, Human
ugccugcccaggccccugccaccc

SEQ ID NO: 2738360 - RNA, 16 nt, Human
ugccugcccaggcccc

SEQ ID NO: 2738361 - RNA, 12 nt, Human
ugcccaggcagg

SEQ ID NO: 2738362 - RNA, 13 nt, Human
ugcccaggcaggu

SEQ ID NO: 2738363 - RNA, 14 nt, Human
ugcccaggcagguc

SEQ ID NO: 2738364 - RNA, 13 nt, Human
ugccucugccucu

SEQ ID NO: 2738365 - RNA, 14 nt, Human
ugccucugccucug

SEQ ID NO: 2738366 - RNA, 13 nt, Human
ugccugcccaggc

SEQ ID NO: 2738367 - RNA, 15 nt, Human
ugccucugccucuga

SEQ ID NO: 2738368 - RNA, 19 nt, Human
ugcuacaaaaacacagcaa

SEQ ID NO: 2738369 - RNA, 18 nt, Human
ugcuacaaaaacacagca

SEQ ID NO: 2738370 - RNA, 17 nt, Human
ugcuacaaaaacacagc

SEQ ID NO: 2738371 - RNA, 16 nt, Human
ugcuacaaaaacacag

SEQ ID NO: 2738372 - RNA, 15 nt, Human
ugcuacaaaaacaca

SEQ ID NO: 2738373 - RNA, 22 nt, Human
ugcuaaggacuuguuagaucua

SEQ ID NO: 2738374 - RNA, 18 nt, Human
ugcuaaggacuuguuaga

SEQ ID NO: 2738375 - RNA, 13 nt, Human
ugcuaaggacuug

SEQ ID NO: 2738376 - RNA, 20 nt, Human
ugcuacaaaaacacagcaag

SEQ ID NO: 2738377 - RNA, 14 nt, Human
agcuguucagcugg

SEQ ID NO: 2738378 - RNA, 17 nt, Human
agcuugaaacugagaug

SEQ ID NO: 2738379 - RNA, 19 nt, Human
agcuugaccgugaggccag

SEQ ID NO: 2738380 - RNA, 18 nt, Human
agcuugaggguugggcug

SEQ ID NO: 2738381 - RNA, 14 nt, Human
agcuugaggguugg

SEQ ID NO: 2738382 - RNA, 17 nt, Human
ugcggccuuuggcuuca

SEQ ID NO: 2738383 - RNA, 19 nt, Human
ugcggccuuuggcuucacg

SEQ ID NO: 2738384 - RNA, 20 nt, Human
ugcgggcuuccuccuggugu

SEQ ID NO: 2738385 - RNA, 17 nt, Human
ugcgguccacccaggag

SEQ ID NO: 2738386 - RNA, 18 nt, Human
ugcgguccacccaggagc

SEQ ID NO: 2738387 - RNA, 17 nt, Human
ugcggugcuaucucccc

SEQ ID NO: 2738388 - RNA, 21 nt, Human
ugcggugcuaucucccccagc

SEQ ID NO: 2738389 - RNA, 12 nt, Human
ugcuaaggacuu

SEQ ID NO: 2738390 - RNA, 23 nt, Human
ugcggacagccacggccaggcca

SEQ ID NO: 2738391 - RNA, 22 nt, Human
ugcggacagccacggccaggcc

SEQ ID NO: 2738392 - RNA, 13 nt, Human
ugcuguauuuuaa

SEQ ID NO: 2738393 - RNA, 21 nt, Human
ugcuguauuuuaaaagaauga

SEQ ID NO: 2738394 - RNA, 22 nt, Human
ugcuguauuuuaaaagaaugau

SEQ ID NO: 2738395 - RNA, 21 nt, Human
ugcugggauuacaagcgugag

SEQ ID NO: 2738396 - RNA, 17 nt, Human
ugcugggauuacaggug

SEQ ID NO: 2738397 - RNA, 19 nt, Human
ugcugggauuacaagcgug

SEQ ID NO: 2738398 - RNA, 19 nt, Human
ugcuggcuguuggcugggg

SEQ ID NO: 2738399 - RNA, 21 nt, Human
ugcuggcuguuggcugggggc

SEQ ID NO: 2738400 - RNA, 11 nt, Human
ugcugcccugu

SEQ ID NO: 2738401 - RNA, 19 nt, Human
ugcugcccugcccaccugg

SEQ ID NO: 2738402 - RNA, 21 nt, Human
ugcugcccugcccaccuggcc

SEQ ID NO: 2738403 - RNA, 23 nt, Human
aggaauggagccugcacggugaa

SEQ ID NO: 2738404 - RNA, 13 nt, Human
ugcugcccugccc

SEQ ID NO: 2738405 - RNA, 16 nt, Human
ugcugcccugcccacc

SEQ ID NO: 2738406 - RNA, 17 nt, Human
ugcugcccugcccaccu

SEQ ID NO: 2738407 - RNA, 18 nt, Human
ugcugcccugcccaccug

SEQ ID NO: 2738408 - RNA, 17 nt, Human
aggacacugauaugggu

SEQ ID NO: 2738409 - RNA, 18 nt, Human
aggacacuaaccacgcug

SEQ ID NO: 2738410 - RNA, 16 nt, Human
ugcuuccagugaggcu

SEQ ID NO: 2738411 - RNA, 20 nt, Human
ugcuucaaggauccugagcc

SEQ ID NO: 2738412 - RNA, 21 nt, Human
ugcuucaaggauccugagcca

SEQ ID NO: 2738413 - RNA, 23 nt, Human
ugcuucaaggauccugagccaga

SEQ ID NO: 2738414 - RNA, 17 nt, Human
ugcugucccuuacguga

SEQ ID NO: 2738415 - RNA, 19 nt, Human
ugcugucccuuacgugagu

SEQ ID NO: 2738416 - RNA, 15 nt, Human
ugcugucccuuuucc

SEQ ID NO: 2738417 - RNA, 17 nt, Human
ugcugucccuuuuccuu

SEQ ID NO: 2738418 - RNA, 23 nt, Human
aggaaaucaaauaugcaaagcac

SEQ ID NO: 2738419 - RNA, 15 nt, Human
aggaaaucaccgaaa

SEQ ID NO: 2738420 - RNA, 19 nt, Human
aggaaaucaccgaaaacgu

SEQ ID NO: 2738421 - RNA, 11 nt, Human
aggaagcacau

SEQ ID NO: 2738422 - RNA, 16 nt, Human
aggaagcacaugccuc

SEQ ID NO: 2738423 - RNA, 17 nt, Human
aggaagcacaugccucu

SEQ ID NO: 2738424 - RNA, 12 nt, Human
aggaaauauuua

SEQ ID NO: 2738425 - RNA, 16 nt, Human
aggaaaggcuccagga

SEQ ID NO: 2738426 - RNA, 15 nt, Human
aggaaaggcuccagg

SEQ ID NO: 2738427 - RNA, 13 nt, Human
aggaaaggcucca

SEQ ID NO: 2738428 - RNA, 14 nt, Human
aggaaaggcuccag

SEQ ID NO: 2738429 - RNA, 18 nt, Human
aggaagccagcaggcucu

SEQ ID NO: 2738430 - RNA, 18 nt, Human
aggaagccgcuggggcca

SEQ ID NO: 2738431 - RNA, 19 nt, Human
aggaagccgcuggggccag

SEQ ID NO: 2738432 - RNA, 20 nt, Human
aggaagccgcuggggccagu

SEQ ID NO: 2738433 - RNA, 21 nt, Human
aggaagccagcaggcucucag

SEQ ID NO: 2738434 - RNA, 22 nt, Human
aggaagccagcaggcucucagg

SEQ ID NO: 2738435 - RNA, 23 nt, Human
aggaagccagcaggcucucaggc

SEQ ID NO: 2738436 - RNA, 18 nt, Human
aggaagccugauuaaaga

SEQ ID NO: 2738437 - RNA, 17 nt, Human
aggaagccugauuaaag

SEQ ID NO: 2738438 - RNA, 12 nt, Human
aggaagcucagg

SEQ ID NO: 2738439 - RNA, 21 nt, Human
aggaagccugauuaaagaaug

SEQ ID NO: 2738440 - RNA, 23 nt, Human
aggaaggaaacccagcucugguc

SEQ ID NO: 2738441 - RNA, 20 nt, Human
aggaaggaaacccagcucug

SEQ ID NO: 2738442 - RNA, 22 nt, Human
aggaaggaaacccagcucuggu

SEQ ID NO: 2738443 - RNA, 14 nt, Human
ugcucauggaauug

SEQ ID NO: 2738444 - RNA, 14 nt, Human
ugcucuggacaggc

SEQ ID NO: 2738445 - RNA, 15 nt, Human
ugcucuggacaggca

SEQ ID NO: 2738446 - RNA, 16 nt, Human
ugcucuggacaggcau

SEQ ID NO: 2738447 - RNA, 11 nt, Human
ugcucauggaa

SEQ ID NO: 2738448 - RNA, 20 nt, Human
ugcuaucucccccagcccca

SEQ ID NO: 2738449 - RNA, 19 nt, Human
ugcuaucucccccagcccc

SEQ ID NO: 2738450 - RNA, 23 nt, Human
agcuuuaucaaagggugaaaauu

SEQ ID NO: 2738451 - RNA, 19 nt, Human
aguagauaggccaugggca

SEQ ID NO: 2738452 - RNA, 18 nt, Human
uguaggaagguuaauguu

SEQ ID NO: 2738453 - RNA, 20 nt, Human
uguaggaagguuaauguuca

SEQ ID NO: 2738454 - RNA, 12 nt, Human
aguagagacagg

SEQ ID NO: 2738455 - RNA, 13 nt, Human
aguagaacagaua

SEQ ID NO: 2738456 - RNA, 19 nt, Human
aguagaacagauaaucagu

SEQ ID NO: 2738457 - RNA, 14 nt, Human
aguacacuguuuca

SEQ ID NO: 2738458 - RNA, 20 nt, Human
aguacacuguuucaaacuuu

SEQ ID NO: 2738459 - RNA, 16 nt, Human
aguacacuguuucaaa

SEQ ID NO: 2738460 - RNA, 15 nt, Human
aguaaaaccacagca

SEQ ID NO: 2738461 - RNA, 20 nt, Human
aguaagccgugauuuucauu

SEQ ID NO: 2738462 - RNA, 11 nt, Human
agguuuuccug

SEQ ID NO: 2738463 - RNA, 17 nt, Human
aguaauaugcacacauu

SEQ ID NO: 2738464 - RNA, 20 nt, Human
aguaauaugcacacauuuuu

SEQ ID NO: 2738465 - RNA, 19 nt, Human
aguaauaugcacacauuuu

SEQ ID NO: 2738466 - RNA, 18 nt, Human
aguaauaugcacacauuu

SEQ ID NO: 2738467 - RNA, 17 nt, Human
uguacuuuuuggcauaa

SEQ ID NO: 2738468 - RNA, 13 nt, Human
uguagagugggag

SEQ ID NO: 2738469 - RNA, 14 nt, Human
uguagagugggagc

SEQ ID NO: 2738470 - RNA, 12 nt, Human
uguacuuuuugg

SEQ ID NO: 2738471 - RNA, 16 nt, Human
uguacuuuuuggcaua

SEQ ID NO: 2738472 - RNA, 15 nt, Human
uguacuuuuuggcau

SEQ ID NO: 2738473 - RNA, 14 nt, Human
uguaauuugugaua

SEQ ID NO: 2738474 - RNA, 21 nt, Human
aggugcacaagcuccaagcuc

SEQ ID NO: 2738475 - RNA, 20 nt, Human
aggugggauccuccaggugc

SEQ ID NO: 2738476 - RNA, 22 nt, Human
uguaaaucccauuauucaaagu

SEQ ID NO: 2738477 - RNA, 20 nt, Human
uguaaaucccauuauucaaa

SEQ ID NO: 2738478 - RNA, 19 nt, Human
uguaaaucccauuauucaa

SEQ ID NO: 2738479 - RNA, 15 nt, Human
aggugcacaagcucc

SEQ ID NO: 2738480 - RNA, 16 nt, Human
aggugcacaagcucca

SEQ ID NO: 2738481 - RNA, 17 nt, Human
aggugcacaagcuccaa

SEQ ID NO: 2738482 - RNA, 18 nt, Human
aggugcacaagcuccaag

SEQ ID NO: 2738483 - RNA, 20 nt, Human
aggugcacaagcuccaagcu

SEQ ID NO: 2738484 - RNA, 13 nt, Human
uguaaaucccauu

SEQ ID NO: 2738485 - RNA, 18 nt, Human
uguaaaucccauuauuca

SEQ ID NO: 2738486 - RNA, 16 nt, Human
uguaaaucccauuauu

SEQ ID NO: 2738487 - RNA, 23 nt, Human
aggucuugaacuccuggccucaa

SEQ ID NO: 2738488 - RNA, 17 nt, Human
aggugguuauggagagg

SEQ ID NO: 2738489 - RNA, 14 nt, Human
agguuggugggggc

SEQ ID NO: 2738490 - RNA, 23 nt, Human
uguaauuaaguacuauguaucaa

SEQ ID NO: 2738491 - RNA, 13 nt, Human
uguaauuauaucu

SEQ ID NO: 2738492 - RNA, 15 nt, Human
uguaauuauaucuga

SEQ ID NO: 2738493 - RNA, 14 nt, Human
uguaauuauaucug

SEQ ID NO: 2738494 - RNA, 15 nt, Human
uguaaguaaacgguc

SEQ ID NO: 2738495 - RNA, 21 nt, Human
ugucaauaaaauccauacauu

SEQ ID NO: 2738496 - RNA, 15 nt, Human
ugucaagccauaauu

SEQ ID NO: 2738497 - RNA, 19 nt, Human
ugucaagagggucugagga

SEQ ID NO: 2738498 - RNA, 14 nt, Human
uguauuuuuuuacu

SEQ ID NO: 2738499 - RNA, 20 nt, Human
ugucaaucagccuaguugau

SEQ ID NO: 2738500 - RNA, 16 nt, Human
aguaggaagacuuugg

SEQ ID NO: 2738501 - RNA, 17 nt, Human
aguaggaagacuuugga

SEQ ID NO: 2738502 - RNA, 18 nt, Human
aguaggaagacuuuggaa

SEQ ID NO: 2738503 - RNA, 19 nt, Human
aguaggaagacuuuggaaa

SEQ ID NO: 2738504 - RNA, 22 nt, Human
aguaggaagacuuuggaaagac

SEQ ID NO: 2738505 - RNA, 22 nt, Human
aguauuucuaugaaauauuaug

SEQ ID NO: 2738506 - RNA, 16 nt, Human
aguauuugagaguucu

SEQ ID NO: 2738507 - RNA, 13 nt, Human
agucaccaagccc

SEQ ID NO: 2738508 - RNA, 14 nt, Human
agucaccaagccca

SEQ ID NO: 2738509 - RNA, 20 nt, Human
agucacauuccugaacagga

SEQ ID NO: 2738510 - RNA, 18 nt, Human
agucacauuccugaacag

SEQ ID NO: 2738511 - RNA, 19 nt, Human
agucacauuccugaacagg

SEQ ID NO: 2738512 - RNA, 13 nt, Human
aguauuucuauga

SEQ ID NO: 2738513 - RNA, 15 nt, Human
aguauuucuaugaaa

SEQ ID NO: 2738514 - RNA, 16 nt, Human
ugucagguggggcagc

SEQ ID NO: 2738515 - RNA, 19 nt, Human
ugucagcugaaccugggua

SEQ ID NO: 2738516 - RNA, 16 nt, Human
ugucagcugaaccugg

SEQ ID NO: 2738517 - RNA, 19 nt, Human
agucacugagacagcccgg

SEQ ID NO: 2738518 - RNA, 18 nt, Human
agucacugagacagcccg

SEQ ID NO: 2738519 - RNA, 16 nt, Human
agucaggaaagagaac

SEQ ID NO: 2738520 - RNA, 15 nt, Human
agucaggaaagagaa

SEQ ID NO: 2738521 - RNA, 22 nt, Human
agucagaaguuucugccgcagc

SEQ ID NO: 2738522 - RNA, 14 nt, Human
ugucgggcaugaca

SEQ ID NO: 2738523 - RNA, 15 nt, Human
ugucgggcaugacac

SEQ ID NO: 2738524 - RNA, 12 nt, Human
ugucgggcauga

SEQ ID NO: 2738525 - RNA, 14 nt, Human
ugucgcccagucug

SEQ ID NO: 2738526 - RNA, 15 nt, Human
ugucgcccagucugg

SEQ ID NO: 2738527 - RNA, 16 nt, Human
uguccuacccacccuc

SEQ ID NO: 2738528 - RNA, 13 nt, Human
uguccgagcuuug

SEQ ID NO: 2738529 - RNA, 14 nt, Human
uguccgagcuuuga

SEQ ID NO: 2738530 - RNA, 17 nt, Human
ugucccuuuuccuuuuu

SEQ ID NO: 2738531 - RNA, 16 nt, Human
agucucacuguugccc

SEQ ID NO: 2738532 - RNA, 17 nt, Human
agucucacuguugccca

SEQ ID NO: 2738533 - RNA, 23 nt, Human
aguccgaaagggacuuggaagcu

SEQ ID NO: 2738534 - RNA, 12 nt, Human
agucccugccaa

SEQ ID NO: 2738535 - RNA, 17 nt, Human
agggcagggacaggaua

SEQ ID NO: 2738536 - RNA, 23 nt, Human
agggcccagagaggguggugacc

SEQ ID NO: 2738537 - RNA, 18 nt, Human
agggcccagagagggugg

SEQ ID NO: 2738538 - RNA, 17 nt, Human
agggaggugaccccagg

SEQ ID NO: 2738539 - RNA, 17 nt, Human
agggagugacagaggca

SEQ ID NO: 2738540 - RNA, 18 nt, Human
agggagugacagaggcag

SEQ ID NO: 2738541 - RNA, 19 nt, Human
agggagugacagaggcagc

SEQ ID NO: 2738542 - RNA, 15 nt, Human
agggagggcuucugc

SEQ ID NO: 2738543 - RNA, 20 nt, Human
ugggcccaaugcacuuuguu

SEQ ID NO: 2738544 - RNA, 14 nt, Human
ugggccaggagccu

SEQ ID NO: 2738545 - RNA, 16 nt, Human
ugggccaggagccucc

SEQ ID NO: 2738546 - RNA, 13 nt, Human
ugggccaggagcc

SEQ ID NO: 2738547 - RNA, 17 nt, Human
ugggcaacccccagccu

SEQ ID NO: 2738548 - RNA, 20 nt, Human
ugggcaacccccagccugcu

SEQ ID NO: 2738549 - RNA, 18 nt, Human
ugggaggucaaggcugca

SEQ ID NO: 2738550 - RNA, 19 nt, Human
ugggaggucaaggcugcag

SEQ ID NO: 2738551 - RNA, 20 nt, Human
ugggaggucaaggcugcagu

SEQ ID NO: 2738552 - RNA, 23 nt, Human
ugggaggucaaggcugcagugag

SEQ ID NO: 2738553 - RNA, 17 nt, Human
ugggaggucaaggcugc

SEQ ID NO: 2738554 - RNA, 16 nt, Human
ugggcaacccccagcc

SEQ ID NO: 2738555 - RNA, 20 nt, Human
uggggcugcaccggcuggcc

SEQ ID NO: 2738556 - RNA, 14 nt, Human
ugggguacccacug

SEQ ID NO: 2738557 - RNA, 17 nt, Human
uggggucacucuggcag

SEQ ID NO: 2738558 - RNA, 18 nt, Human
uggggucacucuggcagc

SEQ ID NO: 2738559 - RNA, 15 nt, Human
ugggguacccacugc

SEQ ID NO: 2738560 - RNA, 16 nt, Human
ugggguacccacugcu

SEQ ID NO: 2738561 - RNA, 20 nt, Human
ugggguacccacugcucugg

SEQ ID NO: 2738562 - RNA, 15 nt, Human
uggggcccugccucc

SEQ ID NO: 2738563 - RNA, 16 nt, Human
uggggcccugccuccu

SEQ ID NO: 2738564 - RNA, 18 nt, Human
uggggcggugagagggga

SEQ ID NO: 2738565 - RNA, 23 nt, Human
uggggaccucaggccugggggcu

SEQ ID NO: 2738566 - RNA, 12 nt, Human
uggggagaaagu

SEQ ID NO: 2738567 - RNA, 14 nt, Human
uggggcccugccuc

SEQ ID NO: 2738568 - RNA, 18 nt, Human
ugggcucccuucccaccu

SEQ ID NO: 2738569 - RNA, 19 nt, Human
ugggcucccuucccaccuc

SEQ ID NO: 2738570 - RNA, 23 nt, Human
agggcuucugccauuucugagau

SEQ ID NO: 2738571 - RNA, 20 nt, Human
ugggcucccuucccaccucu

SEQ ID NO: 2738572 - RNA, 18 nt, Human
ugggcuggguucuaccca

SEQ ID NO: 2738573 - RNA, 19 nt, Human
ugggcuggguucuacccag

SEQ ID NO: 2738574 - RNA, 15 nt, Human
uggggaaugaagaua

SEQ ID NO: 2738575 - RNA, 14 nt, Human
uggggaaugaagau

SEQ ID NO: 2738576 - RNA, 14 nt, Human
uggggaccagagcu

SEQ ID NO: 2738577 - RNA, 15 nt, Human
uggggaccagagcug

SEQ ID NO: 2738578 - RNA, 13 nt, Human
uggggaccucagg

SEQ ID NO: 2738579 - RNA, 17 nt, Human
uggggaccagagcugcc

SEQ ID NO: 2738580 - RNA, 18 nt, Human
uggggaccagagcugcca

SEQ ID NO: 2738581 - RNA, 20 nt, Human
ugguaaggggaauugaggac

SEQ ID NO: 2738582 - RNA, 16 nt, Human
ugguacuaacuuuccu

SEQ ID NO: 2738583 - RNA, 22 nt, Human
agggucucacucugucgcccag

SEQ ID NO: 2738584 - RNA, 21 nt, Human
agggucucacucugucgccca

SEQ ID NO: 2738585 - RNA, 22 nt, Human
uggguggcaccagcagccugga

SEQ ID NO: 2738586 - RNA, 22 nt, Human
ugggugcuuggaggaaggaaac

SEQ ID NO: 2738587 - RNA, 15 nt, Human
ugggugcuuggagga

SEQ ID NO: 2738588 - RNA, 19 nt, Human
ugggugcuuggaggaagga

SEQ ID NO: 2738589 - RNA, 24 nt, Human
agggguucccuuuuuuggcugcug

SEQ ID NO: 2738590 - RNA, 21 nt, Human
agggucucacuauguugccca

SEQ ID NO: 2738591 - RNA, 22 nt, Human
agggucucacuauguugcccag

SEQ ID NO: 2738592 - RNA, 23 nt, Human
agggucucacuauguugcccagg

SEQ ID NO: 2738593 - RNA, 15 nt, Human
aggggguggccuccc

SEQ ID NO: 2738594 - RNA, 17 nt, Human
aggggguggccucccaa

SEQ ID NO: 2738595 - RNA, 18 nt, Human
aggggguggccucccaac

SEQ ID NO: 2738596 - RNA, 22 nt, Human
aggggugggacacccugugaug

SEQ ID NO: 2738597 - RNA, 20 nt, Human
aggggugggacacccuguga

SEQ ID NO: 2738598 - RNA, 20 nt, Human
uggggucacucuggcagcuc

SEQ ID NO: 2738599 - RNA, 19 nt, Human
uggggucacucuggcagcu

SEQ ID NO: 2738600 - RNA, 23 nt, Human
aggggagcaaaaucgaugcagug

SEQ ID NO: 2738601 - RNA, 13 nt, Human
aggguuauaauaa

SEQ ID NO: 2738602 - RNA, 22 nt, Human
aggguguccggucccuguccca

SEQ ID NO: 2738603 - RNA, 21 nt, Human
aggguggugaccucugccuga

SEQ ID NO: 2738604 - RNA, 16 nt, Human
uggucugacccacugc

SEQ ID NO: 2738605 - RNA, 17 nt, Human
uggucugacccacugcu

SEQ ID NO: 2738606 - RNA, 14 nt, Human
uggucccaccccac

SEQ ID NO: 2738607 - RNA, 15 nt, Human
uggucccaccccaca

SEQ ID NO: 2738608 - RNA, 20 nt, Human
uggucaccaaaucagcugcu

SEQ ID NO: 2738609 - RNA, 22 nt, Human
uggucagauuugaacucuucaa

SEQ ID NO: 2738610 - RNA, 18 nt, Human
uggucaccaaaucagcug

SEQ ID NO: 2738611 - RNA, 17 nt, Human
uggucucaaacucuuga

SEQ ID NO: 2738612 - RNA, 23 nt, Human
uggucucaaacucuugaccucag

SEQ ID NO: 2738613 - RNA, 16 nt, Human
uggucucaaacucuug

SEQ ID NO: 2738614 - RNA, 16 nt, Human
uggucccaccccacac

SEQ ID NO: 2738615 - RNA, 23 nt, Human
agguacuucaaauccuugaagau

SEQ ID NO: 2738616 - RNA, 19 nt, Human
agguagaaauaucugaaaa

SEQ ID NO: 2738617 - RNA, 17 nt, Human
agguagaaauaucugaa

SEQ ID NO: 2738618 - RNA, 18 nt, Human
aggguuggccccugcccg

SEQ ID NO: 2738619 - RNA, 23 nt, Human
aggguuggccccugcccggcugc

SEQ ID NO: 2738620 - RNA, 17 nt, Human
aggguuggccccugccc

SEQ ID NO: 2738621 - RNA, 23 nt, Human
agguagaaauaucugaaaaugua

SEQ ID NO: 2738622 - RNA, 21 nt, Human
agguaugcaaucaaaucugcu

SEQ ID NO: 2738623 - RNA, 18 nt, Human
aggucauauuaauauauu

SEQ ID NO: 2738624 - RNA, 19 nt, Human
aggucauauuaauauauuu

SEQ ID NO: 2738625 - RNA, 12 nt, Human
aggucagagccu

SEQ ID NO: 2738626 - RNA, 20 nt, Human
aggucauuuuuuuuaagaaa

SEQ ID NO: 2738627 - RNA, 17 nt, Human
aggucauuuuuuuuaag

SEQ ID NO: 2738628 - RNA, 15 nt, Human
agugccuuacacaau

SEQ ID NO: 2738629 - RNA, 20 nt, Human
agugcugcauuuaaaagaua

SEQ ID NO: 2738630 - RNA, 17 nt, Human
agugccuuacacaaugg

SEQ ID NO: 2738631 - RNA, 22 nt, Human
agugcugcauuuaaaagauaca

SEQ ID NO: 2738632 - RNA, 20 nt, Human
agugcugggauuacaagcgu

SEQ ID NO: 2738633 - RNA, 19 nt, Human
agugcugggauuacaggug

SEQ ID NO: 2738634 - RNA, 16 nt, Human
uguggucccaccccac

SEQ ID NO: 2738635 - RNA, 16 nt, Human
agugcuuccaaggaug

SEQ ID NO: 2738636 - RNA, 17 nt, Human
uguggugacuuuggaua

SEQ ID NO: 2738637 - RNA, 16 nt, Human
uguggugacuuuggau

SEQ ID NO: 2738638 - RNA, 19 nt, Human
ugugucagcauagaaguaa

SEQ ID NO: 2738639 - RNA, 12 nt, Human
ugugguuucauu

SEQ ID NO: 2738640 - RNA, 14 nt, Human
uguguuaugaagca

SEQ ID NO: 2738641 - RNA, 23 nt, Human
uguguuaucacccagaagaaaau

SEQ ID NO: 2738642 - RNA, 16 nt, Human
ugugucucuugguccu

SEQ ID NO: 2738643 - RNA, 13 nt, Human
ugugucucuuggu

SEQ ID NO: 2738644 - RNA, 17 nt, Human
ugugucagguggggcag

SEQ ID NO: 2738645 - RNA, 19 nt, Human
ugugucagguggggcagcu

SEQ ID NO: 2738646 - RNA, 13 nt, Human
uguguugugaaug

SEQ ID NO: 2738647 - RNA, 21 nt, Human
uguuaacauggacaugaucuu

SEQ ID NO: 2738648 - RNA, 11 nt, Human
aguggaaaaau

SEQ ID NO: 2738649 - RNA, 18 nt, Human
aguggaaaaauagccugc

SEQ ID NO: 2738650 - RNA, 19 nt, Human
aguggaaaaauagccugcc

SEQ ID NO: 2738651 - RNA, 19 nt, Human
uguuaaugauagcuacugu

SEQ ID NO: 2738652 - RNA, 22 nt, Human
agugcaaauugucacaggacag

SEQ ID NO: 2738653 - RNA, 18 nt, Human
agugcaaauugucacagg

SEQ ID NO: 2738654 - RNA, 21 nt, Human
agugcaaauugucacaggaca

SEQ ID NO: 2738655 - RNA, 16 nt, Human
agugagucgaggacag

SEQ ID NO: 2738656 - RNA, 22 nt, Human
agugauucuccugccucagccu

SEQ ID NO: 2738657 - RNA, 24 nt, Human
agugauucuccugccucagccucc

SEQ ID NO: 2738658 - RNA, 16 nt, Human
agugccaaaaacaaca

SEQ ID NO: 2738659 - RNA, 14 nt, Human
agugcccacaggau

SEQ ID NO: 2738660 - RNA, 15 nt, Human
ugugcugcccugccc

SEQ ID NO: 2738661 - RNA, 13 nt, Human
ugugcugcccugc

SEQ ID NO: 2738662 - RNA, 14 nt, Human
ugugcugcccugcc

SEQ ID NO: 2738663 - RNA, 12 nt, Human
ugugcugcccug

SEQ ID NO: 2738664 - RNA, 19 nt, Human
ugugcucuggacaggcaug

SEQ ID NO: 2738665 - RNA, 16 nt, Human
ugugcucuggacaggc

SEQ ID NO: 2738666 - RNA, 18 nt, Human
ugugcucuggacaggcau

SEQ ID NO: 2738667 - RNA, 22 nt, Human
ugugcucugaucauccacugug

SEQ ID NO: 2738668 - RNA, 12 nt, Human
ugugcucugauc

SEQ ID NO: 2738669 - RNA, 23 nt, Human
ugugcucugaucauccacugugc

SEQ ID NO: 2738670 - RNA, 15 nt, Human
ugugcucuggacagg

SEQ ID NO: 2738671 - RNA, 21 nt, Human
agucucacuguugcccaggcu

SEQ ID NO: 2738672 - RNA, 20 nt, Human
agucucacuguugcccaggc

SEQ ID NO: 2738673 - RNA, 18 nt, Human
agucucacuguugcccag

SEQ ID NO: 2738674 - RNA, 19 nt, Human
agucucacuguugcccagg

SEQ ID NO: 2738675 - RNA, 21 nt, Human
ugugcccuaaaguguauuuuu

SEQ ID NO: 2738676 - RNA, 20 nt, Human
ugugcccuaaaguguauuuu

SEQ ID NO: 2738677 - RNA, 17 nt, Human
aguguuggagaagaacu

SEQ ID NO: 2738678 - RNA, 18 nt, Human
aguguuggagaagaacug

SEQ ID NO: 2738679 - RNA, 14 nt, Human
aguguuggagaaga

SEQ ID NO: 2738680 - RNA, 16 nt, Human
aguguuggagaagaac

SEQ ID NO: 2738681 - RNA, 21 nt, Human
aguguugaaacggaugauuuc

SEQ ID NO: 2738682 - RNA, 15 nt, Human
uguugcccaggcugg

SEQ ID NO: 2738683 - RNA, 13 nt, Human
uguugcccaggcu

SEQ ID NO: 2738684 - RNA, 19 nt, Human
uguucuuucacccuuuucu

SEQ ID NO: 2738685 - RNA, 20 nt, Human
uguucuugguuuguaaauua

SEQ ID NO: 2738686 - RNA, 22 nt, Human
uguucuugguuuguaaauuaac

SEQ ID NO: 2738687 - RNA, 18 nt, Human
uguucuuaguuugcaguu

SEQ ID NO: 2738688 - RNA, 18 nt, Human
uguucuagcauggcugcc

SEQ ID NO: 2738689 - RNA, 19 nt, Human
aguucggugagcuacaaau

SEQ ID NO: 2738690 - RNA, 15 nt, Human
aguucuacauaagua

SEQ ID NO: 2738691 - RNA, 16 nt, Human
aguucaauucucauuu

SEQ ID NO: 2738692 - RNA, 23 nt, Human
aguuccucauuagcauuuugcua

SEQ ID NO: 2738693 - RNA, 24 nt, Human
aguucacucuccauuuaauaauua

SEQ ID NO: 2738694 - RNA, 22 nt, Human
aguucacucuccauuuaauaau

SEQ ID NO: 2738695 - RNA, 14 nt, Human
uguuuauugucaaa

SEQ ID NO: 2738696 - RNA, 18 nt, Human
uguuuauuacaguauaau

SEQ ID NO: 2738697 - RNA, 19 nt, Human
uguuuagucuugucucaga

SEQ ID NO: 2738698 - RNA, 18 nt, Human
uguuuagucuugucucag

SEQ ID NO: 2738699 - RNA, 17 nt, Human
uguuuagucuugucuca

SEQ ID NO: 2738700 - RNA, 13 nt, Human
uguuuagucuugu

SEQ ID NO: 2738701 - RNA, 16 nt, Human
uguugucugcaacucu

SEQ ID NO: 2738702 - RNA, 13 nt, Human
uguugucugcaac

SEQ ID NO: 2738703 - RNA, 12 nt, Human
uguugugaaugu

SEQ ID NO: 2738704 - RNA, 13 nt, Human
uguugugaauguu

SEQ ID NO: 2738705 - RNA, 14 nt, Human
uguugugauguauu

SEQ ID NO: 2738706 - RNA, 20 nt, Human
uguugugauguauucuagcu

SEQ ID NO: 2738707 - RNA, 20 nt, Human
uguuuagauaauacaccacu

SEQ ID NO: 2738708 - RNA, 23 nt, Human
aguuuucugagaaagacuauuca

SEQ ID NO: 2738709 - RNA, 18 nt, Human
aguuuucugagaaagacu

SEQ ID NO: 2738710 - RNA, 19 nt, Human
aguuuucugagaaagacua

SEQ ID NO: 2738711 - RNA, 23 nt, Human
aguuuuuauggcuuuugugcauu

SEQ ID NO: 2738712 - RNA, 22 nt, Human
auaaaauaauuuuuauauuuga

SEQ ID NO: 2738713 - RNA, 21 nt, Human
uuaagaaaaaggaugcacaga

SEQ ID NO: 2738714 - RNA, 19 nt, Human
uuaagaaaaaggaugcaca

SEQ ID NO: 2738715 - RNA, 20 nt, Human
uuaagaaaaaggaugcacag

SEQ ID NO: 2738716 - RNA, 12 nt, Human
auaaaauaauuu

SEQ ID NO: 2738717 - RNA, 9 nt, Human
uuaaggugg

SEQ ID NO: 2738718 - RNA, 22 nt, Human
uuaagaaagacuaucuaaaugu

SEQ ID NO: 2738719 - RNA, 14 nt, Human
uuaaguauguguaa

SEQ ID NO: 2738720 - RNA, 14 nt, Human
uuaagugcugcauu

SEQ ID NO: 2738721 - RNA, 19 nt, Human
uuaagugcugcauuuaaaa

SEQ ID NO: 2738722 - RNA, 16 nt, Human
uuaagugcugcauuua

SEQ ID NO: 2738723 - RNA, 15 nt, Human
uuaagugcugcauuu

SEQ ID NO: 2738724 - RNA, 22 nt, Human
uuaaucugguuuauuuuuguuc

SEQ ID NO: 2738725 - RNA, 18 nt, Human
uuaaugaaagacuguaca

SEQ ID NO: 2738726 - RNA, 19 nt, Human
uuaaugaaagacuguacaa

SEQ ID NO: 2738727 - RNA, 23 nt, Human
uuaaucauuaggugugacugaau

SEQ ID NO: 2738728 - RNA, 22 nt, Human
uuaaucauuaggugugacugaa

SEQ ID NO: 2738729 - RNA, 13 nt, Human
uuaaucauuaggu

SEQ ID NO: 2738730 - RNA, 13 nt, Human
uguuucaaacaua

SEQ ID NO: 2738731 - RNA, 23 nt, Human
aguugccagucaccccggccacc

SEQ ID NO: 2738732 - RNA, 17 nt, Human
aguugccuaaauccauu

SEQ ID NO: 2738733 - RNA, 11 nt, Human
aguugccuaaa

SEQ ID NO: 2738734 - RNA, 16 nt, Human
aguugccuaaauccau

SEQ ID NO: 2738735 - RNA, 15 nt, Human
aguugccuaaaucca

SEQ ID NO: 2738736 - RNA, 13 nt, Human
aguugggcuuccu

SEQ ID NO: 2738737 - RNA, 19 nt, Human
aguugggcuuccucauagu

SEQ ID NO: 2738738 - RNA, 14 nt, Human
aguuuaaauuguaa

SEQ ID NO: 2738739 - RNA, 17 nt, Human
aguuggucccccuucca

SEQ ID NO: 2738740 - RNA, 11 nt, Human
aguuggucccc

SEQ ID NO: 2738741 - RNA, 13 nt, Human
aguuggucccccu

SEQ ID NO: 2738742 - RNA, 13 nt, Human
uuaaaaaaaaucc

SEQ ID NO: 2738743 - RNA, 18 nt, Human
uuaaauaaugugaaacug

SEQ ID NO: 2738744 - RNA, 16 nt, Human
uuaaauaaugugaaac

SEQ ID NO: 2738745 - RNA, 13 nt, Human
uuaaauaauguga

SEQ ID NO: 2738746 - RNA, 20 nt, Human
uuaacagaaauguacagcaa

SEQ ID NO: 2738747 - RNA, 16 nt, Human
uuaacagaaauguaca

SEQ ID NO: 2738748 - RNA, 19 nt, Human
uuaacagaaauguacagca

SEQ ID NO: 2738749 - RNA, 15 nt, Human
uuaaauaaugugaaa

SEQ ID NO: 2738750 - RNA, 16 nt, Human
uuaaaaaucucaaauu

SEQ ID NO: 2738751 - RNA, 15 nt, Human
uuaaaaaucucaaau

SEQ ID NO: 2738752 - RNA, 14 nt, Human
uuaaaaaucucaaa

SEQ ID NO: 2738753 - RNA, 18 nt, Human
auaauccuaaacauauga

SEQ ID NO: 2738754 - RNA, 15 nt, Human
auaaugcgugcauac

SEQ ID NO: 2738755 - RNA, 15 nt, Human
auaaugaaugaaaca

SEQ ID NO: 2738756 - RNA, 22 nt, Human
auaauugacaggauuauuggaa

SEQ ID NO: 2738757 - RNA, 12 nt, Human
auaauacaccac

SEQ ID NO: 2738758 - RNA, 20 nt, Human
auaauacaccacuacauucu

SEQ ID NO: 2738759 - RNA, 18 nt, Human
auaauacaccacuacauu

SEQ ID NO: 2738760 - RNA, 15 nt, Human
uuaggugaggaagca

SEQ ID NO: 2738761 - RNA, 20 nt, Human
uuagggaaggauacaaaagc

SEQ ID NO: 2738762 - RNA, 18 nt, Human
uuagguuggcaaaaaggc

SEQ ID NO: 2738763 - RNA, 21 nt, Human
uuaggugugacugaauuucuu

SEQ ID NO: 2738764 - RNA, 16 nt, Human
uuaggugugacugaau

SEQ ID NO: 2738765 - RNA, 16 nt, Human
uuaggugaggaagcaa

SEQ ID NO: 2738766 - RNA, 22 nt, Human
uuaguuugcaguuacacuaaaa

SEQ ID NO: 2738767 - RNA, 15 nt, Human
uuaguuucuccaagc

SEQ ID NO: 2738768 - RNA, 18 nt, Human
uuagccaagugugguaga

SEQ ID NO: 2738769 - RNA, 14 nt, Human
uuagcggagacgga

SEQ ID NO: 2738770 - RNA, 18 nt, Human
uuagcaaauucuguuuuu

SEQ ID NO: 2738771 - RNA, 22 nt, Human
auaacgauaaaagacagugaaa

SEQ ID NO: 2738772 - RNA, 13 nt, Human
auaacugugaagu

SEQ ID NO: 2738773 - RNA, 11 nt, Human
auaaauuauuu

SEQ ID NO: 2738774 - RNA, 13 nt, Human
auaaauaaaaaua

SEQ ID NO: 2738775 - RNA, 14 nt, Human
auaaauaaaaauaa

SEQ ID NO: 2738776 - RNA, 22 nt, Human
auaaauagcuagacuggugacu

SEQ ID NO: 2738777 - RNA, 21 nt, Human
auaaauagcuagacuggugac

SEQ ID NO: 2738778 - RNA, 18 nt, Human
auaaauauuuuugccaua

SEQ ID NO: 2738779 - RNA, 19 nt, Human
uuacccucauguucuuaau

SEQ ID NO: 2738780 - RNA, 13 nt, Human
uuagacagagucu

SEQ ID NO: 2738781 - RNA, 20 nt, Human
uuagacagagucucacuguu

SEQ ID NO: 2738782 - RNA, 13 nt, Human
uuagacagucccu

SEQ ID NO: 2738783 - RNA, 13 nt, Human
uuugcucauggaa

SEQ ID NO: 2738784 - RNA, 14 nt, Human
uuuggggauauuuu

SEQ ID NO: 2738785 - RNA, 22 nt, Human
uuugggaggccaaggugggagg

SEQ ID NO: 2738786 - RNA, 13 nt, Human
uuuggggaagaac

SEQ ID NO: 2738787 - RNA, 15 nt, Human
auggcuauaggugcu

SEQ ID NO: 2738788 - RNA, 22 nt, Human
uuugccauguuggccaggcugg

SEQ ID NO: 2738789 - RNA, 11 nt, Human
uuugcucaugg

SEQ ID NO: 2738790 - RNA, 12 nt, Human
uuugcucaugga

SEQ ID NO: 2738791 - RNA, 22 nt, Human
augucuauaaaccgaacugaug

SEQ ID NO: 2738792 - RNA, 23 nt, Human
auguccaagaagcccaggaaagg

SEQ ID NO: 2738793 - RNA, 19 nt, Human
auguccaagaagcccagga

SEQ ID NO: 2738794 - RNA, 18 nt, Human
auguccaagaagcccagg

SEQ ID NO: 2738795 - RNA, 21 nt, Human
augucagugugacugaucucu

SEQ ID NO: 2738796 - RNA, 15 nt, Human
augucagugugacug

SEQ ID NO: 2738797 - RNA, 16 nt, Human
augucagugugacuga

SEQ ID NO: 2738798 - RNA, 12 nt, Human
auguauguguaa

SEQ ID NO: 2738799 - RNA, 15 nt, Human
auguaucugagcagg

SEQ ID NO: 2738800 - RNA, 15 nt, Human
auguaucaaugagua

SEQ ID NO: 2738801 - RNA, 22 nt, Human
uuugggggaaaauuuagaaaua

SEQ ID NO: 2738802 - RNA, 14 nt, Human
uuuuaaaagaauga

SEQ ID NO: 2738803 - RNA, 13 nt, Human
uuuuaaaaaagaa

SEQ ID NO: 2738804 - RNA, 18 nt, Human
uuuguuugaacugauaaa

SEQ ID NO: 2738805 - RNA, 21 nt, Human
uuuuaaaaaacugcugacugu

SEQ ID NO: 2738806 - RNA, 15 nt, Human
uuuuaagugcugcau

SEQ ID NO: 2738807 - RNA, 16 nt, Human
uuuuaagaggcagggu

SEQ ID NO: 2738808 - RNA, 15 nt, Human
uuuuaagaggcaggg

SEQ ID NO: 2738809 - RNA, 11 nt, Human
uuuuaagaaau

SEQ ID NO: 2738810 - RNA, 13 nt, Human
uuuguuucuguac

SEQ ID NO: 2738811 - RNA, 12 nt, Human
uuuguuucugua

SEQ ID NO: 2738812 - RNA, 18 nt, Human
uuugugaggaagccgcug

SEQ ID NO: 2738813 - RNA, 19 nt, Human
uuugugaggaagccgcugg

SEQ ID NO: 2738814 - RNA, 18 nt, Human
uuuguuucuguacuuuuu

SEQ ID NO: 2738815 - RNA, 12 nt, Human
uuuguuugaacu

SEQ ID NO: 2738816 - RNA, 14 nt, Human
uuuguuugaacuga

SEQ ID NO: 2738817 - RNA, 13 nt, Human
uuuguuugaacug

SEQ ID NO: 2738818 - RNA, 15 nt, Human
uuugucuacaccauu

SEQ ID NO: 2738819 - RNA, 19 nt, Human
uuuguagcacugacagauu

SEQ ID NO: 2738820 - RNA, 17 nt, Human
uuuguagaagucacauu

SEQ ID NO: 2738821 - RNA, 17 nt, Human
uuuguagcacugacaga

SEQ ID NO: 2738822 - RNA, 13 nt, Human
uuuguagagccag

SEQ ID NO: 2738823 - RNA, 21 nt, Human
auguuucaaacauauauaaca

SEQ ID NO: 2738824 - RNA, 14 nt, Human
auguuuuccaugag

SEQ ID NO: 2738825 - RNA, 18 nt, Human
auguuucaaacauauaua

SEQ ID NO: 2738826 - RNA, 15 nt, Human
auguugugauguauu

SEQ ID NO: 2738827 - RNA, 16 nt, Human
auuaaaagaauauuuu

SEQ ID NO: 2738828 - RNA, 15 nt, Human
auuaaaagaauauuu

SEQ ID NO: 2738829 - RNA, 20 nt, Human
auuaaaaaaucaguuguaca

SEQ ID NO: 2738830 - RNA, 18 nt, Human
auguuuuucuucucccuc

SEQ ID NO: 2738831 - RNA, 17 nt, Human
auguuuuucuucucccu

SEQ ID NO: 2738832 - RNA, 18 nt, Human
auuaaccacuucagcuga

SEQ ID NO: 2738833 - RNA, 20 nt, Human
auuaaccacuucagcugacu

SEQ ID NO: 2738834 - RNA, 17 nt, Human
auuaaccacuucagcug

SEQ ID NO: 2738835 - RNA, 19 nt, Human
auuaacauguuaaaccaug

SEQ ID NO: 2738836 - RNA, 17 nt, Human
auuaacauguuaaacca

SEQ ID NO: 2738837 - RNA, 15 nt, Human
auuaacauguuaaac

SEQ ID NO: 2738838 - RNA, 14 nt, Human
auuaacauguuaaa

SEQ ID NO: 2738839 - RNA, 13 nt, Human
auuaacauguuaa

SEQ ID NO: 2738840 - RNA, 11 nt, Human
auuaaagccau

SEQ ID NO: 2738841 - RNA, 21 nt, Human
auuaaagccauguuuauuaca

SEQ ID NO: 2738842 - RNA, 17 nt, Human
auuaaagccauguuuau

SEQ ID NO: 2738843 - RNA, 16 nt, Human
auuaaagccauguuua

SEQ ID NO: 2738844 - RNA, 12 nt, Human
auuaaagccaug

SEQ ID NO: 2738845 - RNA, 21 nt, Human
auuaaacuuaaucuaaaugga

SEQ ID NO: 2738846 - RNA, 19 nt, Human
auuaaacuuaaucuaaaug

SEQ ID NO: 2738847 - RNA, 16 nt, Human
auuaaacuuaaucuaa

SEQ ID NO: 2738848 - RNA, 17 nt, Human
auuaaacuuaaucuaaa

SEQ ID NO: 2738849 - RNA, 12 nt, Human
auuaacuuuuau

SEQ ID NO: 2738850 - RNA, 20 nt, Human
auuaacuuuuauaaacuuua

SEQ ID NO: 2738851 - RNA, 19 nt, Human
auuaacuuuuauaaacuuu

SEQ ID NO: 2738852 - RNA, 17 nt, Human
auuaacuuuuauaaacu

SEQ ID NO: 2738853 - RNA, 16 nt, Human
auuaacuuuuauaaac

SEQ ID NO: 2738854 - RNA, 23 nt, Human
auuaacuuuuauaaacuuuaccu

SEQ ID NO: 2738855 - RNA, 14 nt, Human
auuaagaaagacua

SEQ ID NO: 2738856 - RNA, 13 nt, Human
auuaagaaagacu

SEQ ID NO: 2738857 - RNA, 15 nt, Human
auguugacaugggac

SEQ ID NO: 2738858 - RNA, 21 nt, Human
auguucaucauccuaagcuau

SEQ ID NO: 2738859 - RNA, 21 nt, Human
uuuuaagugcugcauuuaaaa

SEQ ID NO: 2738860 - RNA, 17 nt, Human
uuuuaagugcugcauuu

SEQ ID NO: 2738861 - RNA, 16 nt, Human
uuuuaagugcugcauu

SEQ ID NO: 2738862 - RNA, 16 nt, Human
auguuggccaggcugg

SEQ ID NO: 2738863 - RNA, 13 nt, Human
auguuggccaggc

SEQ ID NO: 2738864 - RNA, 14 nt, Human
auguuggccaggcu

SEQ ID NO: 2738865 - RNA, 23 nt, Human
uuuuagaguugauacuacaguuu

SEQ ID NO: 2738866 - RNA, 13 nt, Human
uuuuauaaacuuu

SEQ ID NO: 2738867 - RNA, 12 nt, Human
uuuuauaaacuu

SEQ ID NO: 2738868 - RNA, 19 nt, Human
uuuuauggcacuaguauuu

SEQ ID NO: 2738869 - RNA, 23 nt, Human
uuuuauggaggcuuugcauagau

SEQ ID NO: 2738870 - RNA, 12 nt, Human
uuuuauuaugua

SEQ ID NO: 2738871 - RNA, 14 nt, Human
uuuuauaauuuugu

SEQ ID NO: 2738872 - RNA, 19 nt, Human
uuuuauaaacuuuaccuuu

SEQ ID NO: 2738873 - RNA, 17 nt, Human
uuuuauaaacuuuaccu

SEQ ID NO: 2738874 - RNA, 14 nt, Human
uuuuauaaacuuua

SEQ ID NO: 2738875 - RNA, 21 nt, Human
uuuucauuauuuuauuaugaa

SEQ ID NO: 2738876 - RNA, 22 nt, Human
uuuucauucuccuaucaccugu

SEQ ID NO: 2738877 - RNA, 15 nt, Human
uuuucauuauuuuau

SEQ ID NO: 2738878 - RNA, 19 nt, Human
uuuuccagguuuaagcugu

SEQ ID NO: 2738879 - RNA, 14 nt, Human
uuuuauuauguaaa

SEQ ID NO: 2738880 - RNA, 13 nt, Human
uuuuauuauguaa

SEQ ID NO: 2738881 - RNA, 17 nt, Human
auuauauuuacaaaugg

SEQ ID NO: 2738882 - RNA, 23 nt, Human
auuaucucaaaacugcacuguca

SEQ ID NO: 2738883 - RNA, 18 nt, Human
auuaucucaaaacugcac

SEQ ID NO: 2738884 - RNA, 20 nt, Human
auuauuaccuuacagaaguu

SEQ ID NO: 2738885 - RNA, 15 nt, Human
auuauuuuauuauga

SEQ ID NO: 2738886 - RNA, 23 nt, Human
auuauuuauuaaaugcccagccc

SEQ ID NO: 2738887 - RNA, 16 nt, Human
auuauauuuacaaaug

SEQ ID NO: 2738888 - RNA, 19 nt, Human
auuagagaguguugaaacg

SEQ ID NO: 2738889 - RNA, 18 nt, Human
auuagagaguguugaaac

SEQ ID NO: 2738890 - RNA, 17 nt, Human
auuagagaguguugaaa

SEQ ID NO: 2738891 - RNA, 16 nt, Human
auuagagaguguugaa

SEQ ID NO: 2738892 - RNA, 15 nt, Human
auuagagaguguuga

SEQ ID NO: 2738893 - RNA, 13 nt, Human
auuaaguaaugau

SEQ ID NO: 2738894 - RNA, 15 nt, Human
auuaaguaaugauaa

SEQ ID NO: 2738895 - RNA, 15 nt, Human
auuaauauauuucca

SEQ ID NO: 2738896 - RNA, 23 nt, Human
uuuuuuaaaaaagaaacauuugg

SEQ ID NO: 2738897 - RNA, 20 nt, Human
auuaagagagucuauuuacg

SEQ ID NO: 2738898 - RNA, 22 nt, Human
uuuuuguuccacaaguuaaaua

SEQ ID NO: 2738899 - RNA, 15 nt, Human
auuacauuuguauaa

SEQ ID NO: 2738900 - RNA, 20 nt, Human
auuacauuuguauaaaauaa

SEQ ID NO: 2738901 - RNA, 19 nt, Human
auuaccacagacauacuaa

SEQ ID NO: 2738902 - RNA, 13 nt, Human
auuacauuuguau

SEQ ID NO: 2738903 - RNA, 22 nt, Human
auuaccugaauuuuggcugugu

SEQ ID NO: 2738904 - RNA, 15 nt, Human
auucaaacagucuca

SEQ ID NO: 2738905 - RNA, 14 nt, Human
auucaaacagucuc

SEQ ID NO: 2738906 - RNA, 22 nt, Human
auuauuuuauuaugaaacuugu

SEQ ID NO: 2738907 - RNA, 21 nt, Human
auuauuuuauuaugaaacuug

SEQ ID NO: 2738908 - RNA, 21 nt, Human
auucaguuguuagugugucuu

SEQ ID NO: 2738909 - RNA, 23 nt, Human
auucaggaagcucagggccuggc

SEQ ID NO: 2738910 - RNA, 16 nt, Human
auucaguuguuagugu

SEQ ID NO: 2738911 - RNA, 14 nt, Human
auucagcucugcaa

SEQ ID NO: 2738912 - RNA, 18 nt, Human
auucagcucugcaagaau

SEQ ID NO: 2738913 - RNA, 21 nt, Human
auucaggaagcucagggccug

SEQ ID NO: 2738914 - RNA, 22 nt, Human
auucaggaagcucagggccugg

SEQ ID NO: 2738915 - RNA, 22 nt, Human
auuccccacccugaaagcccug

SEQ ID NO: 2738916 - RNA, 20 nt, Human
auuccccagauugcaacagg

SEQ ID NO: 2738917 - RNA, 16 nt, Human
auuccccaggaggcca

SEQ ID NO: 2738918 - RNA, 19 nt, Human
auuccccaggaggccagcc

SEQ ID NO: 2738919 - RNA, 16 nt, Human
auuuacaaaugggaaa

SEQ ID NO: 2738920 - RNA, 18 nt, Human
auuuaaccucuaaauucu

SEQ ID NO: 2738921 - RNA, 16 nt, Human
auuuaaccucuaaauu

SEQ ID NO: 2738922 - RNA, 19 nt, Human
auuuaauuuuuuugagaca

SEQ ID NO: 2738923 - RNA, 23 nt, Human
auuuaauuuuuuugagacagagu

SEQ ID NO: 2738924 - RNA, 19 nt, Human
auuuaaagcuuauuaaaac

SEQ ID NO: 2738925 - RNA, 20 nt, Human
auuuaacagaaauguacagc

SEQ ID NO: 2738926 - RNA, 19 nt, Human
auuuaacagaaauguacag

SEQ ID NO: 2738927 - RNA, 17 nt, Human
auuuaacagaaauguac

SEQ ID NO: 2738928 - RNA, 16 nt, Human
auuuaacagaaaugua

SEQ ID NO: 2738929 - RNA, 15 nt, Human
auuuaacagaaaugu

SEQ ID NO: 2738930 - RNA, 14 nt, Human
auuguauuacaaau

SEQ ID NO: 2738931 - RNA, 23 nt, Human
auugugcgcuaaacuuuucugau

SEQ ID NO: 2738932 - RNA, 23 nt, Human
auuggcuuuggguugcaggaccu

SEQ ID NO: 2738933 - RNA, 21 nt, Human
auugcuaaucaccaaaggcuc

SEQ ID NO: 2738934 - RNA, 16 nt, Human
auucuccaccugccag

SEQ ID NO: 2738935 - RNA, 17 nt, Human
auucuccaccugccagg

SEQ ID NO: 2738936 - RNA, 13 nt, Human
auucuccaccugc

SEQ ID NO: 2738937 - RNA, 20 nt, Human
auucucagaaucucaaauaa

SEQ ID NO: 2738938 - RNA, 18 nt, Human
auucucagaaucucaaau

SEQ ID NO: 2738939 - RNA, 14 nt, Human
auucucagaaucuc

SEQ ID NO: 2738940 - RNA, 19 nt, Human
auucucacagcuccaagaa

SEQ ID NO: 2738941 - RNA, 22 nt, Human
auucucacagcuccaagaauuu

SEQ ID NO: 2738942 - RNA, 21 nt, Human
auucucacagcuccaagaauu

SEQ ID NO: 2738943 - RNA, 16 nt, Human
auucuacuuugagugc

SEQ ID NO: 2738944 - RNA, 13 nt, Human
auucuacuuugag

SEQ ID NO: 2738945 - RNA, 18 nt, Human
auucuccaccugccaggg

SEQ ID NO: 2738946 - RNA, 18 nt, Human
auugacaggauuauugga

SEQ ID NO: 2738947 - RNA, 13 nt, Human
auugaccugaggc

SEQ ID NO: 2738948 - RNA, 15 nt, Human
auugcaacaggcugg

SEQ ID NO: 2738949 - RNA, 21 nt, Human
auugcaacaggcugggcuuca

SEQ ID NO: 2738950 - RNA, 23 nt, Human
auugccauuucuuccacaagagc

SEQ ID NO: 2738951 - RNA, 17 nt, Human
auugcccacgcuggagu

SEQ ID NO: 2738952 - RNA, 21 nt, Human
auugcccacgcuggagugcag

SEQ ID NO: 2738953 - RNA, 16 nt, Human
auugcggacagccacg

SEQ ID NO: 2738954 - RNA, 18 nt, Human
auugcggacagccacggc

SEQ ID NO: 2738955 - RNA, 19 nt, Human
auugcggacagccacggcc

SEQ ID NO: 2738956 - RNA, 14 nt, Human
auugcuacuguccu

SEQ ID NO: 2738957 - RNA, 14 nt, Human
auuuuaauaauguu

SEQ ID NO: 2738958 - RNA, 15 nt, Human
auuuuaauaauguuu

SEQ ID NO: 2738959 - RNA, 16 nt, Human
auuuuaauaauguuuc

SEQ ID NO: 2738960 - RNA, 21 nt, Human
auuuguauaaaauaauuuuua

SEQ ID NO: 2738961 - RNA, 15 nt, Human
auuuguaucacaaau

SEQ ID NO: 2738962 - RNA, 13 nt, Human
auuuuauuaugua

SEQ ID NO: 2738963 - RNA, 17 nt, Human
auuuuauuaugcaugaa

SEQ ID NO: 2738964 - RNA, 15 nt, Human
auuuuauuaugcaug

SEQ ID NO: 2738965 - RNA, 14 nt, Human
auuuuauuaugcau

SEQ ID NO: 2738966 - RNA, 14 nt, Human
auuuuauuauguaa

SEQ ID NO: 2738967 - RNA, 21 nt, Human
auuuuacuuuaaaaggagcca

SEQ ID NO: 2738968 - RNA, 13 nt, Human
auuuuauuaugca

SEQ ID NO: 2738969 - RNA, 21 nt, Human
auuuuauuaugaaacuugugu

SEQ ID NO: 2738970 - RNA, 18 nt, Human
auuuuauuaugaaacuug

SEQ ID NO: 2738971 - RNA, 12 nt, Human
auuuuauuauga

SEQ ID NO: 2738972 - RNA, 11 nt, Human
auuuuauuaug

SEQ ID NO: 2738973 - RNA, 14 nt, Human
auuuuauuaugaaa

SEQ ID NO: 2738974 - RNA, 13 nt, Human
auuuuauuaugaa

SEQ ID NO: 2738975 - RNA, 22 nt, Human
auuuauuacuguaagaaaauau

SEQ ID NO: 2738976 - RNA, 20 nt, Human
auuuauuaaaugcccagccc

SEQ ID NO: 2738977 - RNA, 13 nt, Human
auuuauuauggca

SEQ ID NO: 2738978 - RNA, 15 nt, Human
auuuacuaaaaugga

SEQ ID NO: 2738979 - RNA, 21 nt, Human
auuucuaaaucuccaaaauaa

SEQ ID NO: 2738980 - RNA, 13 nt, Human
auuucuaaaucuc

SEQ ID NO: 2738981 - RNA, 12 nt, Human
auuucuaaaucu

SEQ ID NO: 2738982 - RNA, 14 nt, Human
auuuccugugucuu

SEQ ID NO: 2738983 - RNA, 16 nt, Human
auuuauuauggcacau

SEQ ID NO: 2738984 - RNA, 22 nt, Human
auuuccugggagcuuuuguaga

SEQ ID NO: 2738985 - RNA, 23 nt, Human
auuuccugggagcuuuuguagaa

SEQ ID NO: 2738986 - RNA, 23 nt, Human
auuugguaaggggaauugaggac

SEQ ID NO: 2738987 - RNA, 17 nt, Human
auuuggugguuucagaa

SEQ ID NO: 2738988 - RNA, 20 nt, Human
auuuggagacacaacuauuu

SEQ ID NO: 2738989 - RNA, 21 nt, Human
auuuggagacacaacuauuuu

SEQ ID NO: 2738990 - RNA, 18 nt, Human
auuuguaguguuggagaa

SEQ ID NO: 2738991 - RNA, 20 nt, Human
auuuggugguuucagaaaug

SEQ ID NO: 2738992 - RNA, 18 nt, Human
auuuggugguuucagaaa

SEQ ID NO: 2738993 - RNA, 17 nt, Human
auuugguuuucacauug

SEQ ID NO: 2738994 - RNA, 15 nt, Human
auuugguuuucacau

SEQ ID NO: 2738995 - RNA, 22 nt, Human
auuugguuuucacauuggaaac

SEQ ID NO: 2738996 - RNA, 21 nt, Human
auuugguuuucacauuggaaa

SEQ ID NO: 2738997 - RNA, 20 nt, Human
auuucuuuugccguuauuaa

SEQ ID NO: 2738998 - RNA, 16 nt, Human
auuugagcagggcuca

SEQ ID NO: 2738999 - RNA, 23 nt, Human
auuugaggucuguucuuuccaaa

SEQ ID NO: 2739000 - RNA, 17 nt, Human
auuugagcagggcucag

SEQ ID NO: 2739001 - RNA, 20 nt, Human
auuuggaaaucuuuaaaaaa

SEQ ID NO: 2739002 - RNA, 17 nt, Human
auuuggaaaucuuuaaa

SEQ ID NO: 2739003 - RNA, 22 nt, Human
auuugaggucuguucuuuccaa

SEQ ID NO: 2739004 - RNA, 23 nt, Human
auuucuuuugccguuauuaaaaa

SEQ ID NO: 2739005 - RNA, 14 nt, Human
auauauaacaaugc

SEQ ID NO: 2739006 - RNA, 12 nt, Human
auauauaaccag

SEQ ID NO: 2739007 - RNA, 13 nt, Human
auauauaaccagu

SEQ ID NO: 2739008 - RNA, 17 nt, Human
auauaacaaugcuguau

SEQ ID NO: 2739009 - RNA, 21 nt, Human
auauauauuuuuuucugaaau

SEQ ID NO: 2739010 - RNA, 22 nt, Human
auaguuggcuaggaccccucca

SEQ ID NO: 2739011 - RNA, 22 nt, Human
auaguuaagcgugcauaaguua

SEQ ID NO: 2739012 - RNA, 13 nt, Human
auagucuuucagu

SEQ ID NO: 2739013 - RNA, 13 nt, Human
auagucuggcugu

SEQ ID NO: 2739014 - RNA, 15 nt, Human
auaguggugugauuu

SEQ ID NO: 2739015 - RNA, 17 nt, Human
auaguggcuuaaaacaa

SEQ ID NO: 2739016 - RNA, 13 nt, Human
uucacaguucucu

SEQ ID NO: 2739017 - RNA, 20 nt, Human
uucacagaugggugcuugga

SEQ ID NO: 2739018 - RNA, 15 nt, Human
uucacaguucucucc

SEQ ID NO: 2739019 - RNA, 20 nt, Human
uucacaguucucuccuucuu

SEQ ID NO: 2739020 - RNA, 17 nt, Human
auaggcguaacuaauuu

SEQ ID NO: 2739021 - RNA, 15 nt, Human
auagcuuuuuucucu

SEQ ID NO: 2739022 - RNA, 12 nt, Human
auaggaaaaacu

SEQ ID NO: 2739023 - RNA, 14 nt, Human
auaggaaaaacuga

SEQ ID NO: 2739024 - RNA, 16 nt, Human
auaggaaaaacugauu

SEQ ID NO: 2739025 - RNA, 17 nt, Human
auaggaaaaacugauuu

SEQ ID NO: 2739026 - RNA, 14 nt, Human
uucaaacauauaua

SEQ ID NO: 2739027 - RNA, 18 nt, Human
uucaaacagucucaggaa

SEQ ID NO: 2739028 - RNA, 21 nt, Human
uucaagcgauucuucugcuuc

SEQ ID NO: 2739029 - RNA, 17 nt, Human
uuauuuuguucauacau

SEQ ID NO: 2739030 - RNA, 18 nt, Human
uuauuuuuagacagaguc

SEQ ID NO: 2739031 - RNA, 17 nt, Human
uuauuuuuagacagagu

SEQ ID NO: 2739032 - RNA, 21 nt, Human
uuauuuuguucauacauauuu

SEQ ID NO: 2739033 - RNA, 18 nt, Human
uucccaacuccagaaagu

SEQ ID NO: 2739034 - RNA, 12 nt, Human
uucccaaauuuc

SEQ ID NO: 2739035 - RNA, 13 nt, Human
uucccaagcucug

SEQ ID NO: 2739036 - RNA, 14 nt, Human
uucccaagcucugc

SEQ ID NO: 2739037 - RNA, 15 nt, Human
uucccaagcucugcu

SEQ ID NO: 2739038 - RNA, 16 nt, Human
uucccaagcucugcuc

SEQ ID NO: 2739039 - RNA, 18 nt, Human
uucccaagcucugcuccu

SEQ ID NO: 2739040 - RNA, 22 nt, Human
uucccaccucucucacuccuug

SEQ ID NO: 2739041 - RNA, 12 nt, Human
uucccaccucuc

SEQ ID NO: 2739042 - RNA, 21 nt, Human
uuccaggggugggacacccug

SEQ ID NO: 2739043 - RNA, 17 nt, Human
uuccagugaggcucugc

SEQ ID NO: 2739044 - RNA, 19 nt, Human
uuccagugaggcucugccc

SEQ ID NO: 2739045 - RNA, 20 nt, Human
uuccagugaggcucugcccu

SEQ ID NO: 2739046 - RNA, 21 nt, Human
uuccagugaggcucugcccuu

SEQ ID NO: 2739047 - RNA, 22 nt, Human
uuccagugaggcucugcccuug

SEQ ID NO: 2739048 - RNA, 23 nt, Human
uucccaaagcagugcaugcuguc

SEQ ID NO: 2739049 - RNA, 17 nt, Human
uuccaggggugggacac

SEQ ID NO: 2739050 - RNA, 18 nt, Human
uuccaccaucaagccacc

SEQ ID NO: 2739051 - RNA, 22 nt, Human
uuccacaagagcccaggccucc

SEQ ID NO: 2739052 - RNA, 19 nt, Human
uuccaccaucaagccacca

SEQ ID NO: 2739053 - RNA, 18 nt, Human
uucauuuaggugaggaag

SEQ ID NO: 2739054 - RNA, 17 nt, Human
uuccaaggguacuaagg

SEQ ID NO: 2739055 - RNA, 15 nt, Human
uuccaaggguacuaa

SEQ ID NO: 2739056 - RNA, 16 nt, Human
auauguggaguucauc

SEQ ID NO: 2739057 - RNA, 15 nt, Human
auauguggaguucau

SEQ ID NO: 2739058 - RNA, 13 nt, Human
uucagaaaugugu

SEQ ID NO: 2739059 - RNA, 11 nt, Human
uucagaaaugu

SEQ ID NO: 2739060 - RNA, 16 nt, Human
uucagugccaaaaaca

SEQ ID NO: 2739061 - RNA, 12 nt, Human
uucagugccuua

SEQ ID NO: 2739062 - RNA, 13 nt, Human
uucagugccuuau

SEQ ID NO: 2739063 - RNA, 13 nt, Human
uucauaugcugua

SEQ ID NO: 2739064 - RNA, 13 nt, Human
uucauacauugua

SEQ ID NO: 2739065 - RNA, 19 nt, Human
uucauacauuguacgaaga

SEQ ID NO: 2739066 - RNA, 12 nt, Human
uucauacauauu

SEQ ID NO: 2739067 - RNA, 23 nt, Human
uucauacauauuuuuguagcacu

SEQ ID NO: 2739068 - RNA, 18 nt, Human
uucagugccuuauggaac

SEQ ID NO: 2739069 - RNA, 15 nt, Human
auauauuuaaugaua

SEQ ID NO: 2739070 - RNA, 13 nt, Human
auauauuuaauga

SEQ ID NO: 2739071 - RNA, 17 nt, Human
uucaucccucuggggcu

SEQ ID NO: 2739072 - RNA, 21 nt, Human
uucaucccucuggggcuguuc

SEQ ID NO: 2739073 - RNA, 17 nt, Human
auauguaacaagccacc

SEQ ID NO: 2739074 - RNA, 16 nt, Human
auauguaacaagccac

SEQ ID NO: 2739075 - RNA, 13 nt, Human
auaugcacacauu

SEQ ID NO: 2739076 - RNA, 16 nt, Human
auaugcacacauuuuu

SEQ ID NO: 2739077 - RNA, 15 nt, Human
auaugcacacauuuu

SEQ ID NO: 2739078 - RNA, 14 nt, Human
auaugcacacauuu

SEQ ID NO: 2739079 - RNA, 16 nt, Human
auaucugaaaauguau

SEQ ID NO: 2739080 - RNA, 20 nt, Human
auaucugaaaauguaugugu

SEQ ID NO: 2739081 - RNA, 17 nt, Human
auaucugaaaauguaug

SEQ ID NO: 2739082 - RNA, 13 nt, Human
auaucuuguagcu

SEQ ID NO: 2739083 - RNA, 19 nt, Human
auaucuccgucaacucaua

SEQ ID NO: 2739084 - RNA, 21 nt, Human
auaucuccgucaacucauauu

SEQ ID NO: 2739085 - RNA, 20 nt, Human
auaucuccgucaacucauau

SEQ ID NO: 2739086 - RNA, 14 nt, Human
auaucuaguaugaa

SEQ ID NO: 2739087 - RNA, 15 nt, Human
auaucuaguaugaaa

SEQ ID NO: 2739088 - RNA, 17 nt, Human
auaucuaguaugaaauu

SEQ ID NO: 2739089 - RNA, 20 nt, Human
aucaaauaugcaaagcacug

SEQ ID NO: 2739090 - RNA, 16 nt, Human
auauuuuuauauuuac

SEQ ID NO: 2739091 - RNA, 14 nt, Human
aucaaguuauuuuu

SEQ ID NO: 2739092 - RNA, 19 nt, Human
aucaaccccuucgcuccug

SEQ ID NO: 2739093 - RNA, 20 nt, Human
aucaaccccuucgcuccugu

SEQ ID NO: 2739094 - RNA, 22 nt, Human
aucaaccccuucgcuccugugu

SEQ ID NO: 2739095 - RNA, 13 nt, Human
auauuuucauucu

SEQ ID NO: 2739096 - RNA, 17 nt, Human
auauuuucauucuccua

SEQ ID NO: 2739097 - RNA, 18 nt, Human
uucccuuuuuuggcugcu

SEQ ID NO: 2739098 - RNA, 19 nt, Human
uucccuuuuuuggcugcug

SEQ ID NO: 2739099 - RNA, 20 nt, Human
uucccuuuuuuggcugcuga

SEQ ID NO: 2739100 - RNA, 20 nt, Human
auauuuuacauaaauuuagu

SEQ ID NO: 2739101 - RNA, 16 nt, Human
auauuuuacauaaauu

SEQ ID NO: 2739102 - RNA, 15 nt, Human
auauuuuacauaaau

SEQ ID NO: 2739103 - RNA, 17 nt, Human
uucuaaguaaaaccaca

SEQ ID NO: 2739104 - RNA, 20 nt, Human
uucuaaguaaaaccacagca

SEQ ID NO: 2739105 - RNA, 19 nt, Human
uucuaaguaaaaccacagc

SEQ ID NO: 2739106 - RNA, 19 nt, Human
uucuaacaaaaaaauauau

SEQ ID NO: 2739107 - RNA, 20 nt, Human
uucuaacaaaaaaauauauu

SEQ ID NO: 2739108 - RNA, 19 nt, Human
uucuaaaucuccaaaauaa

SEQ ID NO: 2739109 - RNA, 13 nt, Human
uucgcuccugugu

SEQ ID NO: 2739110 - RNA, 18 nt, Human
aucaauaaaaaauuauga

SEQ ID NO: 2739111 - RNA, 17 nt, Human
aucaauaaaaaauuaug

SEQ ID NO: 2739112 - RNA, 15 nt, Human
aucaauaaaaaauua

SEQ ID NO: 2739113 - RNA, 21 nt, Human
uucgcaggauucuuccucccu

SEQ ID NO: 2739114 - RNA, 21 nt, Human
uucuaaguaaaaccacagcag

SEQ ID NO: 2739115 - RNA, 14 nt, Human
uucuauaauuuaaa

SEQ ID NO: 2739116 - RNA, 13 nt, Human
uucuauaauuuaa

SEQ ID NO: 2739117 - RNA, 21 nt, Human
uucucacugccaugccagcuu

SEQ ID NO: 2739118 - RNA, 13 nt, Human
aucaggccaggcc

SEQ ID NO: 2739119 - RNA, 13 nt, Human
uucucagaaucuc

SEQ ID NO: 2739120 - RNA, 20 nt, Human
aucauuucugcaucagcugc

SEQ ID NO: 2739121 - RNA, 21 nt, Human
aucauugaaaucuuuuugcuu

SEQ ID NO: 2739122 - RNA, 21 nt, Human
aucaggccaggcccucugccc

SEQ ID NO: 2739123 - RNA, 22 nt, Human
aucaggccaggcccucugccca

SEQ ID NO: 2739124 - RNA, 23 nt, Human
aucaggccaggcccucugcccac

SEQ ID NO: 2739125 - RNA, 20 nt, Human
aucauugaaaucuuuuugcu

SEQ ID NO: 2739126 - RNA, 20 nt, Human
aucaggccaggcccucugcc

SEQ ID NO: 2739127 - RNA, 13 nt, Human
uucugccgcagcc

SEQ ID NO: 2739128 - RNA, 14 nt, Human
uucugacccaugcu

SEQ ID NO: 2739129 - RNA, 16 nt, Human
uucucuuuucaaaaca

SEQ ID NO: 2739130 - RNA, 17 nt, Human
uucucuacucuagggaa

SEQ ID NO: 2739131 - RNA, 14 nt, Human
auccauacauuugu

SEQ ID NO: 2739132 - RNA, 13 nt, Human
auccauuuggaaa

SEQ ID NO: 2739133 - RNA, 19 nt, Human
auccauuuggaaaucuuua

SEQ ID NO: 2739134 - RNA, 17 nt, Human
auccauuuggaaaucuu

SEQ ID NO: 2739135 - RNA, 17 nt, Human
auccaguuuuguuugga

SEQ ID NO: 2739136 - RNA, 18 nt, Human
auccaguuuuguuuggac

SEQ ID NO: 2739137 - RNA, 21 nt, Human
auccaguuuuguuuggaccaa

SEQ ID NO: 2739138 - RNA, 20 nt, Human
auccaguuuuguuuggacca

SEQ ID NO: 2739139 - RNA, 20 nt, Human
uucuggcuaugcauuugaaa

SEQ ID NO: 2739140 - RNA, 18 nt, Human
uucuggcuaugcauuuga

SEQ ID NO: 2739141 - RNA, 14 nt, Human
uucugccgcagccc

SEQ ID NO: 2739142 - RNA, 15 nt, Human
uucugccgcagcccu

SEQ ID NO: 2739143 - RNA, 13 nt, Human
uucuguacuuuuu

SEQ ID NO: 2739144 - RNA, 19 nt, Human
uucuguacuuuuuggcaua

SEQ ID NO: 2739145 - RNA, 18 nt, Human
uucuguacuuuuuggcau

SEQ ID NO: 2739146 - RNA, 19 nt, Human
uugaaauauugacuuuuua

SEQ ID NO: 2739147 - RNA, 20 nt, Human
uugaaauauaggaacuuaaa

SEQ ID NO: 2739148 - RNA, 11 nt, Human
uugaaaucuuu

SEQ ID NO: 2739149 - RNA, 21 nt, Human
uugaaauuuuuauuaaauuau

SEQ ID NO: 2739150 - RNA, 21 nt, Human
auccuaggcauuugcugaaua

SEQ ID NO: 2739151 - RNA, 13 nt, Human
auccuaguuccac

SEQ ID NO: 2739152 - RNA, 20 nt, Human
auccuagucacuaccuucau

SEQ ID NO: 2739153 - RNA, 21 nt, Human
auccuaagcuauucaguaaua

SEQ ID NO: 2739154 - RNA, 12 nt, Human
uucuugcaaagu

SEQ ID NO: 2739155 - RNA, 13 nt, Human
uucuugcaaagua

SEQ ID NO: 2739156 - RNA, 22 nt, Human
uucuuucuggcuaugcauuuga

SEQ ID NO: 2739157 - RNA, 20 nt, Human
uucuguuuuucuaggccugg

SEQ ID NO: 2739158 - RNA, 11 nt, Human
uucuguucuuu

SEQ ID NO: 2739159 - RNA, 18 nt, Human
uucuguucuuucuggcua

SEQ ID NO: 2739160 - RNA, 13 nt, Human
uucuuaauucuua

SEQ ID NO: 2739161 - RNA, 23 nt, Human
uucuuccucccucccucuuuccc

SEQ ID NO: 2739162 - RNA, 23 nt, Human
uugugugaaagguacuucaaauc

SEQ ID NO: 2739163 - RNA, 19 nt, Human
uuguguaaauacaauuuug

SEQ ID NO: 2739164 - RNA, 13 nt, Human
uugugguuaaucu

SEQ ID NO: 2739165 - RNA, 17 nt, Human
uuguguguuuauuguca

SEQ ID NO: 2739166 - RNA, 20 nt, Human
uuguguuaaguauguguaaa

SEQ ID NO: 2739167 - RNA, 19 nt, Human
uuguucuggcucuuccagg

SEQ ID NO: 2739168 - RNA, 20 nt, Human
uuguucuggcucuuccaggc

SEQ ID NO: 2739169 - RNA, 22 nt, Human
uuguucuggcucuuccaggcug

SEQ ID NO: 2739170 - RNA, 23 nt, Human
augagagacacacugaagaagca

SEQ ID NO: 2739171 - RNA, 20 nt, Human
augagagacacacugaagaa

SEQ ID NO: 2739172 - RNA, 21 nt, Human
augagagacacacugaagaag

SEQ ID NO: 2739173 - RNA, 21 nt, Human
uugugaggaagccgcuggggc

SEQ ID NO: 2739174 - RNA, 18 nt, Human
uugugauacaaugcugug

SEQ ID NO: 2739175 - RNA, 22 nt, Human
augauuaugaauuacauuugua

SEQ ID NO: 2739176 - RNA, 20 nt, Human
augauuaaccacuucagcug

SEQ ID NO: 2739177 - RNA, 21 nt, Human
augauuaaccacuucagcuga

SEQ ID NO: 2739178 - RNA, 19 nt, Human
augauuaaccacuucagcu

SEQ ID NO: 2739179 - RNA, 15 nt, Human
uuguugucugcaacu

SEQ ID NO: 2739180 - RNA, 12 nt, Human
augauucccagc

SEQ ID NO: 2739181 - RNA, 21 nt, Human
augauucaacagguuuuccug

SEQ ID NO: 2739182 - RNA, 21 nt, Human
augauucaaaugucuauaaac

SEQ ID NO: 2739183 - RNA, 15 nt, Human
augcaaagcacugac

SEQ ID NO: 2739184 - RNA, 16 nt, Human
augauuucuaugcuga

SEQ ID NO: 2739185 - RNA, 13 nt, Human
augauuucuaugc

SEQ ID NO: 2739186 - RNA, 12 nt, Human
augauuucuaug

SEQ ID NO: 2739187 - RNA, 14 nt, Human
augcaccagcccuu

SEQ ID NO: 2739188 - RNA, 12 nt, Human
augcacuuuguu

SEQ ID NO: 2739189 - RNA, 13 nt, Human
augcaccagcccu

SEQ ID NO: 2739190 - RNA, 14 nt, Human
uuguuuucauuauc

SEQ ID NO: 2739191 - RNA, 16 nt, Human
uuguuuucaguguaca

SEQ ID NO: 2739192 - RNA, 13 nt, Human
uuguuuucagugu

SEQ ID NO: 2739193 - RNA, 15 nt, Human
augcacuuuguucug

SEQ ID NO: 2739194 - RNA, 12 nt, Human
uuuaauucaguu

SEQ ID NO: 2739195 - RNA, 19 nt, Human
uuuaagugcugcauuuaaa

SEQ ID NO: 2739196 - RNA, 17 nt, Human
uuuaagugcugcauuua

SEQ ID NO: 2739197 - RNA, 16 nt, Human
uuuaagugcugcauuu

SEQ ID NO: 2739198 - RNA, 15 nt, Human
uuuaagugcugcauu

SEQ ID NO: 2739199 - RNA, 18 nt, Human
augcaguucugaagaaga

SEQ ID NO: 2739200 - RNA, 19 nt, Human
augcaguucugaagaagau

SEQ ID NO: 2739201 - RNA, 15 nt, Human
augcaguucugaaga

SEQ ID NO: 2739202 - RNA, 17 nt, Human
augcaguucugaagaag

SEQ ID NO: 2739203 - RNA, 17 nt, Human
uuuaauuuuggaauuuu

SEQ ID NO: 2739204 - RNA, 15 nt, Human
uuuaauuuuggaauu

SEQ ID NO: 2739205 - RNA, 14 nt, Human
uuuaauuuuggaau

SEQ ID NO: 2739206 - RNA, 13 nt, Human
augcagccucaca

SEQ ID NO: 2739207 - RNA, 17 nt, Human
augcagccucacagucc

SEQ ID NO: 2739208 - RNA, 14 nt, Human
augcagccucacag

SEQ ID NO: 2739209 - RNA, 15 nt, Human
augcagccucacagu

SEQ ID NO: 2739210 - RNA, 21 nt, Human
auggccgggcgcgguggcuca

SEQ ID NO: 2739211 - RNA, 23 nt, Human
auggcacaucagcacgauuucug

SEQ ID NO: 2739212 - RNA, 17 nt, Human
auggcacaucagcacga

SEQ ID NO: 2739213 - RNA, 18 nt, Human
auggauuuccagccaaag

SEQ ID NO: 2739214 - RNA, 23 nt, Human
auggacguguuaugacuccagaa

SEQ ID NO: 2739215 - RNA, 19 nt, Human
auggacguguuaugacucc

SEQ ID NO: 2739216 - RNA, 20 nt, Human
auggacguguuaugacucca

SEQ ID NO: 2739217 - RNA, 17 nt, Human
auggaauacucuuauau

SEQ ID NO: 2739218 - RNA, 16 nt, Human
auggaaugcuguguua

SEQ ID NO: 2739219 - RNA, 16 nt, Human
auggaauacucuuaua

SEQ ID NO: 2739220 - RNA, 16 nt, Human
auggaagacagcucuu

SEQ ID NO: 2739221 - RNA, 13 nt, Human
uuucagaaaugug

SEQ ID NO: 2739222 - RNA, 14 nt, Human
auggacaugaucuu

SEQ ID NO: 2739223 - RNA, 22 nt, Human
augcugucuacacuaagagaga

SEQ ID NO: 2739224 - RNA, 23 nt, Human
augcugucccuuacgugaguccu

SEQ ID NO: 2739225 - RNA, 19 nt, Human
augcugucccuuacgugag

SEQ ID NO: 2739226 - RNA, 23 nt, Human
auggaacgcguugaaauuguaau

SEQ ID NO: 2739227 - RNA, 16 nt, Human
auggaacacucugaga

SEQ ID NO: 2739228 - RNA, 15 nt, Human
auggaagacagcucu

SEQ ID NO: 2739229 - RNA, 11 nt, Human
auggaacacuc

SEQ ID NO: 2739230 - RNA, 14 nt, Human
auggaacacucuga

SEQ ID NO: 2739231 - RNA, 15 nt, Human
auggaacacucugag

SEQ ID NO: 2739232 - RNA, 23 nt, Human
uuuauuacaguauaauuaacaug

SEQ ID NO: 2739233 - RNA, 15 nt, Human
augcucugcauguua

SEQ ID NO: 2739234 - RNA, 13 nt, Human
uuuauauaagcuu

SEQ ID NO: 2739235 - RNA, 20 nt, Human
uuuauggcuuuugugcauua

SEQ ID NO: 2739236 - RNA, 24 nt, Human
uuuauggcuuuugugcauuaucua

SEQ ID NO: 2739237 - RNA, 22 nt, Human
uuuauuacaguauaauuaacau

SEQ ID NO: 2739238 - RNA, 20 nt, Human
uuuagcuggaaaaguauguu

SEQ ID NO: 2739239 - RNA, 22 nt, Human
uuuagcuggaaaaguauguuag

SEQ ID NO: 2739240 - RNA, 15 nt, Human
uuuaguagagacagg

SEQ ID NO: 2739241 - RNA, 14 nt, Human
uuuagucuugucuc

SEQ ID NO: 2739242 - RNA, 13 nt, Human
uugcccuguuaaa

SEQ ID NO: 2739243 - RNA, 13 nt, Human
uugccgucuaccu

SEQ ID NO: 2739244 - RNA, 22 nt, Human
uugccuaaauccauuuggaaau

SEQ ID NO: 2739245 - RNA, 13 nt, Human
uugccuaaaucca

SEQ ID NO: 2739246 - RNA, 15 nt, Human
uugccuaaauccauu

SEQ ID NO: 2739247 - RNA, 14 nt, Human
uugccuaaauccau

SEQ ID NO: 2739248 - RNA, 14 nt, Human
uugccguuauuaaa

SEQ ID NO: 2739249 - RNA, 19 nt, Human
uugccgucuaccugagggg

SEQ ID NO: 2739250 - RNA, 15 nt, Human
uugccgucuaccuga

SEQ ID NO: 2739251 - RNA, 18 nt, Human
uugccgucuaccugaggg

SEQ ID NO: 2739252 - RNA, 21 nt, Human
aucugaggaauucuguauaga

SEQ ID NO: 2739253 - RNA, 20 nt, Human
aucugaggaauucuguauag

SEQ ID NO: 2739254 - RNA, 18 nt, Human
aucugaggaauucuguau

SEQ ID NO: 2739255 - RNA, 17 nt, Human
aucugaggaauucugua

SEQ ID NO: 2739256 - RNA, 16 nt, Human
aucugaggaauucugu

SEQ ID NO: 2739257 - RNA, 15 nt, Human
aucugaggaauucug

SEQ ID NO: 2739258 - RNA, 18 nt, Human
aucuugaauuguaaggaa

SEQ ID NO: 2739259 - RNA, 17 nt, Human
aucuugcucugcugaca

SEQ ID NO: 2739260 - RNA, 19 nt, Human
aucuugcucugcugacaga

SEQ ID NO: 2739261 - RNA, 23 nt, Human
aucugugaaaggaaagagggagg

SEQ ID NO: 2739262 - RNA, 19 nt, Human
aucugugaacuugaaauuu

SEQ ID NO: 2739263 - RNA, 18 nt, Human
aucugugaacuugaaauu

SEQ ID NO: 2739264 - RNA, 17 nt, Human
aucugugaacuugaaau

SEQ ID NO: 2739265 - RNA, 13 nt, Human
aucugugaacuug

SEQ ID NO: 2739266 - RNA, 20 nt, Human
aucugccuaaggacuucuuu

SEQ ID NO: 2739267 - RNA, 19 nt, Human
aucuggguucacugcaacc

SEQ ID NO: 2739268 - RNA, 17 nt, Human
aucuggguucacugcaa

SEQ ID NO: 2739269 - RNA, 19 nt, Human
aucugccuaaggacuucuu

SEQ ID NO: 2739270 - RNA, 18 nt, Human
aucugccuaaggacuucu

SEQ ID NO: 2739271 - RNA, 13 nt, Human
aucugccuaagga

SEQ ID NO: 2739272 - RNA, 17 nt, Human
aucugccuaaggacuuc

SEQ ID NO: 2739273 - RNA, 16 nt, Human
aucugccuaaggacuu

SEQ ID NO: 2739274 - RNA, 15 nt, Human
aucugccuaaggacu

SEQ ID NO: 2739275 - RNA, 14 nt, Human
aucugccuaaggac

SEQ ID NO: 2739276 - RNA, 13 nt, Human
aucucaauauuuc

SEQ ID NO: 2739277 - RNA, 15 nt, Human
aucucacacaugagc

SEQ ID NO: 2739278 - RNA, 16 nt, Human
aucucacacaugagca

SEQ ID NO: 2739279 - RNA, 15 nt, Human
auccuaguuccacca

SEQ ID NO: 2739280 - RNA, 19 nt, Human
auccuaguuccaccaucaa

SEQ ID NO: 2739281 - RNA, 21 nt, Human
aucucauuuccaagcaaguau

SEQ ID NO: 2739282 - RNA, 18 nt, Human
aucucauaauuuauacag

SEQ ID NO: 2739283 - RNA, 17 nt, Human
aucucauaauuuauaca

SEQ ID NO: 2739284 - RNA, 23 nt, Human
aucucauuuccaagcaaguauua

SEQ ID NO: 2739285 - RNA, 12 nt, Human
aucucccccagc

SEQ ID NO: 2739286 - RNA, 13 nt, Human
aucucccccagcc

SEQ ID NO: 2739287 - RNA, 19 nt, Human
uugauggugguauguuuuc

SEQ ID NO: 2739288 - RNA, 11 nt, Human
uugauguguuu

SEQ ID NO: 2739289 - RNA, 14 nt, Human
uugauucagacagc

SEQ ID NO: 2739290 - RNA, 18 nt, Human
uugauggugguauguuuu

SEQ ID NO: 2739291 - RNA, 15 nt, Human
uugauucagacagcu

SEQ ID NO: 2739292 - RNA, 16 nt, Human
uugauucagacagcug

SEQ ID NO: 2739293 - RNA, 13 nt, Human
aucuuuuucuaac

SEQ ID NO: 2739294 - RNA, 12 nt, Human
augaaagauuca

SEQ ID NO: 2739295 - RNA, 18 nt, Human
aucuuugcagacaggcaa

SEQ ID NO: 2739296 - RNA, 18 nt, Human
uuggcuagagguucaaag

SEQ ID NO: 2739297 - RNA, 22 nt, Human
uuggcgcugccccuggcagccc

SEQ ID NO: 2739298 - RNA, 23 nt, Human
uuggcgcugccccuggcagcccc

SEQ ID NO: 2739299 - RNA, 15 nt, Human
uuggauaauaaggaa

SEQ ID NO: 2739300 - RNA, 21 nt, Human
uuggauaauaaggaaaaguuu

SEQ ID NO: 2739301 - RNA, 19 nt, Human
uuggauaauaaggaaaagu

SEQ ID NO: 2739302 - RNA, 18 nt, Human
augaaauauuauguuaaa

SEQ ID NO: 2739303 - RNA, 13 nt, Human
augaaauauuaug

SEQ ID NO: 2739304 - RNA, 17 nt, Human
augaaauauuauguuaa

SEQ ID NO: 2739305 - RNA, 15 nt, Human
augaagauacugaaa

SEQ ID NO: 2739306 - RNA, 17 nt, Human
augaagauacugaaaua

SEQ ID NO: 2739307 - RNA, 16 nt, Human
augaagauacugaaau

SEQ ID NO: 2739308 - RNA, 20 nt, Human
augaaugucagugugacuga

SEQ ID NO: 2739309 - RNA, 15 nt, Human
uuggggauucuuaaa

SEQ ID NO: 2739310 - RNA, 22 nt, Human
uuggggggcugaggugggagga

SEQ ID NO: 2739311 - RNA, 14 nt, Human
uuggggauauuuuu

SEQ ID NO: 2739312 - RNA, 13 nt, Human
uuggggauucuua

SEQ ID NO: 2739313 - RNA, 16 nt, Human
uuguauaaaauaauuu

SEQ ID NO: 2739314 - RNA, 15 nt, Human
uuguauaaaauaauu

SEQ ID NO: 2739315 - RNA, 22 nt, Human
uuguacaaaguauuaagcauau

SEQ ID NO: 2739316 - RNA, 21 nt, Human
uuguacaaaguauuaagcaua

SEQ ID NO: 2739317 - RNA, 20 nt, Human
uuguacaaaguauuaagcau

SEQ ID NO: 2739318 - RNA, 17 nt, Human
uuguacaaaguauuaag

SEQ ID NO: 2739319 - RNA, 15 nt, Human
uuguacaaaguauua

SEQ ID NO: 2739320 - RNA, 14 nt, Human
uuguacaaaguauu

SEQ ID NO: 2739321 - RNA, 13 nt, Human
uuguacaaaguau

SEQ ID NO: 2739322 - RNA, 16 nt, Human
uuguaucacaaaucuu

SEQ ID NO: 2739323 - RNA, 22 nt, Human
augacacaugcaaggucauuuu

SEQ ID NO: 2739324 - RNA, 14 nt, Human
augacacaugcaag

SEQ ID NO: 2739325 - RNA, 17 nt, Human
uuguauaaaauaauuuu

SEQ ID NO: 2739326 - RNA, 13 nt, Human
augagagacacac

SEQ ID NO: 2739327 - RNA, 14 nt, Human
augagagacacacu

SEQ ID NO: 2739328 - RNA, 17 nt, Human
augagagacacacugaa

SEQ ID NO: 2739329 - RNA, 19 nt, Human
augagagacacacugaaga

SEQ ID NO: 2739330 - RNA, 21 nt, Human
augagaaagguugaagcacca

SEQ ID NO: 2739331 - RNA, 22 nt, Human
augagaaagguugaagcaccaa

SEQ ID NO: 2739332 - RNA, 17 nt, Human
augacuuacuguacaug

SEQ ID NO: 2739333 - RNA, 16 nt, Human
augacuuacuguacau

SEQ ID NO: 2739334 - RNA, 18 nt, Human
augacacgaauauugcug

SEQ ID NO: 2739335 - RNA, 14 nt, Human
augacuuacuguac

SEQ ID NO: 2739336 - RNA, 22 nt, Human
augacuuaagcacacuugacau

SEQ ID NO: 2739337 - RNA, 22 nt, Human
caauuuuucuuauuucauuucu

SEQ ID NO: 2739338 - RNA, 13 nt, Human
cacaaacagaggc

SEQ ID NO: 2739339 - RNA, 14 nt, Human
cacaaacagaggcc

SEQ ID NO: 2739340 - RNA, 18 nt, Human
caauuacaggaaguacug

SEQ ID NO: 2739341 - RNA, 19 nt, Human
caaugugaaaagaaaaaug

SEQ ID NO: 2739342 - RNA, 22 nt, Human
caaugugaaaagaaaaaugagc

SEQ ID NO: 2739343 - RNA, 17 nt, Human
caauuacaggaaguacu

SEQ ID NO: 2739344 - RNA, 14 nt, Human
caauguucucucuu

SEQ ID NO: 2739345 - RNA, 13 nt, Human
cacaaaggagagc

SEQ ID NO: 2739346 - RNA, 17 nt, Human
cacacacgcgugcacac

SEQ ID NO: 2739347 - RNA, 18 nt, Human
cacagccagacuggcaca

SEQ ID NO: 2739348 - RNA, 17 nt, Human
cacagccagacuggcac

SEQ ID NO: 2739349 - RNA, 21 nt, Human
cacagcucuucuccaggcugu

SEQ ID NO: 2739350 - RNA, 19 nt, Human
cacagcaguugaaaagacu

SEQ ID NO: 2739351 - RNA, 21 nt, Human
cacagcaguugaaaagacucc

SEQ ID NO: 2739352 - RNA, 13 nt, Human
cacacugaagaag

SEQ ID NO: 2739353 - RNA, 12 nt, Human
cacagagaaagu

SEQ ID NO: 2739354 - RNA, 21 nt, Human
cacagagaaaguacuucucca

SEQ ID NO: 2739355 - RNA, 19 nt, Human
cacagagaaaguacuucuc

SEQ ID NO: 2739356 - RNA, 20 nt, Human
cacagagaaaguacuucucc

SEQ ID NO: 2739357 - RNA, 23 nt, Human
cacagaugggugcuuggaggaag

SEQ ID NO: 2739358 - RNA, 13 nt, Human
cacagaggcugcc

SEQ ID NO: 2739359 - RNA, 21 nt, Human
cacagaguuguuacauuuuua

SEQ ID NO: 2739360 - RNA, 22 nt, Human
cacagaguuguuacauuuuuaa

SEQ ID NO: 2739361 - RNA, 23 nt, Human
caagggugaugggaaagcauugu

SEQ ID NO: 2739362 - RNA, 21 nt, Human
caagggugaugggaaagcauu

SEQ ID NO: 2739363 - RNA, 18 nt, Human
caaggcugggggaagaag

SEQ ID NO: 2739364 - RNA, 17 nt, Human
caauagucaaauugugu

SEQ ID NO: 2739365 - RNA, 19 nt, Human
caauagucaaauuguguga

SEQ ID NO: 2739366 - RNA, 15 nt, Human
caauaggaaaaacug

SEQ ID NO: 2739367 - RNA, 16 nt, Human
caauaggaaaaacuga

SEQ ID NO: 2739368 - RNA, 17 nt, Human
caauaggaaaaacugau

SEQ ID NO: 2739369 - RNA, 19 nt, Human
caauaauaaauauuuuugc

SEQ ID NO: 2739370 - RNA, 18 nt, Human
caaggaaaaaauaacaau

SEQ ID NO: 2739371 - RNA, 22 nt, Human
caagcuggucccacucagucca

SEQ ID NO: 2739372 - RNA, 23 nt, Human
caagcuggucccacucaguccau

SEQ ID NO: 2739373 - RNA, 20 nt, Human
caaggaaaaaauaacaauga

SEQ ID NO: 2739374 - RNA, 17 nt, Human
caaggcugcagugagcc

SEQ ID NO: 2739375 - RNA, 22 nt, Human
caaggcugcagugagccgagau

SEQ ID NO: 2739376 - RNA, 20 nt, Human
caaggauccugagccagauu

SEQ ID NO: 2739377 - RNA, 16 nt, Human
caaggagauuuacaac

SEQ ID NO: 2739378 - RNA, 18 nt, Human
caaggauccugagccaga

SEQ ID NO: 2739379 - RNA, 19 nt, Human
caaggauccugagccagau

SEQ ID NO: 2739380 - RNA, 21 nt, Human
caagcugcacccucaggcagg

SEQ ID NO: 2739381 - RNA, 18 nt, Human
caagcgauucuucugcuu

SEQ ID NO: 2739382 - RNA, 15 nt, Human
caagcgauucuucug

SEQ ID NO: 2739383 - RNA, 17 nt, Human
caagcgauucuucugcu

SEQ ID NO: 2739384 - RNA, 22 nt, Human
caagcugcacccucaggcaggu

SEQ ID NO: 2739385 - RNA, 21 nt, Human
caagcuggucccacucagucc

SEQ ID NO: 2739386 - RNA, 18 nt, Human
caauaggaaaaacugauu

SEQ ID NO: 2739387 - RNA, 13 nt, Human
caaauaugcaaag

SEQ ID NO: 2739388 - RNA, 12 nt, Human
caaauaugcaaa

SEQ ID NO: 2739389 - RNA, 23 nt, Human
caaauggaaaugggcagagcaga

SEQ ID NO: 2739390 - RNA, 22 nt, Human
caaauggaaaugggcagagcag

SEQ ID NO: 2739391 - RNA, 23 nt, Human
caaagugcugggauuacaagcgu

SEQ ID NO: 2739392 - RNA, 15 nt, Human
caaauaaaaauauug

SEQ ID NO: 2739393 - RNA, 16 nt, Human
caaauaaaaauauugu

SEQ ID NO: 2739394 - RNA, 18 nt, Human
caaauaaaaauauugugu

SEQ ID NO: 2739395 - RNA, 16 nt, Human
caaagagagaaaauaa

SEQ ID NO: 2739396 - RNA, 19 nt, Human
caaagagagaaaauaaaga

SEQ ID NO: 2739397 - RNA, 13 nt, Human
caaagugcuggga

SEQ ID NO: 2739398 - RNA, 19 nt, Human
caaagugcugggauuacaa

SEQ ID NO: 2739399 - RNA, 22 nt, Human
caaauuucuaaaucuccaaaau

SEQ ID NO: 2739400 - RNA, 15 nt, Human
caaauuucuaaaucu

SEQ ID NO: 2739401 - RNA, 20 nt, Human
caacauacucccaucuguga

SEQ ID NO: 2739402 - RNA, 12 nt, Human
caacaggcuggg

SEQ ID NO: 2739403 - RNA, 17 nt, Human
caacauacucccaucug

SEQ ID NO: 2739404 - RNA, 19 nt, Human
caacauacucccaucugug

SEQ ID NO: 2739405 - RNA, 23 nt, Human
caacagcuggugcccugcuuuca

SEQ ID NO: 2739406 - RNA, 14 nt, Human
caagaagcccagga

SEQ ID NO: 2739407 - RNA, 13 nt, Human
caagaagcccagg

SEQ ID NO: 2739408 - RNA, 21 nt, Human
caagaccuucuccuucaccuu

SEQ ID NO: 2739409 - RNA, 23 nt, Human
caagaccuucuccuucaccuuug

SEQ ID NO: 2739410 - RNA, 13 nt, Human
caagacgcugugc

SEQ ID NO: 2739411 - RNA, 15 nt, Human
caagacgcugugcug

SEQ ID NO: 2739412 - RNA, 17 nt, Human
caaacugacucuuaaga

SEQ ID NO: 2739413 - RNA, 21 nt, Human
caaacugacucuuaagaagac

SEQ ID NO: 2739414 - RNA, 16 nt, Human
caaacugacucuuaag

SEQ ID NO: 2739415 - RNA, 21 nt, Human
caaacucuugaccucagguga

SEQ ID NO: 2739416 - RNA, 17 nt, Human
caaacucuugaccucag

SEQ ID NO: 2739417 - RNA, 19 nt, Human
caaacucuugaccucaggu

SEQ ID NO: 2739418 - RNA, 20 nt, Human
caaacucuugaccucaggug

SEQ ID NO: 2739419 - RNA, 11 nt, Human
caaaaugaaac

SEQ ID NO: 2739420 - RNA, 22 nt, Human
caaaaugaaacgcaaccaccac

SEQ ID NO: 2739421 - RNA, 15 nt, Human
caaacagaggccgcc

SEQ ID NO: 2739422 - RNA, 13 nt, Human
caaacagaggccg

SEQ ID NO: 2739423 - RNA, 18 nt, Human
caaaacugcacugucaag

SEQ ID NO: 2739424 - RNA, 17 nt, Human
caaaacugcacugucaa

SEQ ID NO: 2739425 - RNA, 14 nt, Human
caaaacugcacugu

SEQ ID NO: 2739426 - RNA, 19 nt, Human
caaaacucuccucugcugc

SEQ ID NO: 2739427 - RNA, 14 nt, Human
caaaaguuucucuu

SEQ ID NO: 2739428 - RNA, 23 nt, Human
caaaacucuccucugcugcuggc

SEQ ID NO: 2739429 - RNA, 18 nt, Human
auuuuauuuuauuaugca

SEQ ID NO: 2739430 - RNA, 15 nt, Human
caaaacgguuuuacu

SEQ ID NO: 2739431 - RNA, 21 nt, Human
caaaacgguuuuacugcagcu

SEQ ID NO: 2739432 - RNA, 15 nt, Human
caaaacucuccucug

SEQ ID NO: 2739433 - RNA, 16 nt, Human
caaaacucuccucugc

SEQ ID NO: 2739434 - RNA, 18 nt, Human
caaaauaauuuuaagaaa

SEQ ID NO: 2739435 - RNA, 22 nt, Human
caaaauaauuuuaagaaaucaa

SEQ ID NO: 2739436 - RNA, 14 nt, Human
caaaauaaaacuuu

SEQ ID NO: 2739437 - RNA, 16 nt, Human
caaaauaaaacuuuuu

SEQ ID NO: 2739438 - RNA, 20 nt, Human
caaaauaaaacuuuuuaaaa

SEQ ID NO: 2739439 - RNA, 21 nt, Human
caaaaucgaugcagugcuucc

SEQ ID NO: 2739440 - RNA, 13 nt, Human
caacaggcugggc

SEQ ID NO: 2739441 - RNA, 17 nt, Human
cacaguucaauucucau

SEQ ID NO: 2739442 - RNA, 16 nt, Human
caguguacauggaaua

SEQ ID NO: 2739443 - RNA, 23 nt, Human
caguguacauggaauaacaugua

SEQ ID NO: 2739444 - RNA, 20 nt, Human
caguguacauggaauaacau

SEQ ID NO: 2739445 - RNA, 14 nt, Human
cagugugucuaaau

SEQ ID NO: 2739446 - RNA, 23 nt, Human
cagugugucuaaauuugaauguu

SEQ ID NO: 2739447 - RNA, 14 nt, Human
cagugugacaagga

SEQ ID NO: 2739448 - RNA, 12 nt, Human
cagugugacuga

SEQ ID NO: 2739449 - RNA, 22 nt, Human
cagugguuccuaauccucuagg

SEQ ID NO: 2739450 - RNA, 12 nt, Human
caguggcagcug

SEQ ID NO: 2739451 - RNA, 13 nt, Human
caguggcagcugc

SEQ ID NO: 2739452 - RNA, 14 nt, Human
caguggcagcugcu

SEQ ID NO: 2739453 - RNA, 15 nt, Human
caguggcagcugcuu

SEQ ID NO: 2739454 - RNA, 16 nt, Human
caguggcagcugcuuu

SEQ ID NO: 2739455 - RNA, 22 nt, Human
caguguuguggauuuaacagaa

SEQ ID NO: 2739456 - RNA, 20 nt, Human
caguguuguggauuuaacag

SEQ ID NO: 2739457 - RNA, 19 nt, Human
caguguuguggauuuaaca

SEQ ID NO: 2739458 - RNA, 21 nt, Human
caguuaccucugccucagaaa

SEQ ID NO: 2739459 - RNA, 14 nt, Human
caguuacucagaau

SEQ ID NO: 2739460 - RNA, 13 nt, Human
caguuaagagaaa

SEQ ID NO: 2739461 - RNA, 14 nt, Human
caguuaagagaaau

SEQ ID NO: 2739462 - RNA, 12 nt, Human
caguucugaaga

SEQ ID NO: 2739463 - RNA, 22 nt, Human
caguucucuccuucuucccccc

SEQ ID NO: 2739464 - RNA, 13 nt, Human
caguucugaagaa

SEQ ID NO: 2739465 - RNA, 14 nt, Human
caguucugaagaag

SEQ ID NO: 2739466 - RNA, 22 nt, Human
caguucugaagaagaugguacc

SEQ ID NO: 2739467 - RNA, 15 nt, Human
caguucugaagaaga

SEQ ID NO: 2739468 - RNA, 16 nt, Human
caguucugaagaagau

SEQ ID NO: 2739469 - RNA, 22 nt, Human
caguucggugagcuacaaaugc

SEQ ID NO: 2739470 - RNA, 13 nt, Human
caguucucuccuu

SEQ ID NO: 2739471 - RNA, 14 nt, Human
caguucucuccuuc

SEQ ID NO: 2739472 - RNA, 15 nt, Human
caguucucuccuucu

SEQ ID NO: 2739473 - RNA, 12 nt, Human
caguugaaaaac

SEQ ID NO: 2739474 - RNA, 18 nt, Human
caguugaaaaacagcuga

SEQ ID NO: 2739475 - RNA, 19 nt, Human
caguugaaaaacagcugag

SEQ ID NO: 2739476 - RNA, 17 nt, Human
cauaccaacacgagcag

SEQ ID NO: 2739477 - RNA, 15 nt, Human
cauacauuguacgaa

SEQ ID NO: 2739478 - RNA, 12 nt, Human
cauacauauuuu

SEQ ID NO: 2739479 - RNA, 19 nt, Human
cauacauauuuuuguagca

SEQ ID NO: 2739480 - RNA, 11 nt, Human
cauacauauuu

SEQ ID NO: 2739481 - RNA, 19 nt, Human
cauaccacuuuuguucuug

SEQ ID NO: 2739482 - RNA, 11 nt, Human
cauacccaccc

SEQ ID NO: 2739483 - RNA, 12 nt, Human
cauacccacccc

SEQ ID NO: 2739484 - RNA, 18 nt, Human
cauaccacuuuuguucuu

SEQ ID NO: 2739485 - RNA, 15 nt, Human
cauaccacuuuuguu

SEQ ID NO: 2739486 - RNA, 14 nt, Human
cauaccacuuuugu

SEQ ID NO: 2739487 - RNA, 13 nt, Human
cauaccacuuuug

SEQ ID NO: 2739488 - RNA, 16 nt, Human
cauaaguaauucaaga

SEQ ID NO: 2739489 - RNA, 17 nt, Human
cauaaguaauucaagaa

SEQ ID NO: 2739490 - RNA, 18 nt, Human
cauaaguaauucaagaaa

SEQ ID NO: 2739491 - RNA, 22 nt, Human
cauaaguaauucaagaaaacaa

SEQ ID NO: 2739492 - RNA, 14 nt, Human
cauaagauaaaugu

SEQ ID NO: 2739493 - RNA, 21 nt, Human
cauaaaaauuagccaagugug

SEQ ID NO: 2739494 - RNA, 23 nt, Human
cauaaaaagccugcaauuucaua

SEQ ID NO: 2739495 - RNA, 17 nt, Human
cauaaaaacaacuuuau

SEQ ID NO: 2739496 - RNA, 20 nt, Human
cauaaaaacaacuuuauacc

SEQ ID NO: 2739497 - RNA, 21 nt, Human
cauaaaaacaacuuuauaccc

SEQ ID NO: 2739498 - RNA, 23 nt, Human
cauaaaaacaacuuuauacccag

SEQ ID NO: 2739499 - RNA, 21 nt, Human
cauaaacaagaccacguuucu

SEQ ID NO: 2739500 - RNA, 20 nt, Human
cauaaacaagaccacguuuc

SEQ ID NO: 2739501 - RNA, 22 nt, Human
cauaaacaagaccacguuucua

SEQ ID NO: 2739502 - RNA, 23 nt, Human
cauaaaucugugaacuugaaauu

SEQ ID NO: 2739503 - RNA, 22 nt, Human
cauaaaucugugaacuugaaau

SEQ ID NO: 2739504 - RNA, 18 nt, Human
cauaaaucugugaacuug

SEQ ID NO: 2739505 - RNA, 16 nt, Human
cauaaaucugugaacu

SEQ ID NO: 2739506 - RNA, 14 nt, Human
cauaaaucugugaa

SEQ ID NO: 2739507 - RNA, 19 nt, Human
cauaacauaaaucugugaa

SEQ ID NO: 2739508 - RNA, 12 nt, Human
cauaacauaaau

SEQ ID NO: 2739509 - RNA, 20 nt, Human
cauaaauuuaguauuuuguu

SEQ ID NO: 2739510 - RNA, 19 nt, Human
cauaaauuuaguauuuugu

SEQ ID NO: 2739511 - RNA, 21 nt, Human
cauaacauaaaucugugaacu

SEQ ID NO: 2739512 - RNA, 16 nt, Human
cauaaccuagccuuag

SEQ ID NO: 2739513 - RNA, 18 nt, Human
caguugaaaagacuccaa

SEQ ID NO: 2739514 - RNA, 14 nt, Human
caguugaaaagacu

SEQ ID NO: 2739515 - RNA, 23 nt, Human
caguugaaaagacuccaaagaaa

SEQ ID NO: 2739516 - RNA, 22 nt, Human
caguugaaaagacuccaaagaa

SEQ ID NO: 2739517 - RNA, 21 nt, Human
caguugaaaagacuccaaaga

SEQ ID NO: 2739518 - RNA, 20 nt, Human
caguuuucugagaaagacua

SEQ ID NO: 2739519 - RNA, 19 nt, Human
caguuuucugagaaagacu

SEQ ID NO: 2739520 - RNA, 21 nt, Human
caguuuuguuuggaccaaaaa

SEQ ID NO: 2739521 - RNA, 15 nt, Human
cauaaaaacaacuuu

SEQ ID NO: 2739522 - RNA, 15 nt, Human
caguuuucugagaaa

SEQ ID NO: 2739523 - RNA, 14 nt, Human
caguuuucugagaa

SEQ ID NO: 2739524 - RNA, 17 nt, Human
caguuguuagugugucu

SEQ ID NO: 2739525 - RNA, 16 nt, Human
caguuggguggaugcc

SEQ ID NO: 2739526 - RNA, 23 nt, Human
caguugccagucaccccggccac

SEQ ID NO: 2739527 - RNA, 18 nt, Human
caguuggguggaugccug

SEQ ID NO: 2739528 - RNA, 19 nt, Human
caguuggguggaugccugg

SEQ ID NO: 2739529 - RNA, 18 nt, Human
caguuggucccccuucca

SEQ ID NO: 2739530 - RNA, 19 nt, Human
caguuggucccccuuccau

SEQ ID NO: 2739531 - RNA, 20 nt, Human
caguuggucccccuuccaug

SEQ ID NO: 2739532 - RNA, 21 nt, Human
caguuggucccccuuccaugg

SEQ ID NO: 2739533 - RNA, 22 nt, Human
caguuggucccccuuccaugga

SEQ ID NO: 2739534 - RNA, 14 nt, Human
cauacccaccccca

SEQ ID NO: 2739535 - RNA, 17 nt, Human
cauacccacccccaccc

SEQ ID NO: 2739536 - RNA, 18 nt, Human
cauacccacccccaccca

SEQ ID NO: 2739537 - RNA, 21 nt, Human
cauacccacccccacccaagg

SEQ ID NO: 2739538 - RNA, 13 nt, Human
cauacguacacau

SEQ ID NO: 2739539 - RNA, 16 nt, Human
cauacguacacauuuu

SEQ ID NO: 2739540 - RNA, 15 nt, Human
cauacguacacauuu

SEQ ID NO: 2739541 - RNA, 21 nt, Human
cauacuaaccagcagaaaugc

SEQ ID NO: 2739542 - RNA, 14 nt, Human
cauacuaaccagca

SEQ ID NO: 2739543 - RNA, 18 nt, Human
cauacguacacauuuuau

SEQ ID NO: 2739544 - RNA, 17 nt, Human
cauacguacacauuuua

SEQ ID NO: 2739545 - RNA, 22 nt, Human
caucuagugagcagucaggaaa

SEQ ID NO: 2739546 - RNA, 16 nt, Human
caucucacacaugagc

SEQ ID NO: 2739547 - RNA, 17 nt, Human
caucucacacaugagca

SEQ ID NO: 2739548 - RNA, 20 nt, Human
caucucacacaugagcauca

SEQ ID NO: 2739549 - RNA, 14 nt, Human
caucuagugagcag

SEQ ID NO: 2739550 - RNA, 15 nt, Human
caucuacccuccgau

SEQ ID NO: 2739551 - RNA, 19 nt, Human
cauccucuguacagagccc

SEQ ID NO: 2739552 - RNA, 15 nt, Human
cauccucuguacaga

SEQ ID NO: 2739553 - RNA, 18 nt, Human
cauccucuguacagagcc

SEQ ID NO: 2739554 - RNA, 15 nt, Human
cauccucauacccac

SEQ ID NO: 2739555 - RNA, 16 nt, Human
cauccucauacccacc

SEQ ID NO: 2739556 - RNA, 11 nt, Human
cauccuccuca

SEQ ID NO: 2739557 - RNA, 12 nt, Human
cauccuccucag

SEQ ID NO: 2739558 - RNA, 15 nt, Human
cauccuccucagauc

SEQ ID NO: 2739559 - RNA, 16 nt, Human
cauccuccucagaucu

SEQ ID NO: 2739560 - RNA, 18 nt, Human
cauccuccucagaucuuc

SEQ ID NO: 2739561 - RNA, 19 nt, Human
cauccuccucagaucuucu

SEQ ID NO: 2739562 - RNA, 13 nt, Human
cauccucccaagg

SEQ ID NO: 2739563 - RNA, 17 nt, Human
cauccucauacccaccc

SEQ ID NO: 2739564 - RNA, 18 nt, Human
cauccucauacccacccc

SEQ ID NO: 2739565 - RNA, 21 nt, Human
cauccucauacccacccccac

SEQ ID NO: 2739566 - RNA, 22 nt, Human
cauccucauacccacccccacc

SEQ ID NO: 2739567 - RNA, 20 nt, Human
caucuugcucugcugacaga

SEQ ID NO: 2739568 - RNA, 13 nt, Human
caucuugcucugc

SEQ ID NO: 2739569 - RNA, 14 nt, Human
caucuugcucugcu

SEQ ID NO: 2739570 - RNA, 22 nt, Human
caucuuccaaggguacuaagga

SEQ ID NO: 2739571 - RNA, 14 nt, Human
caucccucccucca

SEQ ID NO: 2739572 - RNA, 19 nt, Human
caucccucuggggcuguuc

SEQ ID NO: 2739573 - RNA, 11 nt, Human
caucccugaag

SEQ ID NO: 2739574 - RNA, 13 nt, Human
caucccugaaggc

SEQ ID NO: 2739575 - RNA, 12 nt, Human
caucccucccuc

SEQ ID NO: 2739576 - RNA, 13 nt, Human
caucccucccucc

SEQ ID NO: 2739577 - RNA, 15 nt, Human
cauccagguucagcu

SEQ ID NO: 2739578 - RNA, 15 nt, Human
caucaccaacgucug

SEQ ID NO: 2739579 - RNA, 13 nt, Human
caucauugaaauc

SEQ ID NO: 2739580 - RNA, 14 nt, Human
caucauugaaaucu

SEQ ID NO: 2739581 - RNA, 15 nt, Human
caucauugaaaucuu

SEQ ID NO: 2739582 - RNA, 20 nt, Human
caucauugaaaucuuuuugc

SEQ ID NO: 2739583 - RNA, 21 nt, Human
caucauugaaaucuuuuugcu

SEQ ID NO: 2739584 - RNA, 17 nt, Human
caucccugaaggccccg

SEQ ID NO: 2739585 - RNA, 18 nt, Human
caucccugaaggccccgc

SEQ ID NO: 2739586 - RNA, 19 nt, Human
caucccugaaggccccgcc

SEQ ID NO: 2739587 - RNA, 21 nt, Human
caucccugaaggccccgccca

SEQ ID NO: 2739588 - RNA, 22 nt, Human
caucaagucuuucacauuuaaa

SEQ ID NO: 2739589 - RNA, 14 nt, Human
caucaagaugugac

SEQ ID NO: 2739590 - RNA, 12 nt, Human
cauauuuucaug

SEQ ID NO: 2739591 - RNA, 14 nt, Human
cauauuuuucacau

SEQ ID NO: 2739592 - RNA, 21 nt, Human
cauauuuuucacauaucuagu

SEQ ID NO: 2739593 - RNA, 17 nt, Human
cauauuuacuucuuaua

SEQ ID NO: 2739594 - RNA, 16 nt, Human
cauauuuacuucuuau

SEQ ID NO: 2739595 - RNA, 20 nt, Human
cauauuuacuucuuauacau

SEQ ID NO: 2739596 - RNA, 14 nt, Human
cauauuuacuucuu

SEQ ID NO: 2739597 - RNA, 13 nt, Human
cauaugccugggc

SEQ ID NO: 2739598 - RNA, 18 nt, Human
cauauuuuucacauaucu

SEQ ID NO: 2739599 - RNA, 20 nt, Human
cauauauaacaaugcuguau

SEQ ID NO: 2739600 - RNA, 22 nt, Human
cauauauuuuuauauuuacuaa

SEQ ID NO: 2739601 - RNA, 22 nt, Human
cauauauauguuuuaagaggca

SEQ ID NO: 2739602 - RNA, 20 nt, Human
cauaguaugguggcuggguu

SEQ ID NO: 2739603 - RNA, 18 nt, Human
cauaguaugguggcuggg

SEQ ID NO: 2739604 - RNA, 19 nt, Human
cauaguaugguggcugggu

SEQ ID NO: 2739605 - RNA, 22 nt, Human
cauaguggcuuaaaacaacacu

SEQ ID NO: 2739606 - RNA, 23 nt, Human
cauagagagcaagacgcugugcu

SEQ ID NO: 2739607 - RNA, 19 nt, Human
cauagagagcaagacgcug

SEQ ID NO: 2739608 - RNA, 21 nt, Human
cauagagagcaagacgcugug

SEQ ID NO: 2739609 - RNA, 11 nt, Human
cauacucugcu

SEQ ID NO: 2739610 - RNA, 16 nt, Human
cauacucccaucugug

SEQ ID NO: 2739611 - RNA, 15 nt, Human
cauacucccaucugu

SEQ ID NO: 2739612 - RNA, 18 nt, Human
cauacucccaucugugaa

SEQ ID NO: 2739613 - RNA, 20 nt, Human
cauacucccaucugugaaag

SEQ ID NO: 2739614 - RNA, 23 nt, Human
caugcugucuacacuaagagaga

SEQ ID NO: 2739615 - RNA, 22 nt, Human
caugcugucccuuacgugaguc

SEQ ID NO: 2739616 - RNA, 17 nt, Human
caugcugucccuuacgu

SEQ ID NO: 2739617 - RNA, 20 nt, Human
caugcuguucaugaaagauu

SEQ ID NO: 2739618 - RNA, 17 nt, Human
caugcgggcuuccuccu

SEQ ID NO: 2739619 - RNA, 23 nt, Human
caugccuggauggggcugcaccg

SEQ ID NO: 2739620 - RNA, 18 nt, Human
caugccuggauggggcug

SEQ ID NO: 2739621 - RNA, 21 nt, Human
caugccuggauggggcugcac

SEQ ID NO: 2739622 - RNA, 18 nt, Human
cauggaacgcguugaaau

SEQ ID NO: 2739623 - RNA, 23 nt, Human
cauggaacgcguugaaauuguaa

SEQ ID NO: 2739624 - RNA, 20 nt, Human
cauggaacgcguugaaauug

SEQ ID NO: 2739625 - RNA, 19 nt, Human
cauggaacgcguugaaauu

SEQ ID NO: 2739626 - RNA, 20 nt, Human
cauggaaguacuauaauuua

SEQ ID NO: 2739627 - RNA, 22 nt, Human
cauggaaguacuauaauuuacc

SEQ ID NO: 2739628 - RNA, 18 nt, Human
cauggacaugaucuucuu

SEQ ID NO: 2739629 - RNA, 16 nt, Human
cauggaauaacaugua

SEQ ID NO: 2739630 - RNA, 22 nt, Human
caugggaaugaaugucagugug

SEQ ID NO: 2739631 - RNA, 15 nt, Human
caugggccuccugug

SEQ ID NO: 2739632 - RNA, 16 nt, Human
caugggccuccugugu

SEQ ID NO: 2739633 - RNA, 17 nt, Human
caugggccuccugugug

SEQ ID NO: 2739634 - RNA, 17 nt, Human
cauggagguuugaagau

SEQ ID NO: 2739635 - RNA, 11 nt, Human
cauggacuuug

SEQ ID NO: 2739636 - RNA, 13 nt, Human
cauggacuuuguu

SEQ ID NO: 2739637 - RNA, 18 nt, Human
caugggaaugaaugucag

SEQ ID NO: 2739638 - RNA, 16 nt, Human
cauggaguauauguca

SEQ ID NO: 2739639 - RNA, 14 nt, Human
caugccucucucag

SEQ ID NO: 2739640 - RNA, 15 nt, Human
caugccucucucagg

SEQ ID NO: 2739641 - RNA, 13 nt, Human
caugccuggaugg

SEQ ID NO: 2739642 - RNA, 16 nt, Human
caugccucucucaggc

SEQ ID NO: 2739643 - RNA, 17 nt, Human
caugccucucucaggcc

SEQ ID NO: 2739644 - RNA, 18 nt, Human
caugccucucucaggcca

SEQ ID NO: 2739645 - RNA, 19 nt, Human
caugccucucucaggccaa

SEQ ID NO: 2739646 - RNA, 19 nt, Human
caugccagcuuaucucagg

SEQ ID NO: 2739647 - RNA, 20 nt, Human
caugccagcuuaucucaggg

SEQ ID NO: 2739648 - RNA, 13 nt, Human
caugccccugaac

SEQ ID NO: 2739649 - RNA, 16 nt, Human
cauggucggaaaacau

SEQ ID NO: 2739650 - RNA, 21 nt, Human
cauguaauuaaguacuaugua

SEQ ID NO: 2739651 - RNA, 18 nt, Human
cauguaauuaaguacuau

SEQ ID NO: 2739652 - RNA, 14 nt, Human
caugucuuuucuug

SEQ ID NO: 2739653 - RNA, 19 nt, Human
caugucuuuucuugcauga

SEQ ID NO: 2739654 - RNA, 21 nt, Human
caugucuuuucuugcaugagg

SEQ ID NO: 2739655 - RNA, 23 nt, Human
caugucuuuucuugcaugaggcu

SEQ ID NO: 2739656 - RNA, 12 nt, Human
cauguuuauuac

SEQ ID NO: 2739657 - RNA, 22 nt, Human
cauguuuauuacaguauaauua

SEQ ID NO: 2739658 - RNA, 20 nt, Human
cauguuuauuacaguauaau

SEQ ID NO: 2739659 - RNA, 19 nt, Human
cauguuuauuacaguauaa

SEQ ID NO: 2739660 - RNA, 18 nt, Human
cauguuuauuacaguaua

SEQ ID NO: 2739661 - RNA, 13 nt, Human
cauguuuauuaca

SEQ ID NO: 2739662 - RNA, 23 nt, Human
cauguuugauguaucugagcagg

SEQ ID NO: 2739663 - RNA, 15 nt, Human
cauguuugugauuga

SEQ ID NO: 2739664 - RNA, 21 nt, Human
caugugccagguuuuuggucu

SEQ ID NO: 2739665 - RNA, 15 nt, Human
caugugcacaugcac

SEQ ID NO: 2739666 - RNA, 11 nt, Human
cauuauuuuau

SEQ ID NO: 2739667 - RNA, 15 nt, Human
cauguuuuguuuacg

SEQ ID NO: 2739668 - RNA, 18 nt, Human
cauguuuuucuucucccu

SEQ ID NO: 2739669 - RNA, 21 nt, Human
ccaacacgagcaggcuacugu

SEQ ID NO: 2739670 - RNA, 14 nt, Human
ccaacauacuccca

SEQ ID NO: 2739671 - RNA, 16 nt, Human
ccaacaucaacaucuu

SEQ ID NO: 2739672 - RNA, 14 nt, Human
ccaacacgagcagg

SEQ ID NO: 2739673 - RNA, 22 nt, Human
ccaaauucuuucaguggcuacc

SEQ ID NO: 2739674 - RNA, 15 nt, Human
ccaaauucuuucagu

SEQ ID NO: 2739675 - RNA, 15 nt, Human
ccaagaccuucuccu

SEQ ID NO: 2739676 - RNA, 13 nt, Human
ccaacccucauca

SEQ ID NO: 2739677 - RNA, 15 nt, Human
ccaacccucaucacc

SEQ ID NO: 2739678 - RNA, 13 nt, Human
ccaaagaugcagc

SEQ ID NO: 2739679 - RNA, 14 nt, Human
ccaaagaugcagcc

SEQ ID NO: 2739680 - RNA, 16 nt, Human
ccacaagacccuugug

SEQ ID NO: 2739681 - RNA, 13 nt, Human
ccacaagagccca

SEQ ID NO: 2739682 - RNA, 18 nt, Human
ccacaaaggagagcuagc

SEQ ID NO: 2739683 - RNA, 18 nt, Human
ccaaggugggaggauugc

SEQ ID NO: 2739684 - RNA, 14 nt, Human
ccaaggcuggggga

SEQ ID NO: 2739685 - RNA, 12 nt, Human
ccaagcucccag

SEQ ID NO: 2739686 - RNA, 13 nt, Human
ccaagcucccagg

SEQ ID NO: 2739687 - RNA, 23 nt, Human
ccaagcagagguugggaggccau

SEQ ID NO: 2739688 - RNA, 14 nt, Human
ccaagcaggacaug

SEQ ID NO: 2739689 - RNA, 20 nt, Human
ccacaaguuaaauaaaucau

SEQ ID NO: 2739690 - RNA, 15 nt, Human
ccacaaguuaaauaa

SEQ ID NO: 2739691 - RNA, 20 nt, Human
ccacaagagcccaggccucc

SEQ ID NO: 2739692 - RNA, 21 nt, Human
ccacaagagcccaggccuccu

SEQ ID NO: 2739693 - RNA, 16 nt, Human
ccacaagagcccaggc

SEQ ID NO: 2739694 - RNA, 17 nt, Human
ccacaagagcccaggcc

SEQ ID NO: 2739695 - RNA, 18 nt, Human
ccacaagagcccaggccu

SEQ ID NO: 2739696 - RNA, 19 nt, Human
ccacaagagcccaggccuc

SEQ ID NO: 2739697 - RNA, 19 nt, Human
cauuuaaagcuuauuaaaa

SEQ ID NO: 2739698 - RNA, 17 nt, Human
cauuuacuuuguguuca

SEQ ID NO: 2739699 - RNA, 21 nt, Human
cauuuacuuuguguucaccuu

SEQ ID NO: 2739700 - RNA, 12 nt, Human
cauuuccaagca

SEQ ID NO: 2739701 - RNA, 21 nt, Human
cauuuaaaagauacaguuacu

SEQ ID NO: 2739702 - RNA, 23 nt, Human
cauuucugcaucagcugcugaaa

SEQ ID NO: 2739703 - RNA, 21 nt, Human
cauuucuuccacaagagccca

SEQ ID NO: 2739704 - RNA, 13 nt, Human
cauugaccugagg

SEQ ID NO: 2739705 - RNA, 22 nt, Human
cauugaccugaggcccuucucu

SEQ ID NO: 2739706 - RNA, 19 nt, Human
cauugaaaucuuuuugcuu

SEQ ID NO: 2739707 - RNA, 16 nt, Human
cauuauuuuauuauga

SEQ ID NO: 2739708 - RNA, 14 nt, Human
cauuauuuuauuau

SEQ ID NO: 2739709 - RNA, 12 nt, Human
cauuauuuuauu

SEQ ID NO: 2739710 - RNA, 17 nt, Human
ccaaagaaauguaaggg

SEQ ID NO: 2739711 - RNA, 20 nt, Human
cauuuuuaguagagacaggg

SEQ ID NO: 2739712 - RNA, 21 nt, Human
ccaaaauaaaacuuuuuaaaa

SEQ ID NO: 2739713 - RNA, 18 nt, Human
ccaaaauaaaacuuuuua

SEQ ID NO: 2739714 - RNA, 16 nt, Human
cauuugcucauggaau

SEQ ID NO: 2739715 - RNA, 22 nt, Human
cauuugaggucuguucuuucca

SEQ ID NO: 2739716 - RNA, 15 nt, Human
cauuugcucauggaa

SEQ ID NO: 2739717 - RNA, 14 nt, Human
cauuugcucaugga

SEQ ID NO: 2739718 - RNA, 21 nt, Human
cauuuuauuuuauuaugcaug

SEQ ID NO: 2739719 - RNA, 19 nt, Human
cauuuuauuuuauuaugca

SEQ ID NO: 2739720 - RNA, 18 nt, Human
cauuuugcuaaaugugaa

SEQ ID NO: 2739721 - RNA, 21 nt, Human
cauuuugcuaaaugugaauga

SEQ ID NO: 2739722 - RNA, 24 nt, Human
cauuuugcuaaaugugaaugauga

SEQ ID NO: 2739723 - RNA, 20 nt, Human
cauuuugggguacccacugc

SEQ ID NO: 2739724 - RNA, 21 nt, Human
cauuuugggguacccacugcu

SEQ ID NO: 2739725 - RNA, 22 nt, Human
cauuuugggguacccacugcuc

SEQ ID NO: 2739726 - RNA, 23 nt, Human
cauuuugggguacccacugcucu

SEQ ID NO: 2739727 - RNA, 19 nt, Human
cauuuuuaguagagacagg

SEQ ID NO: 2739728 - RNA, 18 nt, Human
cauuuuuaguagagacag

SEQ ID NO: 2739729 - RNA, 20 nt, Human
cauuuuuaagugcugcauuu

SEQ ID NO: 2739730 - RNA, 15 nt, Human
cauuuuuaagugcug

SEQ ID NO: 2739731 - RNA, 16 nt, Human
cauuugagcagggcuc

SEQ ID NO: 2739732 - RNA, 17 nt, Human
cauuugaggucuguucu

SEQ ID NO: 2739733 - RNA, 19 nt, Human
cauuugaggucuguucuuu

SEQ ID NO: 2739734 - RNA, 18 nt, Human
cauuugaggucuguucuu

SEQ ID NO: 2739735 - RNA, 14 nt, Human
cauuugagcagggc

SEQ ID NO: 2739736 - RNA, 23 nt, Human
cauuucuuccacaagagcccagg

SEQ ID NO: 2739737 - RNA, 14 nt, Human
cccaguuagcucuc

SEQ ID NO: 2739738 - RNA, 20 nt, Human
cccagugguuccuaauccuc

SEQ ID NO: 2739739 - RNA, 15 nt, Human
cccagugccgagaag

SEQ ID NO: 2739740 - RNA, 21 nt, Human
cccagugcccacaggaucagu

SEQ ID NO: 2739741 - RNA, 10 nt, Human
cccagucugg

SEQ ID NO: 2739742 - RNA, 18 nt, Human
cccagucuggaaugcagu

SEQ ID NO: 2739743 - RNA, 19 nt, Human
cccagucuggaaugcagug

SEQ ID NO: 2739744 - RNA, 17 nt, Human
cccaggcauuccccagg

SEQ ID NO: 2739745 - RNA, 23 nt, Human
cccaggcaggucuugaacuccug

SEQ ID NO: 2739746 - RNA, 15 nt, Human
cccaggcauucccca

SEQ ID NO: 2739747 - RNA, 15 nt, Human
cccaggaggccagcc

SEQ ID NO: 2739748 - RNA, 16 nt, Human
cccaggaggccagccu

SEQ ID NO: 2739749 - RNA, 13 nt, Human
cccagguuucuau

SEQ ID NO: 2739750 - RNA, 21 nt, Human
ccccaaauggaaaugggcaga

SEQ ID NO: 2739751 - RNA, 12 nt, Human
cccauuauucaa

SEQ ID NO: 2739752 - RNA, 20 nt, Human
cccaucugugaaaggaaaga

SEQ ID NO: 2739753 - RNA, 13 nt, Human
cccaucucacaca

SEQ ID NO: 2739754 - RNA, 18 nt, Human
cccaucucacacaugagc

SEQ ID NO: 2739755 - RNA, 14 nt, Human
cccaugcugcccug

SEQ ID NO: 2739756 - RNA, 12 nt, Human
cccaugcugccc

SEQ ID NO: 2739757 - RNA, 13 nt, Human
cccaugcugcccu

SEQ ID NO: 2739758 - RNA, 20 nt, Human
cccaugagccucagcauccu

SEQ ID NO: 2739759 - RNA, 15 nt, Human
cccaugagccucagc

SEQ ID NO: 2739760 - RNA, 16 nt, Human
cccaugagccucagca

SEQ ID NO: 2739761 - RNA, 13 nt, Human
ccaugugccaggu

SEQ ID NO: 2739762 - RNA, 13 nt, Human
ccauguuggccag

SEQ ID NO: 2739763 - RNA, 14 nt, Human
ccauguuggccagg

SEQ ID NO: 2739764 - RNA, 15 nt, Human
ccaugcugcccugug

SEQ ID NO: 2739765 - RNA, 15 nt, Human
ccaugcuccuggccc

SEQ ID NO: 2739766 - RNA, 18 nt, Human
ccaugcuccuggcccacu

SEQ ID NO: 2739767 - RNA, 16 nt, Human
ccaugcugcccuguga

SEQ ID NO: 2739768 - RNA, 17 nt, Human
ccaugcugcccugugag

SEQ ID NO: 2739769 - RNA, 13 nt, Human
ccaugcuccuggc

SEQ ID NO: 2739770 - RNA, 19 nt, Human
ccauguuggccaggcuggu

SEQ ID NO: 2739771 - RNA, 21 nt, Human
ccauguuggccaggcuggucu

SEQ ID NO: 2739772 - RNA, 18 nt, Human
ccauguuggccaggcugg

SEQ ID NO: 2739773 - RNA, 15 nt, Human
ccauguuggccaggc

SEQ ID NO: 2739774 - RNA, 12 nt, Human
cccaccuggccu

SEQ ID NO: 2739775 - RNA, 15 nt, Human
cccaccuggccucug

SEQ ID NO: 2739776 - RNA, 16 nt, Human
cccaccuuggcugcag

SEQ ID NO: 2739777 - RNA, 17 nt, Human
cccaccuuggcugcagg

SEQ ID NO: 2739778 - RNA, 19 nt, Human
cccaccuuggcugcaggga

SEQ ID NO: 2739779 - RNA, 20 nt, Human
cccaccuuggcugcagggag

SEQ ID NO: 2739780 - RNA, 15 nt, Human
cccacgcccccacug

SEQ ID NO: 2739781 - RNA, 13 nt, Human
cccacgcccccac

SEQ ID NO: 2739782 - RNA, 14 nt, Human
cccacgcccccacu

SEQ ID NO: 2739783 - RNA, 13 nt, Human
cccaggagccccg

SEQ ID NO: 2739784 - RNA, 14 nt, Human
cccaggagccccga

SEQ ID NO: 2739785 - RNA, 14 nt, Human
cccaggaggccagc

SEQ ID NO: 2739786 - RNA, 14 nt, Human
cccagcgagcccug

SEQ ID NO: 2739787 - RNA, 18 nt, Human
cccagcucugguccauag

SEQ ID NO: 2739788 - RNA, 15 nt, Human
cccagcucuggucca

SEQ ID NO: 2739789 - RNA, 16 nt, Human
cccagcucugguccau

SEQ ID NO: 2739790 - RNA, 12 nt, Human
cccagcucuggu

SEQ ID NO: 2739791 - RNA, 13 nt, Human
cccagcucugguc

SEQ ID NO: 2739792 - RNA, 14 nt, Human
cccagcucuggucc

SEQ ID NO: 2739793 - RNA, 18 nt, Human
cccagccccauccucugu

SEQ ID NO: 2739794 - RNA, 19 nt, Human
cccagccccauccucugua

SEQ ID NO: 2739795 - RNA, 13 nt, Human
cccagccccaucc

SEQ ID NO: 2739796 - RNA, 14 nt, Human
cccagccccauccc

SEQ ID NO: 2739797 - RNA, 14 nt, Human
cccagccccauccu

SEQ ID NO: 2739798 - RNA, 15 nt, Human
cccagccccauccuc

SEQ ID NO: 2739799 - RNA, 23 nt, Human
cccagauugcaacaggcugggcu

SEQ ID NO: 2739800 - RNA, 17 nt, Human
cccagccccaaugaaca

SEQ ID NO: 2739801 - RNA, 11 nt, Human
cccagccccau

SEQ ID NO: 2739802 - RNA, 12 nt, Human
cccagccccauc

SEQ ID NO: 2739803 - RNA, 13 nt, Human
cccagccccaaug

SEQ ID NO: 2739804 - RNA, 18 nt, Human
cccaggaggccagccuug

SEQ ID NO: 2739805 - RNA, 21 nt, Human
ccauccucuguacagagccca

SEQ ID NO: 2739806 - RNA, 14 nt, Human
ccaucaugucuggc

SEQ ID NO: 2739807 - RNA, 16 nt, Human
ccaucaugucuggcua

SEQ ID NO: 2739808 - RNA, 23 nt, Human
ccauagagagcaagacgcugugc

SEQ ID NO: 2739809 - RNA, 19 nt, Human
ccauauuaccacagacaua

SEQ ID NO: 2739810 - RNA, 15 nt, Human
ccauauucuguuggc

SEQ ID NO: 2739811 - RNA, 18 nt, Human
ccauauucuguuggccag

SEQ ID NO: 2739812 - RNA, 12 nt, Human
ccaucacccgcu

SEQ ID NO: 2739813 - RNA, 23 nt, Human
ccagggacagaggggguggccuc

SEQ ID NO: 2739814 - RNA, 16 nt, Human
ccaggcccucugccca

SEQ ID NO: 2739815 - RNA, 17 nt, Human
ccaggcccucugcccac

SEQ ID NO: 2739816 - RNA, 18 nt, Human
ccaggcccucugcccacu

SEQ ID NO: 2739817 - RNA, 19 nt, Human
ccaggcccucugcccacuc

SEQ ID NO: 2739818 - RNA, 13 nt, Human
ccaggccuccuac

SEQ ID NO: 2739819 - RNA, 18 nt, Human
ccaggccuccuacagcuu

SEQ ID NO: 2739820 - RNA, 19 nt, Human
ccaggccuccuacagcuug

SEQ ID NO: 2739821 - RNA, 19 nt, Human
ccaggccccugccacccug

SEQ ID NO: 2739822 - RNA, 21 nt, Human
ccaggccccugccacccuggg

SEQ ID NO: 2739823 - RNA, 23 nt, Human
ccaggccccugccacccugggga

SEQ ID NO: 2739824 - RNA, 14 nt, Human
ccaggccagaggga

SEQ ID NO: 2739825 - RNA, 21 nt, Human
ccaggccagagggagugacag

SEQ ID NO: 2739826 - RNA, 14 nt, Human
ccaggagcagccac

SEQ ID NO: 2739827 - RNA, 22 nt, Human
ccagcugugcucuggacaggca

SEQ ID NO: 2739828 - RNA, 23 nt, Human
ccagcugugcucuggacaggcau

SEQ ID NO: 2739829 - RNA, 14 nt, Human
ccaggaagccagca

SEQ ID NO: 2739830 - RNA, 15 nt, Human
ccaggaagccagcag

SEQ ID NO: 2739831 - RNA, 17 nt, Human
ccaggaagccagcaggc

SEQ ID NO: 2739832 - RNA, 19 nt, Human
ccaggaagccagcaggcuc

SEQ ID NO: 2739833 - RNA, 12 nt, Human
ccaggagcagcc

SEQ ID NO: 2739834 - RNA, 13 nt, Human
ccaggagcagcca

SEQ ID NO: 2739835 - RNA, 18 nt, Human
ccagcugugcucuggaca

SEQ ID NO: 2739836 - RNA, 20 nt, Human
ccagcugugcucuggacagg

SEQ ID NO: 2739837 - RNA, 21 nt, Human
ccagcugugcucuggacaggc

SEQ ID NO: 2739838 - RNA, 13 nt, Human
ccagcugcuuggg

SEQ ID NO: 2739839 - RNA, 15 nt, Human
ccagcugcuugggcu

SEQ ID NO: 2739840 - RNA, 16 nt, Human
ccagcugcuugggcuu

SEQ ID NO: 2739841 - RNA, 18 nt, Human
ccagcugcuugggcuuca

SEQ ID NO: 2739842 - RNA, 13 nt, Human
ccuaaacauauga

SEQ ID NO: 2739843 - RNA, 18 nt, Human
ccuaaauccauuuggaaa

SEQ ID NO: 2739844 - RNA, 19 nt, Human
ccuaaauccauuuggaaau

SEQ ID NO: 2739845 - RNA, 16 nt, Human
ccuaaaauucagugga

SEQ ID NO: 2739846 - RNA, 22 nt, Human
ccuacaguugaaaaacagcuga

SEQ ID NO: 2739847 - RNA, 19 nt, Human
ccuacagcuugaccgugag

SEQ ID NO: 2739848 - RNA, 21 nt, Human
ccuaaauccauuuggaaaucu

SEQ ID NO: 2739849 - RNA, 20 nt, Human
ccuaaauccauuuggaaauc

SEQ ID NO: 2739850 - RNA, 21 nt, Human
ccuagaaauuccccacccuga

SEQ ID NO: 2739851 - RNA, 13 nt, Human
ccuaggugacaga

SEQ ID NO: 2739852 - RNA, 13 nt, Human
ccuacccacccuc

SEQ ID NO: 2739853 - RNA, 18 nt, Human
ccuacccacccuccuuuc

SEQ ID NO: 2739854 - RNA, 19 nt, Human
ccuacuguaauuugugaua

SEQ ID NO: 2739855 - RNA, 12 nt, Human
ccguuauuaaaa

SEQ ID NO: 2739856 - RNA, 12 nt, Human
cccuucccaccu

SEQ ID NO: 2739857 - RNA, 13 nt, Human
cccuucccaccuc

SEQ ID NO: 2739858 - RNA, 17 nt, Human
cccuuggauuguccccg

SEQ ID NO: 2739859 - RNA, 20 nt, Human
cccuuguggucccaccccac

SEQ ID NO: 2739860 - RNA, 22 nt, Human
cccuuguggucccaccccacac

SEQ ID NO: 2739861 - RNA, 22 nt, Human
cccuugguuaggcauuguggga

SEQ ID NO: 2739862 - RNA, 23 nt, Human
cccuugguuaggcauugugggaa

SEQ ID NO: 2739863 - RNA, 17 nt, Human
ccgggaagggggcuggg

SEQ ID NO: 2739864 - RNA, 16 nt, Human
ccucagaucuucugug

SEQ ID NO: 2739865 - RNA, 23 nt, Human
ccucaggccugggggcugggcag

SEQ ID NO: 2739866 - RNA, 16 nt, Human
ccucagggucccuggu

SEQ ID NO: 2739867 - RNA, 17 nt, Human
ccucagggucccuggug

SEQ ID NO: 2739868 - RNA, 20 nt, Human
ccucagggucccugguggca

SEQ ID NO: 2739869 - RNA, 22 nt, Human
ccucagggucccugguggcagc

SEQ ID NO: 2739870 - RNA, 15 nt, Human
ccuaggugacagagu

SEQ ID NO: 2739871 - RNA, 16 nt, Human
ccuauuagagaagaga

SEQ ID NO: 2739872 - RNA, 17 nt, Human
ccuauuagagaagagau

SEQ ID NO: 2739873 - RNA, 23 nt, Human
ccucacaguccuuaccagcagag

SEQ ID NO: 2739874 - RNA, 24 nt, Human
ccucacaguccuuaccagcagagc

SEQ ID NO: 2739875 - RNA, 12 nt, Human
ccuccccuccuc

SEQ ID NO: 2739876 - RNA, 13 nt, Human
ccuccccuccucu

SEQ ID NO: 2739877 - RNA, 18 nt, Human
ccucccgaauagcuggga

SEQ ID NO: 2739878 - RNA, 15 nt, Human
ccucccaacucaccc

SEQ ID NO: 2739879 - RNA, 13 nt, Human
ccucccucuuucc

SEQ ID NO: 2739880 - RNA, 11 nt, Human
ccuccucagau

SEQ ID NO: 2739881 - RNA, 12 nt, Human
ccuccuccagcc

SEQ ID NO: 2739882 - RNA, 17 nt, Human
ccucccgaguagcuggg

SEQ ID NO: 2739883 - RNA, 18 nt, Human
ccucccgaguagcuggga

SEQ ID NO: 2739884 - RNA, 21 nt, Human
ccucccgaauagcugggacua

SEQ ID NO: 2739885 - RNA, 19 nt, Human
ccucccgaauagcugggac

SEQ ID NO: 2739886 - RNA, 20 nt, Human
ccucccgaauagcugggacu

SEQ ID NO: 2739887 - RNA, 12 nt, Human
ccuccauguggg

SEQ ID NO: 2739888 - RNA, 15 nt, Human
ccuccaugugggcua

SEQ ID NO: 2739889 - RNA, 17 nt, Human
ccucccaaagugcuggg

SEQ ID NO: 2739890 - RNA, 14 nt, Human
ccucccaacucacc

SEQ ID NO: 2739891 - RNA, 17 nt, Human
ccuccaggugcacaagc

SEQ ID NO: 2739892 - RNA, 11 nt, Human
ccuccaggugc

SEQ ID NO: 2739893 - RNA, 12 nt, Human
ccuccaggugca

SEQ ID NO: 2739894 - RNA, 17 nt, Human
ccucaggugagaagcag

SEQ ID NO: 2739895 - RNA, 18 nt, Human
ccucaggugagaagcaga

SEQ ID NO: 2739896 - RNA, 20 nt, Human
ccucaggugagaagcagagg

SEQ ID NO: 2739897 - RNA, 21 nt, Human
ccucugacacacagcucuguc

SEQ ID NO: 2739898 - RNA, 13 nt, Human
ccucugacacaca

SEQ ID NO: 2739899 - RNA, 14 nt, Human
ccucugacacacag

SEQ ID NO: 2739900 - RNA, 19 nt, Human
ccucugacacacagcucug

SEQ ID NO: 2739901 - RNA, 20 nt, Human
ccucugacacacagcucugu

SEQ ID NO: 2739902 - RNA, 15 nt, Human
ccucugcacuccccu

SEQ ID NO: 2739903 - RNA, 16 nt, Human
ccucugcacuccccug

SEQ ID NO: 2739904 - RNA, 17 nt, Human
ccucugcacuccccugc

SEQ ID NO: 2739905 - RNA, 19 nt, Human
ccucugcagcaauaaagca

SEQ ID NO: 2739906 - RNA, 13 nt, Human
ccucugcccacuc

SEQ ID NO: 2739907 - RNA, 16 nt, Human
ccucugcccacucccu

SEQ ID NO: 2739908 - RNA, 18 nt, Human
ccucugcagcaauaaagc

SEQ ID NO: 2739909 - RNA, 14 nt, Human
ccucugcagcaaua

SEQ ID NO: 2739910 - RNA, 23 nt, Human
ccucugcacuccccugcugggug

SEQ ID NO: 2739911 - RNA, 18 nt, Human
ccucugcacuccccugcu

SEQ ID NO: 2739912 - RNA, 21 nt, Human
ccuccuccagccgccaugcuc

SEQ ID NO: 2739913 - RNA, 15 nt, Human
ccucuccccagcaag

SEQ ID NO: 2739914 - RNA, 13 nt, Human
ccucucccuugga

SEQ ID NO: 2739915 - RNA, 22 nt, Human
ccucucccuuggauuguccccg

SEQ ID NO: 2739916 - RNA, 20 nt, Human
ccucuccccagcaagugaga

SEQ ID NO: 2739917 - RNA, 20 nt, Human
cccucccuccaccucccugc

SEQ ID NO: 2739918 - RNA, 13 nt, Human
cccucccucuuuc

SEQ ID NO: 2739919 - RNA, 13 nt, Human
cccucccuccacc

SEQ ID NO: 2739920 - RNA, 12 nt, Human
cccucccuccac

SEQ ID NO: 2739921 - RNA, 17 nt, Human
cccuccaugugggcuag

SEQ ID NO: 2739922 - RNA, 22 nt, Human
cccucauccucauacccacccc

SEQ ID NO: 2739923 - RNA, 21 nt, Human
cccuccaagaccuucuccuuc

SEQ ID NO: 2739924 - RNA, 20 nt, Human
cccucagucuggcccuuccu

SEQ ID NO: 2739925 - RNA, 21 nt, Human
cccucagggucccugguggca

SEQ ID NO: 2739926 - RNA, 22 nt, Human
cccucaucaccaacgucugugc

SEQ ID NO: 2739927 - RNA, 17 nt, Human
cccucauccucauaccc

SEQ ID NO: 2739928 - RNA, 20 nt, Human
cccucauccucauacccacc

SEQ ID NO: 2739929 - RNA, 15 nt, Human
cccucagggucccug

SEQ ID NO: 2739930 - RNA, 16 nt, Human
cccucagggucccugg

SEQ ID NO: 2739931 - RNA, 17 nt, Human
cccucagggucccuggu

SEQ ID NO: 2739932 - RNA, 18 nt, Human
cccucagggucccuggug

SEQ ID NO: 2739933 - RNA, 19 nt, Human
cccucagggucccuggugg

SEQ ID NO: 2739934 - RNA, 16 nt, Human
cccggcaggguccuag

SEQ ID NO: 2739935 - RNA, 22 nt, Human
cccuaaaguguauuuuuuuacu

SEQ ID NO: 2739936 - RNA, 17 nt, Human
cccuaaaguguauuuuu

SEQ ID NO: 2739937 - RNA, 14 nt, Human
ccccaggugccagu

SEQ ID NO: 2739938 - RNA, 22 nt, Human
ccccaggugguuauggagaggg

SEQ ID NO: 2739939 - RNA, 15 nt, Human
ccccuggcagccccu

SEQ ID NO: 2739940 - RNA, 12 nt, Human
ccccuggcagcc

SEQ ID NO: 2739941 - RNA, 14 nt, Human
ccccuggcagcccc

SEQ ID NO: 2739942 - RNA, 12 nt, Human
ccccaggaggcc

SEQ ID NO: 2739943 - RNA, 13 nt, Human
ccccagccugcua

SEQ ID NO: 2739944 - RNA, 15 nt, Human
ccccagccccauccu

SEQ ID NO: 2739945 - RNA, 16 nt, Human
ccccagccccauccca

SEQ ID NO: 2739946 - RNA, 22 nt, Human
ccccuguccccgcacugggcuu

SEQ ID NO: 2739947 - RNA, 20 nt, Human
ccccuguucuggcagaguug

SEQ ID NO: 2739948 - RNA, 22 nt, Human
cccgcuaagagggagggagggc

SEQ ID NO: 2739949 - RNA, 20 nt, Human
cccgaggccuucucugaagg

SEQ ID NO: 2739950 - RNA, 15 nt, Human
cccgaggccuucucu

SEQ ID NO: 2739951 - RNA, 14 nt, Human
cccugcaauaaaau

SEQ ID NO: 2739952 - RNA, 15 nt, Human
cccugcaauaaaaug

SEQ ID NO: 2739953 - RNA, 22 nt, Human
cccugcaaccugauugugucuc

SEQ ID NO: 2739954 - RNA, 16 nt, Human
cccugcaaccugauug

SEQ ID NO: 2739955 - RNA, 18 nt, Human
cccugcagagggcacaga

SEQ ID NO: 2739956 - RNA, 22 nt, Human
cccugcacuugcagacucuaca

SEQ ID NO: 2739957 - RNA, 12 nt, Human
cccugcagaggg

SEQ ID NO: 2739958 - RNA, 12 nt, Human
cccugccacccu

SEQ ID NO: 2739959 - RNA, 14 nt, Human
cccugccacccugg

SEQ ID NO: 2739960 - RNA, 15 nt, Human
cccugccacccuggg

SEQ ID NO: 2739961 - RNA, 17 nt, Human
cccugccacccugggga

SEQ ID NO: 2739962 - RNA, 18 nt, Human
cccugccacccuggggag

SEQ ID NO: 2739963 - RNA, 14 nt, Human
cccugccuccuuug

SEQ ID NO: 2739964 - RNA, 16 nt, Human
cccugccuccuuugug

SEQ ID NO: 2739965 - RNA, 23 nt, Human
cccugccuccuuugugaggaagc

SEQ ID NO: 2739966 - RNA, 19 nt, Human
cccugcugguucaggguug

SEQ ID NO: 2739967 - RNA, 20 nt, Human
cccugcugguucaggguugg

SEQ ID NO: 2739968 - RNA, 13 nt, Human
cccugcugguuca

SEQ ID NO: 2739969 - RNA, 22 nt, Human
cccugguggcagugggagcugc

SEQ ID NO: 2739970 - RNA, 14 nt, Human
cccugguggcagcu

SEQ ID NO: 2739971 - RNA, 16 nt, Human
cuaguaugaaauuaua

SEQ ID NO: 2739972 - RNA, 22 nt, Human
cuaguauuucuaugaaauauua

SEQ ID NO: 2739973 - RNA, 19 nt, Human
cuaguauuucuaugaaaua

SEQ ID NO: 2739974 - RNA, 20 nt, Human
cuaguauuucuaugaaauau

SEQ ID NO: 2739975 - RNA, 21 nt, Human
cuaggcauuugcugaauacag

SEQ ID NO: 2739976 - RNA, 19 nt, Human
cuagugugguguuuccugg

SEQ ID NO: 2739977 - RNA, 23 nt, Human
cuagugugguguuuccuggcacu

SEQ ID NO: 2739978 - RNA, 21 nt, Human
cuagugugguguuuccuggca

SEQ ID NO: 2739979 - RNA, 22 nt, Human
cuagugugguguuuccuggcac

SEQ ID NO: 2739980 - RNA, 22 nt, Human
cuaggaaauauuuauuuuaaua

SEQ ID NO: 2739981 - RNA, 21 nt, Human
cuaggaagacuuuggaaagag

SEQ ID NO: 2739982 - RNA, 13 nt, Human
cuaggaacacucc

SEQ ID NO: 2739983 - RNA, 15 nt, Human
cuaggaacacuccuu

SEQ ID NO: 2739984 - RNA, 22 nt, Human
cuaggaccccuccaugugggcu

SEQ ID NO: 2739985 - RNA, 22 nt, Human
cuaggacugaauuaugaaacuu

SEQ ID NO: 2739986 - RNA, 17 nt, Human
cuaggaggucucuaaga

SEQ ID NO: 2739987 - RNA, 19 nt, Human
cuauauuguuugcuaagca

SEQ ID NO: 2739988 - RNA, 22 nt, Human
cuauauuguuuucaguguacau

SEQ ID NO: 2739989 - RNA, 23 nt, Human
cuauauuguuuucaguguacaug

SEQ ID NO: 2739990 - RNA, 12 nt, Human
cuaguucacucu

SEQ ID NO: 2739991 - RNA, 13 nt, Human
cuaugaaauauua

SEQ ID NO: 2739992 - RNA, 18 nt, Human
cuaugaaauauuauguua

SEQ ID NO: 2739993 - RNA, 14 nt, Human
cuaugacacaugca

SEQ ID NO: 2739994 - RNA, 18 nt, Human
cuaugacauaaaaacaac

SEQ ID NO: 2739995 - RNA, 20 nt, Human
cuaucaaguauuauaccuuu

SEQ ID NO: 2739996 - RNA, 13 nt, Human
cucacauuuauau

SEQ ID NO: 2739997 - RNA, 19 nt, Human
cucaccagccccagugccc

SEQ ID NO: 2739998 - RNA, 20 nt, Human
cucaccagccccagugccca

SEQ ID NO: 2739999 - RNA, 21 nt, Human
cucaccagccccagugcccac

SEQ ID NO: 2740000 - RNA, 23 nt, Human
cucacaguccuuaccagcagagc

SEQ ID NO: 2740001 - RNA, 18 nt, Human
cucaagugauucuccugc

SEQ ID NO: 2740002 - RNA, 19 nt, Human
cucaagugauucuccugcc

SEQ ID NO: 2740003 - RNA, 20 nt, Human
cucaagugauucuccugccu

SEQ ID NO: 2740004 - RNA, 16 nt, Human
cucacuauguugccca

SEQ ID NO: 2740005 - RNA, 17 nt, Human
cucacuauguugcccag

SEQ ID NO: 2740006 - RNA, 14 nt, Human
cucaccccagcccc

SEQ ID NO: 2740007 - RNA, 12 nt, Human
cucaccccagcc

SEQ ID NO: 2740008 - RNA, 13 nt, Human
cucaccccagccc

SEQ ID NO: 2740009 - RNA, 14 nt, Human
cuaugcauuugaaa

SEQ ID NO: 2740010 - RNA, 20 nt, Human
cucaacucuccuccagaguc

SEQ ID NO: 2740011 - RNA, 21 nt, Human
cucaacucuccuccagaguca

SEQ ID NO: 2740012 - RNA, 19 nt, Human
cucaacucuccuccagagu

SEQ ID NO: 2740013 - RNA, 21 nt, Human
cuaugacauaaaaacaacuuu

SEQ ID NO: 2740014 - RNA, 12 nt, Human
cuaugcauuuga

SEQ ID NO: 2740015 - RNA, 11 nt, Human
cuaugcauuug

SEQ ID NO: 2740016 - RNA, 22 nt, Human
cuacuuauuguagcauccugga

SEQ ID NO: 2740017 - RNA, 13 nt, Human
cuacucuguguca

SEQ ID NO: 2740018 - RNA, 16 nt, Human
cuacucugugucaggu

SEQ ID NO: 2740019 - RNA, 21 nt, Human
cuacucugugucagguggggc

SEQ ID NO: 2740020 - RNA, 14 nt, Human
cuacccgggaaggg

SEQ ID NO: 2740021 - RNA, 15 nt, Human
cuacccgggaagggg

SEQ ID NO: 2740022 - RNA, 20 nt, Human
cuacccgggaagggggcugg

SEQ ID NO: 2740023 - RNA, 21 nt, Human
cuacccgggaagggggcuggg

SEQ ID NO: 2740024 - RNA, 14 nt, Human
cuacugaggugcua

SEQ ID NO: 2740025 - RNA, 17 nt, Human
cuacuguaauuugugau

SEQ ID NO: 2740026 - RNA, 16 nt, Human
cuacuguaauuuguga

SEQ ID NO: 2740027 - RNA, 17 nt, Human
cuagagugaacuugggc

SEQ ID NO: 2740028 - RNA, 21 nt, Human
cuagagugaacuugggccacu

SEQ ID NO: 2740029 - RNA, 20 nt, Human
cuagacgagcaggcuucuuc

SEQ ID NO: 2740030 - RNA, 21 nt, Human
cuagacgagcaggcuucuucc

SEQ ID NO: 2740031 - RNA, 17 nt, Human
cuagcacuuugggaggc

SEQ ID NO: 2740032 - RNA, 17 nt, Human
cuaaccagcagaaaugc

SEQ ID NO: 2740033 - RNA, 16 nt, Human
cuaaccagcagaaaug

SEQ ID NO: 2740034 - RNA, 17 nt, Human
cuaaccacgcuggaccu

SEQ ID NO: 2740035 - RNA, 22 nt, Human
cuaaggacuucuuuaauuuugg

SEQ ID NO: 2740036 - RNA, 15 nt, Human
cuaaggugugcucug

SEQ ID NO: 2740037 - RNA, 21 nt, Human
cuaagcuauucaguaauaacu

SEQ ID NO: 2740038 - RNA, 19 nt, Human
cuaagcuauucaguaauaa

SEQ ID NO: 2740039 - RNA, 11 nt, Human
cuaaggacuug

SEQ ID NO: 2740040 - RNA, 17 nt, Human
cuaaggacuuguuagau

SEQ ID NO: 2740041 - RNA, 16 nt, Human
cuaaggacuuguuaga

SEQ ID NO: 2740042 - RNA, 18 nt, Human
cuacacugugcugagucu

SEQ ID NO: 2740043 - RNA, 15 nt, Human
cuacacacugcaugu

SEQ ID NO: 2740044 - RNA, 13 nt, Human
cuacacacugcau

SEQ ID NO: 2740045 - RNA, 15 nt, Human
cuacagaggccaugg

SEQ ID NO: 2740046 - RNA, 20 nt, Human
cuacccagcgagcccuggug

SEQ ID NO: 2740047 - RNA, 19 nt, Human
cuacccagcgagcccuggu

SEQ ID NO: 2740048 - RNA, 17 nt, Human
cuacccacccuccuuuc

SEQ ID NO: 2740049 - RNA, 13 nt, Human
cuacccacccucc

SEQ ID NO: 2740050 - RNA, 22 nt, Human
cuacccacccuccuuucaccac

SEQ ID NO: 2740051 - RNA, 20 nt, Human
cuaauaaaauuuaaaagucu

SEQ ID NO: 2740052 - RNA, 16 nt, Human
cuaaggugugcucuga

SEQ ID NO: 2740053 - RNA, 21 nt, Human
cuaauaaaauuuaaaagucuu

SEQ ID NO: 2740054 - RNA, 19 nt, Human
cuaauguaauaacugugaa

SEQ ID NO: 2740055 - RNA, 14 nt, Human
cuaauguacugcau

SEQ ID NO: 2740056 - RNA, 16 nt, Human
cuaauguacugcauau

SEQ ID NO: 2740057 - RNA, 16 nt, Human
cuaaauguugaaagau

SEQ ID NO: 2740058 - RNA, 23 nt, Human
cuaaauuugaauguuaagcagau

SEQ ID NO: 2740059 - RNA, 15 nt, Human
cuaacauggaaguac

SEQ ID NO: 2740060 - RNA, 17 nt, Human
cuaacauggaaguacua

SEQ ID NO: 2740061 - RNA, 16 nt, Human
cuaaauccauuuggaa

SEQ ID NO: 2740062 - RNA, 20 nt, Human
cuaaauccauuuggaaaucu

SEQ ID NO: 2740063 - RNA, 19 nt, Human
cuaaauccauuuggaaauc

SEQ ID NO: 2740064 - RNA, 17 nt, Human
cuaaauccauuuggaaa

SEQ ID NO: 2740065 - RNA, 18 nt, Human
cuaaauggaaccacucua

SEQ ID NO: 2740066 - RNA, 17 nt, Human
cuaaauggaaccacucu

SEQ ID NO: 2740067 - RNA, 16 nt, Human
cuaaauggaaccacuc

SEQ ID NO: 2740068 - RNA, 15 nt, Human
cuaaauggaaccacu

SEQ ID NO: 2740069 - RNA, 20 nt, Human
cuaaaucuccaaaauaaaac

SEQ ID NO: 2740070 - RNA, 18 nt, Human
cgugcacacaccagagcc

SEQ ID NO: 2740071 - RNA, 19 nt, Human
cgugcacacaccagagccc

SEQ ID NO: 2740072 - RNA, 21 nt, Human
cgugcaguggugcgaucuggg

SEQ ID NO: 2740073 - RNA, 23 nt, Human
cgugcauaccacuuuuguucuug

SEQ ID NO: 2740074 - RNA, 16 nt, Human
cgugcacacaccagag

SEQ ID NO: 2740075 - RNA, 20 nt, Human
cgucugacaggcaaugcugg

SEQ ID NO: 2740076 - RNA, 21 nt, Human
cgucugacaggcaaugcuggc

SEQ ID NO: 2740077 - RNA, 22 nt, Human
cgucugacaggcaaugcuggcu

SEQ ID NO: 2740078 - RNA, 16 nt, Human
cgucucauacucaccu

SEQ ID NO: 2740079 - RNA, 16 nt, Human
cgucuaccugaggggc

SEQ ID NO: 2740080 - RNA, 18 nt, Human
cggugcuaucucccccag

SEQ ID NO: 2740081 - RNA, 20 nt, Human
cggugcuaucucccccagcc

SEQ ID NO: 2740082 - RNA, 21 nt, Human
cggugcuaucucccccagccc

SEQ ID NO: 2740083 - RNA, 22 nt, Human
cggugcuaucucccccagcccc

SEQ ID NO: 2740084 - RNA, 16 nt, Human
cgugcuaaggacuugu

SEQ ID NO: 2740085 - RNA, 15 nt, Human
cgugcuaaggacuug

SEQ ID NO: 2740086 - RNA, 14 nt, Human
cgugcuaaggacuu

SEQ ID NO: 2740087 - RNA, 13 nt, Human
cgugcuaaggacu

SEQ ID NO: 2740088 - RNA, 12 nt, Human
cgugcuaaggac

SEQ ID NO: 2740089 - RNA, 18 nt, Human
cguugaaauuguaauuau

SEQ ID NO: 2740090 - RNA, 23 nt, Human
cguugaaauuguaauuauaucug

SEQ ID NO: 2740091 - RNA, 22 nt, Human
cgcugucagccauuccuguucc

SEQ ID NO: 2740092 - RNA, 15 nt, Human
cgcugugcugcccug

SEQ ID NO: 2740093 - RNA, 16 nt, Human
cgcugugcugcccugc

SEQ ID NO: 2740094 - RNA, 17 nt, Human
cgcugugcugcccugcc

SEQ ID NO: 2740095 - RNA, 18 nt, Human
cgcugugcugcccugccc

SEQ ID NO: 2740096 - RNA, 20 nt, Human
cggaaaacaugcuacacacu

SEQ ID NO: 2740097 - RNA, 15 nt, Human
cggaaaacaugcuac

SEQ ID NO: 2740098 - RNA, 16 nt, Human
cgcuacccgggaaggg

SEQ ID NO: 2740099 - RNA, 22 nt, Human
cgcuaagagggagggagggcuc

SEQ ID NO: 2740100 - RNA, 22 nt, Human
cgccagauucuuuccugaggcu

SEQ ID NO: 2740101 - RNA, 20 nt, Human
ccucugcccacucccugcaa

SEQ ID NO: 2740102 - RNA, 17 nt, Human
ccucugcccacucccug

SEQ ID NO: 2740103 - RNA, 19 nt, Human
ccucugcccacucccugca

SEQ ID NO: 2740104 - RNA, 23 nt, Human
cgccaggggaaaaucagccugcu

SEQ ID NO: 2740105 - RNA, 14 nt, Human
cgccaucccagccc

SEQ ID NO: 2740106 - RNA, 16 nt, Human
cgccaucccagcccca

SEQ ID NO: 2740107 - RNA, 22 nt, Human
cgcccaggcuuagucacugaga

SEQ ID NO: 2740108 - RNA, 13 nt, Human
cggccccugcugg

SEQ ID NO: 2740109 - RNA, 18 nt, Human
cggccccugcugguucag

SEQ ID NO: 2740110 - RNA, 19 nt, Human
cggccccugcugguucagg

SEQ ID NO: 2740111 - RNA, 24 nt, Human
cggccaggccagagggagugacag

SEQ ID NO: 2740112 - RNA, 11 nt, Human
cggccaccugc

SEQ ID NO: 2740113 - RNA, 15 nt, Human
cggccaccugcggug

SEQ ID NO: 2740114 - RNA, 16 nt, Human
cggccaccugcggugc

SEQ ID NO: 2740115 - RNA, 17 nt, Human
cggccaccugcggugcu

SEQ ID NO: 2740116 - RNA, 13 nt, Human
cggaagagccuug

SEQ ID NO: 2740117 - RNA, 21 nt, Human
cggguuuuauuguuuaaaauc

SEQ ID NO: 2740118 - RNA, 14 nt, Human
cgguccacccagga

SEQ ID NO: 2740119 - RNA, 15 nt, Human
cgguccacccaggag

SEQ ID NO: 2740120 - RNA, 16 nt, Human
cgguccacccaggagc

SEQ ID NO: 2740121 - RNA, 20 nt, Human
cgguccacccaggagccccg

SEQ ID NO: 2740122 - RNA, 22 nt, Human
cggucggguuuuauuguuuaaa

SEQ ID NO: 2740123 - RNA, 16 nt, Human
cggugaauggcuuugu

SEQ ID NO: 2740124 - RNA, 15 nt, Human
cggugaauggcuuug

SEQ ID NO: 2740125 - RNA, 14 nt, Human
cggugaauggcuuu

SEQ ID NO: 2740126 - RNA, 13 nt, Human
cggugaauggcuu

SEQ ID NO: 2740127 - RNA, 17 nt, Human
cggugagcuacaaaugc

SEQ ID NO: 2740128 - RNA, 22 nt, Human
cggugaauggcuuuguauagaa

SEQ ID NO: 2740129 - RNA, 20 nt, Human
cggugaauggcuuuguauag

SEQ ID NO: 2740130 - RNA, 18 nt, Human
cggugaauggcuuuguau

SEQ ID NO: 2740131 - RNA, 20 nt, Human
cggugagaggggaacagacu

SEQ ID NO: 2740132 - RNA, 21 nt, Human
cggugagaggggaacagacug

SEQ ID NO: 2740133 - RNA, 23 nt, Human
cggggacagcuccuucuguccua

SEQ ID NO: 2740134 - RNA, 15 nt, Human
cgggggcagagaggg

SEQ ID NO: 2740135 - RNA, 18 nt, Human
cgggaggucgaggcagga

SEQ ID NO: 2740136 - RNA, 20 nt, Human
cgggaggucgaggcaggagg

SEQ ID NO: 2740137 - RNA, 22 nt, Human
cggggacagcuccuucuguccu

SEQ ID NO: 2740138 - RNA, 14 nt, Human
cgggcacucagaag

SEQ ID NO: 2740139 - RNA, 22 nt, Human
cgggcacucagaagacacugau

SEQ ID NO: 2740140 - RNA, 23 nt, Human
cggcuggccuggccccucagggu

SEQ ID NO: 2740141 - RNA, 22 nt, Human
cggcuggccuggccccucaggg

SEQ ID NO: 2740142 - RNA, 19 nt, Human
cggcuggccuggccccuca

SEQ ID NO: 2740143 - RNA, 20 nt, Human
cucuccugggcagcugccuc

SEQ ID NO: 2740144 - RNA, 15 nt, Human
cucuccugggcagcu

SEQ ID NO: 2740145 - RNA, 16 nt, Human
cucuccugggcagcug

SEQ ID NO: 2740146 - RNA, 18 nt, Human
cucuccugggcagcugcc

SEQ ID NO: 2740147 - RNA, 19 nt, Human
cucuccugggcagcugccu

SEQ ID NO: 2740148 - RNA, 12 nt, Human
cucuccugggca

SEQ ID NO: 2740149 - RNA, 13 nt, Human
cucucucaggcca

SEQ ID NO: 2740150 - RNA, 12 nt, Human
cucucucacucc

SEQ ID NO: 2740151 - RNA, 13 nt, Human
cucuccccagcaa

SEQ ID NO: 2740152 - RNA, 19 nt, Human
cucuccagccccuggaugc

SEQ ID NO: 2740153 - RNA, 14 nt, Human
cucuccccagcaag

SEQ ID NO: 2740154 - RNA, 22 nt, Human
cucuccccagcaagugagagcu

SEQ ID NO: 2740155 - RNA, 24 nt, Human
cucuccccagcaagugagagcugg

SEQ ID NO: 2740156 - RNA, 12 nt, Human
cucuccucugcu

SEQ ID NO: 2740157 - RNA, 21 nt, Human
cucuccugauagucuuucagu

SEQ ID NO: 2740158 - RNA, 13 nt, Human
cucuccucugcug

SEQ ID NO: 2740159 - RNA, 14 nt, Human
cucuccucugcugc

SEQ ID NO: 2740160 - RNA, 15 nt, Human
cucuccucugcugcu

SEQ ID NO: 2740161 - RNA, 18 nt, Human
cucuccucugcugcuggc

SEQ ID NO: 2740162 - RNA, 21 nt, Human
cucuaguuugauuaaauucuu

SEQ ID NO: 2740163 - RNA, 20 nt, Human
cucuaguuugauuaaauucu

SEQ ID NO: 2740164 - RNA, 19 nt, Human
cucuaguuugauuaaauuc

SEQ ID NO: 2740165 - RNA, 15 nt, Human
cucuaguuugauuaa

SEQ ID NO: 2740166 - RNA, 12 nt, Human
cucucaggccaa

SEQ ID NO: 2740167 - RNA, 20 nt, Human
cucucaggccaaacucaccu

SEQ ID NO: 2740168 - RNA, 21 nt, Human
cucucaggccaaacucaccug

SEQ ID NO: 2740169 - RNA, 22 nt, Human
cucucaggccaaacucaccugc

SEQ ID NO: 2740170 - RNA, 23 nt, Human
cucucaggccaaacucaccugcc

SEQ ID NO: 2740171 - RNA, 13 nt, Human
cucucaggccagc

SEQ ID NO: 2740172 - RNA, 15 nt, Human
cucucaggccagcug

SEQ ID NO: 2740173 - RNA, 14 nt, Human
cucuccagccccug

SEQ ID NO: 2740174 - RNA, 15 nt, Human
cucuccagccccugg

SEQ ID NO: 2740175 - RNA, 16 nt, Human
cucuccagccccugga

SEQ ID NO: 2740176 - RNA, 17 nt, Human
cucuccagccccuggau

SEQ ID NO: 2740177 - RNA, 18 nt, Human
cucuccagccccuggaug

SEQ ID NO: 2740178 - RNA, 17 nt, Human
cucucaggccagcugcu

SEQ ID NO: 2740179 - RNA, 18 nt, Human
cucucaggccagcugcuu

SEQ ID NO: 2740180 - RNA, 19 nt, Human
cucucaggccagcugcuug

SEQ ID NO: 2740181 - RNA, 21 nt, Human
cucucaggccagcugcuuggg

SEQ ID NO: 2740182 - RNA, 15 nt, Human
cucuaggaaauauuu

SEQ ID NO: 2740183 - RNA, 17 nt, Human
cucuaggaaauauuuau

SEQ ID NO: 2740184 - RNA, 23 nt, Human
cucuagggaaaaaccagcgugug

SEQ ID NO: 2740185 - RNA, 20 nt, Human
cucuaccauccccuguagag

SEQ ID NO: 2740186 - RNA, 13 nt, Human
cucuacccuggca

SEQ ID NO: 2740187 - RNA, 13 nt, Human
cuccuucaccuuu

SEQ ID NO: 2740188 - RNA, 19 nt, Human
cuccuucacagaugggugc

SEQ ID NO: 2740189 - RNA, 20 nt, Human
cuccugugugugcgccuaca

SEQ ID NO: 2740190 - RNA, 14 nt, Human
cuccugugugugcg

SEQ ID NO: 2740191 - RNA, 16 nt, Human
cuccuucacagauggg

SEQ ID NO: 2740192 - RNA, 17 nt, Human
cuccuucacagaugggu

SEQ ID NO: 2740193 - RNA, 13 nt, Human
cucuacaaaaagc

SEQ ID NO: 2740194 - RNA, 13 nt, Human
cucuacagaggcc

SEQ ID NO: 2740195 - RNA, 19 nt, Human
cucuacagaggccaugggc

SEQ ID NO: 2740196 - RNA, 14 nt, Human
cucuacagaggcca

SEQ ID NO: 2740197 - RNA, 16 nt, Human
cucuacagaggccaug

SEQ ID NO: 2740198 - RNA, 15 nt, Human
cucccuccaccuccc

SEQ ID NO: 2740199 - RNA, 17 nt, Human
cucccuccaccucccug

SEQ ID NO: 2740200 - RNA, 17 nt, Human
cucccuuucuucccuac

SEQ ID NO: 2740201 - RNA, 18 nt, Human
cucccucagucuggcccu

SEQ ID NO: 2740202 - RNA, 15 nt, Human
cuccgaccagacacc

SEQ ID NO: 2740203 - RNA, 22 nt, Human
cuccucuccccagcaagugaga

SEQ ID NO: 2740204 - RNA, 22 nt, Human
cuccuccagccgccaugcuccu

SEQ ID NO: 2740205 - RNA, 18 nt, Human
cuccugcaggcagccagg

SEQ ID NO: 2740206 - RNA, 20 nt, Human
cuccugcaggcagccaggcc

SEQ ID NO: 2740207 - RNA, 11 nt, Human
cuccugcccuu

SEQ ID NO: 2740208 - RNA, 13 nt, Human
cuccugccucagc

SEQ ID NO: 2740209 - RNA, 14 nt, Human
cuccugccucagcc

SEQ ID NO: 2740210 - RNA, 11 nt, Human
cuccugcaggc

SEQ ID NO: 2740211 - RNA, 16 nt, Human
cuccugcaggcagcca

SEQ ID NO: 2740212 - RNA, 17 nt, Human
cuccugcaggcagccag

SEQ ID NO: 2740213 - RNA, 16 nt, Human
cuccugugugugcgcc

SEQ ID NO: 2740214 - RNA, 19 nt, Human
cuccugugugugcgccuac

SEQ ID NO: 2740215 - RNA, 15 nt, Human
cuccugccucagccu

SEQ ID NO: 2740216 - RNA, 18 nt, Human
cucacuauguugcccagg

SEQ ID NO: 2740217 - RNA, 17 nt, Human
cucccaaagugcuggga

SEQ ID NO: 2740218 - RNA, 13 nt, Human
cuccaugugggcu

SEQ ID NO: 2740219 - RNA, 22 nt, Human
cucccaacucaccccagcccca

SEQ ID NO: 2740220 - RNA, 18 nt, Human
cucccaaagugcugggau

SEQ ID NO: 2740221 - RNA, 16 nt, Human
cucccaacucacccca

SEQ ID NO: 2740222 - RNA, 17 nt, Human
cucccaacucaccccag

SEQ ID NO: 2740223 - RNA, 21 nt, Human
cucccaucucacacaugagca

SEQ ID NO: 2740224 - RNA, 11 nt, Human
cucccaucugu

SEQ ID NO: 2740225 - RNA, 14 nt, Human
cucccaucugugaa

SEQ ID NO: 2740226 - RNA, 15 nt, Human
cucccaucugugaaa

SEQ ID NO: 2740227 - RNA, 18 nt, Human
cucccaucugugaaagga

SEQ ID NO: 2740228 - RNA, 23 nt, Human
cucccaucugugaaaggaaagag

SEQ ID NO: 2740229 - RNA, 17 nt, Human
cucccgaauagcuggga

SEQ ID NO: 2740230 - RNA, 16 nt, Human
cucccgaauagcuggg

SEQ ID NO: 2740231 - RNA, 13 nt, Human
cuccccugcuggg

SEQ ID NO: 2740232 - RNA, 15 nt, Human
cucccgaguagcugg

SEQ ID NO: 2740233 - RNA, 18 nt, Human
cucccgaauagcugggac

SEQ ID NO: 2740234 - RNA, 16 nt, Human
cucccgaguagcuggg

SEQ ID NO: 2740235 - RNA, 17 nt, Human
cucccgaguagcuggga

SEQ ID NO: 2740236 - RNA, 12 nt, Human
cuccccagcaag

SEQ ID NO: 2740237 - RNA, 20 nt, Human
cuccccagccccaucccaaa

SEQ ID NO: 2740238 - RNA, 20 nt, Human
cuccccagcaagugagagcu

SEQ ID NO: 2740239 - RNA, 12 nt, Human
cuccccugcugg

SEQ ID NO: 2740240 - RNA, 15 nt, Human
cugagccagauuuca

SEQ ID NO: 2740241 - RNA, 16 nt, Human
cugagacagcccgggc

SEQ ID NO: 2740242 - RNA, 17 nt, Human
cugagacagcccgggcu

SEQ ID NO: 2740243 - RNA, 18 nt, Human
cugagacagcccgggcuc

SEQ ID NO: 2740244 - RNA, 17 nt, Human
cugagccagauuucacu

SEQ ID NO: 2740245 - RNA, 18 nt, Human
cugagccagauuucacuc

SEQ ID NO: 2740246 - RNA, 19 nt, Human
cugagccagauuucacucu

SEQ ID NO: 2740247 - RNA, 20 nt, Human
cugagccagauuucacucuc

SEQ ID NO: 2740248 - RNA, 21 nt, Human
cugagccagauuucacucucc

SEQ ID NO: 2740249 - RNA, 12 nt, Human
cugaggcccaga

SEQ ID NO: 2740250 - RNA, 13 nt, Human
cugaggcccagag

SEQ ID NO: 2740251 - RNA, 14 nt, Human
cugaggcccagagg

SEQ ID NO: 2740252 - RNA, 15 nt, Human
cugaggcccagaggg

SEQ ID NO: 2740253 - RNA, 16 nt, Human
cugaggcccagagggc

SEQ ID NO: 2740254 - RNA, 17 nt, Human
cugaggcccagagggcc

SEQ ID NO: 2740255 - RNA, 18 nt, Human
cugaggcccagagggccu

SEQ ID NO: 2740256 - RNA, 19 nt, Human
cugaggcccagagggccug

SEQ ID NO: 2740257 - RNA, 21 nt, Human
cugaggcccagagggccugca

SEQ ID NO: 2740258 - RNA, 23 nt, Human
cugaggcccagagggccugcaag

SEQ ID NO: 2740259 - RNA, 14 nt, Human
cugaggcccuucuc

SEQ ID NO: 2740260 - RNA, 15 nt, Human
cugaggcccuucucu

SEQ ID NO: 2740261 - RNA, 18 nt, Human
cugaggcccuucucucca

SEQ ID NO: 2740262 - RNA, 19 nt, Human
cugaggcccuucucuccag

SEQ ID NO: 2740263 - RNA, 20 nt, Human
cugaggcccuucucuccagc

SEQ ID NO: 2740264 - RNA, 23 nt, Human
cugagaaagacuauucaaacagu

SEQ ID NO: 2740265 - RNA, 22 nt, Human
cugagaaagacuauucaaacag

SEQ ID NO: 2740266 - RNA, 14 nt, Human
cugagacagcccgg

SEQ ID NO: 2740267 - RNA, 15 nt, Human
cugagacagcccggg

SEQ ID NO: 2740268 - RNA, 15 nt, Human
cugacuucuaaguaa

SEQ ID NO: 2740269 - RNA, 13 nt, Human
cugacuucuaagu

SEQ ID NO: 2740270 - RNA, 18 nt, Human
cugacuguuuucucuuga

SEQ ID NO: 2740271 - RNA, 16 nt, Human
cugacuucuaaguaaa

SEQ ID NO: 2740272 - RNA, 17 nt, Human
cugacucuuaagaagac

SEQ ID NO: 2740273 - RNA, 16 nt, Human
cugacuguuuucucuu

SEQ ID NO: 2740274 - RNA, 15 nt, Human
cugacuaugacauaa

SEQ ID NO: 2740275 - RNA, 22 nt, Human
cugacauuguuggccaaagcca

SEQ ID NO: 2740276 - RNA, 12 nt, Human
cugacccacugc

SEQ ID NO: 2740277 - RNA, 16 nt, Human
cugacccaugcugccc

SEQ ID NO: 2740278 - RNA, 14 nt, Human
cugacccaugcugc

SEQ ID NO: 2740279 - RNA, 15 nt, Human
cugacccaugcugcc

SEQ ID NO: 2740280 - RNA, 13 nt, Human
cugacccaugcug

SEQ ID NO: 2740281 - RNA, 13 nt, Human
cugacccacugcu

SEQ ID NO: 2740282 - RNA, 14 nt, Human
cugacccacugcuu

SEQ ID NO: 2740283 - RNA, 11 nt, Human
cugacagauuu

SEQ ID NO: 2740284 - RNA, 15 nt, Human
cugacagauuuccau

SEQ ID NO: 2740285 - RNA, 21 nt, Human
cugacauuguuggccaaagcc

SEQ ID NO: 2740286 - RNA, 21 nt, Human
cugacaggcaaugcuggcugu

SEQ ID NO: 2740287 - RNA, 15 nt, Human
cucuggcagcucaga

SEQ ID NO: 2740288 - RNA, 16 nt, Human
cucuggcagcucagag

SEQ ID NO: 2740289 - RNA, 12 nt, Human
cucuggcagcuc

SEQ ID NO: 2740290 - RNA, 14 nt, Human
cucuggcagcucag

SEQ ID NO: 2740291 - RNA, 14 nt, Human
cucuggacaggcau

SEQ ID NO: 2740292 - RNA, 16 nt, Human
cucuggacaggcaugu

SEQ ID NO: 2740293 - RNA, 22 nt, Human
cucuggacaggcauguucucug

SEQ ID NO: 2740294 - RNA, 12 nt, Human
cucugcuugcca

SEQ ID NO: 2740295 - RNA, 14 nt, Human
cucugcuugccauc

SEQ ID NO: 2740296 - RNA, 17 nt, Human
cucugcuugccaucccu

SEQ ID NO: 2740297 - RNA, 20 nt, Human
cucugcuugccaucccuccc

SEQ ID NO: 2740298 - RNA, 15 nt, Human
cucuggacaggcaug

SEQ ID NO: 2740299 - RNA, 13 nt, Human
cucucuccucccu

SEQ ID NO: 2740300 - RNA, 22 nt, Human
cucugccugaagucacacagug

SEQ ID NO: 2740301 - RNA, 21 nt, Human
cucugccugaagucacacagu

SEQ ID NO: 2740302 - RNA, 13 nt, Human
cucuuccaggcug

SEQ ID NO: 2740303 - RNA, 14 nt, Human
cucuuccaggcugg

SEQ ID NO: 2740304 - RNA, 15 nt, Human
cucuuccaggcuggg

SEQ ID NO: 2740305 - RNA, 13 nt, Human
cucuuagaaaaac

SEQ ID NO: 2740306 - RNA, 15 nt, Human
cucuuagaaaaacca

SEQ ID NO: 2740307 - RNA, 15 nt, Human
cucugugucaggugg

SEQ ID NO: 2740308 - RNA, 22 nt, Human
cucuucuuuaaagggauggcaa

SEQ ID NO: 2740309 - RNA, 22 nt, Human
cucuugaaauauaggaacuuaa

SEQ ID NO: 2740310 - RNA, 21 nt, Human
cucuuggguucaagcgauucu

SEQ ID NO: 2740311 - RNA, 19 nt, Human
cucuuggguucaagcgauu

SEQ ID NO: 2740312 - RNA, 18 nt, Human
cucuuuaaugucacaggc

SEQ ID NO: 2740313 - RNA, 13 nt, Human
cucuugguccugc

SEQ ID NO: 2740314 - RNA, 15 nt, Human
cucuugguccugcug

SEQ ID NO: 2740315 - RNA, 16 nt, Human
cucuugguccugcugc

SEQ ID NO: 2740316 - RNA, 17 nt, Human
cucuugguccugcugca

SEQ ID NO: 2740317 - RNA, 20 nt, Human
cucuuuaaugucacaggcag

SEQ ID NO: 2740318 - RNA, 21 nt, Human
cucuuuaaugucacaggcagg

SEQ ID NO: 2740319 - RNA, 22 nt, Human
cucuuuaaugucacaggcaggu

SEQ ID NO: 2740320 - RNA, 23 nt, Human
cucuuuaaugucacaggcagguc

SEQ ID NO: 2740321 - RNA, 17 nt, Human
cucuuucccucccuucc

SEQ ID NO: 2740322 - RNA, 13 nt, Human
cucuuucccuccc

SEQ ID NO: 2740323 - RNA, 23 nt, Human
cugaagaagcaccaaucaugaau

SEQ ID NO: 2740324 - RNA, 19 nt, Human
cugaagaauugaaaaacca

SEQ ID NO: 2740325 - RNA, 13 nt, Human
cugaaauuuccug

SEQ ID NO: 2740326 - RNA, 23 nt, Human
cugaaauuuccugggagcuuuug

SEQ ID NO: 2740327 - RNA, 16 nt, Human
cugaaauuuccuggga

SEQ ID NO: 2740328 - RNA, 16 nt, Human
cugaaagcccugagcu

SEQ ID NO: 2740329 - RNA, 17 nt, Human
cugaaagcccugagcuu

SEQ ID NO: 2740330 - RNA, 18 nt, Human
cugaaagcccugagcuuu

SEQ ID NO: 2740331 - RNA, 19 nt, Human
cugaaagcccugagcuuuc

SEQ ID NO: 2740332 - RNA, 23 nt, Human
cugaaagcccugagcuuucugcu

SEQ ID NO: 2740333 - RNA, 21 nt, Human
cugaaauaaacgucuuaaaua

SEQ ID NO: 2740334 - RNA, 15 nt, Human
cugaaagcccugagc

SEQ ID NO: 2740335 - RNA, 12 nt, Human
cugcccucuccu

SEQ ID NO: 2740336 - RNA, 13 nt, Human
cugcccucuccug

SEQ ID NO: 2740337 - RNA, 14 nt, Human
cugcccucuccugg

SEQ ID NO: 2740338 - RNA, 20 nt, Human
cugcccugcccaccuggccu

SEQ ID NO: 2740339 - RNA, 17 nt, Human
cugcccugcccaccugg

SEQ ID NO: 2740340 - RNA, 15 nt, Human
cugcccucuccuggg

SEQ ID NO: 2740341 - RNA, 21 nt, Human
cugcccugcccaccuggccuc

SEQ ID NO: 2740342 - RNA, 18 nt, Human
cugccugaagucacacag

SEQ ID NO: 2740343 - RNA, 16 nt, Human
cugccugaagucacac

SEQ ID NO: 2740344 - RNA, 19 nt, Human
cugccugaagucacacagu

SEQ ID NO: 2740345 - RNA, 23 nt, Human
cugcgguccacccaggagccccg

SEQ ID NO: 2740346 - RNA, 18 nt, Human
cugcggugcuaucucccc

SEQ ID NO: 2740347 - RNA, 19 nt, Human
cugcggugcuaucuccccc

SEQ ID NO: 2740348 - RNA, 12 nt, Human
cugcucugguua

SEQ ID NO: 2740349 - RNA, 15 nt, Human
cugcugcaguugcca

SEQ ID NO: 2740350 - RNA, 14 nt, Human
cugcugcaguugcc

SEQ ID NO: 2740351 - RNA, 10 nt, Human
cugcugcagu

SEQ ID NO: 2740352 - RNA, 13 nt, Human
cugcugcaguugc

SEQ ID NO: 2740353 - RNA, 20 nt, Human
cugcggugcuaucuccccca

SEQ ID NO: 2740354 - RNA, 21 nt, Human
cugcggugcuaucucccccag

SEQ ID NO: 2740355 - RNA, 22 nt, Human
cugcggugcuaucucccccagc

SEQ ID NO: 2740356 - RNA, 23 nt, Human
cugcggugcuaucucccccagcc

SEQ ID NO: 2740357 - RNA, 15 nt, Human
cugcucuccgaccag

SEQ ID NO: 2740358 - RNA, 23 nt, Human
cugcuccucuccccagcaaguga

SEQ ID NO: 2740359 - RNA, 19 nt, Human
cugcuccucuccccagcaa

SEQ ID NO: 2740360 - RNA, 20 nt, Human
cugcuccucuccccagcaag

SEQ ID NO: 2740361 - RNA, 18 nt, Human
cugcuugccaucccuccc

SEQ ID NO: 2740362 - RNA, 19 nt, Human
cugcuugccaucccucccu

SEQ ID NO: 2740363 - RNA, 20 nt, Human
cugcuugccaucccucccuc

SEQ ID NO: 2740364 - RNA, 22 nt, Human
cugcuugccaucccucccucca

SEQ ID NO: 2740365 - RNA, 20 nt, Human
cugcuugcuugcuuuuuaau

SEQ ID NO: 2740366 - RNA, 16 nt, Human
cugcuugccaucccuc

SEQ ID NO: 2740367 - RNA, 15 nt, Human
cugcuugccaucccu

SEQ ID NO: 2740368 - RNA, 22 nt, Human
cugcuugaggcaacucaucuua

SEQ ID NO: 2740369 - RNA, 19 nt, Human
cugcuugugaaaggaaaga

SEQ ID NO: 2740370 - RNA, 19 nt, Human
cugcuugggcuucauccuc

SEQ ID NO: 2740371 - RNA, 13 nt, Human
cugcuugggcuuc

SEQ ID NO: 2740372 - RNA, 15 nt, Human
cugcuugggcuucau

SEQ ID NO: 2740373 - RNA, 17 nt, Human
cugcuugggcuucaucc

SEQ ID NO: 2740374 - RNA, 18 nt, Human
cugcuugggcuucauccu

SEQ ID NO: 2740375 - RNA, 15 nt, Human
cugcuuucagauacu

SEQ ID NO: 2740376 - RNA, 12 nt, Human
cugcuuucagau

SEQ ID NO: 2740377 - RNA, 15 nt, Human
cugcuuuuggucugu

SEQ ID NO: 2740378 - RNA, 17 nt, Human
cugcuuuuggucugugu

SEQ ID NO: 2740379 - RNA, 12 nt, Human
cugcugcuggcu

SEQ ID NO: 2740380 - RNA, 13 nt, Human
cugcugcuggcug

SEQ ID NO: 2740381 - RNA, 14 nt, Human
cugcuggguguggc

SEQ ID NO: 2740382 - RNA, 15 nt, Human
cugcuggguguggcg

SEQ ID NO: 2740383 - RNA, 17 nt, Human
cugcuggguguggcgca

SEQ ID NO: 2740384 - RNA, 13 nt, Human
cugcuugaggcaa

SEQ ID NO: 2740385 - RNA, 20 nt, Human
cugcuugaggcaacucaucu

SEQ ID NO: 2740386 - RNA, 21 nt, Human
cugcuugaggcaacucaucuu

SEQ ID NO: 2740387 - RNA, 12 nt, Human
cugcacugucaa

SEQ ID NO: 2740388 - RNA, 18 nt, Human
cugcacuccccugcuggg

SEQ ID NO: 2740389 - RNA, 21 nt, Human
cugcacuccccugcugggugu

SEQ ID NO: 2740390 - RNA, 13 nt, Human
cugcagagggcac

SEQ ID NO: 2740391 - RNA, 16 nt, Human
cugcagcaauaaagca

SEQ ID NO: 2740392 - RNA, 15 nt, Human
cugcagcaauaaagc

SEQ ID NO: 2740393 - RNA, 10 nt, Human
cugcagaggg

SEQ ID NO: 2740394 - RNA, 20 nt, Human
cugcacuccagccuggguga

SEQ ID NO: 2740395 - RNA, 18 nt, Human
cugcaccgggccacagag

SEQ ID NO: 2740396 - RNA, 13 nt, Human
cugcacuccccug

SEQ ID NO: 2740397 - RNA, 19 nt, Human
cugcacuccccugcugggu

SEQ ID NO: 2740398 - RNA, 20 nt, Human
cugcacuccccugcugggug

SEQ ID NO: 2740399 - RNA, 14 nt, Human
cugcaccgggccac

SEQ ID NO: 2740400 - RNA, 15 nt, Human
cugcaccgggccaca

SEQ ID NO: 2740401 - RNA, 15 nt, Human
cugcaccggcuggcc

SEQ ID NO: 2740402 - RNA, 16 nt, Human
cugcaccggcuggccu

SEQ ID NO: 2740403 - RNA, 22 nt, Human
cugaggcccuucucuccagccc

SEQ ID NO: 2740404 - RNA, 23 nt, Human
cugaggcccuucucuccagcccc

SEQ ID NO: 2740405 - RNA, 14 nt, Human
cugcaccggcuggc

SEQ ID NO: 2740406 - RNA, 13 nt, Human
cugcaguugccag

SEQ ID NO: 2740407 - RNA, 16 nt, Human
cugcaguugccaguca

SEQ ID NO: 2740408 - RNA, 17 nt, Human
cugcagcaauaaagcag

SEQ ID NO: 2740409 - RNA, 15 nt, Human
cugccagcaacgcag

SEQ ID NO: 2740410 - RNA, 13 nt, Human
cugccaggaagcc

SEQ ID NO: 2740411 - RNA, 14 nt, Human
cugccaggaagcca

SEQ ID NO: 2740412 - RNA, 20 nt, Human
cugccaggaagccagcaggc

SEQ ID NO: 2740413 - RNA, 21 nt, Human
cugccaggaagccagcaggcu

SEQ ID NO: 2740414 - RNA, 15 nt, Human
cugccauccucccaa

SEQ ID NO: 2740415 - RNA, 21 nt, Human
cugccauccagguucagcuug

SEQ ID NO: 2740416 - RNA, 22 nt, Human
cugccaggaagccagcaggcuc

SEQ ID NO: 2740417 - RNA, 21 nt, Human
cugccacccuggggagaaagu

SEQ ID NO: 2740418 - RNA, 12 nt, Human
cugccacccugg

SEQ ID NO: 2740419 - RNA, 15 nt, Human
cugcauaugaaagga

SEQ ID NO: 2740420 - RNA, 20 nt, Human
cugcaucaagaugugacaug

SEQ ID NO: 2740421 - RNA, 16 nt, Human
cugcccaggccccugc

SEQ ID NO: 2740422 - RNA, 18 nt, Human
cugcccaggccccugcca

SEQ ID NO: 2740423 - RNA, 19 nt, Human
cugcccaggccccugccac

SEQ ID NO: 2740424 - RNA, 20 nt, Human
cugcccaggccccugccacc

SEQ ID NO: 2740425 - RNA, 12 nt, Human
cugcccaccugg

SEQ ID NO: 2740426 - RNA, 14 nt, Human
cugcccaggccccu

SEQ ID NO: 2740427 - RNA, 15 nt, Human
cugcccaggccccug

SEQ ID NO: 2740428 - RNA, 15 nt, Human
cugccauuucugaga

SEQ ID NO: 2740429 - RNA, 13 nt, Human
cugcccggcaggg

SEQ ID NO: 2740430 - RNA, 20 nt, Human
cugcccggcaggguccuaga

SEQ ID NO: 2740431 - RNA, 19 nt, Human
cugccccuggcagccccug

SEQ ID NO: 2740432 - RNA, 18 nt, Human
cugccccuggcagccccu

SEQ ID NO: 2740433 - RNA, 17 nt, Human
cugggagagccuuccag

SEQ ID NO: 2740434 - RNA, 18 nt, Human
cugggagagccuuccagg

SEQ ID NO: 2740435 - RNA, 21 nt, Human
cugggagagccuuccaggggu

SEQ ID NO: 2740436 - RNA, 19 nt, Human
cugggagagccuuccaggg

SEQ ID NO: 2740437 - RNA, 20 nt, Human
cugggagagccuuccagggg

SEQ ID NO: 2740438 - RNA, 18 nt, Human
cuggcuguuggcuggggg

SEQ ID NO: 2740439 - RNA, 16 nt, Human
cuggcuguuggcuggg

SEQ ID NO: 2740440 - RNA, 17 nt, Human
cuggcuguuggcugggg

SEQ ID NO: 2740441 - RNA, 20 nt, Human
cuggcugguuagagguuccc

SEQ ID NO: 2740442 - RNA, 19 nt, Human
cugggaggucaaggcugca

SEQ ID NO: 2740443 - RNA, 21 nt, Human
cugggaggucaaggcugcagu

SEQ ID NO: 2740444 - RNA, 17 nt, Human
cugggauuacaggugug

SEQ ID NO: 2740445 - RNA, 20 nt, Human
cugggauuacaggugugaac

SEQ ID NO: 2740446 - RNA, 18 nt, Human
cugggaugauuggagggg

SEQ ID NO: 2740447 - RNA, 20 nt, Human
cugggaucccucauccucau

SEQ ID NO: 2740448 - RNA, 16 nt, Human
cuggccuggccccuca

SEQ ID NO: 2740449 - RNA, 17 nt, Human
cuggccuggccccucag

SEQ ID NO: 2740450 - RNA, 16 nt, Human
cuggccugagcuggga

SEQ ID NO: 2740451 - RNA, 13 nt, Human
cuggccucugcac

SEQ ID NO: 2740452 - RNA, 14 nt, Human
cuggccucugcacu

SEQ ID NO: 2740453 - RNA, 13 nt, Human
cuggccuggcccc

SEQ ID NO: 2740454 - RNA, 14 nt, Human
cuggccuggccccu

SEQ ID NO: 2740455 - RNA, 15 nt, Human
cuggccugagcuggg

SEQ ID NO: 2740456 - RNA, 18 nt, Human
cuggccugagcugggaug

SEQ ID NO: 2740457 - RNA, 23 nt, Human
cuggccucaagugauucuccugc

SEQ ID NO: 2740458 - RNA, 12 nt, Human
cuggccucugca

SEQ ID NO: 2740459 - RNA, 22 nt, Human
cuggccucaagugauucuccug

SEQ ID NO: 2740460 - RNA, 16 nt, Human
cuggcacccggccccu

SEQ ID NO: 2740461 - RNA, 17 nt, Human
cuggcacccggccccug

SEQ ID NO: 2740462 - RNA, 18 nt, Human
cuggcacccggccccugc

SEQ ID NO: 2740463 - RNA, 22 nt, Human
cuggcacccggccccugcuggu

SEQ ID NO: 2740464 - RNA, 18 nt, Human
cuggaauauauaaccagu

SEQ ID NO: 2740465 - RNA, 14 nt, Human
cuggcaagaaugug

SEQ ID NO: 2740466 - RNA, 22 nt, Human
cuggcacuauaauguaagcucu

SEQ ID NO: 2740467 - RNA, 16 nt, Human
cuggcacuauaaugua

SEQ ID NO: 2740468 - RNA, 15 nt, Human
cuggcacuauaaugu

SEQ ID NO: 2740469 - RNA, 16 nt, Human
cuggcaugggaaugaa

SEQ ID NO: 2740470 - RNA, 18 nt, Human
cuggcaugggaaugaaug

SEQ ID NO: 2740471 - RNA, 19 nt, Human
cuggcaugggaaugaaugu

SEQ ID NO: 2740472 - RNA, 22 nt, Human
cuggcaugggaaugaaugucag

SEQ ID NO: 2740473 - RNA, 24 nt, Human
cuggcaugggaaugaaugucagug

SEQ ID NO: 2740474 - RNA, 22 nt, Human
cuggccagaugcaccagcccuu

SEQ ID NO: 2740475 - RNA, 23 nt, Human
cuguacagagcccacgcccccac

SEQ ID NO: 2740476 - RNA, 22 nt, Human
cuguaauuugugauacaaugcu

SEQ ID NO: 2740477 - RNA, 21 nt, Human
cuguaauuugugauacaaugc

SEQ ID NO: 2740478 - RNA, 17 nt, Human
cuguaauuugugauaca

SEQ ID NO: 2740479 - RNA, 18 nt, Human
cuguaauuugugauacaa

SEQ ID NO: 2740480 - RNA, 21 nt, Human
cuguaccucuugagccuugaa

SEQ ID NO: 2740481 - RNA, 23 nt, Human
cuguacaugaaaacacauuuuuc

SEQ ID NO: 2740482 - RNA, 22 nt, Human
cuguacaugaaaacacauuuuu

SEQ ID NO: 2740483 - RNA, 12 nt, Human
cugguggcagcu

SEQ ID NO: 2740484 - RNA, 13 nt, Human
cugguggcagcuc

SEQ ID NO: 2740485 - RNA, 14 nt, Human
cugguggcagcuca

SEQ ID NO: 2740486 - RNA, 20 nt, Human
cugguucaggguuggccccu

SEQ ID NO: 2740487 - RNA, 15 nt, Human
cuggguuggagggug

SEQ ID NO: 2740488 - RNA, 19 nt, Human
cuggguacuuguggacaca

SEQ ID NO: 2740489 - RNA, 18 nt, Human
cuggguacuuguggacac

SEQ ID NO: 2740490 - RNA, 16 nt, Human
cuggguacuuguggac

SEQ ID NO: 2740491 - RNA, 14 nt, Human
cuggguacuugugg

SEQ ID NO: 2740492 - RNA, 19 nt, Human
cugggcucccuucccaccu

SEQ ID NO: 2740493 - RNA, 20 nt, Human
cugggcucccuucccaccuc

SEQ ID NO: 2740494 - RNA, 21 nt, Human
cugggcucccuucccaccucu

SEQ ID NO: 2740495 - RNA, 22 nt, Human
cugggcucccuucccaccucuc

SEQ ID NO: 2740496 - RNA, 21 nt, Human
cugguccauagagagcaagac

SEQ ID NO: 2740497 - RNA, 13 nt, Human
cuggucccacuca

SEQ ID NO: 2740498 - RNA, 23 nt, Human
cuggucucaaacucuugaccuca

SEQ ID NO: 2740499 - RNA, 14 nt, Human
cuggucccacucag

SEQ ID NO: 2740500 - RNA, 22 nt, Human
cugucucaaaaaaagaaaaaga

SEQ ID NO: 2740501 - RNA, 21 nt, Human
cuguccuacucugugucaggu

SEQ ID NO: 2740502 - RNA, 16 nt, Human
cuguccuacucugugu

SEQ ID NO: 2740503 - RNA, 17 nt, Human
cuguccuacucuguguc

SEQ ID NO: 2740504 - RNA, 18 nt, Human
cuguccuacucuguguca

SEQ ID NO: 2740505 - RNA, 20 nt, Human
cuguccuacucugugucagg

SEQ ID NO: 2740506 - RNA, 13 nt, Human
cugucccccugac

SEQ ID NO: 2740507 - RNA, 14 nt, Human
cugucccccugaca

SEQ ID NO: 2740508 - RNA, 13 nt, Human
cuguauuuuaaaa

SEQ ID NO: 2740509 - RNA, 16 nt, Human
cuguauuuuaaaagaa

SEQ ID NO: 2740510 - RNA, 22 nt, Human
cugucccagugccgagaaggaa

SEQ ID NO: 2740511 - RNA, 15 nt, Human
cuguaugauucccag

SEQ ID NO: 2740512 - RNA, 18 nt, Human
cuguaucccaugagccuc

SEQ ID NO: 2740513 - RNA, 14 nt, Human
cuguaucccaugag

SEQ ID NO: 2740514 - RNA, 15 nt, Human
cuguaucccaugagc

SEQ ID NO: 2740515 - RNA, 16 nt, Human
cuguauagauuagaga

SEQ ID NO: 2740516 - RNA, 20 nt, Human
cuguauagauuagaauucug

SEQ ID NO: 2740517 - RNA, 15 nt, Human
cuguauagauuagag

SEQ ID NO: 2740518 - RNA, 22 nt, Human
cuguaccucuugagccuugaac

SEQ ID NO: 2740519 - RNA, 14 nt, Human
gaaccacaagacug

SEQ ID NO: 2740520 - RNA, 15 nt, Human
gaaccacaagacugc

SEQ ID NO: 2740521 - RNA, 20 nt, Human
gaaccacaucuugcucugcu

SEQ ID NO: 2740522 - RNA, 18 nt, Human
gaaccacaucuugcucug

SEQ ID NO: 2740523 - RNA, 17 nt, Human
gaacuuaaauaauguga

SEQ ID NO: 2740524 - RNA, 14 nt, Human
gaacuuaaauaaug

SEQ ID NO: 2740525 - RNA, 17 nt, Human
gaacuuggcgcugcccc

SEQ ID NO: 2740526 - RNA, 22 nt, Human
gaacuugaaauuugaauuuugu

SEQ ID NO: 2740527 - RNA, 15 nt, Human
gaacuugaaauuuga

SEQ ID NO: 2740528 - RNA, 13 nt, Human
gaacuugaaauuu

SEQ ID NO: 2740529 - RNA, 12 nt, Human
gaacuugaaauu

SEQ ID NO: 2740530 - RNA, 22 nt, Human
gaacuuguaaaggaauuuaaaa

SEQ ID NO: 2740531 - RNA, 17 nt, Human
gaacuugggccacugug

SEQ ID NO: 2740532 - RNA, 18 nt, Human
gaacuuggcgcugccccu

SEQ ID NO: 2740533 - RNA, 17 nt, Human
gaacuuuccaggaaggc

SEQ ID NO: 2740534 - RNA, 14 nt, Human
gaagaagcucucuc

SEQ ID NO: 2740535 - RNA, 22 nt, Human
gaacuuugaccucugcagcaau

SEQ ID NO: 2740536 - RNA, 16 nt, Human
gaacuuugaccucugc

SEQ ID NO: 2740537 - RNA, 20 nt, Human
gaagagcuguucacagccag

SEQ ID NO: 2740538 - RNA, 15 nt, Human
gaagagcuguucaca

SEQ ID NO: 2740539 - RNA, 13 nt, Human
gaagagcuguuca

SEQ ID NO: 2740540 - RNA, 23 nt, Human
gaagagcuguucacagccagacu

SEQ ID NO: 2740541 - RNA, 20 nt, Human
gaagaguauuuuugacagaa

SEQ ID NO: 2740542 - RNA, 15 nt, Human
gaagacuucaucccu

SEQ ID NO: 2740543 - RNA, 16 nt, Human
gaagacuucaucccuc

SEQ ID NO: 2740544 - RNA, 12 nt, Human
gaagagccuugc

SEQ ID NO: 2740545 - RNA, 17 nt, Human
gaagacuucaucccucu

SEQ ID NO: 2740546 - RNA, 19 nt, Human
gaagacuucaucccucugg

SEQ ID NO: 2740547 - RNA, 18 nt, Human
gaagcauuuacuuugugu

SEQ ID NO: 2740548 - RNA, 23 nt, Human
gaaguccaagcauuuagauguau

SEQ ID NO: 2740549 - RNA, 18 nt, Human
gaagucuuagauguauau

SEQ ID NO: 2740550 - RNA, 14 nt, Human
gaagucagaucugc

SEQ ID NO: 2740551 - RNA, 23 nt, Human
gaagucagaucugccuaaggacu

SEQ ID NO: 2740552 - RNA, 22 nt, Human
gaagucagaucugccuaaggac

SEQ ID NO: 2740553 - RNA, 21 nt, Human
gaagucacauuccugaacagg

SEQ ID NO: 2740554 - RNA, 20 nt, Human
gaagucacauuccugaacag

SEQ ID NO: 2740555 - RNA, 16 nt, Human
gaagucacauuccuga

SEQ ID NO: 2740556 - RNA, 13 nt, Human
gaagucacacagu

SEQ ID NO: 2740557 - RNA, 21 nt, Human
gaaguaauaugcacacauuuu

SEQ ID NO: 2740558 - RNA, 20 nt, Human
gaaguaauaugcacacauuu

SEQ ID NO: 2740559 - RNA, 19 nt, Human
gaaguaauaugcacacauu

SEQ ID NO: 2740560 - RNA, 13 nt, Human
gaagggggcuggg

SEQ ID NO: 2740561 - RNA, 19 nt, Human
gaaggaagacuucaucccu

SEQ ID NO: 2740562 - RNA, 15 nt, Human
gaaggaacguccccu

SEQ ID NO: 2740563 - RNA, 21 nt, Human
gaaggaaacccagcucugguc

SEQ ID NO: 2740564 - RNA, 22 nt, Human
gaaggaaacccagcucuggucc

SEQ ID NO: 2740565 - RNA, 19 nt, Human
gaaggacauugcggacagc

SEQ ID NO: 2740566 - RNA, 20 nt, Human
gaaggacauugcggacagcc

SEQ ID NO: 2740567 - RNA, 21 nt, Human
gaaggacauugcggacagcca

SEQ ID NO: 2740568 - RNA, 19 nt, Human
gaaggaaacccagcucugg

SEQ ID NO: 2740569 - RNA, 20 nt, Human
gaaggaaacccagcucuggu

SEQ ID NO: 2740570 - RNA, 14 nt, Human
gaagccgcuggggc

SEQ ID NO: 2740571 - RNA, 18 nt, Human
gaagccgcuggggccagu

SEQ ID NO: 2740572 - RNA, 20 nt, Human
gaagccgcuggggccaguug

SEQ ID NO: 2740573 - RNA, 15 nt, Human
gaaauauuuauuuua

SEQ ID NO: 2740574 - RNA, 16 nt, Human
gaaauauuuauuuuaa

SEQ ID NO: 2740575 - RNA, 13 nt, Human
gaaauauuuauuu

SEQ ID NO: 2740576 - RNA, 19 nt, Human
gaaauaucugaaaauguau

SEQ ID NO: 2740577 - RNA, 18 nt, Human
gaaauaucugaaaaugua

SEQ ID NO: 2740578 - RNA, 17 nt, Human
gaaauauaggaacuuaa

SEQ ID NO: 2740579 - RNA, 21 nt, Human
gaaauaaacgucuuaaauauu

SEQ ID NO: 2740580 - RNA, 18 nt, Human
gaaauaaacgucuuaaau

SEQ ID NO: 2740581 - RNA, 14 nt, Human
gaaauaaacgucuu

SEQ ID NO: 2740582 - RNA, 17 nt, Human
gaaauaaacgucuuaaa

SEQ ID NO: 2740583 - RNA, 16 nt, Human
gaaauaaacgucuuaa

SEQ ID NO: 2740584 - RNA, 22 nt, Human
gaaauguaagggaaacugccag

SEQ ID NO: 2740585 - RNA, 17 nt, Human
gaaauguacagcaagga

SEQ ID NO: 2740586 - RNA, 17 nt, Human
gaaaugggcagagcaga

SEQ ID NO: 2740587 - RNA, 19 nt, Human
gaaaugggcagagcagaga

SEQ ID NO: 2740588 - RNA, 18 nt, Human
gaaaugaggucagagccu

SEQ ID NO: 2740589 - RNA, 11 nt, Human
gaaaugagcug

SEQ ID NO: 2740590 - RNA, 16 nt, Human
gaaaugggcagagcag

SEQ ID NO: 2740591 - RNA, 15 nt, Human
gaaaugggcagagca

SEQ ID NO: 2740592 - RNA, 24 nt, Human
gaacaguuaccucugccucagaaa

SEQ ID NO: 2740593 - RNA, 20 nt, Human
gaacaguuguguuugaagca

SEQ ID NO: 2740594 - RNA, 18 nt, Human
gaacagauaaucagugug

SEQ ID NO: 2740595 - RNA, 22 nt, Human
gaacagacuggaagcacagcuu

SEQ ID NO: 2740596 - RNA, 17 nt, Human
gaacaggauauucucac

SEQ ID NO: 2740597 - RNA, 22 nt, Human
gaacaguuguguuugaagcaca

SEQ ID NO: 2740598 - RNA, 17 nt, Human
gaaauuauauaaguauu

SEQ ID NO: 2740599 - RNA, 23 nt, Human
gaaauuauauaaguauucuaaau

SEQ ID NO: 2740600 - RNA, 17 nt, Human
gaacacuccuucacaga

SEQ ID NO: 2740601 - RNA, 20 nt, Human
gaacagacuggaagcacagc

SEQ ID NO: 2740602 - RNA, 19 nt, Human
gaacagacuggaagcacag

SEQ ID NO: 2740603 - RNA, 15 nt, Human
gaacacuccuucaca

SEQ ID NO: 2740604 - RNA, 16 nt, Human
gaacacuccuucacag

SEQ ID NO: 2740605 - RNA, 21 nt, Human
gaaauuuccugggagcuuuug

SEQ ID NO: 2740606 - RNA, 13 nt, Human
gaaauuugaauuu

SEQ ID NO: 2740607 - RNA, 24 nt, Human
gaaauuugaauuuuguguuagaga

SEQ ID NO: 2740608 - RNA, 16 nt, Human
gaaauuugaauuuugu

SEQ ID NO: 2740609 - RNA, 19 nt, Human
gaaagacuauucaaacagu

SEQ ID NO: 2740610 - RNA, 23 nt, Human
gaaagacuauucaaacagucuca

SEQ ID NO: 2740611 - RNA, 22 nt, Human
gaaagacuauucaaacagucuc

SEQ ID NO: 2740612 - RNA, 16 nt, Human
gaaagaucaaaagguu

SEQ ID NO: 2740613 - RNA, 15 nt, Human
gaaacugccagcaac

SEQ ID NO: 2740614 - RNA, 13 nt, Human
gaaacugccagca

SEQ ID NO: 2740615 - RNA, 16 nt, Human
gaaacggaugauuucu

SEQ ID NO: 2740616 - RNA, 16 nt, Human
gaaaaaugagccuggc

SEQ ID NO: 2740617 - RNA, 11 nt, Human
gaaaggaaaga

SEQ ID NO: 2740618 - RNA, 16 nt, Human
gaaaggaaagaggcuc

SEQ ID NO: 2740619 - RNA, 22 nt, Human
gaaaguacuucuccacccugcu

SEQ ID NO: 2740620 - RNA, 23 nt, Human
gaaaguuauugauaaguucauac

SEQ ID NO: 2740621 - RNA, 17 nt, Human
cuugccaaauauaaaua

SEQ ID NO: 2740622 - RNA, 13 nt, Human
cuugcuugcuuuu

SEQ ID NO: 2740623 - RNA, 12 nt, Human
cuuggcugcagg

SEQ ID NO: 2740624 - RNA, 13 nt, Human
cuuggcugcaggg

SEQ ID NO: 2740625 - RNA, 23 nt, Human
cuuggcucaaguccucuuuucug

SEQ ID NO: 2740626 - RNA, 14 nt, Human
cuuggauugucccc

SEQ ID NO: 2740627 - RNA, 13 nt, Human
cuuggauuguccc

SEQ ID NO: 2740628 - RNA, 18 nt, Human
cuuguaaaggaauuuaaa

SEQ ID NO: 2740629 - RNA, 21 nt, Human
cuuguaaauagcucagguguc

SEQ ID NO: 2740630 - RNA, 20 nt, Human
cuugguuuguaaauuaacuu

SEQ ID NO: 2740631 - RNA, 16 nt, Human
cuuggggaccagagcu

SEQ ID NO: 2740632 - RNA, 17 nt, Human
cuuggggaccagagcug

SEQ ID NO: 2740633 - RNA, 18 nt, Human
cuuggggaccagagcugc

SEQ ID NO: 2740634 - RNA, 19 nt, Human
cuuggggaccagagcugcc

SEQ ID NO: 2740635 - RNA, 16 nt, Human
cuuguggacacagcuc

SEQ ID NO: 2740636 - RNA, 17 nt, Human
cuuguggacacagcucu

SEQ ID NO: 2740637 - RNA, 18 nt, Human
cuuguggacacagcucuu

SEQ ID NO: 2740638 - RNA, 23 nt, Human
cuugcaucaauuuuucuuauuuc

SEQ ID NO: 2740639 - RNA, 21 nt, Human
cuugcaugaggcuaguguggu

SEQ ID NO: 2740640 - RNA, 18 nt, Human
cuugcagacucuacagag

SEQ ID NO: 2740641 - RNA, 22 nt, Human
cuugcaaaguaucccuacugua

SEQ ID NO: 2740642 - RNA, 14 nt, Human
cuugcaauggcagc

SEQ ID NO: 2740643 - RNA, 19 nt, Human
cuugagccuugaacuuuga

SEQ ID NO: 2740644 - RNA, 14 nt, Human
cuugagagggugga

SEQ ID NO: 2740645 - RNA, 21 nt, Human
cuugaccauucuccaccugcc

SEQ ID NO: 2740646 - RNA, 17 nt, Human
cuugaccauucuccacc

SEQ ID NO: 2740647 - RNA, 20 nt, Human
cuugaccauucuccaccugc

SEQ ID NO: 2740648 - RNA, 22 nt, Human
cuugagccuugaacuuugaccu

SEQ ID NO: 2740649 - RNA, 20 nt, Human
cuugagccuugaacuuugac

SEQ ID NO: 2740650 - RNA, 20 nt, Human
cuugaaauuugaauuuugug

SEQ ID NO: 2740651 - RNA, 19 nt, Human
cuugaaauuugaauuuugu

SEQ ID NO: 2740652 - RNA, 14 nt, Human
cuugaacuccuggc

SEQ ID NO: 2740653 - RNA, 15 nt, Human
cuugaacuccuggcc

SEQ ID NO: 2740654 - RNA, 17 nt, Human
cuugaacuccuggccuc

SEQ ID NO: 2740655 - RNA, 18 nt, Human
cuugaacuccuggccuca

SEQ ID NO: 2740656 - RNA, 15 nt, Human
cuugaacuuugaccu

SEQ ID NO: 2740657 - RNA, 18 nt, Human
cuugaacuggguacuugu

SEQ ID NO: 2740658 - RNA, 20 nt, Human
cuugaacuggguacuugugg

SEQ ID NO: 2740659 - RNA, 19 nt, Human
cuugaacuccuggccucaa

SEQ ID NO: 2740660 - RNA, 16 nt, Human
cuugaacuggguacuu

SEQ ID NO: 2740661 - RNA, 19 nt, Human
cuucuuuccacagaagcuc

SEQ ID NO: 2740662 - RNA, 13 nt, Human
cuucuuuccacag

SEQ ID NO: 2740663 - RNA, 22 nt, Human
cuucuuuauaauucuacuuuga

SEQ ID NO: 2740664 - RNA, 19 nt, Human
cuugaaauauaggaacuua

SEQ ID NO: 2740665 - RNA, 14 nt, Human
cuuugcagacaggc

SEQ ID NO: 2740666 - RNA, 15 nt, Human
cuuugcagacaggca

SEQ ID NO: 2740667 - RNA, 19 nt, Human
cuuuggaaagaguaggaag

SEQ ID NO: 2740668 - RNA, 23 nt, Human
cuuuggaaagaguaggaagacuu

SEQ ID NO: 2740669 - RNA, 17 nt, Human
cuuuccugaggcugggc

SEQ ID NO: 2740670 - RNA, 16 nt, Human
cuuuccugaggcuggg

SEQ ID NO: 2740671 - RNA, 20 nt, Human
cuuuccugaggcugggcucc

SEQ ID NO: 2740672 - RNA, 21 nt, Human
cuuuccugaggcugggcuccc

SEQ ID NO: 2740673 - RNA, 16 nt, Human
cuuuccaaaugcccag

SEQ ID NO: 2740674 - RNA, 22 nt, Human
cuuuccaaaguacacuguuuca

SEQ ID NO: 2740675 - RNA, 16 nt, Human
cuuuccaaaguacacu

SEQ ID NO: 2740676 - RNA, 14 nt, Human
cuuuccaggaaggc

SEQ ID NO: 2740677 - RNA, 21 nt, Human
cuuguggacacagcucuucuc

SEQ ID NO: 2740678 - RNA, 22 nt, Human
cuuuucauuuaggugaggaagc

SEQ ID NO: 2740679 - RNA, 13 nt, Human
cuuuuccaacccu

SEQ ID NO: 2740680 - RNA, 23 nt, Human
cuuuuccaacccucaucaccaac

SEQ ID NO: 2740681 - RNA, 21 nt, Human
cuuuucgcaggauucuuccuc

SEQ ID NO: 2740682 - RNA, 20 nt, Human
cuuuucgcaggauucuuccu

SEQ ID NO: 2740683 - RNA, 16 nt, Human
cuuuggaacaagaugg

SEQ ID NO: 2740684 - RNA, 22 nt, Human
cuuuuuaauauugauaugcuua

SEQ ID NO: 2740685 - RNA, 13 nt, Human
cuuuucuuuucuu

SEQ ID NO: 2740686 - RNA, 17 nt, Human
cuuuucuuucagccaag

SEQ ID NO: 2740687 - RNA, 15 nt, Human
cuuuuuuauacauaa

SEQ ID NO: 2740688 - RNA, 17 nt, Human
cuuuuuuauacauaaac

SEQ ID NO: 2740689 - RNA, 16 nt, Human
cuuuuuuauacauaaa

SEQ ID NO: 2740690 - RNA, 21 nt, Human
cuuuuucauuauuuuauuaug

SEQ ID NO: 2740691 - RNA, 11 nt, Human
gaaaaagaaaa

SEQ ID NO: 2740692 - RNA, 16 nt, Human
gaaaaagaaaaaauau

SEQ ID NO: 2740693 - RNA, 18 nt, Human
cuuuuuuauacauaaaca

SEQ ID NO: 2740694 - RNA, 23 nt, Human
gaccugauuucugagcauuuaau

SEQ ID NO: 2740695 - RNA, 18 nt, Human
gaccugaggcccuucucu

SEQ ID NO: 2740696 - RNA, 21 nt, Human
gaccugaggcccuucucucca

SEQ ID NO: 2740697 - RNA, 11 nt, Human
gaccucaggcc

SEQ ID NO: 2740698 - RNA, 12 nt, Human
gaccucaggccu

SEQ ID NO: 2740699 - RNA, 13 nt, Human
gaccucaggccug

SEQ ID NO: 2740700 - RNA, 15 nt, Human
gaccugaggcccuuc

SEQ ID NO: 2740701 - RNA, 14 nt, Human
gaccgugaggccag

SEQ ID NO: 2740702 - RNA, 19 nt, Human
gaccgugaggccagagaca

SEQ ID NO: 2740703 - RNA, 15 nt, Human
gaccgugaggccaga

SEQ ID NO: 2740704 - RNA, 13 nt, Human
gaccccuccaugu

SEQ ID NO: 2740705 - RNA, 18 nt, Human
gacccugaggcccagagg

SEQ ID NO: 2740706 - RNA, 23 nt, Human
gacccugucucaaaaaaagaaaa

SEQ ID NO: 2740707 - RNA, 16 nt, Human
gacccugcccuguggg

SEQ ID NO: 2740708 - RNA, 13 nt, Human
gacccugcccugu

SEQ ID NO: 2740709 - RNA, 15 nt, Human
gacccugcccugugg

SEQ ID NO: 2740710 - RNA, 19 nt, Human
gacccugaggcccagaggg

SEQ ID NO: 2740711 - RNA, 20 nt, Human
gacccugaggcccagagggc

SEQ ID NO: 2740712 - RNA, 12 nt, Human
gacccugcccug

SEQ ID NO: 2740713 - RNA, 21 nt, Human
gacccugaggcccagagggcc

SEQ ID NO: 2740714 - RNA, 13 nt, Human
gacccaugcugcc

SEQ ID NO: 2740715 - RNA, 16 nt, Human
gacccaugcugcccug

SEQ ID NO: 2740716 - RNA, 14 nt, Human
gacccaugcugccc

SEQ ID NO: 2740717 - RNA, 15 nt, Human
gacccaugcugcccu

SEQ ID NO: 2740718 - RNA, 11 nt, Human
gacccacugcu

SEQ ID NO: 2740719 - RNA, 12 nt, Human
gacccacugcuu

SEQ ID NO: 2740720 - RNA, 17 nt, Human
gacguguuaugacucca

SEQ ID NO: 2740721 - RNA, 20 nt, Human
gacguguuaugacuccagaa

SEQ ID NO: 2740722 - RNA, 14 nt, Human
gacggagucccacc

SEQ ID NO: 2740723 - RNA, 18 nt, Human
gacggagucccaccuugg

SEQ ID NO: 2740724 - RNA, 21 nt, Human
gacggagucccaccuuggcug

SEQ ID NO: 2740725 - RNA, 21 nt, Human
gaccuuucaauaggaaaaacu

SEQ ID NO: 2740726 - RNA, 23 nt, Human
gaccuugaacuggguacuugugg

SEQ ID NO: 2740727 - RNA, 17 nt, Human
gacuacucccccaggug

SEQ ID NO: 2740728 - RNA, 12 nt, Human
gacuacaggcac

SEQ ID NO: 2740729 - RNA, 22 nt, Human
gacguguuaugacuccagaauu

SEQ ID NO: 2740730 - RNA, 18 nt, Human
gacuccaaagaaauguaa

SEQ ID NO: 2740731 - RNA, 14 nt, Human
gacuccugcaggca

SEQ ID NO: 2740732 - RNA, 15 nt, Human
gacuccugcaggcag

SEQ ID NO: 2740733 - RNA, 16 nt, Human
gacuccugcaggcagc

SEQ ID NO: 2740734 - RNA, 17 nt, Human
gacaugggacauuugcu

SEQ ID NO: 2740735 - RNA, 22 nt, Human
gacaugggacauuugcucaugg

SEQ ID NO: 2740736 - RNA, 17 nt, Human
gacaugucuuuucuugc

SEQ ID NO: 2740737 - RNA, 21 nt, Human
gacaugucuuuucuugcauga

SEQ ID NO: 2740738 - RNA, 20 nt, Human
gaccaaaaaccaguauugua

SEQ ID NO: 2740739 - RNA, 19 nt, Human
gaccaaaaaccaguauugu

SEQ ID NO: 2740740 - RNA, 13 nt, Human
gaccaaaaaccag

SEQ ID NO: 2740741 - RNA, 16 nt, Human
gacauagucuggcugu

SEQ ID NO: 2740742 - RNA, 23 nt, Human
gacauacuaaccagcagaaaugc

SEQ ID NO: 2740743 - RNA, 16 nt, Human
gacauacuaaccagca

SEQ ID NO: 2740744 - RNA, 15 nt, Human
gacauacuaaccagc

SEQ ID NO: 2740745 - RNA, 13 nt, Human
gacagccacggcc

SEQ ID NO: 2740746 - RNA, 12 nt, Human
gacagcugccug

SEQ ID NO: 2740747 - RNA, 13 nt, Human
gacagcugccugg

SEQ ID NO: 2740748 - RNA, 14 nt, Human
gacagacacaggcc

SEQ ID NO: 2740749 - RNA, 20 nt, Human
gacacuaaccacgcuggacc

SEQ ID NO: 2740750 - RNA, 21 nt, Human
gacacuaaccacgcuggaccu

SEQ ID NO: 2740751 - RNA, 15 nt, Human
gacagacacaggccc

SEQ ID NO: 2740752 - RNA, 16 nt, Human
gacagacacaggcccg

SEQ ID NO: 2740753 - RNA, 14 nt, Human
gacagcugccuggg

SEQ ID NO: 2740754 - RNA, 15 nt, Human
gacagcugccuggga

SEQ ID NO: 2740755 - RNA, 14 nt, Human
gacaggcaaugcug

SEQ ID NO: 2740756 - RNA, 16 nt, Human
gacaggcaaugcuggc

SEQ ID NO: 2740757 - RNA, 24 nt, Human
gacaggcaaugcuggcuguuggcu

SEQ ID NO: 2740758 - RNA, 17 nt, Human
gacaggcaaugcuggcu

SEQ ID NO: 2740759 - RNA, 18 nt, Human
gacaggcauguucucuga

SEQ ID NO: 2740760 - RNA, 19 nt, Human
gacaggcauguucucugag

SEQ ID NO: 2740761 - RNA, 15 nt, Human
gacacgaauauugcu

SEQ ID NO: 2740762 - RNA, 18 nt, Human
gacaccuugacagggcac

SEQ ID NO: 2740763 - RNA, 20 nt, Human
gacaccuugacagggcacac

SEQ ID NO: 2740764 - RNA, 15 nt, Human
gacaccuugacaggg

SEQ ID NO: 2740765 - RNA, 17 nt, Human
gacaccuugacagggca

SEQ ID NO: 2740766 - RNA, 19 nt, Human
gacacgaauauugcugaug

SEQ ID NO: 2740767 - RNA, 17 nt, Human
gacacgaauauugcuga

SEQ ID NO: 2740768 - RNA, 18 nt, Human
gacacgaauauugcugau

SEQ ID NO: 2740769 - RNA, 15 nt, Human
gacacuaaccacgcu

SEQ ID NO: 2740770 - RNA, 16 nt, Human
gacacuaaccacgcug

SEQ ID NO: 2740771 - RNA, 17 nt, Human
gacacuaaccacgcugg

SEQ ID NO: 2740772 - RNA, 18 nt, Human
gacacuaaccacgcugga

SEQ ID NO: 2740773 - RNA, 22 nt, Human
gacacccugugauggggcccug

SEQ ID NO: 2740774 - RNA, 23 nt, Human
gacacccugugauggggcccugc

SEQ ID NO: 2740775 - RNA, 12 nt, Human
gacacccuguga

SEQ ID NO: 2740776 - RNA, 13 nt, Human
gacacccugugau

SEQ ID NO: 2740777 - RNA, 18 nt, Human
gacacaggcccggcucca

SEQ ID NO: 2740778 - RNA, 12 nt, Human
gacacaggcccg

SEQ ID NO: 2740779 - RNA, 15 nt, Human
gacacaggcccggcu

SEQ ID NO: 2740780 - RNA, 17 nt, Human
gacacaggcccggcucc

SEQ ID NO: 2740781 - RNA, 22 nt, Human
gacacaagccuucggcgccuua

SEQ ID NO: 2740782 - RNA, 19 nt, Human
gacaauuuauuauggcaca

SEQ ID NO: 2740783 - RNA, 13 nt, Human
gacaauuuauuau

SEQ ID NO: 2740784 - RNA, 12 nt, Human
gacaauuuauua

SEQ ID NO: 2740785 - RNA, 16 nt, Human
gacaaugcaaaccauc

SEQ ID NO: 2740786 - RNA, 18 nt, Human
gacaaugcaaaccaucau

SEQ ID NO: 2740787 - RNA, 21 nt, Human
gacaaugacuuacuguacaug

SEQ ID NO: 2740788 - RNA, 12 nt, Human
gacaaugcaaac

SEQ ID NO: 2740789 - RNA, 20 nt, Human
gacaaugacuuacuguacau

SEQ ID NO: 2740790 - RNA, 17 nt, Human
gacaaugacuuacugua

SEQ ID NO: 2740791 - RNA, 16 nt, Human
gacaaugacccagugg

SEQ ID NO: 2740792 - RNA, 16 nt, Human
gaagucuuuguacaga

SEQ ID NO: 2740793 - RNA, 14 nt, Human
gaagucuuuguaca

SEQ ID NO: 2740794 - RNA, 22 nt, Human
gacaaggauugcuacuguccua

SEQ ID NO: 2740795 - RNA, 18 nt, Human
gagcugcccucuccuggg

SEQ ID NO: 2740796 - RNA, 19 nt, Human
gagcugcccucuccugggc

SEQ ID NO: 2740797 - RNA, 21 nt, Human
gagcugcccucuccugggcag

SEQ ID NO: 2740798 - RNA, 23 nt, Human
gagcugcccucuccugggcagcu

SEQ ID NO: 2740799 - RNA, 20 nt, Human
gagcuuugaaaauucagugg

SEQ ID NO: 2740800 - RNA, 22 nt, Human
gagcuuucugcuaucaaagagg

SEQ ID NO: 2740801 - RNA, 16 nt, Human
gaggaaagcaaaggag

SEQ ID NO: 2740802 - RNA, 17 nt, Human
gaggaaagcaaaggaga

SEQ ID NO: 2740803 - RNA, 14 nt, Human
gagcuuuuguagaa

SEQ ID NO: 2740804 - RNA, 14 nt, Human
gaggaacaaggcaa

SEQ ID NO: 2740805 - RNA, 16 nt, Human
gaggaacaaggcaagg

SEQ ID NO: 2740806 - RNA, 17 nt, Human
gaggaagagaaaaaaua

SEQ ID NO: 2740807 - RNA, 13 nt, Human
gaggaagccgcug

SEQ ID NO: 2740808 - RNA, 14 nt, Human
gaggaagccgcugg

SEQ ID NO: 2740809 - RNA, 17 nt, Human
gaggaagccgcuggggc

SEQ ID NO: 2740810 - RNA, 18 nt, Human
gaggaagccgcuggggcc

SEQ ID NO: 2740811 - RNA, 19 nt, Human
gaggaagccugauuaaaga

SEQ ID NO: 2740812 - RNA, 18 nt, Human
gaggaagccugauuaaag

SEQ ID NO: 2740813 - RNA, 16 nt, Human
gagcucgugggacagu

SEQ ID NO: 2740814 - RNA, 15 nt, Human
gagcugaguggggga

SEQ ID NO: 2740815 - RNA, 17 nt, Human
gagcugcccucuccugg

SEQ ID NO: 2740816 - RNA, 15 nt, Human
gagccugcaguuauu

SEQ ID NO: 2740817 - RNA, 15 nt, Human
gagcuagcagcaggg

SEQ ID NO: 2740818 - RNA, 17 nt, Human
gagcuagcagcagggag

SEQ ID NO: 2740819 - RNA, 13 nt, Human
gagccagauuuca

SEQ ID NO: 2740820 - RNA, 13 nt, Human
gagcccaccuugg

SEQ ID NO: 2740821 - RNA, 15 nt, Human
gagcccaccuuggcu

SEQ ID NO: 2740822 - RNA, 17 nt, Human
gagcccaccuuggcuca

SEQ ID NO: 2740823 - RNA, 18 nt, Human
gagccacugcaccgggcc

SEQ ID NO: 2740824 - RNA, 19 nt, Human
gagccacugcaccgggcca

SEQ ID NO: 2740825 - RNA, 13 nt, Human
gagccacugcacc

SEQ ID NO: 2740826 - RNA, 20 nt, Human
gagccacugcaccgggccac

SEQ ID NO: 2740827 - RNA, 15 nt, Human
gagccagauuucacu

SEQ ID NO: 2740828 - RNA, 18 nt, Human
gagccagauuucacucuc

SEQ ID NO: 2740829 - RNA, 19 nt, Human
gagccagauuucacucucc

SEQ ID NO: 2740830 - RNA, 20 nt, Human
gagauagccaaggccaaagg

SEQ ID NO: 2740831 - RNA, 21 nt, Human
gagauagccaaggccaaagga

SEQ ID NO: 2740832 - RNA, 17 nt, Human
gagcagagaccaucccu

SEQ ID NO: 2740833 - RNA, 18 nt, Human
gagcagagaccaucccug

SEQ ID NO: 2740834 - RNA, 16 nt, Human
gagcagagaccauccc

SEQ ID NO: 2740835 - RNA, 19 nt, Human
gagauagccaaggccaaag

SEQ ID NO: 2740836 - RNA, 23 nt, Human
gagcagagaccaucccugaaggc

SEQ ID NO: 2740837 - RNA, 19 nt, Human
gagcagagaccaucccuga

SEQ ID NO: 2740838 - RNA, 21 nt, Human
gagcagagaccaucccugaag

SEQ ID NO: 2740839 - RNA, 21 nt, Human
gagcagccacauuccugaugc

SEQ ID NO: 2740840 - RNA, 22 nt, Human
gagcagccacauuccugaugcu

SEQ ID NO: 2740841 - RNA, 21 nt, Human
gagccgagaucacgccacugc

SEQ ID NO: 2740842 - RNA, 22 nt, Human
gagccgagaucacgccacugca

SEQ ID NO: 2740843 - RNA, 19 nt, Human
gagccgagaucacgccacu

SEQ ID NO: 2740844 - RNA, 20 nt, Human
gagccgagaucacgccacug

SEQ ID NO: 2740845 - RNA, 18 nt, Human
gagcccacgcccccacug

SEQ ID NO: 2740846 - RNA, 12 nt, Human
gagccugcaguu

SEQ ID NO: 2740847 - RNA, 13 nt, Human
gagccuccugccc

SEQ ID NO: 2740848 - RNA, 13 nt, Human
gagccucagcauc

SEQ ID NO: 2740849 - RNA, 17 nt, Human
gagccucagcauccugg

SEQ ID NO: 2740850 - RNA, 14 nt, Human
gagccucagcaucc

SEQ ID NO: 2740851 - RNA, 15 nt, Human
gagccucagcauccu

SEQ ID NO: 2740852 - RNA, 19 nt, Human
gagagacacacugaagaag

SEQ ID NO: 2740853 - RNA, 17 nt, Human
gagagaagagaaugcac

SEQ ID NO: 2740854 - RNA, 17 nt, Human
gagauacagaauuuuau

SEQ ID NO: 2740855 - RNA, 13 nt, Human
gagagccuuccag

SEQ ID NO: 2740856 - RNA, 14 nt, Human
gagagccuuccagg

SEQ ID NO: 2740857 - RNA, 13 nt, Human
gagaggggaacag

SEQ ID NO: 2740858 - RNA, 18 nt, Human
gagaggggaacagacugg

SEQ ID NO: 2740859 - RNA, 21 nt, Human
gagagggugggagugggccca

SEQ ID NO: 2740860 - RNA, 24 nt, Human
gagacagcccgggcucugccuccc

SEQ ID NO: 2740861 - RNA, 14 nt, Human
gagacagcccgggc

SEQ ID NO: 2740862 - RNA, 17 nt, Human
gagacagcccgggcucu

SEQ ID NO: 2740863 - RNA, 18 nt, Human
gagacagcccgggcucug

SEQ ID NO: 2740864 - RNA, 19 nt, Human
gagacagcccgggcucugc

SEQ ID NO: 2740865 - RNA, 20 nt, Human
gagacagcccgggcucugcc

SEQ ID NO: 2740866 - RNA, 21 nt, Human
gagacagcccgggcucugccu

SEQ ID NO: 2740867 - RNA, 22 nt, Human
gagacagcccgggcucugccuc

SEQ ID NO: 2740868 - RNA, 23 nt, Human
gagacagcccgggcucugccucc

SEQ ID NO: 2740869 - RNA, 14 nt, Human
gagacucugucuca

SEQ ID NO: 2740870 - RNA, 22 nt, Human
gagacuccugcaggcagccagg

SEQ ID NO: 2740871 - RNA, 16 nt, Human
gagacucgcgacaaug

SEQ ID NO: 2740872 - RNA, 18 nt, Human
gagacucgcgacaaugca

SEQ ID NO: 2740873 - RNA, 18 nt, Human
gagacacacugaagaagc

SEQ ID NO: 2740874 - RNA, 15 nt, Human
gagacacaagccuuc

SEQ ID NO: 2740875 - RNA, 17 nt, Human
gagacacaagccuucgg

SEQ ID NO: 2740876 - RNA, 19 nt, Human
gagacagaguuuucacucu

SEQ ID NO: 2740877 - RNA, 12 nt, Human
gagacagcccgg

SEQ ID NO: 2740878 - RNA, 13 nt, Human
gagaagagcuguu

SEQ ID NO: 2740879 - RNA, 22 nt, Human
gagaagagcuguucacagccag

SEQ ID NO: 2740880 - RNA, 15 nt, Human
gagaagagcuguuca

SEQ ID NO: 2740881 - RNA, 13 nt, Human
gagaagaacugaa

SEQ ID NO: 2740882 - RNA, 14 nt, Human
gagaagaacugaaa

SEQ ID NO: 2740883 - RNA, 16 nt, Human
gagaagaacugaaauc

SEQ ID NO: 2740884 - RNA, 22 nt, Human
gagaaugcacaaacagaggccg

SEQ ID NO: 2740885 - RNA, 20 nt, Human
gagaaugcacaaacagaggc

SEQ ID NO: 2740886 - RNA, 21 nt, Human
gagaaugcacaaacagaggcc

SEQ ID NO: 2740887 - RNA, 18 nt, Human
gagaaagacuauucaaac

SEQ ID NO: 2740888 - RNA, 17 nt, Human
gagaaagacuauucaaa

SEQ ID NO: 2740889 - RNA, 15 nt, Human
gagaaagacuauuca

SEQ ID NO: 2740890 - RNA, 13 nt, Human
gagaaagacuauu

SEQ ID NO: 2740891 - RNA, 23 nt, Human
gagaaaguacuucuccacccugc

SEQ ID NO: 2740892 - RNA, 22 nt, Human
gagaaaguacuucuccacccug

SEQ ID NO: 2740893 - RNA, 13 nt, Human
gacuuggaagcuc

SEQ ID NO: 2740894 - RNA, 12 nt, Human
gacuuguuagau

SEQ ID NO: 2740895 - RNA, 21 nt, Human
gagaaaauggacguguuauga

SEQ ID NO: 2740896 - RNA, 14 nt, Human
gacuuggaagcucc

SEQ ID NO: 2740897 - RNA, 15 nt, Human
gacuuggaagcuccg

SEQ ID NO: 2740898 - RNA, 16 nt, Human
gacuuggaagcuccgc

SEQ ID NO: 2740899 - RNA, 19 nt, Human
gacucgcgacaaugcaaac

SEQ ID NO: 2740900 - RNA, 17 nt, Human
gacuccugcaggcagcc

SEQ ID NO: 2740901 - RNA, 18 nt, Human
gacucgcgacaaugcaaa

SEQ ID NO: 2740902 - RNA, 13 nt, Human
gauccuggaaauc

SEQ ID NO: 2740903 - RNA, 21 nt, Human
gauccugagccagauuucacu

SEQ ID NO: 2740904 - RNA, 22 nt, Human
gauccugagccagauuucacuc

SEQ ID NO: 2740905 - RNA, 15 nt, Human
gaucccucauccuca

SEQ ID NO: 2740906 - RNA, 16 nt, Human
gaucccucauccucau

SEQ ID NO: 2740907 - RNA, 14 nt, Human
gaugaaaauauuug

SEQ ID NO: 2740908 - RNA, 18 nt, Human
gaucuuugcagacaggca

SEQ ID NO: 2740909 - RNA, 17 nt, Human
gaucuuugcagacaggc

SEQ ID NO: 2740910 - RNA, 13 nt, Human
gauggggcccugc

SEQ ID NO: 2740911 - RNA, 14 nt, Human
gauggggcccugcc

SEQ ID NO: 2740912 - RNA, 22 nt, Human
gauggggcccugccuccuuugu

SEQ ID NO: 2740913 - RNA, 20 nt, Human
gaugccugguggcagcugcg

SEQ ID NO: 2740914 - RNA, 18 nt, Human
gaugccugguggcagcug

SEQ ID NO: 2740915 - RNA, 19 nt, Human
gaugccugguggcagcugc

SEQ ID NO: 2740916 - RNA, 22 nt, Human
gauggauuuccagccaaagccu

SEQ ID NO: 2740917 - RNA, 12 nt, Human
gaugcagccuca

SEQ ID NO: 2740918 - RNA, 19 nt, Human
gaugcagccucacaguccu

SEQ ID NO: 2740919 - RNA, 14 nt, Human
gaugcagccucaca

SEQ ID NO: 2740920 - RNA, 13 nt, Human
gaugcaccagccc

SEQ ID NO: 2740921 - RNA, 22 nt, Human
gaugcacagaguuguuacauuu

SEQ ID NO: 2740922 - RNA, 21 nt, Human
gaugcacagaguuguuacauu

SEQ ID NO: 2740923 - RNA, 17 nt, Human
gaugacaacuucccagu

SEQ ID NO: 2740924 - RNA, 23 nt, Human
gauagauaggucagugcaaauac

SEQ ID NO: 2740925 - RNA, 11 nt, Human
gauacagaaaa

SEQ ID NO: 2740926 - RNA, 22 nt, Human
gauaauacaccacuacauucug

SEQ ID NO: 2740927 - RNA, 21 nt, Human
gauaauacaccacuacauucu

SEQ ID NO: 2740928 - RNA, 18 nt, Human
gauaauacaccacuacau

SEQ ID NO: 2740929 - RNA, 14 nt, Human
gauaauacaccacu

SEQ ID NO: 2740930 - RNA, 20 nt, Human
gauagcacagacccugcccu

SEQ ID NO: 2740931 - RNA, 21 nt, Human
gauagcacagacccugcccug

SEQ ID NO: 2740932 - RNA, 22 nt, Human
gauagcacagacccugcccugu

SEQ ID NO: 2740933 - RNA, 18 nt, Human
gauacaggaaaagcugcu

SEQ ID NO: 2740934 - RNA, 12 nt, Human
gauaaguucaua

SEQ ID NO: 2740935 - RNA, 14 nt, Human
gauaaguucauaca

SEQ ID NO: 2740936 - RNA, 16 nt, Human
gauaaguucauacauu

SEQ ID NO: 2740937 - RNA, 13 nt, Human
gaggaaggaaacc

SEQ ID NO: 2740938 - RNA, 19 nt, Human
gaggaaggaaacccagcuc

SEQ ID NO: 2740939 - RNA, 20 nt, Human
gaggaaggaaacccagcucu

SEQ ID NO: 2740940 - RNA, 21 nt, Human
gaggaaggaaacccagcucug

SEQ ID NO: 2740941 - RNA, 17 nt, Human
gaucauccacugugcca

SEQ ID NO: 2740942 - RNA, 19 nt, Human
gaucauccacugugccaug

SEQ ID NO: 2740943 - RNA, 16 nt, Human
gaucauccacugugcc

SEQ ID NO: 2740944 - RNA, 21 nt, Human
gaucauccacugugccaugug

SEQ ID NO: 2740945 - RNA, 12 nt, Human
gaucagccuggg

SEQ ID NO: 2740946 - RNA, 15 nt, Human
gaucagccugggcaa

SEQ ID NO: 2740947 - RNA, 22 nt, Human
gaucagucugauucccaagcuc

SEQ ID NO: 2740948 - RNA, 12 nt, Human
gaucacggcuca

SEQ ID NO: 2740949 - RNA, 21 nt, Human
gaucaaguuauuuuuaauuug

SEQ ID NO: 2740950 - RNA, 16 nt, Human
gaucacgccacugcac

SEQ ID NO: 2740951 - RNA, 18 nt, Human
gaucacgccacugcacua

SEQ ID NO: 2740952 - RNA, 22 nt, Human
gauagucuuucaguuaaggaga

SEQ ID NO: 2740953 - RNA, 15 nt, Human
gauaguaacaaugaa

SEQ ID NO: 2740954 - RNA, 14 nt, Human
gauagucuuucagu

SEQ ID NO: 2740955 - RNA, 14 nt, Human
gcaagggugauggg

SEQ ID NO: 2740956 - RNA, 11 nt, Human
gcaaggcuguc

SEQ ID NO: 2740957 - RNA, 10 nt, Human
gcaagccaga

SEQ ID NO: 2740958 - RNA, 18 nt, Human
gcaaggagauuuacaacu

SEQ ID NO: 2740959 - RNA, 17 nt, Human
gcaaucaaaucugcuuu

SEQ ID NO: 2740960 - RNA, 15 nt, Human
gcaaucaaaucugcu

SEQ ID NO: 2740961 - RNA, 15 nt, Human
gcaaugaccuuucaa

SEQ ID NO: 2740962 - RNA, 17 nt, Human
gcaaugaccuuucaaua

SEQ ID NO: 2740963 - RNA, 20 nt, Human
gcaaugaccuuucaauagga

SEQ ID NO: 2740964 - RNA, 22 nt, Human
gcaaugaccuuucaauaggaaa

SEQ ID NO: 2740965 - RNA, 23 nt, Human
gcaaugaccuuucaauaggaaaa

SEQ ID NO: 2740966 - RNA, 13 nt, Human
gcaaugcuggcug

SEQ ID NO: 2740967 - RNA, 14 nt, Human
gcaaugcuggcugu

SEQ ID NO: 2740968 - RNA, 22 nt, Human
gcaaugcuggcuguuggcuggg

SEQ ID NO: 2740969 - RNA, 23 nt, Human
gcaaugcuggcuguuggcugggg

SEQ ID NO: 2740970 - RNA, 23 nt, Human
gcaaagcacugacuucuaaguaa

SEQ ID NO: 2740971 - RNA, 17 nt, Human
gcaaaauugauguguuu

SEQ ID NO: 2740972 - RNA, 16 nt, Human
gcaaaguaucccuacu

SEQ ID NO: 2740973 - RNA, 23 nt, Human
gcaagacgcugugcugcccugcc

SEQ ID NO: 2740974 - RNA, 14 nt, Human
gcaagacgcugugc

SEQ ID NO: 2740975 - RNA, 20 nt, Human
gcaagacgcugugcugcccu

SEQ ID NO: 2740976 - RNA, 21 nt, Human
gcaagacgcugugcugcccug

SEQ ID NO: 2740977 - RNA, 22 nt, Human
gcaagacgcugugcugcccugc

SEQ ID NO: 2740978 - RNA, 17 nt, Human
gcaagaauugaagcagg

SEQ ID NO: 2740979 - RNA, 15 nt, Human
gauuuuccugaaaac

SEQ ID NO: 2740980 - RNA, 23 nt, Human
gauuuuauuauguaaaucccauu

SEQ ID NO: 2740981 - RNA, 20 nt, Human
gauuuuauuauguaaauccc

SEQ ID NO: 2740982 - RNA, 19 nt, Human
gauuuuauuauguaaaucc

SEQ ID NO: 2740983 - RNA, 18 nt, Human
gauuuuauuauguaaauc

SEQ ID NO: 2740984 - RNA, 15 nt, Human
gauuuuauuauguaa

SEQ ID NO: 2740985 - RNA, 13 nt, Human
gauuuuauuaugu

SEQ ID NO: 2740986 - RNA, 19 nt, Human
gauuucuguuuagauaaua

SEQ ID NO: 2740987 - RNA, 11 nt, Human
gauuucuguuu

SEQ ID NO: 2740988 - RNA, 18 nt, Human
gauuuccguuaaaauacc

SEQ ID NO: 2740989 - RNA, 15 nt, Human
gauuuccguuaaaau

SEQ ID NO: 2740990 - RNA, 16 nt, Human
gauugcaccacugcac

SEQ ID NO: 2740991 - RNA, 23 nt, Human
gauugcaccacugcacuccagcc

SEQ ID NO: 2740992 - RNA, 21 nt, Human
gauugcaacaggcugggcuuc

SEQ ID NO: 2740993 - RNA, 20 nt, Human
gauugcaacaggcugggcuu

SEQ ID NO: 2740994 - RNA, 18 nt, Human
gauucuuuccugaggcug

SEQ ID NO: 2740995 - RNA, 16 nt, Human
gauucuuuccugaggc

SEQ ID NO: 2740996 - RNA, 17 nt, Human
gauucuuuccugaggcu

SEQ ID NO: 2740997 - RNA, 12 nt, Human
gauucuuuccug

SEQ ID NO: 2740998 - RNA, 21 nt, Human
gauucccaagcucugcuccuc

SEQ ID NO: 2740999 - RNA, 19 nt, Human
gauucccaagcucugcucc

SEQ ID NO: 2741000 - RNA, 20 nt, Human
gauucccaagcucugcuccu

SEQ ID NO: 2741001 - RNA, 19 nt, Human
gauucagacagcugccugg

SEQ ID NO: 2741002 - RNA, 13 nt, Human
gauucagcucugc

SEQ ID NO: 2741003 - RNA, 15 nt, Human
gauucagcucugcaa

SEQ ID NO: 2741004 - RNA, 23 nt, Human
gauggggcugcaccggcuggccu

SEQ ID NO: 2741005 - RNA, 18 nt, Human
gauucccaagcucugcuc

SEQ ID NO: 2741006 - RNA, 19 nt, Human
gauucauauuuacuucuua

SEQ ID NO: 2741007 - RNA, 18 nt, Human
gauucauauuuacuucuu

SEQ ID NO: 2741008 - RNA, 17 nt, Human
gauucauauuuacuucu

SEQ ID NO: 2741009 - RNA, 16 nt, Human
gcaguucagagcugcc

SEQ ID NO: 2741010 - RNA, 17 nt, Human
gcaguuauuaacacuaa

SEQ ID NO: 2741011 - RNA, 15 nt, Human
gcaguucugaagaag

SEQ ID NO: 2741012 - RNA, 17 nt, Human
gcaguucagagcugccc

SEQ ID NO: 2741013 - RNA, 18 nt, Human
gcaguucagagcugcccu

SEQ ID NO: 2741014 - RNA, 14 nt, Human
gcaguucugaagaa

SEQ ID NO: 2741015 - RNA, 17 nt, Human
gcaguucugaagaagau

SEQ ID NO: 2741016 - RNA, 13 nt, Human
gcauagaaguaaa

SEQ ID NO: 2741017 - RNA, 23 nt, Human
gcaguggugguuuucuguucuuu

SEQ ID NO: 2741018 - RNA, 22 nt, Human
gcaguggugguuuucuguucuu

SEQ ID NO: 2741019 - RNA, 13 nt, Human
gcagugggagcug

SEQ ID NO: 2741020 - RNA, 12 nt, Human
gcagugggagcu

SEQ ID NO: 2741021 - RNA, 14 nt, Human
gcagugggagcugc

SEQ ID NO: 2741022 - RNA, 15 nt, Human
gcagugggagcugcc

SEQ ID NO: 2741023 - RNA, 17 nt, Human
gcauagguuuaauaauu

SEQ ID NO: 2741024 - RNA, 20 nt, Human
gcauauauuuuuauauuuac

SEQ ID NO: 2741025 - RNA, 20 nt, Human
gcauauuuuucacauaucua

SEQ ID NO: 2741026 - RNA, 14 nt, Human
gcauauuuuucaca

SEQ ID NO: 2741027 - RNA, 15 nt, Human
gcauauuuuucacau

SEQ ID NO: 2741028 - RNA, 16 nt, Human
gcauauuuuucacaua

SEQ ID NO: 2741029 - RNA, 19 nt, Human
gcauauuuuucacauaucu

SEQ ID NO: 2741030 - RNA, 17 nt, Human
gcagggucucacucugu

SEQ ID NO: 2741031 - RNA, 18 nt, Human
gcagggucucacucuguc

SEQ ID NO: 2741032 - RNA, 14 nt, Human
gcagggcucagcgg

SEQ ID NO: 2741033 - RNA, 22 nt, Human
gcagggcucagcggggacagcu

SEQ ID NO: 2741034 - RNA, 15 nt, Human
gcaggcagccaggcc

SEQ ID NO: 2741035 - RNA, 16 nt, Human
gcaggcagccaggcca

SEQ ID NO: 2741036 - RNA, 19 nt, Human
gcagggcucagcggggaca

SEQ ID NO: 2741037 - RNA, 21 nt, Human
gcagggcucagcggggacagc

SEQ ID NO: 2741038 - RNA, 15 nt, Human
gcagugcaugcuguc

SEQ ID NO: 2741039 - RNA, 16 nt, Human
gcagugcaugcugucc

SEQ ID NO: 2741040 - RNA, 19 nt, Human
gcaggucuugaacuccugg

SEQ ID NO: 2741041 - RNA, 20 nt, Human
gcaggucuugaacuccuggc

SEQ ID NO: 2741042 - RNA, 22 nt, Human
gcagguccaggguuugaguuca

SEQ ID NO: 2741043 - RNA, 13 nt, Human
gcauuauauuuau

SEQ ID NO: 2741044 - RNA, 22 nt, Human
gcauguucucugaggacacuaa

SEQ ID NO: 2741045 - RNA, 15 nt, Human
gcauguucucugagg

SEQ ID NO: 2741046 - RNA, 21 nt, Human
gcauguucucugaggacacua

SEQ ID NO: 2741047 - RNA, 14 nt, Human
gcauguucucugag

SEQ ID NO: 2741048 - RNA, 18 nt, Human
gcaugcgggcuuccuccu

SEQ ID NO: 2741049 - RNA, 12 nt, Human
gcaucagcugcu

SEQ ID NO: 2741050 - RNA, 18 nt, Human
gcaugaaguaauaugcac

SEQ ID NO: 2741051 - RNA, 13 nt, Human
gcauuugcugaau

SEQ ID NO: 2741052 - RNA, 21 nt, Human
gcauuugaggucuguucuuuc

SEQ ID NO: 2741053 - RNA, 14 nt, Human
gcauuugcugaaua

SEQ ID NO: 2741054 - RNA, 16 nt, Human
gcauuuguuugaacug

SEQ ID NO: 2741055 - RNA, 16 nt, Human
gcauuuguguugaaga

SEQ ID NO: 2741056 - RNA, 19 nt, Human
gcauucaaauguauuacag

SEQ ID NO: 2741057 - RNA, 17 nt, Human
gcauuaucuagauacug

SEQ ID NO: 2741058 - RNA, 16 nt, Human
gccaaagccuccucca

SEQ ID NO: 2741059 - RNA, 19 nt, Human
gccaaagccuccuccagcc

SEQ ID NO: 2741060 - RNA, 13 nt, Human
gccaaagccaaag

SEQ ID NO: 2741061 - RNA, 20 nt, Human
gccaaagccaaagcuaggcc

SEQ ID NO: 2741062 - RNA, 16 nt, Human
gccaaagcuaggccug

SEQ ID NO: 2741063 - RNA, 22 nt, Human
gccaaagcuaggccuggccaga

SEQ ID NO: 2741064 - RNA, 12 nt, Human
gccaaaggaagc

SEQ ID NO: 2741065 - RNA, 18 nt, Human
gcauuuguuugaacugau

SEQ ID NO: 2741066 - RNA, 14 nt, Human
gccaaacucaccug

SEQ ID NO: 2741067 - RNA, 16 nt, Human
gccaaacucaccugcc

SEQ ID NO: 2741068 - RNA, 20 nt, Human
gcagccccuguucuggcaga

SEQ ID NO: 2741069 - RNA, 21 nt, Human
gcagccccuguucuggcagag

SEQ ID NO: 2741070 - RNA, 13 nt, Human
gcagcccugcaga

SEQ ID NO: 2741071 - RNA, 17 nt, Human
gcagccccauucugccu

SEQ ID NO: 2741072 - RNA, 23 nt, Human
gcagcaauaaagcagcguuucua

SEQ ID NO: 2741073 - RNA, 16 nt, Human
gcagcaauaaagcagc

SEQ ID NO: 2741074 - RNA, 18 nt, Human
gcagccccauucugccug

SEQ ID NO: 2741075 - RNA, 19 nt, Human
gcagccccauucugccugc

SEQ ID NO: 2741076 - RNA, 21 nt, Human
gcagccccauucugccugccc

SEQ ID NO: 2741077 - RNA, 24 nt, Human
gcagccccauucugccugcccagg

SEQ ID NO: 2741078 - RNA, 20 nt, Human
gcagaguugaagacagagcu

SEQ ID NO: 2741079 - RNA, 21 nt, Human
gcagaguugaagacagagcua

SEQ ID NO: 2741080 - RNA, 17 nt, Human
gcagacaguuaagagaa

SEQ ID NO: 2741081 - RNA, 18 nt, Human
gcagauuauucacugauu

SEQ ID NO: 2741082 - RNA, 22 nt, Human
gcagauacaggaaaagcugcug

SEQ ID NO: 2741083 - RNA, 12 nt, Human
gcaggcagccag

SEQ ID NO: 2741084 - RNA, 13 nt, Human
gcaggcagccagg

SEQ ID NO: 2741085 - RNA, 14 nt, Human
gcaggcagccaggc

SEQ ID NO: 2741086 - RNA, 20 nt, Human
gcaggaggaucacuugaguc

SEQ ID NO: 2741087 - RNA, 23 nt, Human
gcaggaggaucacuugaguccag

SEQ ID NO: 2741088 - RNA, 14 nt, Human
gcagcucaccucuc

SEQ ID NO: 2741089 - RNA, 15 nt, Human
gcagccuuggcaaac

SEQ ID NO: 2741090 - RNA, 15 nt, Human
gcagcucaccucucc

SEQ ID NO: 2741091 - RNA, 14 nt, Human
gcagcccugcagag

SEQ ID NO: 2741092 - RNA, 15 nt, Human
gcagcccugcagagg

SEQ ID NO: 2741093 - RNA, 16 nt, Human
gcagcccugcagaggg

SEQ ID NO: 2741094 - RNA, 17 nt, Human
gcagcccugcagagggc

SEQ ID NO: 2741095 - RNA, 12 nt, Human
gcagacaggacc

SEQ ID NO: 2741096 - RNA, 13 nt, Human
gcagacaggacca

SEQ ID NO: 2741097 - RNA, 15 nt, Human
gcagacaggaccagg

SEQ ID NO: 2741098 - RNA, 23 nt, Human
gcagacaggcaagcaccuccugc

SEQ ID NO: 2741099 - RNA, 19 nt, Human
gcagacaggcaagcaccuc

SEQ ID NO: 2741100 - RNA, 16 nt, Human
gcacugcuuccaguga

SEQ ID NO: 2741101 - RNA, 18 nt, Human
gcacugcuuccagugagg

SEQ ID NO: 2741102 - RNA, 22 nt, Human
gcacugcuuccagugaggcucu

SEQ ID NO: 2741103 - RNA, 20 nt, Human
gcacugcuuccagugaggcu

SEQ ID NO: 2741104 - RNA, 22 nt, Human
gcaccuggaauauauaaccagu

SEQ ID NO: 2741105 - RNA, 14 nt, Human
gcaccuuagacagu

SEQ ID NO: 2741106 - RNA, 17 nt, Human
gcaccuuagacaguccc

SEQ ID NO: 2741107 - RNA, 15 nt, Human
gcacccucaggcagg

SEQ ID NO: 2741108 - RNA, 21 nt, Human
gcaccuggaauauauaaccag

SEQ ID NO: 2741109 - RNA, 18 nt, Human
gcaccuggaauauauaac

SEQ ID NO: 2741110 - RNA, 18 nt, Human
gcaccuuagacagucccu

SEQ ID NO: 2741111 - RNA, 18 nt, Human
gcacggugaauggcuuug

SEQ ID NO: 2741112 - RNA, 12 nt, Human
gcacgauuucug

SEQ ID NO: 2741113 - RNA, 20 nt, Human
gcaccacugcacuccagccu

SEQ ID NO: 2741114 - RNA, 14 nt, Human
gcaauggcagccuu

SEQ ID NO: 2741115 - RNA, 12 nt, Human
gcaauggcagcc

SEQ ID NO: 2741116 - RNA, 13 nt, Human
gcaauggcagccu

SEQ ID NO: 2741117 - RNA, 15 nt, Human
gcaccagcagccugg

SEQ ID NO: 2741118 - RNA, 14 nt, Human
gcaccagcagccug

SEQ ID NO: 2741119 - RNA, 21 nt, Human
gcaccacugcacuccagccug

SEQ ID NO: 2741120 - RNA, 22 nt, Human
gcaccacugcacuccagccugg

SEQ ID NO: 2741121 - RNA, 16 nt, Human
gcaccagcagccugga

SEQ ID NO: 2741122 - RNA, 22 nt, Human
gcacccaccaucaugucuggcu

SEQ ID NO: 2741123 - RNA, 18 nt, Human
gcacccggccccugcugg

SEQ ID NO: 2741124 - RNA, 19 nt, Human
gcacccggccccugcuggu

SEQ ID NO: 2741125 - RNA, 15 nt, Human
gcgccuacaggagug

SEQ ID NO: 2741126 - RNA, 11 nt, Human
gcggacagcca

SEQ ID NO: 2741127 - RNA, 13 nt, Human
gcggacagccacg

SEQ ID NO: 2741128 - RNA, 15 nt, Human
gcggacagccacggc

SEQ ID NO: 2741129 - RNA, 19 nt, Human
gcgucucauacucaccuca

SEQ ID NO: 2741130 - RNA, 20 nt, Human
gcuaccuuuguauucucucc

SEQ ID NO: 2741131 - RNA, 16 nt, Human
gcuaccuuuguauucu

SEQ ID NO: 2741132 - RNA, 13 nt, Human
gcuauaggugcua

SEQ ID NO: 2741133 - RNA, 15 nt, Human
gcuaggaacacuccu

SEQ ID NO: 2741134 - RNA, 13 nt, Human
gcuaaacuuuucu

SEQ ID NO: 2741135 - RNA, 17 nt, Human
gcuaaacuuuucugaua

SEQ ID NO: 2741136 - RNA, 15 nt, Human
gcuaaacuuuucuga

SEQ ID NO: 2741137 - RNA, 13 nt, Human
gcuaagagggagg

SEQ ID NO: 2741138 - RNA, 14 nt, Human
gcuacacaggggaa

SEQ ID NO: 2741139 - RNA, 20 nt, Human
gcuaagagggagggagggcu

SEQ ID NO: 2741140 - RNA, 20 nt, Human
gcuacacacugcauguuugu

SEQ ID NO: 2741141 - RNA, 13 nt, Human
gcuacacacugca

SEQ ID NO: 2741142 - RNA, 21 nt, Human
gccuuccaggggugggacacc

SEQ ID NO: 2741143 - RNA, 15 nt, Human
gccuuccaggggugg

SEQ ID NO: 2741144 - RNA, 16 nt, Human
gccuuccagggguggg

SEQ ID NO: 2741145 - RNA, 12 nt, Human
gccuuccagggg

SEQ ID NO: 2741146 - RNA, 16 nt, Human
gccuuauggaacacuc

SEQ ID NO: 2741147 - RNA, 18 nt, Human
gccuuauggaacacucug

SEQ ID NO: 2741148 - RNA, 19 nt, Human
gccuuauggaacacucuga

SEQ ID NO: 2741149 - RNA, 20 nt, Human
gccuuauggaacacucugag

SEQ ID NO: 2741150 - RNA, 13 nt, Human
gccuuuggcuuca

SEQ ID NO: 2741151 - RNA, 23 nt, Human
gccuuuuucauuauuuuauuaug

SEQ ID NO: 2741152 - RNA, 23 nt, Human
gcgacaaugcaaaccaucauuga

SEQ ID NO: 2741153 - RNA, 14 nt, Human
gccugguggcagcu

SEQ ID NO: 2741154 - RNA, 18 nt, Human
gccugguggcagcugcgg

SEQ ID NO: 2741155 - RNA, 19 nt, Human
gccugguggcagcugcggu

SEQ ID NO: 2741156 - RNA, 21 nt, Human
gccugguggcagcugcggucc

SEQ ID NO: 2741157 - RNA, 13 nt, Human
gccugguggcagc

SEQ ID NO: 2741158 - RNA, 15 nt, Human
gccugcaauuucaua

SEQ ID NO: 2741159 - RNA, 22 nt, Human
gccugggggcugggcagaggaa

SEQ ID NO: 2741160 - RNA, 10 nt, Human
gccuuaugga

SEQ ID NO: 2741161 - RNA, 14 nt, Human
gccuuauggaacac

SEQ ID NO: 2741162 - RNA, 19 nt, Human
gccuuagaagucacacagu

SEQ ID NO: 2741163 - RNA, 17 nt, Human
gccuuagaagucacaca

SEQ ID NO: 2741164 - RNA, 18 nt, Human
gccuuagaagucacacag

SEQ ID NO: 2741165 - RNA, 20 nt, Human
gccuuacacaaugguuuucu

SEQ ID NO: 2741166 - RNA, 18 nt, Human
gccuuacccucauguucu

SEQ ID NO: 2741167 - RNA, 21 nt, Human
gccuuacacaaugguuuucuu

SEQ ID NO: 2741168 - RNA, 21 nt, Human
gccuguugggccaggagccuc

SEQ ID NO: 2741169 - RNA, 20 nt, Human
gccguguaaccauggaccca

SEQ ID NO: 2741170 - RNA, 15 nt, Human
gccgucuaccugagg

SEQ ID NO: 2741171 - RNA, 16 nt, Human
gccgucuaccugaggg

SEQ ID NO: 2741172 - RNA, 17 nt, Human
gccgucuaccugagggg

SEQ ID NO: 2741173 - RNA, 21 nt, Human
gccuaaauccauuuggaaauc

SEQ ID NO: 2741174 - RNA, 19 nt, Human
gccuaaauccauuuggaaa

SEQ ID NO: 2741175 - RNA, 13 nt, Human
gccuaaauccauu

SEQ ID NO: 2741176 - RNA, 12 nt, Human
gccuaaauccau

SEQ ID NO: 2741177 - RNA, 23 nt, Human
gccuaaauccauuuggaaaucuu

SEQ ID NO: 2741178 - RNA, 22 nt, Human
gccuaaauccauuuggaaaucu

SEQ ID NO: 2741179 - RNA, 17 nt, Human
gccucaaccuccugggc

SEQ ID NO: 2741180 - RNA, 13 nt, Human
gccucacaguccu

SEQ ID NO: 2741181 - RNA, 17 nt, Human
gccucacaguccuuacc

SEQ ID NO: 2741182 - RNA, 18 nt, Human
gccucaaccuccugggcu

SEQ ID NO: 2741183 - RNA, 19 nt, Human
gccucaaccuccugggcua

SEQ ID NO: 2741184 - RNA, 21 nt, Human
gccgggcgcgguggcucacgc

SEQ ID NO: 2741185 - RNA, 11 nt, Human
gccgcagcccu

SEQ ID NO: 2741186 - RNA, 12 nt, Human
gccgcagcccug

SEQ ID NO: 2741187 - RNA, 22 nt, Human
gccgagaucacgccacugcacu

SEQ ID NO: 2741188 - RNA, 20 nt, Human
gccgagaucacgccacugca

SEQ ID NO: 2741189 - RNA, 21 nt, Human
gccgagaucacgccacugcac

SEQ ID NO: 2741190 - RNA, 16 nt, Human
gcccugcuuucagaua

SEQ ID NO: 2741191 - RNA, 14 nt, Human
gcccugcuuucaga

SEQ ID NO: 2741192 - RNA, 14 nt, Human
gcccuucucuccag

SEQ ID NO: 2741193 - RNA, 16 nt, Human
gcccuucucuccagcc

SEQ ID NO: 2741194 - RNA, 17 nt, Human
gcccuucucuccagccc

SEQ ID NO: 2741195 - RNA, 18 nt, Human
gcccuucucuccagcccc

SEQ ID NO: 2741196 - RNA, 17 nt, Human
gccuccccuccucugcu

SEQ ID NO: 2741197 - RNA, 19 nt, Human
gccuccccuccucugcuug

SEQ ID NO: 2741198 - RNA, 17 nt, Human
gccucccaucacccgcu

SEQ ID NO: 2741199 - RNA, 16 nt, Human
gccuccccuccucugc

SEQ ID NO: 2741200 - RNA, 23 nt, Human
gccuccccuccucugcuugccau

SEQ ID NO: 2741201 - RNA, 17 nt, Human
gccucccgaguagcugg

SEQ ID NO: 2741202 - RNA, 20 nt, Human
gccuccccuccucugcuugc

SEQ ID NO: 2741203 - RNA, 22 nt, Human
gccuccccuccucugcuugcca

SEQ ID NO: 2741204 - RNA, 20 nt, Human
gccucccgaguagcugggac

SEQ ID NO: 2741205 - RNA, 18 nt, Human
gccucccgaguagcuggg

SEQ ID NO: 2741206 - RNA, 19 nt, Human
gccucccgaguagcuggga

SEQ ID NO: 2741207 - RNA, 18 nt, Human
gccucacaguccuuacca

SEQ ID NO: 2741208 - RNA, 15 nt, Human
gccucagcauccugg

SEQ ID NO: 2741209 - RNA, 16 nt, Human
gccucagcauccuggc

SEQ ID NO: 2741210 - RNA, 18 nt, Human
gccucccaaagugcuggg

SEQ ID NO: 2741211 - RNA, 19 nt, Human
gccucccaaagugcuggga

SEQ ID NO: 2741212 - RNA, 13 nt, Human
gccucccaacuca

SEQ ID NO: 2741213 - RNA, 14 nt, Human
gccucccaucaccc

SEQ ID NO: 2741214 - RNA, 16 nt, Human
gccucccaucacccgc

SEQ ID NO: 2741215 - RNA, 16 nt, Human
gccucccaacucaccc

SEQ ID NO: 2741216 - RNA, 17 nt, Human
gccucccaacucacccc

SEQ ID NO: 2741217 - RNA, 18 nt, Human
gccucccaacucacccca

SEQ ID NO: 2741218 - RNA, 19 nt, Human
gccucccaacucaccccag

SEQ ID NO: 2741219 - RNA, 12 nt, Human
gccucugccucu

SEQ ID NO: 2741220 - RNA, 13 nt, Human
gccucugccucug

SEQ ID NO: 2741221 - RNA, 13 nt, Human
gccugcaagggag

SEQ ID NO: 2741222 - RNA, 15 nt, Human
gccugcaagggagug

SEQ ID NO: 2741223 - RNA, 13 nt, Human
gccucucucaggc

SEQ ID NO: 2741224 - RNA, 14 nt, Human
gccucucucaggcc

SEQ ID NO: 2741225 - RNA, 17 nt, Human
gccucugacacacagcu

SEQ ID NO: 2741226 - RNA, 18 nt, Human
gccucugacacacagcuc

SEQ ID NO: 2741227 - RNA, 16 nt, Human
gccucucucaggccaa

SEQ ID NO: 2741228 - RNA, 19 nt, Human
gccucugacacacagcucu

SEQ ID NO: 2741229 - RNA, 20 nt, Human
gccucugacacacagcucug

SEQ ID NO: 2741230 - RNA, 21 nt, Human
gccucugacacacagcucugu

SEQ ID NO: 2741231 - RNA, 14 nt, Human
gccucugcacuccc

SEQ ID NO: 2741232 - RNA, 19 nt, Human
gccaugggcacugugggua

SEQ ID NO: 2741233 - RNA, 24 nt, Human
gccaugcuccuggcccacugcauc

SEQ ID NO: 2741234 - RNA, 15 nt, Human
gccaugggccuccug

SEQ ID NO: 2741235 - RNA, 16 nt, Human
gccaugggccuccugu

SEQ ID NO: 2741236 - RNA, 14 nt, Human
gcccacuucugcca

SEQ ID NO: 2741237 - RNA, 13 nt, Human
gcccaccuuggcu

SEQ ID NO: 2741238 - RNA, 15 nt, Human
gcccaccuuggcuca

SEQ ID NO: 2741239 - RNA, 16 nt, Human
gcccaccuuggcucaa

SEQ ID NO: 2741240 - RNA, 17 nt, Human
gcccaccuuggcucaag

SEQ ID NO: 2741241 - RNA, 15 nt, Human
gcccaccuggccucu

SEQ ID NO: 2741242 - RNA, 16 nt, Human
gcccaccuggccucug

SEQ ID NO: 2741243 - RNA, 17 nt, Human
gcccaccuggccucugc

SEQ ID NO: 2741244 - RNA, 20 nt, Human
gcccaccuggccucugcacu

SEQ ID NO: 2741245 - RNA, 21 nt, Human
gcccaccuggccucugcacuc

SEQ ID NO: 2741246 - RNA, 24 nt, Human
gcccaccuggccucugcacucccc

SEQ ID NO: 2741247 - RNA, 18 nt, Human
gccaucccucccuccacc

SEQ ID NO: 2741248 - RNA, 23 nt, Human
gccaucccucccuccaccucccu

SEQ ID NO: 2741249 - RNA, 20 nt, Human
gccaugaggaacaaggcaag

SEQ ID NO: 2741250 - RNA, 14 nt, Human
gccaugcuccuggc

SEQ ID NO: 2741251 - RNA, 21 nt, Human
gccagucaccccggccaccug

SEQ ID NO: 2741252 - RNA, 13 nt, Human
gccaggcuggucu

SEQ ID NO: 2741253 - RNA, 15 nt, Human
gccaggcuggucuca

SEQ ID NO: 2741254 - RNA, 12 nt, Human
gccaguaaaugg

SEQ ID NO: 2741255 - RNA, 23 nt, Human
gccaguaaaugggggugcauuug

SEQ ID NO: 2741256 - RNA, 15 nt, Human
gccaggaagccagca

SEQ ID NO: 2741257 - RNA, 20 nt, Human
gccaggaagccagcaggcuc

SEQ ID NO: 2741258 - RNA, 14 nt, Human
gccaggagccuccu

SEQ ID NO: 2741259 - RNA, 16 nt, Human
gccaggagccuccugc

SEQ ID NO: 2741260 - RNA, 19 nt, Human
gccaggagccuccugcccu

SEQ ID NO: 2741261 - RNA, 20 nt, Human
gccaggagccuccugcccuu

SEQ ID NO: 2741262 - RNA, 16 nt, Human
gccagcugcuugggcu

SEQ ID NO: 2741263 - RNA, 17 nt, Human
gccagcugcuugggcuu

SEQ ID NO: 2741264 - RNA, 18 nt, Human
gccagcugcuugggcuuc

SEQ ID NO: 2741265 - RNA, 20 nt, Human
gccagcugcuugggcuucau

SEQ ID NO: 2741266 - RNA, 12 nt, Human
gccaggaagcca

SEQ ID NO: 2741267 - RNA, 13 nt, Human
gccaggaagccag

SEQ ID NO: 2741268 - RNA, 14 nt, Human
gccaggaagccagc

SEQ ID NO: 2741269 - RNA, 22 nt, Human
gccagccgagauagccaaggcc

SEQ ID NO: 2741270 - RNA, 19 nt, Human
gccagauucuuuccugagg

SEQ ID NO: 2741271 - RNA, 15 nt, Human
gccagaugcaccagc

SEQ ID NO: 2741272 - RNA, 20 nt, Human
gccagauucuuuccugaggc

SEQ ID NO: 2741273 - RNA, 24 nt, Human
gccagauucuuuccugaggcuggg

SEQ ID NO: 2741274 - RNA, 13 nt, Human
gccagauuucacu

SEQ ID NO: 2741275 - RNA, 17 nt, Human
gccagagggagugacag

SEQ ID NO: 2741276 - RNA, 14 nt, Human
gccagaugcaccag

SEQ ID NO: 2741277 - RNA, 20 nt, Human
gccacugcaccgggccacag

SEQ ID NO: 2741278 - RNA, 21 nt, Human
gccacugcaccgggccacaga

SEQ ID NO: 2741279 - RNA, 19 nt, Human
gccacugcaccgggccaca

SEQ ID NO: 2741280 - RNA, 22 nt, Human
gccagagacacaagccuucggc

SEQ ID NO: 2741281 - RNA, 22 nt, Human
gccacugcaccgggccacagag

SEQ ID NO: 2741282 - RNA, 21 nt, Human
gccagagacacaagccuucgg

SEQ ID NO: 2741283 - RNA, 20 nt, Human
gccaaggccaaaggaagcac

SEQ ID NO: 2741284 - RNA, 19 nt, Human
gccaaggccaaaggaagca

SEQ ID NO: 2741285 - RNA, 24 nt, Human
gccaaggccaaaggaagcacaugc

SEQ ID NO: 2741286 - RNA, 15 nt, Human
gcccugcagagggca

SEQ ID NO: 2741287 - RNA, 13 nt, Human
gcccugcagaggg

SEQ ID NO: 2741288 - RNA, 14 nt, Human
gcccugcagagggc

SEQ ID NO: 2741289 - RNA, 14 nt, Human
gcccugagcuuucu

SEQ ID NO: 2741290 - RNA, 13 nt, Human
gcccucugcccac

SEQ ID NO: 2741291 - RNA, 16 nt, Human
gcccucugcccacucc

SEQ ID NO: 2741292 - RNA, 18 nt, Human
gcccucugcccacucccu

SEQ ID NO: 2741293 - RNA, 19 nt, Human
gcccucugcccacucccug

SEQ ID NO: 2741294 - RNA, 19 nt, Human
gcccuccaagaccuucucc

SEQ ID NO: 2741295 - RNA, 21 nt, Human
gcccuccaagaccuucuccuu

SEQ ID NO: 2741296 - RNA, 22 nt, Human
gcccuccaagaccuucuccuuc

SEQ ID NO: 2741297 - RNA, 23 nt, Human
gcccuccaagaccuucuccuuca

SEQ ID NO: 2741298 - RNA, 15 nt, Human
gccccgaggccuucu

SEQ ID NO: 2741299 - RNA, 18 nt, Human
gccccgaggccuucucug

SEQ ID NO: 2741300 - RNA, 14 nt, Human
gccccucagggucc

SEQ ID NO: 2741301 - RNA, 16 nt, Human
gccccucagggucccu

SEQ ID NO: 2741302 - RNA, 18 nt, Human
gccccucagggucccugg

SEQ ID NO: 2741303 - RNA, 12 nt, Human
gccccagugccc

SEQ ID NO: 2741304 - RNA, 13 nt, Human
gccccagugccca

SEQ ID NO: 2741305 - RNA, 14 nt, Human
gccccagugcccac

SEQ ID NO: 2741306 - RNA, 18 nt, Human
gccccaucccaaacccuu

SEQ ID NO: 2741307 - RNA, 15 nt, Human
gccccauucugccug

SEQ ID NO: 2741308 - RNA, 14 nt, Human
gccccauucugccu

SEQ ID NO: 2741309 - RNA, 13 nt, Human
gccccauccucug

SEQ ID NO: 2741310 - RNA, 14 nt, Human
gccccauccucugu

SEQ ID NO: 2741311 - RNA, 22 nt, Human
gccccauccucuguacagagcc

SEQ ID NO: 2741312 - RNA, 12 nt, Human
gcccaggcuggc

SEQ ID NO: 2741313 - RNA, 15 nt, Human
gcccagagagggugg

SEQ ID NO: 2741314 - RNA, 21 nt, Human
gcccagagaggguggugaccu

SEQ ID NO: 2741315 - RNA, 23 nt, Human
gcccaggccccugccacccuggg

SEQ ID NO: 2741316 - RNA, 13 nt, Human
gcccaggccuccu

SEQ ID NO: 2741317 - RNA, 22 nt, Human
gcccaguuggguggaugccugg

SEQ ID NO: 2741318 - RNA, 20 nt, Human
uuuuaauaauguuucaaaca

SEQ ID NO: 2741319 - RNA, 12 nt, Human
uuuuaaaugcac

SEQ ID NO: 2741320 - RNA, 11 nt, Human
uuuuaaaugca

SEQ ID NO: 2741321 - RNA, 21 nt, Human
uuuuaaaugcaccuggaauau

SEQ ID NO: 2741322 - RNA, 21 nt, Human
uuuuaaaagaaugauuaugaa

SEQ ID NO: 2741323 - RNA, 15 nt, Human
uuuuaaaagaaugau

SEQ ID NO: 2741324 - RNA, 17 nt, Human
uuuuaaagaaugcucuu

SEQ ID NO: 2741325 - RNA, 21 nt, Human
uuuguucuggcucuuccaggc

SEQ ID NO: 2741326 - RNA, 13 nt, Human
uuuguauaaaaua

SEQ ID NO: 2741327 - RNA, 14 nt, Human
uuuguauaaaauaa

SEQ ID NO: 2741328 - RNA, 16 nt, Human
uuuguauaaaauaauu

SEQ ID NO: 2741329 - RNA, 19 nt, Human
uuugguuuucacauuggaa

SEQ ID NO: 2741330 - RNA, 21 nt, Human
uuuggaauuuugugcccccau

SEQ ID NO: 2741331 - RNA, 16 nt, Human
uuuggauaauaaggaa

SEQ ID NO: 2741332 - RNA, 16 nt, Human
uuugcuuugugauuuu

SEQ ID NO: 2741333 - RNA, 15 nt, Human
uuugcuuugugauuu

SEQ ID NO: 2741334 - RNA, 22 nt, Human
uuuggaauuuuccuccuuucuc

SEQ ID NO: 2741335 - RNA, 14 nt, Human
uuuggaauuuugug

SEQ ID NO: 2741336 - RNA, 13 nt, Human
uuucugagaaaga

SEQ ID NO: 2741337 - RNA, 20 nt, Human
uuucuguucuuucuggcuau

SEQ ID NO: 2741338 - RNA, 19 nt, Human
uuucugaaauuuccuggga

SEQ ID NO: 2741339 - RNA, 21 nt, Human
uuucugaaauuuccugggagc

SEQ ID NO: 2741340 - RNA, 18 nt, Human
uuucucugauacagaaaa

SEQ ID NO: 2741341 - RNA, 17 nt, Human
uuucucugauacagaaa

SEQ ID NO: 2741342 - RNA, 16 nt, Human
uuucucugauacagaa

SEQ ID NO: 2741343 - RNA, 15 nt, Human
uuucucugauacaga

SEQ ID NO: 2741344 - RNA, 23 nt, Human
uuucuacucgaguuacagacaaa

SEQ ID NO: 2741345 - RNA, 18 nt, Human
uuucuaaaggcuaccuuu

SEQ ID NO: 2741346 - RNA, 21 nt, Human
uuucuaaaggcuaccuuugua

SEQ ID NO: 2741347 - RNA, 20 nt, Human
uuucuaaaggcuaccuuugu

SEQ ID NO: 2741348 - RNA, 16 nt, Human
uuuccugaggcugggc

SEQ ID NO: 2741349 - RNA, 17 nt, Human
uuaccacagacauacua

SEQ ID NO: 2741350 - RNA, 14 nt, Human
uuaccacagacaua

SEQ ID NO: 2741351 - RNA, 18 nt, Human
uuugaaucaucaagucuu

SEQ ID NO: 2741352 - RNA, 22 nt, Human
uuugaagaugccgcauuuggau

SEQ ID NO: 2741353 - RNA, 16 nt, Human
uuugaaucucauaauu

SEQ ID NO: 2741354 - RNA, 19 nt, Human
uuugaaucucauaauuuau

SEQ ID NO: 2741355 - RNA, 20 nt, Human
uuugaaucucauaauuuaua

SEQ ID NO: 2741356 - RNA, 21 nt, Human
uuugaaucucauaauuuauac

SEQ ID NO: 2741357 - RNA, 22 nt, Human
uuugaaucucauaauuuauaca

SEQ ID NO: 2741358 - RNA, 19 nt, Human
uuugaacugauaaagauga

SEQ ID NO: 2741359 - RNA, 17 nt, Human
uuugaacugauaaagau

SEQ ID NO: 2741360 - RNA, 14 nt, Human
uuugaacucuucaa

SEQ ID NO: 2741361 - RNA, 15 nt, Human
uuugaacugauaaag

SEQ ID NO: 2741362 - RNA, 17 nt, Human
uuucuuauuucauuucu

SEQ ID NO: 2741363 - RNA, 23 nt, Human
uuucuuagggaaggauacaaaag

SEQ ID NO: 2741364 - RNA, 18 nt, Human
uuucuuagggaaggauac

SEQ ID NO: 2741365 - RNA, 13 nt, Human
uuucuucucccuc

SEQ ID NO: 2741366 - RNA, 12 nt, Human
uuucuucucccu

SEQ ID NO: 2741367 - RNA, 19 nt, Human
uuuuucucuaggaaauauu

SEQ ID NO: 2741368 - RNA, 23 nt, Human
uuuuucucugauacagaaaaguu

SEQ ID NO: 2741369 - RNA, 19 nt, Human
uuuuuccuucagugccuua

SEQ ID NO: 2741370 - RNA, 11 nt, Human
uuuuuccuuca

SEQ ID NO: 2741371 - RNA, 14 nt, Human
uuuuccugaaaacc

SEQ ID NO: 2741372 - RNA, 18 nt, Human
uuuuggucuggagggaag

SEQ ID NO: 2741373 - RNA, 15 nt, Human
uuuuggucuguguga

SEQ ID NO: 2741374 - RNA, 14 nt, Human
uuuuggcugcugaa

SEQ ID NO: 2741375 - RNA, 20 nt, Human
uuuugaaucucauaauuuau

SEQ ID NO: 2741376 - RNA, 20 nt, Human
uuuugacaaggggcaguggu

SEQ ID NO: 2741377 - RNA, 21 nt, Human
uuuuggcauaacauaaaucug

SEQ ID NO: 2741378 - RNA, 11 nt, Human
uuuugacagaa

SEQ ID NO: 2741379 - RNA, 18 nt, Human
uuuuuaaaaaagaaacau

SEQ ID NO: 2741380 - RNA, 16 nt, Human
uuuugucauauaagau

SEQ ID NO: 2741381 - RNA, 19 nt, Human
uuuuguagagccagggucu

SEQ ID NO: 2741382 - RNA, 19 nt, Human
uuuuguagcacugacagau

SEQ ID NO: 2741383 - RNA, 18 nt, Human
uuuuguagcacugacaga

SEQ ID NO: 2741384 - RNA, 22 nt, Human
gucagcuccccucggagaagag

SEQ ID NO: 2741385 - RNA, 21 nt, Human
gucagcuccccucggagaaga

SEQ ID NO: 2741386 - RNA, 23 nt, Human
gucagcuccccucggagaagagc

SEQ ID NO: 2741387 - RNA, 21 nt, Human
gucauucagauaugauucaaa

SEQ ID NO: 2741388 - RNA, 21 nt, Human
gucccaccuuggcugcaggga

SEQ ID NO: 2741389 - RNA, 23 nt, Human
guccacccaggagccccgaggcc

SEQ ID NO: 2741390 - RNA, 12 nt, Human
guccacccagga

SEQ ID NO: 2741391 - RNA, 17 nt, Human
guccccaccgcagacag

SEQ ID NO: 2741392 - RNA, 20 nt, Human
gucccaccuuggcugcaggg

SEQ ID NO: 2741393 - RNA, 23 nt, Human
gucccaccuuggcugcagggagu

SEQ ID NO: 2741394 - RNA, 16 nt, Human
gucccugcacuugcag

SEQ ID NO: 2741395 - RNA, 19 nt, Human
gucccugcacuugcagacu

SEQ ID NO: 2741396 - RNA, 21 nt, Human
gucccugcacuugcagacucu

SEQ ID NO: 2741397 - RNA, 23 nt, Human
gucaauaaaauccauacauuugu

SEQ ID NO: 2741398 - RNA, 22 nt, Human
gucaauaaaauccauacauuug

SEQ ID NO: 2741399 - RNA, 15 nt, Human
gucaagugaaaaagg

SEQ ID NO: 2741400 - RNA, 19 nt, Human
guauuuuguuuuugucuua

SEQ ID NO: 2741401 - RNA, 15 nt, Human
gucaccccggccacc

SEQ ID NO: 2741402 - RNA, 18 nt, Human
guauuuuaaaagaaugau

SEQ ID NO: 2741403 - RNA, 20 nt, Human
guauuuuaaaagaaugauua

SEQ ID NO: 2741404 - RNA, 21 nt, Human
guauuaagcauauauuuuuau

SEQ ID NO: 2741405 - RNA, 18 nt, Human
guauuaagcauauauuuu

SEQ ID NO: 2741406 - RNA, 15 nt, Human
guauuaagcauauau

SEQ ID NO: 2741407 - RNA, 17 nt, Human
guauuaagcauauauuu

SEQ ID NO: 2741408 - RNA, 16 nt, Human
guauuaagcauauauu

SEQ ID NO: 2741409 - RNA, 14 nt, Human
guauuuuacuaaua

SEQ ID NO: 2741410 - RNA, 19 nt, Human
gucagcuccccucggagaa

SEQ ID NO: 2741411 - RNA, 18 nt, Human
gucagaucugccuaagga

SEQ ID NO: 2741412 - RNA, 16 nt, Human
gucagaucugccuaag

SEQ ID NO: 2741413 - RNA, 21 nt, Human
gucagaucugccuaaggacuu

SEQ ID NO: 2741414 - RNA, 20 nt, Human
gucagaucugccuaaggacu

SEQ ID NO: 2741415 - RNA, 19 nt, Human
gucagaucugccuaaggac

SEQ ID NO: 2741416 - RNA, 14 nt, Human
gucagagccugcag

SEQ ID NO: 2741417 - RNA, 15 nt, Human
gucagagccugcagu

SEQ ID NO: 2741418 - RNA, 16 nt, Human
gucagagccugcaguu

SEQ ID NO: 2741419 - RNA, 22 nt, Human
gucaccccggccaccugcggug

SEQ ID NO: 2741420 - RNA, 17 nt, Human
gucaccccggccaccug

SEQ ID NO: 2741421 - RNA, 18 nt, Human
gucaccccggccaccugc

SEQ ID NO: 2741422 - RNA, 17 nt, Human
gucacucuggcagcuca

SEQ ID NO: 2741423 - RNA, 19 nt, Human
gucacucuggcagcucaga

SEQ ID NO: 2741424 - RNA, 12 nt, Human
gucacucuggca

SEQ ID NO: 2741425 - RNA, 13 nt, Human
gucacucuggcag

SEQ ID NO: 2741426 - RNA, 14 nt, Human
gucacucuggcagc

SEQ ID NO: 2741427 - RNA, 16 nt, Human
gucacucuggcagcuc

SEQ ID NO: 2741428 - RNA, 14 nt, Human
guaguguuggagaa

SEQ ID NO: 2741429 - RNA, 15 nt, Human
guaguguuggagaag

SEQ ID NO: 2741430 - RNA, 10 nt, Human
guauaauuaa

SEQ ID NO: 2741431 - RNA, 14 nt, Human
guauaauuaacaug

SEQ ID NO: 2741432 - RNA, 13 nt, Human
guauaauuaacau

SEQ ID NO: 2741433 - RNA, 23 nt, Human
guauaauuaacauguuaaaccau

SEQ ID NO: 2741434 - RNA, 22 nt, Human
guauaauuaacauguuaaacca

SEQ ID NO: 2741435 - RNA, 19 nt, Human
guauaauuaacauguuaaa

SEQ ID NO: 2741436 - RNA, 17 nt, Human
guauaauuaacauguua

SEQ ID NO: 2741437 - RNA, 15 nt, Human
guauaauuaacaugu

SEQ ID NO: 2741438 - RNA, 16 nt, Human
guaggguuauaauaau

SEQ ID NO: 2741439 - RNA, 14 nt, Human
guagucaggugccu

SEQ ID NO: 2741440 - RNA, 18 nt, Human
gcuauaggugcuacaaaa

SEQ ID NO: 2741441 - RNA, 15 nt, Human
guagagugugccuga

SEQ ID NO: 2741442 - RNA, 16 nt, Human
guagcauccuggaaua

SEQ ID NO: 2741443 - RNA, 14 nt, Human
guagcacugacaga

SEQ ID NO: 2741444 - RNA, 15 nt, Human
guagcacugacagau

SEQ ID NO: 2741445 - RNA, 16 nt, Human
guagggcgggaggaug

SEQ ID NO: 2741446 - RNA, 23 nt, Human
guagggcgggaggauguucuggg

SEQ ID NO: 2741447 - RNA, 21 nt, Human
guagggcgggaggauguucug

SEQ ID NO: 2741448 - RNA, 22 nt, Human
guagggcgggaggauguucugg

SEQ ID NO: 2741449 - RNA, 21 nt, Human
guagcauuuguguugaagagg

SEQ ID NO: 2741450 - RNA, 17 nt, Human
guauguuagugcaaauu

SEQ ID NO: 2741451 - RNA, 21 nt, Human
guaugaucacggcucacugca

SEQ ID NO: 2741452 - RNA, 21 nt, Human
guaugugugaagugagugagu

SEQ ID NO: 2741453 - RNA, 20 nt, Human
guaugaucacggcucacugc

SEQ ID NO: 2741454 - RNA, 20 nt, Human
guaugaggcauuuguuugaa

SEQ ID NO: 2741455 - RNA, 17 nt, Human
guaugaggcauuuguuu

SEQ ID NO: 2741456 - RNA, 19 nt, Human
guaucuggugacuuuccuc

SEQ ID NO: 2741457 - RNA, 12 nt, Human
guaucugagcag

SEQ ID NO: 2741458 - RNA, 12 nt, Human
guaucuggugac

SEQ ID NO: 2741459 - RNA, 15 nt, Human
guaugaggcauuugu

SEQ ID NO: 2741460 - RNA, 13 nt, Human
guaugaggcauuu

SEQ ID NO: 2741461 - RNA, 13 nt, Human
guaugaaauuaua

SEQ ID NO: 2741462 - RNA, 23 nt, Human
guaugaaauuauauaaguauucu

SEQ ID NO: 2741463 - RNA, 14 nt, Human
guauagauuagaau

SEQ ID NO: 2741464 - RNA, 19 nt, Human
guauagaaccucuuugucu

SEQ ID NO: 2741465 - RNA, 22 nt, Human
guauaugucaagccauaauugu

SEQ ID NO: 2741466 - RNA, 18 nt, Human
gucugugccauuuuguau

SEQ ID NO: 2741467 - RNA, 17 nt, Human
gucuguucuuuccaaag

SEQ ID NO: 2741468 - RNA, 14 nt, Human
gucuguucuuucca

SEQ ID NO: 2741469 - RNA, 15 nt, Human
gucuugucucagauu

SEQ ID NO: 2741470 - RNA, 16 nt, Human
gucuuuuuucacuaca

SEQ ID NO: 2741471 - RNA, 22 nt, Human
gucuugucucagauuuuauuau

SEQ ID NO: 2741472 - RNA, 20 nt, Human
gucuugucucagauuuuauu

SEQ ID NO: 2741473 - RNA, 20 nt, Human
gucuugccuuuuucauuauu

SEQ ID NO: 2741474 - RNA, 18 nt, Human
gucuugccuuuuucauua

SEQ ID NO: 2741475 - RNA, 17 nt, Human
gucuugccuuuuucauu

SEQ ID NO: 2741476 - RNA, 16 nt, Human
gucuugccuuuuucau

SEQ ID NO: 2741477 - RNA, 15 nt, Human
gucuugccuuuuuca

SEQ ID NO: 2741478 - RNA, 23 nt, Human
gucuugcaauggcagccuuggca

SEQ ID NO: 2741479 - RNA, 20 nt, Human
gucuugcaauggcagccuug

SEQ ID NO: 2741480 - RNA, 21 nt, Human
gucuugcaauggcagccuugg

SEQ ID NO: 2741481 - RNA, 21 nt, Human
gucuuaaaaaguggaaaaaua

SEQ ID NO: 2741482 - RNA, 16 nt, Human
gucuugaacuccuggc

SEQ ID NO: 2741483 - RNA, 17 nt, Human
gucuugaacuccuggcc

SEQ ID NO: 2741484 - RNA, 21 nt, Human
gucuugaacuccuggccucaa

SEQ ID NO: 2741485 - RNA, 18 nt, Human
gucuugaacuccuggccu

SEQ ID NO: 2741486 - RNA, 20 nt, Human
gucuugaacuccuggccuca

SEQ ID NO: 2741487 - RNA, 16 nt, Human
gucuugcaauggcagc

SEQ ID NO: 2741488 - RNA, 17 nt, Human
gucuugcaauggcagcc

SEQ ID NO: 2741489 - RNA, 18 nt, Human
gucuugcaauggcagccu

SEQ ID NO: 2741490 - RNA, 19 nt, Human
gucuugcaauggcagccuu

SEQ ID NO: 2741491 - RNA, 18 nt, Human
gucgucaaagcugaaaug

SEQ ID NO: 2741492 - RNA, 18 nt, Human
gucucacuauguugccca

SEQ ID NO: 2741493 - RNA, 11 nt, Human
gucucacucug

SEQ ID NO: 2741494 - RNA, 19 nt, Human
gucucacuauguugcccag

SEQ ID NO: 2741495 - RNA, 13 nt, Human
gucuaaauuugaa

SEQ ID NO: 2741496 - RNA, 21 nt, Human
gucuaagauaguaacaaugaa

SEQ ID NO: 2741497 - RNA, 21 nt, Human
gucggaaaacaugcuacacac

SEQ ID NO: 2741498 - RNA, 23 nt, Human
gucggguuuuauuguuuaaaauc

SEQ ID NO: 2741499 - RNA, 16 nt, Human
gucgggcaugacacga

SEQ ID NO: 2741500 - RNA, 15 nt, Human
gucccugccaaugga

SEQ ID NO: 2741501 - RNA, 11 nt, Human
gucccugccaa

SEQ ID NO: 2741502 - RNA, 14 nt, Human
gucccugccaaugg

SEQ ID NO: 2741503 - RNA, 21 nt, Human
guccuuaccagcagagcaccu

SEQ ID NO: 2741504 - RNA, 18 nt, Human
guccuuaccagcagagca

SEQ ID NO: 2741505 - RNA, 19 nt, Human
guccuuaccagcagagcac

SEQ ID NO: 2741506 - RNA, 13 nt, Human
gucugacuguuuc

SEQ ID NO: 2741507 - RNA, 21 nt, Human
gucucagauuuuauuauguaa

SEQ ID NO: 2741508 - RNA, 17 nt, Human
gucucagauuuuauuau

SEQ ID NO: 2741509 - RNA, 15 nt, Human
gucucacucugucgc

SEQ ID NO: 2741510 - RNA, 16 nt, Human
gucucacucugucgcc

SEQ ID NO: 2741511 - RNA, 18 nt, Human
gucucacucugucgccca

SEQ ID NO: 2741512 - RNA, 19 nt, Human
gucucacucugucgcccag

SEQ ID NO: 2741513 - RNA, 22 nt, Human
gucucacucugucgcccagucu

SEQ ID NO: 2741514 - RNA, 14 nt, Human
gucucagauuuuau

SEQ ID NO: 2741515 - RNA, 16 nt, Human
gucucagauuuuauua

SEQ ID NO: 2741516 - RNA, 15 nt, Human
gucucagauuuuauu

SEQ ID NO: 2741517 - RNA, 14 nt, Human
gugcggccuuuggc

SEQ ID NO: 2741518 - RNA, 14 nt, Human
gugcgccuacagga

SEQ ID NO: 2741519 - RNA, 21 nt, Human
gugcgcuaaacuuuucugaua

SEQ ID NO: 2741520 - RNA, 17 nt, Human
gugcgcuaaacuuuucu

SEQ ID NO: 2741521 - RNA, 20 nt, Human
gugcuaaggacuuguuagau

SEQ ID NO: 2741522 - RNA, 14 nt, Human
gugcuaaggacuug

SEQ ID NO: 2741523 - RNA, 13 nt, Human
gugcuaaggacuu

SEQ ID NO: 2741524 - RNA, 12 nt, Human
gugcuaaggacu

SEQ ID NO: 2741525 - RNA, 14 nt, Human
gugccaugugccag

SEQ ID NO: 2741526 - RNA, 16 nt, Human
gugccaugugccaggu

SEQ ID NO: 2741527 - RNA, 21 nt, Human
gugcgaucuggguucacugca

SEQ ID NO: 2741528 - RNA, 22 nt, Human
gugcacuaauguguaagacaaa

SEQ ID NO: 2741529 - RNA, 23 nt, Human
gugauccacccaccucagccucc

SEQ ID NO: 2741530 - RNA, 24 nt, Human
gugauccacccaccucagccuccc

SEQ ID NO: 2741531 - RNA, 18 nt, Human
gugauuuuuguaauuuuu

SEQ ID NO: 2741532 - RNA, 13 nt, Human
gugauuuuuguaa

SEQ ID NO: 2741533 - RNA, 22 nt, Human
gugcauaccacuuuuguucuug

SEQ ID NO: 2741534 - RNA, 20 nt, Human
gugcaguggugcgaucuggg

SEQ ID NO: 2741535 - RNA, 23 nt, Human
gugcaguggugcgaucuggguuc

SEQ ID NO: 2741536 - RNA, 13 nt, Human
gugaacacaucag

SEQ ID NO: 2741537 - RNA, 16 nt, Human
gugacaagcucacaga

SEQ ID NO: 2741538 - RNA, 20 nt, Human
gugacaaggauugcuacugu

SEQ ID NO: 2741539 - RNA, 22 nt, Human
gugaauucuugaaggaaaauga

SEQ ID NO: 2741540 - RNA, 21 nt, Human
gugaaugaugauccuaggcau

SEQ ID NO: 2741541 - RNA, 18 nt, Human
gugaauucuugaaggaaa

SEQ ID NO: 2741542 - RNA, 12 nt, Human
gugacagaggca

SEQ ID NO: 2741543 - RNA, 13 nt, Human
gugacagaggcag

SEQ ID NO: 2741544 - RNA, 14 nt, Human
gugacagaggcagc

SEQ ID NO: 2741545 - RNA, 15 nt, Human
gugaccucugccuga

SEQ ID NO: 2741546 - RNA, 12 nt, Human
gugaccucugcc

SEQ ID NO: 2741547 - RNA, 15 nt, Human
gugacagaggcagcc

SEQ ID NO: 2741548 - RNA, 13 nt, Human
gugaccucugccu

SEQ ID NO: 2741549 - RNA, 14 nt, Human
gugaccucugccug

SEQ ID NO: 2741550 - RNA, 17 nt, Human
gugaggaugaaaaaaua

SEQ ID NO: 2741551 - RNA, 19 nt, Human
gugagccgagaucacgcca

SEQ ID NO: 2741552 - RNA, 14 nt, Human
gugagccacugcac

SEQ ID NO: 2741553 - RNA, 15 nt, Human
gugagccacugcacc

SEQ ID NO: 2741554 - RNA, 20 nt, Human
gugagccacugcaccgggcc

SEQ ID NO: 2741555 - RNA, 15 nt, Human
gugauacaaugcugu

SEQ ID NO: 2741556 - RNA, 17 nt, Human
gugauacaaugcugugc

SEQ ID NO: 2741557 - RNA, 17 nt, Human
gugaguugauagcacag

SEQ ID NO: 2741558 - RNA, 22 nt, Human
gugauccacccaccucagccuc

SEQ ID NO: 2741559 - RNA, 14 nt, Human
guucugaagaagau

SEQ ID NO: 2741560 - RNA, 15 nt, Human
guucugaagaagaug

SEQ ID NO: 2741561 - RNA, 12 nt, Human
guucugaagaag

SEQ ID NO: 2741562 - RNA, 13 nt, Human
guucugaagaaga

SEQ ID NO: 2741563 - RNA, 19 nt, Human
guucugauccuaguuccac

SEQ ID NO: 2741564 - RNA, 23 nt, Human
guugaaaagacuccaaagaaaug

SEQ ID NO: 2741565 - RNA, 22 nt, Human
guugaaaagacuccaaagaaau

SEQ ID NO: 2741566 - RNA, 17 nt, Human
guugaaaagacuccaaa

SEQ ID NO: 2741567 - RNA, 17 nt, Human
guugaaaaacagcugag

SEQ ID NO: 2741568 - RNA, 20 nt, Human
guucuuuccaaaguacacug

SEQ ID NO: 2741569 - RNA, 18 nt, Human
guucuuuccaaaguacac

SEQ ID NO: 2741570 - RNA, 14 nt, Human
guucuuuccaaagu

SEQ ID NO: 2741571 - RNA, 13 nt, Human
guucuuuccaaag

SEQ ID NO: 2741572 - RNA, 12 nt, Human
guucuggcucuu

SEQ ID NO: 2741573 - RNA, 16 nt, Human
guucuggcucuuccag

SEQ ID NO: 2741574 - RNA, 20 nt, Human
guucuggcucuuccaggcug

SEQ ID NO: 2741575 - RNA, 23 nt, Human
guucuggcagaguugaagacaga

SEQ ID NO: 2741576 - RNA, 11 nt, Human
guucugggaca

SEQ ID NO: 2741577 - RNA, 12 nt, Human
guucugggacac

SEQ ID NO: 2741578 - RNA, 14 nt, Human
guucugggacacag

SEQ ID NO: 2741579 - RNA, 15 nt, Human
guucugggacacagu

SEQ ID NO: 2741580 - RNA, 16 nt, Human
guucugggacacaguu

SEQ ID NO: 2741581 - RNA, 18 nt, Human
guucuuucacccuuuucu

SEQ ID NO: 2741582 - RNA, 21 nt, Human
guugauggugguauguuuuca

SEQ ID NO: 2741583 - RNA, 20 nt, Human
guugauggugguauguuuuc

SEQ ID NO: 2741584 - RNA, 22 nt, Human
guugaauuuauuggcuuuucug

SEQ ID NO: 2741585 - RNA, 21 nt, Human
guugaauuuauuggcuuuucu

SEQ ID NO: 2741586 - RNA, 14 nt, Human
guugaauuuauugg

SEQ ID NO: 2741587 - RNA, 16 nt, Human
guugaagacagagcua

SEQ ID NO: 2741588 - RNA, 18 nt, Human
guugaagagguuuuaaag

SEQ ID NO: 2741589 - RNA, 22 nt, Human
guugaaacggaugauuucuaug

SEQ ID NO: 2741590 - RNA, 21 nt, Human
guugaaacggaugauuucuau

SEQ ID NO: 2741591 - RNA, 15 nt, Human
guugaaauuguaauu

SEQ ID NO: 2741592 - RNA, 20 nt, Human
guugaaauuguaauuauauc

SEQ ID NO: 2741593 - RNA, 16 nt, Human
guugaaauuguaauua

SEQ ID NO: 2741594 - RNA, 15 nt, Human
guugcaggaccucag

SEQ ID NO: 2741595 - RNA, 23 nt, Human
guuggccaaagccaaagcuaggc

SEQ ID NO: 2741596 - RNA, 18 nt, Human
guuggcaaaaaggcagga

SEQ ID NO: 2741597 - RNA, 14 nt, Human
guuggcaaaaaggc

SEQ ID NO: 2741598 - RNA, 13 nt, Human
guuggccaggcug

SEQ ID NO: 2741599 - RNA, 15 nt, Human
guuggccaggcuggu

SEQ ID NO: 2741600 - RNA, 14 nt, Human
guuggccaggcugg

SEQ ID NO: 2741601 - RNA, 17 nt, Human
guuggccaggcuggucu

SEQ ID NO: 2741602 - RNA, 19 nt, Human
guuggccaggcuggucuca

SEQ ID NO: 2741603 - RNA, 14 nt, Human
guuggccaguguga

SEQ ID NO: 2741604 - RNA, 13 nt, Human
guugccagucacc

SEQ ID NO: 2741605 - RNA, 14 nt, Human
guugccagucaccc

SEQ ID NO: 2741606 - RNA, 16 nt, Human
guugccagucaccccg

SEQ ID NO: 2741607 - RNA, 17 nt, Human
guugccagucaccccgg

SEQ ID NO: 2741608 - RNA, 18 nt, Human
guugccagucaccccggc

SEQ ID NO: 2741609 - RNA, 23 nt, Human
guugccagucaccccggccaccu

SEQ ID NO: 2741610 - RNA, 12 nt, Human
guugcccaggca

SEQ ID NO: 2741611 - RNA, 14 nt, Human
guugcccaggcagg

SEQ ID NO: 2741612 - RNA, 23 nt, Human
guuaccucugccucagaaaacaa

SEQ ID NO: 2741613 - RNA, 21 nt, Human
guuacauuuuuaagugcugca

SEQ ID NO: 2741614 - RNA, 23 nt, Human
guuaccauuuugggguacccacu

SEQ ID NO: 2741615 - RNA, 16 nt, Human
guuacccaaauuaaga

SEQ ID NO: 2741616 - RNA, 19 nt, Human
guuacauaagauaaaugug

SEQ ID NO: 2741617 - RNA, 18 nt, Human
guuacauaagauaaaugu

SEQ ID NO: 2741618 - RNA, 15 nt, Human
guuacagacaaagcg

SEQ ID NO: 2741619 - RNA, 17 nt, Human
guuacagacaaagcgug

SEQ ID NO: 2741620 - RNA, 22 nt, Human
guuaguuucuccaagcaggaca

SEQ ID NO: 2741621 - RNA, 16 nt, Human
guuaguuucuccaagc

SEQ ID NO: 2741622 - RNA, 19 nt, Human
guuaguuucuccaagcagg

SEQ ID NO: 2741623 - RNA, 22 nt, Human
guuacuaaguuuuuauggcuuu

SEQ ID NO: 2741624 - RNA, 15 nt, Human
guuacucagaauucu

SEQ ID NO: 2741625 - RNA, 21 nt, Human
guuaugacuccagaauuuccc

SEQ ID NO: 2741626 - RNA, 19 nt, Human
guuaucugaagucagaucu

SEQ ID NO: 2741627 - RNA, 19 nt, Human
guucaagcgauucuucugc

SEQ ID NO: 2741628 - RNA, 19 nt, Human
guuauuaaaaaucucaaau

SEQ ID NO: 2741629 - RNA, 18 nt, Human
guucaauaauaaauauuu

SEQ ID NO: 2741630 - RNA, 20 nt, Human
guucaagcgauucuucugcu

SEQ ID NO: 2741631 - RNA, 23 nt, Human
guucaauucucauuugucacaca

SEQ ID NO: 2741632 - RNA, 16 nt, Human
guucaauucucauuug

SEQ ID NO: 2741633 - RNA, 13 nt, Human
guucagagcugcc

SEQ ID NO: 2741634 - RNA, 14 nt, Human
guucagagcugccc

SEQ ID NO: 2741635 - RNA, 23 nt, Human
guucagagcugcccucuccuggg

SEQ ID NO: 2741636 - RNA, 20 nt, Human
guucagagcugcccucuccu

SEQ ID NO: 2741637 - RNA, 22 nt, Human
guucagagcugcccucuccugg

SEQ ID NO: 2741638 - RNA, 15 nt, Human
guucagagcugcccu

SEQ ID NO: 2741639 - RNA, 16 nt, Human
guucagagcugcccuc

SEQ ID NO: 2741640 - RNA, 17 nt, Human
guucagagcugcccucu

SEQ ID NO: 2741641 - RNA, 19 nt, Human
guucagagcugcccucucc

SEQ ID NO: 2741642 - RNA, 19 nt, Human
guucacugcaaccuccgcc

SEQ ID NO: 2741643 - RNA, 19 nt, Human
guucacucuccauuuaaua

SEQ ID NO: 2741644 - RNA, 17 nt, Human
guucaucauccuaagcu

SEQ ID NO: 2741645 - RNA, 23 nt, Human
guucauggaacgcguugaaauug

SEQ ID NO: 2741646 - RNA, 22 nt, Human
guucauggaacgcguugaaauu

SEQ ID NO: 2741647 - RNA, 12 nt, Human
guucaugaaaga

SEQ ID NO: 2741648 - RNA, 18 nt, Human
guucaucuugaauuguaa

SEQ ID NO: 2741649 - RNA, 12 nt, Human
guucaucuugaa

SEQ ID NO: 2741650 - RNA, 13 nt, Human
guucaucuugaau

SEQ ID NO: 2741651 - RNA, 17 nt, Human
guuccaccaucaagcca

SEQ ID NO: 2741652 - RNA, 20 nt, Human
guuccaccaucaagccacca

SEQ ID NO: 2741653 - RNA, 14 nt, Human
guuccuaauccucu

SEQ ID NO: 2741654 - RNA, 22 nt, Human
guuccucauuagcauuuugcua

SEQ ID NO: 2741655 - RNA, 16 nt, Human
guuaaaagaugaaaau

SEQ ID NO: 2741656 - RNA, 14 nt, Human
guuaaaagaugaaa

SEQ ID NO: 2741657 - RNA, 20 nt, Human
guuaaaagaugaaaauauuu

SEQ ID NO: 2741658 - RNA, 22 nt, Human
guuaaaauaccagccaguaaau

SEQ ID NO: 2741659 - RNA, 18 nt, Human
guuaaaccaugggauaaa

SEQ ID NO: 2741660 - RNA, 21 nt, Human
guuaaaccaugggauaaaugc

SEQ ID NO: 2741661 - RNA, 16 nt, Human
guuacacuaaaaggug

SEQ ID NO: 2741662 - RNA, 15 nt, Human
guuacacuaaaaggu

SEQ ID NO: 2741663 - RNA, 13 nt, Human
guuacagacaaag

SEQ ID NO: 2741664 - RNA, 13 nt, Human
guuacagaagccc

SEQ ID NO: 2741665 - RNA, 18 nt, Human
guguuaugacuccagaau

SEQ ID NO: 2741666 - RNA, 14 nt, Human
guguuacuaaguuu

SEQ ID NO: 2741667 - RNA, 12 nt, Human
guguuacuaagu

SEQ ID NO: 2741668 - RNA, 12 nt, Human
gugugcucugau

SEQ ID NO: 2741669 - RNA, 15 nt, Human
gugugcucugaucau

SEQ ID NO: 2741670 - RNA, 22 nt, Human
gugugcucugaucauccacugu

SEQ ID NO: 2741671 - RNA, 21 nt, Human
guguggagaagcggcuggcag

SEQ ID NO: 2741672 - RNA, 13 nt, Human
guguggagaagcg

SEQ ID NO: 2741673 - RNA, 20 nt, Human
gugugagucaccaagcccag

SEQ ID NO: 2741674 - RNA, 22 nt, Human
gugucucuugguccugcugcag

SEQ ID NO: 2741675 - RNA, 18 nt, Human
gugucucuugguccugcu

SEQ ID NO: 2741676 - RNA, 19 nt, Human
gugucucuugguccugcug

SEQ ID NO: 2741677 - RNA, 20 nt, Human
gugucucuugguccugcugc

SEQ ID NO: 2741678 - RNA, 21 nt, Human
gugucucuugguccugcugca

SEQ ID NO: 2741679 - RNA, 14 nt, Human
gugucucuuggucc

SEQ ID NO: 2741680 - RNA, 17 nt, Human
gugucucccuucauccu

SEQ ID NO: 2741681 - RNA, 14 nt, Human
guguccggucccug

SEQ ID NO: 2741682 - RNA, 23 nt, Human
gugucccugcacuugcagacucu

SEQ ID NO: 2741683 - RNA, 15 nt, Human
gugucgggcaugaca

SEQ ID NO: 2741684 - RNA, 21 nt, Human
guguaaguagauaggccaugg

SEQ ID NO: 2741685 - RNA, 21 nt, Human
guguaaguauucuuauuuaau

SEQ ID NO: 2741686 - RNA, 16 nt, Human
guggugacuuuggaua

SEQ ID NO: 2741687 - RNA, 17 nt, Human
guguaagacaaaaagcu

SEQ ID NO: 2741688 - RNA, 19 nt, Human
guggugcgaucuggguuca

SEQ ID NO: 2741689 - RNA, 14 nt, Human
guggugaccucugc

SEQ ID NO: 2741690 - RNA, 17 nt, Human
guggugaccucugccug

SEQ ID NO: 2741691 - RNA, 21 nt, Human
guggugagaggcauccaguau

SEQ ID NO: 2741692 - RNA, 15 nt, Human
guggugacuuuggau

SEQ ID NO: 2741693 - RNA, 13 nt, Human
guggugacuuugg

SEQ ID NO: 2741694 - RNA, 17 nt, Human
guggucccaccccacac

SEQ ID NO: 2741695 - RNA, 18 nt, Human
gugguccuaaucuucuga

SEQ ID NO: 2741696 - RNA, 14 nt, Human
guggucccacccca

SEQ ID NO: 2741697 - RNA, 15 nt, Human
guggucccaccccac

SEQ ID NO: 2741698 - RNA, 16 nt, Human
guggucccaccccaca

SEQ ID NO: 2741699 - RNA, 17 nt, Human
gugguagagugugccug

SEQ ID NO: 2741700 - RNA, 19 nt, Human
gugguaugaucacggcuca

SEQ ID NO: 2741701 - RNA, 13 nt, Human
gugucccugcacu

SEQ ID NO: 2741702 - RNA, 16 nt, Human
gugucccugcacuugc

SEQ ID NO: 2741703 - RNA, 18 nt, Human
gugucccugcacuugcag

SEQ ID NO: 2741704 - RNA, 17 nt, Human
guguacauggaauaaca

SEQ ID NO: 2741705 - RNA, 15 nt, Human
guguacuuaacuauu

SEQ ID NO: 2741706 - RNA, 22 nt, Human
guguacauggaauaacauguaa

SEQ ID NO: 2741707 - RNA, 20 nt, Human
gugcuacaaaaacacagcaa

SEQ ID NO: 2741708 - RNA, 15 nt, Human
gugcuacaaaaacac

SEQ ID NO: 2741709 - RNA, 14 nt, Human
guggcucacgccug

SEQ ID NO: 2741710 - RNA, 12 nt, Human
guggcugcuuca

SEQ ID NO: 2741711 - RNA, 14 nt, Human
guggcugcuucaag

SEQ ID NO: 2741712 - RNA, 23 nt, Human
guggcugcuucaaggauccugag

SEQ ID NO: 2741713 - RNA, 19 nt, Human
guggcuggguuggagggug

SEQ ID NO: 2741714 - RNA, 15 nt, Human
guggcugcuucaagg

SEQ ID NO: 2741715 - RNA, 16 nt, Human
guggcugcuucaagga

SEQ ID NO: 2741716 - RNA, 19 nt, Human
guggcugcuucaaggaucc

SEQ ID NO: 2741717 - RNA, 22 nt, Human
guggcugcuucaaggauccuga

SEQ ID NO: 2741718 - RNA, 22 nt, Human
guggcuuaaaacaacacucaca

SEQ ID NO: 2741719 - RNA, 17 nt, Human
gugggcccaaugcacuu

SEQ ID NO: 2741720 - RNA, 15 nt, Human
gugggcauucaaaug

SEQ ID NO: 2741721 - RNA, 15 nt, Human
gugggcuaguugggc

SEQ ID NO: 2741722 - RNA, 17 nt, Human
guggggcagcuugaggg

SEQ ID NO: 2741723 - RNA, 13 nt, Human
guggggcagcuug

SEQ ID NO: 2741724 - RNA, 23 nt, Human
guggguuucuaaagcugccagcc

SEQ ID NO: 2741725 - RNA, 15 nt, Human
guggggaccucaggc

SEQ ID NO: 2741726 - RNA, 18 nt, Human
guggggaccucaggccug

SEQ ID NO: 2741727 - RNA, 20 nt, Human
guuuagcuggaaaaguaugu

SEQ ID NO: 2741728 - RNA, 21 nt, Human
guuuagcuggaaaaguauguu

SEQ ID NO: 2741729 - RNA, 20 nt, Human
guuuauauaagcuuguauuc

SEQ ID NO: 2741730 - RNA, 15 nt, Human
guuuagauaauacac

SEQ ID NO: 2741731 - RNA, 14 nt, Human
guuuagauaauaca

SEQ ID NO: 2741732 - RNA, 15 nt, Human
guuguuacauuuuua

SEQ ID NO: 2741733 - RNA, 14 nt, Human
guuguuacauuuuu

SEQ ID NO: 2741734 - RNA, 14 nt, Human
guugugguuaaucu

SEQ ID NO: 2741735 - RNA, 22 nt, Human
guuguggauuuaacagaaaugu

SEQ ID NO: 2741736 - RNA, 14 nt, Human
guugugaauguugu

SEQ ID NO: 2741737 - RNA, 19 nt, Human
guugucugcaacucugaag

SEQ ID NO: 2741738 - RNA, 12 nt, Human
guugucagcuga

SEQ ID NO: 2741739 - RNA, 19 nt, Human
guuggcugggggccucagu

SEQ ID NO: 2741740 - RNA, 20 nt, Human
guuggccccugcccggcugc

SEQ ID NO: 2741741 - RNA, 13 nt, Human
guuggccccugcc

SEQ ID NO: 2741742 - RNA, 14 nt, Human
guuggccccugccc

SEQ ID NO: 2741743 - RNA, 12 nt, Human
guuggcuggggg

SEQ ID NO: 2741744 - RNA, 17 nt, Human
guuugagaucagccugg

SEQ ID NO: 2741745 - RNA, 23 nt, Human
guuugauuaaauucuugcaaagu

SEQ ID NO: 2741746 - RNA, 20 nt, Human
guuuguaaauuaacuuuuau

SEQ ID NO: 2741747 - RNA, 16 nt, Human
guuugauucagacagc

SEQ ID NO: 2741748 - RNA, 20 nt, Human
guuugauucagacagcugcc

SEQ ID NO: 2741749 - RNA, 21 nt, Human
guuugauucagacagcugccu

SEQ ID NO: 2741750 - RNA, 18 nt, Human
guuuguuucugaaaggga

SEQ ID NO: 2741751 - RNA, 11 nt, Human
guuuucacucu

SEQ ID NO: 2741752 - RNA, 12 nt, Human
guuuucacucuu

SEQ ID NO: 2741753 - RNA, 17 nt, Human
guuuucaaaauaaaaau

SEQ ID NO: 2741754 - RNA, 20 nt, Human
guuuguuucugaaagggacg

SEQ ID NO: 2741755 - RNA, 20 nt, Human
guuuuccagguuuaagcugu

SEQ ID NO: 2741756 - RNA, 19 nt, Human
guuuuccaugaguccccug

SEQ ID NO: 2741757 - RNA, 20 nt, Human
guuuuccaugaguccccugu

SEQ ID NO: 2741758 - RNA, 13 nt, Human
guuuuccugaaga

SEQ ID NO: 2741759 - RNA, 21 nt, Human
uaaaagauacaguuacucaga

SEQ ID NO: 2741760 - RNA, 20 nt, Human
uaaaagauacaguuacucag

SEQ ID NO: 2741761 - RNA, 17 nt, Human
uaaaagauacaguuacu

SEQ ID NO: 2741762 - RNA, 14 nt, Human
uaaaagauacaguu

SEQ ID NO: 2741763 - RNA, 13 nt, Human
uaaaaucauuucu

SEQ ID NO: 2741764 - RNA, 10 nt, Human
uaaaaucauu

SEQ ID NO: 2741765 - RNA, 12 nt, Human
uaaaaggugacc

SEQ ID NO: 2741766 - RNA, 15 nt, Human
uaaaauccauacauu

SEQ ID NO: 2741767 - RNA, 17 nt, Human
uaaaauccauacauuug

SEQ ID NO: 2741768 - RNA, 22 nt, Human
uaaaaucauuucugcaucagcu

SEQ ID NO: 2741769 - RNA, 18 nt, Human
uaaaaucauuucugcauc

SEQ ID NO: 2741770 - RNA, 21 nt, Human
uaaaagguaugcaaucaaauc

SEQ ID NO: 2741771 - RNA, 12 nt, Human
uaaaaggagcca

SEQ ID NO: 2741772 - RNA, 22 nt, Human
uaaaacaagcacuaaacaaaga

SEQ ID NO: 2741773 - RNA, 15 nt, Human
uaaaacaacacucac

SEQ ID NO: 2741774 - RNA, 17 nt, Human
uaaaacacaacaucuuu

SEQ ID NO: 2741775 - RNA, 22 nt, Human
uaaaacacaacaucuuuuucua

SEQ ID NO: 2741776 - RNA, 23 nt, Human
uaaaacacaacaucuuuuucuac

SEQ ID NO: 2741777 - RNA, 21 nt, Human
uaaaaagacauucuuccaaaa

SEQ ID NO: 2741778 - RNA, 13 nt, Human
uaaaaacaacuuu

SEQ ID NO: 2741779 - RNA, 18 nt, Human
uaaaaacaacuuuauacc

SEQ ID NO: 2741780 - RNA, 19 nt, Human
uaaaaacaacuuuauaccc

SEQ ID NO: 2741781 - RNA, 14 nt, Human
uaaaguguuugaaa

SEQ ID NO: 2741782 - RNA, 17 nt, Human
uaaaggcuaccuuugua

SEQ ID NO: 2741783 - RNA, 15 nt, Human
uaaaggcuaccuuug

SEQ ID NO: 2741784 - RNA, 13 nt, Human
uaaagccauguuu

SEQ ID NO: 2741785 - RNA, 11 nt, Human
uaaagccaugu

SEQ ID NO: 2741786 - RNA, 20 nt, Human
uaaagccauguuuauuacag

SEQ ID NO: 2741787 - RNA, 15 nt, Human
uaaagccauguuuau

SEQ ID NO: 2741788 - RNA, 19 nt, Human
uaaagcagcguuucuauga

SEQ ID NO: 2741789 - RNA, 17 nt, Human
uaaagcagcguuucuau

SEQ ID NO: 2741790 - RNA, 16 nt, Human
uaaagcagcguuucua

SEQ ID NO: 2741791 - RNA, 12 nt, Human
uaaagaaaacug

SEQ ID NO: 2741792 - RNA, 19 nt, Human
uaaacaagaccacguuucu

SEQ ID NO: 2741793 - RNA, 20 nt, Human
uaaacaagaccacguuucua

SEQ ID NO: 2741794 - RNA, 22 nt, Human
uaaacaagaccacguuucuaaa

SEQ ID NO: 2741795 - RNA, 21 nt, Human
uaaacaagaccacguuucuaa

SEQ ID NO: 2741796 - RNA, 22 nt, Human
uaaacuugguuuuuaaaaaacu

SEQ ID NO: 2741797 - RNA, 23 nt, Human
uaaugauaacuggaaacuucagc

SEQ ID NO: 2741798 - RNA, 15 nt, Human
uaaugcgugcauacc

SEQ ID NO: 2741799 - RNA, 17 nt, Human
uaaugauaacuggaaac

SEQ ID NO: 2741800 - RNA, 22 nt, Human
uaaugauaacuggaaacuucag

SEQ ID NO: 2741801 - RNA, 23 nt, Human
uaaugcgugcauaccacuuuugu

SEQ ID NO: 2741802 - RNA, 22 nt, Human
uaaugcgugcauaccacuuuug

SEQ ID NO: 2741803 - RNA, 19 nt, Human
uaaugcgugcauaccacuu

SEQ ID NO: 2741804 - RNA, 15 nt, Human
uaauggggcggugag

SEQ ID NO: 2741805 - RNA, 22 nt, Human
uaauguuucaaacauauauaac

SEQ ID NO: 2741806 - RNA, 21 nt, Human
uaauuaacauguuaaaccaug

SEQ ID NO: 2741807 - RNA, 20 nt, Human
uaauuaacauguuaaaccau

SEQ ID NO: 2741808 - RNA, 20 nt, Human
uaauuaaguacuauguauca

SEQ ID NO: 2741809 - RNA, 17 nt, Human
uaauuaaguacuaugua

SEQ ID NO: 2741810 - RNA, 14 nt, Human
uaauuaaguacuau

SEQ ID NO: 2741811 - RNA, 14 nt, Human
uaauaauguuucaa

SEQ ID NO: 2741812 - RNA, 19 nt, Human
uaauaugcacacauuuuuu

SEQ ID NO: 2741813 - RNA, 16 nt, Human
uaauauuaaagccaug

SEQ ID NO: 2741814 - RNA, 15 nt, Human
uaauauuaaagccau

SEQ ID NO: 2741815 - RNA, 18 nt, Human
uaauaugcacacauuuuu

SEQ ID NO: 2741816 - RNA, 17 nt, Human
uaauaugcacacauuuu

SEQ ID NO: 2741817 - RNA, 16 nt, Human
uaauaugcacacauuu

SEQ ID NO: 2741818 - RNA, 15 nt, Human
uaauaugcacacauu

SEQ ID NO: 2741819 - RNA, 20 nt, Human
uaauauuaaggaagacaaug

SEQ ID NO: 2741820 - RNA, 21 nt, Human
uaauauuaaagccauguuuau

SEQ ID NO: 2741821 - RNA, 20 nt, Human
uaauauuaaagccauguuua

SEQ ID NO: 2741822 - RNA, 17 nt, Human
uaauauuaaagccaugu

SEQ ID NO: 2741823 - RNA, 13 nt, Human
uaaucuaaaugga

SEQ ID NO: 2741824 - RNA, 12 nt, Human
uaaucuaaaugg

SEQ ID NO: 2741825 - RNA, 20 nt, Human
uaauccucuaggaggucucu

SEQ ID NO: 2741826 - RNA, 12 nt, Human
uaagugagagag

SEQ ID NO: 2741827 - RNA, 23 nt, Human
uaagugaggaugaaaaaauaaca

SEQ ID NO: 2741828 - RNA, 14 nt, Human
uaagugcugcauuu

SEQ ID NO: 2741829 - RNA, 19 nt, Human
uaauaaauauuuuugccau

SEQ ID NO: 2741830 - RNA, 21 nt, Human
uaauaacugugaaguuuacau

SEQ ID NO: 2741831 - RNA, 16 nt, Human
uaauaaggaaaaguuu

SEQ ID NO: 2741832 - RNA, 22 nt, Human
uaagugcugcauuuaaaagaua

SEQ ID NO: 2741833 - RNA, 18 nt, Human
uaagugcugcauuuaaaa

SEQ ID NO: 2741834 - RNA, 16 nt, Human
uaagugcugcauuuaa

SEQ ID NO: 2741835 - RNA, 15 nt, Human
uaagugcugcauuua

SEQ ID NO: 2741836 - RNA, 16 nt, Human
uaaggauguucuagca

SEQ ID NO: 2741837 - RNA, 12 nt, Human
uaagaggcaggg

SEQ ID NO: 2741838 - RNA, 15 nt, Human
uaagaggcagggucu

SEQ ID NO: 2741839 - RNA, 20 nt, Human
uaagguggguacgggagggu

SEQ ID NO: 2741840 - RNA, 15 nt, Human
uaaggugugcucuga

SEQ ID NO: 2741841 - RNA, 17 nt, Human
uaaggguaucuggugac

SEQ ID NO: 2741842 - RNA, 16 nt, Human
uaaaugugccuucauu

SEQ ID NO: 2741843 - RNA, 11 nt, Human
uaaauuauuuu

SEQ ID NO: 2741844 - RNA, 22 nt, Human
uaaauucuugcaaaguaucccu

SEQ ID NO: 2741845 - RNA, 18 nt, Human
uaaauucuugcaaaguau

SEQ ID NO: 2741846 - RNA, 17 nt, Human
uaaauucuugcaaagua

SEQ ID NO: 2741847 - RNA, 16 nt, Human
uaaauucuugcaaagu

SEQ ID NO: 2741848 - RNA, 13 nt, Human
uaaauucuuucau

SEQ ID NO: 2741849 - RNA, 22 nt, Human
uaaauuuaguauuuuguuucag

SEQ ID NO: 2741850 - RNA, 22 nt, Human
uaaauuugaauguuaagcagau

SEQ ID NO: 2741851 - RNA, 14 nt, Human
uaaauuugaauguu

SEQ ID NO: 2741852 - RNA, 18 nt, Human
uaacaccaugauuaacca

SEQ ID NO: 2741853 - RNA, 20 nt, Human
uaaauggcuuccuggcaaua

SEQ ID NO: 2741854 - RNA, 17 nt, Human
uaaaugggggugcauuu

SEQ ID NO: 2741855 - RNA, 14 nt, Human
uaaaugggggugca

SEQ ID NO: 2741856 - RNA, 19 nt, Human
uaaaugggggugcauuuga

SEQ ID NO: 2741857 - RNA, 18 nt, Human
uaaaugggggugcauuug

SEQ ID NO: 2741858 - RNA, 20 nt, Human
uaaaugucuaguuguaacac

SEQ ID NO: 2741859 - RNA, 22 nt, Human
uaaaugucucuuuaaugucaca

SEQ ID NO: 2741860 - RNA, 16 nt, Human
uaaauggaaccacucu

SEQ ID NO: 2741861 - RNA, 14 nt, Human
uaaaugcccagccc

SEQ ID NO: 2741862 - RNA, 15 nt, Human
uaaaugcccagcccc

SEQ ID NO: 2741863 - RNA, 16 nt, Human
uaaaugcccagccccu

SEQ ID NO: 2741864 - RNA, 17 nt, Human
uaaaugcccagccccuu

SEQ ID NO: 2741865 - RNA, 13 nt, Human
uaaaugcccagcc

SEQ ID NO: 2741866 - RNA, 23 nt, Human
uaaaugccaucaauaaaaaauua

SEQ ID NO: 2741867 - RNA, 16 nt, Human
uaaaugccaucaauaa

SEQ ID NO: 2741868 - RNA, 15 nt, Human
uaacuggaaacuuca

SEQ ID NO: 2741869 - RNA, 17 nt, Human
uaacugugaaguuuaca

SEQ ID NO: 2741870 - RNA, 18 nt, Human
uaacugugaaguuuacau

SEQ ID NO: 2741871 - RNA, 18 nt, Human
uaagaaaaaggaugcaca

SEQ ID NO: 2741872 - RNA, 16 nt, Human
uaagaaaaaggaugca

SEQ ID NO: 2741873 - RNA, 23 nt, Human
uaagaaaaaggaugcacagaguu

SEQ ID NO: 2741874 - RNA, 19 nt, Human
uaagaaaaaggaugcacag

SEQ ID NO: 2741875 - RNA, 13 nt, Human
uaagagagaauga

SEQ ID NO: 2741876 - RNA, 19 nt, Human
uaagaaccuuuugagugcc

SEQ ID NO: 2741877 - RNA, 14 nt, Human
uaagagagaaugag

SEQ ID NO: 2741878 - RNA, 21 nt, Human
uaagaaaauaucacuugucaa

SEQ ID NO: 2741879 - RNA, 19 nt, Human
uaagaaaucaaagagagaa

SEQ ID NO: 2741880 - RNA, 17 nt, Human
uaaccaggggccaugaa

SEQ ID NO: 2741881 - RNA, 23 nt, Human
uaaccaguguuguggauuuaaca

SEQ ID NO: 2741882 - RNA, 16 nt, Human
uaaccacuucagcuga

SEQ ID NO: 2741883 - RNA, 11 nt, Human
uaacagaaaug

SEQ ID NO: 2741884 - RNA, 14 nt, Human
uauaugcuucuguu

SEQ ID NO: 2741885 - RNA, 16 nt, Human
uauaugcuucuguuuu

SEQ ID NO: 2741886 - RNA, 20 nt, Human
uauauuugaaauauugacuu

SEQ ID NO: 2741887 - RNA, 20 nt, Human
uauauuuuuuucugaaauuu

SEQ ID NO: 2741888 - RNA, 19 nt, Human
uauauuuuuuucugaaauu

SEQ ID NO: 2741889 - RNA, 16 nt, Human
uauauuuuuuucugaa

SEQ ID NO: 2741890 - RNA, 16 nt, Human
uauauuuucauucucc

SEQ ID NO: 2741891 - RNA, 19 nt, Human
uaucaggugcugccaucca

SEQ ID NO: 2741892 - RNA, 20 nt, Human
uaucaggugcugccauccag

SEQ ID NO: 2741893 - RNA, 17 nt, Human
uaucaugacaaagacug

SEQ ID NO: 2741894 - RNA, 17 nt, Human
uauauaacaaugcugua

SEQ ID NO: 2741895 - RNA, 19 nt, Human
uauauaacaaugcuguauu

SEQ ID NO: 2741896 - RNA, 23 nt, Human
uauaucugaggaauucuguauag

SEQ ID NO: 2741897 - RNA, 14 nt, Human
uauaucuuguagcu

SEQ ID NO: 2741898 - RNA, 20 nt, Human
uauagaaccucuuugucuac

SEQ ID NO: 2741899 - RNA, 21 nt, Human
uauagaaccucuuugucuaca

SEQ ID NO: 2741900 - RNA, 17 nt, Human
uaguauuguccaggucu

SEQ ID NO: 2741901 - RNA, 16 nt, Human
uaguaugguggcuggg

SEQ ID NO: 2741902 - RNA, 15 nt, Human
uaguaugaggcauuu

SEQ ID NO: 2741903 - RNA, 20 nt, Human
uaguggcuuaaaacaacacu

SEQ ID NO: 2741904 - RNA, 20 nt, Human
uaguuguuugauucagacag

SEQ ID NO: 2741905 - RNA, 21 nt, Human
uaguuguuugauucagacagc

SEQ ID NO: 2741906 - RNA, 22 nt, Human
uaguuguuugauucagacagcu

SEQ ID NO: 2741907 - RNA, 17 nt, Human
uauaaacuuuaccuuuu

SEQ ID NO: 2741908 - RNA, 16 nt, Human
uauaaacuuuaccuuu

SEQ ID NO: 2741909 - RNA, 15 nt, Human
uauaaacuuuaccuu

SEQ ID NO: 2741910 - RNA, 11 nt, Human
uauaaacuuua

SEQ ID NO: 2741911 - RNA, 18 nt, Human
uauaaaccgaacugaugu

SEQ ID NO: 2741912 - RNA, 14 nt, Human
uauaaacuuuaccu

SEQ ID NO: 2741913 - RNA, 13 nt, Human
uauaaacuuuacc

SEQ ID NO: 2741914 - RNA, 15 nt, Human
uaguuugauuaaauu

SEQ ID NO: 2741915 - RNA, 21 nt, Human
uaguuugauuaaauucuugca

SEQ ID NO: 2741916 - RNA, 16 nt, Human
uaguuugauuaaauuc

SEQ ID NO: 2741917 - RNA, 18 nt, Human
uaggugcuacaaaaacac

SEQ ID NO: 2741918 - RNA, 23 nt, Human
uaggugcuacaaaaacacagcaa

SEQ ID NO: 2741919 - RNA, 22 nt, Human
uaggugcuacaaaaacacagca

SEQ ID NO: 2741920 - RNA, 20 nt, Human
uaggugcuacaaaaacacag

SEQ ID NO: 2741921 - RNA, 11 nt, Human
uaggugacaga

SEQ ID NO: 2741922 - RNA, 16 nt, Human
uaggugacagagugag

SEQ ID NO: 2741923 - RNA, 22 nt, Human
uagguuaauuccaauuauauga

SEQ ID NO: 2741924 - RNA, 13 nt, Human
uagguguggggga

SEQ ID NO: 2741925 - RNA, 17 nt, Human
uaggugugggggaagca

SEQ ID NO: 2741926 - RNA, 19 nt, Human
uaggugugacugaauuucu

SEQ ID NO: 2741927 - RNA, 23 nt, Human
uaggugugacugaauuucuuuug

SEQ ID NO: 2741928 - RNA, 21 nt, Human
uaggugugacugaauuucuuu

SEQ ID NO: 2741929 - RNA, 18 nt, Human
uaguaugaggcauuuguu

SEQ ID NO: 2741930 - RNA, 17 nt, Human
uaguaugaggcauuugu

SEQ ID NO: 2741931 - RNA, 14 nt, Human
uagauaggccaugg

SEQ ID NO: 2741932 - RNA, 16 nt, Human
uagauacuguaucaug

SEQ ID NO: 2741933 - RNA, 15 nt, Human
uagauuagaauucug

SEQ ID NO: 2741934 - RNA, 14 nt, Human
uagauuagaauucu

SEQ ID NO: 2741935 - RNA, 20 nt, Human
uagauuagaauucuguauag

SEQ ID NO: 2741936 - RNA, 19 nt, Human
uagauuagaauucuguaua

SEQ ID NO: 2741937 - RNA, 17 nt, Human
uagauuagaauucugua

SEQ ID NO: 2741938 - RNA, 16 nt, Human
uagauuagaauucugu

SEQ ID NO: 2741939 - RNA, 20 nt, Human
uagauuagagaguguugaaa

SEQ ID NO: 2741940 - RNA, 18 nt, Human
uagcauccuggaauaucu

SEQ ID NO: 2741941 - RNA, 16 nt, Human
uagcauccuggaauau

SEQ ID NO: 2741942 - RNA, 15 nt, Human
uagcauccuggaaua

SEQ ID NO: 2741943 - RNA, 13 nt, Human
uagcauccuggaa

SEQ ID NO: 2741944 - RNA, 11 nt, Human
uagcagggaaa

SEQ ID NO: 2741945 - RNA, 19 nt, Human
uagcauacguacacauuuu

SEQ ID NO: 2741946 - RNA, 18 nt, Human
uagcauacguacacauuu

SEQ ID NO: 2741947 - RNA, 17 nt, Human
uagcauacguacacauu

SEQ ID NO: 2741948 - RNA, 16 nt, Human
uagcauacguacacau

SEQ ID NO: 2741949 - RNA, 15 nt, Human
uagcauggcauauuu

SEQ ID NO: 2741950 - RNA, 17 nt, Human
uagcauggcauauuuuu

SEQ ID NO: 2741951 - RNA, 18 nt, Human
uagcauggcauauuuuuc

SEQ ID NO: 2741952 - RNA, 12 nt, Human
uagcugggacua

SEQ ID NO: 2741953 - RNA, 15 nt, Human
uagcugggacuacag

SEQ ID NO: 2741954 - RNA, 17 nt, Human
uagcugggacuacaggc

SEQ ID NO: 2741955 - RNA, 19 nt, Human
uagcugggacuacaggcac

SEQ ID NO: 2741956 - RNA, 20 nt, Human
uagccugugccucugggacu

SEQ ID NO: 2741957 - RNA, 18 nt, Human
uagccugugccucuggga

SEQ ID NO: 2741958 - RNA, 12 nt, Human
uagcucauucuc

SEQ ID NO: 2741959 - RNA, 20 nt, Human
uagcucaggugucccugcac

SEQ ID NO: 2741960 - RNA, 21 nt, Human
uagcucaggugucccugcacu

SEQ ID NO: 2741961 - RNA, 23 nt, Human
uagaauaccacaggaaccacaag

SEQ ID NO: 2741962 - RNA, 20 nt, Human
uagaagucuuagauguauau

SEQ ID NO: 2741963 - RNA, 12 nt, Human
uagagugggagc

SEQ ID NO: 2741964 - RNA, 17 nt, Human
uagaguugauacuacag

SEQ ID NO: 2741965 - RNA, 14 nt, Human
uagaguugauacua

SEQ ID NO: 2741966 - RNA, 15 nt, Human
uagagguucaaagau

SEQ ID NO: 2741967 - RNA, 14 nt, Human
uagagguucaaaga

SEQ ID NO: 2741968 - RNA, 13 nt, Human
uagaauucuguau

SEQ ID NO: 2741969 - RNA, 11 nt, Human
uagaauucugu

SEQ ID NO: 2741970 - RNA, 21 nt, Human
uagaauucuguauagauuaga

SEQ ID NO: 2741971 - RNA, 16 nt, Human
uagaauucuguauaga

SEQ ID NO: 2741972 - RNA, 15 nt, Human
uagaauucuguauag

SEQ ID NO: 2741973 - RNA, 14 nt, Human
uagaauucuguaua

SEQ ID NO: 2741974 - RNA, 20 nt, Human
uagacuggugacugauucuu

SEQ ID NO: 2741975 - RNA, 23 nt, Human
uagacuggugacugauucuucag

SEQ ID NO: 2741976 - RNA, 21 nt, Human
uagacuggugacugauucuuc

SEQ ID NO: 2741977 - RNA, 13 nt, Human
uaauuuugugaag

SEQ ID NO: 2741978 - RNA, 16 nt, Human
uaauuuuuauauuuga

SEQ ID NO: 2741979 - RNA, 17 nt, Human
uaauuuuuauauuugaa

SEQ ID NO: 2741980 - RNA, 18 nt, Human
uaauuuugugaagcaaaa

SEQ ID NO: 2741981 - RNA, 12 nt, Human
uaauuuuuauau

SEQ ID NO: 2741982 - RNA, 19 nt, Human
uacaaaguauuaagcauau

SEQ ID NO: 2741983 - RNA, 18 nt, Human
uacaaaguauuaagcaua

SEQ ID NO: 2741984 - RNA, 16 nt, Human
uacaaaguauuaagca

SEQ ID NO: 2741985 - RNA, 15 nt, Human
uacaaaguauuaagc

SEQ ID NO: 2741986 - RNA, 18 nt, Human
uacaaaguagaagucuua

SEQ ID NO: 2741987 - RNA, 14 nt, Human
uacaaaguagaagu

SEQ ID NO: 2741988 - RNA, 12 nt, Human
uacaaaguauua

SEQ ID NO: 2741989 - RNA, 14 nt, Human
uacaaaguauuaag

SEQ ID NO: 2741990 - RNA, 13 nt, Human
uacaaaguauuaa

SEQ ID NO: 2741991 - RNA, 16 nt, Human
uacacacucaaaucaa

SEQ ID NO: 2741992 - RNA, 17 nt, Human
uacacacucaaaucaag

SEQ ID NO: 2741993 - RNA, 15 nt, Human
uacacacugcauguu

SEQ ID NO: 2741994 - RNA, 21 nt, Human
uacacugugcugagucugaag

SEQ ID NO: 2741995 - RNA, 12 nt, Human
uacaauuuuguu

SEQ ID NO: 2741996 - RNA, 16 nt, Human
uacaauuuuguuucug

SEQ ID NO: 2741997 - RNA, 15 nt, Human
uacaauuuuguuucu

SEQ ID NO: 2741998 - RNA, 11 nt, Human
uacacacacac

SEQ ID NO: 2741999 - RNA, 17 nt, Human
uacaauuuuguuucugu

SEQ ID NO: 2742000 - RNA, 23 nt, Human
uacaguucggugagcuacaaaug

SEQ ID NO: 2742001 - RNA, 15 nt, Human
uacaggagugagcac

SEQ ID NO: 2742002 - RNA, 22 nt, Human
uacaggaaguacuggagaaaau

SEQ ID NO: 2742003 - RNA, 14 nt, Human
uacaggaaguacug

SEQ ID NO: 2742004 - RNA, 15 nt, Human
uacaggaaguacugg

SEQ ID NO: 2742005 - RNA, 20 nt, Human
uacaguugaaaaacagcuga

SEQ ID NO: 2742006 - RNA, 18 nt, Human
uacaguuuguuaguauga

SEQ ID NO: 2742007 - RNA, 17 nt, Human
uacaguugaaaaacagc

SEQ ID NO: 2742008 - RNA, 19 nt, Human
uacaguugaaaaacagcug

SEQ ID NO: 2742009 - RNA, 20 nt, Human
uacacuguuucaaacuuuac

SEQ ID NO: 2742010 - RNA, 22 nt, Human
uacacugugcugagucugaagg

SEQ ID NO: 2742011 - RNA, 23 nt, Human
uacacugugcugagucugaaggc

SEQ ID NO: 2742012 - RNA, 16 nt, Human
uacacuuacacuuuau

SEQ ID NO: 2742013 - RNA, 22 nt, Human
uacacuguuucaaacuuuacua

SEQ ID NO: 2742014 - RNA, 18 nt, Human
uacaggaagguagaaaua

SEQ ID NO: 2742015 - RNA, 13 nt, Human
uacaggaaguacu

SEQ ID NO: 2742016 - RNA, 20 nt, Human
uacagcuugaccgugaggcc

SEQ ID NO: 2742017 - RNA, 22 nt, Human
uacauggaauaacauguaauua

SEQ ID NO: 2742018 - RNA, 19 nt, Human
uacauggaauaacauguaa

SEQ ID NO: 2742019 - RNA, 18 nt, Human
uacauggaauaacaugua

SEQ ID NO: 2742020 - RNA, 14 nt, Human
uacauggaauaaca

SEQ ID NO: 2742021 - RNA, 14 nt, Human
uacauuuuuaagug

SEQ ID NO: 2742022 - RNA, 21 nt, Human
uacauggcuggagcuagaauu

SEQ ID NO: 2742023 - RNA, 22 nt, Human
uacauuuuuaagugcugcauuu

SEQ ID NO: 2742024 - RNA, 19 nt, Human
uacauuuuuaagugcugca

SEQ ID NO: 2742025 - RNA, 16 nt, Human
uacaugaaaacacauu

SEQ ID NO: 2742026 - RNA, 17 nt, Human
uacauaagauaaaugug

SEQ ID NO: 2742027 - RNA, 16 nt, Human
uacauaagauaaaugu

SEQ ID NO: 2742028 - RNA, 23 nt, Human
uacaugaaaacacauuuuucuua

SEQ ID NO: 2742029 - RNA, 19 nt, Human
uacaugaaaacacauuuuu

SEQ ID NO: 2742030 - RNA, 18 nt, Human
uacaugaaaacacauuuu

SEQ ID NO: 2742031 - RNA, 17 nt, Human
uacaugaaaacacauuu

SEQ ID NO: 2742032 - RNA, 16 nt, Human
uacauaaacaaguccu

SEQ ID NO: 2742033 - RNA, 21 nt, Human
uacaguuuguuaguaugaggc

SEQ ID NO: 2742034 - RNA, 19 nt, Human
uacaguuuguuaguaugag

SEQ ID NO: 2742035 - RNA, 23 nt, Human
uacugucagcuccccucggagaa

SEQ ID NO: 2742036 - RNA, 16 nt, Human
uacuguccuacccacc

SEQ ID NO: 2742037 - RNA, 21 nt, Human
uacugucuucaguaagccgug

SEQ ID NO: 2742038 - RNA, 13 nt, Human
uacuuaacuauuc

SEQ ID NO: 2742039 - RNA, 13 nt, Human
uacuuguggacac

SEQ ID NO: 2742040 - RNA, 22 nt, Human
uacucgaguuacagacaaagcg

SEQ ID NO: 2742041 - RNA, 18 nt, Human
uacucgaguuacagacaa

SEQ ID NO: 2742042 - RNA, 14 nt, Human
uacuacaguuuguu

SEQ ID NO: 2742043 - RNA, 13 nt, Human
uacuacaguuugu

SEQ ID NO: 2742044 - RNA, 22 nt, Human
uacuacaguccucccaucucac

SEQ ID NO: 2742045 - RNA, 23 nt, Human
uaccuuuguucccaaauuucaua

SEQ ID NO: 2742046 - RNA, 13 nt, Human
uaccuuuuuuaga

SEQ ID NO: 2742047 - RNA, 22 nt, Human
uaccuuuuuuagaguugauacu

SEQ ID NO: 2742048 - RNA, 19 nt, Human
uaccuuuuuuagaguugau

SEQ ID NO: 2742049 - RNA, 18 nt, Human
uaccucggugccuuccuc

SEQ ID NO: 2742050 - RNA, 21 nt, Human
uaccucuugagccuugaacuu

SEQ ID NO: 2742051 - RNA, 15 nt, Human
uacuaaaauggacug

SEQ ID NO: 2742052 - RNA, 17 nt, Human
uacuaaaauggacugug

SEQ ID NO: 2742053 - RNA, 18 nt, Human
uacgaaaagaggggaaga

SEQ ID NO: 2742054 - RNA, 21 nt, Human
uacgaaaagaggggaagagac

SEQ ID NO: 2742055 - RNA, 17 nt, Human
uaccuuuuuuauacaua

SEQ ID NO: 2742056 - RNA, 16 nt, Human
uaccuuuuuuauacau

SEQ ID NO: 2742057 - RNA, 13 nt, Human
uaccuuuuuuaua

SEQ ID NO: 2742058 - RNA, 23 nt, Human
uacuaaaauggacuguggugacu

SEQ ID NO: 2742059 - RNA, 13 nt, Human
uacuaacuuuccu

SEQ ID NO: 2742060 - RNA, 14 nt, Human
uacuaaggaaucuu

SEQ ID NO: 2742061 - RNA, 21 nt, Human
uacuaauagacaauuuauuau

SEQ ID NO: 2742062 - RNA, 20 nt, Human
uacuaauagacaauuuauua

SEQ ID NO: 2742063 - RNA, 22 nt, Human
uaccaaaaaucucaauauuuca

SEQ ID NO: 2742064 - RNA, 15 nt, Human
uacccacugcucugg

SEQ ID NO: 2742065 - RNA, 14 nt, Human
uacccagaaaguua

SEQ ID NO: 2742066 - RNA, 23 nt, Human
uacauuuuuaagugcugcauuua

SEQ ID NO: 2742067 - RNA, 16 nt, Human
uaccuaucaucuuaag

SEQ ID NO: 2742068 - RNA, 15 nt, Human
uaccuacauacaauu

SEQ ID NO: 2742069 - RNA, 14 nt, Human
ugaauuacauuugu

SEQ ID NO: 2742070 - RNA, 13 nt, Human
ugaauuguaagga

SEQ ID NO: 2742071 - RNA, 21 nt, Human
ugaauuguaaggaaugauuaa

SEQ ID NO: 2742072 - RNA, 13 nt, Human
ugaauuacauuug

SEQ ID NO: 2742073 - RNA, 14 nt, Human
ugaauuaaguuuuu

SEQ ID NO: 2742074 - RNA, 23 nt, Human
ugacaacacucauugaccugagg

SEQ ID NO: 2742075 - RNA, 16 nt, Human
ugaauuuaaauagcuu

SEQ ID NO: 2742076 - RNA, 13 nt, Human
ugacaacacucau

SEQ ID NO: 2742077 - RNA, 18 nt, Human
ugacagaauauguuucaa

SEQ ID NO: 2742078 - RNA, 15 nt, Human
ugacacacagcucug

SEQ ID NO: 2742079 - RNA, 14 nt, Human
ugacacacagcucu

SEQ ID NO: 2742080 - RNA, 14 nt, Human
ugacagacacaggc

SEQ ID NO: 2742081 - RNA, 16 nt, Human
ugacagacacaggccc

SEQ ID NO: 2742082 - RNA, 13 nt, Human
ugacagacacagg

SEQ ID NO: 2742083 - RNA, 21 nt, Human
ugacagaauauguuucaaacu

SEQ ID NO: 2742084 - RNA, 22 nt, Human
ugacagaauauguuucaaacuu

SEQ ID NO: 2742085 - RNA, 22 nt, Human
ugacaacuucccagugaauucu

SEQ ID NO: 2742086 - RNA, 23 nt, Human
ugacaaggauugcuacuguccua

SEQ ID NO: 2742087 - RNA, 20 nt, Human
ugaccagcaccaucucuccu

SEQ ID NO: 2742088 - RNA, 22 nt, Human
ugacagagcaagugagacccug

SEQ ID NO: 2742089 - RNA, 23 nt, Human
ugacaucaacugcaucaagaugu

SEQ ID NO: 2742090 - RNA, 23 nt, Human
ugacagaauauguuucaaacuuu

SEQ ID NO: 2742091 - RNA, 17 nt, Human
ugacagacacaggcccg

SEQ ID NO: 2742092 - RNA, 18 nt, Human
ugacagacacaggcccgg

SEQ ID NO: 2742093 - RNA, 23 nt, Human
ugaaugaugauccuaggcauuug

SEQ ID NO: 2742094 - RNA, 13 nt, Human
ugaaucucauaau

SEQ ID NO: 2742095 - RNA, 20 nt, Human
ugaaucucauaauuuauaca

SEQ ID NO: 2742096 - RNA, 16 nt, Human
ugaaguuuacauugua

SEQ ID NO: 2742097 - RNA, 20 nt, Human
ugaaguuuacauuguaaaua

SEQ ID NO: 2742098 - RNA, 14 nt, Human
ugaaguuuacauug

SEQ ID NO: 2742099 - RNA, 20 nt, Human
ugaaggcuggguucugaucc

SEQ ID NO: 2742100 - RNA, 21 nt, Human
ugaaggcuggguucugauccu

SEQ ID NO: 2742101 - RNA, 18 nt, Human
ugaacuugaaauuugaau

SEQ ID NO: 2742102 - RNA, 14 nt, Human
ugaacuugaaauuu

SEQ ID NO: 2742103 - RNA, 13 nt, Human
ugaacuugaaauu

SEQ ID NO: 2742104 - RNA, 19 nt, Human
ugaagacucauucuucugu

SEQ ID NO: 2742105 - RNA, 20 nt, Human
ugaagacucauucuucugua

SEQ ID NO: 2742106 - RNA, 23 nt, Human
ugaacuggguacuuguggacaca

SEQ ID NO: 2742107 - RNA, 15 nt, Human
ugaaggaaaaugaua

SEQ ID NO: 2742108 - RNA, 18 nt, Human
ugaaggccccgcccaggc

SEQ ID NO: 2742109 - RNA, 16 nt, Human
ugaaggcuggguucug

SEQ ID NO: 2742110 - RNA, 19 nt, Human
ugaaggccccgcccaggcu

SEQ ID NO: 2742111 - RNA, 20 nt, Human
ugaaggccccgcccaggcuu

SEQ ID NO: 2742112 - RNA, 19 nt, Human
ugaagagguuuuaaagcuu

SEQ ID NO: 2742113 - RNA, 21 nt, Human
ugaagagguuuuaaagcuucc

SEQ ID NO: 2742114 - RNA, 20 nt, Human
ugaagagguuuuaaagcuuc

SEQ ID NO: 2742115 - RNA, 14 nt, Human
ugacucuuaagaag

SEQ ID NO: 2742116 - RNA, 15 nt, Human
ugacucuuaagaaga

SEQ ID NO: 2742117 - RNA, 16 nt, Human
ugacucuuaagaagac

SEQ ID NO: 2742118 - RNA, 13 nt, Human
ugacucuuaagaa

SEQ ID NO: 2742119 - RNA, 13 nt, Human
ugaccauucucca

SEQ ID NO: 2742120 - RNA, 14 nt, Human
ugaccauucuccac

SEQ ID NO: 2742121 - RNA, 21 nt, Human
ugacucuuucuauuguuucuu

SEQ ID NO: 2742122 - RNA, 16 nt, Human
ugacuuuccucuuugg

SEQ ID NO: 2742123 - RNA, 22 nt, Human
ugacuuuggauaauaaggaaaa

SEQ ID NO: 2742124 - RNA, 20 nt, Human
ugacuuuggauaauaaggaa

SEQ ID NO: 2742125 - RNA, 16 nt, Human
ugacuuuggauaauaa

SEQ ID NO: 2742126 - RNA, 15 nt, Human
ugacuuuggauaaua

SEQ ID NO: 2742127 - RNA, 14 nt, Human
ugacuuuggauaau

SEQ ID NO: 2742128 - RNA, 13 nt, Human
ugacuuuggauaa

SEQ ID NO: 2742129 - RNA, 12 nt, Human
ugacuuuggaua

SEQ ID NO: 2742130 - RNA, 15 nt, Human
ugagaaagacuauuc

SEQ ID NO: 2742131 - RNA, 15 nt, Human
ugagaaauaaaguuu

SEQ ID NO: 2742132 - RNA, 22 nt, Human
ugacuuuucuguccgagcuuug

SEQ ID NO: 2742133 - RNA, 20 nt, Human
ugagcaggauuuuaaucuuu

SEQ ID NO: 2742134 - RNA, 15 nt, Human
ugagcaggauuuuaa

SEQ ID NO: 2742135 - RNA, 14 nt, Human
ugagaccaaccugg

SEQ ID NO: 2742136 - RNA, 18 nt, Human
ugagaggggaacagacug

SEQ ID NO: 2742137 - RNA, 14 nt, Human
ugagaggggaacag

SEQ ID NO: 2742138 - RNA, 15 nt, Human
ugaggcucugcccuu

SEQ ID NO: 2742139 - RNA, 16 nt, Human
ugaggcucugcccuug

SEQ ID NO: 2742140 - RNA, 18 nt, Human
ugaggcucugcccuuggu

SEQ ID NO: 2742141 - RNA, 15 nt, Human
ugaggcugggcuccc

SEQ ID NO: 2742142 - RNA, 16 nt, Human
ugaggcugggcucccu

SEQ ID NO: 2742143 - RNA, 21 nt, Human
ugaggugggaggaucucuuga

SEQ ID NO: 2742144 - RNA, 21 nt, Human
ugaggcugggcucccuuccca

SEQ ID NO: 2742145 - RNA, 18 nt, Human
ugaggucagagccugcag

SEQ ID NO: 2742146 - RNA, 19 nt, Human
ugaggucagagccugcagu

SEQ ID NO: 2742147 - RNA, 11 nt, Human
ugagcucagga

SEQ ID NO: 2742148 - RNA, 19 nt, Human
ugagcucaggaguuugaga

SEQ ID NO: 2742149 - RNA, 23 nt, Human
ugagccgagaucacgccacugca

SEQ ID NO: 2742150 - RNA, 20 nt, Human
ugagcagggcucagcgggga

SEQ ID NO: 2742151 - RNA, 22 nt, Human
ugagcagggcucagcggggaca

SEQ ID NO: 2742152 - RNA, 23 nt, Human
ugagcagggcucagcggggacag

SEQ ID NO: 2742153 - RNA, 22 nt, Human
ugagccgagaucacgccacugc

SEQ ID NO: 2742154 - RNA, 22 nt, Human
ugaggaugaaaaaauaacacug

SEQ ID NO: 2742155 - RNA, 13 nt, Human
ucugucuaggaau

SEQ ID NO: 2742156 - RNA, 20 nt, Human
ucuguccuacucugugucag

SEQ ID NO: 2742157 - RNA, 15 nt, Human
ucuguacagagccca

SEQ ID NO: 2742158 - RNA, 14 nt, Human
ucuguacagagccc

SEQ ID NO: 2742159 - RNA, 12 nt, Human
ucuguccuggga

SEQ ID NO: 2742160 - RNA, 17 nt, Human
ucugucgcccagucugg

SEQ ID NO: 2742161 - RNA, 16 nt, Human
ucuggugacuuuccuc

SEQ ID NO: 2742162 - RNA, 11 nt, Human
ucugcugcugg

SEQ ID NO: 2742163 - RNA, 13 nt, Human
ucugcugcuggcu

SEQ ID NO: 2742164 - RNA, 17 nt, Human
ucugccugcccaggccc

SEQ ID NO: 2742165 - RNA, 18 nt, Human
ucugccugcccaggcccc

SEQ ID NO: 2742166 - RNA, 20 nt, Human
ucugccugcccaggccccug

SEQ ID NO: 2742167 - RNA, 17 nt, Human
ucugcugcuggcugguu

SEQ ID NO: 2742168 - RNA, 14 nt, Human
ucugcugcuggcug

SEQ ID NO: 2742169 - RNA, 15 nt, Human
ucugcugcuggcugg

SEQ ID NO: 2742170 - RNA, 18 nt, Human
ucugccauauucuguugg

SEQ ID NO: 2742171 - RNA, 12 nt, Human
ucugcccacucc

SEQ ID NO: 2742172 - RNA, 22 nt, Human
ucugccauauucuguuggccag

SEQ ID NO: 2742173 - RNA, 23 nt, Human
ucugccauauucuguuggccagu

SEQ ID NO: 2742174 - RNA, 21 nt, Human
ucugccuaaggacuucuuuaa

SEQ ID NO: 2742175 - RNA, 20 nt, Human
ucugccuaaggacuucuuua

SEQ ID NO: 2742176 - RNA, 13 nt, Human
ucugcccacuccc

SEQ ID NO: 2742177 - RNA, 14 nt, Human
ucugcccacucccu

SEQ ID NO: 2742178 - RNA, 23 nt, Human
ucugccuaaggacuucuuuaauu

SEQ ID NO: 2742179 - RNA, 12 nt, Human
ucugccucccau

SEQ ID NO: 2742180 - RNA, 13 nt, Human
ucugccucccauc

SEQ ID NO: 2742181 - RNA, 15 nt, Human
ucugccucccaucac

SEQ ID NO: 2742182 - RNA, 15 nt, Human
ucugccucugacaca

SEQ ID NO: 2742183 - RNA, 18 nt, Human
ucugccucugacacacag

SEQ ID NO: 2742184 - RNA, 16 nt, Human
ucugccucccaucacc

SEQ ID NO: 2742185 - RNA, 17 nt, Human
ucugccucccaucaccc

SEQ ID NO: 2742186 - RNA, 20 nt, Human
ucugccucccaucacccgcu

SEQ ID NO: 2742187 - RNA, 21 nt, Human
ucugccucccaucacccgcua

SEQ ID NO: 2742188 - RNA, 23 nt, Human
ucugccucugacacacagcucug

SEQ ID NO: 2742189 - RNA, 21 nt, Human
ucugccucugacacacagcuc

SEQ ID NO: 2742190 - RNA, 22 nt, Human
ucugccucugacacacagcucu

SEQ ID NO: 2742191 - RNA, 19 nt, Human
ucugccugaagucacacag

SEQ ID NO: 2742192 - RNA, 20 nt, Human
ucugccugaagucacacagu

SEQ ID NO: 2742193 - RNA, 22 nt, Human
ucugaggaauccagacccggcu

SEQ ID NO: 2742194 - RNA, 18 nt, Human
ucugaggaauccagaccc

SEQ ID NO: 2742195 - RNA, 21 nt, Human
ucugaggaauccagacccggc

SEQ ID NO: 2742196 - RNA, 13 nt, Human
ucugcacuccccu

SEQ ID NO: 2742197 - RNA, 24 nt, Human
ucugagaucaaaacgguuuuacug

SEQ ID NO: 2742198 - RNA, 18 nt, Human
ucugagaggacuuuucuu

SEQ ID NO: 2742199 - RNA, 23 nt, Human
ucucauaauuuauacaggucaua

SEQ ID NO: 2742200 - RNA, 19 nt, Human
ucugacccaugcugcccug

SEQ ID NO: 2742201 - RNA, 20 nt, Human
ucugacccaugcugcccugu

SEQ ID NO: 2742202 - RNA, 22 nt, Human
ucugacccaugcugcccuguga

SEQ ID NO: 2742203 - RNA, 23 nt, Human
ucugacccaugcugcccugugag

SEQ ID NO: 2742204 - RNA, 17 nt, Human
ucuuuccacagaagcuc

SEQ ID NO: 2742205 - RNA, 17 nt, Human
ucuuuccaaaguacacu

SEQ ID NO: 2742206 - RNA, 12 nt, Human
ucuuucccuccc

SEQ ID NO: 2742207 - RNA, 23 nt, Human
ucuuucccucccuuccucuuucc

SEQ ID NO: 2742208 - RNA, 13 nt, Human
ucuuucccucccu

SEQ ID NO: 2742209 - RNA, 17 nt, Human
ucuugucucagauuuua

SEQ ID NO: 2742210 - RNA, 12 nt, Human
ucuugucucaga

SEQ ID NO: 2742211 - RNA, 15 nt, Human
ucuugucucagauuu

SEQ ID NO: 2742212 - RNA, 14 nt, Human
ucuugucucagauu

SEQ ID NO: 2742213 - RNA, 23 nt, Human
ucuuuccaaaguacacuguuuca

SEQ ID NO: 2742214 - RNA, 13 nt, Human
ucuuguguguuua

SEQ ID NO: 2742215 - RNA, 13 nt, Human
ucuuugcagacag

SEQ ID NO: 2742216 - RNA, 23 nt, Human
ucuuugagugaagcugggagaac

SEQ ID NO: 2742217 - RNA, 14 nt, Human
ucuuugcagacagg

SEQ ID NO: 2742218 - RNA, 17 nt, Human
ucuuugcagacaggcaa

SEQ ID NO: 2742219 - RNA, 13 nt, Human
ucuuuggacccug

SEQ ID NO: 2742220 - RNA, 16 nt, Human
ucuuuggacccugagg

SEQ ID NO: 2742221 - RNA, 14 nt, Human
ucuuuggacccuga

SEQ ID NO: 2742222 - RNA, 15 nt, Human
ucuuuggacccugag

SEQ ID NO: 2742223 - RNA, 19 nt, Human
ugaaaagaaaaaugagccu

SEQ ID NO: 2742224 - RNA, 15 nt, Human
ugaaaagaaaaauga

SEQ ID NO: 2742225 - RNA, 19 nt, Human
ugaaaauuauuuuguucau

SEQ ID NO: 2742226 - RNA, 20 nt, Human
ugaaaagaaaaaugagccug

SEQ ID NO: 2742227 - RNA, 22 nt, Human
ugaaaagaaaaaugagccuggc

SEQ ID NO: 2742228 - RNA, 12 nt, Human
ugaaaauuuuga

SEQ ID NO: 2742229 - RNA, 23 nt, Human
ugaaacacucaguuguucaauaa

SEQ ID NO: 2742230 - RNA, 14 nt, Human
ugaaaauucagugg

SEQ ID NO: 2742231 - RNA, 22 nt, Human
ugaaaauuauuuuguucauaca

SEQ ID NO: 2742232 - RNA, 23 nt, Human
ugaaaauuauuuuguucauacau

SEQ ID NO: 2742233 - RNA, 22 nt, Human
ugaaaacacuguucucugcccu

SEQ ID NO: 2742234 - RNA, 23 nt, Human
ugaaaacacuguucucugcccuc

SEQ ID NO: 2742235 - RNA, 17 nt, Human
ugaaaacacuguucucu

SEQ ID NO: 2742236 - RNA, 20 nt, Human
ugaaaacacuguucucugcc

SEQ ID NO: 2742237 - RNA, 21 nt, Human
ugaaaacacuguucucugccc

SEQ ID NO: 2742238 - RNA, 21 nt, Human
ugaaaacacauuuuucuuagg

SEQ ID NO: 2742239 - RNA, 14 nt, Human
ucuuauaauuuaaa

SEQ ID NO: 2742240 - RNA, 13 nt, Human
ucuuauaauuuaa

SEQ ID NO: 2742241 - RNA, 22 nt, Human
ucuuaggguuaugauuaaguaa

SEQ ID NO: 2742242 - RNA, 20 nt, Human
ucuuagguuggcaaaaaggc

SEQ ID NO: 2742243 - RNA, 23 nt, Human
ucuuagguuggcaaaaaggcagg

SEQ ID NO: 2742244 - RNA, 15 nt, Human
ucuuagauguauaua

SEQ ID NO: 2742245 - RNA, 14 nt, Human
ucuuagauguauau

SEQ ID NO: 2742246 - RNA, 17 nt, Human
ucugugucagguggggc

SEQ ID NO: 2742247 - RNA, 20 nt, Human
ucugugucagguggggcagc

SEQ ID NO: 2742248 - RNA, 14 nt, Human
ucuucagaucucua

SEQ ID NO: 2742249 - RNA, 21 nt, Human
ucuucagagacuccugcaggc

SEQ ID NO: 2742250 - RNA, 22 nt, Human
ucuuauccaacaucaacaucuu

SEQ ID NO: 2742251 - RNA, 19 nt, Human
ucuugccaaauauaaauaa

SEQ ID NO: 2742252 - RNA, 19 nt, Human
ucuugaaggaaaaugauac

SEQ ID NO: 2742253 - RNA, 14 nt, Human
ucuugcucugcuga

SEQ ID NO: 2742254 - RNA, 18 nt, Human
ucuuguagcuuuaucaaa

SEQ ID NO: 2742255 - RNA, 15 nt, Human
ucuugcucugcugac

SEQ ID NO: 2742256 - RNA, 23 nt, Human
ucuugcucugcugacagacacag

SEQ ID NO: 2742257 - RNA, 21 nt, Human
ucuugaaauauaggaacuuaa

SEQ ID NO: 2742258 - RNA, 20 nt, Human
ucuugaaauauaggaacuua

SEQ ID NO: 2742259 - RNA, 15 nt, Human
ucuugcaugaggcua

SEQ ID NO: 2742260 - RNA, 13 nt, Human
ucuugaagacuuu

SEQ ID NO: 2742261 - RNA, 22 nt, Human
ucuugaagacuuuucuuucagc

SEQ ID NO: 2742262 - RNA, 16 nt, Human
ucagcugcugaaacaa

SEQ ID NO: 2742263 - RNA, 15 nt, Human
ucagcugcuacuacu

SEQ ID NO: 2742264 - RNA, 22 nt, Human
ucaggagaguagaacagauaau

SEQ ID NO: 2742265 - RNA, 21 nt, Human
ucagcuccccucggagaagag

SEQ ID NO: 2742266 - RNA, 22 nt, Human
ucagcuccccucggagaagagc

SEQ ID NO: 2742267 - RNA, 15 nt, Human
ucagcuccagcucac

SEQ ID NO: 2742268 - RNA, 18 nt, Human
ucagcuccagcucaccag

SEQ ID NO: 2742269 - RNA, 21 nt, Human
ucagcuccagcucaccagccc

SEQ ID NO: 2742270 - RNA, 22 nt, Human
ucagcuccagcucaccagcccc

SEQ ID NO: 2742271 - RNA, 16 nt, Human
ucagccugcuccagcu

SEQ ID NO: 2742272 - RNA, 22 nt, Human
ucagccucccaaagugcuggga

SEQ ID NO: 2742273 - RNA, 12 nt, Human
ucagccucccga

SEQ ID NO: 2742274 - RNA, 20 nt, Human
ucagccucccgaauagcugg

SEQ ID NO: 2742275 - RNA, 15 nt, Human
ucagauacuggauug

SEQ ID NO: 2742276 - RNA, 14 nt, Human
ucagauacuggauu

SEQ ID NO: 2742277 - RNA, 18 nt, Human
ucagauaugauucaaaug

SEQ ID NO: 2742278 - RNA, 16 nt, Human
ucagauaugauucaaa

SEQ ID NO: 2742279 - RNA, 17 nt, Human
ucagauaugauucaaau

SEQ ID NO: 2742280 - RNA, 20 nt, Human
ucagauacuggauuguacuu

SEQ ID NO: 2742281 - RNA, 19 nt, Human
ucagauacuggauuguacu

SEQ ID NO: 2742282 - RNA, 16 nt, Human
ucagauacuggauugu

SEQ ID NO: 2742283 - RNA, 12 nt, Human
ucagccucccaa

SEQ ID NO: 2742284 - RNA, 13 nt, Human
ucagccucccaaa

SEQ ID NO: 2742285 - RNA, 15 nt, Human
ucagcauccuggcac

SEQ ID NO: 2742286 - RNA, 16 nt, Human
ucagcauccuggcacc

SEQ ID NO: 2742287 - RNA, 17 nt, Human
ucagcauccuggcaccc

SEQ ID NO: 2742288 - RNA, 18 nt, Human
ucagcauccuggcacccg

SEQ ID NO: 2742289 - RNA, 17 nt, Human
ucagcacgauuucuguu

SEQ ID NO: 2742290 - RNA, 16 nt, Human
ucagcacgauuucugu

SEQ ID NO: 2742291 - RNA, 15 nt, Human
ucagcacgauuucug

SEQ ID NO: 2742292 - RNA, 15 nt, Human
ucaguccauagcaga

SEQ ID NO: 2742293 - RNA, 21 nt, Human
ucagguggggucacucuggca

SEQ ID NO: 2742294 - RNA, 17 nt, Human
ucagguggggucacucu

SEQ ID NO: 2742295 - RNA, 20 nt, Human
ucagguggggucacucuggc

SEQ ID NO: 2742296 - RNA, 14 nt, Human
ucagguggggcagc

SEQ ID NO: 2742297 - RNA, 18 nt, Human
ucaggugcugccauccag

SEQ ID NO: 2742298 - RNA, 20 nt, Human
ucaggugcugccauccaggu

SEQ ID NO: 2742299 - RNA, 15 nt, Human
ucagguggggcagcu

SEQ ID NO: 2742300 - RNA, 16 nt, Human
ucagguggggcagcuu

SEQ ID NO: 2742301 - RNA, 21 nt, Human
ucagguggggcagcuugaggg

SEQ ID NO: 2742302 - RNA, 17 nt, Human
ucagguggggcagcuug

SEQ ID NO: 2742303 - RNA, 19 nt, Human
ucagugugucuaaauuuga

SEQ ID NO: 2742304 - RNA, 18 nt, Human
ucagugugacugaucucu

SEQ ID NO: 2742305 - RNA, 17 nt, Human
ucagucugauucccaag

SEQ ID NO: 2742306 - RNA, 19 nt, Human
ucagucugauucccaagcu

SEQ ID NO: 2742307 - RNA, 21 nt, Human
ucauggaauuggagcucgugg

SEQ ID NO: 2742308 - RNA, 15 nt, Human
ucaugaaagauucaa

SEQ ID NO: 2742309 - RNA, 19 nt, Human
ucauggaauuggagcucgu

SEQ ID NO: 2742310 - RNA, 13 nt, Human
ucaugaaagauuc

SEQ ID NO: 2742311 - RNA, 15 nt, Human
ucauacucaccucac

SEQ ID NO: 2742312 - RNA, 17 nt, Human
uccauagagagcaagac

SEQ ID NO: 2742313 - RNA, 20 nt, Human
uccauagagagcaagacgcu

SEQ ID NO: 2742314 - RNA, 17 nt, Human
ucccaacucaccccagc

SEQ ID NO: 2742315 - RNA, 18 nt, Human
ucccaacucaccccagcc

SEQ ID NO: 2742316 - RNA, 19 nt, Human
ucccaacucaccccagccc

SEQ ID NO: 2742317 - RNA, 21 nt, Human
ucccaacucaccccagcccca

SEQ ID NO: 2742318 - RNA, 18 nt, Human
ucccaccucagccucccg

SEQ ID NO: 2742319 - RNA, 16 nt, Human
ucccaccucagccucc

SEQ ID NO: 2742320 - RNA, 14 nt, Human
ucccaccucucuca

SEQ ID NO: 2742321 - RNA, 17 nt, Human
ucccaccucucucacuc

SEQ ID NO: 2742322 - RNA, 18 nt, Human
ucccaccucucucacucc

SEQ ID NO: 2742323 - RNA, 19 nt, Human
ucccaccuuggcugcaggg

SEQ ID NO: 2742324 - RNA, 21 nt, Human
ucccaccuuggcugcagggag

SEQ ID NO: 2742325 - RNA, 20 nt, Human
ucccaccucucucacuccuu

SEQ ID NO: 2742326 - RNA, 14 nt, Human
ucccacucagucca

SEQ ID NO: 2742327 - RNA, 17 nt, Human
ucccaggcauuccccag

SEQ ID NO: 2742328 - RNA, 18 nt, Human
ucccaggcauuccccagg

SEQ ID NO: 2742329 - RNA, 19 nt, Human
ucccaggcauuccccagga

SEQ ID NO: 2742330 - RNA, 15 nt, Human
ucccaugagccucag

SEQ ID NO: 2742331 - RNA, 16 nt, Human
ucccaugagccucagc

SEQ ID NO: 2742332 - RNA, 14 nt, Human
uccaagaagcccag

SEQ ID NO: 2742333 - RNA, 15 nt, Human
uccaagaagcccagg

SEQ ID NO: 2742334 - RNA, 16 nt, Human
uccaagaagcccagga

SEQ ID NO: 2742335 - RNA, 19 nt, Human
uccaagaagcccaggaaag

SEQ ID NO: 2742336 - RNA, 20 nt, Human
uccaagaccuucuccuucac

SEQ ID NO: 2742337 - RNA, 14 nt, Human
uccaagcaggacau

SEQ ID NO: 2742338 - RNA, 21 nt, Human
uccacaagagcccaggccucc

SEQ ID NO: 2742339 - RNA, 20 nt, Human
uccacaagagcccaggccuc

SEQ ID NO: 2742340 - RNA, 19 nt, Human
uccacaagagcccaggccu

SEQ ID NO: 2742341 - RNA, 21 nt, Human
uccacccugcucuccgaccag

SEQ ID NO: 2742342 - RNA, 13 nt, Human
uccacccugcucu

SEQ ID NO: 2742343 - RNA, 14 nt, Human
uccacccugcucuc

SEQ ID NO: 2742344 - RNA, 22 nt, Human
uccacugugccaugugccaggu

SEQ ID NO: 2742345 - RNA, 14 nt, Human
uccacuuucuagcc

SEQ ID NO: 2742346 - RNA, 18 nt, Human
ucuaggaggucucuaaga

SEQ ID NO: 2742347 - RNA, 18 nt, Human
ucuacucuagggaaaaac

SEQ ID NO: 2742348 - RNA, 20 nt, Human
ucuacucgaguuacagacaa

SEQ ID NO: 2742349 - RNA, 21 nt, Human
ucuacucgaguuacagacaaa

SEQ ID NO: 2742350 - RNA, 12 nt, Human
ucuagggaaaaa

SEQ ID NO: 2742351 - RNA, 13 nt, Human
ucuauauuuuaca

SEQ ID NO: 2742352 - RNA, 14 nt, Human
ucuauauuuucauu

SEQ ID NO: 2742353 - RNA, 13 nt, Human
ucuauauuuucau

SEQ ID NO: 2742354 - RNA, 13 nt, Human
ucucagauuuuau

SEQ ID NO: 2742355 - RNA, 15 nt, Human
ucucagauuuuauua

SEQ ID NO: 2742356 - RNA, 14 nt, Human
ucucagauuuuauu

SEQ ID NO: 2742357 - RNA, 19 nt, Human
ucucagauuuuauuaugua

SEQ ID NO: 2742358 - RNA, 18 nt, Human
ucucagauuuuauuaugu

SEQ ID NO: 2742359 - RNA, 17 nt, Human
ucucagauuuuauuaug

SEQ ID NO: 2742360 - RNA, 16 nt, Human
ucucagauuuuauuau

SEQ ID NO: 2742361 - RNA, 16 nt, Human
ucucauaauuuauaca

SEQ ID NO: 2742362 - RNA, 22 nt, Human
ucucauaauuuauacaggucau

SEQ ID NO: 2742363 - RNA, 14 nt, Human
ucucacuguugccc

SEQ ID NO: 2742364 - RNA, 15 nt, Human
ucucacuguugccca

SEQ ID NO: 2742365 - RNA, 19 nt, Human
ucuauauuuucauucuccu

SEQ ID NO: 2742366 - RNA, 16 nt, Human
ucuauauuuucauucu

SEQ ID NO: 2742367 - RNA, 15 nt, Human
ucuauauuuucauuc

SEQ ID NO: 2742368 - RNA, 16 nt, Human
ucucaaauuucuaaau

SEQ ID NO: 2742369 - RNA, 14 nt, Human
ucucaaauuucuaa

SEQ ID NO: 2742370 - RNA, 13 nt, Human
ucucaaauuucua

SEQ ID NO: 2742371 - RNA, 20 nt, Human
ucucacugccaugccagcuu

SEQ ID NO: 2742372 - RNA, 23 nt, Human
ucucacucugucgcccagucugg

SEQ ID NO: 2742373 - RNA, 21 nt, Human
ucucacacaugagcaucaggc

SEQ ID NO: 2742374 - RNA, 16 nt, Human
ucucacacaugagcau

SEQ ID NO: 2742375 - RNA, 18 nt, Human
ucucaaauuucuaaaucu

SEQ ID NO: 2742376 - RNA, 14 nt, Human
ucgcccagucugga

SEQ ID NO: 2742377 - RNA, 19 nt, Human
ucgcccagucuggaaugca

SEQ ID NO: 2742378 - RNA, 23 nt, Human
ucgcccagucuggaaugcagugg

SEQ ID NO: 2742379 - RNA, 18 nt, Human
ucggaaaacaugcuacac

SEQ ID NO: 2742380 - RNA, 15 nt, Human
ucggaaaacaugcua

SEQ ID NO: 2742381 - RNA, 22 nt, Human
uccuuuucgcaggauucuuccu

SEQ ID NO: 2742382 - RNA, 18 nt, Human
uccuuuucgcaggauucu

SEQ ID NO: 2742383 - RNA, 17 nt, Human
ucgcaggauucuuccuc

SEQ ID NO: 2742384 - RNA, 23 nt, Human
ucgcaggauucuuccucccuccc

SEQ ID NO: 2742385 - RNA, 21 nt, Human
ucgcaggauucuuccucccuc

SEQ ID NO: 2742386 - RNA, 17 nt, Human
uccuugcaucaauuuuu

SEQ ID NO: 2742387 - RNA, 18 nt, Human
uccuuggugucgggcaug

SEQ ID NO: 2742388 - RNA, 21 nt, Human
uccuuggugucgggcaugaca

SEQ ID NO: 2742389 - RNA, 17 nt, Human
uccuuugugaggaagcc

SEQ ID NO: 2742390 - RNA, 18 nt, Human
uccuuugugaggaagccg

SEQ ID NO: 2742391 - RNA, 22 nt, Human
uccuuugugaggaagccgcugg

SEQ ID NO: 2742392 - RNA, 22 nt, Human
uccuuggugucgggcaugacac

SEQ ID NO: 2742393 - RNA, 20 nt, Human
uccuuaccagcagagcaccu

SEQ ID NO: 2742394 - RNA, 21 nt, Human
uccuuaccagcagagcaccuu

SEQ ID NO: 2742395 - RNA, 22 nt, Human
uccuugaaaacacuguucucug

SEQ ID NO: 2742396 - RNA, 23 nt, Human
uccuugaaaacacuguucucugc

SEQ ID NO: 2742397 - RNA, 18 nt, Human
uccugagccagauuucac

SEQ ID NO: 2742398 - RNA, 19 nt, Human
uccugagccagauuucacu

SEQ ID NO: 2742399 - RNA, 19 nt, Human
uccucuguacagagcccac

SEQ ID NO: 2742400 - RNA, 23 nt, Human
uccucuguacagagcccacgccc

SEQ ID NO: 2742401 - RNA, 17 nt, Human
uccugagccagauuuca

SEQ ID NO: 2742402 - RNA, 12 nt, Human
uccugaggcugg

SEQ ID NO: 2742403 - RNA, 15 nt, Human
uccugaggcugggcu

SEQ ID NO: 2742404 - RNA, 16 nt, Human
uccugaggcugggcuc

SEQ ID NO: 2742405 - RNA, 17 nt, Human
uccugaggcugggcucc

SEQ ID NO: 2742406 - RNA, 19 nt, Human
uccugaggcugggcucccu

SEQ ID NO: 2742407 - RNA, 14 nt, Human
uccucugcuugcca

SEQ ID NO: 2742408 - RNA, 15 nt, Human
uccucugcuugccau

SEQ ID NO: 2742409 - RNA, 16 nt, Human
uccucugcuugccauc

SEQ ID NO: 2742410 - RNA, 17 nt, Human
uccucugcuugccaucc

SEQ ID NO: 2742411 - RNA, 17 nt, Human
uccucugcugcuggcug

SEQ ID NO: 2742412 - RNA, 15 nt, Human
uccucuggccugugu

SEQ ID NO: 2742413 - RNA, 13 nt, Human
uccucuguacaga

SEQ ID NO: 2742414 - RNA, 21 nt, Human
uccuccuuuucacaguucucu

SEQ ID NO: 2742415 - RNA, 17 nt, Human
uccucuaggaggucucu

SEQ ID NO: 2742416 - RNA, 21 nt, Human
uccucuaggaggucucuaaga

SEQ ID NO: 2742417 - RNA, 12 nt, Human
uccuccucagau

SEQ ID NO: 2742418 - RNA, 12 nt, Human
uccuccaggugc

SEQ ID NO: 2742419 - RNA, 13 nt, Human
uccuccaggugca

SEQ ID NO: 2742420 - RNA, 14 nt, Human
uccuccaggugcac

SEQ ID NO: 2742421 - RNA, 18 nt, Human
uccuccaggugcacaagc

SEQ ID NO: 2742422 - RNA, 20 nt, Human
uccuccaggugcacaagcuc

SEQ ID NO: 2742423 - RNA, 22 nt, Human
uccuccaggugcacaagcucca

SEQ ID NO: 2742424 - RNA, 21 nt, Human
uccuaguuccaccaucaagcc

SEQ ID NO: 2742425 - RNA, 16 nt, Human
uccuaagcuauucagu

SEQ ID NO: 2742426 - RNA, 18 nt, Human
uccuaagcuauucaguaa

SEQ ID NO: 2742427 - RNA, 12 nt, Human
uccuaguuccac

SEQ ID NO: 2742428 - RNA, 14 nt, Human
uccuaguuccacca

SEQ ID NO: 2742429 - RNA, 17 nt, Human
uccuaguuccaccauca

SEQ ID NO: 2742430 - RNA, 17 nt, Human
ucccaugagccucagca

SEQ ID NO: 2742431 - RNA, 22 nt, Human
ucccaugagccucagcauccug

SEQ ID NO: 2742432 - RNA, 18 nt, Human
ucccucccuuccucuuuc

SEQ ID NO: 2742433 - RNA, 14 nt, Human
ucccugccaaugga

SEQ ID NO: 2742434 - RNA, 16 nt, Human
ucccugccaauggacu

SEQ ID NO: 2742435 - RNA, 13 nt, Human
ucccucuggggcu

SEQ ID NO: 2742436 - RNA, 20 nt, Human
ucccugcacuugcagacucu

SEQ ID NO: 2742437 - RNA, 17 nt, Human
ucccucuggggcuguuc

SEQ ID NO: 2742438 - RNA, 14 nt, Human
ucccuucccaccuc

SEQ ID NO: 2742439 - RNA, 16 nt, Human
ucccuucccaccucuc

SEQ ID NO: 2742440 - RNA, 17 nt, Human
ucccuucccaccucucu

SEQ ID NO: 2742441 - RNA, 21 nt, Human
ucccuucccacuggaggcaug

SEQ ID NO: 2742442 - RNA, 21 nt, Human
uccgaaagggacuuggaagcu

SEQ ID NO: 2742443 - RNA, 22 nt, Human
uccgaaagggacuuggaagcuc

SEQ ID NO: 2742444 - RNA, 21 nt, Human
uccgcuuucuacccagcgagc

SEQ ID NO: 2742445 - RNA, 16 nt, Human
ugccugguggcagcug

SEQ ID NO: 2742446 - RNA, 14 nt, Human
ugccugguggcagc

SEQ ID NO: 2742447 - RNA, 15 nt, Human
ugccugguggcagcu

SEQ ID NO: 2742448 - RNA, 18 nt, Human
ugccugggcagaaggaag

SEQ ID NO: 2742449 - RNA, 21 nt, Human
ugccugggaucccucauccuc

SEQ ID NO: 2742450 - RNA, 18 nt, Human
ugccccuggcagccccug

SEQ ID NO: 2742451 - RNA, 20 nt, Human
ugccucgaacuggcugcaaa

SEQ ID NO: 2742452 - RNA, 18 nt, Human
ugccucgaacuggcugca

SEQ ID NO: 2742453 - RNA, 19 nt, Human
ugccucgaacuggcugcaa

SEQ ID NO: 2742454 - RNA, 15 nt, Human
ugccuucucaacucc

SEQ ID NO: 2742455 - RNA, 14 nt, Human
ugcgaucuggguuc

SEQ ID NO: 2742456 - RNA, 15 nt, Human
ugcgaucuggguuca

SEQ ID NO: 2742457 - RNA, 19 nt, Human
ugcgaucuggguucacugc

SEQ ID NO: 2742458 - RNA, 20 nt, Human
ugcgaucuggguucacugca

SEQ ID NO: 2742459 - RNA, 21 nt, Human
ugcgaucuggguucacugcaa

SEQ ID NO: 2742460 - RNA, 22 nt, Human
ugcgccuacaggagugagcacu

SEQ ID NO: 2742461 - RNA, 14 nt, Human
ugcgccuacaggag

SEQ ID NO: 2742462 - RNA, 16 nt, Human
ugcgccuacaggagug

SEQ ID NO: 2742463 - RNA, 15 nt, Human
ugcuaaaugugaaug

SEQ ID NO: 2742464 - RNA, 14 nt, Human
ugcuccucucccca

SEQ ID NO: 2742465 - RNA, 15 nt, Human
ugcuaagcauuccaa

SEQ ID NO: 2742466 - RNA, 19 nt, Human
ugcuaagcauuccaacuau

SEQ ID NO: 2742467 - RNA, 15 nt, Human
ugcucacauaucugu

SEQ ID NO: 2742468 - RNA, 16 nt, Human
ugcucacauaucuguc

SEQ ID NO: 2742469 - RNA, 17 nt, Human
ugcugaaacaacaaaua

SEQ ID NO: 2742470 - RNA, 18 nt, Human
ugcuccuuucuuguuuua

SEQ ID NO: 2742471 - RNA, 17 nt, Human
ugcuccucuccccagca

SEQ ID NO: 2742472 - RNA, 18 nt, Human
ugcugauggugcaaugac

SEQ ID NO: 2742473 - RNA, 13 nt, Human
ugcugauggugca

SEQ ID NO: 2742474 - RNA, 15 nt, Human
ugcugauggugcaau

SEQ ID NO: 2742475 - RNA, 17 nt, Human
ugcugauggugcaauga

SEQ ID NO: 2742476 - RNA, 22 nt, Human
ugcugacagacacaggcccggc

SEQ ID NO: 2742477 - RNA, 23 nt, Human
ugcugacagacacaggcccggcu

SEQ ID NO: 2742478 - RNA, 13 nt, Human
ugcugaaggcucg

SEQ ID NO: 2742479 - RNA, 12 nt, Human
ugcugaaggcuc

SEQ ID NO: 2742480 - RNA, 13 nt, Human
ugcugcuggcugg

SEQ ID NO: 2742481 - RNA, 23 nt, Human
ugcugcaguugccagucaccccg

SEQ ID NO: 2742482 - RNA, 18 nt, Human
ugcugcaguugccaguca

SEQ ID NO: 2742483 - RNA, 18 nt, Human
ugcacggugaauggcuuu

SEQ ID NO: 2742484 - RNA, 14 nt, Human
ugcacggugaaugg

SEQ ID NO: 2742485 - RNA, 17 nt, Human
ugcaccgggccacagag

SEQ ID NO: 2742486 - RNA, 22 nt, Human
ugcaccgggccacagagaaagu

SEQ ID NO: 2742487 - RNA, 20 nt, Human
ugaguccccuguuuguuucu

SEQ ID NO: 2742488 - RNA, 14 nt, Human
ugcaccgggccaca

SEQ ID NO: 2742489 - RNA, 15 nt, Human
ugcaccgggccacag

SEQ ID NO: 2742490 - RNA, 19 nt, Human
ugaguccccuguuuguuuc

SEQ ID NO: 2742491 - RNA, 23 nt, Human
ugcaccggcuggccuggccccuc

SEQ ID NO: 2742492 - RNA, 12 nt, Human
ugcacuuuguuc

SEQ ID NO: 2742493 - RNA, 14 nt, Human
ugcacuuuguucug

SEQ ID NO: 2742494 - RNA, 23 nt, Human
ugcagcaauaaagcagcguuucu

SEQ ID NO: 2742495 - RNA, 20 nt, Human
ugcagcaauaaagcagcguu

SEQ ID NO: 2742496 - RNA, 16 nt, Human
ugcagugcuuccaagg

SEQ ID NO: 2742497 - RNA, 15 nt, Human
ugcaggcagccaggc

SEQ ID NO: 2742498 - RNA, 13 nt, Human
ugcaggcagccag

SEQ ID NO: 2742499 - RNA, 14 nt, Human
ugcaggcagccagg

SEQ ID NO: 2742500 - RNA, 15 nt, Human
ugcaguucugaagaa

SEQ ID NO: 2742501 - RNA, 16 nt, Human
ugcaguucugaagaag

SEQ ID NO: 2742502 - RNA, 17 nt, Human
ugcaguucugaagaaga

SEQ ID NO: 2742503 - RNA, 18 nt, Human
ugcaguucugaagaagau

SEQ ID NO: 2742504 - RNA, 14 nt, Human
ugcaguucugaaga

SEQ ID NO: 2742505 - RNA, 22 nt, Human
ugcagugguaugaucacggcuc

SEQ ID NO: 2742506 - RNA, 19 nt, Human
ugcaguucugaagaagaug

SEQ ID NO: 2742507 - RNA, 22 nt, Human
ugcaguucugaagaagauggua

SEQ ID NO: 2742508 - RNA, 13 nt, Human
ugcaguugccagu

SEQ ID NO: 2742509 - RNA, 14 nt, Human
ugcaguugccaguc

SEQ ID NO: 2742510 - RNA, 15 nt, Human
ugcaguugccaguca

SEQ ID NO: 2742511 - RNA, 14 nt, Human
ugccaucccucccu

SEQ ID NO: 2742512 - RNA, 11 nt, Human
ugccaucccuc

SEQ ID NO: 2742513 - RNA, 12 nt, Human
ugccaucccucc

SEQ ID NO: 2742514 - RNA, 21 nt, Human
ugccauccagguucagcuugu

SEQ ID NO: 2742515 - RNA, 20 nt, Human
ugccauccagguucagcuug

SEQ ID NO: 2742516 - RNA, 13 nt, Human
ugcccaccuggcc

SEQ ID NO: 2742517 - RNA, 13 nt, Human
ugcccaggcuggc

SEQ ID NO: 2742518 - RNA, 11 nt, Human
ugcccaggcug

SEQ ID NO: 2742519 - RNA, 16 nt, Human
ugcccacucccugcaa

SEQ ID NO: 2742520 - RNA, 14 nt, Human
ugcccacucccugc

SEQ ID NO: 2742521 - RNA, 15 nt, Human
ugcccacucccugca

SEQ ID NO: 2742522 - RNA, 19 nt, Human
ugccccucaacucuccucc

SEQ ID NO: 2742523 - RNA, 17 nt, Human
ugccccuggcagccccu

SEQ ID NO: 2742524 - RNA, 23 nt, Human
ugccccucaacucuccuccagag

SEQ ID NO: 2742525 - RNA, 19 nt, Human
ugccacccuggggagaaag

SEQ ID NO: 2742526 - RNA, 22 nt, Human
ugccacuacggaauaguuggcu

SEQ ID NO: 2742527 - RNA, 18 nt, Human
ugccagguuuuuggucug

SEQ ID NO: 2742528 - RNA, 19 nt, Human
ugccagguuuuuggucuga

SEQ ID NO: 2742529 - RNA, 22 nt, Human
ugccagguuuuuggucugaccc

SEQ ID NO: 2742530 - RNA, 18 nt, Human
ugccaaauauaaauaaaa

SEQ ID NO: 2742531 - RNA, 17 nt, Human
ugccaaauauaaauaaa

SEQ ID NO: 2742532 - RNA, 22 nt, Human
ugccaaauauaaauaaaaauaa

SEQ ID NO: 2742533 - RNA, 19 nt, Human
ugccaaauauaaauaaaaa

SEQ ID NO: 2742534 - RNA, 19 nt, Human
ugcaucaagaugugacaug

SEQ ID NO: 2742535 - RNA, 14 nt, Human
ugcaucaagaugug

SEQ ID NO: 2742536 - RNA, 14 nt, Human
ugggaguacaaaag

SEQ ID NO: 2742537 - RNA, 22 nt, Human
ugggagcugccuguucagcucc

SEQ ID NO: 2742538 - RNA, 17 nt, Human
ugggagcugccuguuca

SEQ ID NO: 2742539 - RNA, 21 nt, Human
ugggagcugccuguucagcuc

SEQ ID NO: 2742540 - RNA, 15 nt, Human
ugggagugagcuggu

SEQ ID NO: 2742541 - RNA, 15 nt, Human
ugggauccuccaggu

SEQ ID NO: 2742542 - RNA, 15 nt, Human
ugggcagaggaaagc

SEQ ID NO: 2742543 - RNA, 16 nt, Human
ugggauuacaggugug

SEQ ID NO: 2742544 - RNA, 18 nt, Human
ugggauccuccaggugca

SEQ ID NO: 2742545 - RNA, 13 nt, Human
ugggauccuggag

SEQ ID NO: 2742546 - RNA, 13 nt, Human
ugggacacccugu

SEQ ID NO: 2742547 - RNA, 12 nt, Human
ugggacacccug

SEQ ID NO: 2742548 - RNA, 12 nt, Human
ugggagcugccu

SEQ ID NO: 2742549 - RNA, 13 nt, Human
ugggagcugccug

SEQ ID NO: 2742550 - RNA, 14 nt, Human
ugggagcugccugu

SEQ ID NO: 2742551 - RNA, 13 nt, Human
ugggagcaaaaga

SEQ ID NO: 2742552 - RNA, 21 nt, Human
uggcuugaguuuaaauuguaa

SEQ ID NO: 2742553 - RNA, 13 nt, Human
uggcuuuucugau

SEQ ID NO: 2742554 - RNA, 17 nt, Human
uggcuuuucugauccag

SEQ ID NO: 2742555 - RNA, 14 nt, Human
uggcuuuucugauc

SEQ ID NO: 2742556 - RNA, 14 nt, Human
uggcuuuugugcau

SEQ ID NO: 2742557 - RNA, 19 nt, Human
uggcuuuucugauccaguu

SEQ ID NO: 2742558 - RNA, 18 nt, Human
uggcuuuucugauccagu

SEQ ID NO: 2742559 - RNA, 16 nt, Human
uggcuuccuggcaaua

SEQ ID NO: 2742560 - RNA, 22 nt, Human
uggcuuccuaaaauucagugga

SEQ ID NO: 2742561 - RNA, 21 nt, Human
uggcugcuucaaggauccuga

SEQ ID NO: 2742562 - RNA, 16 nt, Human
uggcugcuucaaggau

SEQ ID NO: 2742563 - RNA, 21 nt, Human
uggcugggggccucagugcca

SEQ ID NO: 2742564 - RNA, 21 nt, Human
ugguauguuuucaggcuagau

SEQ ID NO: 2742565 - RNA, 23 nt, Human
ugguauuggcuagagguucaaag

SEQ ID NO: 2742566 - RNA, 18 nt, Human
ugguaugaucacggcuca

SEQ ID NO: 2742567 - RNA, 21 nt, Human
uggguuucuaaagcugccagc

SEQ ID NO: 2742568 - RNA, 17 nt, Human
uggguuucuaaagcugc

SEQ ID NO: 2742569 - RNA, 18 nt, Human
uggguuucuaaagcugcc

SEQ ID NO: 2742570 - RNA, 16 nt, Human
uggguaacuagggaag

SEQ ID NO: 2742571 - RNA, 19 nt, Human
ugggguuuaucagaauucu

SEQ ID NO: 2742572 - RNA, 22 nt, Human
uggguucuacccaggugcuagg

SEQ ID NO: 2742573 - RNA, 15 nt, Human
uggguucuacccagg

SEQ ID NO: 2742574 - RNA, 16 nt, Human
uggguucuacccaggu

SEQ ID NO: 2742575 - RNA, 17 nt, Human
ugggcuucaguggcagc

SEQ ID NO: 2742576 - RNA, 15 nt, Human
ugggcuucaguggca

SEQ ID NO: 2742577 - RNA, 16 nt, Human
ugggcuaguugggcuu

SEQ ID NO: 2742578 - RNA, 17 nt, Human
ugggcuggugucaccug

SEQ ID NO: 2742579 - RNA, 23 nt, Human
ugggcuggguucuacccaggugc

SEQ ID NO: 2742580 - RNA, 22 nt, Human
ugggcuaagugauccucccacc

SEQ ID NO: 2742581 - RNA, 16 nt, Human
ugggcagaggaaagca

SEQ ID NO: 2742582 - RNA, 17 nt, Human
ugggggcugggcagagg

SEQ ID NO: 2742583 - RNA, 18 nt, Human
ugggggcugggcagagga

SEQ ID NO: 2742584 - RNA, 15 nt, Human
ugggggugcauuuga

SEQ ID NO: 2742585 - RNA, 12 nt, Human
ugggggugcauu

SEQ ID NO: 2742586 - RNA, 19 nt, Human
ugggggcugggcagaggaa

SEQ ID NO: 2742587 - RNA, 12 nt, Human
uggggauucuua

SEQ ID NO: 2742588 - RNA, 16 nt, Human
uggggauucuuaaagu

SEQ ID NO: 2742589 - RNA, 13 nt, Human
uggggauucuuaa

SEQ ID NO: 2742590 - RNA, 20 nt, Human
ugggggaucacagccucuga

SEQ ID NO: 2742591 - RNA, 20 nt, Human
uggggauucuuaaaguugaa

SEQ ID NO: 2742592 - RNA, 18 nt, Human
uggggauucuuaaaguug

SEQ ID NO: 2742593 - RNA, 21 nt, Human
ugggggaucacagccucugaa

SEQ ID NO: 2742594 - RNA, 11 nt, Human
uggagggaagc

SEQ ID NO: 2742595 - RNA, 20 nt, Human
uggaggaaggaaacccagcu

SEQ ID NO: 2742596 - RNA, 12 nt, Human
uggaggaaggaa

SEQ ID NO: 2742597 - RNA, 18 nt, Human
uggaggaaggaaacccag

SEQ ID NO: 2742598 - RNA, 24 nt, Human
uggauuuaacagaaauguacagca

SEQ ID NO: 2742599 - RNA, 20 nt, Human
uggauuuaacagaaauguac

SEQ ID NO: 2742600 - RNA, 20 nt, Human
uggccagaugcaccagcccu

SEQ ID NO: 2742601 - RNA, 21 nt, Human
uggccagaugcaccagcccuu

SEQ ID NO: 2742602 - RNA, 21 nt, Human
uggcacccggccccugcuggu

SEQ ID NO: 2742603 - RNA, 13 nt, Human
uggcagcugcuuu

SEQ ID NO: 2742604 - RNA, 21 nt, Human
uggaacauaaaauacaauguu

SEQ ID NO: 2742605 - RNA, 20 nt, Human
uggaacauaaaauacaaugu

SEQ ID NO: 2742606 - RNA, 20 nt, Human
uggaaagaguaggaagacuu

SEQ ID NO: 2742607 - RNA, 23 nt, Human
uggaaacuucagcgguuuauaua

SEQ ID NO: 2742608 - RNA, 21 nt, Human
uggaaagacuuuuccaacccu

SEQ ID NO: 2742609 - RNA, 17 nt, Human
uggaaacaagucaguca

SEQ ID NO: 2742610 - RNA, 20 nt, Human
uggaaaaauagccugccucu

SEQ ID NO: 2742611 - RNA, 17 nt, Human
uggaaaaauagccugcc

SEQ ID NO: 2742612 - RNA, 22 nt, Human
uggaauaauccuaaacauauga

SEQ ID NO: 2742613 - RNA, 17 nt, Human
uggaauaaggagaauga

SEQ ID NO: 2742614 - RNA, 16 nt, Human
uggaauauauaaccag

SEQ ID NO: 2742615 - RNA, 15 nt, Human
uggaauauauaacca

SEQ ID NO: 2742616 - RNA, 14 nt, Human
uggaauaacaugua

SEQ ID NO: 2742617 - RNA, 19 nt, Human
uggaauaacauguaauuaa

SEQ ID NO: 2742618 - RNA, 15 nt, Human
uggaauaacauguaa

SEQ ID NO: 2742619 - RNA, 19 nt, Human
uggaacgcguugaaauugu

SEQ ID NO: 2742620 - RNA, 18 nt, Human
uggaacgcguugaaauug

SEQ ID NO: 2742621 - RNA, 13 nt, Human
uggacaugcacag

SEQ ID NO: 2742622 - RNA, 19 nt, Human
uggacaugcacagcuaaca

SEQ ID NO: 2742623 - RNA, 16 nt, Human
uggaaugcuguguuaa

SEQ ID NO: 2742624 - RNA, 19 nt, Human
ugugcuaguaauuggaaag

SEQ ID NO: 2742625 - RNA, 19 nt, Human
ugugcgccuacaggaguga

SEQ ID NO: 2742626 - RNA, 14 nt, Human
ugugcgccuacagg

SEQ ID NO: 2742627 - RNA, 23 nt, Human
ugugcauuaucuagauacuguau

SEQ ID NO: 2742628 - RNA, 21 nt, Human
ugugcauuaucuagauacugu

SEQ ID NO: 2742629 - RNA, 20 nt, Human
ugugcauuaucuagauacug

SEQ ID NO: 2742630 - RNA, 14 nt, Human
ugugcauuaucuag

SEQ ID NO: 2742631 - RNA, 19 nt, Human
ugugcauuaucuagauacu

SEQ ID NO: 2742632 - RNA, 16 nt, Human
ugugcauuaucuagau

SEQ ID NO: 2742633 - RNA, 14 nt, Human
ugugcacguacaca

SEQ ID NO: 2742634 - RNA, 18 nt, Human
uguggacacagcucuucu

SEQ ID NO: 2742635 - RNA, 19 nt, Human
uguggacacagcucuucuc

SEQ ID NO: 2742636 - RNA, 23 nt, Human
uguggcgcagcauauucaggaag

SEQ ID NO: 2742637 - RNA, 12 nt, Human
uguguagggcgg

SEQ ID NO: 2742638 - RNA, 22 nt, Human
ugugggcuaguugggcuuccuc

SEQ ID NO: 2742639 - RNA, 14 nt, Human
ugucuuuggacccu

SEQ ID NO: 2742640 - RNA, 16 nt, Human
ugucuuuggacccuga

SEQ ID NO: 2742641 - RNA, 21 nt, Human
ugucuuuucuugcaugaggcu

SEQ ID NO: 2742642 - RNA, 21 nt, Human
ugugaaaagaaaaaugagccu

SEQ ID NO: 2742643 - RNA, 23 nt, Human
ugugaaaagaaaaaugagccugg

SEQ ID NO: 2742644 - RNA, 23 nt, Human
ugucuuuucuugcaugaggcuag

SEQ ID NO: 2742645 - RNA, 19 nt, Human
ugugagucaccaagcccag

SEQ ID NO: 2742646 - RNA, 21 nt, Human
ugugagucaccaagcccaguu

SEQ ID NO: 2742647 - RNA, 15 nt, Human
ugugagucaccaagc

SEQ ID NO: 2742648 - RNA, 17 nt, Human
ugugagucaccaagccc

SEQ ID NO: 2742649 - RNA, 15 nt, Human
ugugacauguuuuau

SEQ ID NO: 2742650 - RNA, 21 nt, Human
ugugaauguugugauguauuc

SEQ ID NO: 2742651 - RNA, 18 nt, Human
ugugaagugaaugaaaca

SEQ ID NO: 2742652 - RNA, 12 nt, Human
ugugaggaagcc

SEQ ID NO: 2742653 - RNA, 20 nt, Human
ugugaggaagccgcuggggc

SEQ ID NO: 2742654 - RNA, 13 nt, Human
ugugaggaagccg

SEQ ID NO: 2742655 - RNA, 18 nt, Human
ugugaggaagccgcuggg

SEQ ID NO: 2742656 - RNA, 15 nt, Human
uguaugauucccagc

SEQ ID NO: 2742657 - RNA, 21 nt, Human
uguauugugcgcuaaacuuuu

SEQ ID NO: 2742658 - RNA, 22 nt, Human
uguauucucuccuguaccucuu

SEQ ID NO: 2742659 - RNA, 19 nt, Human
uguauuuuacuaauaaaau

SEQ ID NO: 2742660 - RNA, 17 nt, Human
ugucacacacuuuggcu

SEQ ID NO: 2742661 - RNA, 12 nt, Human
ugucacaggcag

SEQ ID NO: 2742662 - RNA, 16 nt, Human
ugucauuugagcaggg

SEQ ID NO: 2742663 - RNA, 19 nt, Human
ugucauuugagcagggcuc

SEQ ID NO: 2742664 - RNA, 13 nt, Human
ugucaccugaaga

SEQ ID NO: 2742665 - RNA, 13 nt, Human
uguccccaccgca

SEQ ID NO: 2742666 - RNA, 19 nt, Human
uguccccaccgcagacagg

SEQ ID NO: 2742667 - RNA, 22 nt, Human
uguccccaccgcagacaggacc

SEQ ID NO: 2742668 - RNA, 18 nt, Human
uguccccaccgcagacag

SEQ ID NO: 2742669 - RNA, 12 nt, Human
uguccuacucug

SEQ ID NO: 2742670 - RNA, 17 nt, Human
uguccuacucuguguca

SEQ ID NO: 2742671 - RNA, 16 nt, Human
uguccccgacccuugc

SEQ ID NO: 2742672 - RNA, 20 nt, Human
uguccuacccacccuccuuu

SEQ ID NO: 2742673 - RNA, 17 nt, Human
uguccccgacccuugcc

SEQ ID NO: 2742674 - RNA, 22 nt, Human
uguaguguuggagaagaacuga

SEQ ID NO: 2742675 - RNA, 18 nt, Human
uguagcauccuggaauau

SEQ ID NO: 2742676 - RNA, 17 nt, Human
uguagcauccuggaaua

SEQ ID NO: 2742677 - RNA, 16 nt, Human
uguagcauccuggaau

SEQ ID NO: 2742678 - RNA, 14 nt, Human
uguagcauccugga

SEQ ID NO: 2742679 - RNA, 22 nt, Human
uguacgaagaguauuuuugaca

SEQ ID NO: 2742680 - RNA, 15 nt, Human
uguacgucugacagg

SEQ ID NO: 2742681 - RNA, 14 nt, Human
uguacgaagaguau

SEQ ID NO: 2742682 - RNA, 19 nt, Human
uguacugcauaugaaagga

SEQ ID NO: 2742683 - RNA, 18 nt, Human
uguacagagcccacgccc

SEQ ID NO: 2742684 - RNA, 17 nt, Human
uguaauuaaguacuaug

SEQ ID NO: 2742685 - RNA, 13 nt, Human
uguacagagccca

SEQ ID NO: 2742686 - RNA, 16 nt, Human
uguacagagcccacgc

SEQ ID NO: 2742687 - RNA, 17 nt, Human
uguacagagcccacgcc

SEQ ID NO: 2742688 - RNA, 18 nt, Human
uuaaaauacacacucaaa

SEQ ID NO: 2742689 - RNA, 22 nt, Human
uuaaacuuaaucuaaauggaac

SEQ ID NO: 2742690 - RNA, 14 nt, Human
uuaaaacccaagug

SEQ ID NO: 2742691 - RNA, 14 nt, Human
uuaaagccauguuu

SEQ ID NO: 2742692 - RNA, 12 nt, Human
uuaaagccaugu

SEQ ID NO: 2742693 - RNA, 20 nt, Human
uuaaagccauguuuauuaca

SEQ ID NO: 2742694 - RNA, 18 nt, Human
uuaaagccauguuuauua

SEQ ID NO: 2742695 - RNA, 11 nt, Human
uuaaaugcacc

SEQ ID NO: 2742696 - RNA, 14 nt, Human
uuaaaugcccagcc

SEQ ID NO: 2742697 - RNA, 15 nt, Human
uuaaaugcccagccc

SEQ ID NO: 2742698 - RNA, 16 nt, Human
uuaaaugcccagcccc

SEQ ID NO: 2742699 - RNA, 15 nt, Human
uuaaaaaaaaaauug

SEQ ID NO: 2742700 - RNA, 17 nt, Human
uguuuuaagaggcaggg

SEQ ID NO: 2742701 - RNA, 19 nt, Human
uguuuuaaggaugcuugua

SEQ ID NO: 2742702 - RNA, 23 nt, Human
uguuuuaaggaugcuuguacaua

SEQ ID NO: 2742703 - RNA, 22 nt, Human
uguuuuaaggaugcuuguacau

SEQ ID NO: 2742704 - RNA, 19 nt, Human
uguuuccauauuuuauagg

SEQ ID NO: 2742705 - RNA, 15 nt, Human
uguuuccuggcacug

SEQ ID NO: 2742706 - RNA, 16 nt, Human
uguuuuaagaggcagg

SEQ ID NO: 2742707 - RNA, 23 nt, Human
uguuucuguacuuuuuggcauaa

SEQ ID NO: 2742708 - RNA, 22 nt, Human
uguuucuguacuuuuuggcaua

SEQ ID NO: 2742709 - RNA, 11 nt, Human
uguuucuguac

SEQ ID NO: 2742710 - RNA, 20 nt, Human
uuacauuuguauaaaauaau

SEQ ID NO: 2742711 - RNA, 17 nt, Human
uuacauuuuuaagugcu

SEQ ID NO: 2742712 - RNA, 12 nt, Human
uuacauuuuuaa

SEQ ID NO: 2742713 - RNA, 12 nt, Human
uuacauuguaaa

SEQ ID NO: 2742714 - RNA, 13 nt, Human
uuacauuguaaau

SEQ ID NO: 2742715 - RNA, 12 nt, Human
uuacagaagccc

SEQ ID NO: 2742716 - RNA, 20 nt, Human
uuacacuuuaugcacaaaau

SEQ ID NO: 2742717 - RNA, 13 nt, Human
uuacacuuuaugc

SEQ ID NO: 2742718 - RNA, 19 nt, Human
uuaauauuaaagccauguu

SEQ ID NO: 2742719 - RNA, 18 nt, Human
uuaauauuaaagccaugu

SEQ ID NO: 2742720 - RNA, 16 nt, Human
uuaaugauaaguaaau

SEQ ID NO: 2742721 - RNA, 22 nt, Human
uuaauuaaaacacaacaucuuu

SEQ ID NO: 2742722 - RNA, 13 nt, Human
uuaacuuuuauaa

SEQ ID NO: 2742723 - RNA, 12 nt, Human
uuaacuuuuaua

SEQ ID NO: 2742724 - RNA, 13 nt, Human
uuaaaugcccagc

SEQ ID NO: 2742725 - RNA, 14 nt, Human
uuaacuuuuauaaa

SEQ ID NO: 2742726 - RNA, 23 nt, Human
uuaagcauauauuuuuauauuua

SEQ ID NO: 2742727 - RNA, 11 nt, Human
uuaauauuaaa

SEQ ID NO: 2742728 - RNA, 17 nt, Human
uuaauauuaaagccaug

SEQ ID NO: 2742729 - RNA, 16 nt, Human
uuaauauuaaagccau

SEQ ID NO: 2742730 - RNA, 14 nt, Human
uuaauauuaaagcc

SEQ ID NO: 2742731 - RNA, 13 nt, Human
uuaauauuaaagc

SEQ ID NO: 2742732 - RNA, 20 nt, Human
uguugacaugggacauuugc

SEQ ID NO: 2742733 - RNA, 23 nt, Human
uguucuuucuggcuaugcauuug

SEQ ID NO: 2742734 - RNA, 21 nt, Human
uguucuggcucuuccaggcug

SEQ ID NO: 2742735 - RNA, 17 nt, Human
uguucuggcucuuccag

SEQ ID NO: 2742736 - RNA, 20 nt, Human
uguucuggcucuuccaggcu

SEQ ID NO: 2742737 - RNA, 15 nt, Human
uguucucucuucucc

SEQ ID NO: 2742738 - RNA, 16 nt, Human
uguucucucuucucca

SEQ ID NO: 2742739 - RNA, 14 nt, Human
uguucaugaaagau

SEQ ID NO: 2742740 - RNA, 13 nt, Human
uguucaugaaaga

SEQ ID NO: 2742741 - RNA, 19 nt, Human
uguucaucauccuaagcua

SEQ ID NO: 2742742 - RNA, 12 nt, Human
uguucuggcucu

SEQ ID NO: 2742743 - RNA, 13 nt, Human
uguucuggcucuu

SEQ ID NO: 2742744 - RNA, 16 nt, Human
uguucuggcucuucca

SEQ ID NO: 2742745 - RNA, 13 nt, Human
uguucucugcccu

SEQ ID NO: 2742746 - RNA, 14 nt, Human
uguucucugcccuc

SEQ ID NO: 2742747 - RNA, 15 nt, Human
uguucucugcccucc

SEQ ID NO: 2742748 - RNA, 16 nt, Human
uguucucugcccucca

SEQ ID NO: 2742749 - RNA, 16 nt, Human
uguuggagaagaacug

SEQ ID NO: 2742750 - RNA, 17 nt, Human
uguuggagaagaacuga

SEQ ID NO: 2742751 - RNA, 14 nt, Human
uguuggagaagaac

SEQ ID NO: 2742752 - RNA, 19 nt, Human
uguuggagaagaacugaaa

SEQ ID NO: 2742753 - RNA, 20 nt, Human
uguuggagaagaacugaaau

SEQ ID NO: 2742754 - RNA, 15 nt, Human
uguuggccaaagcca

SEQ ID NO: 2742755 - RNA, 15 nt, Human
uguuggccaggcugg

SEQ ID NO: 2742756 - RNA, 16 nt, Human
uguuggccaggcuggu

SEQ ID NO: 2742757 - RNA, 14 nt, Human
uguuuaaaaucauu

SEQ ID NO: 2742758 - RNA, 18 nt, Human
uguuuaaaaucauuucug

SEQ ID NO: 2742759 - RNA, 17 nt, Human
uguuuaaaaucauuucu

SEQ ID NO: 2742760 - RNA, 19 nt, Human
uguuggcugggggccucag

SEQ ID NO: 2742761 - RNA, 17 nt, Human
uguuggcugggggccuc

SEQ ID NO: 2742762 - RNA, 13 nt, Human
uguguuuugcaag

SEQ ID NO: 2742763 - RNA, 19 nt, Human
uguguuuugcaagccagau

SEQ ID NO: 2742764 - RNA, 13 nt, Human
uguguuugaagca

SEQ ID NO: 2742765 - RNA, 16 nt, Human
uguguuuauugucaaa

SEQ ID NO: 2742766 - RNA, 20 nt, Human
ugugugaaagguacuucaaa

SEQ ID NO: 2742767 - RNA, 21 nt, Human
ugugugaaagguacuucaaau

SEQ ID NO: 2742768 - RNA, 22 nt, Human
ugugugaaagguacuucaaauc

SEQ ID NO: 2742769 - RNA, 19 nt, Human
ugugugcacguacacacac

SEQ ID NO: 2742770 - RNA, 21 nt, Human
uguuaaaagaugaaaauauuu

SEQ ID NO: 2742771 - RNA, 14 nt, Human
uguuacuaaguuuu

SEQ ID NO: 2742772 - RNA, 14 nt, Human
uguucauacauauu

SEQ ID NO: 2742773 - RNA, 23 nt, Human
uguucauacauauuuuuguagca

SEQ ID NO: 2742774 - RNA, 18 nt, Human
uguucagcuccagcucac

SEQ ID NO: 2742775 - RNA, 12 nt, Human
uguucauacaua

SEQ ID NO: 2742776 - RNA, 20 nt, Human
uguucagcuccagcucacca

SEQ ID NO: 2742777 - RNA, 21 nt, Human
uguucagcuccagcucaccag

SEQ ID NO: 2742778 - RNA, 22 nt, Human
uguucagcuccagcucaccagc

SEQ ID NO: 2742779 - RNA, 17 nt, Human
uguuaguaugaggcauu

SEQ ID NO: 2742780 - RNA, 20 nt, Human
uguuaguaugaggcauuugu

SEQ ID NO: 2742781 - RNA, 19 nt, Human
uguuaguaugaggcauuug

SEQ ID NO: 2742782 - RNA, 11 nt, Human
guaaaagcauc

SEQ ID NO: 2742783 - RNA, 19 nt, Human
uggugaacuugguuuuaau

SEQ ID NO: 2742784 - RNA, 16 nt, Human
ugcugucccuuacgug

SEQ ID NO: 2742785 - RNA, 16 nt, Human
uacuguaauuugugau

SEQ ID NO: 2742786 - RNA, 15 nt, Human
uucuugguuuguaaa

SEQ ID NO: 2742787 - RNA, 22 nt, Human
uucugcuugcuugcuuuuuaau

SEQ ID NO: 2742788 - RNA, 21 nt, Human
uucuaaaggcuaccuuuguau

SEQ ID NO: 2742789 - RNA, 21 nt, Human
cugaaauggacuuuuguacau

SEQ ID NO: 2742790 - RNA, 13 nt, Human
uuuaaauuguaau

SEQ ID NO: 2742791 - RNA, 16 nt, Human
uugugauuuuuguaau

SEQ ID NO: 2742792 - RNA, 21 nt, Human
gcugaggugggaggaucucuu

SEQ ID NO: 2742793 - RNA, 15 nt, Human
ugguuuucuugugug

SEQ ID NO: 2742794 - RNA, 23 nt, Human
uuugaugcuacaggauuugaaau

SEQ ID NO: 2742795 - RNA, 14 nt, Human
uuuaauuuuggaau

SEQ ID NO: 2742796 - RNA, 13 nt, Human
uugaaauuguaau

SEQ ID NO: 2742797 - RNA, 13 nt, Human
uugaaauuugaau

SEQ ID NO: 2742798 - RNA, 16 nt, Human
uuuaauaauuuuuaau

SEQ ID NO: 2742799 - RNA, 15 nt, Human
uuggaaauuuguuau

SEQ ID NO: 2742800 - RNA, 15 nt, Human
uugugauuuugugau

SEQ ID NO: 2742801 - RNA, 15 nt, Human
acuaagagucucuau

SEQ ID NO: 2742802 - RNA, 15 nt, Human
aaaucucaauauuuc

SEQ ID NO: 2742803 - RNA, 16 nt, Human
aaaaucucaaauuugg

SEQ ID NO: 2742804 - RNA, 17 nt, Human
agugugucuaaauuuga

SEQ ID NO: 2742805 - RNA, 16 nt, Human
aguuaucaaucucuag

SEQ ID NO: 2742806 - RNA, 21 nt, Human
augaagaaguugauaugccuu

SEQ ID NO: 2742807 - RNA, 19 nt, Human
auaaaguguuugaaagcuu

SEQ ID NO: 2742808 - RNA, 20 nt, Human
acuguaagaaaauaucacuu

SEQ ID NO: 2742809 - RNA, 19 nt, Human
auauaagcuuguauuccuu

SEQ ID NO: 2742810 - RNA, 18 nt, Human
auaaaaccccaucucuac

SEQ ID NO: 2742811 - RNA, 23 nt, Human
acaaaugcauuucuaaagccauu

SEQ ID NO: 2742812 - RNA, 12 nt, Human
cugauuuguaac

SEQ ID NO: 2742813 - RNA, 17 nt, Human
cucuaggaaauauuuau

SEQ ID NO: 2742814 - RNA, 12 nt, Human
cauuauauuuau

SEQ ID NO: 2742815 - RNA, 23 nt, Human
ccaaauuaagagagucuauuuac

SEQ ID NO: 2742816 - RNA, 14 nt, Human
caacucauauuuuc

SEQ ID NO: 2742817 - RNA, 19 nt, Human
caaauccuugaagauuuac

SEQ ID NO: 2742818 - RNA, 21 nt, Human
augaauacuuuauaaaggauu

SEQ ID NO: 2742819 - RNA, 21 nt, Human
augaauuaguuuuauaugcuu

SEQ ID NO: 2742820 - RNA, 21 nt, Human
cugacacaugcugaacaucac

SEQ ID NO: 2742821 - RNA, 14 nt, Human
cugacacaccaggc

SEQ ID NO: 2742822 - RNA, 17 nt, Human
cugacacaccaggcgcu

SEQ ID NO: 2742823 - RNA, 19 nt, Human
cugacacaccaggcgcuaa

SEQ ID NO: 2742824 - RNA, 23 nt, Human
cugacacaccaggcgcuaauuca

SEQ ID NO: 2742825 - RNA, 17 nt, Human
cugaaagaggaaugaag

SEQ ID NO: 2742826 - RNA, 13 nt, Human
cugaaagaggaau

SEQ ID NO: 2742827 - RNA, 19 nt, Human
cucccagaggagccaccag

SEQ ID NO: 2742828 - RNA, 21 nt, Human
cucccagaggagccaccaguu

SEQ ID NO: 2742829 - RNA, 22 nt, Human
cucccagaggagccaccaguuc

SEQ ID NO: 2742830 - RNA, 23 nt, Human
cucccagaggagccaccaguucu

SEQ ID NO: 2742831 - RNA, 17 nt, Human
cucucuggccuucggcc

SEQ ID NO: 2742832 - RNA, 22 nt, Human
cucucuggccuucggccuccau

SEQ ID NO: 2742833 - RNA, 19 nt, Human
cucucuggccuucggccuc

SEQ ID NO: 2742834 - RNA, 14 nt, Human
cucgguggacccag

SEQ ID NO: 2742835 - RNA, 17 nt, Human
cuacuaauagaauaaag

SEQ ID NO: 2742836 - RNA, 18 nt, Human
cuacuaauagaauaaagg

SEQ ID NO: 2742837 - RNA, 13 nt, Human
cucaaaacugcac

SEQ ID NO: 2742838 - RNA, 16 nt, Human
cucaaagaaaguguau

SEQ ID NO: 2742839 - RNA, 17 nt, Human
cucaaagaaaguguauu

SEQ ID NO: 2742840 - RNA, 13 nt, Human
cucaaagaaagug

SEQ ID NO: 2742841 - RNA, 12 nt, Human
cucaccuggacu

SEQ ID NO: 2742842 - RNA, 13 nt, Human
cucaccuggacuu

SEQ ID NO: 2742843 - RNA, 23 nt, Human
cucagaaaacaaggaugaauuaa

SEQ ID NO: 2742844 - RNA, 19 nt, Human
cucagaaaacaaggaugaa

SEQ ID NO: 2742845 - RNA, 15 nt, Human
cuaaacuuuuuuucu

SEQ ID NO: 2742846 - RNA, 21 nt, Human
cuaaacuuuuuuucuguacca

SEQ ID NO: 2742847 - RNA, 17 nt, Human
cuaaacuuuuuuucugu

SEQ ID NO: 2742848 - RNA, 18 nt, Human
cuaaacuuuuuuucugua

SEQ ID NO: 2742849 - RNA, 14 nt, Human
cuaacuggacuggu

SEQ ID NO: 2742850 - RNA, 15 nt, Human
cgguuuauauaagcu

SEQ ID NO: 2742851 - RNA, 23 nt, Human
cggagaagagcuguucacagcca

SEQ ID NO: 2742852 - RNA, 24 nt, Human
cggagaagagcuguucacagccag

SEQ ID NO: 2742853 - RNA, 19 nt, Human
ccccauggagcugggcuaa

SEQ ID NO: 2742854 - RNA, 18 nt, Human
cccccuugccagacaugu

SEQ ID NO: 2742855 - RNA, 24 nt, Human
cccagccagcaguucagagcugcc

SEQ ID NO: 2742856 - RNA, 17 nt, Human
cccagcacuaaagcagu

SEQ ID NO: 2742857 - RNA, 16 nt, Human
cccagcacuaaagcag

SEQ ID NO: 2742858 - RNA, 13 nt, Human
ccccugcacucca

SEQ ID NO: 2742859 - RNA, 22 nt, Human
cccuccucugcuugccaucccu

SEQ ID NO: 2742860 - RNA, 13 nt, Human
cccuccucugcuu

SEQ ID NO: 2742861 - RNA, 15 nt, Human
ccaucccucccucca

SEQ ID NO: 2742862 - RNA, 14 nt, Human
ccaucccucccucc

SEQ ID NO: 2742863 - RNA, 13 nt, Human
ccaucccucccuc

SEQ ID NO: 2742864 - RNA, 13 nt, Human
cccaacuccagaa

SEQ ID NO: 2742865 - RNA, 23 nt, Human
ccucggagccucauccgaggcag

SEQ ID NO: 2742866 - RNA, 16 nt, Human
ccucggagccucaucc

SEQ ID NO: 2742867 - RNA, 14 nt, Human
ccucggagccucau

SEQ ID NO: 2742868 - RNA, 13 nt, Human
ccucggagccuca

SEQ ID NO: 2742869 - RNA, 17 nt, Human
ccugucucuacuaaaaa

SEQ ID NO: 2742870 - RNA, 14 nt, Human
ccuaauaaaaaggu

SEQ ID NO: 2742871 - RNA, 15 nt, Human
ccgucuucagccuag

SEQ ID NO: 2742872 - RNA, 14 nt, Human
ccgucuucagccua

SEQ ID NO: 2742873 - RNA, 15 nt, Human
ccuaauaaaaaggug

SEQ ID NO: 2742874 - RNA, 16 nt, Human
ccuaauaaaaagguga

SEQ ID NO: 2742875 - RNA, 20 nt, Human
ccuaauaaaaaggugaccau

SEQ ID NO: 2742876 - RNA, 16 nt, Human
ccucccuucucuucac

SEQ ID NO: 2742877 - RNA, 12 nt, Human
ccucggagaaga

SEQ ID NO: 2742878 - RNA, 14 nt, Human
ccucggagaagagc

SEQ ID NO: 2742879 - RNA, 23 nt, Human
cacuccagccugagcgacaguga

SEQ ID NO: 2742880 - RNA, 13 nt, Human
cacuccagccuga

SEQ ID NO: 2742881 - RNA, 12 nt, Human
cacuccagccug

SEQ ID NO: 2742882 - RNA, 20 nt, Human
cagaaauaaaguuggugaca

SEQ ID NO: 2742883 - RNA, 20 nt, Human
cagaacagccgcuccugucu

SEQ ID NO: 2742884 - RNA, 17 nt, Human
cagaacagccgcuccug

SEQ ID NO: 2742885 - RNA, 12 nt, Human
cagaacagccgc

SEQ ID NO: 2742886 - RNA, 18 nt, Human
cagaacagugauuaccag

SEQ ID NO: 2742887 - RNA, 11 nt, Human
cagaacaguga

SEQ ID NO: 2742888 - RNA, 17 nt, Human
cagaacagugauuacca

SEQ ID NO: 2742889 - RNA, 12 nt, Human
cagaacagugau

SEQ ID NO: 2742890 - RNA, 17 nt, Human
cacuuguguuuugcaag

SEQ ID NO: 2742891 - RNA, 15 nt, Human
cacuuaauguauguu

SEQ ID NO: 2742892 - RNA, 12 nt, Human
cacuuaauguau

SEQ ID NO: 2742893 - RNA, 14 nt, Human
cacuuaauguaugu

SEQ ID NO: 2742894 - RNA, 15 nt, Human
cacuuaaaaaugguu

SEQ ID NO: 2742895 - RNA, 20 nt, Human
cacugggguccuggggccuc

SEQ ID NO: 2742896 - RNA, 23 nt, Human
caauaaaauccauacauuugugu

SEQ ID NO: 2742897 - RNA, 20 nt, Human
caauaaaauccauacauuug

SEQ ID NO: 2742898 - RNA, 16 nt, Human
caaguuguuucauuga

SEQ ID NO: 2742899 - RNA, 15 nt, Human
caauaaaauggguuu

SEQ ID NO: 2742900 - RNA, 16 nt, Human
caaacagucucaggaa

SEQ ID NO: 2742901 - RNA, 17 nt, Human
caaacagucucaggaaa

SEQ ID NO: 2742902 - RNA, 15 nt, Human
caaacagucucagga

SEQ ID NO: 2742903 - RNA, 21 nt, Human
caaaaggauaaugaauacuuu

SEQ ID NO: 2742904 - RNA, 24 nt, Human
caaacccaguguuuuaggagcaug

SEQ ID NO: 2742905 - RNA, 15 nt, Human
auuuuuauauuugaa

SEQ ID NO: 2742906 - RNA, 21 nt, Human
auuuuauaucaauuuaaaaaa

SEQ ID NO: 2742907 - RNA, 13 nt, Human
auuuugaagugcu

SEQ ID NO: 2742908 - RNA, 19 nt, Human
auuuugaagugcuguuuau

SEQ ID NO: 2742909 - RNA, 22 nt, Human
auuuugaagugcuguuuauuaa

SEQ ID NO: 2742910 - RNA, 21 nt, Human
caacuacuaauagaauaaagg

SEQ ID NO: 2742911 - RNA, 13 nt, Human
caacuacuaauag

SEQ ID NO: 2742912 - RNA, 15 nt, Human
caacuacuaauagaa

SEQ ID NO: 2742913 - RNA, 19 nt, Human
caagacccaaaaggcagaa

SEQ ID NO: 2742914 - RNA, 21 nt, Human
caaaucuuaacuugaaggagu

SEQ ID NO: 2742915 - RNA, 21 nt, Human
auuccuuagcuuagaccucag

SEQ ID NO: 2742916 - RNA, 20 nt, Human
auuccuuagcuuagaccuca

SEQ ID NO: 2742917 - RNA, 23 nt, Human
auuccuuagcuuagaccucagcc

SEQ ID NO: 2742918 - RNA, 22 nt, Human
auuccuuagcuuagaccucagc

SEQ ID NO: 2742919 - RNA, 24 nt, Human
auuccuuagcuuagaccucagccu

SEQ ID NO: 2742920 - RNA, 14 nt, Human
auuaggcuguaacu

SEQ ID NO: 2742921 - RNA, 15 nt, Human
auuaggcuguaacua

SEQ ID NO: 2742922 - RNA, 17 nt, Human
auuaggcuguaacuacu

SEQ ID NO: 2742923 - RNA, 21 nt, Human
auuaggcuguaacuacuuuau

SEQ ID NO: 2742924 - RNA, 22 nt, Human
auuaugaauuacauuuguauaa

SEQ ID NO: 2742925 - RNA, 20 nt, Human
auuaugaauuacauuuguau

SEQ ID NO: 2742926 - RNA, 19 nt, Human
auuaugaauuacauuugua

SEQ ID NO: 2742927 - RNA, 22 nt, Human
auuaggcuguaacuacuuuaua

SEQ ID NO: 2742928 - RNA, 23 nt, Human
auuaggcuguaacuacuuuauaa

SEQ ID NO: 2742929 - RNA, 18 nt, Human
auuguguguuauuuaaau

SEQ ID NO: 2742930 - RNA, 16 nt, Human
auuguguguuauuuaa

SEQ ID NO: 2742931 - RNA, 15 nt, Human
auuguuuaaaaucau

SEQ ID NO: 2742932 - RNA, 20 nt, Human
auuucauaccuaucaucuua

SEQ ID NO: 2742933 - RNA, 14 nt, Human
auuucuaugaaaua

SEQ ID NO: 2742934 - RNA, 16 nt, Human
auuuaauaaaugugcc

SEQ ID NO: 2742935 - RNA, 18 nt, Human
ccacagaagcuccaggua

SEQ ID NO: 2742936 - RNA, 18 nt, Human
ccaccagucugacuguuu

SEQ ID NO: 2742937 - RNA, 16 nt, Human
ccacagaagcuccagg

SEQ ID NO: 2742938 - RNA, 20 nt, Human
cauagcucuggggugggcag

SEQ ID NO: 2742939 - RNA, 12 nt, Human
cauagcucuggg

SEQ ID NO: 2742940 - RNA, 13 nt, Human
cauagcucugggg

SEQ ID NO: 2742941 - RNA, 13 nt, Human
cauuaucucaaaa

SEQ ID NO: 2742942 - RNA, 12 nt, Human
cauuaucucaaa

SEQ ID NO: 2742943 - RNA, 15 nt, Human
caggcgcuaauucaa

SEQ ID NO: 2742944 - RNA, 18 nt, Human
cagggaggacgcucucug

SEQ ID NO: 2742945 - RNA, 17 nt, Human
cagggaggacgcucucu

SEQ ID NO: 2742946 - RNA, 15 nt, Human
cagucucaggaaauc

SEQ ID NO: 2742947 - RNA, 15 nt, Human
cagagcugcccucuc

SEQ ID NO: 2742948 - RNA, 13 nt, Human
cagagcugcccuc

SEQ ID NO: 2742949 - RNA, 17 nt, Human
cagagcugcccucuccu

SEQ ID NO: 2742950 - RNA, 22 nt, Human
cagcacagccucuuagaugcag

SEQ ID NO: 2742951 - RNA, 14 nt, Human
cagccagcaguuca

SEQ ID NO: 2742952 - RNA, 21 nt, Human
cagccagcagccagcucucag

SEQ ID NO: 2742953 - RNA, 19 nt, Human
cagccagcagccagcucuc

SEQ ID NO: 2742954 - RNA, 15 nt, Human
cagccagcagccagc

SEQ ID NO: 2742955 - RNA, 18 nt, Human
cagccagcagccagcucu

SEQ ID NO: 2742956 - RNA, 17 nt, Human
cagccagcagccagcuc

SEQ ID NO: 2742957 - RNA, 21 nt, Human
cagccagcaguucagagcugc

SEQ ID NO: 2742958 - RNA, 15 nt, Human
cagccagcaguucag

SEQ ID NO: 2742959 - RNA, 22 nt, Human
cagccagcaguucagagcugcc

SEQ ID NO: 2742960 - RNA, 20 nt, Human
cagcaguugaaaagacucca

SEQ ID NO: 2742961 - RNA, 21 nt, Human
cagcaguugaaaagacuccaa

SEQ ID NO: 2742962 - RNA, 17 nt, Human
cagcaguugaaaagacu

SEQ ID NO: 2742963 - RNA, 22 nt, Human
cagcaguugaaaagacuccaaa

SEQ ID NO: 2742964 - RNA, 18 nt, Human
cagccugagcgacaguga

SEQ ID NO: 2742965 - RNA, 19 nt, Human
cagccugagcgacagugag

SEQ ID NO: 2742966 - RNA, 20 nt, Human
cagcccuucuuuccacagaa

SEQ ID NO: 2742967 - RNA, 19 nt, Human
cagcccuucuuuccacaga

SEQ ID NO: 2742968 - RNA, 15 nt, Human
cagcccuucuuucca

SEQ ID NO: 2742969 - RNA, 23 nt, Human
cagcccuuaugcgguuaauuuug

SEQ ID NO: 2742970 - RNA, 22 nt, Human
cagcugccuccccuccucugcu

SEQ ID NO: 2742971 - RNA, 21 nt, Human
cagcugccuccccuccucugc

SEQ ID NO: 2742972 - RNA, 24 nt, Human
cagcugccuccccuccucugcuug

SEQ ID NO: 2742973 - RNA, 23 nt, Human
cagcugccuccccuccucugcuu

SEQ ID NO: 2742974 - RNA, 17 nt, Human
cagcuccccucggagaa

SEQ ID NO: 2742975 - RNA, 18 nt, Human
cagcuccccucggagaag

SEQ ID NO: 2742976 - RNA, 16 nt, Human
cagcuccccucggaga

SEQ ID NO: 2742977 - RNA, 22 nt, Human
cagcugcaagguacucugguga

SEQ ID NO: 2742978 - RNA, 19 nt, Human
cagcugcaagguacucugg

SEQ ID NO: 2742979 - RNA, 20 nt, Human
cagcugcaagguacucuggu

SEQ ID NO: 2742980 - RNA, 20 nt, Human
caggaaagagaacuuccaga

SEQ ID NO: 2742981 - RNA, 22 nt, Human
caggaaaucaaauaugcaaagc

SEQ ID NO: 2742982 - RNA, 23 nt, Human
caggaaaucaaauaugcaaagca

SEQ ID NO: 2742983 - RNA, 20 nt, Human
cuuagcuuagaccucagccu

SEQ ID NO: 2742984 - RNA, 19 nt, Human
cuuagcuuagaccucagcc

SEQ ID NO: 2742985 - RNA, 18 nt, Human
cuuagcuuagaccucagc

SEQ ID NO: 2742986 - RNA, 17 nt, Human
cuuagcuuagaccucag

SEQ ID NO: 2742987 - RNA, 16 nt, Human
cuuagcuuagaccuca

SEQ ID NO: 2742988 - RNA, 15 nt, Human
cuuagcuuagaccuc

SEQ ID NO: 2742989 - RNA, 14 nt, Human
cuuagcuuagaccu

SEQ ID NO: 2742990 - RNA, 22 nt, Human
cuuagcuuagaccucagccugu

SEQ ID NO: 2742991 - RNA, 21 nt, Human
cuuagcuuagaccucagccug

SEQ ID NO: 2742992 - RNA, 23 nt, Human
cuuagcuuagaccucagccugug

SEQ ID NO: 2742993 - RNA, 21 nt, Human
cuuaaaaaugguuuaaauggu

SEQ ID NO: 2742994 - RNA, 19 nt, Human
cuguuauaaucuuucacag

SEQ ID NO: 2742995 - RNA, 13 nt, Human
cuguuauaaucuu

SEQ ID NO: 2742996 - RNA, 16 nt, Human
cuguaacuacuuuaua

SEQ ID NO: 2742997 - RNA, 17 nt, Human
cuguaacuacuuuauaa

SEQ ID NO: 2742998 - RNA, 19 nt, Human
cuguaacuacuuuauaacu

SEQ ID NO: 2742999 - RNA, 22 nt, Human
cugucauccucaaagaaagugu

SEQ ID NO: 2743000 - RNA, 23 nt, Human
cugucauccucaaagaaagugua

SEQ ID NO: 2743001 - RNA, 20 nt, Human
cugucauccucaaagaaagu

SEQ ID NO: 2743002 - RNA, 21 nt, Human
cugucauccucaaagaaagug

SEQ ID NO: 2743003 - RNA, 17 nt, Human
cugucggagcccugucu

SEQ ID NO: 2743004 - RNA, 18 nt, Human
cuggauaguccgucucug

SEQ ID NO: 2743005 - RNA, 19 nt, Human
cuggauaguccgucucugc

SEQ ID NO: 2743006 - RNA, 21 nt, Human
cugccuccccuccucugcuug

SEQ ID NO: 2743007 - RNA, 22 nt, Human
cugcuagcacuuggagccaagg

SEQ ID NO: 2743008 - RNA, 13 nt, Human
cuucucacauuua

SEQ ID NO: 2743009 - RNA, 20 nt, Human
cuucucacauuuauauuuuu

SEQ ID NO: 2743010 - RNA, 21 nt, Human
cuucuaaguaaaaccacagca

SEQ ID NO: 2743011 - RNA, 13 nt, Human
cuucuaaguaaaa

SEQ ID NO: 2743012 - RNA, 17 nt, Human
cuucuaaguaaaaccac

SEQ ID NO: 2743013 - RNA, 20 nt, Human
cuugcuaccaguauuuagaa

SEQ ID NO: 2743014 - RNA, 17 nt, Human
cuugcuaccaguauuua

SEQ ID NO: 2743015 - RNA, 18 nt, Human
cuugcuaccaguauuuag

SEQ ID NO: 2743016 - RNA, 13 nt, Human
cuugcuaccagua

SEQ ID NO: 2743017 - RNA, 16 nt, Human
cuuggucugugagaug

SEQ ID NO: 2743018 - RNA, 19 nt, Human
cuuggucugugagaugcua

SEQ ID NO: 2743019 - RNA, 15 nt, Human
cuuggucuuauuuau

SEQ ID NO: 2743020 - RNA, 15 nt, Human
cuuggguaggcggga

SEQ ID NO: 2743021 - RNA, 16 nt, Human
gaacccaaguccaagc

SEQ ID NO: 2743022 - RNA, 17 nt, Human
gaacccaaguccaagca

SEQ ID NO: 2743023 - RNA, 17 nt, Human
gaacccgggaggcagag

SEQ ID NO: 2743024 - RNA, 16 nt, Human
gaaaagacuccaaaga

SEQ ID NO: 2743025 - RNA, 17 nt, Human
gaaaagacuccaaagaa

SEQ ID NO: 2743026 - RNA, 14 nt, Human
gaaaagacuccaaa

SEQ ID NO: 2743027 - RNA, 21 nt, Human
gaaaacuuuaugcuaagugaa

SEQ ID NO: 2743028 - RNA, 21 nt, Human
gaacaaguuguuucauugacu

SEQ ID NO: 2743029 - RNA, 19 nt, Human
gaacaaguuguuucauuga

SEQ ID NO: 2743030 - RNA, 18 nt, Human
gaaagaaaaucaggcugg

SEQ ID NO: 2743031 - RNA, 12 nt, Human
gaaagggauuuu

SEQ ID NO: 2743032 - RNA, 20 nt, Human
gaaagggauuuucagcccuc

SEQ ID NO: 2743033 - RNA, 21 nt, Human
gaugcugucuucguacuggga

SEQ ID NO: 2743034 - RNA, 16 nt, Human
gcaauaaaauggguuu

SEQ ID NO: 2743035 - RNA, 18 nt, Human
gcaauagucaaauugugu

SEQ ID NO: 2743036 - RNA, 17 nt, Human
gcacucccaccugacac

SEQ ID NO: 2743037 - RNA, 18 nt, Human
gcacucccaccugacaca

SEQ ID NO: 2743038 - RNA, 22 nt, Human
gcacucccaccugacacaccag

SEQ ID NO: 2743039 - RNA, 18 nt, Human
gccaacuaugauuauuaa

SEQ ID NO: 2743040 - RNA, 16 nt, Human
gcauuguaaaugugcu

SEQ ID NO: 2743041 - RNA, 15 nt, Human
gcagcuuauucacaa

SEQ ID NO: 2743042 - RNA, 22 nt, Human
gcaguugaaaagacuccaaaga

SEQ ID NO: 2743043 - RNA, 15 nt, Human
gagcgacagugagac

SEQ ID NO: 2743044 - RNA, 13 nt, Human
gagcgacagugag

SEQ ID NO: 2743045 - RNA, 15 nt, Human
gacuauucaaacagu

SEQ ID NO: 2743046 - RNA, 16 nt, Human
gacuauucaaacaguc

SEQ ID NO: 2743047 - RNA, 21 nt, Human
gacagcccuucuuuccacaga

SEQ ID NO: 2743048 - RNA, 20 nt, Human
gacagaaagcagaacaguga

SEQ ID NO: 2743049 - RNA, 14 nt, Human
gacagaaagcagaa

SEQ ID NO: 2743050 - RNA, 11 nt, Human
aaacacagcaa

SEQ ID NO: 2743051 - RNA, 12 nt, Human
aaacacagcaag

SEQ ID NO: 2743052 - RNA, 14 nt, Human
aaacacagcaaggg

SEQ ID NO: 2743053 - RNA, 19 nt, Human
ggggaauugaggacacuga

SEQ ID NO: 2743054 - RNA, 15 nt, Human
aaacagucucaggaa

SEQ ID NO: 2743055 - RNA, 14 nt, Human
aaacaguagugaua

SEQ ID NO: 2743056 - RNA, 12 nt, Human
aaaccacagcag

SEQ ID NO: 2743057 - RNA, 19 nt, Human
ggguccuuuugacacugcu

SEQ ID NO: 2743058 - RNA, 22 nt, Human
ggguccuuuugacacugcucua

SEQ ID NO: 2743059 - RNA, 15 nt, Human
aaacucguuaauuug

SEQ ID NO: 2743060 - RNA, 18 nt, Human
gguccuuuugacacugcu

SEQ ID NO: 2743061 - RNA, 16 nt, Human
gguccuuuugacacug

SEQ ID NO: 2743062 - RNA, 17 nt, Human
aaagcacugacuucuaa

SEQ ID NO: 2743063 - RNA, 21 nt, Human
aaagcacugacuucuaaguaa

SEQ ID NO: 2743064 - RNA, 14 nt, Human
aaagguacuucaaa

SEQ ID NO: 2743065 - RNA, 14 nt, Human
ggguggggcagugc

SEQ ID NO: 2743066 - RNA, 23 nt, Human
aaacuucagcgguuuauauaagc

SEQ ID NO: 2743067 - RNA, 19 nt, Human
aaacuucagacauagaauu

SEQ ID NO: 2743068 - RNA, 13 nt, Human
aaagacagugaaa

SEQ ID NO: 2743069 - RNA, 18 nt, Human
aaagacuauucaaacagu

SEQ ID NO: 2743070 - RNA, 19 nt, Human
aaagacuauucaaacaguc

SEQ ID NO: 2743071 - RNA, 17 nt, Human
aaagacuauucaaacag

SEQ ID NO: 2743072 - RNA, 21 nt, Human
aaagacuauucaaacagucuc

SEQ ID NO: 2743073 - RNA, 15 nt, Human
aaagacuccaaagaa

SEQ ID NO: 2743074 - RNA, 21 nt, Human
aaagacuccaaagaaauguaa

SEQ ID NO: 2743075 - RNA, 14 nt, Human
aaagacuccaaaga

SEQ ID NO: 2743076 - RNA, 15 nt, Human
aaagaggcagcuuga

SEQ ID NO: 2743077 - RNA, 15 nt, Human
aaagaggaaugaagu

SEQ ID NO: 2743078 - RNA, 16 nt, Human
aaaguuggugacagau

SEQ ID NO: 2743079 - RNA, 17 nt, Human
aaaguauguuagugcaa

SEQ ID NO: 2743080 - RNA, 23 nt, Human
aaaguucugcagauaaacaguag

SEQ ID NO: 2743081 - RNA, 20 nt, Human
aaagguauuuuaaucaccaa

SEQ ID NO: 2743082 - RNA, 18 nt, Human
aaaguauguuagugcaaa

SEQ ID NO: 2743083 - RNA, 19 nt, Human
aaauacacacucaaaucaa

SEQ ID NO: 2743084 - RNA, 23 nt, Human
aaauaauuuuuauauuugaaaua

SEQ ID NO: 2743085 - RNA, 22 nt, Human
aaauaauuuuuauauuugaaau

SEQ ID NO: 2743086 - RNA, 15 nt, Human
aaauacacacucaaa

SEQ ID NO: 2743087 - RNA, 21 nt, Human
aaauaauuuuuauauuugaaa

SEQ ID NO: 2743088 - RNA, 23 nt, Human
guacacugccuucucaacuccaa

SEQ ID NO: 2743089 - RNA, 20 nt, Human
guaauaggcguaacuaauuu

SEQ ID NO: 2743090 - RNA, 22 nt, Human
guaccaguuaauuuuuccaacu

SEQ ID NO: 2743091 - RNA, 23 nt, Human
guaccaguuaauuuuuccaacua

SEQ ID NO: 2743092 - RNA, 10 nt, Human
guaccaguua

SEQ ID NO: 2743093 - RNA, 11 nt, Human
guaccaguuaa

SEQ ID NO: 2743094 - RNA, 16 nt, Human
guaccaguuaauuuuu

SEQ ID NO: 2743095 - RNA, 20 nt, Human
guaccaguuaauuuuuccaa

SEQ ID NO: 2743096 - RNA, 18 nt, Human
aaauccauacauuugugu

SEQ ID NO: 2743097 - RNA, 15 nt, Human
aaauccauacauuug

SEQ ID NO: 2743098 - RNA, 12 nt, Human
aaaucagaaguc

SEQ ID NO: 2743099 - RNA, 18 nt, Human
aaaucagaagucaucuug

SEQ ID NO: 2743100 - RNA, 21 nt, Human
aaaucagaagucaucuugcua

SEQ ID NO: 2743101 - RNA, 17 nt, Human
aaauauuauguuaaaac

SEQ ID NO: 2743102 - RNA, 12 nt, Human
aaaucauuucug

SEQ ID NO: 2743103 - RNA, 11 nt, Human
aaaucauuucu

SEQ ID NO: 2743104 - RNA, 19 nt, Human
aaaucauuucugcaucagc

SEQ ID NO: 2743105 - RNA, 21 nt, Human
aaaucauuucugcaucagcug

SEQ ID NO: 2743106 - RNA, 22 nt, Human
aaaucauuucugcaucagcugc

SEQ ID NO: 2743107 - RNA, 23 nt, Human
aaaucauuucugcaucagcugcu

SEQ ID NO: 2743108 - RNA, 23 nt, Human
guacuguguacagaauucugcua

SEQ ID NO: 2743109 - RNA, 22 nt, Human
guacuucaaauccuugaagauu

SEQ ID NO: 2743110 - RNA, 21 nt, Human
guacuucaaauccuugaagau

SEQ ID NO: 2743111 - RNA, 15 nt, Human
guacuucaugcuguc

SEQ ID NO: 2743112 - RNA, 23 nt, Human
guagacgugcacgcacacugucu

SEQ ID NO: 2743113 - RNA, 20 nt, Human
guagacgugcacgcacacug

SEQ ID NO: 2743114 - RNA, 22 nt, Human
gggagggguaaaauuccuuagc

SEQ ID NO: 2743115 - RNA, 17 nt, Human
aaaaaugguuuaaaugg

SEQ ID NO: 2743116 - RNA, 15 nt, Human
aaaacuucagacaua

SEQ ID NO: 2743117 - RNA, 14 nt, Human
aaaaauaacaauga

SEQ ID NO: 2743118 - RNA, 18 nt, Human
aaaaauaaauauaucuac

SEQ ID NO: 2743119 - RNA, 24 nt, Human
aaaaauaaauauaucuaccccaga

SEQ ID NO: 2743120 - RNA, 20 nt, Human
gggaacccaaguccaagcau

SEQ ID NO: 2743121 - RNA, 22 nt, Human
gggacagucaccucauggaauu

SEQ ID NO: 2743122 - RNA, 21 nt, Human
gggacagucaccucauggaau

SEQ ID NO: 2743123 - RNA, 20 nt, Human
gggacagucaccucauggaa

SEQ ID NO: 2743124 - RNA, 20 nt, Human
ggcucagccuggugggccuc

SEQ ID NO: 2743125 - RNA, 13 nt, Human
ggcucagccuggu

SEQ ID NO: 2743126 - RNA, 14 nt, Human
ggcuccacuugguc

SEQ ID NO: 2743127 - RNA, 13 nt, Human
ggccuccauccug

SEQ ID NO: 2743128 - RNA, 15 nt, Human
ggccuccauccugag

SEQ ID NO: 2743129 - RNA, 14 nt, Human
ggccuccauccuga

SEQ ID NO: 2743130 - RNA, 20 nt, Human
ggcagacagcagcucaggca

SEQ ID NO: 2743131 - RNA, 19 nt, Human
ggcagacagcagcucaggc

SEQ ID NO: 2743132 - RNA, 18 nt, Human
ggcagacagcagcucagg

SEQ ID NO: 2743133 - RNA, 17 nt, Human
ggcagacagcagcucag

SEQ ID NO: 2743134 - RNA, 16 nt, Human
ggcagacagcagcuca

SEQ ID NO: 2743135 - RNA, 15 nt, Human
ggcagacagcagcuc

SEQ ID NO: 2743136 - RNA, 14 nt, Human
ggcagacagcagcu

SEQ ID NO: 2743137 - RNA, 13 nt, Human
ggcagacagcagc

SEQ ID NO: 2743138 - RNA, 21 nt, Human
ggcacaguuuucugagaaaga

SEQ ID NO: 2743139 - RNA, 10 nt, Human
ggcaguuuuu

SEQ ID NO: 2743140 - RNA, 13 nt, Human
ggagaaacuggaa

SEQ ID NO: 2743141 - RNA, 22 nt, Human
ggacucauuuuaaaaaauggaa

SEQ ID NO: 2743142 - RNA, 21 nt, Human
gcucuggggugggcaguuuuu

SEQ ID NO: 2743143 - RNA, 19 nt, Human
gcucuggggugggcaguuu

SEQ ID NO: 2743144 - RNA, 17 nt, Human
gcuaauucaaggaauuu

SEQ ID NO: 2743145 - RNA, 22 nt, Human
gcuaauucaaggaauuucuuaa

SEQ ID NO: 2743146 - RNA, 18 nt, Human
gcuagaacucccuuucaa

SEQ ID NO: 2743147 - RNA, 16 nt, Human
gcuagaacucccuuuc

SEQ ID NO: 2743148 - RNA, 15 nt, Human
gcuagaacucccuuu

SEQ ID NO: 2743149 - RNA, 14 nt, Human
gcuagaacucccuu

SEQ ID NO: 2743150 - RNA, 13 nt, Human
gcuagaacucccu

SEQ ID NO: 2743151 - RNA, 12 nt, Human
gcuagaacuccc

SEQ ID NO: 2743152 - RNA, 19 nt, Human
gcuccacuuggucugugag

SEQ ID NO: 2743153 - RNA, 18 nt, Human
gcuccacuuggucuguga

SEQ ID NO: 2743154 - RNA, 21 nt, Human
gcuccccucggagaagagcug

SEQ ID NO: 2743155 - RNA, 15 nt, Human
gcuccacuuggucug

SEQ ID NO: 2743156 - RNA, 19 nt, Human
gcuccaccuugcagcucuc

SEQ ID NO: 2743157 - RNA, 15 nt, Human
gcucuaacagcccuc

SEQ ID NO: 2743158 - RNA, 18 nt, Human
gcucgguggacccaggga

SEQ ID NO: 2743159 - RNA, 17 nt, Human
gcucgguggacccaggg

SEQ ID NO: 2743160 - RNA, 14 nt, Human
gcucgguggaccca

SEQ ID NO: 2743161 - RNA, 12 nt, Human
gcucgguggacc

SEQ ID NO: 2743162 - RNA, 20 nt, Human
gccuucggccuccauccuga

SEQ ID NO: 2743163 - RNA, 21 nt, Human
gccuucggccuccauccugag

SEQ ID NO: 2743164 - RNA, 15 nt, Human
gccucuuagaugcag

SEQ ID NO: 2743165 - RNA, 20 nt, Human
gccuagccgaccucagccuu

SEQ ID NO: 2743166 - RNA, 19 nt, Human
gccuagccgaccucagccu

SEQ ID NO: 2743167 - RNA, 18 nt, Human
gccuagccgaccucagcc

SEQ ID NO: 2743168 - RNA, 17 nt, Human
gccuagccgaccucagc

SEQ ID NO: 2743169 - RNA, 16 nt, Human
gccuagccgaccucag

SEQ ID NO: 2743170 - RNA, 15 nt, Human
gccuagccgaccuca

SEQ ID NO: 2743171 - RNA, 23 nt, Human
auucccguuuugucacuuuuucu

SEQ ID NO: 2743172 - RNA, 16 nt, Human
auucccguuuugucac

SEQ ID NO: 2743173 - RNA, 18 nt, Human
auucccguuuugucacuu

SEQ ID NO: 2743174 - RNA, 21 nt, Human
auucccguuuugucacuuuuu

SEQ ID NO: 2743175 - RNA, 18 nt, Human
auuauauuuauuacugua

SEQ ID NO: 2743176 - RNA, 15 nt, Human
auuauauuuauuacu

SEQ ID NO: 2743177 - RNA, 21 nt, Human
auuauguuaaaacugggacag

SEQ ID NO: 2743178 - RNA, 16 nt, Human
auucaaacagucucag

SEQ ID NO: 2743179 - RNA, 18 nt, Human
auucaaacagucucagga

SEQ ID NO: 2743180 - RNA, 19 nt, Human
auucaaacagucucaggaa

SEQ ID NO: 2743181 - RNA, 20 nt, Human
auucaaacagucucaggaaa

SEQ ID NO: 2743182 - RNA, 19 nt, Human
auucugcuaccucacuggg

SEQ ID NO: 2743183 - RNA, 15 nt, Human
auucugcuaccucac

SEQ ID NO: 2743184 - RNA, 19 nt, Human
auugacacuuaaaaauggu

SEQ ID NO: 2743185 - RNA, 21 nt, Human
auugacuaucaaacugaagcc

SEQ ID NO: 2743186 - RNA, 18 nt, Human
auugacuaucaaacugaa

SEQ ID NO: 2743187 - RNA, 17 nt, Human
auugacacuuaaaaaug

SEQ ID NO: 2743188 - RNA, 15 nt, Human
auugacacuuaaaaa

SEQ ID NO: 2743189 - RNA, 23 nt, Human
auuuuuucucuaggaaauauuua

SEQ ID NO: 2743190 - RNA, 20 nt, Human
auuuuuucucuaggaaauau

SEQ ID NO: 2743191 - RNA, 18 nt, Human
auuuuuuguuaaaugauu

SEQ ID NO: 2743192 - RNA, 14 nt, Human
auuuuuuguauaau

SEQ ID NO: 2743193 - RNA, 15 nt, Human
auuuuuuguauaauu

SEQ ID NO: 2743194 - RNA, 16 nt, Human
auuuuuuguauaauug

SEQ ID NO: 2743195 - RNA, 13 nt, Human
auuuuuuaaauuc

SEQ ID NO: 2743196 - RNA, 21 nt, Human
auuuuuguuuucauuaucuca

SEQ ID NO: 2743197 - RNA, 22 nt, Human
auuuuugugauuuugugauuga

SEQ ID NO: 2743198 - RNA, 13 nt, Human
auuuuuccaacua

SEQ ID NO: 2743199 - RNA, 21 nt, Human
auuuuuccaacuacuaauaga

SEQ ID NO: 2743200 - RNA, 19 nt, Human
auuuuucuuauuucauuuc

SEQ ID NO: 2743201 - RNA, 20 nt, Human
auuuuucuuauuucauuucu

SEQ ID NO: 2743202 - RNA, 15 nt, Human
auuuuucuuauuuca

SEQ ID NO: 2743203 - RNA, 15 nt, Human
auuuuguuggcauag

SEQ ID NO: 2743204 - RNA, 21 nt, Human
auuuuguuggcauagcucugg

SEQ ID NO: 2743205 - RNA, 14 nt, Human
auuuuccugaaaac

SEQ ID NO: 2743206 - RNA, 14 nt, Human
auuuucuauaauuu

SEQ ID NO: 2743207 - RNA, 15 nt, Human
auuuucuauaauuua

SEQ ID NO: 2743208 - RNA, 16 nt, Human
auuuuaaaagaaugau

SEQ ID NO: 2743209 - RNA, 23 nt, Human
auuuuaaaagaaugauuaugaau

SEQ ID NO: 2743210 - RNA, 14 nt, Human
auuuguauaaaaua

SEQ ID NO: 2743211 - RNA, 22 nt, Human
auuuguaguguuggagaagaac

SEQ ID NO: 2743212 - RNA, 19 nt, Human
auuuguaguguuggagaag

SEQ ID NO: 2743213 - RNA, 14 nt, Human
auuuauuuuaauaa

SEQ ID NO: 2743214 - RNA, 13 nt, Human
auugucuagugaa

SEQ ID NO: 2743215 - RNA, 23 nt, Human
auuggauuuccuaauacugucau

SEQ ID NO: 2743216 - RNA, 14 nt, Human
auuggauuuccuaa

SEQ ID NO: 2743217 - RNA, 15 nt, Human
auuggauuuccuaau

SEQ ID NO: 2743218 - RNA, 22 nt, Human
auuggauuuccuaauacuguca

SEQ ID NO: 2743219 - RNA, 17 nt, Human
auugguuuaaagaaagu

SEQ ID NO: 2743220 - RNA, 18 nt, Human
auugguuuaaagaaagug

SEQ ID NO: 2743221 - RNA, 15 nt, Human
auugguuuaaagaaa

SEQ ID NO: 2743222 - RNA, 13 nt, Human
auugacuuuuuau

SEQ ID NO: 2743223 - RNA, 19 nt, Human
auuggagcucgugggacag

SEQ ID NO: 2743224 - RNA, 19 nt, Human
auuggacaguaaaauccac

SEQ ID NO: 2743225 - RNA, 19 nt, Human
uuuauuaaucuuaguguau

SEQ ID NO: 2743226 - RNA, 13 nt, Human
uuuauuaaucuua

SEQ ID NO: 2743227 - RNA, 22 nt, Human
augcuagaacucccuuucaaca

SEQ ID NO: 2743228 - RNA, 19 nt, Human
augcuagaacucccuuuca

SEQ ID NO: 2743229 - RNA, 21 nt, Human
augcuagaacucccuuucaac

SEQ ID NO: 2743230 - RNA, 20 nt, Human
augcuagaacucccuuucaa

SEQ ID NO: 2743231 - RNA, 16 nt, Human
uuucaaacauauauaa

SEQ ID NO: 2743232 - RNA, 23 nt, Human
auggcuauaggugcuacaaaaac

SEQ ID NO: 2743233 - RNA, 19 nt, Human
auggcuaagcaaaauguga

SEQ ID NO: 2743234 - RNA, 16 nt, Human
auggcauaaccugucu

SEQ ID NO: 2743235 - RNA, 17 nt, Human
auggcauaaccugucuc

SEQ ID NO: 2743236 - RNA, 16 nt, Human
auggcacuaguauuuc

SEQ ID NO: 2743237 - RNA, 14 nt, Human
auggcacuaguauu

SEQ ID NO: 2743238 - RNA, 13 nt, Human
uuuaaagaaagug

SEQ ID NO: 2743239 - RNA, 14 nt, Human
uuuaaagaaagugu

SEQ ID NO: 2743240 - RNA, 16 nt, Human
uuuaaagaaaguguau

SEQ ID NO: 2743241 - RNA, 22 nt, Human
augauuacuggccuuuuucauu

SEQ ID NO: 2743242 - RNA, 15 nt, Human
augauuacuggccuu

SEQ ID NO: 2743243 - RNA, 19 nt, Human
augauuacuggccuuuuuc

SEQ ID NO: 2743244 - RNA, 15 nt, Human
augauaacuggaaac

SEQ ID NO: 2743245 - RNA, 14 nt, Human
augauuaaguaaug

SEQ ID NO: 2743246 - RNA, 18 nt, Human
augauuaaguaaugauaa

SEQ ID NO: 2743247 - RNA, 14 nt, Human
augauuacuggccu

SEQ ID NO: 2743248 - RNA, 19 nt, Human
augcgguuaauuuugaagu

SEQ ID NO: 2743249 - RNA, 17 nt, Human
augccauuuaaagcuua

SEQ ID NO: 2743250 - RNA, 21 nt, Human
augccauuuaaagcuuauuaa

SEQ ID NO: 2743251 - RNA, 13 nt, Human
augcaguucugaa

SEQ ID NO: 2743252 - RNA, 15 nt, Human
augcagcuguggcag

SEQ ID NO: 2743253 - RNA, 18 nt, Human
uuuaaauauaugcuaagu

SEQ ID NO: 2743254 - RNA, 15 nt, Human
uuugaaauauugacu

SEQ ID NO: 2743255 - RNA, 14 nt, Human
uuucuguaccaguu

SEQ ID NO: 2743256 - RNA, 15 nt, Human
uuucuguaccaguua

SEQ ID NO: 2743257 - RNA, 18 nt, Human
uuucucccagucauuuaa

SEQ ID NO: 2743258 - RNA, 17 nt, Human
uuucucccagucauuua

SEQ ID NO: 2743259 - RNA, 21 nt, Human
augguucccuugaugaagaag

SEQ ID NO: 2743260 - RNA, 14 nt, Human
uuugcaagccagau

SEQ ID NO: 2743261 - RNA, 16 nt, Human
auguacuucaugcugu

SEQ ID NO: 2743262 - RNA, 19 nt, Human
auguagaggagaaacugga

SEQ ID NO: 2743263 - RNA, 17 nt, Human
auguagaggagaaacug

SEQ ID NO: 2743264 - RNA, 13 nt, Human
auguagaggagaa

SEQ ID NO: 2743265 - RNA, 12 nt, Human
auguagaggaga

SEQ ID NO: 2743266 - RNA, 12 nt, Human
auguauguuacc

SEQ ID NO: 2743267 - RNA, 13 nt, Human
auguauguuacca

SEQ ID NO: 2743268 - RNA, 14 nt, Human
auguauguuaccaa

SEQ ID NO: 2743269 - RNA, 17 nt, Human
auguccacugguucuuc

SEQ ID NO: 2743270 - RNA, 16 nt, Human
auguccacugguucuu

SEQ ID NO: 2743271 - RNA, 16 nt, Human
auguccugccuauuau

SEQ ID NO: 2743272 - RNA, 20 nt, Human
auguccugccuauuaucugu

SEQ ID NO: 2743273 - RNA, 21 nt, Human
auguccugccuauuaucuguc

SEQ ID NO: 2743274 - RNA, 22 nt, Human
auguccugccuauuaucuguca

SEQ ID NO: 2743275 - RNA, 15 nt, Human
uuugugaauuaggcu

SEQ ID NO: 2743276 - RNA, 22 nt, Human
uuugugaauuaggcuguaacua

SEQ ID NO: 2743277 - RNA, 17 nt, Human
uuugugaagcaaaauuu

SEQ ID NO: 2743278 - RNA, 21 nt, Human
uuuguaguguuggagaagaac

SEQ ID NO: 2743279 - RNA, 19 nt, Human
uuuguaguguuggagaaga

SEQ ID NO: 2743280 - RNA, 14 nt, Human
uucggccuccaucc

SEQ ID NO: 2743281 - RNA, 18 nt, Human
uucggccccauguaucuc

SEQ ID NO: 2743282 - RNA, 17 nt, Human
uucggccccauguaucu

SEQ ID NO: 2743283 - RNA, 15 nt, Human
uucggccuccauccu

SEQ ID NO: 2743284 - RNA, 13 nt, Human
uucuaagaaguga

SEQ ID NO: 2743285 - RNA, 23 nt, Human
uucuaagaagugaaaaucuacac

SEQ ID NO: 2743286 - RNA, 15 nt, Human
uucuaaguaaaacca

SEQ ID NO: 2743287 - RNA, 16 nt, Human
uucuaaguaaaaccac

SEQ ID NO: 2743288 - RNA, 19 nt, Human
uucuagcaugaagacagag

SEQ ID NO: 2743289 - RNA, 17 nt, Human
aucaggguuaguauugu

SEQ ID NO: 2743290 - RNA, 19 nt, Human
aucagaagucaucuugcua

SEQ ID NO: 2743291 - RNA, 22 nt, Human
aucacuugucaauaaaauccau

SEQ ID NO: 2743292 - RNA, 18 nt, Human
aucagaagucaucuugcu

SEQ ID NO: 2743293 - RNA, 14 nt, Human
aucaacagauaaau

SEQ ID NO: 2743294 - RNA, 18 nt, Human
auauuuuuuguuaaauga

SEQ ID NO: 2743295 - RNA, 20 nt, Human
auauuuuuuguuaaaugauu

SEQ ID NO: 2743296 - RNA, 19 nt, Human
uuccguagguuauuuucag

SEQ ID NO: 2743297 - RNA, 19 nt, Human
uucccucccagaggagcca

SEQ ID NO: 2743298 - RNA, 12 nt, Human
uucucuaggaaa

SEQ ID NO: 2743299 - RNA, 17 nt, Human
uucuuaacuucuugcuu

SEQ ID NO: 2743300 - RNA, 13 nt, Human
uucuuaacuucuu

SEQ ID NO: 2743301 - RNA, 16 nt, Human
uucuuaacuucuugcu

SEQ ID NO: 2743302 - RNA, 13 nt, Human
auccgaggcaggg

SEQ ID NO: 2743303 - RNA, 17 nt, Human
uugaaauuguauuacaa

SEQ ID NO: 2743304 - RNA, 18 nt, Human
uugaacccgggaggcaga

SEQ ID NO: 2743305 - RNA, 19 nt, Human
uugaacccgggaggcagag

SEQ ID NO: 2743306 - RNA, 12 nt, Human
auccgaggcagg

SEQ ID NO: 2743307 - RNA, 13 nt, Human
uugcaucaauuuu

SEQ ID NO: 2743308 - RNA, 22 nt, Human
uugcaagccagauuuuccugaa

SEQ ID NO: 2743309 - RNA, 14 nt, Human
aucucauuuccaag

SEQ ID NO: 2743310 - RNA, 17 nt, Human
uugaagggaaauuucag

SEQ ID NO: 2743311 - RNA, 18 nt, Human
aucuacacuccagugaga

SEQ ID NO: 2743312 - RNA, 19 nt, Human
aucuacacuccagugagac

SEQ ID NO: 2743313 - RNA, 20 nt, Human
uugcuucuuucuagaaagag

SEQ ID NO: 2743314 - RNA, 12 nt, Human
uugcuucuuucu

SEQ ID NO: 2743315 - RNA, 17 nt, Human
uugcuucuuucuagaaa

SEQ ID NO: 2743316 - RNA, 13 nt, Human
aucuuaguguaug

SEQ ID NO: 2743317 - RNA, 14 nt, Human
aucuuaguguauga

SEQ ID NO: 2743318 - RNA, 19 nt, Human
aucuuaguguaugauuacu

SEQ ID NO: 2743319 - RNA, 15 nt, Human
aucuuaguguaugau

SEQ ID NO: 2743320 - RNA, 16 nt, Human
aucuuaguguaugauu

SEQ ID NO: 2743321 - RNA, 23 nt, Human
aucuugcuaccaguauuuagaag

SEQ ID NO: 2743322 - RNA, 14 nt, Human
aucuuauaauuuaa

SEQ ID NO: 2743323 - RNA, 14 nt, Human
aucuugcuaccagu

SEQ ID NO: 2743324 - RNA, 16 nt, Human
aucuugcuaccaguau

SEQ ID NO: 2743325 - RNA, 19 nt, Human
aucuugcuaccaguauuua

SEQ ID NO: 2743326 - RNA, 16 nt, Human
augaauuacauuugua

SEQ ID NO: 2743327 - RNA, 15 nt, Human
augaauuacauuugu

SEQ ID NO: 2743328 - RNA, 15 nt, Human
augaauuaaguuuuu

SEQ ID NO: 2743329 - RNA, 23 nt, Human
augaauggcuaagcaaaauguga

SEQ ID NO: 2743330 - RNA, 13 nt, Human
uuacuggccuuuu

SEQ ID NO: 2743331 - RNA, 16 nt, Human
uuacuggccuuuuuca

SEQ ID NO: 2743332 - RNA, 18 nt, Human
uuacuggccuuuuucauu

SEQ ID NO: 2743333 - RNA, 18 nt, Human
uuaauuuuuccaacuacu

SEQ ID NO: 2743334 - RNA, 22 nt, Human
uuacaaaucagaagucaucuug

SEQ ID NO: 2743335 - RNA, 16 nt, Human
uuacaaaucagaaguc

SEQ ID NO: 2743336 - RNA, 17 nt, Human
uuacaaaucagaaguca

SEQ ID NO: 2743337 - RNA, 22 nt, Human
uuacaguucugugguuucaugu

SEQ ID NO: 2743338 - RNA, 13 nt, Human
uuacaguucugug

SEQ ID NO: 2743339 - RNA, 14 nt, Human
uuacaguucugugg

SEQ ID NO: 2743340 - RNA, 11 nt, Human
uuacaguucug

SEQ ID NO: 2743341 - RNA, 12 nt, Human
uuacaguucugu

SEQ ID NO: 2743342 - RNA, 14 nt, Human
auaaucuuucacag

SEQ ID NO: 2743343 - RNA, 15 nt, Human
uuagggagagaagau

SEQ ID NO: 2743344 - RNA, 12 nt, Human
uuagggaggggu

SEQ ID NO: 2743345 - RNA, 14 nt, Human
uuagggagagaaga

SEQ ID NO: 2743346 - RNA, 16 nt, Human
uuaggguuaugauuaa

SEQ ID NO: 2743347 - RNA, 14 nt, Human
uuaggguuaugauu

SEQ ID NO: 2743348 - RNA, 22 nt, Human
uuaaaaucauuucugcaucagc

SEQ ID NO: 2743349 - RNA, 14 nt, Human
uuaaaaucauuucu

SEQ ID NO: 2743350 - RNA, 16 nt, Human
uuaaaaaauggaacau

SEQ ID NO: 2743351 - RNA, 19 nt, Human
uuaaaaaagaaacauuugg

SEQ ID NO: 2743352 - RNA, 15 nt, Human
aguuuagcuggaaaa

SEQ ID NO: 2743353 - RNA, 17 nt, Human
aguuuaaauuguaauag

SEQ ID NO: 2743354 - RNA, 20 nt, Human
aguuuaaauuguaauaggcg

SEQ ID NO: 2743355 - RNA, 20 nt, Human
uuaauuuugaagugcuguuu

SEQ ID NO: 2743356 - RNA, 23 nt, Human
uuaauuuugaagugcuguuuauu

SEQ ID NO: 2743357 - RNA, 19 nt, Human
uuaauuuugaagugcuguu

SEQ ID NO: 2743358 - RNA, 13 nt, Human
uuaauuuuuccaa

SEQ ID NO: 2743359 - RNA, 15 nt, Human
uuaauuuuuccaacu

SEQ ID NO: 2743360 - RNA, 19 nt, Human
uuaaucuuaguguaugauu

SEQ ID NO: 2743361 - RNA, 21 nt, Human
uuaaucuuaguguaugauuac

SEQ ID NO: 2743362 - RNA, 22 nt, Human
aguuuuuugaaaaugggcucaa

SEQ ID NO: 2743363 - RNA, 16 nt, Human
aguuuuauaugcuucu

SEQ ID NO: 2743364 - RNA, 15 nt, Human
uuauuauauuuacaa

SEQ ID NO: 2743365 - RNA, 14 nt, Human
uuauuauauuuaca

SEQ ID NO: 2743366 - RNA, 19 nt, Human
uuauguuaaaacugggaca

SEQ ID NO: 2743367 - RNA, 16 nt, Human
auacucauuaggaugg

SEQ ID NO: 2743368 - RNA, 18 nt, Human
auagauaggucagugcaa

SEQ ID NO: 2743369 - RNA, 17 nt, Human
auagaauuaacacauga

SEQ ID NO: 2743370 - RNA, 20 nt, Human
auagaauaaaggcaguuuuc

SEQ ID NO: 2743371 - RNA, 22 nt, Human
auagaauaaaggcaguuuucua

SEQ ID NO: 2743372 - RNA, 12 nt, Human
auagaauaaagg

SEQ ID NO: 2743373 - RNA, 17 nt, Human
auagaauaaaggcaguu

SEQ ID NO: 2743374 - RNA, 18 nt, Human
auagaauaaaggcaguuu

SEQ ID NO: 2743375 - RNA, 19 nt, Human
auagaauaaaggcaguuuu

SEQ ID NO: 2743376 - RNA, 13 nt, Human
auagaaguaaaaa

SEQ ID NO: 2743377 - RNA, 19 nt, Human
uuaugauuaaguaaugaua

SEQ ID NO: 2743378 - RNA, 21 nt, Human
uuaugaauuacauuuguauaa

SEQ ID NO: 2743379 - RNA, 17 nt, Human
uuaugaauuacauuugu

SEQ ID NO: 2743380 - RNA, 16 nt, Human
uuaugaauuacauuug

SEQ ID NO: 2743381 - RNA, 14 nt, Human
uuaugaauuacauu

SEQ ID NO: 2743382 - RNA, 19 nt, Human
uuauauuugaaauauugac

SEQ ID NO: 2743383 - RNA, 15 nt, Human
uuauauuugaaauau

SEQ ID NO: 2743384 - RNA, 17 nt, Human
auacuauggaauuucuc

SEQ ID NO: 2743385 - RNA, 20 nt, Human
ugugcugcccgucuucagcc

SEQ ID NO: 2743386 - RNA, 17 nt, Human
agugccacuuaauguau

SEQ ID NO: 2743387 - RNA, 21 nt, Human
agugccacuuaauguauguua

SEQ ID NO: 2743388 - RNA, 18 nt, Human
agugccacuuaauguaug

SEQ ID NO: 2743389 - RNA, 20 nt, Human
agugccacuuaauguauguu

SEQ ID NO: 2743390 - RNA, 14 nt, Human
agugcaaauuguca

SEQ ID NO: 2743391 - RNA, 22 nt, Human
agugcaaauugucacaggacag

SEQ ID NO: 2743392 - RNA, 23 nt, Human
agugaacaaauuuacagagacag

SEQ ID NO: 2743393 - RNA, 22 nt, Human
agugaacaaauuuacagagaca

SEQ ID NO: 2743394 - RNA, 16 nt, Human
agucuuucacauuuaa

SEQ ID NO: 2743395 - RNA, 21 nt, Human
agugaacaaauuuacagagac

SEQ ID NO: 2743396 - RNA, 22 nt, Human
uguugcccacagcuguaugauu

SEQ ID NO: 2743397 - RNA, 15 nt, Human
uguucuaagaaguga

SEQ ID NO: 2743398 - RNA, 23 nt, Human
aguguuggagaagaacugaaauc

SEQ ID NO: 2743399 - RNA, 22 nt, Human
aguaauuuauuguuuuuccuug

SEQ ID NO: 2743400 - RNA, 23 nt, Human
aguaauuuauuguuuuuccuugu

SEQ ID NO: 2743401 - RNA, 13 nt, Human
aguaauuuauugu

SEQ ID NO: 2743402 - RNA, 13 nt, Human
aguaauuggaaag

SEQ ID NO: 2743403 - RNA, 12 nt, Human
aguaauuggaaa

SEQ ID NO: 2743404 - RNA, 16 nt, Human
aguaaaaccacagcag

SEQ ID NO: 2743405 - RNA, 17 nt, Human
aguaaaaccacagcagu

SEQ ID NO: 2743406 - RNA, 19 nt, Human
aguaaaaccacagcaguug

SEQ ID NO: 2743407 - RNA, 20 nt, Human
aguaaaaccacagcaguuga

SEQ ID NO: 2743408 - RNA, 16 nt, Human
uguaguguuggagaag

SEQ ID NO: 2743409 - RNA, 18 nt, Human
uguaguguuggagaagaa

SEQ ID NO: 2743410 - RNA, 17 nt, Human
uguaguguuggagaaga

SEQ ID NO: 2743411 - RNA, 13 nt, Human
uguaagggaaacu

SEQ ID NO: 2743412 - RNA, 18 nt, Human
uguaagggaaacugccag

SEQ ID NO: 2743413 - RNA, 19 nt, Human
uguaagggaaacugccagc

SEQ ID NO: 2743414 - RNA, 14 nt, Human
agguugcagugagc

SEQ ID NO: 2743415 - RNA, 16 nt, Human
aggugcuacaaaaaca

SEQ ID NO: 2743416 - RNA, 13 nt, Human
agucucaggaaau

SEQ ID NO: 2743417 - RNA, 14 nt, Human
agucaggaaagaga

SEQ ID NO: 2743418 - RNA, 15 nt, Human
aguauuuagaagcca

SEQ ID NO: 2743419 - RNA, 19 nt, Human
aguauuuagaagccaacua

SEQ ID NO: 2743420 - RNA, 20 nt, Human
uguccagccccguagacgug

SEQ ID NO: 2743421 - RNA, 19 nt, Human
ugggaggcugagaugggag

SEQ ID NO: 2743422 - RNA, 13 nt, Human
agggagagaagau

SEQ ID NO: 2743423 - RNA, 14 nt, Human
agggagagaagaua

SEQ ID NO: 2743424 - RNA, 23 nt, Human
agggacuucugucuucacaacag

SEQ ID NO: 2743425 - RNA, 18 nt, Human
agggccccagcacuaaag

SEQ ID NO: 2743426 - RNA, 14 nt, Human
agggccccagcacu

SEQ ID NO: 2743427 - RNA, 12 nt, Human
agggccccagca

SEQ ID NO: 2743428 - RNA, 22 nt, Human
agggcuguuauaaucuuucaca

SEQ ID NO: 2743429 - RNA, 18 nt, Human
ugggcucaaccagaaaag

SEQ ID NO: 2743430 - RNA, 20 nt, Human
ugggaacccaaguccaagca

SEQ ID NO: 2743431 - RNA, 16 nt, Human
agggaaacugccagca

SEQ ID NO: 2743432 - RNA, 19 nt, Human
agggaaacugccagcaacg

SEQ ID NO: 2743433 - RNA, 21 nt, Human
agggaaacugccagcaacgca

SEQ ID NO: 2743434 - RNA, 23 nt, Human
agggaaacugccagcaacgcagg

SEQ ID NO: 2743435 - RNA, 14 nt, Human
agggaaacugccag

SEQ ID NO: 2743436 - RNA, 15 nt, Human
agggaaacugccagc

SEQ ID NO: 2743437 - RNA, 14 nt, Human
ugggaaagcauugu

SEQ ID NO: 2743438 - RNA, 16 nt, Human
ugggaaagcauuguaa

SEQ ID NO: 2743439 - RNA, 17 nt, Human
ugggaaagcauuguaaa

SEQ ID NO: 2743440 - RNA, 18 nt, Human
ugggaaagcauuguaaau

SEQ ID NO: 2743441 - RNA, 18 nt, Human
ugggaaacaaaaggauaa

SEQ ID NO: 2743442 - RNA, 23 nt, Human
uggcuauaggugcuacaaaaaca

SEQ ID NO: 2743443 - RNA, 18 nt, Human
uggcuaagcaaaauguga

SEQ ID NO: 2743444 - RNA, 15 nt, Human
uggcuauaggugcua

SEQ ID NO: 2743445 - RNA, 19 nt, Human
uggcuauaggugcuacaaa

SEQ ID NO: 2743446 - RNA, 12 nt, Human
uggcccaggagu

SEQ ID NO: 2743447 - RNA, 11 nt, Human
uggcccaggag

SEQ ID NO: 2743448 - RNA, 22 nt, Human
aggcuccacuuggucugugaga

SEQ ID NO: 2743449 - RNA, 21 nt, Human
aggcuccacuuggucugugag

SEQ ID NO: 2743450 - RNA, 17 nt, Human
aggcuccacuuggucug

SEQ ID NO: 2743451 - RNA, 11 nt, Human
aggcuccacuu

SEQ ID NO: 2743452 - RNA, 22 nt, Human
ugcugcccgucuucagccuagc

SEQ ID NO: 2743453 - RNA, 21 nt, Human
ugcugcccgucuucagccuag

SEQ ID NO: 2743454 - RNA, 20 nt, Human
ugcugcccgucuucagccua

SEQ ID NO: 2743455 - RNA, 17 nt, Human
ugcugcccgucuucagc

SEQ ID NO: 2743456 - RNA, 13 nt, Human
aggaguuuggcca

SEQ ID NO: 2743457 - RNA, 12 nt, Human
aggaguuuggcc

SEQ ID NO: 2743458 - RNA, 21 nt, Human
uggacaccaggagucccuggu

SEQ ID NO: 2743459 - RNA, 20 nt, Human
uggacaccaggagucccugg

SEQ ID NO: 2743460 - RNA, 21 nt, Human
uggagcucgugggacagucac

SEQ ID NO: 2743461 - RNA, 12 nt, Human
aggcaauuagac

SEQ ID NO: 2743462 - RNA, 21 nt, Human
aggcaauuagacacuuuggaa

SEQ ID NO: 2743463 - RNA, 16 nt, Human
uggagaagaacugaaa

SEQ ID NO: 2743464 - RNA, 13 nt, Human
aggaaauauuuau

SEQ ID NO: 2743465 - RNA, 18 nt, Human
aggaaauauuuauuuuaa

SEQ ID NO: 2743466 - RNA, 14 nt, Human
aggaaauauuuauu

SEQ ID NO: 2743467 - RNA, 23 nt, Human
ugcugccaauauccuaauaaaaa

SEQ ID NO: 2743468 - RNA, 19 nt, Human
aggaauugacccacaagaa

SEQ ID NO: 2743469 - RNA, 22 nt, Human
ugcuaccucacugggguccugg

SEQ ID NO: 2743470 - RNA, 16 nt, Human
ugcuaccucacugggg

SEQ ID NO: 2743471 - RNA, 15 nt, Human
ugcuaccucacuggg

SEQ ID NO: 2743472 - RNA, 14 nt, Human
ugcuaccucacugg

SEQ ID NO: 2743473 - RNA, 21 nt, Human
agcuuauugucuagugaaacu

SEQ ID NO: 2743474 - RNA, 20 nt, Human
agcuuauuaaaacucauuuu

SEQ ID NO: 2743475 - RNA, 15 nt, Human
agcuuauuaaaacuc

SEQ ID NO: 2743476 - RNA, 19 nt, Human
aggaaagagaacuuccaga

SEQ ID NO: 2743477 - RNA, 13 nt, Human
aggaaagagaacu

SEQ ID NO: 2743478 - RNA, 14 nt, Human
ugcuaguaauugga

SEQ ID NO: 2743479 - RNA, 16 nt, Human
ugcuaguaauuggaaa

SEQ ID NO: 2743480 - RNA, 13 nt, Human
agcucucagccaa

SEQ ID NO: 2743481 - RNA, 12 nt, Human
agcucucagcca

SEQ ID NO: 2743482 - RNA, 17 nt, Human
agcugggcuaaguaaau

SEQ ID NO: 2743483 - RNA, 23 nt, Human
agcugccuccccuccucugcuug

SEQ ID NO: 2743484 - RNA, 22 nt, Human
agcugccuccccuccucugcuu

SEQ ID NO: 2743485 - RNA, 21 nt, Human
agcugccuccccuccucugcu

SEQ ID NO: 2743486 - RNA, 20 nt, Human
agcugccuccccuccucugc

SEQ ID NO: 2743487 - RNA, 19 nt, Human
agcugccuccccuccucug

SEQ ID NO: 2743488 - RNA, 18 nt, Human
agcugccuccccuccucu

SEQ ID NO: 2743489 - RNA, 17 nt, Human
agcugccuccccuccuc

SEQ ID NO: 2743490 - RNA, 13 nt, Human
agcuggaaaagua

SEQ ID NO: 2743491 - RNA, 14 nt, Human
ugcagugagccgag

SEQ ID NO: 2743492 - RNA, 22 nt, Human
ugcagcuguggcagaguuacag

SEQ ID NO: 2743493 - RNA, 20 nt, Human
ugcagcuguggcagaguuac

SEQ ID NO: 2743494 - RNA, 18 nt, Human
agccugagcgacagugag

SEQ ID NO: 2743495 - RNA, 14 nt, Human
ugcacucccaccug

SEQ ID NO: 2743496 - RNA, 15 nt, Human
ugcacucccaccuga

SEQ ID NO: 2743497 - RNA, 17 nt, Human
ugcacucccaccugaca

SEQ ID NO: 2743498 - RNA, 19 nt, Human
ugcacucccaccugacaca

SEQ ID NO: 2743499 - RNA, 20 nt, Human
ugcagagacaggaccugacu

SEQ ID NO: 2743500 - RNA, 17 nt, Human
ugcagagacaggaccug

SEQ ID NO: 2743501 - RNA, 17 nt, Human
agcccuucuuuccacag

SEQ ID NO: 2743502 - RNA, 21 nt, Human
agcccuuaugcgguuaauuuu

SEQ ID NO: 2743503 - RNA, 22 nt, Human
agcccuuaugcgguuaauuuug

SEQ ID NO: 2743504 - RNA, 19 nt, Human
agcccuucuuuccacagaa

SEQ ID NO: 2743505 - RNA, 18 nt, Human
agcccuucuuuccacaga

SEQ ID NO: 2743506 - RNA, 23 nt, Human
ugccaauauccuaauaaaaaggu

SEQ ID NO: 2743507 - RNA, 19 nt, Human
ugccaauauccuaauaaaa

SEQ ID NO: 2743508 - RNA, 21 nt, Human
ugccaauauccuaauaaaaag

SEQ ID NO: 2743509 - RNA, 15 nt, Human
ugccaauauccuaau

SEQ ID NO: 2743510 - RNA, 16 nt, Human
ugccaauauccuaaua

SEQ ID NO: 2743511 - RNA, 17 nt, Human
ugccaauauccuaauaa

SEQ ID NO: 2743512 - RNA, 18 nt, Human
ugccaauauccuaauaaa

SEQ ID NO: 2743513 - RNA, 14 nt, Human
ugccacuuaaugua

SEQ ID NO: 2743514 - RNA, 17 nt, Human
ugccacuuaauguaugu

SEQ ID NO: 2743515 - RNA, 18 nt, Human
ugccacuuaauguauguu

SEQ ID NO: 2743516 - RNA, 20 nt, Human
ugccacuuaauguauguuac

SEQ ID NO: 2743517 - RNA, 23 nt, Human
ugccacuuaauguauguuaccaa

SEQ ID NO: 2743518 - RNA, 19 nt, Human
agcuacuaauuuuaaaaug

SEQ ID NO: 2743519 - RNA, 23 nt, Human
ugcccuagagcacacuguagcau

SEQ ID NO: 2743520 - RNA, 17 nt, Human
ugcccuagagcacacug

SEQ ID NO: 2743521 - RNA, 13 nt, Human
ucugucagcugca

SEQ ID NO: 2743522 - RNA, 14 nt, Human
ucugucagcugcaa

SEQ ID NO: 2743523 - RNA, 18 nt, Human
ucuguuuuauaauuuugu

SEQ ID NO: 2743524 - RNA, 18 nt, Human
ucuuaauuaaaagaauau

SEQ ID NO: 2743525 - RNA, 21 nt, Human
ucuuaauuaaaagaauauuuu

SEQ ID NO: 2743526 - RNA, 14 nt, Human
ucuuaauuaaaaga

SEQ ID NO: 2743527 - RNA, 18 nt, Human
agacuggcacaguuuucu

SEQ ID NO: 2743528 - RNA, 21 nt, Human
agacuggauaguccgucucug

SEQ ID NO: 2743529 - RNA, 14 nt, Human
agacuggcacaguu

SEQ ID NO: 2743530 - RNA, 15 nt, Human
agacuggcacaguuu

SEQ ID NO: 2743531 - RNA, 20 nt, Human
agacuguggcugcuagcacu

SEQ ID NO: 2743532 - RNA, 14 nt, Human
agacuguggcugcu

SEQ ID NO: 2743533 - RNA, 11 nt, Human
agacuguggcu

SEQ ID NO: 2743534 - RNA, 17 nt, Human
agagacacacugaagaa

SEQ ID NO: 2743535 - RNA, 15 nt, Human
agagaaugagagaca

SEQ ID NO: 2743536 - RNA, 20 nt, Human
agagacacacugaagaagca

SEQ ID NO: 2743537 - RNA, 18 nt, Human
agagacacacugaagaag

SEQ ID NO: 2743538 - RNA, 17 nt, Human
ucuuuaaaauacacacu

SEQ ID NO: 2743539 - RNA, 21 nt, Human
ucuuuaaagggauggcaagau

SEQ ID NO: 2743540 - RNA, 18 nt, Human
agacccucaugcugccaa

SEQ ID NO: 2743541 - RNA, 19 nt, Human
agacccucaugcugccaau

SEQ ID NO: 2743542 - RNA, 24 nt, Human
agacccucaugcugccaauauccu

SEQ ID NO: 2743543 - RNA, 20 nt, Human
agacccucaugcugccaaua

SEQ ID NO: 2743544 - RNA, 21 nt, Human
agacccucaugcugccaauau

SEQ ID NO: 2743545 - RNA, 17 nt, Human
agacauguggugggaca

SEQ ID NO: 2743546 - RNA, 16 nt, Human
agacuccaaagaaaug

SEQ ID NO: 2743547 - RNA, 19 nt, Human
agacuccaaagaaauguaa

SEQ ID NO: 2743548 - RNA, 16 nt, Human
agacuauucaaacagu

SEQ ID NO: 2743549 - RNA, 13 nt, Human
agacuccaaagaa

SEQ ID NO: 2743550 - RNA, 14 nt, Human
agacuccaaagaaa

SEQ ID NO: 2743551 - RNA, 12 nt, Human
agacuccaaaga

SEQ ID NO: 2743552 - RNA, 18 nt, Human
agacuauucaaacagucu

SEQ ID NO: 2743553 - RNA, 20 nt, Human
agacuauucaaacagucuca

SEQ ID NO: 2743554 - RNA, 21 nt, Human
agacuauucaaacagucucag

SEQ ID NO: 2743555 - RNA, 19 nt, Human
agaaagacuauucaaacag

SEQ ID NO: 2743556 - RNA, 18 nt, Human
agaaagacuauucaaaca

SEQ ID NO: 2743557 - RNA, 20 nt, Human
agaaagacuauucaaacagu

SEQ ID NO: 2743558 - RNA, 23 nt, Human
agaaagacuauucaaacagucuc

SEQ ID NO: 2743559 - RNA, 21 nt, Human
ucugacuguuuccaucaaggg

SEQ ID NO: 2743560 - RNA, 14 nt, Human
ucugagaaagacua

SEQ ID NO: 2743561 - RNA, 15 nt, Human
ucugagaaagacuau

SEQ ID NO: 2743562 - RNA, 19 nt, Human
ucugagaaagacuauucaa

SEQ ID NO: 2743563 - RNA, 20 nt, Human
ucugagaaagacuauucaaa

SEQ ID NO: 2743564 - RNA, 23 nt, Human
ucugagaaagacuauucaaacag

SEQ ID NO: 2743565 - RNA, 21 nt, Human
ucugagaaagacuauucaaac

SEQ ID NO: 2743566 - RNA, 22 nt, Human
ucugagaaagacuauucaaaca

SEQ ID NO: 2743567 - RNA, 14 nt, Human
agaacucccuuuca

SEQ ID NO: 2743568 - RNA, 21 nt, Human
agaagaacugaaaucauacuu

SEQ ID NO: 2743569 - RNA, 14 nt, Human
ucugcuaccucacu

SEQ ID NO: 2743570 - RNA, 17 nt, Human
ucugcuaccucacuggg

SEQ ID NO: 2743571 - RNA, 11 nt, Human
ucugcuugcca

SEQ ID NO: 2743572 - RNA, 16 nt, Human
ucuggcccaccagggu

SEQ ID NO: 2743573 - RNA, 14 nt, Human
ucuggcccaccagg

SEQ ID NO: 2743574 - RNA, 12 nt, Human
ucugcuugccau

SEQ ID NO: 2743575 - RNA, 15 nt, Human
ucucccagucauuua

SEQ ID NO: 2743576 - RNA, 15 nt, Human
ucuccucucucugua

SEQ ID NO: 2743577 - RNA, 22 nt, Human
acuuuuuauggcacuaguauuu

SEQ ID NO: 2743578 - RNA, 22 nt, Human
acuuuugugaauuaggcuguaa

SEQ ID NO: 2743579 - RNA, 11 nt, Human
acuuuuucuga

SEQ ID NO: 2743580 - RNA, 12 nt, Human
acuuuuucugau

SEQ ID NO: 2743581 - RNA, 23 nt, Human
acuuuuuuucuguaccaguuaau

SEQ ID NO: 2743582 - RNA, 20 nt, Human
acuuuuuuucuguaccaguu

SEQ ID NO: 2743583 - RNA, 21 nt, Human
acuuuuuuucuguaccaguua

SEQ ID NO: 2743584 - RNA, 16 nt, Human
agaaaacaaggaugaa

SEQ ID NO: 2743585 - RNA, 19 nt, Human
agaaaacaaggaugaauua

SEQ ID NO: 2743586 - RNA, 15 nt, Human
agaaacauuugguaa

SEQ ID NO: 2743587 - RNA, 14 nt, Human
agaaagaaaaucag

SEQ ID NO: 2743588 - RNA, 15 nt, Human
agaaacuggaacucu

SEQ ID NO: 2743589 - RNA, 13 nt, Human
agaaacuggaacu

SEQ ID NO: 2743590 - RNA, 13 nt, Human
ucucuucuuuaaa

SEQ ID NO: 2743591 - RNA, 12 nt, Human
ucucuucuuuaa

SEQ ID NO: 2743592 - RNA, 13 nt, Human
ucucuggccuucg

SEQ ID NO: 2743593 - RNA, 17 nt, Human
ucucuggccuucggccu

SEQ ID NO: 2743594 - RNA, 16 nt, Human
ucucuggccuucggcc

SEQ ID NO: 2743595 - RNA, 16 nt, Human
agauuuaccacuugug

SEQ ID NO: 2743596 - RNA, 16 nt, Human
agauugugccccugca

SEQ ID NO: 2743597 - RNA, 15 nt, Human
ugacuguuuccauca

SEQ ID NO: 2743598 - RNA, 14 nt, Human
agauccuggaaauc

SEQ ID NO: 2743599 - RNA, 19 nt, Human
agaugaugaugaucuuuaa

SEQ ID NO: 2743600 - RNA, 18 nt, Human
agauggaaaauucauuuu

SEQ ID NO: 2743601 - RNA, 22 nt, Human
agauggaaaauucauuuuuuaa

SEQ ID NO: 2743602 - RNA, 22 nt, Human
agaugcuagaacucccuuucaa

SEQ ID NO: 2743603 - RNA, 23 nt, Human
agaugcuagaacucccuuucaac

SEQ ID NO: 2743604 - RNA, 20 nt, Human
ugaagaagcaccaaucauga

SEQ ID NO: 2743605 - RNA, 14 nt, Human
ugaagaagauggua

SEQ ID NO: 2743606 - RNA, 17 nt, Human
ugaagauguagaggaga

SEQ ID NO: 2743607 - RNA, 18 nt, Human
ugaagauguagaggagaa

SEQ ID NO: 2743608 - RNA, 14 nt, Human
agagugaacaaauu

SEQ ID NO: 2743609 - RNA, 22 nt, Human
agagugaacaaauuuacagaga

SEQ ID NO: 2743610 - RNA, 16 nt, Human
ugagcuacaaaugcau

SEQ ID NO: 2743611 - RNA, 13 nt, Human
ugagcuacaaaug

SEQ ID NO: 2743612 - RNA, 14 nt, Human
ugagcuacaaaugc

SEQ ID NO: 2743613 - RNA, 15 nt, Human
ugaggacacugauau

SEQ ID NO: 2743614 - RNA, 17 nt, Human
ugagguacugagaguga

SEQ ID NO: 2743615 - RNA, 22 nt, Human
ugagguacugagagugaacaaa

SEQ ID NO: 2743616 - RNA, 20 nt, Human
ugagcgacagugagacucug

SEQ ID NO: 2743617 - RNA, 16 nt, Human
ugagcgacagugagac

SEQ ID NO: 2743618 - RNA, 14 nt, Human
ugagcgacagugag

SEQ ID NO: 2743619 - RNA, 13 nt, Human
ugagcgacaguga

SEQ ID NO: 2743620 - RNA, 23 nt, Human
agcacuuggagccaaggguucag

SEQ ID NO: 2743621 - RNA, 14 nt, Human
agcagaacagugau

SEQ ID NO: 2743622 - RNA, 14 nt, Human
agcaacgcaggccc

SEQ ID NO: 2743623 - RNA, 12 nt, Human
agcacagcccuu

SEQ ID NO: 2743624 - RNA, 22 nt, Human
agcacagccucuuagaugcagu

SEQ ID NO: 2743625 - RNA, 16 nt, Human
agcaccaaucaugaau

SEQ ID NO: 2743626 - RNA, 22 nt, Human
accaggagucccugguaauaag

SEQ ID NO: 2743627 - RNA, 17 nt, Human
accaggagucccuggua

SEQ ID NO: 2743628 - RNA, 23 nt, Human
accacuuguguuuugcaagccag

SEQ ID NO: 2743629 - RNA, 19 nt, Human
accacuuguguuuugcaag

SEQ ID NO: 2743630 - RNA, 13 nt, Human
accacugcagaag

SEQ ID NO: 2743631 - RNA, 19 nt, Human
accacugcagaagacagua

SEQ ID NO: 2743632 - RNA, 14 nt, Human
accacugcagaaga

SEQ ID NO: 2743633 - RNA, 11 nt, Human
accacagcagu

SEQ ID NO: 2743634 - RNA, 12 nt, Human
uauuucauuucu

SEQ ID NO: 2743635 - RNA, 16 nt, Human
accaguucucaugggu

SEQ ID NO: 2743636 - RNA, 14 nt, Human
accaguuaauuuuu

SEQ ID NO: 2743637 - RNA, 16 nt, Human
accaguuaauuuuucc

SEQ ID NO: 2743638 - RNA, 12 nt, Human
accaguuaauuu

SEQ ID NO: 2743639 - RNA, 13 nt, Human
accaguuaauuuu

SEQ ID NO: 2743640 - RNA, 21 nt, Human
accaguucucauggguggcac

SEQ ID NO: 2743641 - RNA, 22 nt, Human
ucaccuggacuuaagcaucugg

SEQ ID NO: 2743642 - RNA, 18 nt, Human
acccaaaaggcagaagca

SEQ ID NO: 2743643 - RNA, 21 nt, Human
acccaaauguucaucaaugaa

SEQ ID NO: 2743644 - RNA, 15 nt, Human
acccaaaaggcagaa

SEQ ID NO: 2743645 - RNA, 13 nt, Human
acccaaaaggcag

SEQ ID NO: 2743646 - RNA, 19 nt, Human
accccauggagcugggcua

SEQ ID NO: 2743647 - RNA, 18 nt, Human
ucagaugcacaugagcug

SEQ ID NO: 2743648 - RNA, 18 nt, Human
accguuggggauugggga

SEQ ID NO: 2743649 - RNA, 21 nt, Human
accuaagauuacaaaucagaa

SEQ ID NO: 2743650 - RNA, 23 nt, Human
accucacugggguccuggggccu

SEQ ID NO: 2743651 - RNA, 21 nt, Human
accucacugggguccuggggc

SEQ ID NO: 2743652 - RNA, 21 nt, Human
ucauugacuaucaaacugaag

SEQ ID NO: 2743653 - RNA, 20 nt, Human
ucauugacuaucaaacugaa

SEQ ID NO: 2743654 - RNA, 15 nt, Human
ucauguuaguuaccu

SEQ ID NO: 2743655 - RNA, 19 nt, Human
ucauguuaguuaccuuaua

SEQ ID NO: 2743656 - RNA, 23 nt, Human
ucauguuaguuaccuuauaguua

SEQ ID NO: 2743657 - RNA, 21 nt, Human
ucaugaauuaguuuuauaugc

SEQ ID NO: 2743658 - RNA, 22 nt, Human
ucaugaauuaguuuuauaugcu

SEQ ID NO: 2743659 - RNA, 20 nt, Human
uccaacuacuaauagaauaa

SEQ ID NO: 2743660 - RNA, 21 nt, Human
uccaacuacuaauagaauaaa

SEQ ID NO: 2743661 - RNA, 23 nt, Human
uccaacuacuaauagaauaaagg

SEQ ID NO: 2743662 - RNA, 22 nt, Human
accuuauaguuacuguguaauu

SEQ ID NO: 2743663 - RNA, 23 nt, Human
accuuauaguuacuguguaauua

SEQ ID NO: 2743664 - RNA, 12 nt, Human
accuuauaguua

SEQ ID NO: 2743665 - RNA, 14 nt, Human
accuuauaguuacu

SEQ ID NO: 2743666 - RNA, 18 nt, Human
accuuauaguuacugugu

SEQ ID NO: 2743667 - RNA, 19 nt, Human
accuuauaguuacugugua

SEQ ID NO: 2743668 - RNA, 20 nt, Human
accuuauaguuacuguguaa

SEQ ID NO: 2743669 - RNA, 21 nt, Human
uccagccugagcgacagugag

SEQ ID NO: 2743670 - RNA, 20 nt, Human
uccagccugagcgacaguga

SEQ ID NO: 2743671 - RNA, 22 nt, Human
acugaggggaggggagcauggg

SEQ ID NO: 2743672 - RNA, 17 nt, Human
acugaggggaggggagc

SEQ ID NO: 2743673 - RNA, 23 nt, Human
acugaggcagacagcagcucagg

SEQ ID NO: 2743674 - RNA, 22 nt, Human
acugaggcagacagcagcucag

SEQ ID NO: 2743675 - RNA, 19 nt, Human
acugaggcagacagcagcu

SEQ ID NO: 2743676 - RNA, 15 nt, Human
acugaggcagacagc

SEQ ID NO: 2743677 - RNA, 13 nt, Human
acugaggcagaca

SEQ ID NO: 2743678 - RNA, 17 nt, Human
uccugggcagcugccuc

SEQ ID NO: 2743679 - RNA, 16 nt, Human
uccugggcagcugccu

SEQ ID NO: 2743680 - RNA, 15 nt, Human
uccugggcagcugcc

SEQ ID NO: 2743681 - RNA, 14 nt, Human
uccugggcagcugc

SEQ ID NO: 2743682 - RNA, 23 nt, Human
uccugggcagcugccuccccucc

SEQ ID NO: 2743683 - RNA, 22 nt, Human
uccugggcagcugccuccccuc

SEQ ID NO: 2743684 - RNA, 19 nt, Human
uccugggcagcugccuccc

SEQ ID NO: 2743685 - RNA, 18 nt, Human
uccugggcagcugccucc

SEQ ID NO: 2743686 - RNA, 22 nt, Human
uccuggggccucggagccucau

SEQ ID NO: 2743687 - RNA, 21 nt, Human
uccuggggccucggagccuca

SEQ ID NO: 2743688 - RNA, 13 nt, Human
uccuggggccucg

SEQ ID NO: 2743689 - RNA, 22 nt, Human
uccugucugccagccagcagcc

SEQ ID NO: 2743690 - RNA, 22 nt, Human
acugccuucucaacuccaaacu

SEQ ID NO: 2743691 - RNA, 20 nt, Human
acugccuucucaacuccaaa

SEQ ID NO: 2743692 - RNA, 21 nt, Human
acuggcacaguuuucugagaa

SEQ ID NO: 2743693 - RNA, 22 nt, Human
acuggcacaguuuucugagaaa

SEQ ID NO: 2743694 - RNA, 18 nt, Human
acuggccuuuuucauuua

SEQ ID NO: 2743695 - RNA, 13 nt, Human
uccuucagccuga

SEQ ID NO: 2743696 - RNA, 20 nt, Human
acuaaagcaguggacaccag

SEQ ID NO: 2743697 - RNA, 13 nt, Human
acuaaaaauacaa

SEQ ID NO: 2743698 - RNA, 16 nt, Human
uccccuugcccagggc

SEQ ID NO: 2743699 - RNA, 15 nt, Human
uccccuugcccaggg

SEQ ID NO: 2743700 - RNA, 13 nt, Human
uccccuugcccag

SEQ ID NO: 2743701 - RNA, 12 nt, Human
uccccuccucug

SEQ ID NO: 2743702 - RNA, 14 nt, Human
uccucacuguaucc

SEQ ID NO: 2743703 - RNA, 20 nt, Human
uccucaaaacuucagacaua

SEQ ID NO: 2743704 - RNA, 15 nt, Human
uccucaaagaaagug

SEQ ID NO: 2743705 - RNA, 16 nt, Human
uccucaaagaaagugu

SEQ ID NO: 2743706 - RNA, 18 nt, Human
uccucaaagaaaguguau

SEQ ID NO: 2743707 - RNA, 19 nt, Human
uccucaaagaaaguguauu

SEQ ID NO: 2743708 - RNA, 17 nt, Human
acaccaggagucccugg

SEQ ID NO: 2743709 - RNA, 19 nt, Human
acaccaggagucccuggua

SEQ ID NO: 2743710 - RNA, 22 nt, Human
uauaaaauaauuuuuauauuug

SEQ ID NO: 2743711 - RNA, 21 nt, Human
uauaaaauaauuuuuauauuu

SEQ ID NO: 2743712 - RNA, 22 nt, Human
acacaucagcuugcccuguuaa

SEQ ID NO: 2743713 - RNA, 22 nt, Human
uagugagcagucaggaaagaga

SEQ ID NO: 2743714 - RNA, 17 nt, Human
uaguuacuguguaauua

SEQ ID NO: 2743715 - RNA, 18 nt, Human
uaguuacuguguaauuag

SEQ ID NO: 2743716 - RNA, 19 nt, Human
uaguuacuguguaauuagu

SEQ ID NO: 2743717 - RNA, 16 nt, Human
uaguuuuauaugcuuc

SEQ ID NO: 2743718 - RNA, 15 nt, Human
uaguuuuauaugcuu

SEQ ID NO: 2743719 - RNA, 14 nt, Human
uauaauuuugugaa

SEQ ID NO: 2743720 - RNA, 18 nt, Human
uauaacaaugcuguauuu

SEQ ID NO: 2743721 - RNA, 21 nt, Human
uauaggugcuacaaaaacaca

SEQ ID NO: 2743722 - RNA, 20 nt, Human
uauaggugcuacaaaaacac

SEQ ID NO: 2743723 - RNA, 23 nt, Human
uauaggugcuacaaaaacacagc

SEQ ID NO: 2743724 - RNA, 13 nt, Human
uauaggaauugac

SEQ ID NO: 2743725 - RNA, 14 nt, Human
uauaggaauugacc

SEQ ID NO: 2743726 - RNA, 17 nt, Human
acagcagcucaggcaca

SEQ ID NO: 2743727 - RNA, 16 nt, Human
acagcagcucaggcac

SEQ ID NO: 2743728 - RNA, 15 nt, Human
acagcagcucaggca

SEQ ID NO: 2743729 - RNA, 14 nt, Human
acagcagcucaggc

SEQ ID NO: 2743730 - RNA, 16 nt, Human
uauggcuauaggugcu

SEQ ID NO: 2743731 - RNA, 17 nt, Human
uauggcuauaggugcua

SEQ ID NO: 2743732 - RNA, 14 nt, Human
uauauuuacaaaug

SEQ ID NO: 2743733 - RNA, 15 nt, Human
uauauuuacaaaugg

SEQ ID NO: 2743734 - RNA, 21 nt, Human
acaguauggcagcuuuccuca

SEQ ID NO: 2743735 - RNA, 21 nt, Human
acaguuaccucugccucagaa

SEQ ID NO: 2743736 - RNA, 18 nt, Human
acagugagacucugucuc

SEQ ID NO: 2743737 - RNA, 14 nt, Human
acagugagacucug

SEQ ID NO: 2743738 - RNA, 17 nt, Human
acagucucaggaaauca

SEQ ID NO: 2743739 - RNA, 20 nt, Human
acagugaaagaaaauaacaa

SEQ ID NO: 2743740 - RNA, 13 nt, Human
acagucucaggaa

SEQ ID NO: 2743741 - RNA, 14 nt, Human
acagucucaggaaa

SEQ ID NO: 2743742 - RNA, 15 nt, Human
acagucucaggaaau

SEQ ID NO: 2743743 - RNA, 16 nt, Human
acagucucaggaaauc

SEQ ID NO: 2743744 - RNA, 12 nt, Human
uauuaaaacuca

SEQ ID NO: 2743745 - RNA, 15 nt, Human
uauuagaauaccaca

SEQ ID NO: 2743746 - RNA, 15 nt, Human
uauuaccccuuuucg

SEQ ID NO: 2743747 - RNA, 23 nt, Human
uauucauagcagcuuauucacaa

SEQ ID NO: 2743748 - RNA, 20 nt, Human
uauugguuuaaagaaagugu

SEQ ID NO: 2743749 - RNA, 12 nt, Human
acaguucugugg

SEQ ID NO: 2743750 - RNA, 22 nt, Human
acaguucugugguuucauguua

SEQ ID NO: 2743751 - RNA, 19 nt, Human
acaguucggugagcuacaa

SEQ ID NO: 2743752 - RNA, 22 nt, Human
acaguucggugagcuacaaaug

SEQ ID NO: 2743753 - RNA, 23 nt, Human
acaguucggugagcuacaaaugc

SEQ ID NO: 2743754 - RNA, 17 nt, Human
uauugucuagugaaacu

SEQ ID NO: 2743755 - RNA, 18 nt, Human
uauuuauuuuaauaaugu

SEQ ID NO: 2743756 - RNA, 16 nt, Human
uauuuauuuuaauaau

SEQ ID NO: 2743757 - RNA, 14 nt, Human
uauuuauuuuaaua

SEQ ID NO: 2743758 - RNA, 16 nt, Human
uagaugcaguucugaa

SEQ ID NO: 2743759 - RNA, 19 nt, Human
uagaugcaguucugaagaa

SEQ ID NO: 2743760 - RNA, 17 nt, Human
uagaugcaguucugaag

SEQ ID NO: 2743761 - RNA, 21 nt, Human
uagcaugucgucaaagcugaa

SEQ ID NO: 2743762 - RNA, 18 nt, Human
uagcaugucgucaaagcu

SEQ ID NO: 2743763 - RNA, 18 nt, Human
acaagcacuaaacaaaga

SEQ ID NO: 2743764 - RNA, 22 nt, Human
acaagaaaugaaagcagggacu

SEQ ID NO: 2743765 - RNA, 15 nt, Human
uagaacucccuuuca

SEQ ID NO: 2743766 - RNA, 21 nt, Human
uacuucaaauccuugaagauu

SEQ ID NO: 2743767 - RNA, 18 nt, Human
uagaacucccuuucaaca

SEQ ID NO: 2743768 - RNA, 19 nt, Human
aauuuuuauauuugaaaua

SEQ ID NO: 2743769 - RNA, 16 nt, Human
acaaaaacacagcaag

SEQ ID NO: 2743770 - RNA, 19 nt, Human
aauuuuuucucuaggaaau

SEQ ID NO: 2743771 - RNA, 20 nt, Human
aauuuuuccaacuacuaaua

SEQ ID NO: 2743772 - RNA, 14 nt, Human
aauuuuuccaacua

SEQ ID NO: 2743773 - RNA, 19 nt, Human
uacuucaaauccuugaaga

SEQ ID NO: 2743774 - RNA, 14 nt, Human
uacuucaaauccuu

SEQ ID NO: 2743775 - RNA, 18 nt, Human
aauuuaccuaagauuaca

SEQ ID NO: 2743776 - RNA, 21 nt, Human
aauuuaccuaagauuacaaau

SEQ ID NO: 2743777 - RNA, 13 nt, Human
aauuuaccuaaga

SEQ ID NO: 2743778 - RNA, 14 nt, Human
aauuuaccuaagau

SEQ ID NO: 2743779 - RNA, 16 nt, Human
aauuuaccuaagauua

SEQ ID NO: 2743780 - RNA, 17 nt, Human
aauuuaccuaagauuac

SEQ ID NO: 2743781 - RNA, 20 nt, Human
aauuucucccagucauuuaa

SEQ ID NO: 2743782 - RNA, 23 nt, Human
aauugugugaaagguacuucaaa

SEQ ID NO: 2743783 - RNA, 21 nt, Human
aauucuugccaaauauaaaua

SEQ ID NO: 2743784 - RNA, 19 nt, Human
aauugacccacaagaaaug

SEQ ID NO: 2743785 - RNA, 16 nt, Human
aauugacccacaagaa

SEQ ID NO: 2743786 - RNA, 13 nt, Human
aauugacccacaa

SEQ ID NO: 2743787 - RNA, 22 nt, Human
uaccccagacuagauguaguau

SEQ ID NO: 2743788 - RNA, 21 nt, Human
uaccccagacuagauguagua

SEQ ID NO: 2743789 - RNA, 20 nt, Human
uaccccauggagcugggcua

SEQ ID NO: 2743790 - RNA, 18 nt, Human
aauguugacaugggacau

SEQ ID NO: 2743791 - RNA, 16 nt, Human
aaugguuuaaaugguc

SEQ ID NO: 2743792 - RNA, 22 nt, Human
uaauucacagugcucuuuucuc

SEQ ID NO: 2743793 - RNA, 14 nt, Human
uaauucacagugcu

SEQ ID NO: 2743794 - RNA, 21 nt, Human
uaauucacagugcucuuuucu

SEQ ID NO: 2743795 - RNA, 21 nt, Human
uaauuuaccuaagauuacaaa

SEQ ID NO: 2743796 - RNA, 22 nt, Human
uaauuuaccuaagauuacaaau

SEQ ID NO: 2743797 - RNA, 16 nt, Human
uacaaaaacacagcaa

SEQ ID NO: 2743798 - RNA, 17 nt, Human
uacaaaaacacagcaag

SEQ ID NO: 2743799 - RNA, 18 nt, Human
uacaaaaacacagcaagg

SEQ ID NO: 2743800 - RNA, 20 nt, Human
uaauagaauaaaggcaguuu

SEQ ID NO: 2743801 - RNA, 22 nt, Human
uaauagaauaaaggcaguuuuc

SEQ ID NO: 2743802 - RNA, 14 nt, Human
uaauagaauaaagg

SEQ ID NO: 2743803 - RNA, 16 nt, Human
uaauagaauaaaggca

SEQ ID NO: 2743804 - RNA, 15 nt, Human
aaugaaugaaugaau

SEQ ID NO: 2743805 - RNA, 20 nt, Human
aacuaucucauuuccaagca

SEQ ID NO: 2743806 - RNA, 13 nt, Human
aacuauauuguuu

SEQ ID NO: 2743807 - RNA, 14 nt, Human
gugagucaccacuu

SEQ ID NO: 2743808 - RNA, 20 nt, Human
aacugaaaucauacuucuua

SEQ ID NO: 2743809 - RNA, 13 nt, Human
aacugaaaucaua

SEQ ID NO: 2743810 - RNA, 17 nt, Human
aacuacuuuauaacuaa

SEQ ID NO: 2743811 - RNA, 13 nt, Human
aacuacuuuauaa

SEQ ID NO: 2743812 - RNA, 15 nt, Human
aacuacuuuauaacu

SEQ ID NO: 2743813 - RNA, 11 nt, Human
aacuaacaugu

SEQ ID NO: 2743814 - RNA, 14 nt, Human
aacuaacauguccu

SEQ ID NO: 2743815 - RNA, 15 nt, Human
aacuaacauguccug

SEQ ID NO: 2743816 - RNA, 13 nt, Human
gucuucacaacag

SEQ ID NO: 2743817 - RNA, 12 nt, Human
gucuucagccua

SEQ ID NO: 2743818 - RNA, 15 nt, Human
gucuucagccuagcc

SEQ ID NO: 2743819 - RNA, 13 nt, Human
gucuucagccuag

SEQ ID NO: 2743820 - RNA, 23 nt, Human
gucuucagccuagccgaccucag

SEQ ID NO: 2743821 - RNA, 23 nt, Human
gucucaguccaugaagauguaga

SEQ ID NO: 2743822 - RNA, 16 nt, Human
aacauauauaacaaug

SEQ ID NO: 2743823 - RNA, 19 nt, Human
aacagauuauuaccuuaca

SEQ ID NO: 2743824 - RNA, 17 nt, Human
aacagucucaggaaauc

SEQ ID NO: 2743825 - RNA, 19 nt, Human
aacagucucaggaaaucaa

SEQ ID NO: 2743826 - RNA, 14 nt, Human
guggguagacacac

SEQ ID NO: 2743827 - RNA, 18 nt, Human
aagagcuguucacagcca

SEQ ID NO: 2743828 - RNA, 16 nt, Human
aagacuccaaagaaau

SEQ ID NO: 2743829 - RNA, 17 nt, Human
aagacuccaaagaaaug

SEQ ID NO: 2743830 - RNA, 14 nt, Human
aagacuccaaagaa

SEQ ID NO: 2743831 - RNA, 14 nt, Human
aagacuauucaaac

SEQ ID NO: 2743832 - RNA, 13 nt, Human
aagacuauucaaa

SEQ ID NO: 2743833 - RNA, 14 nt, Human
guguguuauuuaaa

SEQ ID NO: 2743834 - RNA, 16 nt, Human
aagcaaguauuagaau

SEQ ID NO: 2743835 - RNA, 19 nt, Human
aagcaaaauuuuuucucua

SEQ ID NO: 2743836 - RNA, 22 nt, Human
aagauguagaggagaaacugga

SEQ ID NO: 2743837 - RNA, 13 nt, Human
aagcaaaauguga

SEQ ID NO: 2743838 - RNA, 19 nt, Human
aagauguagaggagaaacu

SEQ ID NO: 2743839 - RNA, 22 nt, Human
aagaagcaccaaucaugaauua

SEQ ID NO: 2743840 - RNA, 13 nt, Human
aagaaaauaucac

SEQ ID NO: 2743841 - RNA, 18 nt, Human
aagaaaguguauuuggaa

SEQ ID NO: 2743842 - RNA, 12 nt, Human
aagaaaguguau

SEQ ID NO: 2743843 - RNA, 15 nt, Human
aagaaaguguauuug

SEQ ID NO: 2743844 - RNA, 15 nt, Human
guggacaccaggagu

SEQ ID NO: 2743845 - RNA, 22 nt, Human
guggacaccaggagucccuggu

SEQ ID NO: 2743846 - RNA, 21 nt, Human
guggacaccaggagucccugg

SEQ ID NO: 2743847 - RNA, 15 nt, Human
guggcagaguuacag

SEQ ID NO: 2743848 - RNA, 13 nt, Human
aagacccaaaagg

SEQ ID NO: 2743849 - RNA, 13 nt, Human
aagaauauuuuaa

SEQ ID NO: 2743850 - RNA, 11 nt, Human
guuuggccaga

SEQ ID NO: 2743851 - RNA, 23 nt, Human
guuuggccagaagucaaggcuua

SEQ ID NO: 2743852 - RNA, 12 nt, Human
guuuggccagaa

SEQ ID NO: 2743853 - RNA, 18 nt, Human
guuuggccagaagucaag

SEQ ID NO: 2743854 - RNA, 15 nt, Human
guuuucugagaaaga

SEQ ID NO: 2743855 - RNA, 22 nt, Human
guuuuauaauuuugugaagcaa

SEQ ID NO: 2743856 - RNA, 15 nt, Human
guuuuauaauuuugu

SEQ ID NO: 2743857 - RNA, 17 nt, Human
aaguaaaaccacagcag

SEQ ID NO: 2743858 - RNA, 18 nt, Human
aaguaaaaccacagcagu

SEQ ID NO: 2743859 - RNA, 21 nt, Human
guuucuagcaugaagacagag

SEQ ID NO: 2743860 - RNA, 14 nt, Human
aaguaaaaccacag

SEQ ID NO: 2743861 - RNA, 15 nt, Human
aaguaaaaccacagc

SEQ ID NO: 2743862 - RNA, 16 nt, Human
aaguaaaaccacagca

SEQ ID NO: 2743863 - RNA, 21 nt, Human
aagggugaugggaaagcauug

SEQ ID NO: 2743864 - RNA, 13 nt, Human
aagucaaggcuua

SEQ ID NO: 2743865 - RNA, 22 nt, Human
aagucaaggcuuagacccucau

SEQ ID NO: 2743866 - RNA, 16 nt, Human
guuuucugagaaagac

SEQ ID NO: 2743867 - RNA, 17 nt, Human
guuuucugagaaagacu

SEQ ID NO: 2743868 - RNA, 22 nt, Human
guuuucugagaaagacuauuca

SEQ ID NO: 2743869 - RNA, 21 nt, Human
aaguauguuagugcaaauugu

SEQ ID NO: 2743870 - RNA, 23 nt, Human
aaguauguuagugcaaauuguca

SEQ ID NO: 2743871 - RNA, 13 nt, Human
aagucaucuugcu

SEQ ID NO: 2743872 - RNA, 14 nt, Human
aagucaucuugcua

SEQ ID NO: 2743873 - RNA, 20 nt, Human
aagucaucuugcuaccagua

SEQ ID NO: 2743874 - RNA, 23 nt, Human
aagucaucuugcuaccaguauuu

SEQ ID NO: 2743875 - RNA, 23 nt, Human
guuuuuuuuuaaaaaagaaacau

SEQ ID NO: 2743876 - RNA, 13 nt, Human
aaggauaaugaau

SEQ ID NO: 2743877 - RNA, 21 nt, Human
guucugugguuucauguuagu

SEQ ID NO: 2743878 - RNA, 16 nt, Human
guucugugguuucaug

SEQ ID NO: 2743879 - RNA, 19 nt, Human
guucugugguuucauguua

SEQ ID NO: 2743880 - RNA, 19 nt, Human
guucucauggguggcacuc

SEQ ID NO: 2743881 - RNA, 16 nt, Human
aaggaaaaaauaacaa

SEQ ID NO: 2743882 - RNA, 19 nt, Human
aaggaaaaaauaacaauga

SEQ ID NO: 2743883 - RNA, 24 nt, Human
uaaagaaaguguauuuggaaauaa

SEQ ID NO: 2743884 - RNA, 20 nt, Human
uaaagaaaguguauuuggaa

SEQ ID NO: 2743885 - RNA, 23 nt, Human
uaaagaaaguguauuuggaaaua

SEQ ID NO: 2743886 - RNA, 12 nt, Human
uaaacucauuuc

SEQ ID NO: 2743887 - RNA, 17 nt, Human
uaaacucauuucuagca

SEQ ID NO: 2743888 - RNA, 11 nt, Human
uaaagaaagug

SEQ ID NO: 2743889 - RNA, 13 nt, Human
uaaagaaagugua

SEQ ID NO: 2743890 - RNA, 14 nt, Human
uaaagaaaguguau

SEQ ID NO: 2743891 - RNA, 15 nt, Human
uaaagaaaguguauu

SEQ ID NO: 2743892 - RNA, 16 nt, Human
uaaagaaaguguauuu

SEQ ID NO: 2743893 - RNA, 17 nt, Human
uaaagaaaguguauuug

SEQ ID NO: 2743894 - RNA, 19 nt, Human
uaaaccaaggcuagaacca

SEQ ID NO: 2743895 - RNA, 15 nt, Human
aauaaauauaucuac

SEQ ID NO: 2743896 - RNA, 23 nt, Human
aauaaauauaucuaccccagacu

SEQ ID NO: 2743897 - RNA, 12 nt, Human
aauaaaugugcc

SEQ ID NO: 2743898 - RNA, 21 nt, Human
aauaaaugugccuucauuuuu

SEQ ID NO: 2743899 - RNA, 15 nt, Human
aauaacaauaaaaga

SEQ ID NO: 2743900 - RNA, 15 nt, Human
aauaacgauaaaaga

SEQ ID NO: 2743901 - RNA, 15 nt, Human
uaaagucagauggaa

SEQ ID NO: 2743902 - RNA, 13 nt, Human
uaaagucagaugg

SEQ ID NO: 2743903 - RNA, 17 nt, Human
uaaagucagauggaaaa

SEQ ID NO: 2743904 - RNA, 15 nt, Human
aauaaaggcaguuuu

SEQ ID NO: 2743905 - RNA, 19 nt, Human
aauaaaggcaguuuucuaa

SEQ ID NO: 2743906 - RNA, 16 nt, Human
aauaaaggcaguuuuc

SEQ ID NO: 2743907 - RNA, 18 nt, Human
aauaaaggcaguuuucua

SEQ ID NO: 2743908 - RNA, 22 nt, Human
aauaaaauccauacauuugugu

SEQ ID NO: 2743909 - RNA, 12 nt, Human
aauaaaaauaau

SEQ ID NO: 2743910 - RNA, 15 nt, Human
uaaauguugacaugg

SEQ ID NO: 2743911 - RNA, 17 nt, Human
uaaaugauuucauucaa

SEQ ID NO: 2743912 - RNA, 13 nt, Human
uaacaaugcugua

SEQ ID NO: 2743913 - RNA, 17 nt, Human
uaacaaugcuguauuuu

SEQ ID NO: 2743914 - RNA, 15 nt, Human
uaacaaugcuguauu

SEQ ID NO: 2743915 - RNA, 14 nt, Human
aauacacacucaaa

SEQ ID NO: 2743916 - RNA, 12 nt, Human
aaaaacacagca

SEQ ID NO: 2743917 - RNA, 18 nt, Human
aaaaacacagcaagggug

SEQ ID NO: 2743918 - RNA, 13 nt, Human
aaaaacacagcaa

SEQ ID NO: 2743919 - RNA, 15 nt, Human
auccucaaagaaagu

SEQ ID NO: 2743920 - RNA, 16 nt, Human
auccucaaagaaagug

SEQ ID NO: 2743921 - RNA, 18 nt, Human
auccucaaagaaagugua

SEQ ID NO: 2743922 - RNA, 19 nt, Human
auccucaaagaaaguguau

SEQ ID NO: 2743923 - RNA, 20 nt, Human
auccucaaagaaaguguauu

SEQ ID NO: 2743924 - RNA, 21 nt, Human
auccucaaagaaaguguauug

SEQ ID NO: 2743925 - RNA, 21 nt, Human
aucagcugcugaaacaacaaa

SEQ ID NO: 2743926 - RNA, 15 nt, Human
auauuuauuuuaaua

SEQ ID NO: 2743927 - RNA, 14 nt, Human
auauuuauuuuaau

SEQ ID NO: 2743928 - RNA, 17 nt, Human
auauuuauuuuaauaau

SEQ ID NO: 2743929 - RNA, 22 nt, Human
aucagcugcugaaacaacaaau

SEQ ID NO: 2743930 - RNA, 23 nt, Human
aucagcugcugaaacaacaaaua

SEQ ID NO: 2743931 - RNA, 20 nt, Human
augcugccaauauccuaaua

SEQ ID NO: 2743932 - RNA, 21 nt, Human
augcugccaauauccuaauaa

SEQ ID NO: 2743933 - RNA, 22 nt, Human
augcugccaauauccuaauaaa

SEQ ID NO: 2743934 - RNA, 23 nt, Human
augcugccaauauccuaauaaaa

SEQ ID NO: 2743935 - RNA, 13 nt, Human
augcugccaauau

SEQ ID NO: 2743936 - RNA, 14 nt, Human
augcugccaauauc

SEQ ID NO: 2743937 - RNA, 17 nt, Human
augcugccaauauccua

SEQ ID NO: 2743938 - RNA, 18 nt, Human
augcugccaauauccuaa

SEQ ID NO: 2743939 - RNA, 19 nt, Human
augcugccaauauccuaau

SEQ ID NO: 2743940 - RNA, 20 nt, Human
auuaaauauguuagcaaaga

SEQ ID NO: 2743941 - RNA, 22 nt, Human
auuaaauauguuagcaaagagu

SEQ ID NO: 2743942 - RNA, 18 nt, Human
augugggcagugauguca

SEQ ID NO: 2743943 - RNA, 17 nt, Human
auguucuaagaagugaa

SEQ ID NO: 2743944 - RNA, 14 nt, Human
auguaagggaaacu

SEQ ID NO: 2743945 - RNA, 16 nt, Human
auguaagggaaacugc

SEQ ID NO: 2743946 - RNA, 19 nt, Human
auguaagggaaacugccag

SEQ ID NO: 2743947 - RNA, 12 nt, Human
aguccuguaaug

SEQ ID NO: 2743948 - RNA, 19 nt, Human
agucaaauugugugaaagg

SEQ ID NO: 2743949 - RNA, 23 nt, Human
agucaaauugugugaaagguacu

SEQ ID NO: 2743950 - RNA, 13 nt, Human
aguucaugcagcu

SEQ ID NO: 2743951 - RNA, 22 nt, Human
aguucaugcagcuguggcagag

SEQ ID NO: 2743952 - RNA, 22 nt, Human
aguugaaaaucuuauaauuuaa

SEQ ID NO: 2743953 - RNA, 21 nt, Human
aguugaaaagacuccaaagaa

SEQ ID NO: 2743954 - RNA, 15 nt, Human
aguuguuucauugac

SEQ ID NO: 2743955 - RNA, 13 nt, Human
aguuguuucauug

SEQ ID NO: 2743956 - RNA, 19 nt, Human
aguuguuucauugacuauc

SEQ ID NO: 2743957 - RNA, 16 nt, Human
aguuguuucauugacu

SEQ ID NO: 2743958 - RNA, 22 nt, Human
aguugaaaagacuccaaagaaa

SEQ ID NO: 2743959 - RNA, 23 nt, Human
aguugaaaaucuuauaauuuaaa

SEQ ID NO: 2743960 - RNA, 17 nt, Human
agugucuuaauuaaaag

SEQ ID NO: 2743961 - RNA, 18 nt, Human
agugucuuaauuaaaaga

SEQ ID NO: 2743962 - RNA, 19 nt, Human
aguguaugauuacuggccu

SEQ ID NO: 2743963 - RNA, 14 nt, Human
aguguaugauuacu

SEQ ID NO: 2743964 - RNA, 15 nt, Human
aguguaugauuacug

SEQ ID NO: 2743965 - RNA, 14 nt, Human
aguguauuuggaaa

SEQ ID NO: 2743966 - RNA, 23 nt, Human
aguguauuuggaaauaaagucag

SEQ ID NO: 2743967 - RNA, 15 nt, Human
agugucuuaauuaaa

SEQ ID NO: 2743968 - RNA, 23 nt, Human
auaauguuucaaacauauauaac

SEQ ID NO: 2743969 - RNA, 15 nt, Human
auaaugucccuucac

SEQ ID NO: 2743970 - RNA, 17 nt, Human
auacacacucaaaucaa

SEQ ID NO: 2743971 - RNA, 18 nt, Human
auacacacucaaaucaag

SEQ ID NO: 2743972 - RNA, 18 nt, Human
auaaaggauuaaugucaa

SEQ ID NO: 2743973 - RNA, 18 nt, Human
auaaaggcaguuuucuaa

SEQ ID NO: 2743974 - RNA, 16 nt, Human
auaaaggcaguuuucu

SEQ ID NO: 2743975 - RNA, 17 nt, Human
auaaaggcaguuuucua

SEQ ID NO: 2743976 - RNA, 13 nt, Human
auauuuauuuuaa

SEQ ID NO: 2743977 - RNA, 22 nt, Human
auauuuauuacuguaagaaaau

SEQ ID NO: 2743978 - RNA, 16 nt, Human
auauuauguuaaaacu

SEQ ID NO: 2743979 - RNA, 20 nt, Human
auauccuaauaaaaagguga

SEQ ID NO: 2743980 - RNA, 16 nt, Human
auauccuaauaaaaag

SEQ ID NO: 2743981 - RNA, 18 nt, Human
auauccuaauaaaaaggu

SEQ ID NO: 2743982 - RNA, 12 nt, Human
auauccuaauaa

SEQ ID NO: 2743983 - RNA, 13 nt, Human
auauccuaauaaa

SEQ ID NO: 2743984 - RNA, 14 nt, Human
auauccuaauaaaa

SEQ ID NO: 2743985 - RNA, 22 nt, Human
auaugcuucuguuuuauaauuu

SEQ ID NO: 2743986 - RNA, 20 nt, Human
auaugcuucuguuuuauaau

SEQ ID NO: 2743987 - RNA, 18 nt, Human
auagcagcuuauucacaa

SEQ ID NO: 2743988 - RNA, 15 nt, Human
auaggugcuacaaaa

SEQ ID NO: 2743989 - RNA, 21 nt, Human
auaggugcuacaaaaacacag

SEQ ID NO: 2743990 - RNA, 23 nt, Human
auaggugcuacaaaaacacagca

SEQ ID NO: 2743991 - RNA, 14 nt, Human
auaggugcuacaaa

SEQ ID NO: 2743992 - RNA, 15 nt, Human
auagguuuaauaauu

SEQ ID NO: 2743993 - RNA, 14 nt, Human
auagucaaauugug

SEQ ID NO: 2743994 - RNA, 15 nt, Human
aggcuguaacuacuu

SEQ ID NO: 2743995 - RNA, 12 nt, Human
aggcuguaacua

SEQ ID NO: 2743996 - RNA, 16 nt, Human
aggcuagauguaugua

SEQ ID NO: 2743997 - RNA, 15 nt, Human
aggcuagauguaugu

SEQ ID NO: 2743998 - RNA, 17 nt, Human
aggcuagauguauguac

SEQ ID NO: 2743999 - RNA, 17 nt, Human
aggcuacugucagcucc

SEQ ID NO: 2744000 - RNA, 21 nt, Human
aggcuagaaccaccugccuau

SEQ ID NO: 2744001 - RNA, 15 nt, Human
agggucaggagaggg

SEQ ID NO: 2744002 - RNA, 14 nt, Human
agggucaggagagg

SEQ ID NO: 2744003 - RNA, 18 nt, Human
agggucaggagaggggca

SEQ ID NO: 2744004 - RNA, 23 nt, Human
aggugcuacaaaaacacagcaag

SEQ ID NO: 2744005 - RNA, 24 nt, Human
aggugcuacaaaaacacagcaagg

SEQ ID NO: 2744006 - RNA, 20 nt, Human
agguaaaagcaucacaugaa

SEQ ID NO: 2744007 - RNA, 19 nt, Human
aggugcuacaaaaacacag

SEQ ID NO: 2744008 - RNA, 20 nt, Human
aggugcuacaaaaacacagc

SEQ ID NO: 2744009 - RNA, 21 nt, Human
aggugcuacaaaaacacagca

SEQ ID NO: 2744010 - RNA, 22 nt, Human
aggugcuacaaaaacacagcaa

SEQ ID NO: 2744011 - RNA, 18 nt, Human
aggugcuacaaaaacaca

SEQ ID NO: 2744012 - RNA, 22 nt, Human
agcuccccucggagaagagcug

SEQ ID NO: 2744013 - RNA, 12 nt, Human
aggagucccugg

SEQ ID NO: 2744014 - RNA, 17 nt, Human
aggauguugaaaaaguu

SEQ ID NO: 2744015 - RNA, 23 nt, Human
aggaugguucccuugaugaagaa

SEQ ID NO: 2744016 - RNA, 21 nt, Human
agauggcauaaccugucucac

SEQ ID NO: 2744017 - RNA, 17 nt, Human
agagaacuuccagaucc

SEQ ID NO: 2744018 - RNA, 21 nt, Human
agacugcauuauauuuauuac

SEQ ID NO: 2744019 - RNA, 21 nt, Human
agacgugcacgcacacugucu

SEQ ID NO: 2744020 - RNA, 22 nt, Human
agacgugcacgcacacugucug

SEQ ID NO: 2744021 - RNA, 17 nt, Human
agcccuccucugcacuc

SEQ ID NO: 2744022 - RNA, 21 nt, Human
agccgcuccugucugccagcc

SEQ ID NO: 2744023 - RNA, 19 nt, Human
agccgcuccugucugccag

SEQ ID NO: 2744024 - RNA, 17 nt, Human
agccgcuccugucugcc

SEQ ID NO: 2744025 - RNA, 16 nt, Human
agccgcuccugucugc

SEQ ID NO: 2744026 - RNA, 22 nt, Human
agccgcuccugucugccagcca

SEQ ID NO: 2744027 - RNA, 14 nt, Human
agccgcuccugucu

SEQ ID NO: 2744028 - RNA, 19 nt, Human
agcacacuguagcauuaca

SEQ ID NO: 2744029 - RNA, 14 nt, Human
agcacacuguagca

SEQ ID NO: 2744030 - RNA, 16 nt, Human
agcacugacuucuaag

SEQ ID NO: 2744031 - RNA, 15 nt, Human
agcaugaagacagag

SEQ ID NO: 2744032 - RNA, 20 nt, Human
agcaguucagagcugcccuc

SEQ ID NO: 2744033 - RNA, 23 nt, Human
agcaguucagagcugcccucucc

SEQ ID NO: 2744034 - RNA, 13 nt, Human
agcaguugaaaag

SEQ ID NO: 2744035 - RNA, 16 nt, Human
agcaguugaaaagacu

SEQ ID NO: 2744036 - RNA, 23 nt, Human
aauguuucaaacauauauaacaa

SEQ ID NO: 2744037 - RNA, 20 nt, Human
aauauaucuaccccagacua

SEQ ID NO: 2744038 - RNA, 15 nt, Human
aauagaauaaaggca

SEQ ID NO: 2744039 - RNA, 16 nt, Human
aauagaauaaaggcag

SEQ ID NO: 2744040 - RNA, 21 nt, Human
aaugauuaugaauuacauuug

SEQ ID NO: 2744041 - RNA, 15 nt, Human
aaugauuaugaauua

SEQ ID NO: 2744042 - RNA, 20 nt, Human
aagauuacaaaucagaaguc

SEQ ID NO: 2744043 - RNA, 21 nt, Human
aagauuacaaaucagaaguca

SEQ ID NO: 2744044 - RNA, 20 nt, Human
aaggcagcucuaaaugucaa

SEQ ID NO: 2744045 - RNA, 18 nt, Human
aaguccaagcauuuagau

SEQ ID NO: 2744046 - RNA, 17 nt, Human
aaguccaagcauaccaa

SEQ ID NO: 2744047 - RNA, 21 nt, Human
aaguagggacuucugucuuca

SEQ ID NO: 2744048 - RNA, 23 nt, Human
aagggaaacugccagcaacgcag

SEQ ID NO: 2744049 - RNA, 16 nt, Human
aagggaaacugccagc

SEQ ID NO: 2744050 - RNA, 17 nt, Human
aagggaaacugccagca

SEQ ID NO: 2744051 - RNA, 19 nt, Human
aaauugacacuuaaaaaug

SEQ ID NO: 2744052 - RNA, 17 nt, Human
aaaucuuauaauuuaaa

SEQ ID NO: 2744053 - RNA, 22 nt, Human
aaauguuguucucuucuuuaaa

SEQ ID NO: 2744054 - RNA, 16 nt, Human
aacacaucagcuugcc

SEQ ID NO: 2744055 - RNA, 18 nt, Human
aacaaauuuacagagaca

SEQ ID NO: 2744056 - RNA, 22 nt, Human
aaccacuggaaaguuuaugguu

SEQ ID NO: 2744057 - RNA, 15 nt, Human
aacccgucuggccca

SEQ ID NO: 2744058 - RNA, 17 nt, Human
aaccuagggugauauua

SEQ ID NO: 2744059 - RNA, 20 nt, Human
aacugaggcagacagcagcu

SEQ ID NO: 2744060 - RNA, 12 nt, Human
aacugaggcaga

SEQ ID NO: 2744061 - RNA, 18 nt, Human
aacugacucuuaagaaga

SEQ ID NO: 2744062 - RNA, 15 nt, Human
aacugacucuuaaga

SEQ ID NO: 2744063 - RNA, 20 nt, Human
aacugacucuuaagaagacu

SEQ ID NO: 2744064 - RNA, 19 nt, Human
aacugacucuuaagaagac

SEQ ID NO: 2744065 - RNA, 20 nt, Human
aacugagaugugaacacauc

SEQ ID NO: 2744066 - RNA, 20 nt, Human
aacuuuaugcuaagugaaau

SEQ ID NO: 2744067 - RNA, 21 nt, Human
aacuuuaugcuaagugaaaua

SEQ ID NO: 2744068 - RNA, 16 nt, Human
aaaaagaaacauuugg

SEQ ID NO: 2744069 - RNA, 18 nt, Human
aaaaguucugcagauaaa

SEQ ID NO: 2744070 - RNA, 21 nt, Human
aaaaucuacacuccagugaga

SEQ ID NO: 2744071 - RNA, 16 nt, Human
aaaaucucaauauuuc

SEQ ID NO: 2744072 - RNA, 21 nt, Human
aaacugagaugugaacacauc

SEQ ID NO: 2744073 - RNA, 23 nt, Human
aaacugagaugugaacacaucag

SEQ ID NO: 2744074 - RNA, 15 nt, Human
aaagaaauguaaggg

SEQ ID NO: 2744075 - RNA, 15 nt, Human
aaaucaaauaugcaa

SEQ ID NO: 2744076 - RNA, 12 nt, Human
aaaucaaauaug

SEQ ID NO: 2744077 - RNA, 14 nt, Human
aaaucaaauaugca

SEQ ID NO: 2744078 - RNA, 20 nt, Human
aaauauuuauuuuaauaaug

SEQ ID NO: 2744079 - RNA, 13 nt, Human
aaauauuuauuuu

SEQ ID NO: 2744080 - RNA, 15 nt, Human
aaauauuuauuuuaa

SEQ ID NO: 2744081 - RNA, 18 nt, Human
aaauaaaguuggugacag

SEQ ID NO: 2744082 - RNA, 14 nt, Human
aaaggcagaagcaa

SEQ ID NO: 2744083 - RNA, 14 nt, Human
acacgagcaggcua

SEQ ID NO: 2744084 - RNA, 19 nt, Human
acacgagcaggcuacuguc

SEQ ID NO: 2744085 - RNA, 21 nt, Human
acacgagcaggcuacugucag

SEQ ID NO: 2744086 - RNA, 19 nt, Human
acaggcaacugaggcagac

SEQ ID NO: 2744087 - RNA, 18 nt, Human
acaggcaacugaggcaga

SEQ ID NO: 2744088 - RNA, 16 nt, Human
acaggcaacugaggca

SEQ ID NO: 2744089 - RNA, 15 nt, Human
acagaauucugcuac

SEQ ID NO: 2744090 - RNA, 17 nt, Human
acagaauucugcuaccu

SEQ ID NO: 2744091 - RNA, 22 nt, Human
acagcaguugaaaagacuccaa

SEQ ID NO: 2744092 - RNA, 23 nt, Human
acagcaguugaaaagacuccaaa

SEQ ID NO: 2744093 - RNA, 21 nt, Human
acagcaguugaaaagacucca

SEQ ID NO: 2744094 - RNA, 22 nt, Human
acaggcaacugaggcagacagc

SEQ ID NO: 2744095 - RNA, 17 nt, Human
acccacaagaaaugaaa

SEQ ID NO: 2744096 - RNA, 21 nt, Human
acccacaagaaaugaaagcag

SEQ ID NO: 2744097 - RNA, 22 nt, Human
acccaguguuuuaggagcauga

SEQ ID NO: 2744098 - RNA, 19 nt, Human
acccaguguuuuaggagca

SEQ ID NO: 2744099 - RNA, 21 nt, Human
acuuggucugugagaugcuag

SEQ ID NO: 2744100 - RNA, 22 nt, Human
acuucugucuucacaacagauu

SEQ ID NO: 2744101 - RNA, 21 nt, Human
acuucugucuucacaacagau

SEQ ID NO: 2744102 - RNA, 12 nt, Human
acuucagacaua

SEQ ID NO: 2744103 - RNA, 13 nt, Human
acugccagcaacg

SEQ ID NO: 2744104 - RNA, 18 nt, Human
acucugucucaguccaug

SEQ ID NO: 2744105 - RNA, 20 nt, Human
acucugucucaguccaugaa

SEQ ID NO: 2744106 - RNA, 13 nt, Human
acuguaagaaaau

SEQ ID NO: 2744107 - RNA, 19 nt, Human
acuguaagaaaauaucacu

SEQ ID NO: 2744108 - RNA, 22 nt, Human
acuguaagaaaauaucacuugu

SEQ ID NO: 2744109 - RNA, 11 nt, Human
agaaaguguau

SEQ ID NO: 2744110 - RNA, 17 nt, Human
agaaaguguauuuggaa

SEQ ID NO: 2744111 - RNA, 13 nt, Human
agaaaguguauuu

SEQ ID NO: 2744112 - RNA, 16 nt, Human
agaaaguguauuugga

SEQ ID NO: 2744113 - RNA, 22 nt, Human
acuuuauuuucuauaauuuaaa

SEQ ID NO: 2744114 - RNA, 16 nt, Human
agaaaaucaggcuggc

SEQ ID NO: 2744115 - RNA, 14 nt, Human
agaaaauaacaaua

SEQ ID NO: 2744116 - RNA, 18 nt, Human
accugucucaccuggacu

SEQ ID NO: 2744117 - RNA, 13 nt, Human
acuaagagagaau

SEQ ID NO: 2744118 - RNA, 19 nt, Human
acgcaggcccccaggugcc

SEQ ID NO: 2744119 - RNA, 22 nt, Human
acgcaggcccccaggugccagu

SEQ ID NO: 2744120 - RNA, 17 nt, Human
acucagucucucuucuc

SEQ ID NO: 2744121 - RNA, 22 nt, Human
acucagggccccagcacuaaag

SEQ ID NO: 2744122 - RNA, 18 nt, Human
acucagggccccagcacu

SEQ ID NO: 2744123 - RNA, 15 nt, Human
acucagggccccagc

SEQ ID NO: 2744124 - RNA, 14 nt, Human
acucaaaucaagaa

SEQ ID NO: 2744125 - RNA, 21 nt, Human
acuauucaaacagucucagga

SEQ ID NO: 2744126 - RNA, 20 nt, Human
acuaguauuucuaugaaaua

SEQ ID NO: 2744127 - RNA, 16 nt, Human
acuagauguaguauuu

SEQ ID NO: 2744128 - RNA, 17 nt, Human
acuagauguaguauuuu

SEQ ID NO: 2744129 - RNA, 12 nt, Human
acuagauguagu

SEQ ID NO: 2744130 - RNA, 13 nt, Human
acuagauguagua

SEQ ID NO: 2744131 - RNA, 20 nt, Human
acucuggugagucaccacuu

SEQ ID NO: 2744132 - RNA, 17 nt, Human
acucuauguucuaagaa

SEQ ID NO: 2744133 - RNA, 17 nt, Human
caagcacuaaacaaaga

SEQ ID NO: 2744134 - RNA, 15 nt, Human
caaauuuacagagac

SEQ ID NO: 2744135 - RNA, 14 nt, Human
caaauuuacagaga

SEQ ID NO: 2744136 - RNA, 14 nt, Human
caaagaaaguguau

SEQ ID NO: 2744137 - RNA, 13 nt, Human
caaagaaagugua

SEQ ID NO: 2744138 - RNA, 14 nt, Human
caaauaugcaaagc

SEQ ID NO: 2744139 - RNA, 20 nt, Human
caaauguucaucaaugaaug

SEQ ID NO: 2744140 - RNA, 21 nt, Human
caaauguucaucaaugaauga

SEQ ID NO: 2744141 - RNA, 14 nt, Human
caaaucagaaguca

SEQ ID NO: 2744142 - RNA, 15 nt, Human
caaaucagaagucau

SEQ ID NO: 2744143 - RNA, 22 nt, Human
caaaucagaagucaucuugcua

SEQ ID NO: 2744144 - RNA, 18 nt, Human
caaauaugcaaagcacug

SEQ ID NO: 2744145 - RNA, 16 nt, Human
caaauaugcaaagcac

SEQ ID NO: 2744146 - RNA, 17 nt, Human
caaauaugcaaagcacu

SEQ ID NO: 2744147 - RNA, 15 nt, Human
cacaguuuucugaga

SEQ ID NO: 2744148 - RNA, 14 nt, Human
cacaguuuucugag

SEQ ID NO: 2744149 - RNA, 20 nt, Human
cacaggcaacugaggcagac

SEQ ID NO: 2744150 - RNA, 23 nt, Human
cacaggcaacugaggcagacagc

SEQ ID NO: 2744151 - RNA, 22 nt, Human
cacaggcaacugaggcagacag

SEQ ID NO: 2744152 - RNA, 19 nt, Human
cacaggaaccacaagacug

SEQ ID NO: 2744153 - RNA, 20 nt, Human
cacaggaaccacaagacugc

SEQ ID NO: 2744154 - RNA, 15 nt, Human
cacaggaaguagagg

SEQ ID NO: 2744155 - RNA, 22 nt, Human
cacagcaguugaaaagacucca

SEQ ID NO: 2744156 - RNA, 21 nt, Human
cacacacaggcaacugaggca

SEQ ID NO: 2744157 - RNA, 13 nt, Human
cacacacaggcaa

SEQ ID NO: 2744158 - RNA, 13 nt, Human
cacaacuauauug

SEQ ID NO: 2744159 - RNA, 14 nt, Human
cacacugaagaagc

SEQ ID NO: 2744160 - RNA, 19 nt, Human
cacacucaaaucaagaaac

SEQ ID NO: 2744161 - RNA, 23 nt, Human
cacacuguagcauuacagugggu

SEQ ID NO: 2744162 - RNA, 11 nt, Human
cacaacagauu

SEQ ID NO: 2744163 - RNA, 22 nt, Human
caaugaaugaaugaauggcuaa

SEQ ID NO: 2744164 - RNA, 12 nt, Human
uuggauuuccua

SEQ ID NO: 2744165 - RNA, 14 nt, Human
uuggauuuccuaau

SEQ ID NO: 2744166 - RNA, 21 nt, Human
uuggauuuccuaauacuguca

SEQ ID NO: 2744167 - RNA, 22 nt, Human
uuggaagauggcauaaccuguc

SEQ ID NO: 2744168 - RNA, 16 nt, Human
uugcuaagcauuccaa

SEQ ID NO: 2744169 - RNA, 18 nt, Human
uugcuaagcauuccaacu

SEQ ID NO: 2744170 - RNA, 16 nt, Human
uuguaccgcaauguga

SEQ ID NO: 2744171 - RNA, 20 nt, Human
uuguaaaauggugugaccac

SEQ ID NO: 2744172 - RNA, 16 nt, Human
uuggcauagcucuggg

SEQ ID NO: 2744173 - RNA, 20 nt, Human
uugguaaggggaauugagga

SEQ ID NO: 2744174 - RNA, 12 nt, Human
uugguaacuuuu

SEQ ID NO: 2744175 - RNA, 14 nt, Human
uugguaacuuuugu

SEQ ID NO: 2744176 - RNA, 15 nt, Human
uugguaacuuuugug

SEQ ID NO: 2744177 - RNA, 13 nt, Human
uuguaaaauggug

SEQ ID NO: 2744178 - RNA, 12 nt, Human
uuguaaaauggu

SEQ ID NO: 2744179 - RNA, 20 nt, Human
uugauaugccuuuucccaac

SEQ ID NO: 2744180 - RNA, 13 nt, Human
uugccaucccucc

SEQ ID NO: 2744181 - RNA, 22 nt, Human
uugccagacauguggugggaca

SEQ ID NO: 2744182 - RNA, 18 nt, Human
uugccaucccucccucca

SEQ ID NO: 2744183 - RNA, 17 nt, Human
uugccaucccucccucc

SEQ ID NO: 2744184 - RNA, 16 nt, Human
uugccaucccucccuc

SEQ ID NO: 2744185 - RNA, 14 nt, Human
uugccaucccuccc

SEQ ID NO: 2744186 - RNA, 23 nt, Human
uugccaucccucccuccaccucc

SEQ ID NO: 2744187 - RNA, 22 nt, Human
uugccaucccucccuccaccuc

SEQ ID NO: 2744188 - RNA, 14 nt, Human
uugcagagacagga

SEQ ID NO: 2744189 - RNA, 19 nt, Human
uugcagagacaggaccuga

SEQ ID NO: 2744190 - RNA, 18 nt, Human
uugcagauucauuuuucu

SEQ ID NO: 2744191 - RNA, 23 nt, Human
uugcagcucuccccuucucugua

SEQ ID NO: 2744192 - RNA, 24 nt, Human
uucuaaguaaaaccacagcaguug

SEQ ID NO: 2744193 - RNA, 19 nt, Human
uucuuaggguuaugauuaa

SEQ ID NO: 2744194 - RNA, 12 nt, Human
uucuuucuagaa

SEQ ID NO: 2744195 - RNA, 13 nt, Human
uucuuucuagaaa

SEQ ID NO: 2744196 - RNA, 18 nt, Human
uucuuuccacagaagcuc

SEQ ID NO: 2744197 - RNA, 21 nt, Human
uugaaaaucuuauaauuuaaa

SEQ ID NO: 2744198 - RNA, 20 nt, Human
uuucauuuaucuauaauuua

SEQ ID NO: 2744199 - RNA, 12 nt, Human
uuuccuaauacu

SEQ ID NO: 2744200 - RNA, 12 nt, Human
uuucucuaggaa

SEQ ID NO: 2744201 - RNA, 18 nt, Human
uuugguaaggggaauuga

SEQ ID NO: 2744202 - RNA, 20 nt, Human
uuugaagugcuguuuauuaa

SEQ ID NO: 2744203 - RNA, 15 nt, Human
uuugaagugcuguuu

SEQ ID NO: 2744204 - RNA, 16 nt, Human
uuugaagugcuguuua

SEQ ID NO: 2744205 - RNA, 13 nt, Human
uuucuuaacuucu

SEQ ID NO: 2744206 - RNA, 14 nt, Human
uuucuuaacuucuu

SEQ ID NO: 2744207 - RNA, 21 nt, Human
uuugaaauuguauuacaaauc

SEQ ID NO: 2744208 - RNA, 18 nt, Human
uuguuuaaaaucauuucu

SEQ ID NO: 2744209 - RNA, 17 nt, Human
uuguuuaaaaucauuuc

SEQ ID NO: 2744210 - RNA, 12 nt, Human
uuuaaaaugucu

SEQ ID NO: 2744211 - RNA, 17 nt, Human
uuuaaaagaaugauuau

SEQ ID NO: 2744212 - RNA, 14 nt, Human
uuuaaaagaaugau

SEQ ID NO: 2744213 - RNA, 16 nt, Human
uuuaaaaucauuucug

SEQ ID NO: 2744214 - RNA, 19 nt, Human
uuuaaaauacacacucaaa

SEQ ID NO: 2744215 - RNA, 14 nt, Human
uuuauaacuaacau

SEQ ID NO: 2744216 - RNA, 13 nt, Human
uuuacagagacag

SEQ ID NO: 2744217 - RNA, 19 nt, Human
uuuaauaauguuucaaaca

SEQ ID NO: 2744218 - RNA, 15 nt, Human
uuuaauaauguuuca

SEQ ID NO: 2744219 - RNA, 14 nt, Human
uuuaauaauguuuc

SEQ ID NO: 2744220 - RNA, 13 nt, Human
uuuaauaaaccau

SEQ ID NO: 2744221 - RNA, 22 nt, Human
uuaucuauaauuuaccuaagau

SEQ ID NO: 2744222 - RNA, 15 nt, Human
uuaucuauaauuuac

SEQ ID NO: 2744223 - RNA, 17 nt, Human
uuaucuauaauuuaccu

SEQ ID NO: 2744224 - RNA, 14 nt, Human
uuaucuauaauuua

SEQ ID NO: 2744225 - RNA, 16 nt, Human
uuaucugucagcugca

SEQ ID NO: 2744226 - RNA, 21 nt, Human
uuauggcacuaguauuucuau

SEQ ID NO: 2744227 - RNA, 19 nt, Human
uuaugcgguuaauuuugaa

SEQ ID NO: 2744228 - RNA, 16 nt, Human
uuaugcgguuaauuuu

SEQ ID NO: 2744229 - RNA, 17 nt, Human
uuauggcuauaggugcu

SEQ ID NO: 2744230 - RNA, 17 nt, Human
uuauuaaucuuagugua

SEQ ID NO: 2744231 - RNA, 16 nt, Human
uuauuacuguaagaaa

SEQ ID NO: 2744232 - RNA, 18 nt, Human
uuauuacuguaagaaaau

SEQ ID NO: 2744233 - RNA, 17 nt, Human
uuauuacuguaagaaaa

SEQ ID NO: 2744234 - RNA, 16 nt, Human
uucagacauagaauua

SEQ ID NO: 2744235 - RNA, 20 nt, Human
uucagacauagaauuaacac

SEQ ID NO: 2744236 - RNA, 14 nt, Human
uucagagcugcccu

SEQ ID NO: 2744237 - RNA, 13 nt, Human
uucagagcugccc

SEQ ID NO: 2744238 - RNA, 16 nt, Human
uuauuuuaauaauguu

SEQ ID NO: 2744239 - RNA, 15 nt, Human
uuauuuuaauaaugu

SEQ ID NO: 2744240 - RNA, 15 nt, Human
uuauugucuagugaa

SEQ ID NO: 2744241 - RNA, 17 nt, Human
uucaaauccuugaagau

SEQ ID NO: 2744242 - RNA, 13 nt, Human
uucaugcagcugu

SEQ ID NO: 2744243 - RNA, 14 nt, Human
uucaugcagcugug

SEQ ID NO: 2744244 - RNA, 15 nt, Human
uucaugcagcugugg

SEQ ID NO: 2744245 - RNA, 19 nt, Human
uuccagauccuggaaauca

SEQ ID NO: 2744246 - RNA, 22 nt, Human
uucggccuccauccugaggcuc

SEQ ID NO: 2744247 - RNA, 17 nt, Human
uuccuuggacucauuuu

SEQ ID NO: 2744248 - RNA, 20 nt, Human
uuccuuggacucauuuuaaa

SEQ ID NO: 2744249 - RNA, 17 nt, Human
uucccuugaugaagaag

SEQ ID NO: 2744250 - RNA, 16 nt, Human
uuacuguguaauuagu

SEQ ID NO: 2744251 - RNA, 20 nt, Human
uuacuguguaauuagugcca

SEQ ID NO: 2744252 - RNA, 13 nt, Human
uuacuguguaauu

SEQ ID NO: 2744253 - RNA, 17 nt, Human
uuacuaguuucccuugc

SEQ ID NO: 2744254 - RNA, 20 nt, Human
uuagacccucaugcugccaa

SEQ ID NO: 2744255 - RNA, 19 nt, Human
uuagacccucaugcugcca

SEQ ID NO: 2744256 - RNA, 11 nt, Human
uuagaccucag

SEQ ID NO: 2744257 - RNA, 13 nt, Human
uuagaccucagcc

SEQ ID NO: 2744258 - RNA, 12 nt, Human
uuagaccucagc

SEQ ID NO: 2744259 - RNA, 15 nt, Human
uuagaccucagccug

SEQ ID NO: 2744260 - RNA, 14 nt, Human
uuagaccucagccu

SEQ ID NO: 2744261 - RNA, 16 nt, Human
uuagaccucagccugu

SEQ ID NO: 2744262 - RNA, 19 nt, Human
uuagaaacacaacuauauu

SEQ ID NO: 2744263 - RNA, 13 nt, Human
uuagcuggaaaag

SEQ ID NO: 2744264 - RNA, 12 nt, Human
uuagcuggaaaa

SEQ ID NO: 2744265 - RNA, 21 nt, Human
uuagcuuagaccucagccugu

SEQ ID NO: 2744266 - RNA, 18 nt, Human
uuagcuuagaccucagcc

SEQ ID NO: 2744267 - RNA, 17 nt, Human
uuagcuuagaccucagc

SEQ ID NO: 2744268 - RNA, 16 nt, Human
uuagcuuagaccucag

SEQ ID NO: 2744269 - RNA, 21 nt, Human
uuagaugcaguucugaagaag

SEQ ID NO: 2744270 - RNA, 20 nt, Human
uuagaugcaguucugaagaa

SEQ ID NO: 2744271 - RNA, 21 nt, Human
uuaguuaccuuauaguuacug

SEQ ID NO: 2744272 - RNA, 22 nt, Human
uuaguuaccuuauaguuacugu

SEQ ID NO: 2744273 - RNA, 13 nt, Human
uuaguuaccuuau

SEQ ID NO: 2744274 - RNA, 16 nt, Human
uuaguuaccuuauagu

SEQ ID NO: 2744275 - RNA, 18 nt, Human
uuaguuaccuuauaguua

SEQ ID NO: 2744276 - RNA, 19 nt, Human
uuaguuaccuuauaguuac

SEQ ID NO: 2744277 - RNA, 20 nt, Human
uuaguuaccuuauaguuacu

SEQ ID NO: 2744278 - RNA, 17 nt, Human
uuaggcuguaacuacuu

SEQ ID NO: 2744279 - RNA, 20 nt, Human
uuaggcuguaacuacuuuau

SEQ ID NO: 2744280 - RNA, 14 nt, Human
uuaggcuguaacua

SEQ ID NO: 2744281 - RNA, 18 nt, Human
uuaggauguugaaaaagu

SEQ ID NO: 2744282 - RNA, 13 nt, Human
uuaauguauguua

SEQ ID NO: 2744283 - RNA, 15 nt, Human
uuaauguauguuacc

SEQ ID NO: 2744284 - RNA, 17 nt, Human
uuaauguauguuaccaa

SEQ ID NO: 2744285 - RNA, 18 nt, Human
uuaauguauguuaccaaa

SEQ ID NO: 2744286 - RNA, 21 nt, Human
uuaacuucuugcuucuuucua

SEQ ID NO: 2744287 - RNA, 14 nt, Human
uuaacuucuugcuu

SEQ ID NO: 2744288 - RNA, 17 nt, Human
uuaacuucuugcuucuu

SEQ ID NO: 2744289 - RNA, 14 nt, Human
uuaacgauguccaa

SEQ ID NO: 2744290 - RNA, 22 nt, Human
uguuucaaacauauauaacaau

SEQ ID NO: 2744291 - RNA, 21 nt, Human
uguuucaaacauauauaacaa

SEQ ID NO: 2744292 - RNA, 19 nt, Human
uguuucaaacauauauaac

SEQ ID NO: 2744293 - RNA, 21 nt, Human
uuaaaagaauauuuuaacuuc

SEQ ID NO: 2744294 - RNA, 22 nt, Human
uuaaaagaauauuuuaacuucc

SEQ ID NO: 2744295 - RNA, 15 nt, Human
uuaaaagaugaaaau

SEQ ID NO: 2744296 - RNA, 18 nt, Human
uuaaaagaugaaaauauu

SEQ ID NO: 2744297 - RNA, 19 nt, Human
uuaaaauacacacucaaau

SEQ ID NO: 2744298 - RNA, 12 nt, Human
uuaaagaaagug

SEQ ID NO: 2744299 - RNA, 17 nt, Human
uuaaagaaaguguauuu

SEQ ID NO: 2744300 - RNA, 15 nt, Human
ugggcagcugccucc

SEQ ID NO: 2744301 - RNA, 14 nt, Human
ugggcagcugccuc

SEQ ID NO: 2744302 - RNA, 13 nt, Human
ugggcagcugccu

SEQ ID NO: 2744303 - RNA, 12 nt, Human
ugggcagcugcc

SEQ ID NO: 2744304 - RNA, 19 nt, Human
ugggcagcugccuccccuc

SEQ ID NO: 2744305 - RNA, 17 nt, Human
ugggcagcugccucccc

SEQ ID NO: 2744306 - RNA, 16 nt, Human
uggugauuuagcagga

SEQ ID NO: 2744307 - RNA, 22 nt, Human
uggugauuuagcaggaagcugu

SEQ ID NO: 2744308 - RNA, 16 nt, Human
uggucccagccagcag

SEQ ID NO: 2744309 - RNA, 17 nt, Human
uggucacaggaaguaga

SEQ ID NO: 2744310 - RNA, 22 nt, Human
uggucacaggaaguagaggagg

SEQ ID NO: 2744311 - RNA, 13 nt, Human
ugguauguuuuca

SEQ ID NO: 2744312 - RNA, 12 nt, Human
uggcagaguuac

SEQ ID NO: 2744313 - RNA, 17 nt, Human
uggcagaguuacaguuc

SEQ ID NO: 2744314 - RNA, 19 nt, Human
uggcagaguuacaguucug

SEQ ID NO: 2744315 - RNA, 20 nt, Human
uggcagaguuacaguucugu

SEQ ID NO: 2744316 - RNA, 23 nt, Human
ugcuguuuauuaaucuuagugua

SEQ ID NO: 2744317 - RNA, 14 nt, Human
ugcuguuuauuaau

SEQ ID NO: 2744318 - RNA, 17 nt, Human
ugcuguuuauuaaucuu

SEQ ID NO: 2744319 - RNA, 20 nt, Human
uggcaauagucaaauugugu

SEQ ID NO: 2744320 - RNA, 15 nt, Human
uggcacuaguauuuc

SEQ ID NO: 2744321 - RNA, 21 nt, Human
ugccuauuaucugucagcugc

SEQ ID NO: 2744322 - RNA, 16 nt, Human
ugccacuaaauugaca

SEQ ID NO: 2744323 - RNA, 13 nt, Human
ugcaucagcugcu

SEQ ID NO: 2744324 - RNA, 12 nt, Human
ugcaguucugaa

SEQ ID NO: 2744325 - RNA, 22 nt, Human
ugcaucaauuuuucuuauuuca

SEQ ID NO: 2744326 - RNA, 15 nt, Human
ugcugccaauauccu

SEQ ID NO: 2744327 - RNA, 16 nt, Human
ugcugccaauauccua

SEQ ID NO: 2744328 - RNA, 17 nt, Human
ugcugccaauauccuaa

SEQ ID NO: 2744329 - RNA, 18 nt, Human
ugcugccaauauccuaau

SEQ ID NO: 2744330 - RNA, 19 nt, Human
ugcugccaauauccuaaua

SEQ ID NO: 2744331 - RNA, 22 nt, Human
ugcugccaauauccuaauaaaa

SEQ ID NO: 2744332 - RNA, 21 nt, Human
ugcugccaauauccuaauaaa

SEQ ID NO: 2744333 - RNA, 20 nt, Human
ugcugggggggauuguaaaa

SEQ ID NO: 2744334 - RNA, 16 nt, Human
ugcucuaacagcccuc

SEQ ID NO: 2744335 - RNA, 15 nt, Human
ugcucuaacagcccu

SEQ ID NO: 2744336 - RNA, 17 nt, Human
ugcuagaacucccuuuc

SEQ ID NO: 2744337 - RNA, 15 nt, Human
ugcuagaacucccuu

SEQ ID NO: 2744338 - RNA, 14 nt, Human
ugcuagaacucccu

SEQ ID NO: 2744339 - RNA, 13 nt, Human
ugcuagaacuccc

SEQ ID NO: 2744340 - RNA, 20 nt, Human
ugaggcuccacuuggucugu

SEQ ID NO: 2744341 - RNA, 18 nt, Human
ugaggcuccacuuggucu

SEQ ID NO: 2744342 - RNA, 16 nt, Human
ugauaacuggaaacuu

SEQ ID NO: 2744343 - RNA, 21 nt, Human
ugagcucgguggacccaggga

SEQ ID NO: 2744344 - RNA, 20 nt, Human
ugagcucgguggacccaggg

SEQ ID NO: 2744345 - RNA, 14 nt, Human
ugagcucgguggac

SEQ ID NO: 2744346 - RNA, 13 nt, Human
ugagccccaaaag

SEQ ID NO: 2744347 - RNA, 16 nt, Human
ugagagugaacaaauu

SEQ ID NO: 2744348 - RNA, 17 nt, Human
ugaucagcuuauugucu

SEQ ID NO: 2744349 - RNA, 24 nt, Human
ugaucagcuuauugucuagugaaa

SEQ ID NO: 2744350 - RNA, 14 nt, Human
ugaucuuuaaaaua

SEQ ID NO: 2744351 - RNA, 17 nt, Human
ugaucuuuaaaauacac

SEQ ID NO: 2744352 - RNA, 23 nt, Human
ugaugcuacaggauuugaaauug

SEQ ID NO: 2744353 - RNA, 20 nt, Human
ugaugcuacaggauuugaaa

SEQ ID NO: 2744354 - RNA, 15 nt, Human
ugauggugguauguu

SEQ ID NO: 2744355 - RNA, 22 nt, Human
ugauuaugaauuacauuuguau

SEQ ID NO: 2744356 - RNA, 21 nt, Human
ugauuaugaauuacauuugua

SEQ ID NO: 2744357 - RNA, 20 nt, Human
ugauuauuaacgauguccaa

SEQ ID NO: 2744358 - RNA, 19 nt, Human
ugauuaugaauuacauuug

SEQ ID NO: 2744359 - RNA, 17 nt, Human
ugauuaugaauuacauu

SEQ ID NO: 2744360 - RNA, 13 nt, Human
ugauuauauguca

SEQ ID NO: 2744361 - RNA, 23 nt, Human
ugauuacuggccuuuuucauuua

SEQ ID NO: 2744362 - RNA, 20 nt, Human
ugauuacuggccuuuuucau

SEQ ID NO: 2744363 - RNA, 21 nt, Human
ugauuacuggccuuuuucauu

SEQ ID NO: 2744364 - RNA, 22 nt, Human
ugauguuuagaaacacaacuau

SEQ ID NO: 2744365 - RNA, 16 nt, Human
ugauuaccagggacug

SEQ ID NO: 2744366 - RNA, 12 nt, Human
ucuuugccaagu

SEQ ID NO: 2744367 - RNA, 19 nt, Human
ucuuuccacagaagcucca

SEQ ID NO: 2744368 - RNA, 13 nt, Human
ucuugcuaccagu

SEQ ID NO: 2744369 - RNA, 11 nt, Human
ucuugcuucuu

SEQ ID NO: 2744370 - RNA, 14 nt, Human
ucuugcuaccagua

SEQ ID NO: 2744371 - RNA, 20 nt, Human
ucuugcuaccaguauuuaga

SEQ ID NO: 2744372 - RNA, 18 nt, Human
ucuugcuucuuucuagaa

SEQ ID NO: 2744373 - RNA, 16 nt, Human
ucuugcuucuuucuag

SEQ ID NO: 2744374 - RNA, 17 nt, Human
ucuugcuucuuucuaga

SEQ ID NO: 2744375 - RNA, 17 nt, Human
ucuuucacauuuaaaua

SEQ ID NO: 2744376 - RNA, 20 nt, Human
ugaacaaguuguuucauuga

SEQ ID NO: 2744377 - RNA, 19 nt, Human
ugaacaaguuguuucauug

SEQ ID NO: 2744378 - RNA, 22 nt, Human
ugaacaaguuguuucauugacu

SEQ ID NO: 2744379 - RNA, 16 nt, Human
ugaaauauugacuuuu

SEQ ID NO: 2744380 - RNA, 19 nt, Human
ugaaauggacuuuuguaca

SEQ ID NO: 2744381 - RNA, 22 nt, Human
ugaaacaacaaauaggaauugu

SEQ ID NO: 2744382 - RNA, 18 nt, Human
ugaaagaggcagcuugaa

SEQ ID NO: 2744383 - RNA, 16 nt, Human
ugaaagguacuucaaa

SEQ ID NO: 2744384 - RNA, 15 nt, Human
ugaaagguacuucaa

SEQ ID NO: 2744385 - RNA, 18 nt, Human
ugaauuacauuuguauaa

SEQ ID NO: 2744386 - RNA, 16 nt, Human
ugaauuacauuuguau

SEQ ID NO: 2744387 - RNA, 15 nt, Human
ugaauuacauuugua

SEQ ID NO: 2744388 - RNA, 17 nt, Human
ugaauuaggcuguaacu

SEQ ID NO: 2744389 - RNA, 20 nt, Human
ugaauuaggcuguaacuacu

SEQ ID NO: 2744390 - RNA, 21 nt, Human
ugaauuaggcuguaacuacuu

SEQ ID NO: 2744391 - RNA, 22 nt, Human
ugaauuaggcuguaacuacuuu

SEQ ID NO: 2744392 - RNA, 14 nt, Human
ugaauuacauuugu

SEQ ID NO: 2744393 - RNA, 20 nt, Human
ugaaugaauggcuaagcaaa

SEQ ID NO: 2744394 - RNA, 13 nt, Human
ugaaguccaagca

SEQ ID NO: 2744395 - RNA, 22 nt, Human
ugaagugcuguuuauuaaucuu

SEQ ID NO: 2744396 - RNA, 18 nt, Human
ugaagugcuguuuauuaa

SEQ ID NO: 2744397 - RNA, 11 nt, Human
ugaaguccaag

SEQ ID NO: 2744398 - RNA, 16 nt, Human
ugacaugucccuacac

SEQ ID NO: 2744399 - RNA, 18 nt, Human
ugacaugggacauuugcu

SEQ ID NO: 2744400 - RNA, 17 nt, Human
ugacaugggacauuugc

SEQ ID NO: 2744401 - RNA, 16 nt, Human
ugacaugggacauuug

SEQ ID NO: 2744402 - RNA, 20 nt, Human
ugaccacugcagaagacagu

SEQ ID NO: 2744403 - RNA, 20 nt, Human
ugacaagcucacagaccuuu

SEQ ID NO: 2744404 - RNA, 15 nt, Human
ugacaagcucacaga

SEQ ID NO: 2744405 - RNA, 12 nt, Human
ugacaagcucac

SEQ ID NO: 2744406 - RNA, 12 nt, Human
ucuccagcugac

SEQ ID NO: 2744407 - RNA, 14 nt, Human
ucuccagcugacua

SEQ ID NO: 2744408 - RNA, 15 nt, Human
ucuccagcugacuaa

SEQ ID NO: 2744409 - RNA, 23 nt, Human
ucucaguccaugaagauguagag

SEQ ID NO: 2744410 - RNA, 14 nt, Human
ucggagaagagcug

SEQ ID NO: 2744411 - RNA, 16 nt, Human
ucggagaagagcuguu

SEQ ID NO: 2744412 - RNA, 12 nt, Human
ucggagaagagc

SEQ ID NO: 2744413 - RNA, 22 nt, Human
uccuuagcuuagaccucagccu

SEQ ID NO: 2744414 - RNA, 21 nt, Human
uccuuagcuuagaccucagcc

SEQ ID NO: 2744415 - RNA, 21 nt, Human
uccugucugccagccagcagc

SEQ ID NO: 2744416 - RNA, 17 nt, Human
uccugucugccagccag

SEQ ID NO: 2744417 - RNA, 20 nt, Human
uccuuagcuuagaccucagc

SEQ ID NO: 2744418 - RNA, 19 nt, Human
uccuuagcuuagaccucag

SEQ ID NO: 2744419 - RNA, 18 nt, Human
uccuuagcuuagaccuca

SEQ ID NO: 2744420 - RNA, 18 nt, Human
ucuaugaaauauuauguu

SEQ ID NO: 2744421 - RNA, 16 nt, Human
uccugucugccagcca

SEQ ID NO: 2744422 - RNA, 14 nt, Human
uccugucugccagc

SEQ ID NO: 2744423 - RNA, 13 nt, Human
uccugucugccag

SEQ ID NO: 2744424 - RNA, 12 nt, Human
uccugucugcca

SEQ ID NO: 2744425 - RNA, 16 nt, Human
uccucuguccagggcc

SEQ ID NO: 2744426 - RNA, 14 nt, Human
uccucuguccaggg

SEQ ID NO: 2744427 - RNA, 23 nt, Human
uccucuguccagggcccugagcu

SEQ ID NO: 2744428 - RNA, 20 nt, Human
uccugaggcuccacuugguc

SEQ ID NO: 2744429 - RNA, 19 nt, Human
uccugaggcuccacuuggu

SEQ ID NO: 2744430 - RNA, 18 nt, Human
uccugccccugagcccau

SEQ ID NO: 2744431 - RNA, 17 nt, Human
uccugccccugagccca

SEQ ID NO: 2744432 - RNA, 20 nt, Human
ucccuucacaaacccagugu

SEQ ID NO: 2744433 - RNA, 14 nt, Human
uccuagugaaagag

SEQ ID NO: 2744434 - RNA, 23 nt, Human
uccuagugaaagaggcagcuuga

SEQ ID NO: 2744435 - RNA, 22 nt, Human
uccucauuuuuauaaugucccu

SEQ ID NO: 2744436 - RNA, 23 nt, Human
ucccaccugacacaccaggcgcu

SEQ ID NO: 2744437 - RNA, 13 nt, Human
ucccaccugacac

SEQ ID NO: 2744438 - RNA, 19 nt, Human
ucccaccugacacaccagg

SEQ ID NO: 2744439 - RNA, 12 nt, Human
uccauacauuug

SEQ ID NO: 2744440 - RNA, 19 nt, Human
uccagguagagggugugua

SEQ ID NO: 2744441 - RNA, 15 nt, Human
uccauacauuugugu

SEQ ID NO: 2744442 - RNA, 20 nt, Human
uccaugggccauaugaaaag

SEQ ID NO: 2744443 - RNA, 14 nt, Human
uccagcugacuaaa

SEQ ID NO: 2744444 - RNA, 21 nt, Human
uccagcugacuaaacuuuuuu

SEQ ID NO: 2744445 - RNA, 23 nt, Human
uccacuuggucugugagaugcua

SEQ ID NO: 2744446 - RNA, 17 nt, Human
uccacuuggucugugag

SEQ ID NO: 2744447 - RNA, 21 nt, Human
uccacuuggucugugagaugc

SEQ ID NO: 2744448 - RNA, 21 nt, Human
ucaucuugcuaccaguauuua

SEQ ID NO: 2744449 - RNA, 22 nt, Human
ucaucuugcuaccaguauuuag

SEQ ID NO: 2744450 - RNA, 11 nt, Human
ucaucuugcua

SEQ ID NO: 2744451 - RNA, 17 nt, Human
ucaucuugcuaccagua

SEQ ID NO: 2744452 - RNA, 18 nt, Human
ucaucuugcuaccaguau

SEQ ID NO: 2744453 - RNA, 17 nt, Human
ucaucaaugaaugaaug

SEQ ID NO: 2744454 - RNA, 12 nt, Human
ucauagcagcuu

SEQ ID NO: 2744455 - RNA, 11 nt, Human
ucauagcagcu

SEQ ID NO: 2744456 - RNA, 18 nt, Human
ucauuuaucuauaauuua

SEQ ID NO: 2744457 - RNA, 21 nt, Human
ucauuuaucuauaauuuaccu

SEQ ID NO: 2744458 - RNA, 12 nt, Human
ucauuuaucuau

SEQ ID NO: 2744459 - RNA, 16 nt, Human
ucauuuaucuauaauu

SEQ ID NO: 2744460 - RNA, 14 nt, Human
uccaaagaaaugua

SEQ ID NO: 2744461 - RNA, 17 nt, Human
uccaaagaaauguaagg

SEQ ID NO: 2744462 - RNA, 16 nt, Human
ucauuaggauggcuag

SEQ ID NO: 2744463 - RNA, 16 nt, Human
uaggucagugcaaaua

SEQ ID NO: 2744464 - RNA, 18 nt, Human
uaggccaugggacaggga

SEQ ID NO: 2744465 - RNA, 16 nt, Human
uaggccaugggacagg

SEQ ID NO: 2744466 - RNA, 12 nt, Human
uaggaauugacc

SEQ ID NO: 2744467 - RNA, 15 nt, Human
uagugcaaauuguca

SEQ ID NO: 2744468 - RNA, 14 nt, Human
uagugcaaauuguc

SEQ ID NO: 2744469 - RNA, 14 nt, Human
uagucaaauugugu

SEQ ID NO: 2744470 - RNA, 13 nt, Human
uagucaaauugug

SEQ ID NO: 2744471 - RNA, 19 nt, Human
uaguauuuuuuguauaauu

SEQ ID NO: 2744472 - RNA, 22 nt, Human
uagugccacuuaauguauguua

SEQ ID NO: 2744473 - RNA, 16 nt, Human
uaguauuucuaugaaa

SEQ ID NO: 2744474 - RNA, 19 nt, Human
uaguauuucuaugaaauau

SEQ ID NO: 2744475 - RNA, 18 nt, Human
uaguauuucuaugaaaua

SEQ ID NO: 2744476 - RNA, 18 nt, Human
uaguauuuuuuguauaau

SEQ ID NO: 2744477 - RNA, 13 nt, Human
uaguaucaaaaga

SEQ ID NO: 2744478 - RNA, 22 nt, Human
uauaauuggauuuccuaauacu

SEQ ID NO: 2744479 - RNA, 19 nt, Human
uauaauuggauuuccuaau

SEQ ID NO: 2744480 - RNA, 20 nt, Human
uauaauuggauuuccuaaua

SEQ ID NO: 2744481 - RNA, 17 nt, Human
uauaauuggauuuccua

SEQ ID NO: 2744482 - RNA, 18 nt, Human
uauaauuggauuuccuaa

SEQ ID NO: 2744483 - RNA, 13 nt, Human
uauauaacaaugc

SEQ ID NO: 2744484 - RNA, 13 nt, Human
uauaugcuucugu

SEQ ID NO: 2744485 - RNA, 22 nt, Human
uauaguuacuguguaauuagug

SEQ ID NO: 2744486 - RNA, 18 nt, Human
uauaguuacuguguaauu

SEQ ID NO: 2744487 - RNA, 20 nt, Human
uauaguuacuguguaauuag

SEQ ID NO: 2744488 - RNA, 13 nt, Human
uauaguuacugug

SEQ ID NO: 2744489 - RNA, 15 nt, Human
uauaguuacugugua

SEQ ID NO: 2744490 - RNA, 16 nt, Human
uauaguuacuguguaa

SEQ ID NO: 2744491 - RNA, 16 nt, Human
uaugcuucuguuuuau

SEQ ID NO: 2744492 - RNA, 15 nt, Human
uaugcuucuguuuua

SEQ ID NO: 2744493 - RNA, 22 nt, Human
uaugauuacuggccuuuuucau

SEQ ID NO: 2744494 - RNA, 12 nt, Human
uaugauuauuaa

SEQ ID NO: 2744495 - RNA, 21 nt, Human
uaugauuauuaacgaugucca

SEQ ID NO: 2744496 - RNA, 16 nt, Human
uaugauucccagccag

SEQ ID NO: 2744497 - RNA, 15 nt, Human
uaugauuacuggccu

SEQ ID NO: 2744498 - RNA, 15 nt, Human
uaugcaaagcacuga

SEQ ID NO: 2744499 - RNA, 13 nt, Human
uaugcaaagcacu

SEQ ID NO: 2744500 - RNA, 14 nt, Human
uaugcaaagcacug

SEQ ID NO: 2744501 - RNA, 12 nt, Human
uaugcaaagcac

SEQ ID NO: 2744502 - RNA, 15 nt, Human
uaucugucagcugca

SEQ ID NO: 2744503 - RNA, 17 nt, Human
uaugaauuacauuugua

SEQ ID NO: 2744504 - RNA, 23 nt, Human
uaugaauuacauuuguauaaaau

SEQ ID NO: 2744505 - RNA, 22 nt, Human
uaucuaccccagacuagaugua

SEQ ID NO: 2744506 - RNA, 14 nt, Human
uauccuucagccug

SEQ ID NO: 2744507 - RNA, 15 nt, Human
uauccuucagccuga

SEQ ID NO: 2744508 - RNA, 15 nt, Human
uauuaacgaugucca

SEQ ID NO: 2744509 - RNA, 17 nt, Human
uauguucuaagaaguga

SEQ ID NO: 2744510 - RNA, 19 nt, Human
uauggaggcuuugcauaga

SEQ ID NO: 2744511 - RNA, 12 nt, Human
uauguuaaaacu

SEQ ID NO: 2744512 - RNA, 19 nt, Human
uauguuagugcaaauuguc

SEQ ID NO: 2744513 - RNA, 17 nt, Human
uauuauauuuacaaaug

SEQ ID NO: 2744514 - RNA, 14 nt, Human
uauuaucugucagc

SEQ ID NO: 2744515 - RNA, 13 nt, Human
uauuaucugucag

SEQ ID NO: 2744516 - RNA, 15 nt, Human
uauuauuguguguua

SEQ ID NO: 2744517 - RNA, 16 nt, Human
uauuauguuaaaacug

SEQ ID NO: 2744518 - RNA, 20 nt, Human
uauuguuuaaaaucauuucu

SEQ ID NO: 2744519 - RNA, 22 nt, Human
uauuuaaauauuaaauauguua

SEQ ID NO: 2744520 - RNA, 15 nt, Human
uauuucuaugaaaua

SEQ ID NO: 2744521 - RNA, 14 nt, Human
uauuucuaugaaau

SEQ ID NO: 2744522 - RNA, 13 nt, Human
uauuuauuacugu

SEQ ID NO: 2744523 - RNA, 13 nt, Human
uauuucuaugaaa

SEQ ID NO: 2744524 - RNA, 14 nt, Human
uauuuauuacugua

SEQ ID NO: 2744525 - RNA, 19 nt, Human
uauuguguguuauuuaaau

SEQ ID NO: 2744526 - RNA, 17 nt, Human
uauuguguguuauuuaa

SEQ ID NO: 2744527 - RNA, 15 nt, Human
uauuguuuaaaauca

SEQ ID NO: 2744528 - RNA, 16 nt, Human
uauuguuuaaaaucau

SEQ ID NO: 2744529 - RNA, 17 nt, Human
uauuguuuaaaaucauu

SEQ ID NO: 2744530 - RNA, 14 nt, Human
ucaauaaaauccau

SEQ ID NO: 2744531 - RNA, 22 nt, Human
ucacaagacccaaaaggcagaa

SEQ ID NO: 2744532 - RNA, 21 nt, Human
ucacacacaggcaacugaggc

SEQ ID NO: 2744533 - RNA, 20 nt, Human
ucacacacaggcaacugagg

SEQ ID NO: 2744534 - RNA, 12 nt, Human
ucacauuuaaau

SEQ ID NO: 2744535 - RNA, 16 nt, Human
ucaaggaauuucuuaa

SEQ ID NO: 2744536 - RNA, 19 nt, Human
ucaaggaauuucuuaacuu

SEQ ID NO: 2744537 - RNA, 21 nt, Human
ucaaggaauuucuuaacuucu

SEQ ID NO: 2744538 - RNA, 23 nt, Human
ucaaggaauuucuuaacuucuug

SEQ ID NO: 2744539 - RNA, 22 nt, Human
ucaacuccaaacugacucuuaa

SEQ ID NO: 2744540 - RNA, 16 nt, Human
ucaaauaugcaaagca

SEQ ID NO: 2744541 - RNA, 17 nt, Human
ucaaauaugcaaagcac

SEQ ID NO: 2744542 - RNA, 18 nt, Human
ucaaauaugcaaagcacu

SEQ ID NO: 2744543 - RNA, 19 nt, Human
ucaaauaugcaaagcacug

SEQ ID NO: 2744544 - RNA, 15 nt, Human
ucaaauccuugaaga

SEQ ID NO: 2744545 - RNA, 16 nt, Human
ucaaauccuugaagau

SEQ ID NO: 2744546 - RNA, 22 nt, Human
ucaaacagucucaggaaaucaa

SEQ ID NO: 2744547 - RNA, 17 nt, Human
ucaaacauauauaacaa

SEQ ID NO: 2744548 - RNA, 20 nt, Human
gugcucuuuucuccucacug

SEQ ID NO: 2744549 - RNA, 14 nt, Human
gugcucuuuucucc

SEQ ID NO: 2744550 - RNA, 16 nt, Human
gugcucuuuucuccuc

SEQ ID NO: 2744551 - RNA, 19 nt, Human
gugcugcccgucuucagcc

SEQ ID NO: 2744552 - RNA, 18 nt, Human
gugcugcccgucuucagc

SEQ ID NO: 2744553 - RNA, 21 nt, Human
gugcugcccgucuucagccua

SEQ ID NO: 2744554 - RNA, 15 nt, Human
gugcuguuuauuaau

SEQ ID NO: 2744555 - RNA, 19 nt, Human
gugcuguuuauuaaucuua

SEQ ID NO: 2744556 - RNA, 13 nt, Human
gugcuuggcccag

SEQ ID NO: 2744557 - RNA, 14 nt, Human
gugcuuggcccagg

SEQ ID NO: 2744558 - RNA, 15 nt, Human
gugcuuggcccagga

SEQ ID NO: 2744559 - RNA, 16 nt, Human
gugcuuggcccaggag

SEQ ID NO: 2744560 - RNA, 17 nt, Human
gugcuuggcccaggagu

SEQ ID NO: 2744561 - RNA, 19 nt, Human
gugcuuggcccaggaguuu

SEQ ID NO: 2744562 - RNA, 24 nt, Human
gugcuuggcccaggaguuuggcca

SEQ ID NO: 2744563 - RNA, 14 nt, Human
gugagcuacaaaug

SEQ ID NO: 2744564 - RNA, 16 nt, Human
gugagcagucaggaaa

SEQ ID NO: 2744565 - RNA, 22 nt, Human
gugaauuaggcuguaacuacuu

SEQ ID NO: 2744566 - RNA, 18 nt, Human
gugaauuaggcuguaacu

SEQ ID NO: 2744567 - RNA, 21 nt, Human
gugaauuaggcuguaacuacu

SEQ ID NO: 2744568 - RNA, 15 nt, Human
gucugccagccagca

SEQ ID NO: 2744569 - RNA, 14 nt, Human
gucugccagccagc

SEQ ID NO: 2744570 - RNA, 19 nt, Human
gugaaagaaaauaacaaua

SEQ ID NO: 2744571 - RNA, 20 nt, Human
gugaaacucguuaauuugua

SEQ ID NO: 2744572 - RNA, 18 nt, Human
gugcaaauugucacagga

SEQ ID NO: 2744573 - RNA, 15 nt, Human
gucccugguaauaag

SEQ ID NO: 2744574 - RNA, 22 nt, Human
guccuggggccucggagccuca

SEQ ID NO: 2744575 - RNA, 14 nt, Human
guccuggggccucg

SEQ ID NO: 2744576 - RNA, 18 nt, Human
guccugucggagcccugu

SEQ ID NO: 2744577 - RNA, 20 nt, Human
guccugucggagcccugucu

SEQ ID NO: 2744578 - RNA, 21 nt, Human
guccugucggagcccugucuc

SEQ ID NO: 2744579 - RNA, 17 nt, Human
gucuacacuaagagaga

SEQ ID NO: 2744580 - RNA, 23 nt, Human
gucuacacuaagagagaaugaga

SEQ ID NO: 2744581 - RNA, 19 nt, Human
gucauccucaaagaaagug

SEQ ID NO: 2744582 - RNA, 22 nt, Human
gucauccucaaagaaaguguau

SEQ ID NO: 2744583 - RNA, 22 nt, Human
gucaucuugcuaccaguauuua

SEQ ID NO: 2744584 - RNA, 12 nt, Human
gucaucuugcua

SEQ ID NO: 2744585 - RNA, 14 nt, Human
gucaucuugcuacc

SEQ ID NO: 2744586 - RNA, 15 nt, Human
gucaucuugcuacca

SEQ ID NO: 2744587 - RNA, 18 nt, Human
gucaucuugcuaccagua

SEQ ID NO: 2744588 - RNA, 16 nt, Human
guccagggcccugagc

SEQ ID NO: 2744589 - RNA, 15 nt, Human
guccagggcccugag

SEQ ID NO: 2744590 - RNA, 14 nt, Human
guccagggcccuga

SEQ ID NO: 2744591 - RNA, 20 nt, Human
gucccagccagcaguucaga

SEQ ID NO: 2744592 - RNA, 21 nt, Human
gucaauaaaauccauacauuu

SEQ ID NO: 2744593 - RNA, 15 nt, Human
gucaauaaaauccau

SEQ ID NO: 2744594 - RNA, 14 nt, Human
gucaccucauggaa

SEQ ID NO: 2744595 - RNA, 13 nt, Human
gucaaggcuuaga

SEQ ID NO: 2744596 - RNA, 14 nt, Human
gucaaggcuuagac

SEQ ID NO: 2744597 - RNA, 17 nt, Human
guauuuuaaaagaauga

SEQ ID NO: 2744598 - RNA, 16 nt, Human
guauuuuaaaagaaug

SEQ ID NO: 2744599 - RNA, 21 nt, Human
guauuuggaaauaaagucaga

SEQ ID NO: 2744600 - RNA, 19 nt, Human
guauuuggaaauaaaguca

SEQ ID NO: 2744601 - RNA, 20 nt, Human
guauuuggaaauaaagucag

SEQ ID NO: 2744602 - RNA, 17 nt, Human
guauuucuaugaaauau

SEQ ID NO: 2744603 - RNA, 22 nt, Human
guauuucuaugaaauauuaugu

SEQ ID NO: 2744604 - RNA, 17 nt, Human
ggggcagaacagccgcu

SEQ ID NO: 2744605 - RNA, 23 nt, Human
ggguaccuugaacacugggggag

SEQ ID NO: 2744606 - RNA, 22 nt, Human
ggugccccccuugccagacaug

SEQ ID NO: 2744607 - RNA, 19 nt, Human
ggugcuacaaaaacacagc

SEQ ID NO: 2744608 - RNA, 21 nt, Human
ggguagccacuggacugacga

SEQ ID NO: 2744609 - RNA, 22 nt, Human
gguacuucaaauccuugaagau

SEQ ID NO: 2744610 - RNA, 12 nt, Human
gguaccuugaac

SEQ ID NO: 2744611 - RNA, 18 nt, Human
gguaccuugaacacuggg

SEQ ID NO: 2744612 - RNA, 22 nt, Human
gguagacacacaugaaguccaa

SEQ ID NO: 2744613 - RNA, 15 nt, Human
gguagacacacauga

SEQ ID NO: 2744614 - RNA, 16 nt, Human
gguucagagacucagg

SEQ ID NO: 2744615 - RNA, 18 nt, Human
gguuuaaagaaaguguau

SEQ ID NO: 2744616 - RNA, 23 nt, Human
guaaaaccacagcaguugaaaag

SEQ ID NO: 2744617 - RNA, 14 nt, Human
guaaaaccacagca

SEQ ID NO: 2744618 - RNA, 15 nt, Human
guaaaaccacagcag

SEQ ID NO: 2744619 - RNA, 16 nt, Human
guaaaaccacagcagu

SEQ ID NO: 2744620 - RNA, 18 nt, Human
guaaaaccacagcaguug

SEQ ID NO: 2744621 - RNA, 14 nt, Human
guaaauaggaauug

SEQ ID NO: 2744622 - RNA, 14 nt, Human
guaacuuuugugaa

SEQ ID NO: 2744623 - RNA, 17 nt, Human
guaagggaaacugccag

SEQ ID NO: 2744624 - RNA, 18 nt, Human
guaagggaaacugccagc

SEQ ID NO: 2744625 - RNA, 23 nt, Human
guacuuuauuuucuauaauuuaa

SEQ ID NO: 2744626 - RNA, 15 nt, Human
guagaggagaaacug

SEQ ID NO: 2744627 - RNA, 23 nt, Human
guaccuugaacacugggggaggg

SEQ ID NO: 2744628 - RNA, 18 nt, Human
guaccuugaacacugggg

SEQ ID NO: 2744629 - RNA, 14 nt, Human
guaccuugaacacu

SEQ ID NO: 2744630 - RNA, 15 nt, Human
guaccgcaaugugac

SEQ ID NO: 2744631 - RNA, 20 nt, Human
guacagaauucugcuaccuc

SEQ ID NO: 2744632 - RNA, 20 nt, Human
guaauuagugccacuuaaug

SEQ ID NO: 2744633 - RNA, 21 nt, Human
guaauuagugccacuuaaugu

SEQ ID NO: 2744634 - RNA, 15 nt, Human
guaauuggaaaggca

SEQ ID NO: 2744635 - RNA, 19 nt, Human
guaaugauaacuggaaacu

SEQ ID NO: 2744636 - RNA, 14 nt, Human
gcugccaauauccu

SEQ ID NO: 2744637 - RNA, 15 nt, Human
gcugccaauauccua

SEQ ID NO: 2744638 - RNA, 16 nt, Human
gcugccaauauccuaa

SEQ ID NO: 2744639 - RNA, 17 nt, Human
gcugccaauauccuaau

SEQ ID NO: 2744640 - RNA, 18 nt, Human
gcugccaauauccuaaua

SEQ ID NO: 2744641 - RNA, 19 nt, Human
gcugccaauauccuaauaa

SEQ ID NO: 2744642 - RNA, 20 nt, Human
gcucucuggccuucggccuc

SEQ ID NO: 2744643 - RNA, 19 nt, Human
gcucucuggccuucggccu

SEQ ID NO: 2744644 - RNA, 15 nt, Human
gcucucuggccuucg

SEQ ID NO: 2744645 - RNA, 14 nt, Human
gcucucuggccuuc

SEQ ID NO: 2744646 - RNA, 11 nt, Human
gcucucuggcc

SEQ ID NO: 2744647 - RNA, 13 nt, Human
gcucucuggccuu

SEQ ID NO: 2744648 - RNA, 12 nt, Human
gcucucuggccu

SEQ ID NO: 2744649 - RNA, 11 nt, Human
gcucagccugg

SEQ ID NO: 2744650 - RNA, 20 nt, Human
gcucagccuggugggccucc

SEQ ID NO: 2744651 - RNA, 19 nt, Human
gcucagccuggugggccuc

SEQ ID NO: 2744652 - RNA, 18 nt, Human
gcucagccuggugggccu

SEQ ID NO: 2744653 - RNA, 17 nt, Human
gcucagccuggugggcc

SEQ ID NO: 2744654 - RNA, 15 nt, Human
gcucagccugguggg

SEQ ID NO: 2744655 - RNA, 14 nt, Human
gcucagccuggugg

SEQ ID NO: 2744656 - RNA, 17 nt, Human
gcuaagcaaaaugugau

SEQ ID NO: 2744657 - RNA, 14 nt, Human
gcuaagcauuccaa

SEQ ID NO: 2744658 - RNA, 23 nt, Human
gcccucuccugggcagcugccuc

SEQ ID NO: 2744659 - RNA, 22 nt, Human
gcccucuccugggcagcugccu

SEQ ID NO: 2744660 - RNA, 13 nt, Human
gcccucuccuggg

SEQ ID NO: 2744661 - RNA, 12 nt, Human
gcccucuccugg

SEQ ID NO: 2744662 - RNA, 17 nt, Human
gccucauccgaggcagg

SEQ ID NO: 2744663 - RNA, 16 nt, Human
gccucauccgaggcag

SEQ ID NO: 2744664 - RNA, 19 nt, Human
gccucauccgaggcagggu

SEQ ID NO: 2744665 - RNA, 18 nt, Human
gccucauccgaggcaggg

SEQ ID NO: 2744666 - RNA, 23 nt, Human
gccucggagccucauccgaggca

SEQ ID NO: 2744667 - RNA, 17 nt, Human
gccucggagccucaucc

SEQ ID NO: 2744668 - RNA, 15 nt, Human
gccucggagccucau

SEQ ID NO: 2744669 - RNA, 14 nt, Human
gccucggagccuca

SEQ ID NO: 2744670 - RNA, 17 nt, Human
gccuaagugcagccccg

SEQ ID NO: 2744671 - RNA, 22 nt, Human
gccuauauuuuuuguuaaauga

SEQ ID NO: 2744672 - RNA, 23 nt, Human
gcuuagaccucagccugugcugc

SEQ ID NO: 2744673 - RNA, 19 nt, Human
gcuuagaccucagccugug

SEQ ID NO: 2744674 - RNA, 18 nt, Human
gcuuagaccucagccugu

SEQ ID NO: 2744675 - RNA, 20 nt, Human
gcugccaauauccuaauaaa

SEQ ID NO: 2744676 - RNA, 21 nt, Human
gcugccaauauccuaauaaaa

SEQ ID NO: 2744677 - RNA, 20 nt, Human
gcugucuacacuaagagaga

SEQ ID NO: 2744678 - RNA, 23 nt, Human
gcugccaauauccuaauaaaaag

SEQ ID NO: 2744679 - RNA, 16 nt, Human
ggaaaucaaauaugca

SEQ ID NO: 2744680 - RNA, 17 nt, Human
ggaaaucaaauaugcaa

SEQ ID NO: 2744681 - RNA, 15 nt, Human
ggaaaauucauuuuu

SEQ ID NO: 2744682 - RNA, 14 nt, Human
ggaaaauucauuuu

SEQ ID NO: 2744683 - RNA, 23 nt, Human
ggaaagggauuuucagcccucag

SEQ ID NO: 2744684 - RNA, 20 nt, Human
ggaagugacgguuuaauggg

SEQ ID NO: 2744685 - RNA, 22 nt, Human
ggaauuggagcucgugggacag

SEQ ID NO: 2744686 - RNA, 16 nt, Human
ggaauuggagcucgug

SEQ ID NO: 2744687 - RNA, 23 nt, Human
ggaauuucucccagucauuuaau

SEQ ID NO: 2744688 - RNA, 18 nt, Human
ggaauuucuuaacuucuu

SEQ ID NO: 2744689 - RNA, 22 nt, Human
ggaauuucuuaacuucuugcuu

SEQ ID NO: 2744690 - RNA, 19 nt, Human
ggagaaucacuugaacccg

SEQ ID NO: 2744691 - RNA, 15 nt, Human
ggagaaucacuugaa

SEQ ID NO: 2744692 - RNA, 14 nt, Human
ggacgcucucuggc

SEQ ID NO: 2744693 - RNA, 13 nt, Human
ggacgcucucugg

SEQ ID NO: 2744694 - RNA, 21 nt, Human
ggcccugagcucgguggaccc

SEQ ID NO: 2744695 - RNA, 19 nt, Human
ggcccugagcucgguggac

SEQ ID NO: 2744696 - RNA, 14 nt, Human
ggcccugagcucgg

SEQ ID NO: 2744697 - RNA, 22 nt, Human
ggccucggagccucauccgagg

SEQ ID NO: 2744698 - RNA, 19 nt, Human
ggccucggagccucauccg

SEQ ID NO: 2744699 - RNA, 15 nt, Human
ggccucggagccuca

SEQ ID NO: 2744700 - RNA, 13 nt, Human
ggccucggagccu

SEQ ID NO: 2744701 - RNA, 14 nt, Human
ggcauggcugggaa

SEQ ID NO: 2744702 - RNA, 12 nt, Human
ggauuggggaag

SEQ ID NO: 2744703 - RNA, 15 nt, Human
ggauuguaaaauggu

SEQ ID NO: 2744704 - RNA, 19 nt, Human
ggauuggggaagacugugg

SEQ ID NO: 2744705 - RNA, 18 nt, Human
ggauuggggaagacugug

SEQ ID NO: 2744706 - RNA, 20 nt, Human
gauuggggaagacuguggcu

SEQ ID NO: 2744707 - RNA, 13 nt, Human
gauuuccuaauac

SEQ ID NO: 2744708 - RNA, 16 nt, Human
gcaaauugucacagga

SEQ ID NO: 2744709 - RNA, 18 nt, Human
gaugcuagaacucccuuu

SEQ ID NO: 2744710 - RNA, 22 nt, Human
gaugcuagaacucccuuucaac

SEQ ID NO: 2744711 - RNA, 20 nt, Human
gaugcuagaacucccuuuca

SEQ ID NO: 2744712 - RNA, 13 nt, Human
gcacacugucugc

SEQ ID NO: 2744713 - RNA, 12 nt, Human
gcacacuguagc

SEQ ID NO: 2744714 - RNA, 21 nt, Human
gcagacagcagcucaggcaca

SEQ ID NO: 2744715 - RNA, 20 nt, Human
gcagacagcagcucaggcac

SEQ ID NO: 2744716 - RNA, 19 nt, Human
gcagacagcagcucaggca

SEQ ID NO: 2744717 - RNA, 18 nt, Human
gcagacagcagcucaggc

SEQ ID NO: 2744718 - RNA, 17 nt, Human
gcagacagcagcucagg

SEQ ID NO: 2744719 - RNA, 16 nt, Human
gcagacagcagcucag

SEQ ID NO: 2744720 - RNA, 14 nt, Human
gcagacagcagcuc

SEQ ID NO: 2744721 - RNA, 13 nt, Human
gcagacagcagcu

SEQ ID NO: 2744722 - RNA, 18 nt, Human
gcacugacuucuaaguaa

SEQ ID NO: 2744723 - RNA, 15 nt, Human
gcacugacuucuaag

SEQ ID NO: 2744724 - RNA, 16 nt, Human
gaguaauuuauuguuu

SEQ ID NO: 2744725 - RNA, 14 nt, Human
gaguaauuuauugu

SEQ ID NO: 2744726 - RNA, 13 nt, Human
gaguuacaguucu

SEQ ID NO: 2744727 - RNA, 14 nt, Human
gaguuacaguucug

SEQ ID NO: 2744728 - RNA, 15 nt, Human
gaguuacaguucugu

SEQ ID NO: 2744729 - RNA, 16 nt, Human
gaguuacaguucugug

SEQ ID NO: 2744730 - RNA, 22 nt, Human
gauaaauggcuuccuggcaaua

SEQ ID NO: 2744731 - RNA, 15 nt, Human
gaggguuagggaggg

SEQ ID NO: 2744732 - RNA, 22 nt, Human
gaggcagacagcagcucaggca

SEQ ID NO: 2744733 - RNA, 21 nt, Human
gaggcagacagcagcucaggc

SEQ ID NO: 2744734 - RNA, 20 nt, Human
gaggcagacagcagcucagg

SEQ ID NO: 2744735 - RNA, 19 nt, Human
gaggcagacagcagcucag

SEQ ID NO: 2744736 - RNA, 12 nt, Human
gagcccugucuc

SEQ ID NO: 2744737 - RNA, 13 nt, Human
gagccaccaguuc

SEQ ID NO: 2744738 - RNA, 19 nt, Human
gagccaaggguucagagac

SEQ ID NO: 2744739 - RNA, 23 nt, Human
gagccaaggguucagagacucag

SEQ ID NO: 2744740 - RNA, 12 nt, Human
gagccaccaguu

SEQ ID NO: 2744741 - RNA, 21 nt, Human
gagaaugagagacacacugaa

SEQ ID NO: 2744742 - RNA, 20 nt, Human
gagaaugagagacacacuga

SEQ ID NO: 2744743 - RNA, 20 nt, Human
gagacagcucugcauacuca

SEQ ID NO: 2744744 - RNA, 16 nt, Human
gagacaggaccugacu

SEQ ID NO: 2744745 - RNA, 22 nt, Human
gagaaccuagggugauauuaac

SEQ ID NO: 2744746 - RNA, 21 nt, Human
gagaaccuagggugauauuaa

SEQ ID NO: 2744747 - RNA, 23 nt, Human
gagaacuuccagauccuggaaau

SEQ ID NO: 2744748 - RNA, 22 nt, Human
gagaacuuccagauccuggaaa

SEQ ID NO: 2744749 - RNA, 17 nt, Human
gagaaugagagacacac

SEQ ID NO: 2744750 - RNA, 20 nt, Human
gacuuaagcaucuggcucua

SEQ ID NO: 2744751 - RNA, 22 nt, Human
gacuuaagcaucuggcucuaau

SEQ ID NO: 2744752 - RNA, 16 nt, Human
gacuucuaaguaaaac

SEQ ID NO: 2744753 - RNA, 17 nt, Human
gacuucuaaguaaaacc

SEQ ID NO: 2744754 - RNA, 18 nt, Human
gacuucuaaguaaaacca

SEQ ID NO: 2744755 - RNA, 20 nt, Human
gacuucugucuucacaacag

SEQ ID NO: 2744756 - RNA, 23 nt, Human
gacuucugucuucacaacagauu

SEQ ID NO: 2744757 - RNA, 19 nt, Human
gacuucuaaguaaaaccac

SEQ ID NO: 2744758 - RNA, 23 nt, Human
gacuucuaaguaaaaccacagca

SEQ ID NO: 2744759 - RNA, 24 nt, Human
gacuucuaaguaaaaccacagcag

SEQ ID NO: 2744760 - RNA, 17 nt, Human
gacuagauguaguauuu

SEQ ID NO: 2744761 - RNA, 18 nt, Human
gacuagauguaguauuuu

SEQ ID NO: 2744762 - RNA, 16 nt, Human
gacuccaaagaaaugu

SEQ ID NO: 2744763 - RNA, 21 nt, Human
gacucauuuuaaaaaauggaa

SEQ ID NO: 2744764 - RNA, 11 nt, Human
gacuccaaaga

SEQ ID NO: 2744765 - RNA, 12 nt, Human
gacuccaaagaa

SEQ ID NO: 2744766 - RNA, 15 nt, Human
gacuccaaagaaaug

SEQ ID NO: 2744767 - RNA, 16 nt, Human
gacugcauuauauuua

SEQ ID NO: 2744768 - RNA, 14 nt, Human
gacugcauuauauu

SEQ ID NO: 2744769 - RNA, 16 nt, Human
gacuggauaguccguc

SEQ ID NO: 2744770 - RNA, 20 nt, Human
gacaccaggagucccuggua

SEQ ID NO: 2744771 - RNA, 19 nt, Human
gacaccaggagucccuggu

SEQ ID NO: 2744772 - RNA, 19 nt, Human
gacagagccccacccucag

SEQ ID NO: 2744773 - RNA, 20 nt, Human
gacauagaauuaacacauga

SEQ ID NO: 2744774 - RNA, 17 nt, Human
gacagggaggacgcucu

SEQ ID NO: 2744775 - RNA, 19 nt, Human
gacagggacccacuucaca

SEQ ID NO: 2744776 - RNA, 13 nt, Human
gacagggacccac

SEQ ID NO: 2744777 - RNA, 18 nt, Human
gacagggaggacgcucuc

SEQ ID NO: 2744778 - RNA, 16 nt, Human
gacaugggacauuugc

SEQ ID NO: 2744779 - RNA, 21 nt, Human
gaccacugcagaagacaguau

SEQ ID NO: 2744780 - RNA, 15 nt, Human
gacccacaagaaaug

SEQ ID NO: 2744781 - RNA, 16 nt, Human
gacccaaaaggcagaa

SEQ ID NO: 2744782 - RNA, 16 nt, Human
gacaaggaaaaaauaa

SEQ ID NO: 2744783 - RNA, 13 nt, Human
gaauuucuuaacu

SEQ ID NO: 2744784 - RNA, 14 nt, Human
gaauuucuuaacuu

SEQ ID NO: 2744785 - RNA, 15 nt, Human
gaauuucuuaacuuc

SEQ ID NO: 2744786 - RNA, 16 nt, Human
gaauuucuuaacuucu

SEQ ID NO: 2744787 - RNA, 17 nt, Human
gaauuucuuaacuucuu

SEQ ID NO: 2744788 - RNA, 18 nt, Human
gaauuucuuaacuucuug

SEQ ID NO: 2744789 - RNA, 19 nt, Human
gaauuucuuaacuucuugc

SEQ ID NO: 2744790 - RNA, 21 nt, Human
gaauuucuuaacuucuugcuu

SEQ ID NO: 2744791 - RNA, 15 nt, Human
gacaagcucacagac

SEQ ID NO: 2744792 - RNA, 16 nt, Human
gaauuggagcucgugg

SEQ ID NO: 2744793 - RNA, 21 nt, Human
gaauugacccacaagaaauga

SEQ ID NO: 2744794 - RNA, 16 nt, Human
gaauugacccacaaga

SEQ ID NO: 2744795 - RNA, 14 nt, Human
cugucucaccugga

SEQ ID NO: 2744796 - RNA, 17 nt, Human
cugucucaccuggacuu

SEQ ID NO: 2744797 - RNA, 12 nt, Human
cugucucaccug

SEQ ID NO: 2744798 - RNA, 17 nt, Human
cuguggcagaguuacag

SEQ ID NO: 2744799 - RNA, 18 nt, Human
cuguggcagaguuacagu

SEQ ID NO: 2744800 - RNA, 23 nt, Human
cuguggcagaguuacaguucugu

SEQ ID NO: 2744801 - RNA, 19 nt, Human
cuguggcagaguuacaguu

SEQ ID NO: 2744802 - RNA, 22 nt, Human
cuguggcagaguuacaguucug

SEQ ID NO: 2744803 - RNA, 17 nt, Human
cuguggcugcuagcacu

SEQ ID NO: 2744804 - RNA, 21 nt, Human
cuguuaaaagaugaaaauauu

SEQ ID NO: 2744805 - RNA, 23 nt, Human
cuguuaaaagaugaaaauauuug

SEQ ID NO: 2744806 - RNA, 20 nt, Human
cuguuaaaagaugaaaauau

SEQ ID NO: 2744807 - RNA, 18 nt, Human
cugggguccuggggccuc

SEQ ID NO: 2744808 - RNA, 15 nt, Human
cugggguccuggggc

SEQ ID NO: 2744809 - RNA, 19 nt, Human
cugggguccuggggccucg

SEQ ID NO: 2744810 - RNA, 22 nt, Human
cugggggggauuguaaaauggu

SEQ ID NO: 2744811 - RNA, 23 nt, Human
cuguaaucacagcuacuugggag

SEQ ID NO: 2744812 - RNA, 18 nt, Human
cuguccagggcccugagc

SEQ ID NO: 2744813 - RNA, 23 nt, Human
cuguccagggcccugagcucggu

SEQ ID NO: 2744814 - RNA, 22 nt, Human
cuguccagggcccugagcucgg

SEQ ID NO: 2744815 - RNA, 20 nt, Human
cuguccagggcccugagcuc

SEQ ID NO: 2744816 - RNA, 19 nt, Human
cuguccagggcccugagcu

SEQ ID NO: 2744817 - RNA, 20 nt, Human
cugucuacacuaagagagaa

SEQ ID NO: 2744818 - RNA, 23 nt, Human
cuguauccagguucccucccaga

SEQ ID NO: 2744819 - RNA, 22 nt, Human
cuguauuuuaaaagaaugauua

SEQ ID NO: 2744820 - RNA, 19 nt, Human
cuguauuuuaaaagaauga

SEQ ID NO: 2744821 - RNA, 20 nt, Human
cuguauuuuaaaagaaugau

SEQ ID NO: 2744822 - RNA, 16 nt, Human
cuggagcucugcccau

SEQ ID NO: 2744823 - RNA, 13 nt, Human
cuggagcucugcc

SEQ ID NO: 2744824 - RNA, 12 nt, Human
cuggagcucugc

SEQ ID NO: 2744825 - RNA, 23 nt, Human
cuggccuucggccuccauccuga

SEQ ID NO: 2744826 - RNA, 22 nt, Human
cuggccuucggccuccauccug

SEQ ID NO: 2744827 - RNA, 21 nt, Human
cuggcacaguuuucugagaaa

SEQ ID NO: 2744828 - RNA, 22 nt, Human
cuggcacaguuuucugagaaag

SEQ ID NO: 2744829 - RNA, 20 nt, Human
cuggcacaguuuucugagaa

SEQ ID NO: 2744830 - RNA, 18 nt, Human
cugcugaaacaacaaaua

SEQ ID NO: 2744831 - RNA, 13 nt, Human
cugccuccccucc

SEQ ID NO: 2744832 - RNA, 21 nt, Human
cugcccuagagcacacuguag

SEQ ID NO: 2744833 - RNA, 19 nt, Human
cugcccuagagcacacugu

SEQ ID NO: 2744834 - RNA, 15 nt, Human
cugcccuagagcaca

SEQ ID NO: 2744835 - RNA, 19 nt, Human
cugcccucuccugggcagc

SEQ ID NO: 2744836 - RNA, 18 nt, Human
cugcccucuccugggcag

SEQ ID NO: 2744837 - RNA, 16 nt, Human
cugcccucuccugggc

SEQ ID NO: 2744838 - RNA, 21 nt, Human
cugcccucuccugggcagcug

SEQ ID NO: 2744839 - RNA, 20 nt, Human
cugcccucuccugggcagcu

SEQ ID NO: 2744840 - RNA, 16 nt, Human
cuugaacacuggggga

SEQ ID NO: 2744841 - RNA, 15 nt, Human
cuugaacacuggggg

SEQ ID NO: 2744842 - RNA, 13 nt, Human
cuugaacacuggg

SEQ ID NO: 2744843 - RNA, 20 nt, Human
cuucuuggucuuauuuauua

SEQ ID NO: 2744844 - RNA, 16 nt, Human
cuucuuggucuuauuu

SEQ ID NO: 2744845 - RNA, 20 nt, Human
cuucuugcuucuuucuagaa

SEQ ID NO: 2744846 - RNA, 21 nt, Human
cuucuugcuucuuucuagaaa

SEQ ID NO: 2744847 - RNA, 14 nt, Human
cuucucuccagcug

SEQ ID NO: 2744848 - RNA, 15 nt, Human
cuucucuccagcuga

SEQ ID NO: 2744849 - RNA, 16 nt, Human
cuucucuccagcugac

SEQ ID NO: 2744850 - RNA, 19 nt, Human
cuucucuccagcugacuaa

SEQ ID NO: 2744851 - RNA, 17 nt, Human
cuucucuccagcugacu

SEQ ID NO: 2744852 - RNA, 18 nt, Human
cuucucuccagcugacua

SEQ ID NO: 2744853 - RNA, 21 nt, Human
cuucugucuucacaacagauu

SEQ ID NO: 2744854 - RNA, 22 nt, Human
cuucugucuucacaacagauua

SEQ ID NO: 2744855 - RNA, 18 nt, Human
cuucugucuucacaacag

SEQ ID NO: 2744856 - RNA, 11 nt, Human
cuuaguguaug

SEQ ID NO: 2744857 - RNA, 15 nt, Human
cuuaguguaugauua

SEQ ID NO: 2744858 - RNA, 22 nt, Human
cuuagaugcaguucugaagaag

SEQ ID NO: 2744859 - RNA, 20 nt, Human
cuuagaugcaguucugaaga

SEQ ID NO: 2744860 - RNA, 22 nt, Human
cuucacacacaggcaacugagg

SEQ ID NO: 2744861 - RNA, 21 nt, Human
cuucacacacaggcaacugag

SEQ ID NO: 2744862 - RNA, 15 nt, Human
cuuauuucauuucuu

SEQ ID NO: 2744863 - RNA, 15 nt, Human
cuuauuuccucauuu

SEQ ID NO: 2744864 - RNA, 13 nt, Human
cuuauuuauuauu

SEQ ID NO: 2744865 - RNA, 14 nt, Human
cuuauuucauuucu

SEQ ID NO: 2744866 - RNA, 23 nt, Human
cuugucaauaaaauccauacauu

SEQ ID NO: 2744867 - RNA, 19 nt, Human
cuugaguuuaaauuguaau

SEQ ID NO: 2744868 - RNA, 18 nt, Human
gaaaauauuuguaucaca

SEQ ID NO: 2744869 - RNA, 22 nt, Human
gaaaaucuacacuccagugaga

SEQ ID NO: 2744870 - RNA, 18 nt, Human
gaaaaucuuauaauuuaa

SEQ ID NO: 2744871 - RNA, 14 nt, Human
gaaagcagggacuu

SEQ ID NO: 2744872 - RNA, 17 nt, Human
gaaagcagaacagugau

SEQ ID NO: 2744873 - RNA, 22 nt, Human
gaaagcagaacagugauuacca

SEQ ID NO: 2744874 - RNA, 20 nt, Human
gaaagaggcagcuugaaacu

SEQ ID NO: 2744875 - RNA, 21 nt, Human
gaaagaggaaugaaguacuca

SEQ ID NO: 2744876 - RNA, 18 nt, Human
gaaagagaaacaguuggu

SEQ ID NO: 2744877 - RNA, 17 nt, Human
gaaagagaacuuccaga

SEQ ID NO: 2744878 - RNA, 14 nt, Human
gaaacccugucucu

SEQ ID NO: 2744879 - RNA, 23 nt, Human
gaaacucguuaauuuguaguguu

SEQ ID NO: 2744880 - RNA, 11 nt, Human
gaaacauuugg

SEQ ID NO: 2744881 - RNA, 16 nt, Human
gaaacacaacuauauu

SEQ ID NO: 2744882 - RNA, 22 nt, Human
ccugagcucgguggacccaggg

SEQ ID NO: 2744883 - RNA, 21 nt, Human
ccugagcucgguggacccagg

SEQ ID NO: 2744884 - RNA, 20 nt, Human
ccugagcucgguggacccag

SEQ ID NO: 2744885 - RNA, 19 nt, Human
ccugagcucgguggaccca

SEQ ID NO: 2744886 - RNA, 18 nt, Human
ccugagcucgguggaccc

SEQ ID NO: 2744887 - RNA, 16 nt, Human
ccugagcucgguggac

SEQ ID NO: 2744888 - RNA, 15 nt, Human
ccugagcucggugga

SEQ ID NO: 2744889 - RNA, 14 nt, Human
ccugaggcuccacu

SEQ ID NO: 2744890 - RNA, 13 nt, Human
ccugaggcuccac

SEQ ID NO: 2744891 - RNA, 18 nt, Human
ccugcccuagagcacacu

SEQ ID NO: 2744892 - RNA, 24 nt, Human
ccugcccuagagcacacuguagca

SEQ ID NO: 2744893 - RNA, 22 nt, Human
ccugcccuagagcacacuguag

SEQ ID NO: 2744894 - RNA, 19 nt, Human
ccugcccuagagcacacug

SEQ ID NO: 2744895 - RNA, 17 nt, Human
ccugccccugagcccau

SEQ ID NO: 2744896 - RNA, 14 nt, Human
ccugggcagcugcc

SEQ ID NO: 2744897 - RNA, 13 nt, Human
ccugggcagcugc

SEQ ID NO: 2744898 - RNA, 22 nt, Human
cgaggcagggucaggagagggg

SEQ ID NO: 2744899 - RNA, 14 nt, Human
cgaggcagggucag

SEQ ID NO: 2744900 - RNA, 23 nt, Human
cgggaaggaggguuagggagggg

SEQ ID NO: 2744901 - RNA, 14 nt, Human
cgggaaggaggguu

SEQ ID NO: 2744902 - RNA, 12 nt, Human
cgggaaggaggg

SEQ ID NO: 2744903 - RNA, 14 nt, Human
cgcuccugucugcc

SEQ ID NO: 2744904 - RNA, 21 nt, Human
ccuuguauuuaaauauuaaau

SEQ ID NO: 2744905 - RNA, 16 nt, Human
ccuuguauuuaaauau

SEQ ID NO: 2744906 - RNA, 14 nt, Human
ccuuguauuuaaau

SEQ ID NO: 2744907 - RNA, 13 nt, Human
ccuuguauuuaaa

SEQ ID NO: 2744908 - RNA, 15 nt, Human
ccuuggacucauuuu

SEQ ID NO: 2744909 - RNA, 17 nt, Human
ccuucggccuccauccu

SEQ ID NO: 2744910 - RNA, 16 nt, Human
ccuucggccuccaucc

SEQ ID NO: 2744911 - RNA, 18 nt, Human
ccuucggccuccauccug

SEQ ID NO: 2744912 - RNA, 12 nt, Human
cuaacagcccuc

SEQ ID NO: 2744913 - RNA, 21 nt, Human
cuaacagcccuccucugcacu

SEQ ID NO: 2744914 - RNA, 22 nt, Human
cuaacagcccuccucugcacuc

SEQ ID NO: 2744915 - RNA, 19 nt, Human
cuaaauugacacuuaaaaa

SEQ ID NO: 2744916 - RNA, 15 nt, Human
cuaagagagaaugag

SEQ ID NO: 2744917 - RNA, 14 nt, Human
cuaagagagaauga

SEQ ID NO: 2744918 - RNA, 20 nt, Human
cgggaggcagagguugcagu

SEQ ID NO: 2744919 - RNA, 20 nt, Human
cuaauucaaggaauuucuua

SEQ ID NO: 2744920 - RNA, 16 nt, Human
cuaauucaaggaauuu

SEQ ID NO: 2744921 - RNA, 18 nt, Human
cuaauucaaggaauuucu

SEQ ID NO: 2744922 - RNA, 22 nt, Human
cuaauucacagugcucuuuucu

SEQ ID NO: 2744923 - RNA, 15 nt, Human
cuaauucacagugcu

SEQ ID NO: 2744924 - RNA, 16 nt, Human
cuaauucacagugcuc

SEQ ID NO: 2744925 - RNA, 14 nt, Human
cuacacuaagagag

SEQ ID NO: 2744926 - RNA, 23 nt, Human
cuacacgagauacagaauuuuau

SEQ ID NO: 2744927 - RNA, 22 nt, Human
cuacaccccuccccugcccuag

SEQ ID NO: 2744928 - RNA, 19 nt, Human
cuaagauuacaaaucagaa

SEQ ID NO: 2744929 - RNA, 21 nt, Human
cuaagauuacaaaucagaagu

SEQ ID NO: 2744930 - RNA, 22 nt, Human
cuaagauuacaaaucagaaguc

SEQ ID NO: 2744931 - RNA, 23 nt, Human
cuaagauuacaaaucagaaguca

SEQ ID NO: 2744932 - RNA, 21 nt, Human
cuaagcuucacuguaaaauaa

SEQ ID NO: 2744933 - RNA, 20 nt, Human
cuaauagaauaaaggcaguu

SEQ ID NO: 2744934 - RNA, 21 nt, Human
cuaauagaauaaaggcaguuu

SEQ ID NO: 2744935 - RNA, 23 nt, Human
cuaauagaauaaaggcaguuuuc

SEQ ID NO: 2744936 - RNA, 14 nt, Human
cuaaguaaaaccac

SEQ ID NO: 2744937 - RNA, 18 nt, Human
cuaaguaaaaccacagca

SEQ ID NO: 2744938 - RNA, 19 nt, Human
cuaaguaaaaccacagcag

SEQ ID NO: 2744939 - RNA, 20 nt, Human
cuaggaaauauuuauuuuaa

SEQ ID NO: 2744940 - RNA, 19 nt, Human
cuaggaaauauuuauuuua

SEQ ID NO: 2744941 - RNA, 15 nt, Human
cuaggaaauauuuau

SEQ ID NO: 2744942 - RNA, 14 nt, Human
cuaggaaauauuua

SEQ ID NO: 2744943 - RNA, 17 nt, Human
cuaccucacuggggucc

SEQ ID NO: 2744944 - RNA, 19 nt, Human
cuagaguuuagcuggaaaa

SEQ ID NO: 2744945 - RNA, 18 nt, Human
cuagaguuuagcuggaaa

SEQ ID NO: 2744946 - RNA, 19 nt, Human
cuauuaucugucagcugca

SEQ ID NO: 2744947 - RNA, 14 nt, Human
cuaugauuauuaac

SEQ ID NO: 2744948 - RNA, 19 nt, Human
cuaugaaauauuauguuaa

SEQ ID NO: 2744949 - RNA, 18 nt, Human
cuaugaaauauuauguua

SEQ ID NO: 2744950 - RNA, 12 nt, Human
cuauaauuuaaa

SEQ ID NO: 2744951 - RNA, 13 nt, Human
cuauaauuuaaau

SEQ ID NO: 2744952 - RNA, 22 nt, Human
cucacugggguccuggggccuc

SEQ ID NO: 2744953 - RNA, 20 nt, Human
cucacugggguccuggggcc

SEQ ID NO: 2744954 - RNA, 17 nt, Human
cucacugggguccuggg

SEQ ID NO: 2744955 - RNA, 21 nt, Human
cucagaugcacaugagcuggc

SEQ ID NO: 2744956 - RNA, 16 nt, Human
cucagggccccagcac

SEQ ID NO: 2744957 - RNA, 14 nt, Human
cucagggccccagc

SEQ ID NO: 2744958 - RNA, 18 nt, Human
cucagggccccagcacua

SEQ ID NO: 2744959 - RNA, 13 nt, Human
cucagggccccag

SEQ ID NO: 2744960 - RNA, 12 nt, Human
cucagggcccca

SEQ ID NO: 2744961 - RNA, 22 nt, Human
cucaggaaaucaaauaugcaaa

SEQ ID NO: 2744962 - RNA, 20 nt, Human
cuccagcugacuaaacuuuu

SEQ ID NO: 2744963 - RNA, 14 nt, Human
cuccccucggagaa

SEQ ID NO: 2744964 - RNA, 23 nt, Human
cucauuuuuauaaugucccuuca

SEQ ID NO: 2744965 - RNA, 12 nt, Human
cucauuuccaag

SEQ ID NO: 2744966 - RNA, 14 nt, Human
cucauuuccaagca

SEQ ID NO: 2744967 - RNA, 13 nt, Human
cucauuuccaagc

SEQ ID NO: 2744968 - RNA, 17 nt, Human
cucauuuccaagcaagu

SEQ ID NO: 2744969 - RNA, 15 nt, Human
ccccagacuagaugu

SEQ ID NO: 2744970 - RNA, 18 nt, Human
ccccagacuagauguagu

SEQ ID NO: 2744971 - RNA, 17 nt, Human
ccccuccucugcuugcc

SEQ ID NO: 2744972 - RNA, 14 nt, Human
ccccuccucugcuu

SEQ ID NO: 2744973 - RNA, 13 nt, Human
ccccuccucugcu

SEQ ID NO: 2744974 - RNA, 15 nt, Human
ccccucggagaagag

SEQ ID NO: 2744975 - RNA, 17 nt, Human
ccgcuccugucugccag

SEQ ID NO: 2744976 - RNA, 15 nt, Human
ccgcuccugucugcc

SEQ ID NO: 2744977 - RNA, 14 nt, Human
ccgcuccugucugc

SEQ ID NO: 2744978 - RNA, 15 nt, Human
ccuaacgaaguaucc

SEQ ID NO: 2744979 - RNA, 20 nt, Human
ccguuggggauuggggaaga

SEQ ID NO: 2744980 - RNA, 19 nt, Human
cccuuaugcgguuaauuuu

SEQ ID NO: 2744981 - RNA, 13 nt, Human
cccuugccagaca

SEQ ID NO: 2744982 - RNA, 15 nt, Human
cccuugccagacaug

SEQ ID NO: 2744983 - RNA, 12 nt, Human
cccuugcccagg

SEQ ID NO: 2744984 - RNA, 20 nt, Human
cccuugcccagggcucagcc

SEQ ID NO: 2744985 - RNA, 19 nt, Human
cccuugcccagggcucagc

SEQ ID NO: 2744986 - RNA, 15 nt, Human
cccuugcccagggcu

SEQ ID NO: 2744987 - RNA, 14 nt, Human
cccuugcccagggc

SEQ ID NO: 2744988 - RNA, 22 nt, Human
cccuugcccagggcucagccug

SEQ ID NO: 2744989 - RNA, 21 nt, Human
cccuugcccagggcucagccu

SEQ ID NO: 2744990 - RNA, 23 nt, Human
cccuugcccagggcucagccugg

SEQ ID NO: 2744991 - RNA, 16 nt, Human
cccuccccugcccuag

SEQ ID NO: 2744992 - RNA, 22 nt, Human
cccucuccugggcagcugccuc

SEQ ID NO: 2744993 - RNA, 21 nt, Human
cccucuccugggcagcugccu

SEQ ID NO: 2744994 - RNA, 20 nt, Human
cccucuccugggcagcugcc

SEQ ID NO: 2744995 - RNA, 23 nt, Human
cccucuccugggcagcugccucc

SEQ ID NO: 2744996 - RNA, 12 nt, Human
ccaggugccagu

SEQ ID NO: 2744997 - RNA, 13 nt, Human
ccaggugccaguu

SEQ ID NO: 2744998 - RNA, 18 nt, Human
ccauccugaggcuccacu

SEQ ID NO: 2744999 - RNA, 20 nt, Human
ccauccugaggcuccacuug

SEQ ID NO: 2745000 - RNA, 20 nt, Human
ccagguagaggguguguaag

SEQ ID NO: 2745001 - RNA, 18 nt, Human
ccagggcccugagcucgg

SEQ ID NO: 2745002 - RNA, 15 nt, Human
ccagggcccugagcu

SEQ ID NO: 2745003 - RNA, 19 nt, Human
ccagccugagcgacaguga

SEQ ID NO: 2745004 - RNA, 15 nt, Human
ccacugguucuucuu

SEQ ID NO: 2745005 - RNA, 14 nt, Human
ccagacaucaacag

SEQ ID NO: 2745006 - RNA, 23 nt, Human
ccagacauguggugggacaggga

SEQ ID NO: 2745007 - RNA, 19 nt, Human
ccagacauguggugggaca

SEQ ID NO: 2745008 - RNA, 15 nt, Human
ccaccucccugcaau

SEQ ID NO: 2745009 - RNA, 21 nt, Human
ccaccucccugcaauaaaaug

SEQ ID NO: 2745010 - RNA, 19 nt, Human
ccaccucccugcaauaaaa

SEQ ID NO: 2745011 - RNA, 17 nt, Human
aaaacaaggaugaauua

SEQ ID NO: 2745012 - RNA, 12 nt, Human
aaaacacagcaa

SEQ ID NO: 2745013 - RNA, 13 nt, Human
aaaacacagcaag

SEQ ID NO: 2745014 - RNA, 18 nt, Human
aaaacacagcaaggguga

SEQ ID NO: 2745015 - RNA, 14 nt, Human
aaaacaaggaugaa

SEQ ID NO: 2745016 - RNA, 12 nt, Human
agcaugaagaca

SEQ ID NO: 2745017 - RNA, 19 nt, Human
agccagauuuuccugaaaa

SEQ ID NO: 2745018 - RNA, 15 nt, Human
agccagauuuuccug

SEQ ID NO: 2745019 - RNA, 19 nt, Human
agcaguucagagcugcccu

SEQ ID NO: 2745020 - RNA, 23 nt, Human
agcacuaaagcaguggacaccag

SEQ ID NO: 2745021 - RNA, 20 nt, Human
agcacuaaagcaguggacac

SEQ ID NO: 2745022 - RNA, 17 nt, Human
agcacuaaagcagugga

SEQ ID NO: 2745023 - RNA, 16 nt, Human
agcacuaaagcagugg

SEQ ID NO: 2745024 - RNA, 14 nt, Human
agcacuaaagcagu

SEQ ID NO: 2745025 - RNA, 13 nt, Human
agcacuaaagcag

SEQ ID NO: 2745026 - RNA, 18 nt, Human
agcaguucagagcugccc

SEQ ID NO: 2745027 - RNA, 17 nt, Human
agcaguucagagcugcc

SEQ ID NO: 2745028 - RNA, 15 nt, Human
agcaguucagagcug

SEQ ID NO: 2745029 - RNA, 16 nt, Human
agcaguucagagcugc

SEQ ID NO: 2745030 - RNA, 23 nt, Human
agcaguugaaaagacuccaaaga

SEQ ID NO: 2745031 - RNA, 21 nt, Human
agcaguugaaaagacuccaaa

SEQ ID NO: 2745032 - RNA, 15 nt, Human
agcagccagcucuca

SEQ ID NO: 2745033 - RNA, 14 nt, Human
agcagccagcucuc

SEQ ID NO: 2745034 - RNA, 13 nt, Human
agcagccagcucu

SEQ ID NO: 2745035 - RNA, 23 nt, Human
agcagccagcucucagccaacga

SEQ ID NO: 2745036 - RNA, 19 nt, Human
agcagccagcucucagcca

SEQ ID NO: 2745037 - RNA, 18 nt, Human
agcagccagcucucagcc

SEQ ID NO: 2745038 - RNA, 17 nt, Human
agcagccagcucucagc

SEQ ID NO: 2745039 - RNA, 16 nt, Human
agcagccagcucucag

SEQ ID NO: 2745040 - RNA, 21 nt, Human
agaugggagaaucacuugaac

SEQ ID NO: 2745041 - RNA, 14 nt, Human
agauguagaggaga

SEQ ID NO: 2745042 - RNA, 19 nt, Human
agccccacccucagaugca

SEQ ID NO: 2745043 - RNA, 21 nt, Human
agcccaaguucaugcagcugu

SEQ ID NO: 2745044 - RNA, 23 nt, Human
agcccaaguucaugcagcugugg

SEQ ID NO: 2745045 - RNA, 21 nt, Human
agccgggcgugguggugagug

SEQ ID NO: 2745046 - RNA, 16 nt, Human
agaggggcagaacagc

SEQ ID NO: 2745047 - RNA, 15 nt, Human
agaggggcagaacag

SEQ ID NO: 2745048 - RNA, 15 nt, Human
agaguuacaguucug

SEQ ID NO: 2745049 - RNA, 16 nt, Human
agaguuacaguucugu

SEQ ID NO: 2745050 - RNA, 17 nt, Human
agaguuacaguucugug

SEQ ID NO: 2745051 - RNA, 22 nt, Human
agaguuacaguucugugguuuc

SEQ ID NO: 2745052 - RNA, 20 nt, Human
agaguuaauauauagaaggg

SEQ ID NO: 2745053 - RNA, 11 nt, Human
agaguuacagu

SEQ ID NO: 2745054 - RNA, 17 nt, Human
agaggagccaccaguuc

SEQ ID NO: 2745055 - RNA, 21 nt, Human
agauaggucagugcaaauacu

SEQ ID NO: 2745056 - RNA, 17 nt, Human
agacugcauuauauuua

SEQ ID NO: 2745057 - RNA, 14 nt, Human
aggggcagaacagc

SEQ ID NO: 2745058 - RNA, 21 nt, Human
aggcagacagcagcucaggca

SEQ ID NO: 2745059 - RNA, 20 nt, Human
aggcagacagcagcucaggc

SEQ ID NO: 2745060 - RNA, 19 nt, Human
aggcagacagcagcucagg

SEQ ID NO: 2745061 - RNA, 18 nt, Human
aggcagacagcagcucag

SEQ ID NO: 2745062 - RNA, 15 nt, Human
aggcagacagcagcu

SEQ ID NO: 2745063 - RNA, 14 nt, Human
aggcagacagcagc

SEQ ID NO: 2745064 - RNA, 13 nt, Human
aggcagacagcag

SEQ ID NO: 2745065 - RNA, 14 nt, Human
agguucccucccag

SEQ ID NO: 2745066 - RNA, 19 nt, Human
aggagaggggcagaacagc

SEQ ID NO: 2745067 - RNA, 18 nt, Human
aggagaggggcagaacag

SEQ ID NO: 2745068 - RNA, 13 nt, Human
aggagaggggcag

SEQ ID NO: 2745069 - RNA, 14 nt, Human
aggauguugaaaaa

SEQ ID NO: 2745070 - RNA, 18 nt, Human
agcuucacuguaaaauaa

SEQ ID NO: 2745071 - RNA, 14 nt, Human
auggagcugggcua

SEQ ID NO: 2745072 - RNA, 21 nt, Human
auguggugggacagggaccca

SEQ ID NO: 2745073 - RNA, 15 nt, Human
auguggugggacagg

SEQ ID NO: 2745074 - RNA, 21 nt, Human
auguaagggaaacugccagca

SEQ ID NO: 2745075 - RNA, 22 nt, Human
auguaagggaaacugccagcaa

SEQ ID NO: 2745076 - RNA, 20 nt, Human
auguaagggaaacugccagc

SEQ ID NO: 2745077 - RNA, 19 nt, Human
augucuuggguaggcggga

SEQ ID NO: 2745078 - RNA, 22 nt, Human
aucuuauaauuuaaaauaugcu

SEQ ID NO: 2745079 - RNA, 17 nt, Human
aucagcugcugaaacaa

SEQ ID NO: 2745080 - RNA, 21 nt, Human
aguccaagcauuuagauguau

SEQ ID NO: 2745081 - RNA, 16 nt, Human
aguccaagcauuuaga

SEQ ID NO: 2745082 - RNA, 16 nt, Human
agucaaggcuuagacc

SEQ ID NO: 2745083 - RNA, 14 nt, Human
agucaaggcuuaga

SEQ ID NO: 2745084 - RNA, 17 nt, Human
agucaaauugugugaaa

SEQ ID NO: 2745085 - RNA, 15 nt, Human
agucaaauuguguga

SEQ ID NO: 2745086 - RNA, 13 nt, Human
agucaaauugugu

SEQ ID NO: 2745087 - RNA, 21 nt, Human
agugucuuaauuaaaagaaua

SEQ ID NO: 2745088 - RNA, 15 nt, Human
agugauuaccaggga

SEQ ID NO: 2745089 - RNA, 18 nt, Human
agugauuaccagggacug

SEQ ID NO: 2745090 - RNA, 13 nt, Human
aguuacaguucug

SEQ ID NO: 2745091 - RNA, 14 nt, Human
aguuacaguucugu

SEQ ID NO: 2745092 - RNA, 15 nt, Human
aguuacaguucugug

SEQ ID NO: 2745093 - RNA, 16 nt, Human
aguuacaguucugugg

SEQ ID NO: 2745094 - RNA, 18 nt, Human
aguuguaccgcaauguga

SEQ ID NO: 2745095 - RNA, 19 nt, Human
aguuguaccgcaaugugac

SEQ ID NO: 2745096 - RNA, 19 nt, Human
auauuuauuacuguaagaa

SEQ ID NO: 2745097 - RNA, 14 nt, Human
auauuuauuacugu

SEQ ID NO: 2745098 - RNA, 18 nt, Human
auauuuauuuuaauaaug

SEQ ID NO: 2745099 - RNA, 23 nt, Human
auauuucagauaaucacaauaca

SEQ ID NO: 2745100 - RNA, 23 nt, Human
auaugcuucuguuuuauaauuuu

SEQ ID NO: 2745101 - RNA, 18 nt, Human
auaucacuugucaauaaa

SEQ ID NO: 2745102 - RNA, 23 nt, Human
auauccuaauaaaaaggugacca

SEQ ID NO: 2745103 - RNA, 15 nt, Human
auaucaauuuaaaaa

SEQ ID NO: 2745104 - RNA, 18 nt, Human
auaaguacuguguacaga

SEQ ID NO: 2745105 - RNA, 19 nt, Human
auaaguacuguguacagaa

SEQ ID NO: 2745106 - RNA, 14 nt, Human
auaauuacuauguc

SEQ ID NO: 2745107 - RNA, 16 nt, Human
acuaauagaauaaagg

SEQ ID NO: 2745108 - RNA, 17 nt, Human
acuaauagaauaaaggc

SEQ ID NO: 2745109 - RNA, 20 nt, Human
acuaauagaauaaaggcagu

SEQ ID NO: 2745110 - RNA, 16 nt, Human
acuaagagagaaugag

SEQ ID NO: 2745111 - RNA, 15 nt, Human
acuaagagagaauga

SEQ ID NO: 2745112 - RNA, 16 nt, Human
acgugcacgcacacug

SEQ ID NO: 2745113 - RNA, 13 nt, Human
acucccuuucaac

SEQ ID NO: 2745114 - RNA, 12 nt, Human
acucccuuucaa

SEQ ID NO: 2745115 - RNA, 14 nt, Human
acuagcuauggugu

SEQ ID NO: 2745116 - RNA, 14 nt, Human
acucagggccccag

SEQ ID NO: 2745117 - RNA, 13 nt, Human
acucagggcccca

SEQ ID NO: 2745118 - RNA, 19 nt, Human
acucagucucucuucucuc

SEQ ID NO: 2745119 - RNA, 23 nt, Human
acucagucucucuucucuccagc

SEQ ID NO: 2745120 - RNA, 21 nt, Human
agaaauaaaguuggugacaga

SEQ ID NO: 2745121 - RNA, 19 nt, Human
agaaauaaaguuggugaca

SEQ ID NO: 2745122 - RNA, 16 nt, Human
acuuuauaacuaacau

SEQ ID NO: 2745123 - RNA, 18 nt, Human
acuuuauaacuaacaugu

SEQ ID NO: 2745124 - RNA, 12 nt, Human
acuggaacucuc

SEQ ID NO: 2745125 - RNA, 16 nt, Human
acuucacacacaggca

SEQ ID NO: 2745126 - RNA, 19 nt, Human
acuucacacacaggcaacu

SEQ ID NO: 2745127 - RNA, 17 nt, Human
acuucacacacaggcaa

SEQ ID NO: 2745128 - RNA, 19 nt, Human
acuuguaaaggaauuuaaa

SEQ ID NO: 2745129 - RNA, 20 nt, Human
acuuguaaaggaauuuaaaa

SEQ ID NO: 2745130 - RNA, 18 nt, Human
acuuguaaaggaauuuaa

SEQ ID NO: 2745131 - RNA, 15 nt, Human
acuuggucugugaga

SEQ ID NO: 2745132 - RNA, 13 nt, Human
acuuggucuguga

SEQ ID NO: 2745133 - RNA, 14 nt, Human
acuuggucugugag

SEQ ID NO: 2745134 - RNA, 16 nt, Human
acccaaguccaagcau

SEQ ID NO: 2745135 - RNA, 15 nt, Human
acccacaagaaauga

SEQ ID NO: 2745136 - RNA, 14 nt, Human
acauuuguauaaaa

SEQ ID NO: 2745137 - RNA, 16 nt, Human
acauuugcucauggaa

SEQ ID NO: 2745138 - RNA, 18 nt, Human
acauuugcucauggaauu

SEQ ID NO: 2745139 - RNA, 13 nt, Human
acauguuacaaca

SEQ ID NO: 2745140 - RNA, 15 nt, Human
acagcaguugaaaag

SEQ ID NO: 2745141 - RNA, 18 nt, Human
acagcaguugaaaagacu

SEQ ID NO: 2745142 - RNA, 16 nt, Human
acagccagacuggcac

SEQ ID NO: 2745143 - RNA, 13 nt, Human
acagccagacugg

SEQ ID NO: 2745144 - RNA, 15 nt, Human
acagccagacuggca

SEQ ID NO: 2745145 - RNA, 20 nt, Human
acacugcucuaacagcccuc

SEQ ID NO: 2745146 - RNA, 17 nt, Human
acacugcucuaacagcc

SEQ ID NO: 2745147 - RNA, 19 nt, Human
acacugcucuaacagcccu

SEQ ID NO: 2745148 - RNA, 13 nt, Human
acacugcucuaac

SEQ ID NO: 2745149 - RNA, 14 nt, Human
acacugcucuaaca

SEQ ID NO: 2745150 - RNA, 20 nt, Human
acagcucugcauacucauua

SEQ ID NO: 2745151 - RNA, 14 nt, Human
aauuuugaagugcu

SEQ ID NO: 2745152 - RNA, 19 nt, Human
aauuuugaagugcuguuua

SEQ ID NO: 2745153 - RNA, 20 nt, Human
aauuuugaagugcuguuuau

SEQ ID NO: 2745154 - RNA, 13 nt, Human
acaacuauauugu

SEQ ID NO: 2745155 - RNA, 15 nt, Human
aacacgagcaggcua

SEQ ID NO: 2745156 - RNA, 23 nt, Human
aacugacacaugcugaacaucac

SEQ ID NO: 2745157 - RNA, 13 nt, Human
aacuuuugugaau

SEQ ID NO: 2745158 - RNA, 19 nt, Human
aacuuuugugaauuaggcu

SEQ ID NO: 2745159 - RNA, 13 nt, Human
aagaaauguaagg

SEQ ID NO: 2745160 - RNA, 14 nt, Human
aagaaauguaaggg

SEQ ID NO: 2745161 - RNA, 22 nt, Human
aacuuuuuuucuguaccaguua

SEQ ID NO: 2745162 - RNA, 21 nt, Human
aacuuuuuuucuguaccaguu

SEQ ID NO: 2745163 - RNA, 12 nt, Human
aaaauucauuuu

SEQ ID NO: 2745164 - RNA, 16 nt, Human
aaagaaaguguauuug

SEQ ID NO: 2745165 - RNA, 10 nt, Human
aaagaaagug

SEQ ID NO: 2745166 - RNA, 12 nt, Human
aaagaaagugua

SEQ ID NO: 2745167 - RNA, 13 nt, Human
aaagaaaguguau

SEQ ID NO: 2745168 - RNA, 16 nt, Human
aaacugacucuuaaga

SEQ ID NO: 2745169 - RNA, 14 nt, Human
aaacugaagccaga

SEQ ID NO: 2745170 - RNA, 14 nt, Human
aaacugccagcaac

SEQ ID NO: 2745171 - RNA, 15 nt, Human
aaacugccagcaacg

SEQ ID NO: 2745172 - RNA, 17 nt, Human
aaacugacucuuaagaa

SEQ ID NO: 2745173 - RNA, 19 nt, Human
aaacugccagcaacgcagg

SEQ ID NO: 2745174 - RNA, 17 nt, Human
aaagaugaaaauauuug

SEQ ID NO: 2745175 - RNA, 13 nt, Human
aaagaugaaaaua

SEQ ID NO: 2745176 - RNA, 16 nt, Human
aaagaugaaaauauuu

SEQ ID NO: 2745177 - RNA, 12 nt, Human
aaauaacaauga

SEQ ID NO: 2745178 - RNA, 18 nt, Human
aaauggcuuccuggcaau

SEQ ID NO: 2745179 - RNA, 16 nt, Human
aaaucaaauaugcaaa

SEQ ID NO: 2745180 - RNA, 18 nt, Human
aaaucaaauaugcaaagc

SEQ ID NO: 2745181 - RNA, 19 nt, Human
aaaucaaauaugcaaagca

SEQ ID NO: 2745182 - RNA, 16 nt, Human
aaugggcucaaccaga

SEQ ID NO: 2745183 - RNA, 20 nt, Human
aauuaguuuuauaugcuucu

SEQ ID NO: 2745184 - RNA, 17 nt, Human
aauuaguuuuauaugcu

SEQ ID NO: 2745185 - RNA, 14 nt, Human
aauuaguuuuauau

SEQ ID NO: 2745186 - RNA, 16 nt, Human
aauauuauguuaaaac

SEQ ID NO: 2745187 - RNA, 13 nt, Human
aaucacaauacau

SEQ ID NO: 2745188 - RNA, 15 nt, Human
aaucaagaaacuuaa

SEQ ID NO: 2745189 - RNA, 13 nt, Human
aauccauacauuu

SEQ ID NO: 2745190 - RNA, 17 nt, Human
aaugauaacuggaaacu

SEQ ID NO: 2745191 - RNA, 20 nt, Human
aaugauaacuggaaacuuca

SEQ ID NO: 2745192 - RNA, 14 nt, Human
aagugcuguuuauu

SEQ ID NO: 2745193 - RNA, 16 nt, Human
aagugcuguuuauuaa

SEQ ID NO: 2745194 - RNA, 17 nt, Human
aagugcuguuuauuaau

SEQ ID NO: 2745195 - RNA, 18 nt, Human
aagugcuguuuauuaauc

SEQ ID NO: 2745196 - RNA, 20 nt, Human
aagugcuguuuauuaaucuu

SEQ ID NO: 2745197 - RNA, 19 nt, Human
aauaaaauggguuuuacug

SEQ ID NO: 2745198 - RNA, 14 nt, Human
aauaaaauggguuu

SEQ ID NO: 2745199 - RNA, 15 nt, Human
aaguuguuucauuga

SEQ ID NO: 2745200 - RNA, 21 nt, Human
aagugcuguuuauuaaucuua

SEQ ID NO: 2745201 - RNA, 22 nt, Human
aagugcuguuuauuaaucuuag

SEQ ID NO: 2745202 - RNA, 21 nt, Human
aauaauccuaaacauaugaau

SEQ ID NO: 2745203 - RNA, 13 nt, Human
aagccagauuuuc

SEQ ID NO: 2745204 - RNA, 16 nt, Human
aagauuuaccacuugu

SEQ ID NO: 2745205 - RNA, 16 nt, Human
auuagugccacuuaau

SEQ ID NO: 2745206 - RNA, 18 nt, Human
auuagugccacuuaaugu

SEQ ID NO: 2745207 - RNA, 19 nt, Human
auuagugccacuuaaugua

SEQ ID NO: 2745208 - RNA, 20 nt, Human
auuagugccacuuaauguau

SEQ ID NO: 2745209 - RNA, 21 nt, Human
auuagugccacuuaauguaug

SEQ ID NO: 2745210 - RNA, 22 nt, Human
auuagugccacuuaauguaugu

SEQ ID NO: 2745211 - RNA, 23 nt, Human
auuaaguaaugauaacuggaaac

SEQ ID NO: 2745212 - RNA, 21 nt, Human
auuaaguaaugauaacuggaa

SEQ ID NO: 2745213 - RNA, 19 nt, Human
uuuuugugaaaagcuccau

SEQ ID NO: 2745214 - RNA, 15 nt, Human
auuacagugggugcc

SEQ ID NO: 2745215 - RNA, 17 nt, Human
auuacauuuguauaaaa

SEQ ID NO: 2745216 - RNA, 18 nt, Human
auuacauuuguauaaaau

SEQ ID NO: 2745217 - RNA, 16 nt, Human
auuacauuuguauaaa

SEQ ID NO: 2745218 - RNA, 12 nt, Human
auuaccagggac

SEQ ID NO: 2745219 - RNA, 17 nt, Human
uuuuuauauuugaaaua

SEQ ID NO: 2745220 - RNA, 19 nt, Human
uuuuuauauuugaaauauu

SEQ ID NO: 2745221 - RNA, 14 nt, Human
uuuuaauaauguuu

SEQ ID NO: 2745222 - RNA, 13 nt, Human
uuuuaauaauguu

SEQ ID NO: 2745223 - RNA, 12 nt, Human
uuuuaauaaugu

SEQ ID NO: 2745224 - RNA, 16 nt, Human
uuuuaauaauguuuca

SEQ ID NO: 2745225 - RNA, 19 nt, Human
augugcuaguaauuggaaa

SEQ ID NO: 2745226 - RNA, 15 nt, Human
auguuagcaaagagu

SEQ ID NO: 2745227 - RNA, 18 nt, Human
auguucaucaaugaauga

SEQ ID NO: 2745228 - RNA, 15 nt, Human
auguuuucaggcuag

SEQ ID NO: 2745229 - RNA, 21 nt, Human
auguuuucaggcuagauguau

SEQ ID NO: 2745230 - RNA, 17 nt, Human
auguuuucaggcuagau

SEQ ID NO: 2745231 - RNA, 14 nt, Human
uuuucuguaccagu

SEQ ID NO: 2745232 - RNA, 21 nt, Human
uuuucuguaccaguuaauuuu

SEQ ID NO: 2745233 - RNA, 21 nt, Human
uuuucuccucacuguauccag

SEQ ID NO: 2745234 - RNA, 13 nt, Human
uuuucauuuaucu

SEQ ID NO: 2745235 - RNA, 15 nt, Human
uuuucugagaaagac

SEQ ID NO: 2745236 - RNA, 18 nt, Human
uuuucugagaaagacuau

SEQ ID NO: 2745237 - RNA, 14 nt, Human
uuuucucuaggaaa

SEQ ID NO: 2745238 - RNA, 22 nt, Human
auuuucaguuauuauauuuaca

SEQ ID NO: 2745239 - RNA, 22 nt, Human
auuuuaaaagaaugauuaugaa

SEQ ID NO: 2745240 - RNA, 18 nt, Human
auuuuaaaagaaugauua

SEQ ID NO: 2745241 - RNA, 18 nt, Human
auuuguauaaaauaauuu

SEQ ID NO: 2745242 - RNA, 15 nt, Human
auuuguauaaaauaa

SEQ ID NO: 2745243 - RNA, 19 nt, Human
auuuguauaaaauaauuuu

SEQ ID NO: 2745244 - RNA, 17 nt, Human
auuuuaaaagaaugauu

SEQ ID NO: 2745245 - RNA, 15 nt, Human
auuguauuacaaauc

SEQ ID NO: 2745246 - RNA, 18 nt, Human
auugacccacaagaaaug

SEQ ID NO: 2745247 - RNA, 19 nt, Human
auuggggaagacuguggcu

SEQ ID NO: 2745248 - RNA, 14 nt, Human
auuugaaauauuga

SEQ ID NO: 2745249 - RNA, 20 nt, Human
auuuauuuuaauaauguuuc

SEQ ID NO: 2745250 - RNA, 19 nt, Human
auuuauuuuaauaauguuu

SEQ ID NO: 2745251 - RNA, 12 nt, Human
auuucauuucuu

SEQ ID NO: 2745252 - RNA, 17 nt, Human
auuuauuuuaauaaugu

SEQ ID NO: 2745253 - RNA, 12 nt, Human
auuuagaagcca

SEQ ID NO: 2745254 - RNA, 13 nt, Human
auuuagaagccaa

SEQ ID NO: 2745255 - RNA, 21 nt, Human
auuuagaagccaacuaugauu

SEQ ID NO: 2745256 - RNA, 22 nt, Human
auuuagaagccaacuaugauua

SEQ ID NO: 2745257 - RNA, 23 nt, Human
auuuagaagccaacuaugauuau

SEQ ID NO: 2745258 - RNA, 13 nt, Human
auuuagauguaua

SEQ ID NO: 2745259 - RNA, 20 nt, Human
augaaauauuauguuaaaac

SEQ ID NO: 2745260 - RNA, 21 nt, Human
augaaauauuauguuaaaacu

SEQ ID NO: 2745261 - RNA, 12 nt, Human
uugcuaccagua

SEQ ID NO: 2745262 - RNA, 15 nt, Human
uugcuaccaguauuu

SEQ ID NO: 2745263 - RNA, 16 nt, Human
uugcuaccaguauuua

SEQ ID NO: 2745264 - RNA, 20 nt, Human
uugcuaccaguauuuagaag

SEQ ID NO: 2745265 - RNA, 22 nt, Human
uugcuaccaguauuuagaagcc

SEQ ID NO: 2745266 - RNA, 23 nt, Human
uugcuaccaguauuuagaagcca

SEQ ID NO: 2745267 - RNA, 11 nt, Human
uugcucaugga

SEQ ID NO: 2745268 - RNA, 12 nt, Human
uugcucauggaa

SEQ ID NO: 2745269 - RNA, 23 nt, Human
augaauuaguuuuauaugcuucu

SEQ ID NO: 2745270 - RNA, 21 nt, Human
augaauuaguuuuauaugcuu

SEQ ID NO: 2745271 - RNA, 22 nt, Human
augaauuacauuuguauaaaau

SEQ ID NO: 2745272 - RNA, 23 nt, Human
uuguaguguuggagaagaacuga

SEQ ID NO: 2745273 - RNA, 13 nt, Human
uuguauaaaauaa

SEQ ID NO: 2745274 - RNA, 19 nt, Human
uuguauaaaauaauuuuua

SEQ ID NO: 2745275 - RNA, 21 nt, Human
uuguauaauuggauuuccuaa

SEQ ID NO: 2745276 - RNA, 11 nt, Human
uuguauaauug

SEQ ID NO: 2745277 - RNA, 12 nt, Human
uuguauaauugg

SEQ ID NO: 2745278 - RNA, 20 nt, Human
uuguauaauuggauuuccua

SEQ ID NO: 2745279 - RNA, 17 nt, Human
augaauuacauuuguau

SEQ ID NO: 2745280 - RNA, 19 nt, Human
augaauuacauuuguauaa

SEQ ID NO: 2745281 - RNA, 18 nt, Human
augaauuacauuuguaua

SEQ ID NO: 2745282 - RNA, 22 nt, Human
uuguuuuuccuuguauuuaaau

SEQ ID NO: 2745283 - RNA, 21 nt, Human
uuguuuuuccuuguauuuaaa

SEQ ID NO: 2745284 - RNA, 13 nt, Human
uuguuuuuccuug

SEQ ID NO: 2745285 - RNA, 20 nt, Human
uuuaaaaaagaaacauuugg

SEQ ID NO: 2745286 - RNA, 18 nt, Human
uugugaagcaaaauuuuu

SEQ ID NO: 2745287 - RNA, 14 nt, Human
augauaacuggaaa

SEQ ID NO: 2745288 - RNA, 16 nt, Human
auggaacauaaaauac

SEQ ID NO: 2745289 - RNA, 16 nt, Human
uuuauuuuaauaaugu

SEQ ID NO: 2745290 - RNA, 19 nt, Human
uuuauuacuguaagaaaau

SEQ ID NO: 2745291 - RNA, 23 nt, Human
augcugucuacacuaagagagaa

SEQ ID NO: 2745292 - RNA, 14 nt, Human
augcuguauuuuaa

SEQ ID NO: 2745293 - RNA, 23 nt, Human
auggaauuggagcucgugggaca

SEQ ID NO: 2745294 - RNA, 17 nt, Human
uuuauaugcuucuguuu

SEQ ID NO: 2745295 - RNA, 16 nt, Human
uuuauuacuguaagaa

SEQ ID NO: 2745296 - RNA, 24 nt, Human
uuuaaagcuuauuaaaacucauuu

SEQ ID NO: 2745297 - RNA, 12 nt, Human
uuuaaagaaagu

SEQ ID NO: 2745298 - RNA, 13 nt, Human
augcuaagugaaa

SEQ ID NO: 2745299 - RNA, 13 nt, Human
uuucuaugaaaua

SEQ ID NO: 2745300 - RNA, 20 nt, Human
uuucuaugaaauauuauguu

SEQ ID NO: 2745301 - RNA, 14 nt, Human
uuucuaugaaauau

SEQ ID NO: 2745302 - RNA, 14 nt, Human
uuucugcaucagcu

SEQ ID NO: 2745303 - RNA, 14 nt, Human
uuugaaauauugac

SEQ ID NO: 2745304 - RNA, 11 nt, Human
uuugaaaaugg

SEQ ID NO: 2745305 - RNA, 17 nt, Human
auggaauuucucccagu

SEQ ID NO: 2745306 - RNA, 16 nt, Human
auggcuauaggugcua

SEQ ID NO: 2745307 - RNA, 19 nt, Human
auggcuauaggugcuacaa

SEQ ID NO: 2745308 - RNA, 21 nt, Human
auggcuauaggugcuacaaaa

SEQ ID NO: 2745309 - RNA, 21 nt, Human
augggacauuugcucauggaa

SEQ ID NO: 2745310 - RNA, 22 nt, Human
augggacauuugcucauggaau

SEQ ID NO: 2745311 - RNA, 18 nt, Human
uuccaacuacuaauagaa

SEQ ID NO: 2745312 - RNA, 16 nt, Human
uucauugacuaucaaa

SEQ ID NO: 2745313 - RNA, 14 nt, Human
uucauuaucucaaa

SEQ ID NO: 2745314 - RNA, 13 nt, Human
auaugcaaagcac

SEQ ID NO: 2745315 - RNA, 14 nt, Human
auaugcaaagcacu

SEQ ID NO: 2745316 - RNA, 23 nt, Human
auauguaccuaacgaaguauccu

SEQ ID NO: 2745317 - RNA, 13 nt, Human
auauaugcuaagu

SEQ ID NO: 2745318 - RNA, 15 nt, Human
uucaucaaugaauga

SEQ ID NO: 2745319 - RNA, 17 nt, Human
uucagcgguuuauauaa

SEQ ID NO: 2745320 - RNA, 14 nt, Human
auauuguuugcuaa

SEQ ID NO: 2745321 - RNA, 13 nt, Human
auauuuacaaaug

SEQ ID NO: 2745322 - RNA, 15 nt, Human
aucaaauaugcaaag

SEQ ID NO: 2745323 - RNA, 16 nt, Human
aucaaggguacacugc

SEQ ID NO: 2745324 - RNA, 16 nt, Human
aucaaauaugcaaagc

SEQ ID NO: 2745325 - RNA, 17 nt, Human
aucaaauaugcaaagca

SEQ ID NO: 2745326 - RNA, 18 nt, Human
aucaaauaugcaaagcac

SEQ ID NO: 2745327 - RNA, 21 nt, Human
aucaaggguacacugccuucu

SEQ ID NO: 2745328 - RNA, 13 nt, Human
aucaauuuaaaaa

SEQ ID NO: 2745329 - RNA, 14 nt, Human
aucaauuuuucuua

SEQ ID NO: 2745330 - RNA, 18 nt, Human
uucuccucacuguaucca

SEQ ID NO: 2745331 - RNA, 23 nt, Human
aucacuugaacccgggaggcaga

SEQ ID NO: 2745332 - RNA, 17 nt, Human
uucuguuuuauaauuuu

SEQ ID NO: 2745333 - RNA, 16 nt, Human
uucuguuuuauaauuu

SEQ ID NO: 2745334 - RNA, 15 nt, Human
auccagguucccucc

SEQ ID NO: 2745335 - RNA, 19 nt, Human
auccagguucccucccaga

SEQ ID NO: 2745336 - RNA, 21 nt, Human
aucccucccuccaccucccug

SEQ ID NO: 2745337 - RNA, 20 nt, Human
aucccucccuccaccucccu

SEQ ID NO: 2745338 - RNA, 18 nt, Human
aucccucccuccaccucc

SEQ ID NO: 2745339 - RNA, 17 nt, Human
aucccucccuccaccuc

SEQ ID NO: 2745340 - RNA, 16 nt, Human
aucccucccuccaccu

SEQ ID NO: 2745341 - RNA, 14 nt, Human
aucccucccuccac

SEQ ID NO: 2745342 - RNA, 23 nt, Human
uugacacugcucuaacagcccuc

SEQ ID NO: 2745343 - RNA, 19 nt, Human
uugacacuuaaaaaugguu

SEQ ID NO: 2745344 - RNA, 21 nt, Human
uugaaggaugcugucuucgua

SEQ ID NO: 2745345 - RNA, 14 nt, Human
uugaaggaugcugu

SEQ ID NO: 2745346 - RNA, 16 nt, Human
uugaaggaugcugucu

SEQ ID NO: 2745347 - RNA, 17 nt, Human
uugacacuuaaaaaugg

SEQ ID NO: 2745348 - RNA, 14 nt, Human
uugacacugcucua

SEQ ID NO: 2745349 - RNA, 15 nt, Human
uugacacugcucuaa

SEQ ID NO: 2745350 - RNA, 16 nt, Human
uugacacugcucuaac

SEQ ID NO: 2745351 - RNA, 22 nt, Human
uugacacugcucuaacagcccu

SEQ ID NO: 2745352 - RNA, 18 nt, Human
auccugaggcuccacuug

SEQ ID NO: 2745353 - RNA, 16 nt, Human
auccugaggcuccacu

SEQ ID NO: 2745354 - RNA, 13 nt, Human
auccugaggcucc

SEQ ID NO: 2745355 - RNA, 11 nt, Human
auccugaggcu

SEQ ID NO: 2745356 - RNA, 13 nt, Human
auccugccccuga

SEQ ID NO: 2745357 - RNA, 22 nt, Human
auccugaggcuccacuuggucu

SEQ ID NO: 2745358 - RNA, 16 nt, Human
auccugcaauuccacu

SEQ ID NO: 2745359 - RNA, 22 nt, Human
uggcacaguuuucugagaaaga

SEQ ID NO: 2745360 - RNA, 20 nt, Human
uggcacaguuuucugagaaa

SEQ ID NO: 2745361 - RNA, 18 nt, Human
uggacgagaaaacaauaa

SEQ ID NO: 2745362 - RNA, 14 nt, Human
uggcugcuagcacu

SEQ ID NO: 2745363 - RNA, 13 nt, Human
uggcugcuagcac

SEQ ID NO: 2745364 - RNA, 15 nt, Human
uggcugcuagcacuu

SEQ ID NO: 2745365 - RNA, 20 nt, Human
ugggaaagggauuuucagcc

SEQ ID NO: 2745366 - RNA, 21 nt, Human
ugggaaagcauuguaaaugug

SEQ ID NO: 2745367 - RNA, 18 nt, Human
aggaagcugugagagcag

SEQ ID NO: 2745368 - RNA, 11 nt, Human
aggaauuuaaa

SEQ ID NO: 2745369 - RNA, 23 nt, Human
aggaauugacccacaagaaauga

SEQ ID NO: 2745370 - RNA, 13 nt, Human
aggaauuucuuaa

SEQ ID NO: 2745371 - RNA, 23 nt, Human
ugcuguauuuuaaaagaaugauu

SEQ ID NO: 2745372 - RNA, 23 nt, Human
aggaauuucuuaacuucuugcuu

SEQ ID NO: 2745373 - RNA, 15 nt, Human
aggaauuucuuaacu

SEQ ID NO: 2745374 - RNA, 19 nt, Human
aggaauuucuuaacuucuu

SEQ ID NO: 2745375 - RNA, 14 nt, Human
ugcuggagcucugc

SEQ ID NO: 2745376 - RNA, 13 nt, Human
ugcuggagcucug

SEQ ID NO: 2745377 - RNA, 23 nt, Human
aggacagcccuucuuuccacaga

SEQ ID NO: 2745378 - RNA, 14 nt, Human
aggacacugauaug

SEQ ID NO: 2745379 - RNA, 14 nt, Human
aggagccaccaguu

SEQ ID NO: 2745380 - RNA, 15 nt, Human
aggagccaccaguuc

SEQ ID NO: 2745381 - RNA, 17 nt, Human
aggagccaccaguucuc

SEQ ID NO: 2745382 - RNA, 11 nt, Human
aggagaaacug

SEQ ID NO: 2745383 - RNA, 18 nt, Human
ugcuuggcccaggaguuu

SEQ ID NO: 2745384 - RNA, 23 nt, Human
ugcuuggcccaggaguuuggcca

SEQ ID NO: 2745385 - RNA, 12 nt, Human
ugcuuggcccag

SEQ ID NO: 2745386 - RNA, 15 nt, Human
ugcuuggcccaggag

SEQ ID NO: 2745387 - RNA, 16 nt, Human
ugcuuggcccaggagu

SEQ ID NO: 2745388 - RNA, 15 nt, Human
ugcuugccaucccuc

SEQ ID NO: 2745389 - RNA, 16 nt, Human
ugcuugccaucccucc

SEQ ID NO: 2745390 - RNA, 14 nt, Human
aggaguuuggccag

SEQ ID NO: 2745391 - RNA, 15 nt, Human
aggaguuuggccaga

SEQ ID NO: 2745392 - RNA, 16 nt, Human
aggaguuuggccagaa

SEQ ID NO: 2745393 - RNA, 17 nt, Human
aggaguuuggccagaag

SEQ ID NO: 2745394 - RNA, 18 nt, Human
aggaguuuggccagaagu

SEQ ID NO: 2745395 - RNA, 20 nt, Human
uggacccagggaugacaugu

SEQ ID NO: 2745396 - RNA, 16 nt, Human
aggcaacugaggcaga

SEQ ID NO: 2745397 - RNA, 15 nt, Human
aggcaacugaggcag

SEQ ID NO: 2745398 - RNA, 14 nt, Human
aggcaacugaggca

SEQ ID NO: 2745399 - RNA, 22 nt, Human
uggaauuucucccagucauuua

SEQ ID NO: 2745400 - RNA, 18 nt, Human
uggaauuggagcucgugg

SEQ ID NO: 2745401 - RNA, 19 nt, Human
aggcaacugaggcagacag

SEQ ID NO: 2745402 - RNA, 17 nt, Human
aggcaacugaggcagac

SEQ ID NO: 2745403 - RNA, 21 nt, Human
agccagcaguucagagcugcc

SEQ ID NO: 2745404 - RNA, 20 nt, Human
agccagcaguucagagcugc

SEQ ID NO: 2745405 - RNA, 22 nt, Human
agccagcaguucagagcugccc

SEQ ID NO: 2745406 - RNA, 19 nt, Human
agccagcaguucagagcug

SEQ ID NO: 2745407 - RNA, 17 nt, Human
agccagcaguucagagc

SEQ ID NO: 2745408 - RNA, 15 nt, Human
agccagcaguucaga

SEQ ID NO: 2745409 - RNA, 18 nt, Human
ugauuaaguaaugauaac

SEQ ID NO: 2745410 - RNA, 23 nt, Human
ugauuaaguaaugauaacuggaa

SEQ ID NO: 2745411 - RNA, 12 nt, Human
ugaugaagaagu

SEQ ID NO: 2745412 - RNA, 11 nt, Human
ugaugaagaag

SEQ ID NO: 2745413 - RNA, 14 nt, Human
ugaugggaaagcau

SEQ ID NO: 2745414 - RNA, 19 nt, Human
ugaugggaaagcauuguaa

SEQ ID NO: 2745415 - RNA, 13 nt, Human
agccagcucucag

SEQ ID NO: 2745416 - RNA, 15 nt, Human
agccagcucucagcc

SEQ ID NO: 2745417 - RNA, 14 nt, Human
agccagcucucagc

SEQ ID NO: 2745418 - RNA, 16 nt, Human
agccagcucucagcca

SEQ ID NO: 2745419 - RNA, 17 nt, Human
ugauuuagcaggaagcu

SEQ ID NO: 2745420 - RNA, 20 nt, Human
ugauuuagcaggaagcugug

SEQ ID NO: 2745421 - RNA, 17 nt, Human
agccucauccgaggcag

SEQ ID NO: 2745422 - RNA, 14 nt, Human
agccucauccgagg

SEQ ID NO: 2745423 - RNA, 15 nt, Human
ugcagaagacaguau

SEQ ID NO: 2745424 - RNA, 14 nt, Human
ugcagaagacagua

SEQ ID NO: 2745425 - RNA, 11 nt, Human
agcccugucuc

SEQ ID NO: 2745426 - RNA, 18 nt, Human
agcccugucuccucucuc

SEQ ID NO: 2745427 - RNA, 12 nt, Human
ugccagccagca

SEQ ID NO: 2745428 - RNA, 11 nt, Human
ugccagccagc

SEQ ID NO: 2745429 - RNA, 22 nt, Human
agccuuccccuugcccagggcu

SEQ ID NO: 2745430 - RNA, 20 nt, Human
agccuuccccuugcccaggg

SEQ ID NO: 2745431 - RNA, 22 nt, Human
ugcagcucuccccuucucugua

SEQ ID NO: 2745432 - RNA, 20 nt, Human
ugcagcucuccccuucucug

SEQ ID NO: 2745433 - RNA, 16 nt, Human
ugccccauucaacauc

SEQ ID NO: 2745434 - RNA, 18 nt, Human
ugccccccuugccagaca

SEQ ID NO: 2745435 - RNA, 19 nt, Human
agcuauggugucauaggcu

SEQ ID NO: 2745436 - RNA, 22 nt, Human
ugccauuuaaagcuuauuaaaa

SEQ ID NO: 2745437 - RNA, 12 nt, Human
ugcccucuccug

SEQ ID NO: 2745438 - RNA, 15 nt, Human
ugcccucuccugggc

SEQ ID NO: 2745439 - RNA, 14 nt, Human
ugcccucuccuggg

SEQ ID NO: 2745440 - RNA, 13 nt, Human
ugcccucuccugg

SEQ ID NO: 2745441 - RNA, 20 nt, Human
ugcccucuccugggcagcug

SEQ ID NO: 2745442 - RNA, 18 nt, Human
ugcccucuccugggcagc

SEQ ID NO: 2745443 - RNA, 17 nt, Human
ugcccucuccugggcag

SEQ ID NO: 2745444 - RNA, 16 nt, Human
ugcccucuccugggca

SEQ ID NO: 2745445 - RNA, 23 nt, Human
ugcccucuccugggcagcugccu

SEQ ID NO: 2745446 - RNA, 22 nt, Human
ugcccucuccugggcagcugcc

SEQ ID NO: 2745447 - RNA, 23 nt, Human
agcucugcccauccugccccuga

SEQ ID NO: 2745448 - RNA, 18 nt, Human
agcugcccucuccugggc

SEQ ID NO: 2745449 - RNA, 17 nt, Human
agcugcccucuccuggg

SEQ ID NO: 2745450 - RNA, 20 nt, Human
agcugcccucuccugggcag

SEQ ID NO: 2745451 - RNA, 19 nt, Human
agcugcccucuccugggca

SEQ ID NO: 2745452 - RNA, 21 nt, Human
agcugcccucuccugggcagc

SEQ ID NO: 2745453 - RNA, 15 nt, Human
ugccucaccccuugc

SEQ ID NO: 2745454 - RNA, 11 nt, Human
ugccuccccuc

SEQ ID NO: 2745455 - RNA, 15 nt, Human
ugccuccccuccucu

SEQ ID NO: 2745456 - RNA, 14 nt, Human
ugccuccccuccuc

SEQ ID NO: 2745457 - RNA, 13 nt, Human
ugccuccccuccu

SEQ ID NO: 2745458 - RNA, 12 nt, Human
ugccuccccucc

SEQ ID NO: 2745459 - RNA, 16 nt, Human
ugccuccccuccucug

SEQ ID NO: 2745460 - RNA, 18 nt, Human
ugccucagaaaacaagga

SEQ ID NO: 2745461 - RNA, 19 nt, Human
uguuugcuaagcauuccaa

SEQ ID NO: 2745462 - RNA, 15 nt, Human
uguuugcuaagcauu

SEQ ID NO: 2745463 - RNA, 20 nt, Human
uguuuuauaauuuugugaag

SEQ ID NO: 2745464 - RNA, 13 nt, Human
uguuuuauaauuu

SEQ ID NO: 2745465 - RNA, 14 nt, Human
uguuuuaggagcau

SEQ ID NO: 2745466 - RNA, 21 nt, Human
aguugauaugccuuuucccaa

SEQ ID NO: 2745467 - RNA, 14 nt, Human
aguucugaagaaga

SEQ ID NO: 2745468 - RNA, 13 nt, Human
aguucugaagaag

SEQ ID NO: 2745469 - RNA, 15 nt, Human
aguucugaagaagau

SEQ ID NO: 2745470 - RNA, 23 nt, Human
aguucugugguuucauguuaguu

SEQ ID NO: 2745471 - RNA, 16 nt, Human
aguucugugguuucau

SEQ ID NO: 2745472 - RNA, 19 nt, Human
aguucugugguuucauguu

SEQ ID NO: 2745473 - RNA, 22 nt, Human
aguucugugguuucauguuagu

SEQ ID NO: 2745474 - RNA, 12 nt, Human
aguuuggccaga

SEQ ID NO: 2745475 - RNA, 19 nt, Human
uuaaauucccguuuuguca

SEQ ID NO: 2745476 - RNA, 22 nt, Human
uuaaauucccguuuugucacuu

SEQ ID NO: 2745477 - RNA, 16 nt, Human
aguuugguuucuagca

SEQ ID NO: 2745478 - RNA, 13 nt, Human
aguuuggccagaa

SEQ ID NO: 2745479 - RNA, 14 nt, Human
aguuuggccagaag

SEQ ID NO: 2745480 - RNA, 20 nt, Human
uuaaaaaugguuuaaauggu

SEQ ID NO: 2745481 - RNA, 22 nt, Human
aguugcauagguuuaauaauuu

SEQ ID NO: 2745482 - RNA, 18 nt, Human
uuaaaaaagaaacauuug

SEQ ID NO: 2745483 - RNA, 15 nt, Human
uuaaaaaagaaacau

SEQ ID NO: 2745484 - RNA, 22 nt, Human
aguuaccuuauaguuacugugu

SEQ ID NO: 2745485 - RNA, 16 nt, Human
aguuaccuuauaguua

SEQ ID NO: 2745486 - RNA, 17 nt, Human
aguuaccuuauaguuac

SEQ ID NO: 2745487 - RNA, 20 nt, Human
aguuaccuuauaguuacugu

SEQ ID NO: 2745488 - RNA, 21 nt, Human
aguuaccuuauaguuacugug

SEQ ID NO: 2745489 - RNA, 20 nt, Human
aguuauuauauuuacaaaug

SEQ ID NO: 2745490 - RNA, 19 nt, Human
aguuauggcuauaggugcu

SEQ ID NO: 2745491 - RNA, 18 nt, Human
aguucagagcugcccucu

SEQ ID NO: 2745492 - RNA, 17 nt, Human
aguucagagcugcccuc

SEQ ID NO: 2745493 - RNA, 16 nt, Human
aguucagagcugcccu

SEQ ID NO: 2745494 - RNA, 15 nt, Human
aguucagagcugccc

SEQ ID NO: 2745495 - RNA, 14 nt, Human
aguucagagcugcc

SEQ ID NO: 2745496 - RNA, 20 nt, Human
aguucggugagcuacaaaug

SEQ ID NO: 2745497 - RNA, 21 nt, Human
auacaguucggugagcuacaa

SEQ ID NO: 2745498 - RNA, 20 nt, Human
auacaucccuuaccugggaa

SEQ ID NO: 2745499 - RNA, 22 nt, Human
auaccacaggaaccacaagacu

SEQ ID NO: 2745500 - RNA, 22 nt, Human
auaauuuuuauauuugaaauau

SEQ ID NO: 2745501 - RNA, 21 nt, Human
auaauuuuuauauuugaaaua

SEQ ID NO: 2745502 - RNA, 22 nt, Human
auacaaaaaaaaaaaaaaauua

SEQ ID NO: 2745503 - RNA, 20 nt, Human
auaauuuugugaagcaaaau

SEQ ID NO: 2745504 - RNA, 15 nt, Human
auaauuuugugaagc

SEQ ID NO: 2745505 - RNA, 14 nt, Human
auaauuuugugaag

SEQ ID NO: 2745506 - RNA, 13 nt, Human
auaauuuugugaa

SEQ ID NO: 2745507 - RNA, 19 nt, Human
auaauuuuuauauuugaaa

SEQ ID NO: 2745508 - RNA, 16 nt, Human
auaauuuuuauauuug

SEQ ID NO: 2745509 - RNA, 14 nt, Human
auaauuuuuauauu

SEQ ID NO: 2745510 - RNA, 18 nt, Human
uuauauaagcuuguauuc

SEQ ID NO: 2745511 - RNA, 19 nt, Human
uuauaguuacuguguaauu

SEQ ID NO: 2745512 - RNA, 13 nt, Human
uuauaguuacugu

SEQ ID NO: 2745513 - RNA, 14 nt, Human
uuauaguuacugug

SEQ ID NO: 2745514 - RNA, 15 nt, Human
uuauaguuacugugu

SEQ ID NO: 2745515 - RNA, 19 nt, Human
uuauaacuaacauguccug

SEQ ID NO: 2745516 - RNA, 15 nt, Human
uuauaacuaacaugu

SEQ ID NO: 2745517 - RNA, 21 nt, Human
uuagccguggugauuuagcag

SEQ ID NO: 2745518 - RNA, 15 nt, Human
auaaacucauuucua

SEQ ID NO: 2745519 - RNA, 12 nt, Human
aguuuucugaga

SEQ ID NO: 2745520 - RNA, 13 nt, Human
aguuuucugagaa

SEQ ID NO: 2745521 - RNA, 14 nt, Human
aguuuucugagaaa

SEQ ID NO: 2745522 - RNA, 17 nt, Human
aguuuucugagaaagac

SEQ ID NO: 2745523 - RNA, 19 nt, Human
auaaaugugccuucauuuu

SEQ ID NO: 2745524 - RNA, 12 nt, Human
auaacuggaaac

SEQ ID NO: 2745525 - RNA, 18 nt, Human
uuaccuaagauuacaaau

SEQ ID NO: 2745526 - RNA, 14 nt, Human
uuaccuaagauuac

SEQ ID NO: 2745527 - RNA, 21 nt, Human
auaaucuuucacaggggacag

SEQ ID NO: 2745528 - RNA, 14 nt, Human
auaaugaauacuuu

SEQ ID NO: 2745529 - RNA, 22 nt, Human
uuagaugcaguucugaagaaga

SEQ ID NO: 2745530 - RNA, 23 nt, Human
uuagaugcaguucugaagaagau

SEQ ID NO: 2745531 - RNA, 16 nt, Human
auaauuggauuuccua

SEQ ID NO: 2745532 - RNA, 17 nt, Human
auaauuggauuuccuaa

SEQ ID NO: 2745533 - RNA, 18 nt, Human
auaauuggauuuccuaau

SEQ ID NO: 2745534 - RNA, 20 nt, Human
auaauuggauuuccuaauac

SEQ ID NO: 2745535 - RNA, 18 nt, Human
uuagcaggaagcugugag

SEQ ID NO: 2745536 - RNA, 23 nt, Human
agucaucuugcuaccaguauuua

SEQ ID NO: 2745537 - RNA, 11 nt, Human
agucaucuugc

SEQ ID NO: 2745538 - RNA, 13 nt, Human
agucaucuugcua

SEQ ID NO: 2745539 - RNA, 19 nt, Human
agucaucuugcuaccagua

SEQ ID NO: 2745540 - RNA, 20 nt, Human
agucagauggaaaauucauu

SEQ ID NO: 2745541 - RNA, 22 nt, Human
agucagauggaaaauucauuuu

SEQ ID NO: 2745542 - RNA, 23 nt, Human
agucagauggaaaauucauuuuu

SEQ ID NO: 2745543 - RNA, 20 nt, Human
ugucagcuccccucggagaa

SEQ ID NO: 2745544 - RNA, 21 nt, Human
ugucagcuccccucggagaag

SEQ ID NO: 2745545 - RNA, 23 nt, Human
ugucagcuccccucggagaagag

SEQ ID NO: 2745546 - RNA, 19 nt, Human
ugucccuacaccccucccc

SEQ ID NO: 2745547 - RNA, 12 nt, Human
ugucccuacacc

SEQ ID NO: 2745548 - RNA, 16 nt, Human
aguauuguccaggucu

SEQ ID NO: 2745549 - RNA, 15 nt, Human
aguauuguccagguc

SEQ ID NO: 2745550 - RNA, 20 nt, Human
agucacauuccaagccucau

SEQ ID NO: 2745551 - RNA, 21 nt, Human
aguauguuagugcaaauuguc

SEQ ID NO: 2745552 - RNA, 18 nt, Human
aguauguuagugcaaauu

SEQ ID NO: 2745553 - RNA, 21 nt, Human
aguauuagaauaccacaggaa

SEQ ID NO: 2745554 - RNA, 14 nt, Human
ugucuuaauuaaaa

SEQ ID NO: 2745555 - RNA, 15 nt, Human
ugucuccucucucug

SEQ ID NO: 2745556 - RNA, 17 nt, Human
ugucucuacuaaaaaua

SEQ ID NO: 2745557 - RNA, 14 nt, Human
ugucuucacaacag

SEQ ID NO: 2745558 - RNA, 16 nt, Human
agugagccgagauugu

SEQ ID NO: 2745559 - RNA, 21 nt, Human
agugagcagucaggaaagaga

SEQ ID NO: 2745560 - RNA, 22 nt, Human
agugaaagaggcagcuugaaac

SEQ ID NO: 2745561 - RNA, 14 nt, Human
agugagacagcucu

SEQ ID NO: 2745562 - RNA, 16 nt, Human
agugaaagaggcagcu

SEQ ID NO: 2745563 - RNA, 17 nt, Human
agugaaagaaaauaaca

SEQ ID NO: 2745564 - RNA, 14 nt, Human
ugugaagcaaaauu

SEQ ID NO: 2745565 - RNA, 22 nt, Human
ugugagaugcuagaacucccuu

SEQ ID NO: 2745566 - RNA, 21 nt, Human
agucucucuucucuccagcug

SEQ ID NO: 2745567 - RNA, 23 nt, Human
agucucucuucucuccagcugac

SEQ ID NO: 2745568 - RNA, 15 nt, Human
aggucagugcaaaua

SEQ ID NO: 2745569 - RNA, 20 nt, Human
aggguuuauguuuaggaugu

SEQ ID NO: 2745570 - RNA, 18 nt, Human
aggguucagagacucagg

SEQ ID NO: 2745571 - RNA, 16 nt, Human
aggguucagagacuca

SEQ ID NO: 2745572 - RNA, 17 nt, Human
aggguuaugauuaagua

SEQ ID NO: 2745573 - RNA, 22 nt, Human
uggucugugagaugcuagaacu

SEQ ID NO: 2745574 - RNA, 22 nt, Human
ugguccaugggccauaugaaaa

SEQ ID NO: 2745575 - RNA, 19 nt, Human
aggguaccuugaacacugg

SEQ ID NO: 2745576 - RNA, 23 nt, Human
aggguaccuugaacacuggggga

SEQ ID NO: 2745577 - RNA, 16 nt, Human
aggggaauugaggaca

SEQ ID NO: 2745578 - RNA, 21 nt, Human
agggugaugggaaagcauugu

SEQ ID NO: 2745579 - RNA, 22 nt, Human
agggugaugggaaagcauugua

SEQ ID NO: 2745580 - RNA, 15 nt, Human
ugguuuaaagaaagu

SEQ ID NO: 2745581 - RNA, 16 nt, Human
ugguuuaaagaaagug

SEQ ID NO: 2745582 - RNA, 17 nt, Human
ugguuuaaagaaagugu

SEQ ID NO: 2745583 - RNA, 19 nt, Human
ugguuuaaagaaaguguau

SEQ ID NO: 2745584 - RNA, 23 nt, Human
uggugugaccacugcagaagaca

SEQ ID NO: 2745585 - RNA, 21 nt, Human
ugguuuaaagaaaguguauuu

SEQ ID NO: 2745586 - RNA, 15 nt, Human
ugguuucuagcauga

SEQ ID NO: 2745587 - RNA, 12 nt, Human
ugguuucauguu

SEQ ID NO: 2745588 - RNA, 15 nt, Human
ugguuucauguuagu

SEQ ID NO: 2745589 - RNA, 18 nt, Human
uguaagaaaauaucacuu

SEQ ID NO: 2745590 - RNA, 17 nt, Human
uguaagaaaauaucacu

SEQ ID NO: 2745591 - RNA, 14 nt, Human
ugaaauaagccaga

SEQ ID NO: 2745592 - RNA, 20 nt, Human
agagcugcccucuccugggc

SEQ ID NO: 2745593 - RNA, 19 nt, Human
agagcugcccucuccuggg

SEQ ID NO: 2745594 - RNA, 18 nt, Human
agagcugcccucuccugg

SEQ ID NO: 2745595 - RNA, 17 nt, Human
agagcugcccucuccug

SEQ ID NO: 2745596 - RNA, 16 nt, Human
agagcugcccucuccu

SEQ ID NO: 2745597 - RNA, 13 nt, Human
ugaacaaauuuac

SEQ ID NO: 2745598 - RNA, 18 nt, Human
ugaacccgggaggcagag

SEQ ID NO: 2745599 - RNA, 22 nt, Human
ugaacccauauuuguacaccaa

SEQ ID NO: 2745600 - RNA, 22 nt, Human
ugaagaagcaccaaucaugaau

SEQ ID NO: 2745601 - RNA, 17 nt, Human
ugaaguacucauacaug

SEQ ID NO: 2745602 - RNA, 20 nt, Human
ugaagauuuaccacuugugu

SEQ ID NO: 2745603 - RNA, 17 nt, Human
ugaagauuuaccacuug

SEQ ID NO: 2745604 - RNA, 18 nt, Human
agagcuguucacagccag

SEQ ID NO: 2745605 - RNA, 23 nt, Human
agacuggcacaguuuucugagaa

SEQ ID NO: 2745606 - RNA, 20 nt, Human
agacuggcacaguuuucuga

SEQ ID NO: 2745607 - RNA, 21 nt, Human
agacuggcacaguuuucugag

SEQ ID NO: 2745608 - RNA, 18 nt, Human
agacaggaccugacuauu

SEQ ID NO: 2745609 - RNA, 22 nt, Human
agacuccaaagaaauguaaggg

SEQ ID NO: 2745610 - RNA, 16 nt, Human
agagacacacugaaga

SEQ ID NO: 2745611 - RNA, 14 nt, Human
agagacagaaagca

SEQ ID NO: 2745612 - RNA, 17 nt, Human
ugaaagaggaaugaagu

SEQ ID NO: 2745613 - RNA, 18 nt, Human
ugaaagaggaaugaagua

SEQ ID NO: 2745614 - RNA, 17 nt, Human
ugaaaauauuuguauca

SEQ ID NO: 2745615 - RNA, 20 nt, Human
ugaaaaucuuauaauuuaaa

SEQ ID NO: 2745616 - RNA, 21 nt, Human
ugaaaauauuuguaucacaaa

SEQ ID NO: 2745617 - RNA, 22 nt, Human
ugaaaauauuuguaucacaaau

SEQ ID NO: 2745618 - RNA, 16 nt, Human
ugaaaaugggcucaac

SEQ ID NO: 2745619 - RNA, 13 nt, Human
ugaaagaaaauaa

SEQ ID NO: 2745620 - RNA, 24 nt, Human
ugagaugugaacacaucagcuugc

SEQ ID NO: 2745621 - RNA, 18 nt, Human
ugagaugugaacacauca

SEQ ID NO: 2745622 - RNA, 19 nt, Human
ugagaugugaacacaucag

SEQ ID NO: 2745623 - RNA, 13 nt, Human
ugagaugugaaca

SEQ ID NO: 2745624 - RNA, 22 nt, Human
ugagagacacacugaagaagca

SEQ ID NO: 2745625 - RNA, 21 nt, Human
ugagagacacacugaagaagc

SEQ ID NO: 2745626 - RNA, 21 nt, Human
ugagagcaguuugguuucuag

SEQ ID NO: 2745627 - RNA, 23 nt, Human
ugagagcaguuugguuucuagca

SEQ ID NO: 2745628 - RNA, 20 nt, Human
ugagagacacacugaagaag

SEQ ID NO: 2745629 - RNA, 19 nt, Human
ugagagacacacugaagaa

SEQ ID NO: 2745630 - RNA, 17 nt, Human
ugagagacacacugaag

SEQ ID NO: 2745631 - RNA, 16 nt, Human
ugagagacacacugaa

SEQ ID NO: 2745632 - RNA, 12 nt, Human
ugagacagcucu

SEQ ID NO: 2745633 - RNA, 20 nt, Human
ugagacucugucucagucca

SEQ ID NO: 2745634 - RNA, 14 nt, Human
agauuuuccugaaa

SEQ ID NO: 2745635 - RNA, 15 nt, Human
agauuuuccugaaaa

SEQ ID NO: 2745636 - RNA, 16 nt, Human
agauuuuccugaaaac

SEQ ID NO: 2745637 - RNA, 20 nt, Human
agcaagggugaugggaaagc

SEQ ID NO: 2745638 - RNA, 22 nt, Human
agcaagggugaugggaaagcau

SEQ ID NO: 2745639 - RNA, 16 nt, Human
agcaagggugauggga

SEQ ID NO: 2745640 - RNA, 20 nt, Human
agauuacaaaucagaaguca

SEQ ID NO: 2745641 - RNA, 21 nt, Human
agauugugccccugcacucca

SEQ ID NO: 2745642 - RNA, 22 nt, Human
ugacuaucaaacugaagccaga

SEQ ID NO: 2745643 - RNA, 16 nt, Human
ugacuaucaaacugaa

SEQ ID NO: 2745644 - RNA, 20 nt, Human
ugacuauugaaguugcagau

SEQ ID NO: 2745645 - RNA, 22 nt, Human
agaugugaacacaucagcuugc

SEQ ID NO: 2745646 - RNA, 17 nt, Human
agaugugaacacaucag

SEQ ID NO: 2745647 - RNA, 22 nt, Human
agauguauguacuucaugcugu

SEQ ID NO: 2745648 - RNA, 13 nt, Human
ugacacugcucua

SEQ ID NO: 2745649 - RNA, 15 nt, Human
ugacacugcucuaac

SEQ ID NO: 2745650 - RNA, 16 nt, Human
ugacacugcucuaaca

SEQ ID NO: 2745651 - RNA, 22 nt, Human
ugacacugcucuaacagcccuc

SEQ ID NO: 2745652 - RNA, 19 nt, Human
ugacacugcucuaacagcc

SEQ ID NO: 2745653 - RNA, 21 nt, Human
ugacacugcucuaacagcccu

SEQ ID NO: 2745654 - RNA, 15 nt, Human
ugacacuuaaaaaug

SEQ ID NO: 2745655 - RNA, 20 nt, Human
agaugcaguucugaagaaga

SEQ ID NO: 2745656 - RNA, 16 nt, Human
agaugcacaugagcug

SEQ ID NO: 2745657 - RNA, 13 nt, Human
agaugcacaugag

SEQ ID NO: 2745658 - RNA, 21 nt, Human
agaugcaguucugaagaagau

SEQ ID NO: 2745659 - RNA, 19 nt, Human
agaugcuagaacucccuuu

SEQ ID NO: 2745660 - RNA, 21 nt, Human
agaugcuagaacucccuuuca

SEQ ID NO: 2745661 - RNA, 14 nt, Human
agauguaguauuuu

SEQ ID NO: 2745662 - RNA, 13 nt, Human
agauccuggaaau

SEQ ID NO: 2745663 - RNA, 14 nt, Human
ucugcuugccaucc

SEQ ID NO: 2745664 - RNA, 23 nt, Human
ucugcuugccaucccucccucca

SEQ ID NO: 2745665 - RNA, 20 nt, Human
ucugcuugccaucccucccu

SEQ ID NO: 2745666 - RNA, 17 nt, Human
ucugcuugccaucccuc

SEQ ID NO: 2745667 - RNA, 16 nt, Human
ucugcuugccaucccu

SEQ ID NO: 2745668 - RNA, 18 nt, Human
agaagccaacuaugauua

SEQ ID NO: 2745669 - RNA, 23 nt, Human
agaagccaacuaugauuauuaac

SEQ ID NO: 2745670 - RNA, 18 nt, Human
agaagaugguaccaccag

SEQ ID NO: 2745671 - RNA, 14 nt, Human
agaagaacugaaau

SEQ ID NO: 2745672 - RNA, 13 nt, Human
agaagaacugaaa

SEQ ID NO: 2745673 - RNA, 14 nt, Human
agaaaugaaagcag

SEQ ID NO: 2745674 - RNA, 15 nt, Human
ucugcagauaaacag

SEQ ID NO: 2745675 - RNA, 18 nt, Human
ucugcagauaaacaguag

SEQ ID NO: 2745676 - RNA, 15 nt, Human
agacacacaugaagu

SEQ ID NO: 2745677 - RNA, 12 nt, Human
agacacacauga

SEQ ID NO: 2745678 - RNA, 24 nt, Human
agacagagccccacccucagaugc

SEQ ID NO: 2745679 - RNA, 22 nt, Human
agacagagccccacccucagau

SEQ ID NO: 2745680 - RNA, 14 nt, Human
ucugugagaugcua

SEQ ID NO: 2745681 - RNA, 22 nt, Human
ucugugagaugcuagaacuccc

SEQ ID NO: 2745682 - RNA, 17 nt, Human
ucugugagaugcuagaa

SEQ ID NO: 2745683 - RNA, 23 nt, Human
ucugugagaugcuagaacucccu

SEQ ID NO: 2745684 - RNA, 23 nt, Human
agaauuaacacaugauccugcaa

SEQ ID NO: 2745685 - RNA, 15 nt, Human
agaauuaacacauga

SEQ ID NO: 2745686 - RNA, 16 nt, Human
acuuaauguauguuac

SEQ ID NO: 2745687 - RNA, 13 nt, Human
acuuaauguaugu

SEQ ID NO: 2745688 - RNA, 15 nt, Human
acuuaauguauguua

SEQ ID NO: 2745689 - RNA, 14 nt, Human
ucuaaguaaaacca

SEQ ID NO: 2745690 - RNA, 15 nt, Human
ucuaaguaaaaccac

SEQ ID NO: 2745691 - RNA, 19 nt, Human
ucuaaguaaaaccacagca

SEQ ID NO: 2745692 - RNA, 13 nt, Human
uccugggcagcug

SEQ ID NO: 2745693 - RNA, 12 nt, Human
uccugggcagcu

SEQ ID NO: 2745694 - RNA, 17 nt, Human
ucuaggaaauauuuauu

SEQ ID NO: 2745695 - RNA, 16 nt, Human
ucuaggaaauauuuau

SEQ ID NO: 2745696 - RNA, 15 nt, Human
ucuccucacuguauc

SEQ ID NO: 2745697 - RNA, 15 nt, Human
acuugucaauaaaau

SEQ ID NO: 2745698 - RNA, 17 nt, Human
ucucauggguggcacuc

SEQ ID NO: 2745699 - RNA, 15 nt, Human
ucucauuuccaagca

SEQ ID NO: 2745700 - RNA, 12 nt, Human
ucucaggaaauc

SEQ ID NO: 2745701 - RNA, 15 nt, Human
ucucagccaacgagu

SEQ ID NO: 2745702 - RNA, 14 nt, Human
ucucaggaaaucaa

SEQ ID NO: 2745703 - RNA, 21 nt, Human
ucucaggaaaucaaauaugca

SEQ ID NO: 2745704 - RNA, 23 nt, Human
ucucaggaaaucaaauaugcaaa

SEQ ID NO: 2745705 - RNA, 17 nt, Human
acuauauuguuugcuaa

SEQ ID NO: 2745706 - RNA, 22 nt, Human
acuauauuguuugcuaagcauu

SEQ ID NO: 2745707 - RNA, 15 nt, Human
acuaucucauuucca

SEQ ID NO: 2745708 - RNA, 19 nt, Human
acuaucaaacugaagccag

SEQ ID NO: 2745709 - RNA, 14 nt, Human
acuaucaaacugaa

SEQ ID NO: 2745710 - RNA, 17 nt, Human
acuaucucauuuccaag

SEQ ID NO: 2745711 - RNA, 16 nt, Human
acuaucucauuuccaa

SEQ ID NO: 2745712 - RNA, 23 nt, Human
ucccagaggagccaccaguucuc

SEQ ID NO: 2745713 - RNA, 16 nt, Human
ucccagaggagccacc

SEQ ID NO: 2745714 - RNA, 20 nt, Human
ucccagaggagccaccaguu

SEQ ID NO: 2745715 - RNA, 21 nt, Human
ucccagaggagccaccaguuc

SEQ ID NO: 2745716 - RNA, 17 nt, Human
acuaaacuuuuuuucug

SEQ ID NO: 2745717 - RNA, 18 nt, Human
acuaaacuuuuuuucugu

SEQ ID NO: 2745718 - RNA, 22 nt, Human
acuaaacuuuuuuucuguacca

SEQ ID NO: 2745719 - RNA, 19 nt, Human
acuaaacuuuuuuucugua

SEQ ID NO: 2745720 - RNA, 20 nt, Human
acuaaacuuuuuuucuguac

SEQ ID NO: 2745721 - RNA, 15 nt, Human
acuaauuuuaaaaug

SEQ ID NO: 2745722 - RNA, 15 nt, Human
uccauccugaggcuc

SEQ ID NO: 2745723 - RNA, 12 nt, Human
uccauccugagg

SEQ ID NO: 2745724 - RNA, 11 nt, Human
uccauccugag

SEQ ID NO: 2745725 - RNA, 18 nt, Human
uccagugagacagcucug

SEQ ID NO: 2745726 - RNA, 15 nt, Human
acgccugaggcaauu

SEQ ID NO: 2745727 - RNA, 19 nt, Human
acgccugaggcaauuagac

SEQ ID NO: 2745728 - RNA, 11 nt, Human
acgcucucugg

SEQ ID NO: 2745729 - RNA, 20 nt, Human
accuuuuggucuggagggaa

SEQ ID NO: 2745730 - RNA, 22 nt, Human
uccacugguucuucuuggucuc

SEQ ID NO: 2745731 - RNA, 19 nt, Human
accuugaaaacuuuaugcu

SEQ ID NO: 2745732 - RNA, 21 nt, Human
accuugaacacugggggaggg

SEQ ID NO: 2745733 - RNA, 18 nt, Human
accuugaacacuggggga

SEQ ID NO: 2745734 - RNA, 12 nt, Human
acugaagaagca

SEQ ID NO: 2745735 - RNA, 16 nt, Human
acugacucuuaagaag

SEQ ID NO: 2745736 - RNA, 15 nt, Human
acugacucuuaagaa

SEQ ID NO: 2745737 - RNA, 14 nt, Human
acugacucuuaaga

SEQ ID NO: 2745738 - RNA, 13 nt, Human
acugacucuuaag

SEQ ID NO: 2745739 - RNA, 20 nt, Human
acugacucuuaagaagacug

SEQ ID NO: 2745740 - RNA, 18 nt, Human
acugacucuuaagaagac

SEQ ID NO: 2745741 - RNA, 17 nt, Human
acugacucuuaagaaga

SEQ ID NO: 2745742 - RNA, 13 nt, Human
acugacuucuaag

SEQ ID NO: 2745743 - RNA, 15 nt, Human
acugacuucuaagua

SEQ ID NO: 2745744 - RNA, 16 nt, Human
acugacuucuaaguaa

SEQ ID NO: 2745745 - RNA, 22 nt, Human
acugacuucuaaguaaaaccac

SEQ ID NO: 2745746 - RNA, 18 nt, Human
acugagagugaacaaauu

SEQ ID NO: 2745747 - RNA, 22 nt, Human
acugagaugugaacacaucagc

SEQ ID NO: 2745748 - RNA, 17 nt, Human
acugagaugugaacaca

SEQ ID NO: 2745749 - RNA, 16 nt, Human
uccuggaaaucagggu

SEQ ID NO: 2745750 - RNA, 21 nt, Human
acucuuaagaagacugcauua

SEQ ID NO: 2745751 - RNA, 19 nt, Human
acuccagugagacagcucu

SEQ ID NO: 2745752 - RNA, 23 nt, Human
ucagccuuccccuugcccagggc

SEQ ID NO: 2745753 - RNA, 22 nt, Human
ucagccuuccccuugcccaggg

SEQ ID NO: 2745754 - RNA, 21 nt, Human
ucagccuuccccuugcccagg

SEQ ID NO: 2745755 - RNA, 16 nt, Human
ucagccugugcugccc

SEQ ID NO: 2745756 - RNA, 12 nt, Human
ucagccugugcu

SEQ ID NO: 2745757 - RNA, 14 nt, Human
ucagccuggugggc

SEQ ID NO: 2745758 - RNA, 17 nt, Human
ucagccugugcugcccg

SEQ ID NO: 2745759 - RNA, 19 nt, Human
ucagccuggugggccuccu

SEQ ID NO: 2745760 - RNA, 18 nt, Human
ucagccuggugggccucc

SEQ ID NO: 2745761 - RNA, 17 nt, Human
ucagccuggugggccuc

SEQ ID NO: 2745762 - RNA, 19 nt, Human
accccagacuagauguagu

SEQ ID NO: 2745763 - RNA, 14 nt, Human
ucagcccucagaau

SEQ ID NO: 2745764 - RNA, 17 nt, Human
acccgggaggcagaggu

SEQ ID NO: 2745765 - RNA, 15 nt, Human
acccgggaggcagag

SEQ ID NO: 2745766 - RNA, 12 nt, Human
ucaugcagcugu

SEQ ID NO: 2745767 - RNA, 14 nt, Human
ucaugcagcugugg

SEQ ID NO: 2745768 - RNA, 15 nt, Human
ucaguuuuugugaaa

SEQ ID NO: 2745769 - RNA, 17 nt, Human
ucaguuuuugugaaaag

SEQ ID NO: 2745770 - RNA, 14 nt, Human
acaugggacauuug

SEQ ID NO: 2745771 - RNA, 11 nt, Human
acaugggacau

SEQ ID NO: 2745772 - RNA, 20 nt, Human
acaugggacauuugcucaug

SEQ ID NO: 2745773 - RNA, 15 nt, Human
acaugggacauuugc

SEQ ID NO: 2745774 - RNA, 21 nt, Human
acaugggacauuugcucaugg

SEQ ID NO: 2745775 - RNA, 16 nt, Human
acaugaaguccaagca

SEQ ID NO: 2745776 - RNA, 20 nt, Human
acaugagguacugagaguga

SEQ ID NO: 2745777 - RNA, 16 nt, Human
acaugagguacugaga

SEQ ID NO: 2745778 - RNA, 23 nt, Human
acaugagguacugagagugaaca

SEQ ID NO: 2745779 - RNA, 15 nt, Human
ucaaauugugugaaa

SEQ ID NO: 2745780 - RNA, 18 nt, Human
ucaaauugugugaaaggu

SEQ ID NO: 2745781 - RNA, 23 nt, Human
accaaaaaucucaauauuucaga

SEQ ID NO: 2745782 - RNA, 19 nt, Human
ucaauauuucagauaauca

SEQ ID NO: 2745783 - RNA, 15 nt, Human
ucaauauuucagaua

SEQ ID NO: 2745784 - RNA, 23 nt, Human
ucaaugaaugaaugaauggcuaa

SEQ ID NO: 2745785 - RNA, 22 nt, Human
ucaauaucuuuuuuuuaauaaa

SEQ ID NO: 2745786 - RNA, 16 nt, Human
ucaauucuugccaaau

SEQ ID NO: 2745787 - RNA, 21 nt, Human
ucacaacagauuauuaccuua

SEQ ID NO: 2745788 - RNA, 14 nt, Human
ucaccucauggaau

SEQ ID NO: 2745789 - RNA, 13 nt, Human
ucaccucauggaa

SEQ ID NO: 2745790 - RNA, 12 nt, Human
ucaccucaugga

SEQ ID NO: 2745791 - RNA, 23 nt, Human
ucacuugaacccgggaggcagag

SEQ ID NO: 2745792 - RNA, 11 nt, Human
accaguauuua

SEQ ID NO: 2745793 - RNA, 19 nt, Human
accaguauuuagaagccaa

SEQ ID NO: 2745794 - RNA, 14 nt, Human
accaguauuuagaa

SEQ ID NO: 2745795 - RNA, 18 nt, Human
accaguauuuagaagcca

SEQ ID NO: 2745796 - RNA, 14 nt, Human
accagucugacugu

SEQ ID NO: 2745797 - RNA, 14 nt, Human
uaacuacuuuauaa

SEQ ID NO: 2745798 - RNA, 20 nt, Human
uaacgauaaaagacagugaa

SEQ ID NO: 2745799 - RNA, 16 nt, Human
uaacuacuuuauaacu

SEQ ID NO: 2745800 - RNA, 17 nt, Human
uaacuacuuuauaacua

SEQ ID NO: 2745801 - RNA, 23 nt, Human
uaacuacuuuauaacuaacaugu

SEQ ID NO: 2745802 - RNA, 18 nt, Human
uaagaagugaaaaucuac

SEQ ID NO: 2745803 - RNA, 12 nt, Human
uaacuucuugcu

SEQ ID NO: 2745804 - RNA, 13 nt, Human
uaacuucuugcuu

SEQ ID NO: 2745805 - RNA, 15 nt, Human
uaacuucuugcuucu

SEQ ID NO: 2745806 - RNA, 19 nt, Human
uaacuucuugcuucuuucu

SEQ ID NO: 2745807 - RNA, 20 nt, Human
uaacuucuugcuucuuucua

SEQ ID NO: 2745808 - RNA, 16 nt, Human
aauagucaaauugugu

SEQ ID NO: 2745809 - RNA, 22 nt, Human
aauaucacuugucaauaaaauc

SEQ ID NO: 2745810 - RNA, 20 nt, Human
aauaucacuugucaauaaaa

SEQ ID NO: 2745811 - RNA, 21 nt, Human
aaucaggguuaguauugucca

SEQ ID NO: 2745812 - RNA, 16 nt, Human
aaucaggguuaguauu

SEQ ID NO: 2745813 - RNA, 22 nt, Human
aaucaggguuaguauuguccag

SEQ ID NO: 2745814 - RNA, 24 nt, Human
aauaugccccauucaacaucuagu

SEQ ID NO: 2745815 - RNA, 21 nt, Human
aauaugccccauucaacaucu

SEQ ID NO: 2745816 - RNA, 19 nt, Human
aauauuuauuuuaauaaug

SEQ ID NO: 2745817 - RNA, 18 nt, Human
aauauuuauuuuaauaau

SEQ ID NO: 2745818 - RNA, 16 nt, Human
uaauguauguuaccaa

SEQ ID NO: 2745819 - RNA, 17 nt, Human
uaauguauguuaccaaa

SEQ ID NO: 2745820 - RNA, 22 nt, Human
aaugaauggcuaagcaaaaugu

SEQ ID NO: 2745821 - RNA, 18 nt, Human
aaucuuaguguaugauua

SEQ ID NO: 2745822 - RNA, 21 nt, Human
aaucuuaguguaugauuacug

SEQ ID NO: 2745823 - RNA, 13 nt, Human
uaaucuuucacag

SEQ ID NO: 2745824 - RNA, 15 nt, Human
aaucaugaauuaguu

SEQ ID NO: 2745825 - RNA, 12 nt, Human
aaucaugaauua

SEQ ID NO: 2745826 - RNA, 12 nt, Human
uaauaaacucau

SEQ ID NO: 2745827 - RNA, 16 nt, Human
uaagcuuguauuccuu

SEQ ID NO: 2745828 - RNA, 19 nt, Human
uaaguaaugauaacuggaa

SEQ ID NO: 2745829 - RNA, 19 nt, Human
aaucuacacuccagugaga

SEQ ID NO: 2745830 - RNA, 19 nt, Human
aaucuuauaauuuaaaaua

SEQ ID NO: 2745831 - RNA, 23 nt, Human
aaucgcuccaccuugcagcucuc

SEQ ID NO: 2745832 - RNA, 18 nt, Human
uaccaccagucugacugu

SEQ ID NO: 2745833 - RNA, 17 nt, Human
aauguauguuaccaaaa

SEQ ID NO: 2745834 - RNA, 21 nt, Human
aauguauguuaccaaaaauaa

SEQ ID NO: 2745835 - RNA, 13 nt, Human
aauguauguuacc

SEQ ID NO: 2745836 - RNA, 20 nt, Human
uacaucccuuaccugggaaa

SEQ ID NO: 2745837 - RNA, 14 nt, Human
uacacuaagagaga

SEQ ID NO: 2745838 - RNA, 16 nt, Human
aaugcuguauuuuaaa

SEQ ID NO: 2745839 - RNA, 15 nt, Human
aauuaggcuguaacu

SEQ ID NO: 2745840 - RNA, 16 nt, Human
aauuaggcuguaacua

SEQ ID NO: 2745841 - RNA, 17 nt, Human
aauuaggcuguaacuac

SEQ ID NO: 2745842 - RNA, 18 nt, Human
aauuaggcuguaacuacu

SEQ ID NO: 2745843 - RNA, 19 nt, Human
aauuaggcuguaacuacuu

SEQ ID NO: 2745844 - RNA, 21 nt, Human
aauuaggcuguaacuacuuua

SEQ ID NO: 2745845 - RNA, 22 nt, Human
aauuaggcuguaacuacuuuau

SEQ ID NO: 2745846 - RNA, 15 nt, Human
aauuagugccacuua

SEQ ID NO: 2745847 - RNA, 23 nt, Human
aauuaggcuguaacuacuuuaua

SEQ ID NO: 2745848 - RNA, 17 nt, Human
aauuagugccacuuaau

SEQ ID NO: 2745849 - RNA, 20 nt, Human
aauuagugccacuuaaugua

SEQ ID NO: 2745850 - RNA, 18 nt, Human
aauucauuuuuuaaauuc

SEQ ID NO: 2745851 - RNA, 18 nt, Human
aauuccaagugauugaaa

SEQ ID NO: 2745852 - RNA, 20 nt, Human
aauucacagugcucuuuucu

SEQ ID NO: 2745853 - RNA, 22 nt, Human
aauuccacuuauaggaauugac

SEQ ID NO: 2745854 - RNA, 20 nt, Human
aauucccguuuugucacuuu

SEQ ID NO: 2745855 - RNA, 21 nt, Human
aauucccguuuugucacuuuu

SEQ ID NO: 2745856 - RNA, 14 nt, Human
uacuguaagaaaau

SEQ ID NO: 2745857 - RNA, 13 nt, Human
uacuguaagaaaa

SEQ ID NO: 2745858 - RNA, 18 nt, Human
uacuggccuuuuucauuu

SEQ ID NO: 2745859 - RNA, 22 nt, Human
aauugacccacaagaaaugaaa

SEQ ID NO: 2745860 - RNA, 21 nt, Human
aauugacccacaagaaaugaa

SEQ ID NO: 2745861 - RNA, 16 nt, Human
uauuaaaacucauuuu

SEQ ID NO: 2745862 - RNA, 21 nt, Human
uauguuuucaggcuagaugua

SEQ ID NO: 2745863 - RNA, 22 nt, Human
acaggaaccacaagacugcaca

SEQ ID NO: 2745864 - RNA, 17 nt, Human
acaggaaguagaggagg

SEQ ID NO: 2745865 - RNA, 23 nt, Human
uauucaaacagucucaggaaauc

SEQ ID NO: 2745866 - RNA, 15 nt, Human
uauucaaacagucuc

SEQ ID NO: 2745867 - RNA, 14 nt, Human
uauuacuguaagaa

SEQ ID NO: 2745868 - RNA, 16 nt, Human
acagucaccucaugga

SEQ ID NO: 2745869 - RNA, 18 nt, Human
acagucaccucauggaau

SEQ ID NO: 2745870 - RNA, 17 nt, Human
acagucaccucauggaa

SEQ ID NO: 2745871 - RNA, 21 nt, Human
acagggaggacgcucucuggc

SEQ ID NO: 2745872 - RNA, 20 nt, Human
acagggaggacgcucucugg

SEQ ID NO: 2745873 - RNA, 12 nt, Human
acagggacccac

SEQ ID NO: 2745874 - RNA, 18 nt, Human
acagccgcuccugucugc

SEQ ID NO: 2745875 - RNA, 14 nt, Human
acagccgcuccugu

SEQ ID NO: 2745876 - RNA, 21 nt, Human
uaugaaauauuauguuaaaac

SEQ ID NO: 2745877 - RNA, 24 nt, Human
acagccgcuccugucugccagcca

SEQ ID NO: 2745878 - RNA, 23 nt, Human
acagccgcuccugucugccagcc

SEQ ID NO: 2745879 - RNA, 20 nt, Human
acagccgcuccugucugcca

SEQ ID NO: 2745880 - RNA, 19 nt, Human
acagccgcuccugucugcc

SEQ ID NO: 2745881 - RNA, 20 nt, Human
uaugauuaaguaaugauaac

SEQ ID NO: 2745882 - RNA, 16 nt, Human
uaugauuaaguaauga

SEQ ID NO: 2745883 - RNA, 21 nt, Human
uaugauuaaguaaugauaacu

SEQ ID NO: 2745884 - RNA, 13 nt, Human
uaugcgguuaauu

SEQ ID NO: 2745885 - RNA, 15 nt, Human
uaugccccauucaac

SEQ ID NO: 2745886 - RNA, 19 nt, Human
uaugccccauucaacaucu

SEQ ID NO: 2745887 - RNA, 16 nt, Human
acagccucuuagaugc

SEQ ID NO: 2745888 - RNA, 19 nt, Human
uauaauuuugugaagcaaa

SEQ ID NO: 2745889 - RNA, 15 nt, Human
uauauuguuugcuaa

SEQ ID NO: 2745890 - RNA, 22 nt, Human
uauccuaauaaaaaggugacca

SEQ ID NO: 2745891 - RNA, 19 nt, Human
uauccuaauaaaaagguga

SEQ ID NO: 2745892 - RNA, 15 nt, Human
uauccuaauaaaaag

SEQ ID NO: 2745893 - RNA, 18 nt, Human
uauccuaauaaaaaggug

SEQ ID NO: 2745894 - RNA, 12 nt, Human
uauccuaauaaa

SEQ ID NO: 2745895 - RNA, 19 nt, Human
uauccagguucccucccag

SEQ ID NO: 2745896 - RNA, 17 nt, Human
uaucucaaaacugcacu

SEQ ID NO: 2745897 - RNA, 22 nt, Human
uaguuaccuuauaguuacugug

SEQ ID NO: 2745898 - RNA, 23 nt, Human
uaguuaccuuauaguuacugugu

SEQ ID NO: 2745899 - RNA, 15 nt, Human
acacaucagcuugcc

SEQ ID NO: 2745900 - RNA, 15 nt, Human
acacaugaaguccaa

SEQ ID NO: 2745901 - RNA, 18 nt, Human
acacaugauccugcaauu

SEQ ID NO: 2745902 - RNA, 13 nt, Human
acacuaagagaga

SEQ ID NO: 2745903 - RNA, 14 nt, Human
acacuaagagagaa

SEQ ID NO: 2745904 - RNA, 19 nt, Human
acacucaaaucaagaaacu

SEQ ID NO: 2745905 - RNA, 22 nt, Human
acaaugcuguauuuuaaaagaa

SEQ ID NO: 2745906 - RNA, 18 nt, Human
acaaugcuguauuuuaaa

SEQ ID NO: 2745907 - RNA, 15 nt, Human
acacacucaaaucaa

SEQ ID NO: 2745908 - RNA, 23 nt, Human
uaguguuggagaagaacugaaau

SEQ ID NO: 2745909 - RNA, 12 nt, Human
uaguuaccuuau

SEQ ID NO: 2745910 - RNA, 14 nt, Human
uaguuaccuuauag

SEQ ID NO: 2745911 - RNA, 17 nt, Human
uaguuaccuuauaguua

SEQ ID NO: 2745912 - RNA, 18 nt, Human
uaguuaccuuauaguuac

SEQ ID NO: 2745913 - RNA, 19 nt, Human
uaguuaccuuauaguuacu

SEQ ID NO: 2745914 - RNA, 21 nt, Human
uaguuaccuuauaguuacugu

SEQ ID NO: 2745915 - RNA, 22 nt, Human
uagugaaacucguuaauuugua

SEQ ID NO: 2745916 - RNA, 19 nt, Human
acaaauuuacagagacaga

SEQ ID NO: 2745917 - RNA, 18 nt, Human
acaaauuuacagagacag

SEQ ID NO: 2745918 - RNA, 20 nt, Human
acaagacccaaaaggcagaa

SEQ ID NO: 2745919 - RNA, 15 nt, Human
uagaugcaguucuga

SEQ ID NO: 2745920 - RNA, 22 nt, Human
uagaggagaaacuggaacucuc

SEQ ID NO: 2745921 - RNA, 17 nt, Human
uagagcacacuguagca

SEQ ID NO: 2745922 - RNA, 16 nt, Human
uagagcacacuguagc

SEQ ID NO: 2745923 - RNA, 19 nt, Human
uagaggagaaacuggaacu

SEQ ID NO: 2745924 - RNA, 18 nt, Human
acaaaaggauaaugaaua

SEQ ID NO: 2745925 - RNA, 14 nt, Human
acaagacugcacau

SEQ ID NO: 2745926 - RNA, 13 nt, Human
acaagacugcaca

SEQ ID NO: 2745927 - RNA, 23 nt, Human
acaauacaucccuuaccugggaa

SEQ ID NO: 2745928 - RNA, 19 nt, Human
uaggaaauauuuauuuuaa

SEQ ID NO: 2745929 - RNA, 18 nt, Human
uaggaaauauuuauuuua

SEQ ID NO: 2745930 - RNA, 12 nt, Human
uaggagcaugag

SEQ ID NO: 2745931 - RNA, 14 nt, Human
uagggagagaagau

SEQ ID NO: 2745932 - RNA, 15 nt, Human
uagggagagaagaua

SEQ ID NO: 2745933 - RNA, 24 nt, Human
aacucauuuuuguuuucauuaucu

SEQ ID NO: 2745934 - RNA, 21 nt, Human
aacucauuuuuguuuucauua

SEQ ID NO: 2745935 - RNA, 14 nt, Human
gucuuauuuauuau

SEQ ID NO: 2745936 - RNA, 14 nt, Human
gucuuaauuaaaag

SEQ ID NO: 2745937 - RNA, 19 nt, Human
gucuuauauauuguagaua

SEQ ID NO: 2745938 - RNA, 11 nt, Human
aagaaacauuu

SEQ ID NO: 2745939 - RNA, 16 nt, Human
aagaaagaaaaucagg

SEQ ID NO: 2745940 - RNA, 13 nt, Human
aagaaagaaaauc

SEQ ID NO: 2745941 - RNA, 14 nt, Human
aagaaagaaaauca

SEQ ID NO: 2745942 - RNA, 21 nt, Human
gugcuacaaaaacacagcaag

SEQ ID NO: 2745943 - RNA, 22 nt, Human
gugcuacaaaaacacagcaagg

SEQ ID NO: 2745944 - RNA, 18 nt, Human
gugcacgcacacugucug

SEQ ID NO: 2745945 - RNA, 16 nt, Human
gugauuaccagggacu

SEQ ID NO: 2745946 - RNA, 11 nt, Human
gugauuaccag

SEQ ID NO: 2745947 - RNA, 17 nt, Human
gugauuaccagggacug

SEQ ID NO: 2745948 - RNA, 19 nt, Human
aacuucuugcuucuuucua

SEQ ID NO: 2745949 - RNA, 22 nt, Human
aacuucuugcuucuuucuagaa

SEQ ID NO: 2745950 - RNA, 23 nt, Human
aacuuccuuggacucauuuuaaa

SEQ ID NO: 2745951 - RNA, 20 nt, Human
aacuucgaaagcaucauuau

SEQ ID NO: 2745952 - RNA, 20 nt, Human
aacuucuugcuucuuucuag

SEQ ID NO: 2745953 - RNA, 22 nt, Human
aacuuccuuggacucauuuuaa

SEQ ID NO: 2745954 - RNA, 18 nt, Human
aacuucagcgguuuauau

SEQ ID NO: 2745955 - RNA, 13 nt, Human
aacuucagacaua

SEQ ID NO: 2745956 - RNA, 23 nt, Human
guccaugaagauguagaggagaa

SEQ ID NO: 2745957 - RNA, 22 nt, Human
guccaugaagauguagaggaga

SEQ ID NO: 2745958 - RNA, 16 nt, Human
aacacugggggagggg

SEQ ID NO: 2745959 - RNA, 17 nt, Human
aacacugggggagggga

SEQ ID NO: 2745960 - RNA, 17 nt, Human
aacacaacuauauuguu

SEQ ID NO: 2745961 - RNA, 20 nt, Human
aacacagcaagggugauggg

SEQ ID NO: 2745962 - RNA, 18 nt, Human
aacacagcaagggugaug

SEQ ID NO: 2745963 - RNA, 17 nt, Human
guccuuuugacacugcu

SEQ ID NO: 2745964 - RNA, 19 nt, Human
guccuuuugacacugcucu

SEQ ID NO: 2745965 - RNA, 20 nt, Human
guccuuuugacacugcucua

SEQ ID NO: 2745966 - RNA, 21 nt, Human
guccuuuugacacugcucuaa

SEQ ID NO: 2745967 - RNA, 15 nt, Human
guccuuuugacacug

SEQ ID NO: 2745968 - RNA, 16 nt, Human
guccuuuugacacugc

SEQ ID NO: 2745969 - RNA, 19 nt, Human
aacauguccugccuauuau

SEQ ID NO: 2745970 - RNA, 20 nt, Human
aacauguccugccuauuauc

SEQ ID NO: 2745971 - RNA, 12 nt, Human
aacauauauaac

SEQ ID NO: 2745972 - RNA, 14 nt, Human
aacagucucaggaa

SEQ ID NO: 2745973 - RNA, 14 nt, Human
aacauaaaauacaa

SEQ ID NO: 2745974 - RNA, 13 nt, Human
aacagucucagga

SEQ ID NO: 2745975 - RNA, 15 nt, Human
gucacaggaaguaga

SEQ ID NO: 2745976 - RNA, 13 nt, Human
gucacaggaagua

SEQ ID NO: 2745977 - RNA, 21 nt, Human
gucaauuuuguuauguauauu

SEQ ID NO: 2745978 - RNA, 20 nt, Human
gucacaggaaguagaggagg

SEQ ID NO: 2745979 - RNA, 13 nt, Human
gucaggaaagaga

SEQ ID NO: 2745980 - RNA, 14 nt, Human
gucaggaaagagaa

SEQ ID NO: 2745981 - RNA, 14 nt, Human
gucacuuuuucuga

SEQ ID NO: 2745982 - RNA, 14 nt, Human
guauuuagaagcca

SEQ ID NO: 2745983 - RNA, 17 nt, Human
aaauuccaagugauuga

SEQ ID NO: 2745984 - RNA, 22 nt, Human
aaauuccuuagcuuagaccuca

SEQ ID NO: 2745985 - RNA, 23 nt, Human
aaauuccuuagcuuagaccucag

SEQ ID NO: 2745986 - RNA, 17 nt, Human
aaauuguauuacaaauc

SEQ ID NO: 2745987 - RNA, 18 nt, Human
aaaugugccuucauuuuu

SEQ ID NO: 2745988 - RNA, 15 nt, Human
aaaugugcuuuuaaa

SEQ ID NO: 2745989 - RNA, 18 nt, Human
aagcuuauuaaaacucau

SEQ ID NO: 2745990 - RNA, 18 nt, Human
guucccuugaugaagaag

SEQ ID NO: 2745991 - RNA, 21 nt, Human
aagccuuggggcugaugcagu

SEQ ID NO: 2745992 - RNA, 20 nt, Human
guuaauuuuuccaacuacua

SEQ ID NO: 2745993 - RNA, 22 nt, Human
guuaauuuugaagugcuguuua

SEQ ID NO: 2745994 - RNA, 14 nt, Human
guuaauuuuuccaa

SEQ ID NO: 2745995 - RNA, 17 nt, Human
guuaauuuugaagugcu

SEQ ID NO: 2745996 - RNA, 17 nt, Human
guuauuauauuuacaaa

SEQ ID NO: 2745997 - RNA, 10 nt, Human
guuauuuaaa

SEQ ID NO: 2745998 - RNA, 19 nt, Human
guuauuauauuuacaaaug

SEQ ID NO: 2745999 - RNA, 13 nt, Human
guuacuguguaau

SEQ ID NO: 2746000 - RNA, 15 nt, Human
aagauagcagggcau

SEQ ID NO: 2746001 - RNA, 14 nt, Human
aagauagcagggca

SEQ ID NO: 2746002 - RNA, 22 nt, Human
gugucuuaauuaaaagaauauu

SEQ ID NO: 2746003 - RNA, 19 nt, Human
aagauggcauaaccugucu

SEQ ID NO: 2746004 - RNA, 17 nt, Human
aagcaacccaaauguuc

SEQ ID NO: 2746005 - RNA, 18 nt, Human
aagcauuguaaaugugcu

SEQ ID NO: 2746006 - RNA, 19 nt, Human
aagcacugacuucuaagua

SEQ ID NO: 2746007 - RNA, 20 nt, Human
aagcacugacuucuaaguaa

SEQ ID NO: 2746008 - RNA, 19 nt, Human
aagcauuguaaaugugcuu

SEQ ID NO: 2746009 - RNA, 13 nt, Human
aagcacagcccuu

SEQ ID NO: 2746010 - RNA, 16 nt, Human
aagcacugacuucuaa

SEQ ID NO: 2746011 - RNA, 17 nt, Human
aagcacugacuucuaag

SEQ ID NO: 2746012 - RNA, 16 nt, Human
aagcacuaaacaaaga

SEQ ID NO: 2746013 - RNA, 14 nt, Human
uaaaaccacagcag

SEQ ID NO: 2746014 - RNA, 13 nt, Human
uaaaaccacagca

SEQ ID NO: 2746015 - RNA, 15 nt, Human
uaaaaccacagcagu

SEQ ID NO: 2746016 - RNA, 13 nt, Human
uaaaaaggugacc

SEQ ID NO: 2746017 - RNA, 15 nt, Human
uaaaaaggugaccau

SEQ ID NO: 2746018 - RNA, 20 nt, Human
aagucagauggaaaauucau

SEQ ID NO: 2746019 - RNA, 23 nt, Human
aagucagauggaaaauucauuuu

SEQ ID NO: 2746020 - RNA, 21 nt, Human
uaaaaaaaaaccugagcccca

SEQ ID NO: 2746021 - RNA, 13 nt, Human
uaaaagaauauuu

SEQ ID NO: 2746022 - RNA, 21 nt, Human
uaaaauacacacucaaaucaa

SEQ ID NO: 2746023 - RNA, 22 nt, Human
uaaaauaauuuuuauauuugaa

SEQ ID NO: 2746024 - RNA, 9 nt, Human
uaaaauggu

SEQ ID NO: 2746025 - RNA, 16 nt, Human
aaguacuguguacaga

SEQ ID NO: 2746026 - RNA, 19 nt, Human
aaguauguuagugcaaauu

SEQ ID NO: 2746027 - RNA, 18 nt, Human
aaguauguuagugcaaau

SEQ ID NO: 2746028 - RNA, 18 nt, Human
guuuaaagaaaguguauu

SEQ ID NO: 2746029 - RNA, 21 nt, Human
guuuaaagaaaguguauuugg

SEQ ID NO: 2746030 - RNA, 14 nt, Human
guuuaaagaaagug

SEQ ID NO: 2746031 - RNA, 15 nt, Human
guuuaaagaaagugu

SEQ ID NO: 2746032 - RNA, 16 nt, Human
guuuaaagaaagugua

SEQ ID NO: 2746033 - RNA, 17 nt, Human
guuuaaagaaaguguau

SEQ ID NO: 2746034 - RNA, 23 nt, Human
guuuauuaaucuuaguguaugau

SEQ ID NO: 2746035 - RNA, 14 nt, Human
guuuaugauuccac

SEQ ID NO: 2746036 - RNA, 15 nt, Human
aagggcuguuauaau

SEQ ID NO: 2746037 - RNA, 17 nt, Human
aaggggaauugaggaca

SEQ ID NO: 2746038 - RNA, 17 nt, Human
aagggcuguuauaaucu

SEQ ID NO: 2746039 - RNA, 15 nt, Human
gggccucggagccuc

SEQ ID NO: 2746040 - RNA, 17 nt, Human
gggccucggagccucau

SEQ ID NO: 2746041 - RNA, 20 nt, Human
gggcucagccuggugggccu

SEQ ID NO: 2746042 - RNA, 16 nt, Human
gggcucagccuggugg

SEQ ID NO: 2746043 - RNA, 13 nt, Human
gggcucagccugg

SEQ ID NO: 2746044 - RNA, 12 nt, Human
gggcucagccug

SEQ ID NO: 2746045 - RNA, 11 nt, Human
gggcucagccu

SEQ ID NO: 2746046 - RNA, 16 nt, Human
aaaauggguuuuacug

SEQ ID NO: 2746047 - RNA, 18 nt, Human
aaaaugguuuaaaugguc

SEQ ID NO: 2746048 - RNA, 16 nt, Human
aaaaugguuuaaaugg

SEQ ID NO: 2746049 - RNA, 17 nt, Human
aaaaucucaauauuuca

SEQ ID NO: 2746050 - RNA, 11 nt, Human
aaaauaauuuu

SEQ ID NO: 2746051 - RNA, 17 nt, Human
aaaauaauuuuuauauu

SEQ ID NO: 2746052 - RNA, 16 nt, Human
aaaauaauuuuuauau

SEQ ID NO: 2746053 - RNA, 14 nt, Human
aaaauacacacuca

SEQ ID NO: 2746054 - RNA, 22 nt, Human
gggguaaaauuccuuagcuuag

SEQ ID NO: 2746055 - RNA, 24 nt, Human
gguaacuuuugugaauuaggcugu

SEQ ID NO: 2746056 - RNA, 14 nt, Human
ggucagugcaaaua

SEQ ID NO: 2746057 - RNA, 20 nt, Human
ggguuuuauuguuuaaaauc

SEQ ID NO: 2746058 - RNA, 20 nt, Human
aaauauguuagcaaagaguu

SEQ ID NO: 2746059 - RNA, 13 nt, Human
aaauaugcaaagc

SEQ ID NO: 2746060 - RNA, 15 nt, Human
aaauaugcaaagcac

SEQ ID NO: 2746061 - RNA, 16 nt, Human
aaauaugcaaagcacu

SEQ ID NO: 2746062 - RNA, 17 nt, Human
aaauaugcaaagcacug

SEQ ID NO: 2746063 - RNA, 21 nt, Human
aaauaccaugccauuuaaagc

SEQ ID NO: 2746064 - RNA, 18 nt, Human
aaauauaugcuaagucuu

SEQ ID NO: 2746065 - RNA, 22 nt, Human
aaauaucacuugucaauaaaau

SEQ ID NO: 2746066 - RNA, 13 nt, Human
guaauaaacucau

SEQ ID NO: 2746067 - RNA, 12 nt, Human
guaacuacuuua

SEQ ID NO: 2746068 - RNA, 14 nt, Human
guaacuacuuuaua

SEQ ID NO: 2746069 - RNA, 14 nt, Human
gguggacccaggga

SEQ ID NO: 2746070 - RNA, 16 nt, Human
aaagcagaacagugau

SEQ ID NO: 2746071 - RNA, 19 nt, Human
aaacuuuaugcuaagugaa

SEQ ID NO: 2746072 - RNA, 12 nt, Human
aaacuuuaugcu

SEQ ID NO: 2746073 - RNA, 12 nt, Human
gguggacccagg

SEQ ID NO: 2746074 - RNA, 22 nt, Human
aaagggcuguuauaaucuuuca

SEQ ID NO: 2746075 - RNA, 20 nt, Human
aaagggcuguuauaaucuuu

SEQ ID NO: 2746076 - RNA, 20 nt, Human
aaagggauggcaagaugugg

SEQ ID NO: 2746077 - RNA, 16 nt, Human
gguuucauguuaguua

SEQ ID NO: 2746078 - RNA, 19 nt, Human
gguuuuauuguuuaaaauc

SEQ ID NO: 2746079 - RNA, 20 nt, Human
ggcuaagcuucacuguaaaa

SEQ ID NO: 2746080 - RNA, 16 nt, Human
ggccuucggccuccau

SEQ ID NO: 2746081 - RNA, 18 nt, Human
ggccuucggccuccaucc

SEQ ID NO: 2746082 - RNA, 21 nt, Human
ggccccagcacuaaagcagug

SEQ ID NO: 2746083 - RNA, 16 nt, Human
ggccccagcacuaaag

SEQ ID NO: 2746084 - RNA, 13 nt, Human
ggccccagcacua

SEQ ID NO: 2746085 - RNA, 13 nt, Human
aaaaauacaaaaa

SEQ ID NO: 2746086 - RNA, 19 nt, Human
ggcucuaauucacagugcu

SEQ ID NO: 2746087 - RNA, 17 nt, Human
ggcucuaauucacagug

SEQ ID NO: 2746088 - RNA, 15 nt, Human
gccugugcugcccgu

SEQ ID NO: 2746089 - RNA, 14 nt, Human
gccugugcugcccg

SEQ ID NO: 2746090 - RNA, 23 nt, Human
gccugugcugcccgucuucagcc

SEQ ID NO: 2746091 - RNA, 16 nt, Human
gccugugcugcccguc

SEQ ID NO: 2746092 - RNA, 23 nt, Human
gccuucggccuccauccugaggc

SEQ ID NO: 2746093 - RNA, 14 nt, Human
gcgggaaggagggu

SEQ ID NO: 2746094 - RNA, 13 nt, Human
gcgggaaggaggg

SEQ ID NO: 2746095 - RNA, 12 nt, Human
gccuccauccug

SEQ ID NO: 2746096 - RNA, 16 nt, Human
gccuccucuguccagg

SEQ ID NO: 2746097 - RNA, 13 nt, Human
gccuccucugucc

SEQ ID NO: 2746098 - RNA, 14 nt, Human
gccuccauccugag

SEQ ID NO: 2746099 - RNA, 13 nt, Human
gccuccauccuga

SEQ ID NO: 2746100 - RNA, 22 nt, Human
gccucauguccacugguucuuc

SEQ ID NO: 2746101 - RNA, 22 nt, Human
gccucauccgaggcagggucag

SEQ ID NO: 2746102 - RNA, 19 nt, Human
gccgcuccugucugccagc

SEQ ID NO: 2746103 - RNA, 15 nt, Human
gccgcuccugucugc

SEQ ID NO: 2746104 - RNA, 21 nt, Human
gccgcuccugucugccagcca

SEQ ID NO: 2746105 - RNA, 20 nt, Human
gccgcuccugucugccagcc

SEQ ID NO: 2746106 - RNA, 22 nt, Human
gccgcuccugucugccagccag

SEQ ID NO: 2746107 - RNA, 18 nt, Human
gcccgucuucagccuagc

SEQ ID NO: 2746108 - RNA, 17 nt, Human
gcccgucuucagccuag

SEQ ID NO: 2746109 - RNA, 16 nt, Human
gcccgucuucagccua

SEQ ID NO: 2746110 - RNA, 15 nt, Human
gcccgucuucagccu

SEQ ID NO: 2746111 - RNA, 14 nt, Human
gcccgucuucagcc

SEQ ID NO: 2746112 - RNA, 13 nt, Human
gcauuuagaugua

SEQ ID NO: 2746113 - RNA, 19 nt, Human
gcauuuaggccaugggaca

SEQ ID NO: 2746114 - RNA, 12 nt, Human
gcauuuagaugu

SEQ ID NO: 2746115 - RNA, 19 nt, Human
gcccaggaguuuggccaga

SEQ ID NO: 2746116 - RNA, 20 nt, Human
gcccaggaguuuggccagaa

SEQ ID NO: 2746117 - RNA, 11 nt, Human
gccccaaaagg

SEQ ID NO: 2746118 - RNA, 13 nt, Human
ggaaacugccagc

SEQ ID NO: 2746119 - RNA, 16 nt, Human
ggaaaaaauaacaaug

SEQ ID NO: 2746120 - RNA, 16 nt, Human
gcuguuuauuaaucuu

SEQ ID NO: 2746121 - RNA, 13 nt, Human
ggacaccaggagu

SEQ ID NO: 2746122 - RNA, 21 nt, Human
ggacagucaccucauggaauu

SEQ ID NO: 2746123 - RNA, 18 nt, Human
ggacagucaccucaugga

SEQ ID NO: 2746124 - RNA, 17 nt, Human
ggacagucaccucaugg

SEQ ID NO: 2746125 - RNA, 19 nt, Human
ggaaaucaggguuaguauu

SEQ ID NO: 2746126 - RNA, 20 nt, Human
gcugcccgucuucagccuag

SEQ ID NO: 2746127 - RNA, 19 nt, Human
gcugcccgucuucagccua

SEQ ID NO: 2746128 - RNA, 16 nt, Human
gcugcccgucuucagc

SEQ ID NO: 2746129 - RNA, 21 nt, Human
gcugcccgucuucagccuagc

SEQ ID NO: 2746130 - RNA, 14 nt, Human
gcugccuccccucc

SEQ ID NO: 2746131 - RNA, 12 nt, Human
gcugcaagguac

SEQ ID NO: 2746132 - RNA, 20 nt, Human
gcugcaagguacucugguga

SEQ ID NO: 2746133 - RNA, 18 nt, Human
gcugcaagcacagcccuu

SEQ ID NO: 2746134 - RNA, 18 nt, Human
gcuguauuuuaaaagaau

SEQ ID NO: 2746135 - RNA, 20 nt, Human
gcuguauuuuaaaagaauga

SEQ ID NO: 2746136 - RNA, 21 nt, Human
gcuguauuuuaaaagaaugau

SEQ ID NO: 2746137 - RNA, 13 nt, Human
gcugcugaaacaa

SEQ ID NO: 2746138 - RNA, 13 nt, Human
gcagccagcucuc

SEQ ID NO: 2746139 - RNA, 18 nt, Human
gcagccagcucucagcca

SEQ ID NO: 2746140 - RNA, 17 nt, Human
gcagccagcucucagcc

SEQ ID NO: 2746141 - RNA, 16 nt, Human
gcagccagcucucagc

SEQ ID NO: 2746142 - RNA, 15 nt, Human
gcagccagcucucag

SEQ ID NO: 2746143 - RNA, 15 nt, Human
gcagcucuccccuuc

SEQ ID NO: 2746144 - RNA, 22 nt, Human
gcagaacagugauuaccaggga

SEQ ID NO: 2746145 - RNA, 18 nt, Human
gcagaacagugauuacca

SEQ ID NO: 2746146 - RNA, 23 nt, Human
gcagaacagccgcuccugucugc

SEQ ID NO: 2746147 - RNA, 13 nt, Human
gcagaacagugau

SEQ ID NO: 2746148 - RNA, 12 nt, Human
gcagaacaguga

SEQ ID NO: 2746149 - RNA, 22 nt, Human
gcaguuguugcccacagcugua

SEQ ID NO: 2746150 - RNA, 13 nt, Human
gcagugaugucac

SEQ ID NO: 2746151 - RNA, 17 nt, Human
gauggaaaauucauuuu

SEQ ID NO: 2746152 - RNA, 12 nt, Human
gaggcuccacuu

SEQ ID NO: 2746153 - RNA, 15 nt, Human
gaggcuccacuuggu

SEQ ID NO: 2746154 - RNA, 18 nt, Human
gaggcugagaugggagaa

SEQ ID NO: 2746155 - RNA, 17 nt, Human
gaggcuccacuuggucu

SEQ ID NO: 2746156 - RNA, 18 nt, Human
gaggggcagaacagccgc

SEQ ID NO: 2746157 - RNA, 14 nt, Human
gaggagaaacugga

SEQ ID NO: 2746158 - RNA, 12 nt, Human
gaggagaaacug

SEQ ID NO: 2746159 - RNA, 20 nt, Human
gaggacgcucucuggccuuc

SEQ ID NO: 2746160 - RNA, 21 nt, Human
gaggacgcucucuggccuucg

SEQ ID NO: 2746161 - RNA, 14 nt, Human
gagcagucaggaaa

SEQ ID NO: 2746162 - RNA, 17 nt, Human
gagccccacccucagau

SEQ ID NO: 2746163 - RNA, 16 nt, Human
gagccccacccucaga

SEQ ID NO: 2746164 - RNA, 17 nt, Human
gagcuguucacagccag

SEQ ID NO: 2746165 - RNA, 20 nt, Human
gagcuguucacagccagacu

SEQ ID NO: 2746166 - RNA, 22 nt, Human
gagcuguucacagccagacugg

SEQ ID NO: 2746167 - RNA, 17 nt, Human
gagacucagggccccag

SEQ ID NO: 2746168 - RNA, 21 nt, Human
gagacucagggccccagcacu

SEQ ID NO: 2746169 - RNA, 21 nt, Human
gagauugugccccugcacucc

SEQ ID NO: 2746170 - RNA, 20 nt, Human
gagaugcuagaacucccuuu

SEQ ID NO: 2746171 - RNA, 16 nt, Human
gagaugcuagaacucc

SEQ ID NO: 2746172 - RNA, 22 nt, Human
gacuuuuuauggcacuaguauu

SEQ ID NO: 2746173 - RNA, 20 nt, Human
gaauuacauuuguauaaaau

SEQ ID NO: 2746174 - RNA, 18 nt, Human
gaauuacauuuguauaaa

SEQ ID NO: 2746175 - RNA, 15 nt, Human
gaauuacauuuguau

SEQ ID NO: 2746176 - RNA, 13 nt, Human
gaauuacauuugu

SEQ ID NO: 2746177 - RNA, 15 nt, Human
gaauuaacacaugau

SEQ ID NO: 2746178 - RNA, 14 nt, Human
gaauuaacacauga

SEQ ID NO: 2746179 - RNA, 22 nt, Human
gaaugauuaugaauuacauuug

SEQ ID NO: 2746180 - RNA, 14 nt, Human
gaaugauuaugaau

SEQ ID NO: 2746181 - RNA, 20 nt, Human
gaaugaauggcuaagcaaaa

SEQ ID NO: 2746182 - RNA, 15 nt, Human
gaaugaauggcuaag

SEQ ID NO: 2746183 - RNA, 19 nt, Human
gaauuaggcuguaacuacu

SEQ ID NO: 2746184 - RNA, 23 nt, Human
gaauuaggcuguaacuacuuuau

SEQ ID NO: 2746185 - RNA, 15 nt, Human
gaauuaggcuguaac

SEQ ID NO: 2746186 - RNA, 16 nt, Human
gaauuaggcuguaacu

SEQ ID NO: 2746187 - RNA, 17 nt, Human
gaauuaggcuguaacua

SEQ ID NO: 2746188 - RNA, 18 nt, Human
gaauuaggcuguaacuac

SEQ ID NO: 2746189 - RNA, 14 nt, Human
gaaugaauggcuaa

SEQ ID NO: 2746190 - RNA, 14 nt, Human
gacacugcucuaac

SEQ ID NO: 2746191 - RNA, 20 nt, Human
gacacugcucuaacagcccu

SEQ ID NO: 2746192 - RNA, 21 nt, Human
gacacugcucuaacagcccuc

SEQ ID NO: 2746193 - RNA, 22 nt, Human
gacauguggugggacagggacc

SEQ ID NO: 2746194 - RNA, 16 nt, Human
gacauguggugggaca

SEQ ID NO: 2746195 - RNA, 14 nt, Human
gacaugugguggga

SEQ ID NO: 2746196 - RNA, 18 nt, Human
gacagucaccucauggaa

SEQ ID NO: 2746197 - RNA, 12 nt, Human
gacagcucugca

SEQ ID NO: 2746198 - RNA, 18 nt, Human
gacccucaugcugccaau

SEQ ID NO: 2746199 - RNA, 21 nt, Human
gacccucaugcugccaauauc

SEQ ID NO: 2746200 - RNA, 22 nt, Human
gacccucaugcugccaauaucc

SEQ ID NO: 2746201 - RNA, 23 nt, Human
gacccucaugcugccaauauccu

SEQ ID NO: 2746202 - RNA, 12 nt, Human
gacccucaugcu

SEQ ID NO: 2746203 - RNA, 14 nt, Human
gacccucaugcugc

SEQ ID NO: 2746204 - RNA, 16 nt, Human
gacccucaugcugcca

SEQ ID NO: 2746205 - RNA, 17 nt, Human
gacccucaugcugccaa

SEQ ID NO: 2746206 - RNA, 14 nt, Human
gacgcucucuggcc

SEQ ID NO: 2746207 - RNA, 12 nt, Human
cugucagcugca

SEQ ID NO: 2746208 - RNA, 17 nt, Human
cuguagcauuacagugg

SEQ ID NO: 2746209 - RNA, 18 nt, Human
cuguagcauuacaguggg

SEQ ID NO: 2746210 - RNA, 23 nt, Human
cugucggagcccugucuccucuc

SEQ ID NO: 2746211 - RNA, 20 nt, Human
cuguaagaaaauaucacuug

SEQ ID NO: 2746212 - RNA, 23 nt, Human
cugugagaugcuagaacucccuu

SEQ ID NO: 2746213 - RNA, 21 nt, Human
cugugagaugcuagaacuccc

SEQ ID NO: 2746214 - RNA, 22 nt, Human
cuguucacagccagacuggcac

SEQ ID NO: 2746215 - RNA, 12 nt, Human
cuguucacagcc

SEQ ID NO: 2746216 - RNA, 19 nt, Human
cuguucacagccagacugg

SEQ ID NO: 2746217 - RNA, 12 nt, Human
cuuaaaaauggu

SEQ ID NO: 2746218 - RNA, 20 nt, Human
cuuaaaaaugguuuaaaugg

SEQ ID NO: 2746219 - RNA, 13 nt, Human
cuuaaaaaugguu

SEQ ID NO: 2746220 - RNA, 23 nt, Human
cuggaaaaguauguuagugcaaa

SEQ ID NO: 2746221 - RNA, 20 nt, Human
cugccuccccuccucugcuu

SEQ ID NO: 2746222 - RNA, 19 nt, Human
cugccuccccuccucugcu

SEQ ID NO: 2746223 - RNA, 14 nt, Human
cugccuccccuccu

SEQ ID NO: 2746224 - RNA, 18 nt, Human
cugccuccccuccucugc

SEQ ID NO: 2746225 - RNA, 17 nt, Human
cugccuccccuccucug

SEQ ID NO: 2746226 - RNA, 17 nt, Human
cugcuaccucacugggg

SEQ ID NO: 2746227 - RNA, 18 nt, Human
cugcuaccucacuggggu

SEQ ID NO: 2746228 - RNA, 21 nt, Human
cugcuagcacuuggagccaag

SEQ ID NO: 2746229 - RNA, 14 nt, Human
cugcuagcacuugg

SEQ ID NO: 2746230 - RNA, 23 nt, Human
cuuggucucagugucaaugcagc

SEQ ID NO: 2746231 - RNA, 15 nt, Human
cuuggcccaggaguu

SEQ ID NO: 2746232 - RNA, 16 nt, Human
cuuggcccaggaguuu

SEQ ID NO: 2746233 - RNA, 20 nt, Human
cuuggcccaggaguuuggcc

SEQ ID NO: 2746234 - RNA, 22 nt, Human
cuuggcccaggaguuuggccag

SEQ ID NO: 2746235 - RNA, 23 nt, Human
cuuggcccaggaguuuggccaga

SEQ ID NO: 2746236 - RNA, 22 nt, Human
cuucucuguauuccuagaaacu

SEQ ID NO: 2746237 - RNA, 23 nt, Human
gaacaaauuuacagagacagaaa

SEQ ID NO: 2746238 - RNA, 18 nt, Human
gaacaaauuuacagagac

SEQ ID NO: 2746239 - RNA, 17 nt, Human
gaacaaauuuacagaga

SEQ ID NO: 2746240 - RNA, 18 nt, Human
gaaaugaaagcagggacu

SEQ ID NO: 2746241 - RNA, 23 nt, Human
gaaaucaaauaugcaaagcacug

SEQ ID NO: 2746242 - RNA, 17 nt, Human
gaaaugaaagcagggac

SEQ ID NO: 2746243 - RNA, 21 nt, Human
gaaaucaaauaugcaaagcac

SEQ ID NO: 2746244 - RNA, 16 nt, Human
gaaaucaaauaugcaa

SEQ ID NO: 2746245 - RNA, 23 nt, Human
gaaacuucagcgguuuauauaag

SEQ ID NO: 2746246 - RNA, 20 nt, Human
cuuuuuuucuguaccaguua

SEQ ID NO: 2746247 - RNA, 21 nt, Human
gaaaagacuccaaagaaaugu

SEQ ID NO: 2746248 - RNA, 20 nt, Human
gaaaagacuccaaagaaaug

SEQ ID NO: 2746249 - RNA, 18 nt, Human
gaaaagacuccaaagaaa

SEQ ID NO: 2746250 - RNA, 23 nt, Human
caccaggcgcuaauucaaggaau

SEQ ID NO: 2746251 - RNA, 17 nt, Human
caccaggcgcuaauuca

SEQ ID NO: 2746252 - RNA, 16 nt, Human
cacaagacugcacauc

SEQ ID NO: 2746253 - RNA, 12 nt, Human
caauuuaaaaaa

SEQ ID NO: 2746254 - RNA, 23 nt, Human
caaugcuguauuuuaaaagaaug

SEQ ID NO: 2746255 - RNA, 14 nt, Human
caaugcuguauuuu

SEQ ID NO: 2746256 - RNA, 20 nt, Human
caauauuucagauaaucaca

SEQ ID NO: 2746257 - RNA, 12 nt, Human
caauauuucaga

SEQ ID NO: 2746258 - RNA, 20 nt, Human
caaguauuagaauaccacag

SEQ ID NO: 2746259 - RNA, 14 nt, Human
caaguauuagaaua

SEQ ID NO: 2746260 - RNA, 17 nt, Human
cacucccaccugacaca

SEQ ID NO: 2746261 - RNA, 22 nt, Human
cacucccaccugacacaccagg

SEQ ID NO: 2746262 - RNA, 23 nt, Human
cacucccaccugacacaccaggc

SEQ ID NO: 2746263 - RNA, 22 nt, Human
caccuugcagcucuccccuucu

SEQ ID NO: 2746264 - RNA, 13 nt, Human
caccuugcagcuc

SEQ ID NO: 2746265 - RNA, 15 nt, Human
caccuugcagcucuc

SEQ ID NO: 2746266 - RNA, 23 nt, Human
caccucaaaauaccaugccauuu

SEQ ID NO: 2746267 - RNA, 21 nt, Human
caccuacaugagguacugaga

SEQ ID NO: 2746268 - RNA, 21 nt, Human
caccguuggggauuggggaag

SEQ ID NO: 2746269 - RNA, 20 nt, Human
cacuuggucugugagaugcu

SEQ ID NO: 2746270 - RNA, 17 nt, Human
cacuuggucugugagau

SEQ ID NO: 2746271 - RNA, 21 nt, Human
caacuaucucauuuccaagca

SEQ ID NO: 2746272 - RNA, 19 nt, Human
caacccaaauguucaucaa

SEQ ID NO: 2746273 - RNA, 15 nt, Human
caacacgagcaggcu

SEQ ID NO: 2746274 - RNA, 15 nt, Human
caaauccuugaagau

SEQ ID NO: 2746275 - RNA, 17 nt, Human
auucuugccaaauauaa

SEQ ID NO: 2746276 - RNA, 18 nt, Human
auugacuuuuuauggcac

SEQ ID NO: 2746277 - RNA, 17 nt, Human
auucauuuuuuaaauuc

SEQ ID NO: 2746278 - RNA, 16 nt, Human
auucaaggaauuucuu

SEQ ID NO: 2746279 - RNA, 18 nt, Human
auucacaagacccaaaag

SEQ ID NO: 2746280 - RNA, 20 nt, Human
auucaaggaauuucuuaacu

SEQ ID NO: 2746281 - RNA, 19 nt, Human
auucaaggaauuucuuaac

SEQ ID NO: 2746282 - RNA, 17 nt, Human
auucaaggaauuucuua

SEQ ID NO: 2746283 - RNA, 18 nt, Human
auucaaggaauuucuuaa

SEQ ID NO: 2746284 - RNA, 14 nt, Human
auuguaaaugugcu

SEQ ID NO: 2746285 - RNA, 15 nt, Human
auuguaaaugugcuu

SEQ ID NO: 2746286 - RNA, 17 nt, Human
auuguaaaugugcuuuu

SEQ ID NO: 2746287 - RNA, 19 nt, Human
auuguuuaaaaucauuucu

SEQ ID NO: 2746288 - RNA, 18 nt, Human
auuucuaugaaauauuau

SEQ ID NO: 2746289 - RNA, 15 nt, Human
auuucuaugaaauau

SEQ ID NO: 2746290 - RNA, 20 nt, Human
auuucuaugaaauauuaugu

SEQ ID NO: 2746291 - RNA, 15 nt, Human
caggcacacuucuuc

SEQ ID NO: 2746292 - RNA, 19 nt, Human
caggugccaguuauggcua

SEQ ID NO: 2746293 - RNA, 16 nt, Human
cagucaccucauggaa

SEQ ID NO: 2746294 - RNA, 15 nt, Human
cagucacauuccaag

SEQ ID NO: 2746295 - RNA, 15 nt, Human
cagucaccucaugga

SEQ ID NO: 2746296 - RNA, 19 nt, Human
cagucaccucauggaauug

SEQ ID NO: 2746297 - RNA, 20 nt, Human
cagucugacuguuuccauca

SEQ ID NO: 2746298 - RNA, 16 nt, Human
cagccagcucucagcc

SEQ ID NO: 2746299 - RNA, 15 nt, Human
cagccagcucucagc

SEQ ID NO: 2746300 - RNA, 12 nt, Human
cagccagcucuc

SEQ ID NO: 2746301 - RNA, 18 nt, Human
cagccagcucucagccaa

SEQ ID NO: 2746302 - RNA, 17 nt, Human
cagccagcucucagcca

SEQ ID NO: 2746303 - RNA, 21 nt, Human
cagccagcucucagccaacga

SEQ ID NO: 2746304 - RNA, 13 nt, Human
cagcaguucagag

SEQ ID NO: 2746305 - RNA, 16 nt, Human
cagagguugcagugag

SEQ ID NO: 2746306 - RNA, 17 nt, Human
cagagguugcagugagc

SEQ ID NO: 2746307 - RNA, 12 nt, Human
cagauccuggaa

SEQ ID NO: 2746308 - RNA, 19 nt, Human
cagccgcuccugucugcca

SEQ ID NO: 2746309 - RNA, 18 nt, Human
cagccgcuccugucugcc

SEQ ID NO: 2746310 - RNA, 17 nt, Human
cagccgcuccugucugc

SEQ ID NO: 2746311 - RNA, 16 nt, Human
cagccgcuccugucug

SEQ ID NO: 2746312 - RNA, 14 nt, Human
cagccgcuccuguc

SEQ ID NO: 2746313 - RNA, 23 nt, Human
cagccgcuccugucugccagcca

SEQ ID NO: 2746314 - RNA, 22 nt, Human
cagccgcuccugucugccagcc

SEQ ID NO: 2746315 - RNA, 21 nt, Human
cagccgcuccugucugccagc

SEQ ID NO: 2746316 - RNA, 20 nt, Human
cagccgcuccugucugccag

SEQ ID NO: 2746317 - RNA, 12 nt, Human
cagcuguggcag

SEQ ID NO: 2746318 - RNA, 16 nt, Human
cagcuguggcagaguu

SEQ ID NO: 2746319 - RNA, 21 nt, Human
cagcuccccucggagaagagc

SEQ ID NO: 2746320 - RNA, 22 nt, Human
cagcuccccucggagaagagcu

SEQ ID NO: 2746321 - RNA, 20 nt, Human
cagcuccccucggagaagag

SEQ ID NO: 2746322 - RNA, 14 nt, Human
cauguuaguuaccu

SEQ ID NO: 2746323 - RNA, 21 nt, Human
cauguuaguuaccuuauaguu

SEQ ID NO: 2746324 - RNA, 22 nt, Human
cauguuaguuaccuuauaguua

SEQ ID NO: 2746325 - RNA, 24 nt, Human
cauguuaguuaccuuauaguuacu

SEQ ID NO: 2746326 - RNA, 17 nt, Human
caugucccuacaccccu

SEQ ID NO: 2746327 - RNA, 13 nt, Human
cauguccugccua

SEQ ID NO: 2746328 - RNA, 22 nt, Human
cauguccugccuauuaucuguc

SEQ ID NO: 2746329 - RNA, 14 nt, Human
caugauguuuagaa

SEQ ID NO: 2746330 - RNA, 12 nt, Human
ccaccaguucuc

SEQ ID NO: 2746331 - RNA, 23 nt, Human
ccacagcaguugaaaagacucca

SEQ ID NO: 2746332 - RNA, 17 nt, Human
ccacagcaguugaaaag

SEQ ID NO: 2746333 - RNA, 18 nt, Human
ccacagcaguugaaaaga

SEQ ID NO: 2746334 - RNA, 12 nt, Human
ccacagcaguug

SEQ ID NO: 2746335 - RNA, 17 nt, Human
cauuuguauaaaauaau

SEQ ID NO: 2746336 - RNA, 20 nt, Human
cauuuguauaaaauaauuuu

SEQ ID NO: 2746337 - RNA, 19 nt, Human
cauuuguauaaaauaauuu

SEQ ID NO: 2746338 - RNA, 17 nt, Human
ccaaauguucaucaaug

SEQ ID NO: 2746339 - RNA, 20 nt, Human
cccagggcucagccuggugg

SEQ ID NO: 2746340 - RNA, 18 nt, Human
cccagggcucagccuggu

SEQ ID NO: 2746341 - RNA, 17 nt, Human
cccagggcucagccugg

SEQ ID NO: 2746342 - RNA, 16 nt, Human
cccagggcucagccug

SEQ ID NO: 2746343 - RNA, 15 nt, Human
cccagggcucagccu

SEQ ID NO: 2746344 - RNA, 14 nt, Human
cccagggcucagcc

SEQ ID NO: 2746345 - RNA, 18 nt, Human
ccccugcacuccagccug

SEQ ID NO: 2746346 - RNA, 17 nt, Human
ccaguauuuagaagcca

SEQ ID NO: 2746347 - RNA, 18 nt, Human
ccaguauuuagaagccaa

SEQ ID NO: 2746348 - RNA, 14 nt, Human
ccauacauuugugu

SEQ ID NO: 2746349 - RNA, 13 nt, Human
ccauacauuugug

SEQ ID NO: 2746350 - RNA, 22 nt, Human
ccauuuaaagcuuauuaaaacu

SEQ ID NO: 2746351 - RNA, 19 nt, Human
cccugucuccucucucugu

SEQ ID NO: 2746352 - RNA, 21 nt, Human
ccucauuuuuauaaugucccu

SEQ ID NO: 2746353 - RNA, 23 nt, Human
ccucauggaauuggagcucgugg

SEQ ID NO: 2746354 - RNA, 20 nt, Human
ccucaugcugccaauauccu

SEQ ID NO: 2746355 - RNA, 21 nt, Human
ccucaugcugccaauauccua

SEQ ID NO: 2746356 - RNA, 14 nt, Human
ccucaaagaaagug

SEQ ID NO: 2746357 - RNA, 16 nt, Human
ccucaaagaaagugua

SEQ ID NO: 2746358 - RNA, 16 nt, Human
ccucagccugugcugc

SEQ ID NO: 2746359 - RNA, 22 nt, Human
ccucagccuuccccuugcccag

SEQ ID NO: 2746360 - RNA, 12 nt, Human
ccucagccugug

SEQ ID NO: 2746361 - RNA, 11 nt, Human
ccucagccugu

SEQ ID NO: 2746362 - RNA, 22 nt, Human
ccuggggccucggagccucauc

SEQ ID NO: 2746363 - RNA, 12 nt, Human
ccuggggccucg

SEQ ID NO: 2746364 - RNA, 16 nt, Human
ccugucggagcccugu

SEQ ID NO: 2746365 - RNA, 17 nt, Human
ccugucggagcccuguc

SEQ ID NO: 2746366 - RNA, 21 nt, Human
ccugucggagcccugucuccu

SEQ ID NO: 2746367 - RNA, 15 nt, Human
ccuguaaucacagcu

SEQ ID NO: 2746368 - RNA, 20 nt, Human
ccuggugggccuccucuguc

SEQ ID NO: 2746369 - RNA, 18 nt, Human
ccuggugggccuccucug

SEQ ID NO: 2746370 - RNA, 14 nt, Human
ccuggugggccucc

SEQ ID NO: 2746371 - RNA, 23 nt, Human
ccugucugccagccagcagccag

SEQ ID NO: 2746372 - RNA, 21 nt, Human
ccugucugccagccagcagcc

SEQ ID NO: 2746373 - RNA, 15 nt, Human
ccugucucaccugga

SEQ ID NO: 2746374 - RNA, 22 nt, Human
ccugucggagcccugucuccuc

SEQ ID NO: 2746375 - RNA, 20 nt, Human
ccugucugccagccagcagc

SEQ ID NO: 2746376 - RNA, 19 nt, Human
ccugucugccagccagcag

SEQ ID NO: 2746377 - RNA, 17 nt, Human
ccugucugccagccagc

SEQ ID NO: 2746378 - RNA, 16 nt, Human
ccugucugccagccag

SEQ ID NO: 2746379 - RNA, 15 nt, Human
ccugucugccagcca

SEQ ID NO: 2746380 - RNA, 14 nt, Human
ccugucugccagcc

SEQ ID NO: 2746381 - RNA, 13 nt, Human
cuagaacucccuu

SEQ ID NO: 2746382 - RNA, 12 nt, Human
cuagaacucccu

SEQ ID NO: 2746383 - RNA, 11 nt, Human
cuaauaaaaag

SEQ ID NO: 2746384 - RNA, 15 nt, Human
cuaauaaaaagguga

SEQ ID NO: 2746385 - RNA, 14 nt, Human
cuaauaaaaaggug

SEQ ID NO: 2746386 - RNA, 13 nt, Human
cuaauaaaaaggu

SEQ ID NO: 2746387 - RNA, 17 nt, Human
cuaaguaaauaggaauu

SEQ ID NO: 2746388 - RNA, 22 nt, Human
cuaaguaaaaccacagcaguug

SEQ ID NO: 2746389 - RNA, 23 nt, Human
cuaaguaaaaccacagcaguuga

SEQ ID NO: 2746390 - RNA, 20 nt, Human
cuaaguaaaaccacagcagu

SEQ ID NO: 2746391 - RNA, 20 nt, Human
cgugugugugcguccugucg

SEQ ID NO: 2746392 - RNA, 18 nt, Human
cuacaugagguacugaga

SEQ ID NO: 2746393 - RNA, 20 nt, Human
cuacaugagguacugagagu

SEQ ID NO: 2746394 - RNA, 18 nt, Human
cuacauacuauggaauuu

SEQ ID NO: 2746395 - RNA, 16 nt, Human
cuacaaaaacacagca

SEQ ID NO: 2746396 - RNA, 17 nt, Human
cuacaaaaacacagcaa

SEQ ID NO: 2746397 - RNA, 18 nt, Human
cuacaaaaacacagcaag

SEQ ID NO: 2746398 - RNA, 15 nt, Human
cuacaaaaacacagc

SEQ ID NO: 2746399 - RNA, 23 nt, Human
cucaaaauaccaugccauuuaaa

SEQ ID NO: 2746400 - RNA, 17 nt, Human
cucaaaacugcacuguc

SEQ ID NO: 2746401 - RNA, 18 nt, Human
ccuuuugacacugcucua

SEQ ID NO: 2746402 - RNA, 13 nt, Human
ccuuuugacacug

SEQ ID NO: 2746403 - RNA, 15 nt, Human
ccuuuugacacugcu

SEQ ID NO: 2746404 - RNA, 22 nt, Human
ccuugcugcaagcacagcccuu

SEQ ID NO: 2746405 - RNA, 21 nt, Human
ccuugcccagggcucagccug

SEQ ID NO: 2746406 - RNA, 22 nt, Human
ccuugcccagggcucagccugg

SEQ ID NO: 2746407 - RNA, 17 nt, Human
cgccugaggcaauuaga

SEQ ID NO: 2746408 - RNA, 18 nt, Human
cgcaggcccccaggugcc

SEQ ID NO: 2746409 - RNA, 22 nt, Human
cguggugauuuagcaggaagcu

SEQ ID NO: 2746410 - RNA, 15 nt, Human
cguggugauuuagca

SEQ ID NO: 2746411 - RNA, 15 nt, Human
cugaaacaacaaaua

SEQ ID NO: 2746412 - RNA, 15 nt, Human
cucuggggugggcag

SEQ ID NO: 2746413 - RNA, 23 nt, Human
cucuggugagucaccacuucagg

SEQ ID NO: 2746414 - RNA, 20 nt, Human
cucuguccagggcccugagc

SEQ ID NO: 2746415 - RNA, 14 nt, Human
cucuguccagggcc

SEQ ID NO: 2746416 - RNA, 16 nt, Human
cucuccccuucucugu

SEQ ID NO: 2746417 - RNA, 21 nt, Human
cucuuagaugcaguucugaag

SEQ ID NO: 2746418 - RNA, 21 nt, Human
cucuguccagggcccugagcu

SEQ ID NO: 2746419 - RNA, 22 nt, Human
cucuuagaugcaguucugaaga

SEQ ID NO: 2746420 - RNA, 15 nt, Human
cuccacuuggucugu

SEQ ID NO: 2746421 - RNA, 13 nt, Human
cuccacuuggucu

SEQ ID NO: 2746422 - RNA, 22 nt, Human
cuccacuuggucugugagaugc

SEQ ID NO: 2746423 - RNA, 21 nt, Human
cuccacuuggucugugagaug

SEQ ID NO: 2746424 - RNA, 17 nt, Human
cuccacuuggucuguga

SEQ ID NO: 2746425 - RNA, 16 nt, Human
cuccacuuggucugug

SEQ ID NO: 2746426 - RNA, 18 nt, Human
cucaguagucagacugga

SEQ ID NO: 2746427 - RNA, 13 nt, Human
cucaguaccccau

SEQ ID NO: 2746428 - RNA, 19 nt, Human
cuccccaugauguuuagaa

SEQ ID NO: 2746429 - RNA, 14 nt, Human
cucccaccugacac

SEQ ID NO: 2746430 - RNA, 15 nt, Human
cucccaccugacaca

SEQ ID NO: 2746431 - RNA, 20 nt, Human
cucccaccugacacaccagg

SEQ ID NO: 2746432 - RNA, 21 nt, Human
cucccaccugacacaccaggc

SEQ ID NO: 2746433 - RNA, 23 nt, Human
cuccacuuggucugugagaugcu

SEQ ID NO: 2746434 - RNA, 14 nt, Human
cucguuaauuugua

SEQ ID NO: 2746435 - RNA, 12 nt, Human
cuccugggcagc

SEQ ID NO: 2746436 - RNA, 17 nt, Human
cuccugggcagcugccu

SEQ ID NO: 2746437 - RNA, 16 nt, Human
cuccugggcagcugcc

SEQ ID NO: 2746438 - RNA, 15 nt, Human
cuccugggcagcugc

SEQ ID NO: 2746439 - RNA, 14 nt, Human
cuccugggcagcug

SEQ ID NO: 2746440 - RNA, 19 nt, Human
cuccugggcagcugccucc

SEQ ID NO: 2746441 - RNA, 18 nt, Human
cuccugggcagcugccuc

SEQ ID NO: 2746442 - RNA, 22 nt, Human
cuccugggcagcugccuccccu

SEQ ID NO: 2746443 - RNA, 20 nt, Human
cuccucugcuugccaucccu

SEQ ID NO: 2746444 - RNA, 17 nt, Human
cuccucugcuugccauc

SEQ ID NO: 2746445 - RNA, 16 nt, Human
cuccucugcuugccau

SEQ ID NO: 2746446 - RNA, 15 nt, Human
cuccucugcuugcca

SEQ ID NO: 2746447 - RNA, 21 nt, Human
cuccucugcuugccaucccuc

SEQ ID NO: 2746448 - RNA, 14 nt, Human
cuccucugcuugcc

SEQ ID NO: 2746449 - RNA, 12 nt, Human
cuccucugcuug

SEQ ID NO: 2746450 - RNA, 16 nt, Human
cacaguuuucugagaa

SEQ ID NO: 2746451 - RNA, 17 nt, Human
cacaguuuucugagaaa

SEQ ID NO: 2746452 - RNA, 19 nt, Human
cacaguuuucugagaaaga

SEQ ID NO: 2746453 - RNA, 22 nt, Human
caaaauuuuuucucuaggaaau

SEQ ID NO: 2746454 - RNA, 21 nt, Human
caaaauuuuuucucuaggaaa

SEQ ID NO: 2746455 - RNA, 16 nt, Human
caaaauuuuuucucua

SEQ ID NO: 2746456 - RNA, 15 nt, Human
caaauugugugaaag

SEQ ID NO: 2746457 - RNA, 19 nt, Human
caaauaugcaaagcacuga

SEQ ID NO: 2746458 - RNA, 21 nt, Human
caaauaugcaaagcacugacu

SEQ ID NO: 2746459 - RNA, 13 nt, Human
caaaaacacagca

SEQ ID NO: 2746460 - RNA, 14 nt, Human
caaaaacacagcaa

SEQ ID NO: 2746461 - RNA, 15 nt, Human
caaaaacacagcaag

SEQ ID NO: 2746462 - RNA, 17 nt, Human
caaaaacacagcaaggg

SEQ ID NO: 2746463 - RNA, 13 nt, Human
auuuuccugaaaa

SEQ ID NO: 2746464 - RNA, 19 nt, Human
caaaaaucucaauauuuca

SEQ ID NO: 2746465 - RNA, 23 nt, Human
caaaacuucagacauagaauuaa

SEQ ID NO: 2746466 - RNA, 23 nt, Human
caauacaucccuuaccugggaaa

SEQ ID NO: 2746467 - RNA, 22 nt, Human
caaugugacuuaaugccacuaa

SEQ ID NO: 2746468 - RNA, 22 nt, Human
caacugaggcagacagcagcuc

SEQ ID NO: 2746469 - RNA, 21 nt, Human
caacugaggcagacagcagcu

SEQ ID NO: 2746470 - RNA, 20 nt, Human
caacugaggcagacagcagc

SEQ ID NO: 2746471 - RNA, 17 nt, Human
caacugaggcagacagc

SEQ ID NO: 2746472 - RNA, 16 nt, Human
caacugaggcagacag

SEQ ID NO: 2746473 - RNA, 14 nt, Human
caacugaggcagac

SEQ ID NO: 2746474 - RNA, 13 nt, Human
caacugaggcaga

SEQ ID NO: 2746475 - RNA, 20 nt, Human
caacccgucuggcccaccag

SEQ ID NO: 2746476 - RNA, 21 nt, Human
caacccgucuggcccaccagg

SEQ ID NO: 2746477 - RNA, 22 nt, Human
caacccgucuggcccaccaggg

SEQ ID NO: 2746478 - RNA, 15 nt, Human
caaggcuuagacccu

SEQ ID NO: 2746479 - RNA, 14 nt, Human
caaggcuuagaccc

SEQ ID NO: 2746480 - RNA, 18 nt, Human
caaggcuuagacccucau

SEQ ID NO: 2746481 - RNA, 21 nt, Human
caagccagauuuuccugaaaa

SEQ ID NO: 2746482 - RNA, 12 nt, Human
caaggaauuucu

SEQ ID NO: 2746483 - RNA, 15 nt, Human
caaggaauuucuuaa

SEQ ID NO: 2746484 - RNA, 16 nt, Human
caaggaauuucuuaac

SEQ ID NO: 2746485 - RNA, 18 nt, Human
caaggaauuucuuaacuu

SEQ ID NO: 2746486 - RNA, 21 nt, Human
caaggaauuucuuaacuucuu

SEQ ID NO: 2746487 - RNA, 23 nt, Human
caaggaauuucuuaacuucuugc

SEQ ID NO: 2746488 - RNA, 17 nt, Human
caaggcugauuaaacca

SEQ ID NO: 2746489 - RNA, 17 nt, Human
uucugucuucacaacag

SEQ ID NO: 2746490 - RNA, 18 nt, Human
uucugugguuucauguua

SEQ ID NO: 2746491 - RNA, 22 nt, Human
uucugugguuucauguuaguua

SEQ ID NO: 2746492 - RNA, 14 nt, Human
uugaugaagaaguu

SEQ ID NO: 2746493 - RNA, 13 nt, Human
uugaugaagaagu

SEQ ID NO: 2746494 - RNA, 23 nt, Human
uugaugaagaaguugauaugccu

SEQ ID NO: 2746495 - RNA, 17 nt, Human
uugacccacaagaaaug

SEQ ID NO: 2746496 - RNA, 14 nt, Human
uugacccacaagaa

SEQ ID NO: 2746497 - RNA, 14 nt, Human
uucuaugaaauauu

SEQ ID NO: 2746498 - RNA, 21 nt, Human
uucuaugaaauauuauguuaa

SEQ ID NO: 2746499 - RNA, 15 nt, Human
uucugcuaccucacu

SEQ ID NO: 2746500 - RNA, 21 nt, Human
uucugcuaccucacugggguc

SEQ ID NO: 2746501 - RNA, 16 nt, Human
uucugcuaccucacug

SEQ ID NO: 2746502 - RNA, 19 nt, Human
uucugauaaaagauggcca

SEQ ID NO: 2746503 - RNA, 18 nt, Human
uucugauaaaagauggcc

SEQ ID NO: 2746504 - RNA, 16 nt, Human
uucugagaaagacuau

SEQ ID NO: 2746505 - RNA, 21 nt, Human
uucugagaaagacuauucaaa

SEQ ID NO: 2746506 - RNA, 15 nt, Human
uucuacauacuaugg

SEQ ID NO: 2746507 - RNA, 18 nt, Human
uucggugagcuacaaaug

SEQ ID NO: 2746508 - RNA, 18 nt, Human
uuccuuguauuuaaauau

SEQ ID NO: 2746509 - RNA, 15 nt, Human
uuccuuguauuuaaa

SEQ ID NO: 2746510 - RNA, 23 nt, Human
uucaguuauuauauuuacaaaug

SEQ ID NO: 2746511 - RNA, 18 nt, Human
uuccagauccuggaaauc

SEQ ID NO: 2746512 - RNA, 19 nt, Human
uuauuuuaauaauguuuca

SEQ ID NO: 2746513 - RNA, 17 nt, Human
uuauuuuaauaauguuu

SEQ ID NO: 2746514 - RNA, 20 nt, Human
uuauuuuaauaauguuucaa

SEQ ID NO: 2746515 - RNA, 18 nt, Human
uuauuugcagagacagga

SEQ ID NO: 2746516 - RNA, 15 nt, Human
uuauuugcagagaca

SEQ ID NO: 2746517 - RNA, 19 nt, Human
uucacgccugaggcaauua

SEQ ID NO: 2746518 - RNA, 20 nt, Human
uucagauaaucacaauacau

SEQ ID NO: 2746519 - RNA, 20 nt, Human
uucagagcugcccucuccug

SEQ ID NO: 2746520 - RNA, 19 nt, Human
uucagagcugcccucuccu

SEQ ID NO: 2746521 - RNA, 18 nt, Human
uucagagcugcccucucc

SEQ ID NO: 2746522 - RNA, 17 nt, Human
uucagagcugcccucuc

SEQ ID NO: 2746523 - RNA, 15 nt, Human
uucagagcugcccuc

SEQ ID NO: 2746524 - RNA, 18 nt, Human
uuauaauuuugugaagca

SEQ ID NO: 2746525 - RNA, 17 nt, Human
uuauaauuuugugaagc

SEQ ID NO: 2746526 - RNA, 16 nt, Human
uuauaauuuugugaag

SEQ ID NO: 2746527 - RNA, 18 nt, Human
uuagugccacuuaaugua

SEQ ID NO: 2746528 - RNA, 19 nt, Human
uuagugccacuuaauguau

SEQ ID NO: 2746529 - RNA, 18 nt, Human
uuaguguaugauuacugg

SEQ ID NO: 2746530 - RNA, 12 nt, Human
uuauaauuuaaa

SEQ ID NO: 2746531 - RNA, 15 nt, Human
uuauaauuuugugaa

SEQ ID NO: 2746532 - RNA, 14 nt, Human
uuauaauuuuguga

SEQ ID NO: 2746533 - RNA, 11 nt, Human
uuauaaucuuu

SEQ ID NO: 2746534 - RNA, 13 nt, Human
uuauauuugaaau

SEQ ID NO: 2746535 - RNA, 12 nt, Human
uuauauuugaaa

SEQ ID NO: 2746536 - RNA, 20 nt, Human
uuauauuuauuacuguaaga

SEQ ID NO: 2746537 - RNA, 16 nt, Human
uuauauuuacaaaugg

SEQ ID NO: 2746538 - RNA, 11 nt, Human
uuaucucaaaa

SEQ ID NO: 2746539 - RNA, 22 nt, Human
uuaugauuaaguaaugauaacu

SEQ ID NO: 2746540 - RNA, 21 nt, Human
uuauuaacgauguccaacccg

SEQ ID NO: 2746541 - RNA, 18 nt, Human
uuauggcuauaggugcua

SEQ ID NO: 2746542 - RNA, 16 nt, Human
uuggucugugagaugc

SEQ ID NO: 2746543 - RNA, 19 nt, Human
uuggucuuauuuauuauug

SEQ ID NO: 2746544 - RNA, 15 nt, Human
uuggucuuauuuauu

SEQ ID NO: 2746545 - RNA, 15 nt, Human
uuggucugugagaug

SEQ ID NO: 2746546 - RNA, 15 nt, Human
uugucuagugaaacu

SEQ ID NO: 2746547 - RNA, 12 nt, Human
uugugccccugc

SEQ ID NO: 2746548 - RNA, 18 nt, Human
uuguguuuugcaagccag

SEQ ID NO: 2746549 - RNA, 14 nt, Human
uuguuuaaaaucau

SEQ ID NO: 2746550 - RNA, 20 nt, Human
uuguuucauugacuaucaaa

SEQ ID NO: 2746551 - RNA, 14 nt, Human
uuucauuuaucuau

SEQ ID NO: 2746552 - RNA, 18 nt, Human
uuuccaacuacuaauaga

SEQ ID NO: 2746553 - RNA, 19 nt, Human
uuuccaacuacuaauagaa

SEQ ID NO: 2746554 - RNA, 17 nt, Human
uuucauuuaucuauaau

SEQ ID NO: 2746555 - RNA, 12 nt, Human
uuuccaacuacu

SEQ ID NO: 2746556 - RNA, 22 nt, Human
uuuauuguuuaaaaucauuucu

SEQ ID NO: 2746557 - RNA, 22 nt, Human
uuuauaauuuugugaagcaaaa

SEQ ID NO: 2746558 - RNA, 17 nt, Human
uuuauggcacuaguauu

SEQ ID NO: 2746559 - RNA, 13 nt, Human
uuuaccacuugug

SEQ ID NO: 2746560 - RNA, 13 nt, Human
uuuaauaauguuu

SEQ ID NO: 2746561 - RNA, 19 nt, Human
uuuaacucuauaauguguu

SEQ ID NO: 2746562 - RNA, 21 nt, Human
uuuuuccaacuacuaauagaa

SEQ ID NO: 2746563 - RNA, 23 nt, Human
uuuuuccaacuacuaauagaaua

SEQ ID NO: 2746564 - RNA, 19 nt, Human
uuuguauaaaauaauuuuu

SEQ ID NO: 2746565 - RNA, 18 nt, Human
uuuguauaaaauaauuuu

SEQ ID NO: 2746566 - RNA, 17 nt, Human
uuuguauaaaauaauuu

SEQ ID NO: 2746567 - RNA, 15 nt, Human
uuuccacagaagcuc

SEQ ID NO: 2746568 - RNA, 23 nt, Human
uuuuauaauuuugugaagcaaaa

SEQ ID NO: 2746569 - RNA, 21 nt, Human
uuuuauaauuuugugaagcaa

SEQ ID NO: 2746570 - RNA, 21 nt, Human
uuuuaaaguaacccuacaaaa

SEQ ID NO: 2746571 - RNA, 18 nt, Human
uuuuauauuugaaauauu

SEQ ID NO: 2746572 - RNA, 13 nt, Human
uuuuauauuugaa

SEQ ID NO: 2746573 - RNA, 13 nt, Human
uuuucuuauuuca

SEQ ID NO: 2746574 - RNA, 16 nt, Human
ugcacugucaagauga

SEQ ID NO: 2746575 - RNA, 17 nt, Human
ugcacgcacacugucug

SEQ ID NO: 2746576 - RNA, 16 nt, Human
ugcacgcacacugucu

SEQ ID NO: 2746577 - RNA, 19 nt, Human
ugcccgucuucagccuagc

SEQ ID NO: 2746578 - RNA, 18 nt, Human
ugcccgucuucagccuag

SEQ ID NO: 2746579 - RNA, 17 nt, Human
ugcccgucuucagccua

SEQ ID NO: 2746580 - RNA, 16 nt, Human
ugcccgucuucagccu

SEQ ID NO: 2746581 - RNA, 13 nt, Human
ugcccgucuucag

SEQ ID NO: 2746582 - RNA, 17 nt, Human
ugcaugguuuagaaagc

SEQ ID NO: 2746583 - RNA, 19 nt, Human
ugcagauaaacaguaguga

SEQ ID NO: 2746584 - RNA, 17 nt, Human
ugcagauaaacaguagu

SEQ ID NO: 2746585 - RNA, 13 nt, Human
ugcagauucauuu

SEQ ID NO: 2746586 - RNA, 21 nt, Human
ugcauuauauuuauuacugua

SEQ ID NO: 2746587 - RNA, 24 nt, Human
ugauaguuguaccgcaaugugacu

SEQ ID NO: 2746588 - RNA, 15 nt, Human
ugagcagucaggaaa

SEQ ID NO: 2746589 - RNA, 17 nt, Human
ugagcagucaggaaaga

SEQ ID NO: 2746590 - RNA, 20 nt, Human
ugagcagucaggaaagagaa

SEQ ID NO: 2746591 - RNA, 20 nt, Human
ugagaugcuagaacucccuu

SEQ ID NO: 2746592 - RNA, 16 nt, Human
ugagaugcuagaacuc

SEQ ID NO: 2746593 - RNA, 14 nt, Human
ugagaugcuagaac

SEQ ID NO: 2746594 - RNA, 16 nt, Human
ugagacagcucugcau

SEQ ID NO: 2746595 - RNA, 14 nt, Human
ugagacagcucugc

SEQ ID NO: 2746596 - RNA, 18 nt, Human
ugagaaagacuauucaaa

SEQ ID NO: 2746597 - RNA, 20 nt, Human
ugagaaagacuauucaaaca

SEQ ID NO: 2746598 - RNA, 16 nt, Human
ugagaaagacuauuca

SEQ ID NO: 2746599 - RNA, 17 nt, Human
ugagaaagacuauucaa

SEQ ID NO: 2746600 - RNA, 12 nt, Human
ugacucuuaaga

SEQ ID NO: 2746601 - RNA, 23 nt, Human
ugggcagcugccuccccuccucu

SEQ ID NO: 2746602 - RNA, 22 nt, Human
ugggcagcugccuccccuccuc

SEQ ID NO: 2746603 - RNA, 20 nt, Human
ugggcagcugccuccccucc

SEQ ID NO: 2746604 - RNA, 14 nt, Human
ugggacagggagga

SEQ ID NO: 2746605 - RNA, 23 nt, Human
uggccuucggccuccauccugag

SEQ ID NO: 2746606 - RNA, 20 nt, Human
uggccuucggccuccauccu

SEQ ID NO: 2746607 - RNA, 22 nt, Human
uggccuucggccuccauccuga

SEQ ID NO: 2746608 - RNA, 22 nt, Human
ugcuucuguuuuauaauuuugu

SEQ ID NO: 2746609 - RNA, 17 nt, Human
ugcuucuguuuuauaau

SEQ ID NO: 2746610 - RNA, 16 nt, Human
ugucauccucaaagaa

SEQ ID NO: 2746611 - RNA, 19 nt, Human
uguauuuuaaaagaaugau

SEQ ID NO: 2746612 - RNA, 18 nt, Human
uguauuuuaaaagaauga

SEQ ID NO: 2746613 - RNA, 14 nt, Human
uguauaaaauaauu

SEQ ID NO: 2746614 - RNA, 13 nt, Human
uguauaaaauaau

SEQ ID NO: 2746615 - RNA, 21 nt, Human
uguaguguuggagaagaacug

SEQ ID NO: 2746616 - RNA, 20 nt, Human
uguaguguuggagaagaacu

SEQ ID NO: 2746617 - RNA, 19 nt, Human
uguaguguuggagaagaac

SEQ ID NO: 2746618 - RNA, 16 nt, Human
ugucucaccuggacuu

SEQ ID NO: 2746619 - RNA, 12 nt, Human
ugucuuaauuaa

SEQ ID NO: 2746620 - RNA, 23 nt, Human
ugucauccucaaagaaaguguau

SEQ ID NO: 2746621 - RNA, 19 nt, Human
ugucauccucaaagaaagu

SEQ ID NO: 2746622 - RNA, 20 nt, Human
ugucauccucaaagaaagug

SEQ ID NO: 2746623 - RNA, 21 nt, Human
ugucauccucaaagaaagugu

SEQ ID NO: 2746624 - RNA, 22 nt, Human
ugucauccucaaagaaagugua

SEQ ID NO: 2746625 - RNA, 24 nt, Human
uguccugccuauuaucugucagcu

SEQ ID NO: 2746626 - RNA, 17 nt, Human
uguccugccuauuaucu

SEQ ID NO: 2746627 - RNA, 17 nt, Human
ugucuacacuaagagag

SEQ ID NO: 2746628 - RNA, 22 nt, Human
ugucuacacuaagagagaauga

SEQ ID NO: 2746629 - RNA, 14 nt, Human
uggguagacacaca

SEQ ID NO: 2746630 - RNA, 20 nt, Human
ugguucccuugaugaagaag

SEQ ID NO: 2746631 - RNA, 17 nt, Human
ugguucccuugaugaag

SEQ ID NO: 2746632 - RNA, 16 nt, Human
ugguucccuugaugaa

SEQ ID NO: 2746633 - RNA, 21 nt, Human
uguacagaauucugcuaccuc

SEQ ID NO: 2746634 - RNA, 18 nt, Human
uguacagaauucugcuac

SEQ ID NO: 2746635 - RNA, 12 nt, Human
uguaaaauggug

SEQ ID NO: 2746636 - RNA, 11 nt, Human
uguaaaauggu

SEQ ID NO: 2746637 - RNA, 15 nt, Human
ucugccagccagcag

SEQ ID NO: 2746638 - RNA, 13 nt, Human
ucugccagccagc

SEQ ID NO: 2746639 - RNA, 17 nt, Human
ucugccagccagcagcc

SEQ ID NO: 2746640 - RNA, 16 nt, Human
ucugccagccagcagc

SEQ ID NO: 2746641 - RNA, 19 nt, Human
ucugccagccagcagccag

SEQ ID NO: 2746642 - RNA, 17 nt, Human
ucuggugagucaccacu

SEQ ID NO: 2746643 - RNA, 20 nt, Human
ucuggugagucaccacuuca

SEQ ID NO: 2746644 - RNA, 16 nt, Human
ucuggcucuaauucac

SEQ ID NO: 2746645 - RNA, 12 nt, Human
ucuggcucuaau

SEQ ID NO: 2746646 - RNA, 15 nt, Human
ucuggcucuaauuca

SEQ ID NO: 2746647 - RNA, 10 nt, Human
ucuggccuuc

SEQ ID NO: 2746648 - RNA, 18 nt, Human
ucuggccuucggccucca

SEQ ID NO: 2746649 - RNA, 17 nt, Human
ucuggccuucggccucc

SEQ ID NO: 2746650 - RNA, 12 nt, Human
ucuucagccuag

SEQ ID NO: 2746651 - RNA, 11 nt, Human
ucuucagccua

SEQ ID NO: 2746652 - RNA, 22 nt, Human
ucuucagccuagccgaccucag

SEQ ID NO: 2746653 - RNA, 21 nt, Human
ucuucagccuagccgaccuca

SEQ ID NO: 2746654 - RNA, 23 nt, Human
ucuucagccuagccgaccucagc

SEQ ID NO: 2746655 - RNA, 12 nt, Human
ucuuaagaagac

SEQ ID NO: 2746656 - RNA, 16 nt, Human
ucuuaacuucuugcuu

SEQ ID NO: 2746657 - RNA, 23 nt, Human
ucuuaacuucuugcuucuuucua

SEQ ID NO: 2746658 - RNA, 12 nt, Human
ucuuaacuucuu

SEQ ID NO: 2746659 - RNA, 18 nt, Human
ucuuaagaagacugcauu

SEQ ID NO: 2746660 - RNA, 15 nt, Human
ucugucuucacaaca

SEQ ID NO: 2746661 - RNA, 19 nt, Human
ucugcaucagcugcugaaa

SEQ ID NO: 2746662 - RNA, 21 nt, Human
ucugcaucagcugcugaaaca

SEQ ID NO: 2746663 - RNA, 14 nt, Human
ucugcaucagcugc

SEQ ID NO: 2746664 - RNA, 18 nt, Human
ucucuguaauaaacucau

SEQ ID NO: 2746665 - RNA, 22 nt, Human
ucucuguaauaaacucauuucu

SEQ ID NO: 2746666 - RNA, 17 nt, Human
uccagguucccucccag

SEQ ID NO: 2746667 - RNA, 18 nt, Human
uccagguucccucccaga

SEQ ID NO: 2746668 - RNA, 20 nt, Human
uccagguucccucccagagg

SEQ ID NO: 2746669 - RNA, 16 nt, Human
ucccugcaauaaaaug

SEQ ID NO: 2746670 - RNA, 16 nt, Human
ucccuugaugaagaag

SEQ ID NO: 2746671 - RNA, 15 nt, Human
ucccuugaugaagaa

SEQ ID NO: 2746672 - RNA, 14 nt, Human
uccuaauacuguca

SEQ ID NO: 2746673 - RNA, 15 nt, Human
uccuaauacugucau

SEQ ID NO: 2746674 - RNA, 18 nt, Human
uccuaauaaaaaggugac

SEQ ID NO: 2746675 - RNA, 16 nt, Human
uccuaauaaaaaggug

SEQ ID NO: 2746676 - RNA, 17 nt, Human
uccuaauaaaaagguga

SEQ ID NO: 2746677 - RNA, 12 nt, Human
uccuaauaaaaa

SEQ ID NO: 2746678 - RNA, 13 nt, Human
uccuaauaaaaag

SEQ ID NO: 2746679 - RNA, 14 nt, Human
uccuaauaaaaagg

SEQ ID NO: 2746680 - RNA, 15 nt, Human
uccuaauaaaaaggu

SEQ ID NO: 2746681 - RNA, 22 nt, Human
uccucugcuugccaucccuccc

SEQ ID NO: 2746682 - RNA, 21 nt, Human
uccucugcuugccaucccucc

SEQ ID NO: 2746683 - RNA, 19 nt, Human
uccucugcuugccaucccu

SEQ ID NO: 2746684 - RNA, 20 nt, Human
uccucugcuugccaucccuc

SEQ ID NO: 2746685 - RNA, 16 nt, Human
ucuaauucacagugcu

SEQ ID NO: 2746686 - RNA, 19 nt, Human
ucuagaaagagaaacaguu

SEQ ID NO: 2746687 - RNA, 22 nt, Human
ucuagugagcagucaggaaaga

SEQ ID NO: 2746688 - RNA, 19 nt, Human
ucuagugagcagucaggaa

SEQ ID NO: 2746689 - RNA, 15 nt, Human
ucucaacuccaaacu

SEQ ID NO: 2746690 - RNA, 17 nt, Human
ucuaugaaauauuaugu

SEQ ID NO: 2746691 - RNA, 14 nt, Human
ucuaugaaauauua

SEQ ID NO: 2746692 - RNA, 13 nt, Human
ucuaugaaauauu

SEQ ID NO: 2746693 - RNA, 22 nt, Human
ucgugggacagucaccucaugg

SEQ ID NO: 2746694 - RNA, 21 nt, Human
ucguggaacaguuaccucugc

SEQ ID NO: 2746695 - RNA, 17 nt, Human
ucggccuccauccugag

SEQ ID NO: 2746696 - RNA, 18 nt, Human
ucggccuccauccugagg

SEQ ID NO: 2746697 - RNA, 13 nt, Human
ucguuaauuugua

SEQ ID NO: 2746698 - RNA, 23 nt, Human
ucuaacagcccuccucugcacuc

SEQ ID NO: 2746699 - RNA, 13 nt, Human
ucuaacagcccuc

SEQ ID NO: 2746700 - RNA, 20 nt, Human
ucuaacagcccuccucugca

SEQ ID NO: 2746701 - RNA, 21 nt, Human
ucuaacagcccuccucugcac

SEQ ID NO: 2746702 - RNA, 22 nt, Human
ucuaacagcccuccucugcacu

SEQ ID NO: 2746703 - RNA, 12 nt, Human
ucuaacagcccu

SEQ ID NO: 2746704 - RNA, 17 nt, Human
uccuggcaauagucaaa

SEQ ID NO: 2746705 - RNA, 20 nt, Human
uccugccuaagugcagcccc

SEQ ID NO: 2746706 - RNA, 19 nt, Human
uccugccuauuaucuguca

SEQ ID NO: 2746707 - RNA, 22 nt, Human
uccugucggagcccugucuccu

SEQ ID NO: 2746708 - RNA, 19 nt, Human
uccugucggagcccugucu

SEQ ID NO: 2746709 - RNA, 16 nt, Human
uccuuggacucauuuu

SEQ ID NO: 2746710 - RNA, 18 nt, Human
ucacagugcucuuuucuc

SEQ ID NO: 2746711 - RNA, 20 nt, Human
ucacagugcucuuuucuccu

SEQ ID NO: 2746712 - RNA, 17 nt, Human
ucacagugcucuuuucu

SEQ ID NO: 2746713 - RNA, 14 nt, Human
ucaccaaggcugau

SEQ ID NO: 2746714 - RNA, 16 nt, Human
ucacagucacauucca

SEQ ID NO: 2746715 - RNA, 13 nt, Human
ucacaagacccaa

SEQ ID NO: 2746716 - RNA, 18 nt, Human
ucacaagacccaaaaggc

SEQ ID NO: 2746717 - RNA, 17 nt, Human
ucacaagacccaaaagg

SEQ ID NO: 2746718 - RNA, 13 nt, Human
ucaaugcagcccc

SEQ ID NO: 2746719 - RNA, 21 nt, Human
ucaauaaaauccauacauuug

SEQ ID NO: 2746720 - RNA, 14 nt, Human
uauuuuuuguauaa

SEQ ID NO: 2746721 - RNA, 16 nt, Human
uauuuuuuguauaauu

SEQ ID NO: 2746722 - RNA, 17 nt, Human
uauuuuuuguauaauug

SEQ ID NO: 2746723 - RNA, 14 nt, Human
ucaaauaugcaaag

SEQ ID NO: 2746724 - RNA, 20 nt, Human
ucaaaucaagaaacuuaagg

SEQ ID NO: 2746725 - RNA, 14 nt, Human
ucaaauugugugaa

SEQ ID NO: 2746726 - RNA, 22 nt, Human
uauuguuuuuccuuguauuuaa

SEQ ID NO: 2746727 - RNA, 16 nt, Human
uauuauucccauucua

SEQ ID NO: 2746728 - RNA, 14 nt, Human
uauuaaucuuagug

SEQ ID NO: 2746729 - RNA, 17 nt, Human
uauuaaucuuaguguau

SEQ ID NO: 2746730 - RNA, 18 nt, Human
uauuaaucuuaguguaug

SEQ ID NO: 2746731 - RNA, 17 nt, Human
uauguacuucaugcugu

SEQ ID NO: 2746732 - RNA, 13 nt, Human
uauguacuucaug

SEQ ID NO: 2746733 - RNA, 16 nt, Human
ucauuuccaagcaagu

SEQ ID NO: 2746734 - RNA, 13 nt, Human
ucauuuccaagca

SEQ ID NO: 2746735 - RNA, 19 nt, Human
ucauuaucucaaaacugca

SEQ ID NO: 2746736 - RNA, 20 nt, Human
ucauuaucucaaaacugcac

SEQ ID NO: 2746737 - RNA, 13 nt, Human
ucauuaucucaaa

SEQ ID NO: 2746738 - RNA, 21 nt, Human
ucaugcugccaauauccuaau

SEQ ID NO: 2746739 - RNA, 23 nt, Human
ucaugcugccaauauccuaauaa

SEQ ID NO: 2746740 - RNA, 13 nt, Human
ucaugcugccaau

SEQ ID NO: 2746741 - RNA, 17 nt, Human
ucaugcugccaauaucc

SEQ ID NO: 2746742 - RNA, 19 nt, Human
ucaugcugccaauauccua

SEQ ID NO: 2746743 - RNA, 20 nt, Human
ucaugcugccaauauccuaa

SEQ ID NO: 2746744 - RNA, 18 nt, Human
ucauaccuaucaucuuaa

SEQ ID NO: 2746745 - RNA, 14 nt, Human
uccacuuggucugu

SEQ ID NO: 2746746 - RNA, 16 nt, Human
uccacuuggucuguga

SEQ ID NO: 2746747 - RNA, 15 nt, Human
uccacuuggucugug

SEQ ID NO: 2746748 - RNA, 17 nt, Human
uccaccucccugcaaua

SEQ ID NO: 2746749 - RNA, 16 nt, Human
uccaccucccugcaau

SEQ ID NO: 2746750 - RNA, 15 nt, Human
uccaccucccugcaa

SEQ ID NO: 2746751 - RNA, 14 nt, Human
uccaccucccugca

SEQ ID NO: 2746752 - RNA, 13 nt, Human
uccaccucccugc

SEQ ID NO: 2746753 - RNA, 12 nt, Human
uccaccucccug

SEQ ID NO: 2746754 - RNA, 19 nt, Human
uccacagaagcuccaggua

SEQ ID NO: 2746755 - RNA, 23 nt, Human
ucagggccccagcacuaaagcag

SEQ ID NO: 2746756 - RNA, 16 nt, Human
ucagggccccagcacu

SEQ ID NO: 2746757 - RNA, 14 nt, Human
ucagggccccagca

SEQ ID NO: 2746758 - RNA, 17 nt, Human
ucaggcuagauguaugu

SEQ ID NO: 2746759 - RNA, 13 nt, Human
ucaggcuagaugu

SEQ ID NO: 2746760 - RNA, 21 nt, Human
ucagcugcaagguacucuggu

SEQ ID NO: 2746761 - RNA, 22 nt, Human
ucagcugcaagguacucuggug

SEQ ID NO: 2746762 - RNA, 20 nt, Human
ucagcugcaagguacucugg

SEQ ID NO: 2746763 - RNA, 18 nt, Human
ucagcuccccucggagaa

SEQ ID NO: 2746764 - RNA, 17 nt, Human
ucagcuccccucggaga

SEQ ID NO: 2746765 - RNA, 21 nt, Human
ucacugggguccuggggccuc

SEQ ID NO: 2746766 - RNA, 20 nt, Human
ucacugggguccuggggccu

SEQ ID NO: 2746767 - RNA, 19 nt, Human
ucacugggguccuggggcc

SEQ ID NO: 2746768 - RNA, 17 nt, Human
ucacugggguccugggg

SEQ ID NO: 2746769 - RNA, 16 nt, Human
ucacugggguccuggg

SEQ ID NO: 2746770 - RNA, 22 nt, Human
ucagagcugcccucuccugggc

SEQ ID NO: 2746771 - RNA, 21 nt, Human
ucagagcugcccucuccuggg

SEQ ID NO: 2746772 - RNA, 20 nt, Human
ucagagcugcccucuccugg

SEQ ID NO: 2746773 - RNA, 19 nt, Human
ucagagcugcccucuccug

SEQ ID NO: 2746774 - RNA, 18 nt, Human
ucagagcugcccucuccu

SEQ ID NO: 2746775 - RNA, 21 nt, Human
ggagccucauccgaggcaggg

SEQ ID NO: 2746776 - RNA, 20 nt, Human
ggagccucauccgaggcagg

SEQ ID NO: 2746777 - RNA, 19 nt, Human
ggagccucauccgaggcag

SEQ ID NO: 2746778 - RNA, 18 nt, Human
ggagcccugucuccucuc

SEQ ID NO: 2746779 - RNA, 23 nt, Human
ggagcccugucuccucucucugu

SEQ ID NO: 2746780 - RNA, 16 nt, Human
ggaggacgcucucugg

SEQ ID NO: 2746781 - RNA, 19 nt, Human
ggaggggagcaugggaagu

SEQ ID NO: 2746782 - RNA, 19 nt, Human
ggacgcucucuggccuucg

SEQ ID NO: 2746783 - RNA, 16 nt, Human
ggacgcucucuggccu

SEQ ID NO: 2746784 - RNA, 15 nt, Human
ggacgcucucuggcc

SEQ ID NO: 2746785 - RNA, 23 nt, Human
ggagaagagcuguucacagccag

SEQ ID NO: 2746786 - RNA, 14 nt, Human
ggagaagaacugaa

SEQ ID NO: 2746787 - RNA, 11 nt, Human
ggagaagaacu

SEQ ID NO: 2746788 - RNA, 15 nt, Human
ggagaagagcuguuc

SEQ ID NO: 2746789 - RNA, 20 nt, Human
ggacauuugcucauggaauu

SEQ ID NO: 2746790 - RNA, 17 nt, Human
ggacauuugcucaugga

SEQ ID NO: 2746791 - RNA, 16 nt, Human
ggacauuugcucaugg

SEQ ID NO: 2746792 - RNA, 14 nt, Human
ggcccaccaggguc

SEQ ID NO: 2746793 - RNA, 15 nt, Human
ggcccaccagggucc

SEQ ID NO: 2746794 - RNA, 20 nt, Human
ggcagugcuuggcccaggag

SEQ ID NO: 2746795 - RNA, 21 nt, Human
ggcagugcuuggcccaggagu

SEQ ID NO: 2746796 - RNA, 22 nt, Human
ggcagugcuuggcccaggaguu

SEQ ID NO: 2746797 - RNA, 23 nt, Human
ggcagugcuuggcccaggaguuu

SEQ ID NO: 2746798 - RNA, 17 nt, Human
ggcagugcuuggcccag

SEQ ID NO: 2746799 - RNA, 18 nt, Human
ggcagugcuuggcccagg

SEQ ID NO: 2746800 - RNA, 19 nt, Human
ggcagugcuuggcccagga

SEQ ID NO: 2746801 - RNA, 17 nt, Human
ggcagggucaggagagg

SEQ ID NO: 2746802 - RNA, 15 nt, Human
ggcagggucaggaga

SEQ ID NO: 2746803 - RNA, 16 nt, Human
ggcagcugccuccccu

SEQ ID NO: 2746804 - RNA, 19 nt, Human
ggcagaguuacaguucugu

SEQ ID NO: 2746805 - RNA, 13 nt, Human
ggcagaguuacag

SEQ ID NO: 2746806 - RNA, 18 nt, Human
ggcagaguuacaguucug

SEQ ID NO: 2746807 - RNA, 13 nt, Human
ggcagcugccucc

SEQ ID NO: 2746808 - RNA, 12 nt, Human
ggcagcugccuc

SEQ ID NO: 2746809 - RNA, 11 nt, Human
ggcagcugccu

SEQ ID NO: 2746810 - RNA, 17 nt, Human
ggauuagggagagaaga

SEQ ID NO: 2746811 - RNA, 21 nt, Human
ggcagagguugcagugagccg

SEQ ID NO: 2746812 - RNA, 19 nt, Human
ggauugaaggaugcugucu

SEQ ID NO: 2746813 - RNA, 20 nt, Human
ggcuuagacccucaugcugc

SEQ ID NO: 2746814 - RNA, 22 nt, Human
ggcuuagacccucaugcugcca

SEQ ID NO: 2746815 - RNA, 23 nt, Human
ggcuuagacccucaugcugccaa

SEQ ID NO: 2746816 - RNA, 20 nt, Human
gggaggacgcucucuggccu

SEQ ID NO: 2746817 - RNA, 17 nt, Human
gggaggacgcucucugg

SEQ ID NO: 2746818 - RNA, 21 nt, Human
gggacugaggggaggggagca

SEQ ID NO: 2746819 - RNA, 18 nt, Human
ggccuccucuguccaggg

SEQ ID NO: 2746820 - RNA, 19 nt, Human
ggccuccucuguccagggc

SEQ ID NO: 2746821 - RNA, 23 nt, Human
ggcuauaggugcuacaaaaacac

SEQ ID NO: 2746822 - RNA, 20 nt, Human
ggcuaguaucaaaagaaaga

SEQ ID NO: 2746823 - RNA, 16 nt, Human
ggcuccacuuggucug

SEQ ID NO: 2746824 - RNA, 18 nt, Human
gccuuccccuugcccagg

SEQ ID NO: 2746825 - RNA, 16 nt, Human
gccuuccccuugccca

SEQ ID NO: 2746826 - RNA, 18 nt, Human
gccuuggggcugaugcag

SEQ ID NO: 2746827 - RNA, 20 nt, Human
gccugagcgacagugagacu

SEQ ID NO: 2746828 - RNA, 17 nt, Human
gccugagcgacagugag

SEQ ID NO: 2746829 - RNA, 14 nt, Human
gcuagauguaugua

SEQ ID NO: 2746830 - RNA, 13 nt, Human
gcuagauguaugu

SEQ ID NO: 2746831 - RNA, 21 nt, Human
gcuauaggugcuacaaaaaca

SEQ ID NO: 2746832 - RNA, 19 nt, Human
gcuauaggugcuacaaaaa

SEQ ID NO: 2746833 - RNA, 21 nt, Human
gcuccugucugccagccagca

SEQ ID NO: 2746834 - RNA, 20 nt, Human
gcuccugucugccagccagc

SEQ ID NO: 2746835 - RNA, 19 nt, Human
gcuccugucugccagccag

SEQ ID NO: 2746836 - RNA, 18 nt, Human
gcuccugucugccagcca

SEQ ID NO: 2746837 - RNA, 17 nt, Human
gcuccugucugccagcc

SEQ ID NO: 2746838 - RNA, 16 nt, Human
gcuccugucugccagc

SEQ ID NO: 2746839 - RNA, 14 nt, Human
gcuccugucugcca

SEQ ID NO: 2746840 - RNA, 20 nt, Human
gcuccauuuuuagugaaaua

SEQ ID NO: 2746841 - RNA, 21 nt, Human
gcuggaaaaguauguuagugc

SEQ ID NO: 2746842 - RNA, 23 nt, Human
gcuggaaaaguauguuagugcaa

SEQ ID NO: 2746843 - RNA, 23 nt, Human
gcugcccucuccugggcagcugc

SEQ ID NO: 2746844 - RNA, 22 nt, Human
gcugcccucuccugggcagcug

SEQ ID NO: 2746845 - RNA, 20 nt, Human
gcugcccucuccugggcagc

SEQ ID NO: 2746846 - RNA, 18 nt, Human
gcugcccucuccugggca

SEQ ID NO: 2746847 - RNA, 17 nt, Human
gcugcccucuccugggc

SEQ ID NO: 2746848 - RNA, 16 nt, Human
gcugcccucuccuggg

SEQ ID NO: 2746849 - RNA, 15 nt, Human
gcugcccucuccugg

SEQ ID NO: 2746850 - RNA, 14 nt, Human
gcugcccucuccug

SEQ ID NO: 2746851 - RNA, 13 nt, Human
gcugcccucuccu

SEQ ID NO: 2746852 - RNA, 20 nt, Human
gcugacuaaacuuuuuuucu

SEQ ID NO: 2746853 - RNA, 21 nt, Human
gcugauuaaaccaaggcuaga

SEQ ID NO: 2746854 - RNA, 12 nt, Human
gcugcccucucc

SEQ ID NO: 2746855 - RNA, 23 nt, Human
gcuggucccagccagcaguucag

SEQ ID NO: 2746856 - RNA, 17 nt, Human
gcuuagaccucagccug

SEQ ID NO: 2746857 - RNA, 16 nt, Human
gcuuagaccucagccu

SEQ ID NO: 2746858 - RNA, 15 nt, Human
gcuuagaccucagcc

SEQ ID NO: 2746859 - RNA, 14 nt, Human
gcuuagaccucagc

SEQ ID NO: 2746860 - RNA, 13 nt, Human
gcuuagaccucag

SEQ ID NO: 2746861 - RNA, 16 nt, Human
gcuuagacccucaugc

SEQ ID NO: 2746862 - RNA, 21 nt, Human
gcuuagacccucaugcugcca

SEQ ID NO: 2746863 - RNA, 19 nt, Human
gcuucuguuuuauaauuuu

SEQ ID NO: 2746864 - RNA, 18 nt, Human
gcuugcccuguuaaaaga

SEQ ID NO: 2746865 - RNA, 16 nt, Human
gcagggucaggagagg

SEQ ID NO: 2746866 - RNA, 15 nt, Human
gcagggucaggagag

SEQ ID NO: 2746867 - RNA, 14 nt, Human
gcagggucaggaga

SEQ ID NO: 2746868 - RNA, 17 nt, Human
gcagggucaggagaggg

SEQ ID NO: 2746869 - RNA, 23 nt, Human
gcaguucagagcugcccucuccu

SEQ ID NO: 2746870 - RNA, 22 nt, Human
gcaguucagagcugcccucucc

SEQ ID NO: 2746871 - RNA, 20 nt, Human
gcaguucagagcugcccucu

SEQ ID NO: 2746872 - RNA, 19 nt, Human
gcaguucagagcugcccuc

SEQ ID NO: 2746873 - RNA, 21 nt, Human
gcaguugaaaagacuccaaag

SEQ ID NO: 2746874 - RNA, 16 nt, Human
gcaguugaaaagacuc

SEQ ID NO: 2746875 - RNA, 19 nt, Human
gcaguugaaaagacuccaa

SEQ ID NO: 2746876 - RNA, 15 nt, Human
gcaguugaaaagacu

SEQ ID NO: 2746877 - RNA, 20 nt, Human
gcaucuagcaugucgucaaa

SEQ ID NO: 2746878 - RNA, 22 nt, Human
gcaucauuauuugcagagacag

SEQ ID NO: 2746879 - RNA, 22 nt, Human
gcaucagcugcugaaacaacaa

SEQ ID NO: 2746880 - RNA, 23 nt, Human
gcaucagcugcugaaacaacaaa

SEQ ID NO: 2746881 - RNA, 20 nt, Human
gcacuaaagcaguggacacc

SEQ ID NO: 2746882 - RNA, 14 nt, Human
gcacuaaagcagug

SEQ ID NO: 2746883 - RNA, 15 nt, Human
gcacgcacacugucu

SEQ ID NO: 2746884 - RNA, 16 nt, Human
gcacgcacacugucug

SEQ ID NO: 2746885 - RNA, 19 nt, Human
gcacuguggguagacacac

SEQ ID NO: 2746886 - RNA, 11 nt, Human
gcacagcccuu

SEQ ID NO: 2746887 - RNA, 18 nt, Human
gcacagccucuuagaugc

SEQ ID NO: 2746888 - RNA, 15 nt, Human
gcacagccucuuaga

SEQ ID NO: 2746889 - RNA, 23 nt, Human
gcagagguugcagugagccgaga

SEQ ID NO: 2746890 - RNA, 18 nt, Human
gcagagguugcagugagc

SEQ ID NO: 2746891 - RNA, 16 nt, Human
gcaggaagcugugaga

SEQ ID NO: 2746892 - RNA, 13 nt, Human
gccaauauccuaa

SEQ ID NO: 2746893 - RNA, 14 nt, Human
gccaauauccuaau

SEQ ID NO: 2746894 - RNA, 15 nt, Human
gccaauauccuaaua

SEQ ID NO: 2746895 - RNA, 16 nt, Human
gccaauauccuaauaa

SEQ ID NO: 2746896 - RNA, 17 nt, Human
gccaauauccuaauaaa

SEQ ID NO: 2746897 - RNA, 23 nt, Human
gccaauauccuaauaaaaaggug

SEQ ID NO: 2746898 - RNA, 18 nt, Human
gccaauauccuaauaaaa

SEQ ID NO: 2746899 - RNA, 19 nt, Human
gccaauauccuaauaaaaa

SEQ ID NO: 2746900 - RNA, 20 nt, Human
gccaauauccuaauaaaaag

SEQ ID NO: 2746901 - RNA, 22 nt, Human
gccaauauccuaauaaaaaggu

SEQ ID NO: 2746902 - RNA, 19 nt, Human
gccagacuggcacaguuuu

SEQ ID NO: 2746903 - RNA, 15 nt, Human
gccagacuggcacag

SEQ ID NO: 2746904 - RNA, 18 nt, Human
gccagacuggcacaguuu

SEQ ID NO: 2746905 - RNA, 23 nt, Human
gccaugggacagggaggacgcuc

SEQ ID NO: 2746906 - RNA, 22 nt, Human
gccaugggacagggaggacgcu

SEQ ID NO: 2746907 - RNA, 19 nt, Human
gcccaaguucaugcagcug

SEQ ID NO: 2746908 - RNA, 20 nt, Human
gcccaaguucaugcagcugu

SEQ ID NO: 2746909 - RNA, 13 nt, Human
gauagcagggcau

SEQ ID NO: 2746910 - RNA, 19 nt, Human
gagugucuuaauuaaaaga

SEQ ID NO: 2746911 - RNA, 23 nt, Human
gagugaacaaauuuacagagaca

SEQ ID NO: 2746912 - RNA, 22 nt, Human
gagugaacaaauuuacagagac

SEQ ID NO: 2746913 - RNA, 19 nt, Human
gagugaacaaauuuacaga

SEQ ID NO: 2746914 - RNA, 17 nt, Human
gaguuacaguucugugg

SEQ ID NO: 2746915 - RNA, 21 nt, Human
gaguugaaaaucuuauaauuu

SEQ ID NO: 2746916 - RNA, 13 nt, Human
gauugugccccug

SEQ ID NO: 2746917 - RNA, 19 nt, Human
gauguugaaaaaguucugc

SEQ ID NO: 2746918 - RNA, 18 nt, Human
gaugcaguucugaagaag

SEQ ID NO: 2746919 - RNA, 16 nt, Human
gaugggaaagcauugu

SEQ ID NO: 2746920 - RNA, 13 nt, Human
gaucuuuaaaaua

SEQ ID NO: 2746921 - RNA, 14 nt, Human
gaucuuuaaaauac

SEQ ID NO: 2746922 - RNA, 16 nt, Human
gaggagccaccaguuc

SEQ ID NO: 2746923 - RNA, 18 nt, Human
gaggagccaccaguucuc

SEQ ID NO: 2746924 - RNA, 19 nt, Human
gaggcagagguugcaguga

SEQ ID NO: 2746925 - RNA, 16 nt, Human
gaggcagacagcagcu

SEQ ID NO: 2746926 - RNA, 15 nt, Human
gaggcagacagcagc

SEQ ID NO: 2746927 - RNA, 12 nt, Human
gaggcagacagc

SEQ ID NO: 2746928 - RNA, 21 nt, Human
gaggcaauuagacacuuugga

SEQ ID NO: 2746929 - RNA, 13 nt, Human
gagcacacuguag

SEQ ID NO: 2746930 - RNA, 15 nt, Human
gagcacacuguagca

SEQ ID NO: 2746931 - RNA, 21 nt, Human
gagcaggcuacugucagcucc

SEQ ID NO: 2746932 - RNA, 14 nt, Human
gagccaccaguucu

SEQ ID NO: 2746933 - RNA, 12 nt, Human
gagcuacaaaug

SEQ ID NO: 2746934 - RNA, 13 nt, Human
gagcuacaaaugc

SEQ ID NO: 2746935 - RNA, 14 nt, Human
gagcuacaaaugca

SEQ ID NO: 2746936 - RNA, 16 nt, Human
gagcugcccucuccug

SEQ ID NO: 2746937 - RNA, 15 nt, Human
gagcugcccucuccu

SEQ ID NO: 2746938 - RNA, 14 nt, Human
gagcugcccucucc

SEQ ID NO: 2746939 - RNA, 19 nt, Human
cucuuaagaagacugcauu

SEQ ID NO: 2746940 - RNA, 13 nt, Human
cucuuaagaagac

SEQ ID NO: 2746941 - RNA, 21 nt, Human
cucuggccuucggccuccauc

SEQ ID NO: 2746942 - RNA, 22 nt, Human
cucuggccuucggccuccaucc

SEQ ID NO: 2746943 - RNA, 16 nt, Human
cugagcaggauuuuaa

SEQ ID NO: 2746944 - RNA, 16 nt, Human
cugagaugugaacaca

SEQ ID NO: 2746945 - RNA, 20 nt, Human
cugagaugugaacacaucag

SEQ ID NO: 2746946 - RNA, 19 nt, Human
cugagaaagacuauucaaa

SEQ ID NO: 2746947 - RNA, 20 nt, Human
cugagaaagacuauucaaac

SEQ ID NO: 2746948 - RNA, 21 nt, Human
cugagaugugaacacaucagc

SEQ ID NO: 2746949 - RNA, 12 nt, Human
cugagaaagacu

SEQ ID NO: 2746950 - RNA, 13 nt, Human
cugagaaagacua

SEQ ID NO: 2746951 - RNA, 15 nt, Human
cugagaaagacuauu

SEQ ID NO: 2746952 - RNA, 18 nt, Human
cugagaaagacuauucaa

SEQ ID NO: 2746953 - RNA, 14 nt, Human
cugacuaaacuuuu

SEQ ID NO: 2746954 - RNA, 15 nt, Human
cugacuaaacuuuuu

SEQ ID NO: 2746955 - RNA, 19 nt, Human
cugacuaaacuuuuuuucu

SEQ ID NO: 2746956 - RNA, 22 nt, Human
cugacuaaacuuuuuuucugua

SEQ ID NO: 2746957 - RNA, 23 nt, Human
cugacgacuugagugcucaguag

SEQ ID NO: 2746958 - RNA, 14 nt, Human
cugaagaagauggu

SEQ ID NO: 2746959 - RNA, 23 nt, Human
cugccuauuaucugucagcugca

SEQ ID NO: 2746960 - RNA, 17 nt, Human
cugccuauuaucuguca

SEQ ID NO: 2746961 - RNA, 20 nt, Human
cugcaucagcugcugaaaca

SEQ ID NO: 2746962 - RNA, 15 nt, Human
cugaggcuccacuug

SEQ ID NO: 2746963 - RNA, 21 nt, Human
cugaggcuccacuuggucugu

SEQ ID NO: 2746964 - RNA, 22 nt, Human
cugcaauaaaauggguuuuacu

SEQ ID NO: 2746965 - RNA, 15 nt, Human
cugcaauaaaauggg

SEQ ID NO: 2746966 - RNA, 16 nt, Human
cuaguaauuggaaagg

SEQ ID NO: 2746967 - RNA, 20 nt, Human
cuagugaaacucguuaauuu

SEQ ID NO: 2746968 - RNA, 18 nt, Human
cuagugaaagaggcagcu

SEQ ID NO: 2746969 - RNA, 19 nt, Human
cuagugaaagaggcagcuu

SEQ ID NO: 2746970 - RNA, 21 nt, Human
cuagugagcagucaggaaaga

SEQ ID NO: 2746971 - RNA, 23 nt, Human
cuauucaaacagucucaggaaau

SEQ ID NO: 2746972 - RNA, 18 nt, Human
cuauucaaacagucucag

SEQ ID NO: 2746973 - RNA, 16 nt, Human
cuauucaaacagucuc

SEQ ID NO: 2746974 - RNA, 22 nt, Human
cuauaauuuaccuaagauuaca

SEQ ID NO: 2746975 - RNA, 21 nt, Human
cuauaggugcuacaaaaacac

SEQ ID NO: 2746976 - RNA, 22 nt, Human
cuauaggugcuacaaaaacaca

SEQ ID NO: 2746977 - RNA, 20 nt, Human
cuauaggugcuacaaaaaca

SEQ ID NO: 2746978 - RNA, 18 nt, Human
cuauauuguuugcuaagc

SEQ ID NO: 2746979 - RNA, 15 nt, Human
cuauaggugcuacaa

SEQ ID NO: 2746980 - RNA, 17 nt, Human
cucauccgaggcagggu

SEQ ID NO: 2746981 - RNA, 15 nt, Human
cucauccgaggcagg

SEQ ID NO: 2746982 - RNA, 14 nt, Human
cucauccgaggcag

SEQ ID NO: 2746983 - RNA, 21 nt, Human
cucauuuccaagcaaguauua

SEQ ID NO: 2746984 - RNA, 14 nt, Human
cucauuucuagcag

SEQ ID NO: 2746985 - RNA, 13 nt, Human
cuccaaagaaaug

SEQ ID NO: 2746986 - RNA, 12 nt, Human
cuccaaagaaau

SEQ ID NO: 2746987 - RNA, 21 nt, Human
cuccaaacugacucuuaagaa

SEQ ID NO: 2746988 - RNA, 23 nt, Human
cuccaccucccugcaauaaaaug

SEQ ID NO: 2746989 - RNA, 17 nt, Human
cuccaccuugcagcucu

SEQ ID NO: 2746990 - RNA, 11 nt, Human
cuccauccuga

SEQ ID NO: 2746991 - RNA, 12 nt, Human
cuccauccugag

SEQ ID NO: 2746992 - RNA, 13 nt, Human
cuccccuccucug

SEQ ID NO: 2746993 - RNA, 11 nt, Human
cuccccuccuc

SEQ ID NO: 2746994 - RNA, 13 nt, Human
cuccauccugagg

SEQ ID NO: 2746995 - RNA, 20 nt, Human
cuccccuccucugcuugcca

SEQ ID NO: 2746996 - RNA, 21 nt, Human
cuugccaucccucccuccacc

SEQ ID NO: 2746997 - RNA, 16 nt, Human
cuugccagacaugugg

SEQ ID NO: 2746998 - RNA, 22 nt, Human
cuugccaucccucccuccaccu

SEQ ID NO: 2746999 - RNA, 19 nt, Human
cuuguaaaggaauuuaaaa

SEQ ID NO: 2747000 - RNA, 13 nt, Human
cuuuccacagaag

SEQ ID NO: 2747001 - RNA, 21 nt, Human
cuuuauuuucuauaauuuaaa

SEQ ID NO: 2747002 - RNA, 18 nt, Human
cuuuauaacuaacauguc

SEQ ID NO: 2747003 - RNA, 18 nt, Human
cuuuaaagggauggcaag

SEQ ID NO: 2747004 - RNA, 17 nt, Human
cuuuucuccucacugua

SEQ ID NO: 2747005 - RNA, 18 nt, Human
cuuuugacacugcucuaa

SEQ ID NO: 2747006 - RNA, 12 nt, Human
cuuuugacacug

SEQ ID NO: 2747007 - RNA, 17 nt, Human
cuuuugacacugcucua

SEQ ID NO: 2747008 - RNA, 22 nt, Human
gaaaacaauaacgauaaaagac

SEQ ID NO: 2747009 - RNA, 12 nt, Human
gaaaauaucacu

SEQ ID NO: 2747010 - RNA, 19 nt, Human
gaaaaucuuauaauuuaaa

SEQ ID NO: 2747011 - RNA, 19 nt, Human
gaaaauaacgauaaaagac

SEQ ID NO: 2747012 - RNA, 20 nt, Human
gaaaaucuuauaauuuaaaa

SEQ ID NO: 2747013 - RNA, 19 nt, Human
gaauaaaggcaguuuucua

SEQ ID NO: 2747014 - RNA, 20 nt, Human
gaauaaaggcaguuuucuaa

SEQ ID NO: 2747015 - RNA, 15 nt, Human
gaauaaaggcaguuu

SEQ ID NO: 2747016 - RNA, 16 nt, Human
gaauaaaggcaguuuu

SEQ ID NO: 2747017 - RNA, 17 nt, Human
gaauaaaggcaguuuuc

SEQ ID NO: 2747018 - RNA, 20 nt, Human
gaauaauccuaaacauauga

SEQ ID NO: 2747019 - RNA, 14 nt, Human
gaauacuuuauaaa

SEQ ID NO: 2747020 - RNA, 21 nt, Human
gaagccuuggggcugaugcag

SEQ ID NO: 2747021 - RNA, 18 nt, Human
gaaauaaaguuggugaca

SEQ ID NO: 2747022 - RNA, 19 nt, Human
gaaauaaagucagauggaa

SEQ ID NO: 2747023 - RNA, 14 nt, Human
gaaauaaagucaga

SEQ ID NO: 2747024 - RNA, 18 nt, Human
gaaacaguugguaacuuu

SEQ ID NO: 2747025 - RNA, 19 nt, Human
gaaacaguugguaacuuuu

SEQ ID NO: 2747026 - RNA, 20 nt, Human
gaaacaguugguaacuuuug

SEQ ID NO: 2747027 - RNA, 21 nt, Human
gaaacaguugguaacuuuugu

SEQ ID NO: 2747028 - RNA, 23 nt, Human
gaaacaguugguaacuuuuguga

SEQ ID NO: 2747029 - RNA, 17 nt, Human
gaacacugggggagggg

SEQ ID NO: 2747030 - RNA, 16 nt, Human
gaacacugggggaggg

SEQ ID NO: 2747031 - RNA, 18 nt, Human
gaaauuguauuacaaauc

SEQ ID NO: 2747032 - RNA, 16 nt, Human
gaaauauuauguuaaa

SEQ ID NO: 2747033 - RNA, 13 nt, Human
gaaauauuauguu

SEQ ID NO: 2747034 - RNA, 21 nt, Human
gaagaagcaccaaucaugaau

SEQ ID NO: 2747035 - RNA, 21 nt, Human
gaacuuguaaaggaauuuaaa

SEQ ID NO: 2747036 - RNA, 22 nt, Human
gaacuuccagauccuggaaauc

SEQ ID NO: 2747037 - RNA, 14 nt, Human
gaacucccuuucaa

SEQ ID NO: 2747038 - RNA, 20 nt, Human
gaacacugggggaggggaca

SEQ ID NO: 2747039 - RNA, 18 nt, Human
gaacacugggggagggga

SEQ ID NO: 2747040 - RNA, 22 nt, Human
gaacuagaguuuagcuggaaaa

SEQ ID NO: 2747041 - RNA, 21 nt, Human
gaacuagaguuuagcuggaaa

SEQ ID NO: 2747042 - RNA, 23 nt, Human
cugggguggguggggcagugcuu

SEQ ID NO: 2747043 - RNA, 14 nt, Human
cugucugccagcca

SEQ ID NO: 2747044 - RNA, 21 nt, Human
cugucugccagccagcagcca

SEQ ID NO: 2747045 - RNA, 20 nt, Human
cugucugccagccagcagcc

SEQ ID NO: 2747046 - RNA, 17 nt, Human
cugucugccagccagca

SEQ ID NO: 2747047 - RNA, 16 nt, Human
cugucugccagccagc

SEQ ID NO: 2747048 - RNA, 15 nt, Human
cugucugccagccag

SEQ ID NO: 2747049 - RNA, 18 nt, Human
cugucuucacaacagauu

SEQ ID NO: 2747050 - RNA, 15 nt, Human
cugugguuucauguu

SEQ ID NO: 2747051 - RNA, 16 nt, Human
cugugguuucauguua

SEQ ID NO: 2747052 - RNA, 17 nt, Human
cugugguuucauguuag

SEQ ID NO: 2747053 - RNA, 18 nt, Human
cugugguuucauguuagu

SEQ ID NO: 2747054 - RNA, 19 nt, Human
cuguuaaaagaugaaaaua

SEQ ID NO: 2747055 - RNA, 15 nt, Human
cuguuaaaagaugaa

SEQ ID NO: 2747056 - RNA, 16 nt, Human
cuguuaaaagaugaaa

SEQ ID NO: 2747057 - RNA, 18 nt, Human
cuuagaccucagccugug

SEQ ID NO: 2747058 - RNA, 17 nt, Human
cuuagaccucagccugu

SEQ ID NO: 2747059 - RNA, 20 nt, Human
cuuagaccucagccugugcu

SEQ ID NO: 2747060 - RNA, 16 nt, Human
cuuagaccucagccug

SEQ ID NO: 2747061 - RNA, 15 nt, Human
cuuagaccucagccu

SEQ ID NO: 2747062 - RNA, 14 nt, Human
cuuagaccucagcc

SEQ ID NO: 2747063 - RNA, 13 nt, Human
cuuagaccucagc

SEQ ID NO: 2747064 - RNA, 12 nt, Human
cuuagaccucag

SEQ ID NO: 2747065 - RNA, 23 nt, Human
cuuagacccucaugcugccaaua

SEQ ID NO: 2747066 - RNA, 19 nt, Human
cuuagacccucaugcugcc

SEQ ID NO: 2747067 - RNA, 20 nt, Human
cuuagacccucaugcugcca

SEQ ID NO: 2747068 - RNA, 21 nt, Human
cuuagacccucaugcugccaa

SEQ ID NO: 2747069 - RNA, 22 nt, Human
cuuagacccucaugcugccaau

SEQ ID NO: 2747070 - RNA, 23 nt, Human
cuuaagaagacugcauuauauuu

SEQ ID NO: 2747071 - RNA, 21 nt, Human
cuuaagaagacugcauuauau

SEQ ID NO: 2747072 - RNA, 19 nt, Human
cuuaauuaaaagaauauuu

SEQ ID NO: 2747073 - RNA, 20 nt, Human
cuuaauuaaaagaauauuuu

SEQ ID NO: 2747074 - RNA, 16 nt, Human
cuuaauuaaaagaaua

SEQ ID NO: 2747075 - RNA, 17 nt, Human
cuuaauuaaaagaauau

SEQ ID NO: 2747076 - RNA, 14 nt, Human
cuguuuuauaauuu

SEQ ID NO: 2747077 - RNA, 15 nt, Human
cuguuuuauaauuuu

SEQ ID NO: 2747078 - RNA, 12 nt, Human
cuucacaacaga

SEQ ID NO: 2747079 - RNA, 14 nt, Human
cuucacaacagauu

SEQ ID NO: 2747080 - RNA, 17 nt, Human
cuucacacacaggcaac

SEQ ID NO: 2747081 - RNA, 16 nt, Human
cuucacacacaggcaa

SEQ ID NO: 2747082 - RNA, 17 nt, Human
cuucaaauccuugaaga

SEQ ID NO: 2747083 - RNA, 15 nt, Human
cuucagccugaaaga

SEQ ID NO: 2747084 - RNA, 20 nt, Human
cuuccuuggacucauuuuaa

SEQ ID NO: 2747085 - RNA, 20 nt, Human
cuucggccuccauccugagg

SEQ ID NO: 2747086 - RNA, 19 nt, Human
cuucggccuccauccugag

SEQ ID NO: 2747087 - RNA, 17 nt, Human
ccucccuccaccucccu

SEQ ID NO: 2747088 - RNA, 20 nt, Human
ccucccuccaccucccugca

SEQ ID NO: 2747089 - RNA, 18 nt, Human
ccuccucugcuugccauc

SEQ ID NO: 2747090 - RNA, 13 nt, Human
ccuccucugcuug

SEQ ID NO: 2747091 - RNA, 16 nt, Human
ccuccucugcuugcca

SEQ ID NO: 2747092 - RNA, 12 nt, Human
ccuccucugucc

SEQ ID NO: 2747093 - RNA, 16 nt, Human
ccuccucuguccaggg

SEQ ID NO: 2747094 - RNA, 15 nt, Human
ccuccucuguccagg

SEQ ID NO: 2747095 - RNA, 18 nt, Human
ccuccucuguccagggcc

SEQ ID NO: 2747096 - RNA, 20 nt, Human
ccucauccgaggcaggguca

SEQ ID NO: 2747097 - RNA, 17 nt, Human
ccucauccgaggcaggg

SEQ ID NO: 2747098 - RNA, 15 nt, Human
ccucauccgaggcag

SEQ ID NO: 2747099 - RNA, 14 nt, Human
ccucauccgaggca

SEQ ID NO: 2747100 - RNA, 14 nt, Human
ccuccauccugagg

SEQ ID NO: 2747101 - RNA, 22 nt, Human
ccuccaccucccugcaauaaaa

SEQ ID NO: 2747102 - RNA, 17 nt, Human
ccuccaccucccugcaa

SEQ ID NO: 2747103 - RNA, 15 nt, Human
ccuccaccucccugc

SEQ ID NO: 2747104 - RNA, 14 nt, Human
ccuccaccucccug

SEQ ID NO: 2747105 - RNA, 13 nt, Human
ccuccaccucccu

SEQ ID NO: 2747106 - RNA, 13 nt, Human
ccuacaccauucc

SEQ ID NO: 2747107 - RNA, 20 nt, Human
ccgaggcagggucaggagag

SEQ ID NO: 2747108 - RNA, 14 nt, Human
ccgaggcaggguca

SEQ ID NO: 2747109 - RNA, 16 nt, Human
ccgggcguggugguga

SEQ ID NO: 2747110 - RNA, 13 nt, Human
cccaccagggucc

SEQ ID NO: 2747111 - RNA, 18 nt, Human
cccaccugacacaccagg

SEQ ID NO: 2747112 - RNA, 13 nt, Human
cccacaagaaaug

SEQ ID NO: 2747113 - RNA, 20 nt, Human
cccacaagaaaugaaagcag

SEQ ID NO: 2747114 - RNA, 23 nt, Human
cccugguaauaaguacuguguac

SEQ ID NO: 2747115 - RNA, 12 nt, Human
cccuccaccucc

SEQ ID NO: 2747116 - RNA, 14 nt, Human
cccuccaccucccu

SEQ ID NO: 2747117 - RNA, 17 nt, Human
cccuccaccucccugca

SEQ ID NO: 2747118 - RNA, 15 nt, Human
cccuccaccucccug

SEQ ID NO: 2747119 - RNA, 19 nt, Human
cccuccaccucccugcaau

SEQ ID NO: 2747120 - RNA, 15 nt, Human
cccucuccugggcag

SEQ ID NO: 2747121 - RNA, 14 nt, Human
cccucuccugggca

SEQ ID NO: 2747122 - RNA, 13 nt, Human
cccucuccugggc

SEQ ID NO: 2747123 - RNA, 12 nt, Human
cccucuccuggg

SEQ ID NO: 2747124 - RNA, 11 nt, Human
cccucuccugg

SEQ ID NO: 2747125 - RNA, 18 nt, Human
cccuacaccccuccccug

SEQ ID NO: 2747126 - RNA, 15 nt, Human
cccgugggguuccuc

SEQ ID NO: 2747127 - RNA, 17 nt, Human
cccgucuggcccaccag

SEQ ID NO: 2747128 - RNA, 22 nt, Human
ccugggcagcugccuccccucc

SEQ ID NO: 2747129 - RNA, 19 nt, Human
ccugccuauuaucugucag

SEQ ID NO: 2747130 - RNA, 23 nt, Human
ccuggaaaucaggguuaguauug

SEQ ID NO: 2747131 - RNA, 14 nt, Human
ccugacacaccagg

SEQ ID NO: 2747132 - RNA, 15 nt, Human
ccugacacaccaggc

SEQ ID NO: 2747133 - RNA, 17 nt, Human
ccugacacaccaggcgc

SEQ ID NO: 2747134 - RNA, 18 nt, Human
ccugacacaccaggcgcu

SEQ ID NO: 2747135 - RNA, 11 nt, Human
ccugagcccca

SEQ ID NO: 2747136 - RNA, 16 nt, Human
ccugcaauaaaauggg

SEQ ID NO: 2747137 - RNA, 18 nt, Human
cgagcaggcuacugucag

SEQ ID NO: 2747138 - RNA, 20 nt, Human
ccuguuaaaagaugaaaaua

SEQ ID NO: 2747139 - RNA, 21 nt, Human
ccuguuaaaagaugaaaauau

SEQ ID NO: 2747140 - RNA, 20 nt, Human
ccuucggccuccauccugag

SEQ ID NO: 2747141 - RNA, 19 nt, Human
ccuucggccuccauccuga

SEQ ID NO: 2747142 - RNA, 14 nt, Human
ccuucggccuccau

SEQ ID NO: 2747143 - RNA, 20 nt, Human
ccuugaacacugggggaggg

SEQ ID NO: 2747144 - RNA, 20 nt, Human
ccuugaaaacuuuaugcuaa

SEQ ID NO: 2747145 - RNA, 13 nt, Human
ccuugaacacugg

SEQ ID NO: 2747146 - RNA, 14 nt, Human
ccuugaugaagaag

SEQ ID NO: 2747147 - RNA, 19 nt, Human
ccuuggggcugaugcaguu

SEQ ID NO: 2747148 - RNA, 16 nt, Human
ccaggcgcuaauucaa

SEQ ID NO: 2747149 - RNA, 19 nt, Human
ccaguguuuuaggagcaug

SEQ ID NO: 2747150 - RNA, 14 nt, Human
ccaguuauggcuau

SEQ ID NO: 2747151 - RNA, 16 nt, Human
ccaguuaauuuuucca

SEQ ID NO: 2747152 - RNA, 18 nt, Human
ccaguuaauuuuuccaac

SEQ ID NO: 2747153 - RNA, 21 nt, Human
ccaguuauggcuauaggugcu

SEQ ID NO: 2747154 - RNA, 19 nt, Human
ccaugggacagggaggacg

SEQ ID NO: 2747155 - RNA, 16 nt, Human
ccaugggacagggagg

SEQ ID NO: 2747156 - RNA, 16 nt, Human
ccagaggagccaccag

SEQ ID NO: 2747157 - RNA, 17 nt, Human
ccagaggagccaccagu

SEQ ID NO: 2747158 - RNA, 19 nt, Human
ccagaggagccaccaguuc

SEQ ID NO: 2747159 - RNA, 21 nt, Human
ccagaggagccaccaguucuc

SEQ ID NO: 2747160 - RNA, 18 nt, Human
ccagcacuaaagcagugg

SEQ ID NO: 2747161 - RNA, 17 nt, Human
ccagcacuaaagcagug

SEQ ID NO: 2747162 - RNA, 22 nt, Human
ccagccagcaguucagagcugc

SEQ ID NO: 2747163 - RNA, 23 nt, Human
ccagccagcagccagcucucagc

SEQ ID NO: 2747164 - RNA, 19 nt, Human
ccagccagcagccagcucu

SEQ ID NO: 2747165 - RNA, 16 nt, Human
ccagccagcagccagc

SEQ ID NO: 2747166 - RNA, 15 nt, Human
ccagccagcagccag

SEQ ID NO: 2747167 - RNA, 13 nt, Human
ccagccagcagcc

SEQ ID NO: 2747168 - RNA, 23 nt, Human
ccagcaguucagagcugcccucu

SEQ ID NO: 2747169 - RNA, 22 nt, Human
ccagcaguucagagcugcccuc

SEQ ID NO: 2747170 - RNA, 21 nt, Human
ccagcaguucagagcugcccu

SEQ ID NO: 2747171 - RNA, 20 nt, Human
ccagcaguucagagcugccc

SEQ ID NO: 2747172 - RNA, 19 nt, Human
ccagcaguucagagcugcc

SEQ ID NO: 2747173 - RNA, 18 nt, Human
ccagcaguucagagcugc

SEQ ID NO: 2747174 - RNA, 13 nt, Human
ccagcaguucaga

SEQ ID NO: 2747175 - RNA, 24 nt, Human
ccagcacuaaagcaguggacacca

SEQ ID NO: 2747176 - RNA, 14 nt, Human
ccaccucccugcaa

SEQ ID NO: 2747177 - RNA, 20 nt, Human
ccaccugacacaccaggcgc

SEQ ID NO: 2747178 - RNA, 23 nt, Human
ccaccugacacaccaggcgcuaa

SEQ ID NO: 2747179 - RNA, 16 nt, Human
ccaccugacacaccag

SEQ ID NO: 2747180 - RNA, 17 nt, Human
ccaccugacacaccagg

SEQ ID NO: 2747181 - RNA, 19 nt, Human
caugagguacugagaguga

SEQ ID NO: 2747182 - RNA, 16 nt, Human
caugagguacugagag

SEQ ID NO: 2747183 - RNA, 18 nt, Human
caugaagauguagaggag

SEQ ID NO: 2747184 - RNA, 19 nt, Human
caugaagauguagaggaga

SEQ ID NO: 2747185 - RNA, 12 nt, Human
cagugcuuggcc

SEQ ID NO: 2747186 - RNA, 14 nt, Human
cagugcucuuuucu

SEQ ID NO: 2747187 - RNA, 23 nt, Human
cagugcucuuuucuccucacugu

SEQ ID NO: 2747188 - RNA, 15 nt, Human
cauauauaacaaugc

SEQ ID NO: 2747189 - RNA, 13 nt, Human
cauauauaacaau

SEQ ID NO: 2747190 - RNA, 23 nt, Human
caucccucccuccaccucccugc

SEQ ID NO: 2747191 - RNA, 22 nt, Human
caucccucccuccaccucccug

SEQ ID NO: 2747192 - RNA, 18 nt, Human
caucccuuaccugggaaa

SEQ ID NO: 2747193 - RNA, 22 nt, Human
cauccgaggcagggucaggaga

SEQ ID NO: 2747194 - RNA, 16 nt, Human
cauccgaggcaggguc

SEQ ID NO: 2747195 - RNA, 23 nt, Human
cauccgaggcagggucaggagag

SEQ ID NO: 2747196 - RNA, 15 nt, Human
cauccgaggcagggu

SEQ ID NO: 2747197 - RNA, 14 nt, Human
cauccgaggcaggg

SEQ ID NO: 2747198 - RNA, 13 nt, Human
cauccgaggcagg

SEQ ID NO: 2747199 - RNA, 21 nt, Human
caucauuauuugcagagacag

SEQ ID NO: 2747200 - RNA, 20 nt, Human
caucccucccuccaccuccc

SEQ ID NO: 2747201 - RNA, 23 nt, Human
caugggacagggaggacgcucuc

SEQ ID NO: 2747202 - RNA, 15 nt, Human
cauggagcugggcua

SEQ ID NO: 2747203 - RNA, 20 nt, Human
cauggaauuggagcucgugg

SEQ ID NO: 2747204 - RNA, 20 nt, Human
caugugcuaguaauuggaaa

SEQ ID NO: 2747205 - RNA, 21 nt, Human
cauuguaaaugugcuuuuaaa

SEQ ID NO: 2747206 - RNA, 13 nt, Human
cauucuggaauaa

SEQ ID NO: 2747207 - RNA, 21 nt, Human
cauuacagugggugccccccu

SEQ ID NO: 2747208 - RNA, 22 nt, Human
cauuccaacuaucucauuucca

SEQ ID NO: 2747209 - RNA, 15 nt, Human
cagguucccucccag

SEQ ID NO: 2747210 - RNA, 23 nt, Human
cagguucccucccagaggagcca

SEQ ID NO: 2747211 - RNA, 16 nt, Human
cagguucccucccaga

SEQ ID NO: 2747212 - RNA, 18 nt, Human
cagguucccucccagagg

SEQ ID NO: 2747213 - RNA, 17 nt, Human
caguaccccauggagcu

SEQ ID NO: 2747214 - RNA, 23 nt, Human
caguaccccauggagcugggcua

SEQ ID NO: 2747215 - RNA, 14 nt, Human
cagggucaggagag

SEQ ID NO: 2747216 - RNA, 22 nt, Human
caggguccuuuugacacugcuc

SEQ ID NO: 2747217 - RNA, 23 nt, Human
caggguccuuuugacacugcucu

SEQ ID NO: 2747218 - RNA, 14 nt, Human
caggguccuuuuga

SEQ ID NO: 2747219 - RNA, 19 nt, Human
caggguccuuuugacacug

SEQ ID NO: 2747220 - RNA, 21 nt, Human
caggguccuuuugacacugcu

SEQ ID NO: 2747221 - RNA, 13 nt, Human
caguccaugaaga

SEQ ID NO: 2747222 - RNA, 18 nt, Human
cagucaggaaagagaacu

SEQ ID NO: 2747223 - RNA, 15 nt, Human
cagucaggaaagaga

SEQ ID NO: 2747224 - RNA, 22 nt, Human
cagucaggaaagagaacuucca

SEQ ID NO: 2747225 - RNA, 12 nt, Human
caguagugauag

SEQ ID NO: 2747226 - RNA, 12 nt, Human
caguauggcagc

SEQ ID NO: 2747227 - RNA, 15 nt, Human
cagugagacagcucu

SEQ ID NO: 2747228 - RNA, 16 nt, Human
cagugaaagaaaauaa

SEQ ID NO: 2747229 - RNA, 20 nt, Human
cagugaaagaaaauaacaau

SEQ ID NO: 2747230 - RNA, 17 nt, Human
cagugauuaccagggac

SEQ ID NO: 2747231 - RNA, 18 nt, Human
cagugauuaccagggacu

SEQ ID NO: 2747232 - RNA, 17 nt, Human
caggagaggggcagaac

SEQ ID NO: 2747233 - RNA, 15 nt, Human
caggagaggggcaga

SEQ ID NO: 2747234 - RNA, 15 nt, Human
caggagucccuggua

SEQ ID NO: 2747235 - RNA, 14 nt, Human
caggagucccuggu

SEQ ID NO: 2747236 - RNA, 13 nt, Human
caggagucccugg

SEQ ID NO: 2747237 - RNA, 13 nt, Human
caggaguuuggcc

SEQ ID NO: 2747238 - RNA, 14 nt, Human
caggaguuuggcca

SEQ ID NO: 2747239 - RNA, 17 nt, Human
caggaguuuggccagaa

SEQ ID NO: 2747240 - RNA, 15 nt, Human
caggaguuuggccag

SEQ ID NO: 2747241 - RNA, 16 nt, Human
caggaguuuggccaga

SEQ ID NO: 2747242 - RNA, 23 nt, Human
caggaugguucccuugaugaaga

SEQ ID NO: 2747243 - RNA, 21 nt, Human
caggaugguucccuugaugaa

SEQ ID NO: 2747244 - RNA, 22 nt, Human
caggcaacugaggcagacagca

SEQ ID NO: 2747245 - RNA, 20 nt, Human
caggcaacugaggcagacag

SEQ ID NO: 2747246 - RNA, 16 nt, Human
caggauuuuaaucuuu

SEQ ID NO: 2747247 - RNA, 19 nt, Human
caggcaacugaggcagaca

SEQ ID NO: 2747248 - RNA, 18 nt, Human
caggcaacugaggcagac

SEQ ID NO: 2747249 - RNA, 17 nt, Human
caggcaacugaggcaga

SEQ ID NO: 2747250 - RNA, 16 nt, Human
caggcaacugaggcag

SEQ ID NO: 2747251 - RNA, 15 nt, Human
caggcaacugaggca

SEQ ID NO: 2747252 - RNA, 20 nt, Human
caggcccccaggugccaguu

SEQ ID NO: 2747253 - RNA, 14 nt, Human
caggcccccaggug

SEQ ID NO: 2747254 - RNA, 19 nt, Human
caggcccccaggugccagu

SEQ ID NO: 2747255 - RNA, 18 nt, Human
cagggacaggauaagagg

SEQ ID NO: 2747256 - RNA, 22 nt, Human
cagggacccacuucacacacag

SEQ ID NO: 2747257 - RNA, 17 nt, Human
cagggcauggcugggaa

SEQ ID NO: 2747258 - RNA, 15 nt, Human
cagggccccagcacu

SEQ ID NO: 2747259 - RNA, 14 nt, Human
cagggccccagcac

SEQ ID NO: 2747260 - RNA, 22 nt, Human
cagggccccagcacuaaagcag

SEQ ID NO: 2747261 - RNA, 16 nt, Human
cagggccccagcacua

SEQ ID NO: 2747262 - RNA, 21 nt, Human
cagggcccugagcucggugga

SEQ ID NO: 2747263 - RNA, 15 nt, Human
cagggcccugagcuc

SEQ ID NO: 2747264 - RNA, 16 nt, Human
caggggacaggauggu

SEQ ID NO: 2747265 - RNA, 11 nt, Human
caggggacagg

SEQ ID NO: 2747266 - RNA, 14 nt, Human
caggcuacugucag

SEQ ID NO: 2747267 - RNA, 19 nt, Human
caggcuagauguauguacu

SEQ ID NO: 2747268 - RNA, 13 nt, Human
caggcuagaugua

SEQ ID NO: 2747269 - RNA, 21 nt, Human
cagccaacgaguaauuuauug

SEQ ID NO: 2747270 - RNA, 13 nt, Human
cagcagcucaggc

SEQ ID NO: 2747271 - RNA, 12 nt, Human
cagcagcucagg

SEQ ID NO: 2747272 - RNA, 16 nt, Human
cagcagcucaggcaca

SEQ ID NO: 2747273 - RNA, 15 nt, Human
cagcagcucaggcac

SEQ ID NO: 2747274 - RNA, 14 nt, Human
cagcagcucaggca

SEQ ID NO: 2747275 - RNA, 19 nt, Human
cagcagccagcucucagcc

SEQ ID NO: 2747276 - RNA, 18 nt, Human
cagcagccagcucucagc

SEQ ID NO: 2747277 - RNA, 17 nt, Human
cagcagccagcucucag

SEQ ID NO: 2747278 - RNA, 15 nt, Human
cagcagccagcucuc

SEQ ID NO: 2747279 - RNA, 14 nt, Human
cagcagccagcucu

SEQ ID NO: 2747280 - RNA, 13 nt, Human
cagcagccagcuc

SEQ ID NO: 2747281 - RNA, 21 nt, Human
cagcagccagcucucagccaa

SEQ ID NO: 2747282 - RNA, 20 nt, Human
cagcagccagcucucagcca

SEQ ID NO: 2747283 - RNA, 19 nt, Human
cagcaagggugaugggaaa

SEQ ID NO: 2747284 - RNA, 22 nt, Human
cagcaagggugaugggaaagca

SEQ ID NO: 2747285 - RNA, 23 nt, Human
cagcaagggugaugggaaagcau

SEQ ID NO: 2747286 - RNA, 15 nt, Human
cagauucauuuuucu

SEQ ID NO: 2747287 - RNA, 19 nt, Human
cagauggaaaauucauuuu

SEQ ID NO: 2747288 - RNA, 21 nt, Human
cagauggaaaauucauuuuuu

SEQ ID NO: 2747289 - RNA, 23 nt, Human
cagauuuuguuggcauagcucug

SEQ ID NO: 2747290 - RNA, 15 nt, Human
cagauuuuccugaaa

SEQ ID NO: 2747291 - RNA, 14 nt, Human
cagauuuuccugaa

SEQ ID NO: 2747292 - RNA, 23 nt, Human
cagcaacgcaggcccccaggugc

SEQ ID NO: 2747293 - RNA, 23 nt, Human
cagccuggugggccuccucuguc

SEQ ID NO: 2747294 - RNA, 16 nt, Human
cagccugugcugcccg

SEQ ID NO: 2747295 - RNA, 14 nt, Human
cagccugugcugcc

SEQ ID NO: 2747296 - RNA, 18 nt, Human
cagccuggugggccuccu

SEQ ID NO: 2747297 - RNA, 17 nt, Human
cagccuggugggccucc

SEQ ID NO: 2747298 - RNA, 16 nt, Human
cagccuggugggccuc

SEQ ID NO: 2747299 - RNA, 15 nt, Human
cagccuggugggccu

SEQ ID NO: 2747300 - RNA, 21 nt, Human
cagccuuccccuugcccaggg

SEQ ID NO: 2747301 - RNA, 16 nt, Human
cagccuuccccuugcc

SEQ ID NO: 2747302 - RNA, 23 nt, Human
cagccuuccccuugcccagggcu

SEQ ID NO: 2747303 - RNA, 19 nt, Human
cagcuacuugggaggcuga

SEQ ID NO: 2747304 - RNA, 17 nt, Human
cagcccuccucugcacu

SEQ ID NO: 2747305 - RNA, 18 nt, Human
cagcccuccucugcacuc

SEQ ID NO: 2747306 - RNA, 15 nt, Human
cagccuagccgaccu

SEQ ID NO: 2747307 - RNA, 18 nt, Human
cagccuagccgaccucag

SEQ ID NO: 2747308 - RNA, 17 nt, Human
cagccuagccgaccuca

SEQ ID NO: 2747309 - RNA, 22 nt, Human
cagccuagccgaccucagccuu

SEQ ID NO: 2747310 - RNA, 21 nt, Human
cagccuagccgaccucagccu

SEQ ID NO: 2747311 - RNA, 20 nt, Human
cagccuagccgaccucagcc

SEQ ID NO: 2747312 - RNA, 19 nt, Human
cagccuagccgaccucagc

SEQ ID NO: 2747313 - RNA, 16 nt, Human
cagccuaguugaucag

SEQ ID NO: 2747314 - RNA, 13 nt, Human
cagcccucagaau

SEQ ID NO: 2747315 - RNA, 21 nt, Human
cagcucaggcacacuucuucu

SEQ ID NO: 2747316 - RNA, 12 nt, Human
cagcucaggcac

SEQ ID NO: 2747317 - RNA, 23 nt, Human
cagcucaggcacacuucuucuug

SEQ ID NO: 2747318 - RNA, 20 nt, Human
cagcucugcauacucauuag

SEQ ID NO: 2747319 - RNA, 16 nt, Human
cagcucuccccuucuc

SEQ ID NO: 2747320 - RNA, 12 nt, Human
cagcucucagcc

SEQ ID NO: 2747321 - RNA, 13 nt, Human
cagcucucagcca

SEQ ID NO: 2747322 - RNA, 13 nt, Human
cagcugacuaaac

SEQ ID NO: 2747323 - RNA, 18 nt, Human
cagcugacuaaacuuuuu

SEQ ID NO: 2747324 - RNA, 20 nt, Human
cagcugcugaaacaacaaau

SEQ ID NO: 2747325 - RNA, 21 nt, Human
cagcugcugaaacaacaaaua

SEQ ID NO: 2747326 - RNA, 18 nt, Human
cagcuguaugauucccag

SEQ ID NO: 2747327 - RNA, 18 nt, Human
caggaaccacaagacugc

SEQ ID NO: 2747328 - RNA, 23 nt, Human
cagcuuuccucaaaacuucagac

SEQ ID NO: 2747329 - RNA, 18 nt, Human
cagcuugaaacugagaug

SEQ ID NO: 2747330 - RNA, 22 nt, Human
caggaagcugugagagcaguuu

SEQ ID NO: 2747331 - RNA, 13 nt, Human
caggaagcuguga

SEQ ID NO: 2747332 - RNA, 14 nt, Human
caggaagcugugag

SEQ ID NO: 2747333 - RNA, 13 nt, Human
caggaccugacua

SEQ ID NO: 2747334 - RNA, 15 nt, Human
caggaaguagaggag

SEQ ID NO: 2747335 - RNA, 16 nt, Human
caggaaguagaggagg

SEQ ID NO: 2747336 - RNA, 17 nt, Human
cagaugcacaugagcug

SEQ ID NO: 2747337 - RNA, 13 nt, Human
cagauccuggaaa

SEQ ID NO: 2747338 - RNA, 14 nt, Human
cagauccuggaaau

SEQ ID NO: 2747339 - RNA, 12 nt, Human
cagaguuacagu

SEQ ID NO: 2747340 - RNA, 13 nt, Human
cagaguuacaguu

SEQ ID NO: 2747341 - RNA, 18 nt, Human
cagaguuacaguucugug

SEQ ID NO: 2747342 - RNA, 19 nt, Human
cagaguuacaguucugugg

SEQ ID NO: 2747343 - RNA, 14 nt, Human
cagaguuacaguuc

SEQ ID NO: 2747344 - RNA, 15 nt, Human
cagaguuacaguucu

SEQ ID NO: 2747345 - RNA, 16 nt, Human
cagaguuacaguucug

SEQ ID NO: 2747346 - RNA, 17 nt, Human
cagaguuacaguucugu

SEQ ID NO: 2747347 - RNA, 23 nt, Human
cagauaaauaguuuaugauucca

SEQ ID NO: 2747348 - RNA, 14 nt, Human
cagauaaacaguag

SEQ ID NO: 2747349 - RNA, 14 nt, Human
cagauaaucacaau

SEQ ID NO: 2747350 - RNA, 19 nt, Human
cagagacucagggccccag

SEQ ID NO: 2747351 - RNA, 23 nt, Human
cagagacucagggccccagcacu

SEQ ID NO: 2747352 - RNA, 22 nt, Human
cagagacucagggccccagcac

SEQ ID NO: 2747353 - RNA, 21 nt, Human
cagagacucagggccccagca

SEQ ID NO: 2747354 - RNA, 20 nt, Human
cagagacucagggccccagc

SEQ ID NO: 2747355 - RNA, 20 nt, Human
cagaggagccaccaguucuc

SEQ ID NO: 2747356 - RNA, 18 nt, Human
cagaggagccaccaguuc

SEQ ID NO: 2747357 - RNA, 19 nt, Human
cagaggagccaccaguucu

SEQ ID NO: 2747358 - RNA, 20 nt, Human
cagagccccacccucagaug

SEQ ID NO: 2747359 - RNA, 19 nt, Human
cagaaagcagaacagugau

SEQ ID NO: 2747360 - RNA, 23 nt, Human
cagaacagugauuaccagggacu

SEQ ID NO: 2747361 - RNA, 18 nt, Human
cagaaagcagaacaguga

SEQ ID NO: 2747362 - RNA, 21 nt, Human
cagaaucgcuccaccuugcag

SEQ ID NO: 2747363 - RNA, 23 nt, Human
cagaaucgcuccaccuugcagcu

SEQ ID NO: 2747364 - RNA, 14 nt, Human
cagaagucaucuug

SEQ ID NO: 2747365 - RNA, 18 nt, Human
cagaagucaaggcuuaga

SEQ ID NO: 2747366 - RNA, 16 nt, Human
cagaagucaucuugcu

SEQ ID NO: 2747367 - RNA, 17 nt, Human
cagaagucaucuugcua

SEQ ID NO: 2747368 - RNA, 20 nt, Human
cagaagucaucuugcuacca

SEQ ID NO: 2747369 - RNA, 22 nt, Human
cagaagucaucuugcuaccagu

SEQ ID NO: 2747370 - RNA, 16 nt, Human
cagaagucaaggcuua

SEQ ID NO: 2747371 - RNA, 17 nt, Human
cagaagucaaggcuuag

SEQ ID NO: 2747372 - RNA, 20 nt, Human
cagaagcaacccaaauguuc

SEQ ID NO: 2747373 - RNA, 19 nt, Human
cagaagcaacccaaauguu

SEQ ID NO: 2747374 - RNA, 20 nt, Human
cagacuagauguaguauuuu

SEQ ID NO: 2747375 - RNA, 21 nt, Human
cagacuagauguaguauuuuu

SEQ ID NO: 2747376 - RNA, 14 nt, Human
cagacuagauguag

SEQ ID NO: 2747377 - RNA, 15 nt, Human
cagacuagauguagu

SEQ ID NO: 2747378 - RNA, 19 nt, Human
cagacuagauguaguauuu

SEQ ID NO: 2747379 - RNA, 14 nt, Human
cagaauucugcuac

SEQ ID NO: 2747380 - RNA, 13 nt, Human
cagaauucugcua

SEQ ID NO: 2747381 - RNA, 23 nt, Human
cagaauucugcuaccucacuggg

SEQ ID NO: 2747382 - RNA, 21 nt, Human
cagaauucugcuaccucacug

SEQ ID NO: 2747383 - RNA, 19 nt, Human
cagacauagaauuaacaca

SEQ ID NO: 2747384 - RNA, 17 nt, Human
cagacauagaauuaaca

SEQ ID NO: 2747385 - RNA, 22 nt, Human
cagacauguggugggacaggga

SEQ ID NO: 2747386 - RNA, 18 nt, Human
cagacauguggugggaca

SEQ ID NO: 2747387 - RNA, 15 nt, Human
caccccuccccugcc

SEQ ID NO: 2747388 - RNA, 22 nt, Human
caccccuccccugcccuagagc

SEQ ID NO: 2747389 - RNA, 20 nt, Human
cacccucagaugcacaugag

SEQ ID NO: 2747390 - RNA, 20 nt, Human
caccugacacaccaggcgcu

SEQ ID NO: 2747391 - RNA, 16 nt, Human
caccugacacaccagg

SEQ ID NO: 2747392 - RNA, 17 nt, Human
caccugacacaccaggc

SEQ ID NO: 2747393 - RNA, 14 nt, Human
caccucauggaauu

SEQ ID NO: 2747394 - RNA, 12 nt, Human
caccucauggaa

SEQ ID NO: 2747395 - RNA, 11 nt, Human
caccucaugga

SEQ ID NO: 2747396 - RNA, 10 nt, Human
caccucccug

SEQ ID NO: 2747397 - RNA, 14 nt, Human
caccucccugcaau

SEQ ID NO: 2747398 - RNA, 13 nt, Human
caccucccugcaa

SEQ ID NO: 2747399 - RNA, 18 nt, Human
cacucagucucucuucuc

SEQ ID NO: 2747400 - RNA, 19 nt, Human
cacuaguauuucuaugaaa

SEQ ID NO: 2747401 - RNA, 14 nt, Human
cacuaguauuucua

SEQ ID NO: 2747402 - RNA, 17 nt, Human
cacuaagagagaaugag

SEQ ID NO: 2747403 - RNA, 21 nt, Human
cacuaaauugacacuuaaaaa

SEQ ID NO: 2747404 - RNA, 13 nt, Human
cacuaaagcagug

SEQ ID NO: 2747405 - RNA, 16 nt, Human
cacucaaaucaagaaa

SEQ ID NO: 2747406 - RNA, 15 nt, Human
cacgcacacugucug

SEQ ID NO: 2747407 - RNA, 22 nt, Human
cacgagcaggcuacugucagcu

SEQ ID NO: 2747408 - RNA, 17 nt, Human
cacgagcaggcuacugu

SEQ ID NO: 2747409 - RNA, 19 nt, Human
cacgagcaggcuacuguca

SEQ ID NO: 2747410 - RNA, 20 nt, Human
cacgagcaggcuacugucag

SEQ ID NO: 2747411 - RNA, 13 nt, Human
cacuaaacaaaga

SEQ ID NO: 2747412 - RNA, 22 nt, Human
cacguucuuacuaguuucccuu

SEQ ID NO: 2747413 - RNA, 19 nt, Human
cacugcucuaacagcccuc

SEQ ID NO: 2747414 - RNA, 15 nt, Human
cacugcucuaacagc

SEQ ID NO: 2747415 - RNA, 18 nt, Human
cacugcucuaacagcccu

SEQ ID NO: 2747416 - RNA, 20 nt, Human
cacugccuucucaacuccaa

SEQ ID NO: 2747417 - RNA, 21 nt, Human
cacugacuucuaaguaaaacc

SEQ ID NO: 2747418 - RNA, 14 nt, Human
cacugacuucuaag

SEQ ID NO: 2747419 - RNA, 15 nt, Human
cacugacuucuaagu

SEQ ID NO: 2747420 - RNA, 16 nt, Human
cacugacuucuaagua

SEQ ID NO: 2747421 - RNA, 20 nt, Human
cacugacuucuaaguaaaac

SEQ ID NO: 2747422 - RNA, 14 nt, Human
cacugucaagauga

SEQ ID NO: 2747423 - RNA, 21 nt, Human
cacuguagcauuacagugggu

SEQ ID NO: 2747424 - RNA, 14 nt, Human
cacuguauccaggu

SEQ ID NO: 2747425 - RNA, 24 nt, Human
cacuguggguagacacacaugaag

SEQ ID NO: 2747426 - RNA, 22 nt, Human
cacuguggguagacacacauga

SEQ ID NO: 2747427 - RNA, 19 nt, Human
cacuguggguagacacaca

SEQ ID NO: 2747428 - RNA, 19 nt, Human
cacuucagggcuuuacucc

SEQ ID NO: 2747429 - RNA, 18 nt, Human
cacuucacacacaggcaa

SEQ ID NO: 2747430 - RNA, 15 nt, Human
cacuuggucugugag

SEQ ID NO: 2747431 - RNA, 12 nt, Human
cacuuggagcca

SEQ ID NO: 2747432 - RNA, 23 nt, Human
cacuugaacccgggaggcagagg

SEQ ID NO: 2747433 - RNA, 21 nt, Human
cacuugaacccgggaggcaga

SEQ ID NO: 2747434 - RNA, 20 nt, Human
cacuugaacccgggaggcag

SEQ ID NO: 2747435 - RNA, 23 nt, Human
cacuucuucuuggucuuauuuau

SEQ ID NO: 2747436 - RNA, 22 nt, Human
agccaaggguucagagacucag

SEQ ID NO: 2747437 - RNA, 18 nt, Human
agccaaggguucagagac

SEQ ID NO: 2747438 - RNA, 20 nt, Human
agccaacuaugauuauuaac

SEQ ID NO: 2747439 - RNA, 17 nt, Human
agccaacuaugauuauu

SEQ ID NO: 2747440 - RNA, 13 nt, Human
agcaucuggcucu

SEQ ID NO: 2747441 - RNA, 16 nt, Human
agcaucuggcucuaau

SEQ ID NO: 2747442 - RNA, 18 nt, Human
agcaucuggcucuaauuc

SEQ ID NO: 2747443 - RNA, 14 nt, Human
agccagcaguucag

SEQ ID NO: 2747444 - RNA, 21 nt, Human
agcagcucaggcacacuucuu

SEQ ID NO: 2747445 - RNA, 19 nt, Human
agcaguggacaccaggagu

SEQ ID NO: 2747446 - RNA, 15 nt, Human
agcaguggacaccag

SEQ ID NO: 2747447 - RNA, 12 nt, Human
agcaguggacac

SEQ ID NO: 2747448 - RNA, 14 nt, Human
agcagcucaggcac

SEQ ID NO: 2747449 - RNA, 13 nt, Human
agcagcucaggca

SEQ ID NO: 2747450 - RNA, 12 nt, Human
agcagcucaggc

SEQ ID NO: 2747451 - RNA, 17 nt, Human
agcacugacuucuaagu

SEQ ID NO: 2747452 - RNA, 19 nt, Human
agcacugacuucuaaguaa

SEQ ID NO: 2747453 - RNA, 20 nt, Human
agauagauaggucagugcaa

SEQ ID NO: 2747454 - RNA, 23 nt, Human
agcaaaauuuuuucucuaggaaa

SEQ ID NO: 2747455 - RNA, 18 nt, Human
agaagucaaggcuuagac

SEQ ID NO: 2747456 - RNA, 19 nt, Human
agaagucaaggcuuagacc

SEQ ID NO: 2747457 - RNA, 16 nt, Human
agaagucaaggcuuag

SEQ ID NO: 2747458 - RNA, 17 nt, Human
agaagucaaggcuuaga

SEQ ID NO: 2747459 - RNA, 21 nt, Human
agaagacugcauuauauuuau

SEQ ID NO: 2747460 - RNA, 20 nt, Human
agaagagcuguucacagcca

SEQ ID NO: 2747461 - RNA, 13 nt, Human
agaagauagcagg

SEQ ID NO: 2747462 - RNA, 13 nt, Human
agaagagcuguuc

SEQ ID NO: 2747463 - RNA, 22 nt, Human
agaacagugauuaccagggacu

SEQ ID NO: 2747464 - RNA, 20 nt, Human
agaacagccgcuccugucug

SEQ ID NO: 2747465 - RNA, 19 nt, Human
agaacagccgcuccugucu

SEQ ID NO: 2747466 - RNA, 18 nt, Human
agaacagccgcuccuguc

SEQ ID NO: 2747467 - RNA, 23 nt, Human
agaacagccgcuccugucugcca

SEQ ID NO: 2747468 - RNA, 22 nt, Human
agaacagccgcuccugucugcc

SEQ ID NO: 2747469 - RNA, 13 nt, Human
agagaaacaguug

SEQ ID NO: 2747470 - RNA, 16 nt, Human
agagaaacaguuggua

SEQ ID NO: 2747471 - RNA, 12 nt, Human
agacuagaugua

SEQ ID NO: 2747472 - RNA, 13 nt, Human
agacuagauguag

SEQ ID NO: 2747473 - RNA, 14 nt, Human
agacuagauguagu

SEQ ID NO: 2747474 - RNA, 23 nt, Human
agacuagauguaguauuuuuugu

SEQ ID NO: 2747475 - RNA, 16 nt, Human
agacuagauguaguau

SEQ ID NO: 2747476 - RNA, 19 nt, Human
agacuagauguaguauuuu

SEQ ID NO: 2747477 - RNA, 19 nt, Human
agacaaggaaaaaauaaca

SEQ ID NO: 2747478 - RNA, 18 nt, Human
aggaaaaaauaacaauga

SEQ ID NO: 2747479 - RNA, 18 nt, Human
agcuguaugauucccagc

SEQ ID NO: 2747480 - RNA, 17 nt, Human
agcuguaugauucccag

SEQ ID NO: 2747481 - RNA, 23 nt, Human
agcugacuaaacuuuuuuucugu

SEQ ID NO: 2747482 - RNA, 14 nt, Human
agcuguaugauucc

SEQ ID NO: 2747483 - RNA, 14 nt, Human
agcugcugaaacaa

SEQ ID NO: 2747484 - RNA, 15 nt, Human
agcugcugaaacaac

SEQ ID NO: 2747485 - RNA, 16 nt, Human
agcugcugaaacaaca

SEQ ID NO: 2747486 - RNA, 20 nt, Human
agcugcugaaacaacaaaua

SEQ ID NO: 2747487 - RNA, 15 nt, Human
agcgacagugagacu

SEQ ID NO: 2747488 - RNA, 13 nt, Human
agcgacagugaga

SEQ ID NO: 2747489 - RNA, 12 nt, Human
agcuacaaaugc

SEQ ID NO: 2747490 - RNA, 13 nt, Human
agcuacaaaugca

SEQ ID NO: 2747491 - RNA, 18 nt, Human
aggaggguuagggagggg

SEQ ID NO: 2747492 - RNA, 20 nt, Human
aggcagagguugcagugagc

SEQ ID NO: 2747493 - RNA, 23 nt, Human
aggccaugggcacuguggguaga

SEQ ID NO: 2747494 - RNA, 17 nt, Human
agggacaggauaagagg

SEQ ID NO: 2747495 - RNA, 12 nt, Human
aggcuuagaccc

SEQ ID NO: 2747496 - RNA, 23 nt, Human
aggcuuagacccucaugcugcca

SEQ ID NO: 2747497 - RNA, 22 nt, Human
aggcuuagacccucaugcugcc

SEQ ID NO: 2747498 - RNA, 14 nt, Human
aggcuuagacccuc

SEQ ID NO: 2747499 - RNA, 21 nt, Human
aggcuuagacccucaugcugc

SEQ ID NO: 2747500 - RNA, 20 nt, Human
agggauuagggagagaagau

SEQ ID NO: 2747501 - RNA, 20 nt, Human
augggacauuugcucaugga

SEQ ID NO: 2747502 - RNA, 15 nt, Human
augggacagggagga

SEQ ID NO: 2747503 - RNA, 14 nt, Human
augggaaagcauug

SEQ ID NO: 2747504 - RNA, 20 nt, Human
augggaaagcauuguaaaug

SEQ ID NO: 2747505 - RNA, 23 nt, Human
auggcuuccuggcaauagucaaa

SEQ ID NO: 2747506 - RNA, 14 nt, Human
aucaaacugaagcc

SEQ ID NO: 2747507 - RNA, 16 nt, Human
aucaaacugaagccag

SEQ ID NO: 2747508 - RNA, 15 nt, Human
aucaaacugaagcca

SEQ ID NO: 2747509 - RNA, 17 nt, Human
aucaaacugaagccaga

SEQ ID NO: 2747510 - RNA, 14 nt, Human
aucaaaagaaagaa

SEQ ID NO: 2747511 - RNA, 12 nt, Human
auccuugaagau

SEQ ID NO: 2747512 - RNA, 21 nt, Human
aucaugaauuaguuuuauaug

SEQ ID NO: 2747513 - RNA, 13 nt, Human
agucauuuaauaa

SEQ ID NO: 2747514 - RNA, 19 nt, Human
agugaugucacuagggcag

SEQ ID NO: 2747515 - RNA, 13 nt, Human
agugauuaccagg

SEQ ID NO: 2747516 - RNA, 13 nt, Human
aguacucauacau

SEQ ID NO: 2747517 - RNA, 20 nt, Human
auacacacucaaaucaagaa

SEQ ID NO: 2747518 - RNA, 16 nt, Human
auaaguacuguguaca

SEQ ID NO: 2747519 - RNA, 13 nt, Human
auaaguacugugu

SEQ ID NO: 2747520 - RNA, 15 nt, Human
aguuaauuuuuccaa

SEQ ID NO: 2747521 - RNA, 17 nt, Human
aguuaauuuuuccaacu

SEQ ID NO: 2747522 - RNA, 23 nt, Human
aguuaauuuuuccaacuacuaau

SEQ ID NO: 2747523 - RNA, 16 nt, Human
auaaaagacagugaaa

SEQ ID NO: 2747524 - RNA, 15 nt, Human
auaaaagacagugaa

SEQ ID NO: 2747525 - RNA, 19 nt, Human
acugauaugggucuugaua

SEQ ID NO: 2747526 - RNA, 13 nt, Human
acugacacaugcu

SEQ ID NO: 2747527 - RNA, 19 nt, Human
acucguuaauuuguagugu

SEQ ID NO: 2747528 - RNA, 14 nt, Human
acucguuaauuugu

SEQ ID NO: 2747529 - RNA, 16 nt, Human
acucccaccugacaca

SEQ ID NO: 2747530 - RNA, 14 nt, Human
acucccaccugaca

SEQ ID NO: 2747531 - RNA, 14 nt, Human
acucccuuucaaca

SEQ ID NO: 2747532 - RNA, 19 nt, Human
acuccguaacagauuuugu

SEQ ID NO: 2747533 - RNA, 20 nt, Human
acuucuugcuucuuucuaga

SEQ ID NO: 2747534 - RNA, 11 nt, Human
acuucuugcuu

SEQ ID NO: 2747535 - RNA, 18 nt, Human
acuucuugcuucuuucua

SEQ ID NO: 2747536 - RNA, 19 nt, Human
acuucuugcuucuuucuag

SEQ ID NO: 2747537 - RNA, 21 nt, Human
acuucagacauagaauuaaca

SEQ ID NO: 2747538 - RNA, 17 nt, Human
acuucaaauccuugaag

SEQ ID NO: 2747539 - RNA, 18 nt, Human
acuucaaauccuugaaga

SEQ ID NO: 2747540 - RNA, 22 nt, Human
acuuaaaaaugguuuaaauggu

SEQ ID NO: 2747541 - RNA, 21 nt, Human
acuuaaaaaugguuuaaaugg

SEQ ID NO: 2747542 - RNA, 17 nt, Human
acuguaaaauaauaacu

SEQ ID NO: 2747543 - RNA, 11 nt, Human
accucagccug

SEQ ID NO: 2747544 - RNA, 20 nt, Human
accucagccuuccccuugcc

SEQ ID NO: 2747545 - RNA, 19 nt, Human
accucagccugugcugccc

SEQ ID NO: 2747546 - RNA, 18 nt, Human
accucagccugugcugcc

SEQ ID NO: 2747547 - RNA, 17 nt, Human
accucagccugugcugc

SEQ ID NO: 2747548 - RNA, 16 nt, Human
accucagccugugcug

SEQ ID NO: 2747549 - RNA, 12 nt, Human
accucagccugu

SEQ ID NO: 2747550 - RNA, 21 nt, Human
acccugucucuacuaaaaaua

SEQ ID NO: 2747551 - RNA, 14 nt, Human
acccucaugcugcc

SEQ ID NO: 2747552 - RNA, 16 nt, Human
acccucaugcugccaa

SEQ ID NO: 2747553 - RNA, 22 nt, Human
acccucaugcugccaauauccu

SEQ ID NO: 2747554 - RNA, 20 nt, Human
acccucagaugcacaugagc

SEQ ID NO: 2747555 - RNA, 22 nt, Human
accuugcugcaagcacagcccu

SEQ ID NO: 2747556 - RNA, 23 nt, Human
accuugcugcaagcacagcccuu

SEQ ID NO: 2747557 - RNA, 20 nt, Human
accucugccucagaaaacaa

SEQ ID NO: 2747558 - RNA, 14 nt, Human
acgcacacugucug

SEQ ID NO: 2747559 - RNA, 23 nt, Human
acauguggugggacagggaccca

SEQ ID NO: 2747560 - RNA, 15 nt, Human
acauguggugggaca

SEQ ID NO: 2747561 - RNA, 21 nt, Human
acauuuguauaaaauaauuuu

SEQ ID NO: 2747562 - RNA, 19 nt, Human
acauuuguauaaaauaauu

SEQ ID NO: 2747563 - RNA, 16 nt, Human
acauuuguauaaaaua

SEQ ID NO: 2747564 - RNA, 15 nt, Human
acauuugcucaugga

SEQ ID NO: 2747565 - RNA, 19 nt, Human
acagugauuaccagggacu

SEQ ID NO: 2747566 - RNA, 21 nt, Human
acagugcucuuuucuccucac

SEQ ID NO: 2747567 - RNA, 15 nt, Human
acagugcucuuuucu

SEQ ID NO: 2747568 - RNA, 16 nt, Human
acagugcucuuuucuc

SEQ ID NO: 2747569 - RNA, 17 nt, Human
acagugcucuuuucucc

SEQ ID NO: 2747570 - RNA, 22 nt, Human
acaggaugguucccuugaugaa

SEQ ID NO: 2747571 - RNA, 24 nt, Human
acaggaugguucccuugaugaaga

SEQ ID NO: 2747572 - RNA, 15 nt, Human
acaccaauauucaua

SEQ ID NO: 2747573 - RNA, 22 nt, Human
aauuucauaccuaucaucuuaa

SEQ ID NO: 2747574 - RNA, 11 nt, Human
aauuguaauag

SEQ ID NO: 2747575 - RNA, 23 nt, Human
aauuccuuagcuuagaccucagc

SEQ ID NO: 2747576 - RNA, 13 nt, Human
aauuccuuagcuu

SEQ ID NO: 2747577 - RNA, 16 nt, Human
aauucugcuaccucac

SEQ ID NO: 2747578 - RNA, 15 nt, Human
aauucugcuaccuca

SEQ ID NO: 2747579 - RNA, 19 nt, Human
aauucugcuaccucacugg

SEQ ID NO: 2747580 - RNA, 17 nt, Human
aauuggauuuccuaaua

SEQ ID NO: 2747581 - RNA, 11 nt, Human
aauuggauuuc

SEQ ID NO: 2747582 - RNA, 15 nt, Human
aauuggauuuccuaa

SEQ ID NO: 2747583 - RNA, 15 nt, Human
aauuggagcucgugg

SEQ ID NO: 2747584 - RNA, 15 nt, Human
aaggcaguuuucuaa

SEQ ID NO: 2747585 - RNA, 20 nt, Human
aagagaaacaguugguaacu

SEQ ID NO: 2747586 - RNA, 22 nt, Human
aagacagagccccacccucaga

SEQ ID NO: 2747587 - RNA, 15 nt, Human
aagaacugaaaucau

SEQ ID NO: 2747588 - RNA, 11 nt, Human
aagaacugaaa

SEQ ID NO: 2747589 - RNA, 13 nt, Human
aagaacugaaauc

SEQ ID NO: 2747590 - RNA, 12 nt, Human
aagaacugaaau

SEQ ID NO: 2747591 - RNA, 20 nt, Human
aacgcaggcccccaggugcc

SEQ ID NO: 2747592 - RNA, 15 nt, Human
aagaagacugcauua

SEQ ID NO: 2747593 - RNA, 20 nt, Human
aagaagacugcauuauauuu

SEQ ID NO: 2747594 - RNA, 21 nt, Human
aagacaaggaaaaaauaacaa

SEQ ID NO: 2747595 - RNA, 16 nt, Human
aauauguuagcaaaga

SEQ ID NO: 2747596 - RNA, 16 nt, Human
aaucucaauauuucag

SEQ ID NO: 2747597 - RNA, 20 nt, Human
aaugaauacuuuauaaagga

SEQ ID NO: 2747598 - RNA, 21 nt, Human
aacagccgcuccugucugcca

SEQ ID NO: 2747599 - RNA, 20 nt, Human
aacagccgcuccugucugcc

SEQ ID NO: 2747600 - RNA, 17 nt, Human
aacagcccuccucugca

SEQ ID NO: 2747601 - RNA, 19 nt, Human
aacagcccuccucugcacu

SEQ ID NO: 2747602 - RNA, 23 nt, Human
aaauguugacaugggacauuugc

SEQ ID NO: 2747603 - RNA, 22 nt, Human
aaauguugacaugggacauuug

SEQ ID NO: 2747604 - RNA, 13 nt, Human
aaauguucaucaa

SEQ ID NO: 2747605 - RNA, 18 nt, Human
aaaucucaauauuucaga

SEQ ID NO: 2747606 - RNA, 21 nt, Human
aaauauuuauuuuaauaaugu

SEQ ID NO: 2747607 - RNA, 19 nt, Human
aaacccuugccaugugcua

SEQ ID NO: 2747608 - RNA, 15 nt, Human
aaacugcacugucaa

SEQ ID NO: 2747609 - RNA, 23 nt, Human
aaacuuuuuuucuguaccaguua

SEQ ID NO: 2747610 - RNA, 22 nt, Human
aaacuuuuuuucuguaccaguu

SEQ ID NO: 2747611 - RNA, 21 nt, Human
aaaaucauuucugcaucagcu

SEQ ID NO: 2747612 - RNA, 15 nt, Human
aaagcauuguaaaug

SEQ ID NO: 2747613 - RNA, 17 nt, Human
aaagcauuguaaaugug

SEQ ID NO: 2747614 - RNA, 11 nt, Human
aaaaucauuuc

SEQ ID NO: 2747615 - RNA, 12 nt, Human
aaaaucauuucu

SEQ ID NO: 2747616 - RNA, 10 nt, Human
aaaaucauuu

SEQ ID NO: 2747617 - RNA, 13 nt, Human
aaaagacuccaaa

SEQ ID NO: 2747618 - RNA, 11 nt, Human
aaaagaaugau

SEQ ID NO: 2747619 - RNA, 13 nt, Human
aaaagaauauuuu

SEQ ID NO: 2747620 - RNA, 20 nt, Human
aaaagacaaggaaaaaauaa

SEQ ID NO: 2747621 - RNA, 12 nt, Human
aaaagaauauuu

SEQ ID NO: 2747622 - RNA, 17 nt, Human
aaaagaaagaaaaucag

SEQ ID NO: 2747623 - RNA, 19 nt, Human
cugcaagguacucugguga

SEQ ID NO: 2747624 - RNA, 17 nt, Human
cugcaagguacucuggu

SEQ ID NO: 2747625 - RNA, 18 nt, Human
cugcaagguacucuggug

SEQ ID NO: 2747626 - RNA, 16 nt, Human
cugcaagguacucugg

SEQ ID NO: 2747627 - RNA, 14 nt, Human
cugcaagcacagcc

SEQ ID NO: 2747628 - RNA, 17 nt, Human
cugcaagcacagcccuu

SEQ ID NO: 2747629 - RNA, 16 nt, Human
cugcacuccagccuga

SEQ ID NO: 2747630 - RNA, 20 nt, Human
cugcacuccagccugagcga

SEQ ID NO: 2747631 - RNA, 17 nt, Human
cugcacuccagccugag

SEQ ID NO: 2747632 - RNA, 20 nt, Human
cuggggccucggagccucau

SEQ ID NO: 2747633 - RNA, 23 nt, Human
cuggggccucggagccucauccg

SEQ ID NO: 2747634 - RNA, 15 nt, Human
cugggcagcugccuc

SEQ ID NO: 2747635 - RNA, 14 nt, Human
cugggcagcugccu

SEQ ID NO: 2747636 - RNA, 13 nt, Human
cugggcagcugcc

SEQ ID NO: 2747637 - RNA, 12 nt, Human
cuggugccucac

SEQ ID NO: 2747638 - RNA, 21 nt, Human
cuggugccucaccccuugcca

SEQ ID NO: 2747639 - RNA, 15 nt, Human
cuggcucuaauucac

SEQ ID NO: 2747640 - RNA, 19 nt, Human
cuggcucuaauucacagug

SEQ ID NO: 2747641 - RNA, 23 nt, Human
cuggcucuaauucacagugcucu

SEQ ID NO: 2747642 - RNA, 20 nt, Human
cuggcucuaauucacagugc

SEQ ID NO: 2747643 - RNA, 22 nt, Human
cuggcucuaauucacagugcuc

SEQ ID NO: 2747644 - RNA, 20 nt, Human
cugcuuauccguuagccgug

SEQ ID NO: 2747645 - RNA, 18 nt, Human
cuggacuuaagcaucugg

SEQ ID NO: 2747646 - RNA, 22 nt, Human
cuggacuuaagcaucuggcucu

SEQ ID NO: 2747647 - RNA, 23 nt, Human
cuggacuuaagcaucuggcucua

SEQ ID NO: 2747648 - RNA, 21 nt, Human
cuuugagugucuuaauuaaaa

SEQ ID NO: 2747649 - RNA, 20 nt, Human
cuuuaaagggauggcaagau

SEQ ID NO: 2747650 - RNA, 20 nt, Human
cuucuguuuuauaauuuugu

SEQ ID NO: 2747651 - RNA, 15 nt, Human
cuucuguuuuauaau

SEQ ID NO: 2747652 - RNA, 14 nt, Human
cuuggcccaggagu

SEQ ID NO: 2747653 - RNA, 13 nt, Human
cuuggcccaggag

SEQ ID NO: 2747654 - RNA, 11 nt, Human
cuucagacaua

SEQ ID NO: 2747655 - RNA, 23 nt, Human
cuucaugcugucuacacuaagag

SEQ ID NO: 2747656 - RNA, 22 nt, Human
cugugcugcccgucuucagccu

SEQ ID NO: 2747657 - RNA, 20 nt, Human
cugugcugcccgucuucagc

SEQ ID NO: 2747658 - RNA, 21 nt, Human
cuguguacagaauucugcuac

SEQ ID NO: 2747659 - RNA, 18 nt, Human
cuguguaauuagugccac

SEQ ID NO: 2747660 - RNA, 16 nt, Human
gaguuuaaauuguaau

SEQ ID NO: 2747661 - RNA, 13 nt, Human
gaggcagggucag

SEQ ID NO: 2747662 - RNA, 15 nt, Human
gaggacgcucucugg

SEQ ID NO: 2747663 - RNA, 18 nt, Human
gaggcuccacuuggucug

SEQ ID NO: 2747664 - RNA, 19 nt, Human
gaggcuccacuuggucugu

SEQ ID NO: 2747665 - RNA, 23 nt, Human
gaggcuccacuuggucugugaga

SEQ ID NO: 2747666 - RNA, 16 nt, Human
gauuuaccacuugugu

SEQ ID NO: 2747667 - RNA, 15 nt, Human
gauuuaccacuugug

SEQ ID NO: 2747668 - RNA, 13 nt, Human
gauguaguauuuu

SEQ ID NO: 2747669 - RNA, 22 nt, Human
gaugguucccuugaugaagaag

SEQ ID NO: 2747670 - RNA, 18 nt, Human
gauguagaggagaaacug

SEQ ID NO: 2747671 - RNA, 17 nt, Human
gauguagaggagaaacu

SEQ ID NO: 2747672 - RNA, 16 nt, Human
gaugaucuuuaaaaua

SEQ ID NO: 2747673 - RNA, 23 nt, Human
gcacaguuuucugagaaagacua

SEQ ID NO: 2747674 - RNA, 20 nt, Human
gcacaguuuucugagaaaga

SEQ ID NO: 2747675 - RNA, 22 nt, Human
gcacaguuuucugagaaagacu

SEQ ID NO: 2747676 - RNA, 22 nt, Human
gcaauagucaaauugugugaaa

SEQ ID NO: 2747677 - RNA, 20 nt, Human
gcaaguauuagaauaccaca

SEQ ID NO: 2747678 - RNA, 13 nt, Human
gaacugaaaucau

SEQ ID NO: 2747679 - RNA, 14 nt, Human
gaacugaaaucaua

SEQ ID NO: 2747680 - RNA, 19 nt, Human
gaacccgggaggcagaggu

SEQ ID NO: 2747681 - RNA, 23 nt, Human
gaagcaacccaaauguucaucaa

SEQ ID NO: 2747682 - RNA, 14 nt, Human
gaagcaaaauuuuu

SEQ ID NO: 2747683 - RNA, 15 nt, Human
gaccugacuauugaa

SEQ ID NO: 2747684 - RNA, 15 nt, Human
gacgcucucuggccu

SEQ ID NO: 2747685 - RNA, 17 nt, Human
gacgcucucuggccuuc

SEQ ID NO: 2747686 - RNA, 16 nt, Human
gacgcucucuggccuu

SEQ ID NO: 2747687 - RNA, 12 nt, Human
gacuguggcugc

SEQ ID NO: 2747688 - RNA, 15 nt, Human
gacuguggcugcuag

SEQ ID NO: 2747689 - RNA, 14 nt, Human
gacuguggcugcua

SEQ ID NO: 2747690 - RNA, 21 nt, Human
gacucuuaagaagacugcauu

SEQ ID NO: 2747691 - RNA, 18 nt, Human
gacucuuaagaagacugc

SEQ ID NO: 2747692 - RNA, 14 nt, Human
gacucuuaagaaga

SEQ ID NO: 2747693 - RNA, 21 nt, Human
gacagugagacucugucucag

SEQ ID NO: 2747694 - RNA, 17 nt, Human
gacauuugcucauggaa

SEQ ID NO: 2747695 - RNA, 16 nt, Human
gacauuugcucaugga

SEQ ID NO: 2747696 - RNA, 14 nt, Human
gacacacugaagaa

SEQ ID NO: 2747697 - RNA, 16 nt, Human
gacacacugaagaagc

SEQ ID NO: 2747698 - RNA, 15 nt, Human
gacacacugaagaag

SEQ ID NO: 2747699 - RNA, 21 nt, Human
gacagaaagcagaacagugau

SEQ ID NO: 2747700 - RNA, 20 nt, Human
aaagaggcagcuugaaacug

SEQ ID NO: 2747701 - RNA, 19 nt, Human
aaagagaaacaguugguaa

SEQ ID NO: 2747702 - RNA, 22 nt, Human
aaagagaaacaguugguaacuu

SEQ ID NO: 2747703 - RNA, 18 nt, Human
aaagagaacuuccagauc

SEQ ID NO: 2747704 - RNA, 22 nt, Human
aaagacuauucaaacagucuca

SEQ ID NO: 2747705 - RNA, 13 nt, Human
aaagacuccaaag

SEQ ID NO: 2747706 - RNA, 23 nt, Human
aaagacuauucaaacagucucag

SEQ ID NO: 2747707 - RNA, 16 nt, Human
aaagaaugauuaugaa

SEQ ID NO: 2747708 - RNA, 15 nt, Human
aaacuuuuuuucugu

SEQ ID NO: 2747709 - RNA, 19 nt, Human
aaacuuuuuuucuguacca

SEQ ID NO: 2747710 - RNA, 13 nt, Human
aaagcuuauuaaa

SEQ ID NO: 2747711 - RNA, 13 nt, Human
aaaggaauuuaaa

SEQ ID NO: 2747712 - RNA, 15 nt, Human
ggugccaguuauggc

SEQ ID NO: 2747713 - RNA, 20 nt, Human
ggugauuuagcaggaagcug

SEQ ID NO: 2747714 - RNA, 24 nt, Human
ggucugugagaugcuagaacuccc

SEQ ID NO: 2747715 - RNA, 14 nt, Human
ggucugugagaugc

SEQ ID NO: 2747716 - RNA, 14 nt, Human
gggucaggagaggg

SEQ ID NO: 2747717 - RNA, 16 nt, Human
ggguaggcgggaagga

SEQ ID NO: 2747718 - RNA, 12 nt, Human
ggguaggcggga

SEQ ID NO: 2747719 - RNA, 16 nt, Human
aaaccacagcaguuga

SEQ ID NO: 2747720 - RNA, 15 nt, Human
aaaccacagcaguug

SEQ ID NO: 2747721 - RNA, 16 nt, Human
aaacucauuucuagca

SEQ ID NO: 2747722 - RNA, 19 nt, Human
aaaauuuuuucucuaggaa

SEQ ID NO: 2747723 - RNA, 17 nt, Human
aaacaaggaugaauuaa

SEQ ID NO: 2747724 - RNA, 14 nt, Human
aaacacaacuauau

SEQ ID NO: 2747725 - RNA, 22 nt, Human
aaacaguugguaacuuuuguga

SEQ ID NO: 2747726 - RNA, 16 nt, Human
aaacaguugguaacuu

SEQ ID NO: 2747727 - RNA, 18 nt, Human
aaacaguugguaacuuuu

SEQ ID NO: 2747728 - RNA, 19 nt, Human
aaacaguugguaacuuuug

SEQ ID NO: 2747729 - RNA, 13 nt, Human
aaacauauauaac

SEQ ID NO: 2747730 - RNA, 19 nt, Human
aaacauauauaacaaugcu

SEQ ID NO: 2747731 - RNA, 16 nt, Human
aaacauauauaacaau

SEQ ID NO: 2747732 - RNA, 21 nt, Human
aaacauauauaacaaugcugu

SEQ ID NO: 2747733 - RNA, 23 nt, Human
aaaauaauuuuuauauuugaaau

SEQ ID NO: 2747734 - RNA, 21 nt, Human
aaaauaauuuuuauauuugaa

SEQ ID NO: 2747735 - RNA, 20 nt, Human
aaaauaauuuuuauauuuga

SEQ ID NO: 2747736 - RNA, 17 nt, Human
aaaauaaauauaucuac

SEQ ID NO: 2747737 - RNA, 14 nt, Human
aaaauaaauauauc

SEQ ID NO: 2747738 - RNA, 21 nt, Human
gggauuuucagcccucagaau

SEQ ID NO: 2747739 - RNA, 17 nt, Human
gggauugaaggaugcug

SEQ ID NO: 2747740 - RNA, 23 nt, Human
gggcagcugccuccccuccucug

SEQ ID NO: 2747741 - RNA, 20 nt, Human
gggcagcugccuccccuccu

SEQ ID NO: 2747742 - RNA, 19 nt, Human
gggcagcugccuccccucc

SEQ ID NO: 2747743 - RNA, 14 nt, Human
gggcagcugccucc

SEQ ID NO: 2747744 - RNA, 13 nt, Human
gggcagcugccuc

SEQ ID NO: 2747745 - RNA, 12 nt, Human
gggcagcugccu

SEQ ID NO: 2747746 - RNA, 22 nt, Human
aaaaaugucuuggguaggcggg

SEQ ID NO: 2747747 - RNA, 20 nt, Human
gggaggcagagguugcagug

SEQ ID NO: 2747748 - RNA, 11 nt, Human
gggaggcagag

SEQ ID NO: 2747749 - RNA, 22 nt, Human
aaaagcuccauuuuuagugaaa

SEQ ID NO: 2747750 - RNA, 21 nt, Human
aaaacuuuaugcuaagugaaa

SEQ ID NO: 2747751 - RNA, 16 nt, Human
ggccuccauccugagg

SEQ ID NO: 2747752 - RNA, 22 nt, Human
ggcccaggaguuuggccagaag

SEQ ID NO: 2747753 - RNA, 23 nt, Human
ggcccaggaguuuggccagaagu

SEQ ID NO: 2747754 - RNA, 21 nt, Human
ggcccaggaguuuggccagaa

SEQ ID NO: 2747755 - RNA, 12 nt, Human
ggauuuucagcc

SEQ ID NO: 2747756 - RNA, 15 nt, Human
ggaugacaugucccu

SEQ ID NO: 2747757 - RNA, 20 nt, Human
ggaugacaugucccuacacc

SEQ ID NO: 2747758 - RNA, 16 nt, Human
ggaugacaugucccua

SEQ ID NO: 2747759 - RNA, 23 nt, Human
ggaugguucccuugaugaagaag

SEQ ID NO: 2747760 - RNA, 22 nt, Human
ggaugguucccuugaugaagaa

SEQ ID NO: 2747761 - RNA, 22 nt, Human
ggauguugaaaaaguucugcag

SEQ ID NO: 2747762 - RNA, 20 nt, Human
ggcagaacagccgcuccugu

SEQ ID NO: 2747763 - RNA, 18 nt, Human
ggcagaacagccgcuccu

SEQ ID NO: 2747764 - RNA, 14 nt, Human
ggcagaacagccgc

SEQ ID NO: 2747765 - RNA, 19 nt, Human
ggaggcugagaugggagaa

SEQ ID NO: 2747766 - RNA, 15 nt, Human
ggaggcugagauggg

SEQ ID NO: 2747767 - RNA, 23 nt, Human
ggacuuaagcaucuggcucuaau

SEQ ID NO: 2747768 - RNA, 20 nt, Human
gcugccuccccuccucugcu

SEQ ID NO: 2747769 - RNA, 17 nt, Human
gcugccuccccuccucu

SEQ ID NO: 2747770 - RNA, 16 nt, Human
gcugccuccccuccuc

SEQ ID NO: 2747771 - RNA, 22 nt, Human
gcugccuccccuccucugcuug

SEQ ID NO: 2747772 - RNA, 21 nt, Human
gcugccuccccuccucugcuu

SEQ ID NO: 2747773 - RNA, 17 nt, Human
gcuggagcucugcccau

SEQ ID NO: 2747774 - RNA, 14 nt, Human
gcuggagcucugcc

SEQ ID NO: 2747775 - RNA, 12 nt, Human
gcuucuuucuag

SEQ ID NO: 2747776 - RNA, 15 nt, Human
gcuucuuucuagaaa

SEQ ID NO: 2747777 - RNA, 21 nt, Human
gcuucuuucuagaaagagaaa

SEQ ID NO: 2747778 - RNA, 21 nt, Human
gcuguaacuacuuuauaacua

SEQ ID NO: 2747779 - RNA, 21 nt, Human
gcuaguaauuggaaaggcagc

SEQ ID NO: 2747780 - RNA, 16 nt, Human
gcuaguaucaaaagaa

SEQ ID NO: 2747781 - RNA, 15 nt, Human
gcuccccucggagaa

SEQ ID NO: 2747782 - RNA, 18 nt, Human
gcuccccucggagaagag

SEQ ID NO: 2747783 - RNA, 15 nt, Human
gcucuaauucacagu

SEQ ID NO: 2747784 - RNA, 16 nt, Human
gcucuaauucacagug

SEQ ID NO: 2747785 - RNA, 18 nt, Human
gcucuaauucacagugcu

SEQ ID NO: 2747786 - RNA, 19 nt, Human
gcucuaauucacagugcuc

SEQ ID NO: 2747787 - RNA, 23 nt, Human
gccagcagccagcucucagccaa

SEQ ID NO: 2747788 - RNA, 22 nt, Human
gccagcagccagcucucagcca

SEQ ID NO: 2747789 - RNA, 21 nt, Human
gccagcagccagcucucagcc

SEQ ID NO: 2747790 - RNA, 20 nt, Human
gccagcagccagcucucagc

SEQ ID NO: 2747791 - RNA, 19 nt, Human
gccagcagccagcucucag

SEQ ID NO: 2747792 - RNA, 18 nt, Human
gccagcagccagcucuca

SEQ ID NO: 2747793 - RNA, 17 nt, Human
gccagcagccagcucuc

SEQ ID NO: 2747794 - RNA, 16 nt, Human
gccagcagccagcucu

SEQ ID NO: 2747795 - RNA, 12 nt, Human
gccagcagccag

SEQ ID NO: 2747796 - RNA, 15 nt, Human
gccagcagccagcuc

SEQ ID NO: 2747797 - RNA, 13 nt, Human
gccagcagccagc

SEQ ID NO: 2747798 - RNA, 23 nt, Human
gccagcaguucagagcugcccuc

SEQ ID NO: 2747799 - RNA, 22 nt, Human
gccagcaguucagagcugcccu

SEQ ID NO: 2747800 - RNA, 19 nt, Human
gccagauuuuccugaaaac

SEQ ID NO: 2747801 - RNA, 22 nt, Human
gccagacaucaacagauaaaua

SEQ ID NO: 2747802 - RNA, 14 nt, Human
gccagacauguggu

SEQ ID NO: 2747803 - RNA, 23 nt, Human
gccagaagucaaggcuuagaccc

SEQ ID NO: 2747804 - RNA, 16 nt, Human
gccagaagucaaggcu

SEQ ID NO: 2747805 - RNA, 20 nt, Human
gccagaagucaaggcuuaga

SEQ ID NO: 2747806 - RNA, 22 nt, Human
gccagaagucaaggcuuagacc

SEQ ID NO: 2747807 - RNA, 14 nt, Human
gccagccagcagcc

SEQ ID NO: 2747808 - RNA, 13 nt, Human
gccagccagcagc

SEQ ID NO: 2747809 - RNA, 12 nt, Human
gccagccagcag

SEQ ID NO: 2747810 - RNA, 16 nt, Human
gccauaugaaaaggcu

SEQ ID NO: 2747811 - RNA, 12 nt, Human
gccagaaauaaa

SEQ ID NO: 2747812 - RNA, 18 nt, Human
gccacuuaauguauguua

SEQ ID NO: 2747813 - RNA, 19 nt, Human
gccacuuaauguauguuac

SEQ ID NO: 2747814 - RNA, 13 nt, Human
gccacuuaaugua

SEQ ID NO: 2747815 - RNA, 16 nt, Human
gccacuuaauguaugu

SEQ ID NO: 2747816 - RNA, 19 nt, Human
gccaccaguucucaugggu

SEQ ID NO: 2747817 - RNA, 11 nt, Human
gccaccaguuc

SEQ ID NO: 2747818 - RNA, 13 nt, Human
gccaccaguucuc

SEQ ID NO: 2747819 - RNA, 22 nt, Human
gcacuuggagccaaggguucag

SEQ ID NO: 2747820 - RNA, 16 nt, Human
gcacuuggagccaagg

SEQ ID NO: 2747821 - RNA, 13 nt, Human
gcacuuggagcca

SEQ ID NO: 2747822 - RNA, 16 nt, Human
gcccccaggugccagu

SEQ ID NO: 2747823 - RNA, 17 nt, Human
gcccuagagcacacugu

SEQ ID NO: 2747824 - RNA, 13 nt, Human
gcccuagagcaca

SEQ ID NO: 2747825 - RNA, 19 nt, Human
gcccuagagcacacuguag

SEQ ID NO: 2747826 - RNA, 23 nt, Human
gccgcuccugucugccagccagc

SEQ ID NO: 2747827 - RNA, 14 nt, Human
gcccuguuaaaaga

SEQ ID NO: 2747828 - RNA, 17 nt, Human
gcccuguuaaaagauga

SEQ ID NO: 2747829 - RNA, 13 nt, Human
gcccuguuaaaag

SEQ ID NO: 2747830 - RNA, 21 nt, Human
ccagcagccagcucucagcca

SEQ ID NO: 2747831 - RNA, 15 nt, Human
ccaggggccaugaau

SEQ ID NO: 2747832 - RNA, 18 nt, Human
ccaggaguuuggccagaa

SEQ ID NO: 2747833 - RNA, 14 nt, Human
ccaggaguuuggcc

SEQ ID NO: 2747834 - RNA, 15 nt, Human
ccaggaguuuggcca

SEQ ID NO: 2747835 - RNA, 16 nt, Human
ccaggaguuuggccag

SEQ ID NO: 2747836 - RNA, 17 nt, Human
ccaggaguuuggccaga

SEQ ID NO: 2747837 - RNA, 18 nt, Human
ccagacuagauguaguau

SEQ ID NO: 2747838 - RNA, 22 nt, Human
ccagacuagauguaguauuuuu

SEQ ID NO: 2747839 - RNA, 19 nt, Human
ccacuuggucugugagaug

SEQ ID NO: 2747840 - RNA, 17 nt, Human
ccacuuggucugugaga

SEQ ID NO: 2747841 - RNA, 16 nt, Human
ccacuuggucugugag

SEQ ID NO: 2747842 - RNA, 15 nt, Human
ccacuuggucuguga

SEQ ID NO: 2747843 - RNA, 22 nt, Human
ccacuuggucugugagaugcua

SEQ ID NO: 2747844 - RNA, 20 nt, Human
ccacuuggucugugagaugc

SEQ ID NO: 2747845 - RNA, 12 nt, Human
ccacuuggucug

SEQ ID NO: 2747846 - RNA, 13 nt, Human
ccauuuaaagcuu

SEQ ID NO: 2747847 - RNA, 22 nt, Human
ccauuguggucacaggaaguag

SEQ ID NO: 2747848 - RNA, 18 nt, Human
ccaugggcacugugggua

SEQ ID NO: 2747849 - RNA, 15 nt, Human
ccccauuguggucac

SEQ ID NO: 2747850 - RNA, 13 nt, Human
ccucaugcugcca

SEQ ID NO: 2747851 - RNA, 15 nt, Human
ccucaugcugccaau

SEQ ID NO: 2747852 - RNA, 23 nt, Human
ccucccagaggagccaccaguuc

SEQ ID NO: 2747853 - RNA, 20 nt, Human
ccucccagaggagccaccag

SEQ ID NO: 2747854 - RNA, 21 nt, Human
ccucccagaggagccaccagu

SEQ ID NO: 2747855 - RNA, 16 nt, Human
ccucaugcugccaaua

SEQ ID NO: 2747856 - RNA, 22 nt, Human
ccucuccugggcagcugccucc

SEQ ID NO: 2747857 - RNA, 21 nt, Human
ccucuccugggcagcugccuc

SEQ ID NO: 2747858 - RNA, 16 nt, Human
ccucuccugggcagcu

SEQ ID NO: 2747859 - RNA, 15 nt, Human
ccucuccugggcagc

SEQ ID NO: 2747860 - RNA, 14 nt, Human
ccucuccugggcag

SEQ ID NO: 2747861 - RNA, 20 nt, Human
ccucuccugggcagcugccu

SEQ ID NO: 2747862 - RNA, 19 nt, Human
ccucuccugggcagcugcc

SEQ ID NO: 2747863 - RNA, 18 nt, Human
ccucuccugggcagcugc

SEQ ID NO: 2747864 - RNA, 17 nt, Human
ccucuccugggcagcug

SEQ ID NO: 2747865 - RNA, 13 nt, Human
cccucggagaaga

SEQ ID NO: 2747866 - RNA, 22 nt, Human
cccugagcucgguggacccagg

SEQ ID NO: 2747867 - RNA, 14 nt, Human
cccugagcaggauu

SEQ ID NO: 2747868 - RNA, 12 nt, Human
cccugagcucgg

SEQ ID NO: 2747869 - RNA, 20 nt, Human
ccuagccgaccucagccuuc

SEQ ID NO: 2747870 - RNA, 19 nt, Human
ccuagccgaccucagccuu

SEQ ID NO: 2747871 - RNA, 18 nt, Human
ccuagccgaccucagccu

SEQ ID NO: 2747872 - RNA, 17 nt, Human
ccuagccgaccucagcc

SEQ ID NO: 2747873 - RNA, 16 nt, Human
ccuagccgaccucagc

SEQ ID NO: 2747874 - RNA, 15 nt, Human
ccuagccgaccucag

SEQ ID NO: 2747875 - RNA, 14 nt, Human
ccuagccgaccuca

SEQ ID NO: 2747876 - RNA, 20 nt, Human
ccuaacgaaguauccuucag

SEQ ID NO: 2747877 - RNA, 22 nt, Human
cucuguccagggcccugagcuc

SEQ ID NO: 2747878 - RNA, 18 nt, Human
cucgguggacccagggau

SEQ ID NO: 2747879 - RNA, 15 nt, Human
cucuccccaugaugu

SEQ ID NO: 2747880 - RNA, 16 nt, Human
cucuccccaugauguu

SEQ ID NO: 2747881 - RNA, 19 nt, Human
cucuauguucuaagaagug

SEQ ID NO: 2747882 - RNA, 13 nt, Human
cucucuggccuuc

SEQ ID NO: 2747883 - RNA, 16 nt, Human
cucucuggccuucggc

SEQ ID NO: 2747884 - RNA, 14 nt, Human
cucucuggccuucg

SEQ ID NO: 2747885 - RNA, 16 nt, Human
cucucuguaauaaacu

SEQ ID NO: 2747886 - RNA, 21 nt, Human
cucucuguaauaaacucauuu

SEQ ID NO: 2747887 - RNA, 16 nt, Human
cucucuucucuccagc

SEQ ID NO: 2747888 - RNA, 13 nt, Human
cuccucugcacuc

SEQ ID NO: 2747889 - RNA, 12 nt, Human
cuccucugcacu

SEQ ID NO: 2747890 - RNA, 22 nt, Human
cuccucugcuugccaucccucc

SEQ ID NO: 2747891 - RNA, 18 nt, Human
cuccucuguccagggccc

SEQ ID NO: 2747892 - RNA, 17 nt, Human
cuccucuguccagggcc

SEQ ID NO: 2747893 - RNA, 14 nt, Human
cuccucuguccagg

SEQ ID NO: 2747894 - RNA, 16 nt, Human
cuccucuguccagggc

SEQ ID NO: 2747895 - RNA, 15 nt, Human
cuccucuguccaggg

SEQ ID NO: 2747896 - RNA, 15 nt, Human
cuccugucugccagc

SEQ ID NO: 2747897 - RNA, 14 nt, Human
cuccugucugccag

SEQ ID NO: 2747898 - RNA, 16 nt, Human
cuccugucugccagcc

SEQ ID NO: 2747899 - RNA, 13 nt, Human
cuccugucugcca

SEQ ID NO: 2747900 - RNA, 15 nt, Human
cucccagaggagcca

SEQ ID NO: 2747901 - RNA, 23 nt, Human
cucauggguggcacucagucucu

SEQ ID NO: 2747902 - RNA, 15 nt, Human
cucauggguggcacu

SEQ ID NO: 2747903 - RNA, 19 nt, Human
cucauggguggcacucagu

SEQ ID NO: 2747904 - RNA, 14 nt, Human
cucauggguggcac

SEQ ID NO: 2747905 - RNA, 22 nt, Human
cucccuccaccucccugcaaua

SEQ ID NO: 2747906 - RNA, 21 nt, Human
cucccuccaccucccugcaau

SEQ ID NO: 2747907 - RNA, 20 nt, Human
cucccuccaccucccugcaa

SEQ ID NO: 2747908 - RNA, 19 nt, Human
cucccuccaccucccugca

SEQ ID NO: 2747909 - RNA, 16 nt, Human
cucaguccaugaagau

SEQ ID NO: 2747910 - RNA, 23 nt, Human
cuaugucauuugcuggagcucug

SEQ ID NO: 2747911 - RNA, 18 nt, Human
cuaucucauuuccaagca

SEQ ID NO: 2747912 - RNA, 18 nt, Human
cuauguucuaagaaguga

SEQ ID NO: 2747913 - RNA, 18 nt, Human
ccuuagcuuagaccucag

SEQ ID NO: 2747914 - RNA, 17 nt, Human
ccuuagcuuagaccuca

SEQ ID NO: 2747915 - RNA, 14 nt, Human
ccuuauaguuacug

SEQ ID NO: 2747916 - RNA, 21 nt, Human
ccuuauaguuacuguguaauu

SEQ ID NO: 2747917 - RNA, 22 nt, Human
ccuuagcuuagaccucagccug

SEQ ID NO: 2747918 - RNA, 21 nt, Human
ccuuagcuuagaccucagccu

SEQ ID NO: 2747919 - RNA, 20 nt, Human
ccuuagcuuagaccucagcc

SEQ ID NO: 2747920 - RNA, 19 nt, Human
ccuuagcuuagaccucagc

SEQ ID NO: 2747921 - RNA, 23 nt, Human
ccuuagcuuagaccucagccugu

SEQ ID NO: 2747922 - RNA, 13 nt, Human
ccuugccagacau

SEQ ID NO: 2747923 - RNA, 22 nt, Human
ccuuccccuugcccagggcuca

SEQ ID NO: 2747924 - RNA, 20 nt, Human
ccuuccccuugcccagggcu

SEQ ID NO: 2747925 - RNA, 18 nt, Human
ccuuccccuugcccaggg

SEQ ID NO: 2747926 - RNA, 17 nt, Human
ccuucucuucacaguca

SEQ ID NO: 2747927 - RNA, 18 nt, Human
cuaaagcaguggacacca

SEQ ID NO: 2747928 - RNA, 11 nt, Human
cuaaagcagug

SEQ ID NO: 2747929 - RNA, 20 nt, Human
cuaacgaaguauccuucagc

SEQ ID NO: 2747930 - RNA, 19 nt, Human
cuaauaaaaaggugaccau

SEQ ID NO: 2747931 - RNA, 20 nt, Human
cuacaaaaacacagcaaggg

SEQ ID NO: 2747932 - RNA, 12 nt, Human
ccuuuucccaac

SEQ ID NO: 2747933 - RNA, 22 nt, Human
auucaaggaauuucuuaacuuc

SEQ ID NO: 2747934 - RNA, 22 nt, Human
auugaggacacugauauggguc

SEQ ID NO: 2747935 - RNA, 16 nt, Human
auuucagcagcugcag

SEQ ID NO: 2747936 - RNA, 15 nt, Human
auuuaucuauaauuu

SEQ ID NO: 2747937 - RNA, 10 nt, Human
auuuaucuau

SEQ ID NO: 2747938 - RNA, 11 nt, Human
auuuaucuaua

SEQ ID NO: 2747939 - RNA, 16 nt, Human
auuuuuauauuugaaa

SEQ ID NO: 2747940 - RNA, 19 nt, Human
auuuuuauauuugaaauau

SEQ ID NO: 2747941 - RNA, 17 nt, Human
caaacauauauaacaau

SEQ ID NO: 2747942 - RNA, 21 nt, Human
caaaagguauuuuaaucacca

SEQ ID NO: 2747943 - RNA, 15 nt, Human
auuugcagagacagg

SEQ ID NO: 2747944 - RNA, 22 nt, Human
auuugcagagacaggaccugac

SEQ ID NO: 2747945 - RNA, 19 nt, Human
auuugcagagacaggaccu

SEQ ID NO: 2747946 - RNA, 19 nt, Human
auuuucuauaauuuaaaua

SEQ ID NO: 2747947 - RNA, 17 nt, Human
auuuucuauaauuuaaa

SEQ ID NO: 2747948 - RNA, 18 nt, Human
auuuucuauaauuuaaau

SEQ ID NO: 2747949 - RNA, 17 nt, Human
caccaggagucccuggu

SEQ ID NO: 2747950 - RNA, 13 nt, Human
cacaucagcuugc

SEQ ID NO: 2747951 - RNA, 23 nt, Human
cacaucagcuugcccuguuaaaa

SEQ ID NO: 2747952 - RNA, 23 nt, Human
cacugaagaagcaccaaucauga

SEQ ID NO: 2747953 - RNA, 11 nt, Human
cacugaagaag

SEQ ID NO: 2747954 - RNA, 21 nt, Human
cacuccagugagacagcucug

SEQ ID NO: 2747955 - RNA, 16 nt, Human
cacuccagugagacag

SEQ ID NO: 2747956 - RNA, 14 nt, Human
caagcacagcccuu

SEQ ID NO: 2747957 - RNA, 14 nt, Human
caagcaaguauuag

SEQ ID NO: 2747958 - RNA, 12 nt, Human
caacuccagaaa

SEQ ID NO: 2747959 - RNA, 19 nt, Human
caacuaucucauuuccaag

SEQ ID NO: 2747960 - RNA, 19 nt, Human
caacuauauuguuugcuaa

SEQ ID NO: 2747961 - RNA, 17 nt, Human
caaguucaugcagcugu

SEQ ID NO: 2747962 - RNA, 17 nt, Human
caaucagccuaguugau

SEQ ID NO: 2747963 - RNA, 21 nt, Human
caauauuucagauaaucacaa

SEQ ID NO: 2747964 - RNA, 19 nt, Human
cagcuguaugauucccagc

SEQ ID NO: 2747965 - RNA, 20 nt, Human
cagcugccuccccuccucug

SEQ ID NO: 2747966 - RNA, 19 nt, Human
cagcugccuccccuccucu

SEQ ID NO: 2747967 - RNA, 18 nt, Human
cagcugccuccccuccuc

SEQ ID NO: 2747968 - RNA, 17 nt, Human
cagcugccuccccuccu

SEQ ID NO: 2747969 - RNA, 16 nt, Human
cagcugccuccccucc

SEQ ID NO: 2747970 - RNA, 15 nt, Human
cagcugccuccccuc

SEQ ID NO: 2747971 - RNA, 14 nt, Human
cagcugccuccccu

SEQ ID NO: 2747972 - RNA, 9 nt, Human
cagcugccu

SEQ ID NO: 2747973 - RNA, 10 nt, Human
cagcugccuc

SEQ ID NO: 2747974 - RNA, 11 nt, Human
cagcugccucc

SEQ ID NO: 2747975 - RNA, 20 nt, Human
cagcuuauugucuagugaaa

SEQ ID NO: 2747976 - RNA, 17 nt, Human
cagcuuauucacaagac

SEQ ID NO: 2747977 - RNA, 20 nt, Human
cagcuguaugauucccagcc

SEQ ID NO: 2747978 - RNA, 14 nt, Human
cagcuuauugucua

SEQ ID NO: 2747979 - RNA, 16 nt, Human
caggaaagagaacuuc

SEQ ID NO: 2747980 - RNA, 14 nt, Human
cagggcucagccug

SEQ ID NO: 2747981 - RNA, 13 nt, Human
cagggcucagccu

SEQ ID NO: 2747982 - RNA, 12 nt, Human
cagggcucagcc

SEQ ID NO: 2747983 - RNA, 22 nt, Human
cagggcuuuacuccguaacaga

SEQ ID NO: 2747984 - RNA, 11 nt, Human
caggcuacugu

SEQ ID NO: 2747985 - RNA, 23 nt, Human
cagagcugcccucuccugggcag

SEQ ID NO: 2747986 - RNA, 21 nt, Human
cagagcugcccucuccugggc

SEQ ID NO: 2747987 - RNA, 20 nt, Human
cagagcugcccucuccuggg

SEQ ID NO: 2747988 - RNA, 19 nt, Human
cagagcugcccucuccugg

SEQ ID NO: 2747989 - RNA, 18 nt, Human
cagagcugcccucuccug

SEQ ID NO: 2747990 - RNA, 14 nt, Human
cagccagacuggca

SEQ ID NO: 2747991 - RNA, 19 nt, Human
cagcacuaaagcaguggac

SEQ ID NO: 2747992 - RNA, 17 nt, Human
cagcacuaaagcagugg

SEQ ID NO: 2747993 - RNA, 14 nt, Human
cagcacuaaagcag

SEQ ID NO: 2747994 - RNA, 20 nt, Human
cagcacuaaagcaguggaca

SEQ ID NO: 2747995 - RNA, 15 nt, Human
cagccagacuggcac

SEQ ID NO: 2747996 - RNA, 18 nt, Human
cagccagacuggcacagu

SEQ ID NO: 2747997 - RNA, 23 nt, Human
cagccagcaguucagagcugccc

SEQ ID NO: 2747998 - RNA, 19 nt, Human
cagacagcagcucaggcac

SEQ ID NO: 2747999 - RNA, 18 nt, Human
cagacagcagcucaggca

SEQ ID NO: 2748000 - RNA, 17 nt, Human
cagacagcagcucaggc

SEQ ID NO: 2748001 - RNA, 16 nt, Human
cagacagcagcucagg

SEQ ID NO: 2748002 - RNA, 15 nt, Human
cagacagcagcucag

SEQ ID NO: 2748003 - RNA, 13 nt, Human
cagacagcagcuc

SEQ ID NO: 2748004 - RNA, 22 nt, Human
cagacuggcacaguuuucugag

SEQ ID NO: 2748005 - RNA, 23 nt, Human
cagacuggcacaguuuucugaga

SEQ ID NO: 2748006 - RNA, 19 nt, Human
cagacuggauaguccgucu

SEQ ID NO: 2748007 - RNA, 17 nt, Human
cagacuggcacaguuuu

SEQ ID NO: 2748008 - RNA, 18 nt, Human
cagacuggcacaguuuuc

SEQ ID NO: 2748009 - RNA, 22 nt, Human
caguucagagcugcccucuccu

SEQ ID NO: 2748010 - RNA, 21 nt, Human
caguucagagcugcccucucc

SEQ ID NO: 2748011 - RNA, 19 nt, Human
caguucagagcugcccucu

SEQ ID NO: 2748012 - RNA, 18 nt, Human
caguucagagcugcccuc

SEQ ID NO: 2748013 - RNA, 24 nt, Human
caguucagagcugcccucuccugg

SEQ ID NO: 2748014 - RNA, 23 nt, Human
caguucagagcugcccucuccug

SEQ ID NO: 2748015 - RNA, 22 nt, Human
caguuauuauauuuacaaaugg

SEQ ID NO: 2748016 - RNA, 17 nt, Human
caguucagagcugcccu

SEQ ID NO: 2748017 - RNA, 16 nt, Human
caguucagagcugccc

SEQ ID NO: 2748018 - RNA, 15 nt, Human
caguucagagcugcc

SEQ ID NO: 2748019 - RNA, 14 nt, Human
cagucucucuucuc

SEQ ID NO: 2748020 - RNA, 17 nt, Human
cagucucucuucucucc

SEQ ID NO: 2748021 - RNA, 13 nt, Human
cagugggugcccc

SEQ ID NO: 2748022 - RNA, 22 nt, Human
cagugauuaccagggacugagg

SEQ ID NO: 2748023 - RNA, 22 nt, Human
cagucucucuucucuccagcug

SEQ ID NO: 2748024 - RNA, 13 nt, Human
caguuauggcuau

SEQ ID NO: 2748025 - RNA, 19 nt, Human
caguuauggcuauaggugc

SEQ ID NO: 2748026 - RNA, 20 nt, Human
caguuauggcuauaggugcu

SEQ ID NO: 2748027 - RNA, 17 nt, Human
caguuauuauauuuaca

SEQ ID NO: 2748028 - RNA, 21 nt, Human
caguuauuauauuuacaaaug

SEQ ID NO: 2748029 - RNA, 16 nt, Human
cauagguuuaauaauu

SEQ ID NO: 2748030 - RNA, 19 nt, Human
cauagcagcuuauucacaa

SEQ ID NO: 2748031 - RNA, 19 nt, Human
cauccugaggcuccacuug

SEQ ID NO: 2748032 - RNA, 18 nt, Human
cauccugaggcuccacuu

SEQ ID NO: 2748033 - RNA, 14 nt, Human
caucuggcucuaau

SEQ ID NO: 2748034 - RNA, 18 nt, Human
caucuggcucuaauucac

SEQ ID NO: 2748035 - RNA, 19 nt, Human
cauuauauuuauuacugua

SEQ ID NO: 2748036 - RNA, 21 nt, Human
ccaacuccagaaagugacaag

SEQ ID NO: 2748037 - RNA, 16 nt, Human
cauuuguauaaaauaa

SEQ ID NO: 2748038 - RNA, 14 nt, Human
cauuuguauaaaau

SEQ ID NO: 2748039 - RNA, 14 nt, Human
cauuuaucuauaau

SEQ ID NO: 2748040 - RNA, 16 nt, Human
cauuuaucuauaauuu

SEQ ID NO: 2748041 - RNA, 21 nt, Human
cauuuaucuauaauuuaccua

SEQ ID NO: 2748042 - RNA, 22 nt, Human
cauuuaucuauaauuuaccuaa

SEQ ID NO: 2748043 - RNA, 14 nt, Human
ccaaaaggcagaag

SEQ ID NO: 2748044 - RNA, 16 nt, Human
auuuaaauauuaaaua

SEQ ID NO: 2748045 - RNA, 22 nt, Human
auuuaccacuuguguuuugcaa

SEQ ID NO: 2748046 - RNA, 15 nt, Human
auuuaccacuugugu

SEQ ID NO: 2748047 - RNA, 16 nt, Human
auuguaguccuguaau

SEQ ID NO: 2748048 - RNA, 17 nt, Human
auuuaaaaaaaaaccug

SEQ ID NO: 2748049 - RNA, 20 nt, Human
auuuauuacuguaagaaaau

SEQ ID NO: 2748050 - RNA, 19 nt, Human
auuuauuacuguaagaaaa

SEQ ID NO: 2748051 - RNA, 17 nt, Human
auuuccuaauacuguca

SEQ ID NO: 2748052 - RNA, 21 nt, Human
auuuccuaauacugucauccu

SEQ ID NO: 2748053 - RNA, 17 nt, Human
auuucuuaacuucuugc

SEQ ID NO: 2748054 - RNA, 14 nt, Human
auuucuuaacuucu

SEQ ID NO: 2748055 - RNA, 19 nt, Human
auuucuuaacuucuugcuu

SEQ ID NO: 2748056 - RNA, 21 nt, Human
auuuauuuuaauaauguuuca

SEQ ID NO: 2748057 - RNA, 20 nt, Human
auuucuugagguaaaagcau

SEQ ID NO: 2748058 - RNA, 17 nt, Human
auuggagcucgugggac

SEQ ID NO: 2748059 - RNA, 16 nt, Human
auuggagcucguggaa

SEQ ID NO: 2748060 - RNA, 24 nt, Human
auuccuagaaacugacacaugcug

SEQ ID NO: 2748061 - RNA, 22 nt, Human
auugaacaaguuguuucauuga

SEQ ID NO: 2748062 - RNA, 17 nt, Human
auugaaggaugcugucu

SEQ ID NO: 2748063 - RNA, 16 nt, Human
uuuucucuaggaaaua

SEQ ID NO: 2748064 - RNA, 16 nt, Human
uuuucuauaauuuaaa

SEQ ID NO: 2748065 - RNA, 20 nt, Human
uuuucaggcuagauguaugu

SEQ ID NO: 2748066 - RNA, 14 nt, Human
uuuuccaacuacua

SEQ ID NO: 2748067 - RNA, 18 nt, Human
uuuuccaacuacuaauag

SEQ ID NO: 2748068 - RNA, 22 nt, Human
uuuuauggcacuaguauuucua

SEQ ID NO: 2748069 - RNA, 20 nt, Human
augugcuaguaauuggaaag

SEQ ID NO: 2748070 - RNA, 21 nt, Human
augugcuaguaauuggaaagg

SEQ ID NO: 2748071 - RNA, 16 nt, Human
auguccaacccgucug

SEQ ID NO: 2748072 - RNA, 19 nt, Human
auguauauuuuauaucaau

SEQ ID NO: 2748073 - RNA, 23 nt, Human
augucgucaaagcugaaauggac

SEQ ID NO: 2748074 - RNA, 17 nt, Human
uuuguaguguuggagaa

SEQ ID NO: 2748075 - RNA, 15 nt, Human
uuugacacugcucua

SEQ ID NO: 2748076 - RNA, 19 nt, Human
uuugcuaagcauuccaacu

SEQ ID NO: 2748077 - RNA, 20 nt, Human
uuugcuggagcucugcccau

SEQ ID NO: 2748078 - RNA, 22 nt, Human
auucaaacagucucaggaaauc

SEQ ID NO: 2748079 - RNA, 23 nt, Human
auuauuguguguuauuuaaauga

SEQ ID NO: 2748080 - RNA, 20 nt, Human
auuauauggcuugaguuuaa

SEQ ID NO: 2748081 - RNA, 17 nt, Human
auuccaagugauugaaa

SEQ ID NO: 2748082 - RNA, 15 nt, Human
uuuuugaagcuguau

SEQ ID NO: 2748083 - RNA, 15 nt, Human
uuuuguuuucauuau

SEQ ID NO: 2748084 - RNA, 21 nt, Human
uuuuguuggcauagcucuggg

SEQ ID NO: 2748085 - RNA, 13 nt, Human
uuuuguuggcaua

SEQ ID NO: 2748086 - RNA, 14 nt, Human
uuuugugaagcaaa

SEQ ID NO: 2748087 - RNA, 14 nt, Human
uuuugugaauuagg

SEQ ID NO: 2748088 - RNA, 18 nt, Human
auuagacacuuuggaaga

SEQ ID NO: 2748089 - RNA, 16 nt, Human
auuacuguaagaaaau

SEQ ID NO: 2748090 - RNA, 15 nt, Human
auuacuguaagaaaa

SEQ ID NO: 2748091 - RNA, 23 nt, Human
uugugaauuaggcuguaacuacu

SEQ ID NO: 2748092 - RNA, 18 nt, Human
uugugaauuaggcuguaa

SEQ ID NO: 2748093 - RNA, 19 nt, Human
uugugaauuaggcuguaac

SEQ ID NO: 2748094 - RNA, 14 nt, Human
uugucacuuuuucu

SEQ ID NO: 2748095 - RNA, 16 nt, Human
uugucacuuuuucuga

SEQ ID NO: 2748096 - RNA, 20 nt, Human
uugucaauaaaauccauaca

SEQ ID NO: 2748097 - RNA, 15 nt, Human
augagguacugagag

SEQ ID NO: 2748098 - RNA, 18 nt, Human
augagguacugagaguga

SEQ ID NO: 2748099 - RNA, 17 nt, Human
augagguacugagagug

SEQ ID NO: 2748100 - RNA, 13 nt, Human
augauuucauuca

SEQ ID NO: 2748101 - RNA, 18 nt, Human
uuuaaaaaaauuccaagu

SEQ ID NO: 2748102 - RNA, 12 nt, Human
augcaaagcacu

SEQ ID NO: 2748103 - RNA, 13 nt, Human
augcaaagcacug

SEQ ID NO: 2748104 - RNA, 14 nt, Human
augcaaagcacuga

SEQ ID NO: 2748105 - RNA, 21 nt, Human
uuuaaauauaugcuaagucuu

SEQ ID NO: 2748106 - RNA, 20 nt, Human
uuucacgccugaggcaauua

SEQ ID NO: 2748107 - RNA, 17 nt, Human
uuucaaacauauauaac

SEQ ID NO: 2748108 - RNA, 19 nt, Human
uuucaaacauauauaacaa

SEQ ID NO: 2748109 - RNA, 21 nt, Human
augcuucuguuuuauaauuuu

SEQ ID NO: 2748110 - RNA, 22 nt, Human
augcuguauuuuaaaagaauga

SEQ ID NO: 2748111 - RNA, 19 nt, Human
augcuguauuuuaaaagaa

SEQ ID NO: 2748112 - RNA, 23 nt, Human
augcuguauuuuaaaagaaugau

SEQ ID NO: 2748113 - RNA, 18 nt, Human
augcuacaggauuugaaa

SEQ ID NO: 2748114 - RNA, 22 nt, Human
augccuuuucccaacuccagaa

SEQ ID NO: 2748115 - RNA, 20 nt, Human
augccuuuucccaacuccag

SEQ ID NO: 2748116 - RNA, 14 nt, Human
augccuuuucccaa

SEQ ID NO: 2748117 - RNA, 15 nt, Human
uuuaccuaagauuac

SEQ ID NO: 2748118 - RNA, 17 nt, Human
uuuacuccguaacagau

SEQ ID NO: 2748119 - RNA, 19 nt, Human
uuuauaugcuucuguuuua

SEQ ID NO: 2748120 - RNA, 21 nt, Human
uuuauaugcuucuguuuuaua

SEQ ID NO: 2748121 - RNA, 20 nt, Human
uugcccagggcucagccugg

SEQ ID NO: 2748122 - RNA, 19 nt, Human
uugcccagggcucagccug

SEQ ID NO: 2748123 - RNA, 18 nt, Human
uugcccagggcucagccu

SEQ ID NO: 2748124 - RNA, 17 nt, Human
uugcccagggcucagcc

SEQ ID NO: 2748125 - RNA, 12 nt, Human
uugacuuuuuau

SEQ ID NO: 2748126 - RNA, 13 nt, Human
uugacaugggaca

SEQ ID NO: 2748127 - RNA, 14 nt, Human
aucuaccccagacu

SEQ ID NO: 2748128 - RNA, 20 nt, Human
aucuaccccagacuagaugu

SEQ ID NO: 2748129 - RNA, 21 nt, Human
aucuaccccagacuagaugua

SEQ ID NO: 2748130 - RNA, 22 nt, Human
aucuaccccagacuagauguag

SEQ ID NO: 2748131 - RNA, 19 nt, Human
aucucaaaacugcacuguc

SEQ ID NO: 2748132 - RNA, 20 nt, Human
aucucaaaacugcacuguca

SEQ ID NO: 2748133 - RNA, 15 nt, Human
aucucaaaacugcac

SEQ ID NO: 2748134 - RNA, 15 nt, Human
uuggagaagaacuga

SEQ ID NO: 2748135 - RNA, 22 nt, Human
uuggagaagaacugaaaucaua

SEQ ID NO: 2748136 - RNA, 17 nt, Human
uuggagaagaacugaaa

SEQ ID NO: 2748137 - RNA, 12 nt, Human
aucuuuaaaaua

SEQ ID NO: 2748138 - RNA, 15 nt, Human
aucuuuaaaauacac

SEQ ID NO: 2748139 - RNA, 16 nt, Human
aucuuauaauuuaaaa

SEQ ID NO: 2748140 - RNA, 15 nt, Human
aucuuauaauuuaaa

SEQ ID NO: 2748141 - RNA, 14 nt, Human
uuggguaggcggga

SEQ ID NO: 2748142 - RNA, 15 nt, Human
uuggcccaggaguuu

SEQ ID NO: 2748143 - RNA, 20 nt, Human
uuggcccaggaguuuggcca

SEQ ID NO: 2748144 - RNA, 21 nt, Human
uuggcccaggaguuuggccag

SEQ ID NO: 2748145 - RNA, 22 nt, Human
uuggcccaggaguuuggccaga

SEQ ID NO: 2748146 - RNA, 13 nt, Human
uuggcccaggagu

SEQ ID NO: 2748147 - RNA, 14 nt, Human
uuggcccaggaguu

SEQ ID NO: 2748148 - RNA, 18 nt, Human
augaacuuguaaaggaau

SEQ ID NO: 2748149 - RNA, 23 nt, Human
auaucuaccccagacuagaugua

SEQ ID NO: 2748150 - RNA, 21 nt, Human
auaucuaccccagacuagaug

SEQ ID NO: 2748151 - RNA, 23 nt, Human
uucagccuagccgaccucagccu

SEQ ID NO: 2748152 - RNA, 22 nt, Human
uucagccuagccgaccucagcc

SEQ ID NO: 2748153 - RNA, 21 nt, Human
uucagccuagccgaccucagc

SEQ ID NO: 2748154 - RNA, 20 nt, Human
uucagccuagccgaccucag

SEQ ID NO: 2748155 - RNA, 23 nt, Human
auaugcaaagcacugacuucuaa

SEQ ID NO: 2748156 - RNA, 16 nt, Human
auaugcaaagcacuga

SEQ ID NO: 2748157 - RNA, 15 nt, Human
auaugcaaagcacug

SEQ ID NO: 2748158 - RNA, 15 nt, Human
uucagcccucagaau

SEQ ID NO: 2748159 - RNA, 15 nt, Human
auauaacaaugcugu

SEQ ID NO: 2748160 - RNA, 12 nt, Human
auauaacaaugc

SEQ ID NO: 2748161 - RNA, 19 nt, Human
auauaagcuuguauuccuu

SEQ ID NO: 2748162 - RNA, 18 nt, Human
auauauaacaaugcugua

SEQ ID NO: 2748163 - RNA, 17 nt, Human
auauauaacaaugcugu

SEQ ID NO: 2748164 - RNA, 14 nt, Human
auauauaacaaugc

SEQ ID NO: 2748165 - RNA, 18 nt, Human
auagucaaauugugugaa

SEQ ID NO: 2748166 - RNA, 17 nt, Human
auagucaaauuguguga

SEQ ID NO: 2748167 - RNA, 17 nt, Human
uucaaggaauuucuuaa

SEQ ID NO: 2748168 - RNA, 19 nt, Human
uucaaggaauuucuuaacu

SEQ ID NO: 2748169 - RNA, 15 nt, Human
uucaaacauauauaa

SEQ ID NO: 2748170 - RNA, 15 nt, Human
uucacagugcucuuu

SEQ ID NO: 2748171 - RNA, 21 nt, Human
auaggaauugacccacaagaa

SEQ ID NO: 2748172 - RNA, 14 nt, Human
auagcuacuaauuu

SEQ ID NO: 2748173 - RNA, 17 nt, Human
auagcuacuaauuuuaa

SEQ ID NO: 2748174 - RNA, 19 nt, Human
auagcucuggggugggcag

SEQ ID NO: 2748175 - RNA, 22 nt, Human
auagcucuggggugggcaguuu

SEQ ID NO: 2748176 - RNA, 12 nt, Human
auagcucugggg

SEQ ID NO: 2748177 - RNA, 13 nt, Human
auagcucuggggu

SEQ ID NO: 2748178 - RNA, 18 nt, Human
auagcuacuaauuuuaaa

SEQ ID NO: 2748179 - RNA, 12 nt, Human
uuauuuaaauga

SEQ ID NO: 2748180 - RNA, 17 nt, Human
uuauuguuuaaaaucau

SEQ ID NO: 2748181 - RNA, 18 nt, Human
uucucaacuccaaacuga

SEQ ID NO: 2748182 - RNA, 14 nt, Human
uucucaacuccaaa

SEQ ID NO: 2748183 - RNA, 21 nt, Human
uucuguaccaguuaauuuuuc

SEQ ID NO: 2748184 - RNA, 20 nt, Human
aucauuucugcaucagcugc

SEQ ID NO: 2748185 - RNA, 23 nt, Human
aucccucccuccaccucccugca

SEQ ID NO: 2748186 - RNA, 13 nt, Human
aucccucccucca

SEQ ID NO: 2748187 - RNA, 11 nt, Human
aucccucccuc

SEQ ID NO: 2748188 - RNA, 11 nt, Human
uucuguaccag

SEQ ID NO: 2748189 - RNA, 12 nt, Human
uucuguaccagu

SEQ ID NO: 2748190 - RNA, 13 nt, Human
uucuguaccaguu

SEQ ID NO: 2748191 - RNA, 14 nt, Human
uucuguaccaguua

SEQ ID NO: 2748192 - RNA, 16 nt, Human
uucugcaucagcugcu

SEQ ID NO: 2748193 - RNA, 23 nt, Human
uucugcaucagcugcugaaacaa

SEQ ID NO: 2748194 - RNA, 14 nt, Human
uucugaagaagaug

SEQ ID NO: 2748195 - RNA, 13 nt, Human
uucugaagaagau

SEQ ID NO: 2748196 - RNA, 12 nt, Human
uucugaagaaga

SEQ ID NO: 2748197 - RNA, 13 nt, Human
uucauguuaguua

SEQ ID NO: 2748198 - RNA, 16 nt, Human
uucauguuaguuaccu

SEQ ID NO: 2748199 - RNA, 18 nt, Human
uucauguuaguuaccuua

SEQ ID NO: 2748200 - RNA, 22 nt, Human
uucauguuaguuaccuuauagu

SEQ ID NO: 2748201 - RNA, 23 nt, Human
auauuaaauauguuagcaaagag

SEQ ID NO: 2748202 - RNA, 19 nt, Human
auauuugaaauauugacuu

SEQ ID NO: 2748203 - RNA, 14 nt, Human
auauuugaaauauu

SEQ ID NO: 2748204 - RNA, 23 nt, Human
auauuugaaauauugacuuuuua

SEQ ID NO: 2748205 - RNA, 12 nt, Human
auauuuuaacuu

SEQ ID NO: 2748206 - RNA, 22 nt, Human
auauuuguaucacaaaucuuaa

SEQ ID NO: 2748207 - RNA, 13 nt, Human
auauuugaaauau

SEQ ID NO: 2748208 - RNA, 19 nt, Human
aucaauuuuucuuauuuca

SEQ ID NO: 2748209 - RNA, 22 nt, Human
aguggacaccaggagucccugg

SEQ ID NO: 2748210 - RNA, 20 nt, Human
aguggacaccaggagucccu

SEQ ID NO: 2748211 - RNA, 14 nt, Human
uguuccuagugaaa

SEQ ID NO: 2748212 - RNA, 18 nt, Human
uguuccuagugaaagagg

SEQ ID NO: 2748213 - RNA, 15 nt, Human
uguuauaaucuuuca

SEQ ID NO: 2748214 - RNA, 13 nt, Human
uguguaaguagau

SEQ ID NO: 2748215 - RNA, 20 nt, Human
uguggucacaggaaguagag

SEQ ID NO: 2748216 - RNA, 20 nt, Human
agugcuguuuauuaaucuua

SEQ ID NO: 2748217 - RNA, 21 nt, Human
agugcuguuuauuaaucuuag

SEQ ID NO: 2748218 - RNA, 22 nt, Human
agugcuguuuauuaaucuuagu

SEQ ID NO: 2748219 - RNA, 21 nt, Human
uguggcagaguuacaguucug

SEQ ID NO: 2748220 - RNA, 15 nt, Human
agugaaagaaaauaa

SEQ ID NO: 2748221 - RNA, 20 nt, Human
agugaacaaauuuacagaga

SEQ ID NO: 2748222 - RNA, 16 nt, Human
agugaacaaauuuaca

SEQ ID NO: 2748223 - RNA, 16 nt, Human
ugucacuuuuucugau

SEQ ID NO: 2748224 - RNA, 16 nt, Human
agucucaggaaaucaa

SEQ ID NO: 2748225 - RNA, 22 nt, Human
agucucaggaaaucaaauaugc

SEQ ID NO: 2748226 - RNA, 19 nt, Human
ugugagaugcuagaacucc

SEQ ID NO: 2748227 - RNA, 15 nt, Human
ugugagaugcuagaa

SEQ ID NO: 2748228 - RNA, 14 nt, Human
agucucucuucucu

SEQ ID NO: 2748229 - RNA, 18 nt, Human
agucucucuucucuccag

SEQ ID NO: 2748230 - RNA, 15 nt, Human
agucucucuucucuc

SEQ ID NO: 2748231 - RNA, 16 nt, Human
agucucucuucucucc

SEQ ID NO: 2748232 - RNA, 20 nt, Human
agugaaacucguuaauuugu

SEQ ID NO: 2748233 - RNA, 18 nt, Human
agucuuucacauuuaaau

SEQ ID NO: 2748234 - RNA, 19 nt, Human
auaaaauccauacauuugu

SEQ ID NO: 2748235 - RNA, 18 nt, Human
auaaaauccauacauuug

SEQ ID NO: 2748236 - RNA, 21 nt, Human
auaaaauaauuuuuauauuug

SEQ ID NO: 2748237 - RNA, 16 nt, Human
auaaaauaauuuuuau

SEQ ID NO: 2748238 - RNA, 15 nt, Human
auaaaauaauuuuua

SEQ ID NO: 2748239 - RNA, 18 nt, Human
uuaaguaaugauaacugg

SEQ ID NO: 2748240 - RNA, 22 nt, Human
uuaagaagacugcauuauauuu

SEQ ID NO: 2748241 - RNA, 20 nt, Human
uuaagaagacugcauuauau

SEQ ID NO: 2748242 - RNA, 15 nt, Human
auaacuaacaugucc

SEQ ID NO: 2748243 - RNA, 13 nt, Human
auaaauauaucua

SEQ ID NO: 2748244 - RNA, 21 nt, Human
auaaauauaucuaccccagac

SEQ ID NO: 2748245 - RNA, 18 nt, Human
auaaaguuggugacagau

SEQ ID NO: 2748246 - RNA, 16 nt, Human
auaaaguuggugacag

SEQ ID NO: 2748247 - RNA, 17 nt, Human
auaaaguuggugacaga

SEQ ID NO: 2748248 - RNA, 15 nt, Human
uuacuguaagaaaau

SEQ ID NO: 2748249 - RNA, 20 nt, Human
uuacuggccuuuuucauuua

SEQ ID NO: 2748250 - RNA, 12 nt, Human
uuaccugggaaa

SEQ ID NO: 2748251 - RNA, 14 nt, Human
uuaccuuacagaag

SEQ ID NO: 2748252 - RNA, 16 nt, Human
aguugcagauucauuu

SEQ ID NO: 2748253 - RNA, 13 nt, Human
aguuggugacaga

SEQ ID NO: 2748254 - RNA, 16 nt, Human
aguuuagcuggaaaag

SEQ ID NO: 2748255 - RNA, 14 nt, Human
uguuuauuaaucuu

SEQ ID NO: 2748256 - RNA, 15 nt, Human
uguuuauuaaucuua

SEQ ID NO: 2748257 - RNA, 17 nt, Human
uguuuauuaaucuuagu

SEQ ID NO: 2748258 - RNA, 19 nt, Human
uguuuucauuaucucaaaa

SEQ ID NO: 2748259 - RNA, 14 nt, Human
uguuuugcaagcca

SEQ ID NO: 2748260 - RNA, 16 nt, Human
aguucugaagaagaug

SEQ ID NO: 2748261 - RNA, 21 nt, Human
aguucugcagauaaacaguag

SEQ ID NO: 2748262 - RNA, 16 nt, Human
aguucugcagauaaac

SEQ ID NO: 2748263 - RNA, 16 nt, Human
ugggguccuggggccu

SEQ ID NO: 2748264 - RNA, 15 nt, Human
agggcucagccuggu

SEQ ID NO: 2748265 - RNA, 14 nt, Human
agggcucagccugg

SEQ ID NO: 2748266 - RNA, 23 nt, Human
ugggugccccccuugccagacau

SEQ ID NO: 2748267 - RNA, 14 nt, Human
ugguaacuuuugug

SEQ ID NO: 2748268 - RNA, 16 nt, Human
ugguaacuuuugugaa

SEQ ID NO: 2748269 - RNA, 24 nt, Human
ugguaacuuuugugaauuaggcug

SEQ ID NO: 2748270 - RNA, 18 nt, Human
aggggagcaugggaagug

SEQ ID NO: 2748271 - RNA, 13 nt, Human
agggcucagccug

SEQ ID NO: 2748272 - RNA, 12 nt, Human
agggcucagccu

SEQ ID NO: 2748273 - RNA, 16 nt, Human
agggcccugagcucgg

SEQ ID NO: 2748274 - RNA, 23 nt, Human
agggaggacgcucucuggccuuc

SEQ ID NO: 2748275 - RNA, 22 nt, Human
agggaggacgcucucuggccuu

SEQ ID NO: 2748276 - RNA, 21 nt, Human
agggaggacgcucucuggccu

SEQ ID NO: 2748277 - RNA, 13 nt, Human
agggaaauuucag

SEQ ID NO: 2748278 - RNA, 18 nt, Human
uguaguauuuuuuguaua

SEQ ID NO: 2748279 - RNA, 19 nt, Human
uguaguauuuuuuguauaa

SEQ ID NO: 2748280 - RNA, 20 nt, Human
uguaguauuuuuuguauaau

SEQ ID NO: 2748281 - RNA, 13 nt, Human
aguaaaauccaca

SEQ ID NO: 2748282 - RNA, 20 nt, Human
aguaaugauaacuggaaacu

SEQ ID NO: 2748283 - RNA, 18 nt, Human
aguaaugauaacuggaaa

SEQ ID NO: 2748284 - RNA, 17 nt, Human
aguaaugauaacuggaa

SEQ ID NO: 2748285 - RNA, 13 nt, Human
aguaaugauaacu

SEQ ID NO: 2748286 - RNA, 16 nt, Human
aguauuucuaugaaau

SEQ ID NO: 2748287 - RNA, 17 nt, Human
aguauuucuaugaaaua

SEQ ID NO: 2748288 - RNA, 18 nt, Human
aguauuucuaugaaauau

SEQ ID NO: 2748289 - RNA, 17 nt, Human
agucaccucauggaauu

SEQ ID NO: 2748290 - RNA, 15 nt, Human
agucaccucauggaa

SEQ ID NO: 2748291 - RNA, 14 nt, Human
agucaccucaugga

SEQ ID NO: 2748292 - RNA, 18 nt, Human
aguauuagaauaccacag

SEQ ID NO: 2748293 - RNA, 13 nt, Human
aguagucagacug

SEQ ID NO: 2748294 - RNA, 23 nt, Human
ugucaaaaaugucuuggguaggc

SEQ ID NO: 2748295 - RNA, 13 nt, Human
uguauuacaaauc

SEQ ID NO: 2748296 - RNA, 22 nt, Human
uguauuacaaauccaaugaaau

SEQ ID NO: 2748297 - RNA, 15 nt, Human
uguaucacaaaucuu

SEQ ID NO: 2748298 - RNA, 18 nt, Human
uguaucacaaaucuuaac

SEQ ID NO: 2748299 - RNA, 15 nt, Human
uguaguguuggagaa

SEQ ID NO: 2748300 - RNA, 14 nt, Human
uguaguguuggaga

SEQ ID NO: 2748301 - RNA, 16 nt, Human
uguaaaggaauuuaaa

SEQ ID NO: 2748302 - RNA, 21 nt, Human
agcuguggcagaguuacaguu

SEQ ID NO: 2748303 - RNA, 22 nt, Human
agcuguggcagaguuacaguuc

SEQ ID NO: 2748304 - RNA, 18 nt, Human
agcuguggcagaguuaca

SEQ ID NO: 2748305 - RNA, 14 nt, Human
agcuguucacagcc

SEQ ID NO: 2748306 - RNA, 12 nt, Human
agcucgguggac

SEQ ID NO: 2748307 - RNA, 15 nt, Human
agcucgguggaccca

SEQ ID NO: 2748308 - RNA, 14 nt, Human
agcucgguggaccc

SEQ ID NO: 2748309 - RNA, 19 nt, Human
agcucgguggacccaggga

SEQ ID NO: 2748310 - RNA, 18 nt, Human
agcucgguggacccaggg

SEQ ID NO: 2748311 - RNA, 17 nt, Human
agcucgguggacccagg

SEQ ID NO: 2748312 - RNA, 16 nt, Human
agcucgguggacccag

SEQ ID NO: 2748313 - RNA, 20 nt, Human
agcucgguggacccagggau

SEQ ID NO: 2748314 - RNA, 19 nt, Human
agcucuggggugggcaguu

SEQ ID NO: 2748315 - RNA, 20 nt, Human
agcucuggggugggcaguuu

SEQ ID NO: 2748316 - RNA, 21 nt, Human
agcucuggggugggcaguuuu

SEQ ID NO: 2748317 - RNA, 22 nt, Human
agcucuggggugggcaguuuuu

SEQ ID NO: 2748318 - RNA, 14 nt, Human
agcucugggguggg

SEQ ID NO: 2748319 - RNA, 21 nt, Human
agcugcaagguacucugguga

SEQ ID NO: 2748320 - RNA, 23 nt, Human
agcugcaagguacucuggugagu

SEQ ID NO: 2748321 - RNA, 16 nt, Human
agcugcccucuccugg

SEQ ID NO: 2748322 - RNA, 15 nt, Human
agcugcccucuccug

SEQ ID NO: 2748323 - RNA, 14 nt, Human
agcugcccucuccu

SEQ ID NO: 2748324 - RNA, 13 nt, Human
agcugcccucucc

SEQ ID NO: 2748325 - RNA, 19 nt, Human
ugcccuguuaaaagaugaa

SEQ ID NO: 2748326 - RNA, 20 nt, Human
ugcccuguuaaaagaugaaa

SEQ ID NO: 2748327 - RNA, 20 nt, Human
agcuugcccuggugccucac

SEQ ID NO: 2748328 - RNA, 16 nt, Human
agcuugcccuguuaaa

SEQ ID NO: 2748329 - RNA, 18 nt, Human
agcuugcccuguuaaaag

SEQ ID NO: 2748330 - RNA, 19 nt, Human
agcuugcccuguuaaaaga

SEQ ID NO: 2748331 - RNA, 22 nt, Human
ugcuaccaguauuuagaagcca

SEQ ID NO: 2748332 - RNA, 15 nt, Human
ugcuaccaguauuua

SEQ ID NO: 2748333 - RNA, 18 nt, Human
ugcuaccaguauuuagaa

SEQ ID NO: 2748334 - RNA, 14 nt, Human
ugcuacaaaaacac

SEQ ID NO: 2748335 - RNA, 19 nt, Human
ugccuuuucccaacuccag

SEQ ID NO: 2748336 - RNA, 17 nt, Human
ugccuuuucccaacucc

SEQ ID NO: 2748337 - RNA, 19 nt, Human
aggaaaucaaauaugcaaa

SEQ ID NO: 2748338 - RNA, 20 nt, Human
aggaaaucaaauaugcaaag

SEQ ID NO: 2748339 - RNA, 21 nt, Human
aggaaaucaaauaugcaaagc

SEQ ID NO: 2748340 - RNA, 22 nt, Human
aggaaaucaaauaugcaaagca

SEQ ID NO: 2748341 - RNA, 15 nt, Human
aggcccccaggugcc

SEQ ID NO: 2748342 - RNA, 14 nt, Human
uggaguugaaaauc

SEQ ID NO: 2748343 - RNA, 15 nt, Human
aggcagcuugaaacu

SEQ ID NO: 2748344 - RNA, 20 nt, Human
aggcacacuucuucuugguc

SEQ ID NO: 2748345 - RNA, 16 nt, Human
aggcacacuucuucuu

SEQ ID NO: 2748346 - RNA, 15 nt, Human
aggcacacuucuucu

SEQ ID NO: 2748347 - RNA, 12 nt, Human
aggcacacuucu

SEQ ID NO: 2748348 - RNA, 20 nt, Human
aggcagcucuaaaugucaau

SEQ ID NO: 2748349 - RNA, 23 nt, Human
aggcagggucaggagaggggcag

SEQ ID NO: 2748350 - RNA, 20 nt, Human
aggcagggucaggagagggg

SEQ ID NO: 2748351 - RNA, 14 nt, Human
aggcagggucagga

SEQ ID NO: 2748352 - RNA, 19 nt, Human
aggcagggucaggagaggg

SEQ ID NO: 2748353 - RNA, 17 nt, Human
aggcagggucaggagag

SEQ ID NO: 2748354 - RNA, 12 nt, Human
aggcaguuuucu

SEQ ID NO: 2748355 - RNA, 13 nt, Human
aggcaguuuucua

SEQ ID NO: 2748356 - RNA, 14 nt, Human
aggcaguuuucuaa

SEQ ID NO: 2748357 - RNA, 20 nt, Human
aggcauuuaggccaugggac

SEQ ID NO: 2748358 - RNA, 19 nt, Human
uggacuuaagcaucuggcu

SEQ ID NO: 2748359 - RNA, 14 nt, Human
uggagcucguggaa

SEQ ID NO: 2748360 - RNA, 21 nt, Human
uggagcucguggaacaguuac

SEQ ID NO: 2748361 - RNA, 17 nt, Human
uggagcucguggaacag

SEQ ID NO: 2748362 - RNA, 17 nt, Human
uggagccaaggguucag

SEQ ID NO: 2748363 - RNA, 16 nt, Human
uggaaauaaagucaga

SEQ ID NO: 2748364 - RNA, 12 nt, Human
uggaaauaaagu

SEQ ID NO: 2748365 - RNA, 14 nt, Human
uggaaauaaaguca

SEQ ID NO: 2748366 - RNA, 17 nt, Human
ugcuuuuaaaaaaaaau

SEQ ID NO: 2748367 - RNA, 17 nt, Human
aggagaaacuggaacuc

SEQ ID NO: 2748368 - RNA, 19 nt, Human
aggagaaacuggaacucuc

SEQ ID NO: 2748369 - RNA, 18 nt, Human
aggagaaacuggaacucu

SEQ ID NO: 2748370 - RNA, 20 nt, Human
aggacgcucucuggccuucg

SEQ ID NO: 2748371 - RNA, 19 nt, Human
aggacgcucucuggccuuc

SEQ ID NO: 2748372 - RNA, 17 nt, Human
aggacgcucucuggccu

SEQ ID NO: 2748373 - RNA, 16 nt, Human
aggacgcucucuggcc

SEQ ID NO: 2748374 - RNA, 14 nt, Human
aggacgcucucugg

SEQ ID NO: 2748375 - RNA, 13 nt, Human
aggacgcucucug

SEQ ID NO: 2748376 - RNA, 15 nt, Human
ugcacuccagccuga

SEQ ID NO: 2748377 - RNA, 17 nt, Human
ugcacuccagccugagc

SEQ ID NO: 2748378 - RNA, 22 nt, Human
ugcagaagacaguauggcagcu

SEQ ID NO: 2748379 - RNA, 13 nt, Human
ugauuucauucaa

SEQ ID NO: 2748380 - RNA, 20 nt, Human
ugcaaagcacugacuucuaa

SEQ ID NO: 2748381 - RNA, 22 nt, Human
ugcaaagcacugacuucuaagu

SEQ ID NO: 2748382 - RNA, 18 nt, Human
ugcaaagcacugacuucu

SEQ ID NO: 2748383 - RNA, 21 nt, Human
ugcaagccagauuuuccugaa

SEQ ID NO: 2748384 - RNA, 15 nt, Human
ugcaagccagauuuu

SEQ ID NO: 2748385 - RNA, 16 nt, Human
ugcaagcacagcccuu

SEQ ID NO: 2748386 - RNA, 15 nt, Human
ugcaagcacagcccu

SEQ ID NO: 2748387 - RNA, 16 nt, Human
ugcaagguacucuggu

SEQ ID NO: 2748388 - RNA, 18 nt, Human
ugcaagguacucugguga

SEQ ID NO: 2748389 - RNA, 21 nt, Human
ugcaauaaaauggguuuuacu

SEQ ID NO: 2748390 - RNA, 17 nt, Human
ugcaauaaaauggguuu

SEQ ID NO: 2748391 - RNA, 20 nt, Human
ugcauagauucccugagcag

SEQ ID NO: 2748392 - RNA, 13 nt, Human
ugcauacucauua

SEQ ID NO: 2748393 - RNA, 19 nt, Human
ugcauacucauuaggaugg

SEQ ID NO: 2748394 - RNA, 19 nt, Human
agccugagcgacagugaga

SEQ ID NO: 2748395 - RNA, 23 nt, Human
ugccagccagcagccagcucuca

SEQ ID NO: 2748396 - RNA, 22 nt, Human
ugccagccagcagccagcucuc

SEQ ID NO: 2748397 - RNA, 17 nt, Human
ugccagccagcagccag

SEQ ID NO: 2748398 - RNA, 16 nt, Human
ugccagccagcagcca

SEQ ID NO: 2748399 - RNA, 15 nt, Human
ugccagccagcagcc

SEQ ID NO: 2748400 - RNA, 17 nt, Human
ugccaguuauggcuaua

SEQ ID NO: 2748401 - RNA, 13 nt, Human
ugccauaauuacu

SEQ ID NO: 2748402 - RNA, 18 nt, Human
ugagugucuuaauuaaaa

SEQ ID NO: 2748403 - RNA, 18 nt, Human
agcagucaggaaagagaa

SEQ ID NO: 2748404 - RNA, 17 nt, Human
agcagucaggaaagaga

SEQ ID NO: 2748405 - RNA, 22 nt, Human
agcaguuugguuucuagcauga

SEQ ID NO: 2748406 - RNA, 23 nt, Human
agcaguuugguuucuagcaugaa

SEQ ID NO: 2748407 - RNA, 20 nt, Human
agcaguuugguuucuagcau

SEQ ID NO: 2748408 - RNA, 19 nt, Human
agcagucaggaaagagaac

SEQ ID NO: 2748409 - RNA, 13 nt, Human
agcauaccaacac

SEQ ID NO: 2748410 - RNA, 19 nt, Human
agcauaccaacacgagcag

SEQ ID NO: 2748411 - RNA, 22 nt, Human
agcauaccaacacgagcaggcu

SEQ ID NO: 2748412 - RNA, 19 nt, Human
agcagggcauggcugggaa

SEQ ID NO: 2748413 - RNA, 20 nt, Human
agcaggaagcugugagagca

SEQ ID NO: 2748414 - RNA, 16 nt, Human
agcaggcuacugucag

SEQ ID NO: 2748415 - RNA, 17 nt, Human
agcaggcuacugucagc

SEQ ID NO: 2748416 - RNA, 19 nt, Human
agcaggcuacugucagcuc

SEQ ID NO: 2748417 - RNA, 20 nt, Human
agcaggcuacugucagcucc

SEQ ID NO: 2748418 - RNA, 14 nt, Human
agcaggcuacuguc

SEQ ID NO: 2748419 - RNA, 12 nt, Human
agccaccaguuc

SEQ ID NO: 2748420 - RNA, 14 nt, Human
agccaccaguucuc

SEQ ID NO: 2748421 - RNA, 15 nt, Human
ugauuaaguaaugau

SEQ ID NO: 2748422 - RNA, 16 nt, Human
ugauuaaguaaugaua

SEQ ID NO: 2748423 - RNA, 22 nt, Human
agcauuuagauguauagguuga

SEQ ID NO: 2748424 - RNA, 21 nt, Human
agcaucauuauuugcagagac

SEQ ID NO: 2748425 - RNA, 20 nt, Human
agcaucacaugaacuuguaa

SEQ ID NO: 2748426 - RNA, 14 nt, Human
agagcacacuguag

SEQ ID NO: 2748427 - RNA, 14 nt, Human
agagcugcccucuc

SEQ ID NO: 2748428 - RNA, 13 nt, Human
agagcugcccucu

SEQ ID NO: 2748429 - RNA, 15 nt, Human
agagcugcccucucc

SEQ ID NO: 2748430 - RNA, 23 nt, Human
ugaaauaagccagacaucaacag

SEQ ID NO: 2748431 - RNA, 20 nt, Human
ugaaauaagccagacaucaa

SEQ ID NO: 2748432 - RNA, 18 nt, Human
ugaaauaagccagacauc

SEQ ID NO: 2748433 - RNA, 17 nt, Human
ugaaauaagccagacau

SEQ ID NO: 2748434 - RNA, 15 nt, Human
ugaaauuguauuaca

SEQ ID NO: 2748435 - RNA, 18 nt, Human
ugaaauauuauguuaaaa

SEQ ID NO: 2748436 - RNA, 18 nt, Human
ugaacaaauuuacagaga

SEQ ID NO: 2748437 - RNA, 20 nt, Human
ugaacaaauuuacagagaca

SEQ ID NO: 2748438 - RNA, 19 nt, Human
ugaacaaauuuacagagac

SEQ ID NO: 2748439 - RNA, 23 nt, Human
ugaacuagaguuuagcuggaaaa

SEQ ID NO: 2748440 - RNA, 22 nt, Human
agagcugcccucuccugggcag

SEQ ID NO: 2748441 - RNA, 19 nt, Human
agagcuguucacagccaga

SEQ ID NO: 2748442 - RNA, 21 nt, Human
agagcuguucacagccagacu

SEQ ID NO: 2748443 - RNA, 15 nt, Human
agagguugcagugag

SEQ ID NO: 2748444 - RNA, 23 nt, Human
ugacacaccaggcgcuaauucaa

SEQ ID NO: 2748445 - RNA, 16 nt, Human
ugacacaccaggcgcu

SEQ ID NO: 2748446 - RNA, 22 nt, Human
ugacacaccaggcgcuaauuca

SEQ ID NO: 2748447 - RNA, 17 nt, Human
ugacccacaagaaauga

SEQ ID NO: 2748448 - RNA, 17 nt, Human
agaugcaguucugaaga

SEQ ID NO: 2748449 - RNA, 19 nt, Human
agaugcaguucugaagaag

SEQ ID NO: 2748450 - RNA, 18 nt, Human
agaugcaguucugaagaa

SEQ ID NO: 2748451 - RNA, 15 nt, Human
agaugcuagaacucc

SEQ ID NO: 2748452 - RNA, 14 nt, Human
agaugcuagaacuc

SEQ ID NO: 2748453 - RNA, 17 nt, Human
agaguuuagcuggaaaa

SEQ ID NO: 2748454 - RNA, 16 nt, Human
agaguuuagcuggaaa

SEQ ID NO: 2748455 - RNA, 17 nt, Human
agacccucaugcugcca

SEQ ID NO: 2748456 - RNA, 11 nt, Human
agaccucagcc

SEQ ID NO: 2748457 - RNA, 19 nt, Human
agaccucagccugugcugc

SEQ ID NO: 2748458 - RNA, 17 nt, Human
agaccucagccugugcu

SEQ ID NO: 2748459 - RNA, 16 nt, Human
agaccucagccugugc

SEQ ID NO: 2748460 - RNA, 15 nt, Human
agaccucagccugug

SEQ ID NO: 2748461 - RNA, 14 nt, Human
agaccucagccugu

SEQ ID NO: 2748462 - RNA, 13 nt, Human
agaccucagccug

SEQ ID NO: 2748463 - RNA, 12 nt, Human
agaccucagccu

SEQ ID NO: 2748464 - RNA, 20 nt, Human
agaccucagccugugcugcc

SEQ ID NO: 2748465 - RNA, 23 nt, Human
agacuauucaaacagucucagga

SEQ ID NO: 2748466 - RNA, 16 nt, Human
ucuuauuucauuucuu

SEQ ID NO: 2748467 - RNA, 15 nt, Human
ucuuauuucauuucu

SEQ ID NO: 2748468 - RNA, 13 nt, Human
ucuuauuuauuau

SEQ ID NO: 2748469 - RNA, 15 nt, Human
agagacagaaagcag

SEQ ID NO: 2748470 - RNA, 24 nt, Human
agagacagaaagcagaacagugau

SEQ ID NO: 2748471 - RNA, 17 nt, Human
ucuggggugggcaguuu

SEQ ID NO: 2748472 - RNA, 20 nt, Human
ucuguccagggcccugagcu

SEQ ID NO: 2748473 - RNA, 19 nt, Human
ucuguccagggcccugagc

SEQ ID NO: 2748474 - RNA, 17 nt, Human
ucuguccagggcccuga

SEQ ID NO: 2748475 - RNA, 13 nt, Human
ucuguccagggcc

SEQ ID NO: 2748476 - RNA, 22 nt, Human
ucuuagaugcaguucugaagaa

SEQ ID NO: 2748477 - RNA, 23 nt, Human
ucuuagaugcaguucugaagaag

SEQ ID NO: 2748478 - RNA, 13 nt, Human
agacacuuuggaa

SEQ ID NO: 2748479 - RNA, 22 nt, Human
agaauucugcuaccucacuggg

SEQ ID NO: 2748480 - RNA, 20 nt, Human
agaauucugcuaccucacug

SEQ ID NO: 2748481 - RNA, 13 nt, Human
agaauucugcuac

SEQ ID NO: 2748482 - RNA, 17 nt, Human
agacacacugaagaagc

SEQ ID NO: 2748483 - RNA, 16 nt, Human
agacacacugaagaag

SEQ ID NO: 2748484 - RNA, 16 nt, Human
acuuguguuuugcaag

SEQ ID NO: 2748485 - RNA, 13 nt, Human
ucucaccuggacu

SEQ ID NO: 2748486 - RNA, 24 nt, Human
ucucaccuggacuuaagcaucugg

SEQ ID NO: 2748487 - RNA, 23 nt, Human
acuucuaaguaaaaccacagcag

SEQ ID NO: 2748488 - RNA, 16 nt, Human
acuugucaauaaaauc

SEQ ID NO: 2748489 - RNA, 20 nt, Human
acuugaacccgggaggcaga

SEQ ID NO: 2748490 - RNA, 19 nt, Human
acuugaacccgggaggcag

SEQ ID NO: 2748491 - RNA, 21 nt, Human
acuugaacccauauuuguaca

SEQ ID NO: 2748492 - RNA, 12 nt, Human
ucucuggccuuc

SEQ ID NO: 2748493 - RNA, 19 nt, Human
agaaacaguugguaacuuu

SEQ ID NO: 2748494 - RNA, 17 nt, Human
agaaacaguugguaacu

SEQ ID NO: 2748495 - RNA, 18 nt, Human
agaaacaguugguaacuu

SEQ ID NO: 2748496 - RNA, 23 nt, Human
ucucuggccuucggccuccaucc

SEQ ID NO: 2748497 - RNA, 22 nt, Human
ucucuggccuucggccuccauc

SEQ ID NO: 2748498 - RNA, 21 nt, Human
ucucuggccuucggccuccau

SEQ ID NO: 2748499 - RNA, 12 nt, Human
ucugaagaagau

SEQ ID NO: 2748500 - RNA, 22 nt, Human
ucggguuuuauuguuuaaaauc

SEQ ID NO: 2748501 - RNA, 13 nt, Human
acuguguaauuag

SEQ ID NO: 2748502 - RNA, 18 nt, Human
acuguggguagacacaca

SEQ ID NO: 2748503 - RNA, 21 nt, Human
acugucagcuccccucggaga

SEQ ID NO: 2748504 - RNA, 18 nt, Human
acugggacaggggagaac

SEQ ID NO: 2748505 - RNA, 17 nt, Human
acuuaagcaucuggcuc

SEQ ID NO: 2748506 - RNA, 20 nt, Human
acuuaagcaucuggcucuaa

SEQ ID NO: 2748507 - RNA, 21 nt, Human
acuuaagcaucuggcucuaau

SEQ ID NO: 2748508 - RNA, 23 nt, Human
ucuaaguaaaaccacagcaguug

SEQ ID NO: 2748509 - RNA, 16 nt, Human
ucuacauacuauggaa

SEQ ID NO: 2748510 - RNA, 20 nt, Human
ucuaaguaaaaccacagcag

SEQ ID NO: 2748511 - RNA, 21 nt, Human
ucuaaguaaaaccacagcagu

SEQ ID NO: 2748512 - RNA, 22 nt, Human
ucuaaguaaaaccacagcaguu

SEQ ID NO: 2748513 - RNA, 20 nt, Human
ucuaaagccauuguaguccu

SEQ ID NO: 2748514 - RNA, 13 nt, Human
acuggcacaguuu

SEQ ID NO: 2748515 - RNA, 19 nt, Human
acuggcacaguuuucugag

SEQ ID NO: 2748516 - RNA, 20 nt, Human
acuggcacaguuuucugaga

SEQ ID NO: 2748517 - RNA, 18 nt, Human
acugcucuaacagcccuc

SEQ ID NO: 2748518 - RNA, 19 nt, Human
acugccuucucaacuccaa

SEQ ID NO: 2748519 - RNA, 13 nt, Human
acugccuucucaa

SEQ ID NO: 2748520 - RNA, 15 nt, Human
acugcauuauauuua

SEQ ID NO: 2748521 - RNA, 14 nt, Human
acugcauuauauuu

SEQ ID NO: 2748522 - RNA, 15 nt, Human
uccuuguauuuaaau

SEQ ID NO: 2748523 - RNA, 18 nt, Human
ucgcuccaccuugcagcu

SEQ ID NO: 2748524 - RNA, 22 nt, Human
uccaacccgucuggcccaccag

SEQ ID NO: 2748525 - RNA, 23 nt, Human
uccaacccgucuggcccaccagg

SEQ ID NO: 2748526 - RNA, 21 nt, Human
uccaacuaucucauuuccaag

SEQ ID NO: 2748527 - RNA, 19 nt, Human
acgagcaggcuacugucag

SEQ ID NO: 2748528 - RNA, 20 nt, Human
acgagcaggcuacugucagc

SEQ ID NO: 2748529 - RNA, 14 nt, Human
acgagaaaacaaua

SEQ ID NO: 2748530 - RNA, 14 nt, Human
ucauccucaaagaa

SEQ ID NO: 2748531 - RNA, 15 nt, Human
ucauccgaggcaggg

SEQ ID NO: 2748532 - RNA, 14 nt, Human
ucauccgaggcagg

SEQ ID NO: 2748533 - RNA, 13 nt, Human
accucccugcaau

SEQ ID NO: 2748534 - RNA, 12 nt, Human
accucccugcaa

SEQ ID NO: 2748535 - RNA, 17 nt, Human
ucauccucaaagaaagu

SEQ ID NO: 2748536 - RNA, 18 nt, Human
ucauccucaaagaaagug

SEQ ID NO: 2748537 - RNA, 21 nt, Human
ucauccucaaagaaaguguau

SEQ ID NO: 2748538 - RNA, 22 nt, Human
ucauccucaaagaaaguguauu

SEQ ID NO: 2748539 - RNA, 23 nt, Human
ucauccucaaagaaaguguauug

SEQ ID NO: 2748540 - RNA, 16 nt, Human
ucaugaauuaguuuua

SEQ ID NO: 2748541 - RNA, 22 nt, Human
ucaggaaaucaaauaugcaaag

SEQ ID NO: 2748542 - RNA, 23 nt, Human
ucaggaaaucaaauaugcaaagc

SEQ ID NO: 2748543 - RNA, 16 nt, Human
accuagggugauauua

SEQ ID NO: 2748544 - RNA, 21 nt, Human
accuagggugauauuaaccag

SEQ ID NO: 2748545 - RNA, 20 nt, Human
accugacuauugaaguugca

SEQ ID NO: 2748546 - RNA, 21 nt, Human
ucccugguaauaaguacugug

SEQ ID NO: 2748547 - RNA, 18 nt, Human
acuccagaaagugacaag

SEQ ID NO: 2748548 - RNA, 21 nt, Human
acuccaaagaaauguaaggga

SEQ ID NO: 2748549 - RNA, 15 nt, Human
acuccaaagaaaugu

SEQ ID NO: 2748550 - RNA, 18 nt, Human
acuccaaagaaauguaag

SEQ ID NO: 2748551 - RNA, 14 nt, Human
acuccaaagaaaug

SEQ ID NO: 2748552 - RNA, 11 nt, Human
ucccugagcag

SEQ ID NO: 2748553 - RNA, 16 nt, Human
ucccucccuccaccuc

SEQ ID NO: 2748554 - RNA, 15 nt, Human
ucccucccuccaccu

SEQ ID NO: 2748555 - RNA, 23 nt, Human
ucccuccaccucccugcaauaaa

SEQ ID NO: 2748556 - RNA, 21 nt, Human
ucccuccaccucccugcaaua

SEQ ID NO: 2748557 - RNA, 14 nt, Human
ucccucccuccacc

SEQ ID NO: 2748558 - RNA, 13 nt, Human
ucccucccuccac

SEQ ID NO: 2748559 - RNA, 17 nt, Human
uccccucggagaagagc

SEQ ID NO: 2748560 - RNA, 16 nt, Human
uccccucggagaagag

SEQ ID NO: 2748561 - RNA, 17 nt, Human
uccccuugcccagggcu

SEQ ID NO: 2748562 - RNA, 24 nt, Human
uccccuugcccagggcucagccug

SEQ ID NO: 2748563 - RNA, 22 nt, Human
uccccuugcccagggcucagcc

SEQ ID NO: 2748564 - RNA, 20 nt, Human
uccccuugcccagggcucag

SEQ ID NO: 2748565 - RNA, 17 nt, Human
acuaacauguccugccu

SEQ ID NO: 2748566 - RNA, 18 nt, Human
ucccagccagcaguucag

SEQ ID NO: 2748567 - RNA, 17 nt, Human
ucccagccagcaguuca

SEQ ID NO: 2748568 - RNA, 14 nt, Human
ucccagucauuuaa

SEQ ID NO: 2748569 - RNA, 22 nt, Human
ucccagucauuuaauaaaugug

SEQ ID NO: 2748570 - RNA, 13 nt, Human
uccaugaagaugu

SEQ ID NO: 2748571 - RNA, 21 nt, Human
uccaugaagauguagaggaga

SEQ ID NO: 2748572 - RNA, 21 nt, Human
uccauccugaggcuccacuug

SEQ ID NO: 2748573 - RNA, 20 nt, Human
uccauccugaggcuccacuu

SEQ ID NO: 2748574 - RNA, 19 nt, Human
uccauccugaggcuccacu

SEQ ID NO: 2748575 - RNA, 20 nt, Human
ucaggaaaucaaauaugcaa

SEQ ID NO: 2748576 - RNA, 21 nt, Human
ucaggaaaucaaauaugcaaa

SEQ ID NO: 2748577 - RNA, 19 nt, Human
ucaggaaagagaacuucca

SEQ ID NO: 2748578 - RNA, 13 nt, Human
ucaggaaagagaa

SEQ ID NO: 2748579 - RNA, 21 nt, Human
ucagccuagccgaccucagcc

SEQ ID NO: 2748580 - RNA, 20 nt, Human
ucagccuagccgaccucagc

SEQ ID NO: 2748581 - RNA, 19 nt, Human
ucagccuagccgaccucag

SEQ ID NO: 2748582 - RNA, 18 nt, Human
ucagccuagccgaccuca

SEQ ID NO: 2748583 - RNA, 12 nt, Human
ucagagcugccc

SEQ ID NO: 2748584 - RNA, 21 nt, Human
ucagccaacgaguaauuuauu

SEQ ID NO: 2748585 - RNA, 18 nt, Human
ucagaagucaucuugcua

SEQ ID NO: 2748586 - RNA, 22 nt, Human
ucagaagucaucuugcuaccag

SEQ ID NO: 2748587 - RNA, 15 nt, Human
ucagaagucaucuug

SEQ ID NO: 2748588 - RNA, 23 nt, Human
accauuucuugagguaaaagcau

SEQ ID NO: 2748589 - RNA, 15 nt, Human
accaaucaugaauua

SEQ ID NO: 2748590 - RNA, 13 nt, Human
accaaucaugaau

SEQ ID NO: 2748591 - RNA, 20 nt, Human
ucaauuuuucuuauuucauu

SEQ ID NO: 2748592 - RNA, 23 nt, Human
ucaauuuuucuuauuucauuucu

SEQ ID NO: 2748593 - RNA, 15 nt, Human
ucaauucuugccaaa

SEQ ID NO: 2748594 - RNA, 17 nt, Human
accagaaaagcccaagu

SEQ ID NO: 2748595 - RNA, 18 nt, Human
accacuuguguuuugcaa

SEQ ID NO: 2748596 - RNA, 15 nt, Human
accacuucagggcuu

SEQ ID NO: 2748597 - RNA, 14 nt, Human
accagggacugagg

SEQ ID NO: 2748598 - RNA, 19 nt, Human
acauauauaacaaugcugu

SEQ ID NO: 2748599 - RNA, 18 nt, Human
acauagaauuaacacaug

SEQ ID NO: 2748600 - RNA, 14 nt, Human
acauagaauuaaca

SEQ ID NO: 2748601 - RNA, 13 nt, Human
acaucaacagaua

SEQ ID NO: 2748602 - RNA, 24 nt, Human
acaguugguaacuuuugugaauua

SEQ ID NO: 2748603 - RNA, 15 nt, Human
acaguugguaacuuu

SEQ ID NO: 2748604 - RNA, 16 nt, Human
acaguugguaacuuuu

SEQ ID NO: 2748605 - RNA, 14 nt, Human
acaguugguaacuu

SEQ ID NO: 2748606 - RNA, 13 nt, Human
uauuucauuucuu

SEQ ID NO: 2748607 - RNA, 18 nt, Human
acaguuuucugagaaaga

SEQ ID NO: 2748608 - RNA, 19 nt, Human
acaguuuucugagaaagac

SEQ ID NO: 2748609 - RNA, 20 nt, Human
acaguuuucugagaaagacu

SEQ ID NO: 2748610 - RNA, 21 nt, Human
acaguuuucugagaaagacua

SEQ ID NO: 2748611 - RNA, 16 nt, Human
acaguuuucugagaaa

SEQ ID NO: 2748612 - RNA, 17 nt, Human
acaguuuucugagaaag

SEQ ID NO: 2748613 - RNA, 15 nt, Human
acaguuuucugagaa

SEQ ID NO: 2748614 - RNA, 22 nt, Human
ucaagaugaugaugaucuuuaa

SEQ ID NO: 2748615 - RNA, 14 nt, Human
ucaaggcuuagacc

SEQ ID NO: 2748616 - RNA, 14 nt, Human
acaugcugaacauc

SEQ ID NO: 2748617 - RNA, 21 nt, Human
acaugcugaacaucacagcuu

SEQ ID NO: 2748618 - RNA, 23 nt, Human
acauguccugccuauuaucuguc

SEQ ID NO: 2748619 - RNA, 15 nt, Human
acaugucccuacacc

SEQ ID NO: 2748620 - RNA, 21 nt, Human
ucaaaauaugccccauucaac

SEQ ID NO: 2748621 - RNA, 23 nt, Human
ucaaaauaccaugccauuuaaag

SEQ ID NO: 2748622 - RNA, 21 nt, Human
ucaaaauaccaugccauuuaa

SEQ ID NO: 2748623 - RNA, 18 nt, Human
ucaaaagaaagaaaauca

SEQ ID NO: 2748624 - RNA, 14 nt, Human
ucaaagcugaaaug

SEQ ID NO: 2748625 - RNA, 19 nt, Human
acaugauccugcaauucca

SEQ ID NO: 2748626 - RNA, 15 nt, Human
uauauuuauuacugu

SEQ ID NO: 2748627 - RNA, 19 nt, Human
uauauuuauuacuguaaga

SEQ ID NO: 2748628 - RNA, 21 nt, Human
acagcccuucuuuccacagaa

SEQ ID NO: 2748629 - RNA, 20 nt, Human
acagcccuucuuuccacaga

SEQ ID NO: 2748630 - RNA, 15 nt, Human
acacuuaaaaauggu

SEQ ID NO: 2748631 - RNA, 13 nt, Human
acacuuaaaaaug

SEQ ID NO: 2748632 - RNA, 12 nt, Human
uauauuuacaaa

SEQ ID NO: 2748633 - RNA, 14 nt, Human
acacugaagaagca

SEQ ID NO: 2748634 - RNA, 12 nt, Human
acacugaagaag

SEQ ID NO: 2748635 - RNA, 14 nt, Human
acacuccagugaga

SEQ ID NO: 2748636 - RNA, 23 nt, Human
uauaaaauaauuuuuauauuuga

SEQ ID NO: 2748637 - RNA, 18 nt, Human
acacaugcugaacaucac

SEQ ID NO: 2748638 - RNA, 16 nt, Human
acaccccuccccugcc

SEQ ID NO: 2748639 - RNA, 23 nt, Human
acaccccuccccugcccuagagc

SEQ ID NO: 2748640 - RNA, 14 nt, Human
uauaacuaacaugu

SEQ ID NO: 2748641 - RNA, 19 nt, Human
acacuaagagagaaugaga

SEQ ID NO: 2748642 - RNA, 18 nt, Human
acacuaagagagaaugag

SEQ ID NO: 2748643 - RNA, 17 nt, Human
acacuaagagagaauga

SEQ ID NO: 2748644 - RNA, 12 nt, Human
uaguguuggaga

SEQ ID NO: 2748645 - RNA, 17 nt, Human
uaguguuggagaagaac

SEQ ID NO: 2748646 - RNA, 16 nt, Human
uaguguuggagaagaa

SEQ ID NO: 2748647 - RNA, 20 nt, Human
acacaggcaacugaggcaga

SEQ ID NO: 2748648 - RNA, 19 nt, Human
acacaggcaacugaggcag

SEQ ID NO: 2748649 - RNA, 16 nt, Human
acacaggcaacugagg

SEQ ID NO: 2748650 - RNA, 15 nt, Human
acacaggcaacugag

SEQ ID NO: 2748651 - RNA, 14 nt, Human
acacacugaagaag

SEQ ID NO: 2748652 - RNA, 17 nt, Human
acaaugcuguauuuuaa

SEQ ID NO: 2748653 - RNA, 14 nt, Human
acaaugcuguauuu

SEQ ID NO: 2748654 - RNA, 19 nt, Human
uagcuuagaccucagccug

SEQ ID NO: 2748655 - RNA, 18 nt, Human
uagcuuagaccucagccu

SEQ ID NO: 2748656 - RNA, 17 nt, Human
uagcuuagaccucagcc

SEQ ID NO: 2748657 - RNA, 16 nt, Human
uagcuuagaccucagc

SEQ ID NO: 2748658 - RNA, 23 nt, Human
uagcuuagaccucagccugugcu

SEQ ID NO: 2748659 - RNA, 20 nt, Human
uagcuuagaccucagccugu

SEQ ID NO: 2748660 - RNA, 17 nt, Human
acacaacuauauuguuu

SEQ ID NO: 2748661 - RNA, 14 nt, Human
acacaacuauauug

SEQ ID NO: 2748662 - RNA, 17 nt, Human
acacacaggcaacugag

SEQ ID NO: 2748663 - RNA, 20 nt, Human
acacacucaaaucaagaaac

SEQ ID NO: 2748664 - RNA, 13 nt, Human
acacacugaagaa

SEQ ID NO: 2748665 - RNA, 17 nt, Human
acacaccaggcgcuaau

SEQ ID NO: 2748666 - RNA, 14 nt, Human
acacaccaggcgcu

SEQ ID NO: 2748667 - RNA, 14 nt, Human
uacuaaaaauacaa

SEQ ID NO: 2748668 - RNA, 18 nt, Human
uacuaaaaauacaaaaaa

SEQ ID NO: 2748669 - RNA, 23 nt, Human
uacugggaaagggauuuucagcc

SEQ ID NO: 2748670 - RNA, 17 nt, Human
uacugagagugaacaaa

SEQ ID NO: 2748671 - RNA, 18 nt, Human
aauugaggacacugauau

SEQ ID NO: 2748672 - RNA, 19 nt, Human
aauuucucccagucauuua

SEQ ID NO: 2748673 - RNA, 12 nt, Human
aauuucuuaacu

SEQ ID NO: 2748674 - RNA, 15 nt, Human
aauuucuuaacuucu

SEQ ID NO: 2748675 - RNA, 16 nt, Human
aauuucuuaacuucuu

SEQ ID NO: 2748676 - RNA, 20 nt, Human
aauuucuuaacuucuugcuu

SEQ ID NO: 2748677 - RNA, 18 nt, Human
aauuuacagagacagaaa

SEQ ID NO: 2748678 - RNA, 17 nt, Human
aauuuacagagacagaa

SEQ ID NO: 2748679 - RNA, 19 nt, Human
uacuucuuaggguuaugau

SEQ ID NO: 2748680 - RNA, 16 nt, Human
uacuucaugcugucua

SEQ ID NO: 2748681 - RNA, 17 nt, Human
uagauaggccaugggca

SEQ ID NO: 2748682 - RNA, 22 nt, Human
uagauaggucagugcaaauacu

SEQ ID NO: 2748683 - RNA, 20 nt, Human
uagaugcaguucugaagaag

SEQ ID NO: 2748684 - RNA, 21 nt, Human
uagaugcaguucugaagaaga

SEQ ID NO: 2748685 - RNA, 21 nt, Human
aauuuuucuuauuucauuucu

SEQ ID NO: 2748686 - RNA, 22 nt, Human
aauuuuuucucuaggaaauauu

SEQ ID NO: 2748687 - RNA, 22 nt, Human
acaagcucacagaccuuugaac

SEQ ID NO: 2748688 - RNA, 17 nt, Human
acaaauuuacagagaca

SEQ ID NO: 2748689 - RNA, 15 nt, Human
uagcuuagaccucag

SEQ ID NO: 2748690 - RNA, 16 nt, Human
uagcuacuaauuuuaa

SEQ ID NO: 2748691 - RNA, 18 nt, Human
aauaggcguaacuaauuu

SEQ ID NO: 2748692 - RNA, 16 nt, Human
aauaggaauugguuuc

SEQ ID NO: 2748693 - RNA, 18 nt, Human
uaaccugucucaccugga

SEQ ID NO: 2748694 - RNA, 21 nt, Human
aauauccuaauaaaaagguga

SEQ ID NO: 2748695 - RNA, 15 nt, Human
aauauccuaauaaaa

SEQ ID NO: 2748696 - RNA, 19 nt, Human
aauauccuaauaaaaaggu

SEQ ID NO: 2748697 - RNA, 12 nt, Human
aauaucacuugu

SEQ ID NO: 2748698 - RNA, 15 nt, Human
aauaucacuugucaa

SEQ ID NO: 2748699 - RNA, 12 nt, Human
aauauccuaaua

SEQ ID NO: 2748700 - RNA, 13 nt, Human
aauauccuaauaa

SEQ ID NO: 2748701 - RNA, 14 nt, Human
aauauccuaauaaa

SEQ ID NO: 2748702 - RNA, 15 nt, Human
aauaugcaaagcacu

SEQ ID NO: 2748703 - RNA, 17 nt, Human
aauaugcaaagcacuga

SEQ ID NO: 2748704 - RNA, 24 nt, Human
aauaugcaaagcacugacuucuaa

SEQ ID NO: 2748705 - RNA, 20 nt, Human
aaucagaagucaucuugcua

SEQ ID NO: 2748706 - RNA, 24 nt, Human
aaucagaagucaucuugcuaccag

SEQ ID NO: 2748707 - RNA, 14 nt, Human
aauauuucagauaa

SEQ ID NO: 2748708 - RNA, 15 nt, Human
aauauuucagauaau

SEQ ID NO: 2748709 - RNA, 16 nt, Human
uaacuaacauguccug

SEQ ID NO: 2748710 - RNA, 13 nt, Human
uaacuacuuuaua

SEQ ID NO: 2748711 - RNA, 19 nt, Human
aauaucuuuuuuuuaauaa

SEQ ID NO: 2748712 - RNA, 12 nt, Human
aauaaaaaggug

SEQ ID NO: 2748713 - RNA, 13 nt, Human
aauaaaaagguga

SEQ ID NO: 2748714 - RNA, 16 nt, Human
aauaaaaaggugacca

SEQ ID NO: 2748715 - RNA, 17 nt, Human
aauaaagucagauggaa

SEQ ID NO: 2748716 - RNA, 21 nt, Human
aauaacaaugaaaguugauaa

SEQ ID NO: 2748717 - RNA, 16 nt, Human
aauaauuuuuauauuu

SEQ ID NO: 2748718 - RNA, 19 nt, Human
aauaauuuuuauauuugaa

SEQ ID NO: 2748719 - RNA, 17 nt, Human
aauaauuuuuauauuug

SEQ ID NO: 2748720 - RNA, 20 nt, Human
aauaauuuuuauauuugaaa

SEQ ID NO: 2748721 - RNA, 11 nt, Human
aaugugauaug

SEQ ID NO: 2748722 - RNA, 19 nt, Human
aauggacuuuuguacauag

SEQ ID NO: 2748723 - RNA, 19 nt, Human
uacacuaagagagaaugag

SEQ ID NO: 2748724 - RNA, 18 nt, Human
uacacuaagagagaauga

SEQ ID NO: 2748725 - RNA, 18 nt, Human
uaauucaaggaauuucuu

SEQ ID NO: 2748726 - RNA, 20 nt, Human
uaauucaaggaauuucuuaa

SEQ ID NO: 2748727 - RNA, 22 nt, Human
uaauucaaggaauuucuuaacu

SEQ ID NO: 2748728 - RNA, 13 nt, Human
uacaaaaacacag

SEQ ID NO: 2748729 - RNA, 14 nt, Human
uacaaaaacacagc

SEQ ID NO: 2748730 - RNA, 20 nt, Human
uaauuuauuguuuuuccuug

SEQ ID NO: 2748731 - RNA, 15 nt, Human
uacaaaaacacagca

SEQ ID NO: 2748732 - RNA, 23 nt, Human
aaucuuaguguaugauuacuggc

SEQ ID NO: 2748733 - RNA, 14 nt, Human
aaucuuauaauuua

SEQ ID NO: 2748734 - RNA, 16 nt, Human
aaucuuauaauuuaaa

SEQ ID NO: 2748735 - RNA, 13 nt, Human
aauccuugaagau

SEQ ID NO: 2748736 - RNA, 15 nt, Human
aaucaucaagucuuu

SEQ ID NO: 2748737 - RNA, 17 nt, Human
aaucaugaauuaguuuu

SEQ ID NO: 2748738 - RNA, 19 nt, Human
aaucaugaauuaguuuuau

SEQ ID NO: 2748739 - RNA, 23 nt, Human
aaucaugaauuaguuuuauaugc

SEQ ID NO: 2748740 - RNA, 14 nt, Human
uaaguacuguguac

SEQ ID NO: 2748741 - RNA, 16 nt, Human
uaaugauaacuggaaa

SEQ ID NO: 2748742 - RNA, 21 nt, Human
aaugagagacacacugaagaa

SEQ ID NO: 2748743 - RNA, 22 nt, Human
guggacccagggaugacauguc

SEQ ID NO: 2748744 - RNA, 18 nt, Human
aagaaugauuaugaauua

SEQ ID NO: 2748745 - RNA, 22 nt, Human
guggcacucagucucucuucuc

SEQ ID NO: 2748746 - RNA, 16 nt, Human
aagaaugauuaugaau

SEQ ID NO: 2748747 - RNA, 18 nt, Human
gugcuaguaauuggaaag

SEQ ID NO: 2748748 - RNA, 22 nt, Human
aagaagugaaaaucuacacucc

SEQ ID NO: 2748749 - RNA, 16 nt, Human
aagaagugaaaaucua

SEQ ID NO: 2748750 - RNA, 18 nt, Human
guggugggacagggaccc

SEQ ID NO: 2748751 - RNA, 15 nt, Human
guggguggggcagug

SEQ ID NO: 2748752 - RNA, 21 nt, Human
gugggacagucaccucaugga

SEQ ID NO: 2748753 - RNA, 15 nt, Human
aagacuguggcugcu

SEQ ID NO: 2748754 - RNA, 12 nt, Human
aagacuguggcu

SEQ ID NO: 2748755 - RNA, 19 nt, Human
aagagcuguucacagccag

SEQ ID NO: 2748756 - RNA, 18 nt, Human
aagacuguggcugcuagc

SEQ ID NO: 2748757 - RNA, 14 nt, Human
gugguuucauguua

SEQ ID NO: 2748758 - RNA, 21 nt, Human
gugugaccacugcagaagaca

SEQ ID NO: 2748759 - RNA, 13 nt, Human
guuagggaggggu

SEQ ID NO: 2748760 - RNA, 11 nt, Human
guuagggaggg

SEQ ID NO: 2748761 - RNA, 17 nt, Human
guuaguuaccuuauagu

SEQ ID NO: 2748762 - RNA, 22 nt, Human
guuaguuaccuuauaguuacug

SEQ ID NO: 2748763 - RNA, 23 nt, Human
guuaguuaccuuauaguuacugu

SEQ ID NO: 2748764 - RNA, 13 nt, Human
guuauuuaaauga

SEQ ID NO: 2748765 - RNA, 11 nt, Human
guuauuuaaau

SEQ ID NO: 2748766 - RNA, 15 nt, Human
guuauuuaaaugagu

SEQ ID NO: 2748767 - RNA, 13 nt, Human
guugacaugggac

SEQ ID NO: 2748768 - RNA, 18 nt, Human
guugacaugggacauuug

SEQ ID NO: 2748769 - RNA, 14 nt, Human
guugacaugggaca

SEQ ID NO: 2748770 - RNA, 13 nt, Human
guucccucccaga

SEQ ID NO: 2748771 - RNA, 23 nt, Human
aagcuuguauuccuuuuucucuc

SEQ ID NO: 2748772 - RNA, 23 nt, Human
guuuucugagaaagacuauucaa

SEQ ID NO: 2748773 - RNA, 21 nt, Human
guuucaaacauauauaacaau

SEQ ID NO: 2748774 - RNA, 10 nt, Human
guuuaaaauc

SEQ ID NO: 2748775 - RNA, 16 nt, Human
guuuaaaaucauuucu

SEQ ID NO: 2748776 - RNA, 13 nt, Human
guuuaaagaaagu

SEQ ID NO: 2748777 - RNA, 22 nt, Human
guuuauuaaucuuaguguauga

SEQ ID NO: 2748778 - RNA, 20 nt, Human
guuuauuaaucuuaguguau

SEQ ID NO: 2748779 - RNA, 21 nt, Human
guuuauuaaucuuaguguaug

SEQ ID NO: 2748780 - RNA, 14 nt, Human
guuuauuaaucuua

SEQ ID NO: 2748781 - RNA, 18 nt, Human
guuuauuaaucuuagugu

SEQ ID NO: 2748782 - RNA, 18 nt, Human
guuguaccgcaaugugac

SEQ ID NO: 2748783 - RNA, 20 nt, Human
aacccauauuuguacaccaa

SEQ ID NO: 2748784 - RNA, 13 nt, Human
aacccaaauguuc

SEQ ID NO: 2748785 - RNA, 18 nt, Human
aacccaaauguucaucaa

SEQ ID NO: 2748786 - RNA, 20 nt, Human
aaccuagggugauauuaacc

SEQ ID NO: 2748787 - RNA, 12 nt, Human
aaccacagcagu

SEQ ID NO: 2748788 - RNA, 22 nt, Human
gucuuaauuaaaagaauauuuu

SEQ ID NO: 2748789 - RNA, 19 nt, Human
gucuuaauuaaaagaauau

SEQ ID NO: 2748790 - RNA, 21 nt, Human
gucuuaauuaaaagaauauuu

SEQ ID NO: 2748791 - RNA, 15 nt, Human
gugaacacaucagcu

SEQ ID NO: 2748792 - RNA, 18 nt, Human
aacucguuaauuuguagu

SEQ ID NO: 2748793 - RNA, 14 nt, Human
aacucccuuucaac

SEQ ID NO: 2748794 - RNA, 13 nt, Human
aacucccuuucaa

SEQ ID NO: 2748795 - RNA, 21 nt, Human
aacuccagaaagugacaagcu

SEQ ID NO: 2748796 - RNA, 14 nt, Human
aacuccagaaagug

SEQ ID NO: 2748797 - RNA, 24 nt, Human
guccaagcauaccaacacgagcag

SEQ ID NO: 2748798 - RNA, 21 nt, Human
guccaagcauuuagauguaua

SEQ ID NO: 2748799 - RNA, 15 nt, Human
aacaaggaugaauua

SEQ ID NO: 2748800 - RNA, 21 nt, Human
aacaagccuccuuuuaaagua

SEQ ID NO: 2748801 - RNA, 22 nt, Human
aacaguugguaacuuuugugaa

SEQ ID NO: 2748802 - RNA, 21 nt, Human
aacaguugguaacuuuuguga

SEQ ID NO: 2748803 - RNA, 22 nt, Human
aacaguagugauaguuguaccg

SEQ ID NO: 2748804 - RNA, 18 nt, Human
aacauuugguaaggggaa

SEQ ID NO: 2748805 - RNA, 19 nt, Human
aaauggcuuccuggcaaua

SEQ ID NO: 2748806 - RNA, 14 nt, Human
aaaugcauuucuaa

SEQ ID NO: 2748807 - RNA, 18 nt, Human
aaaugaguguguuuguca

SEQ ID NO: 2748808 - RNA, 12 nt, Human
aaaugagugugu

SEQ ID NO: 2748809 - RNA, 22 nt, Human
aaaugaaagcagggacuugaac

SEQ ID NO: 2748810 - RNA, 21 nt, Human
aaaugaaagcagggacuugaa

SEQ ID NO: 2748811 - RNA, 14 nt, Human
aaauccuugaagau

SEQ ID NO: 2748812 - RNA, 19 nt, Human
aaaucuacacuccagugag

SEQ ID NO: 2748813 - RNA, 14 nt, Human
guaugauucccagc

SEQ ID NO: 2748814 - RNA, 21 nt, Human
guaugauuacuggccuuuuuc

SEQ ID NO: 2748815 - RNA, 22 nt, Human
aaauguaagggaaacugccagc

SEQ ID NO: 2748816 - RNA, 17 nt, Human
aaauucccguuuuguca

SEQ ID NO: 2748817 - RNA, 13 nt, Human
aaauucauuuuuu

SEQ ID NO: 2748818 - RNA, 19 nt, Human
aaauucauuuuuuaaauuc

SEQ ID NO: 2748819 - RNA, 17 nt, Human
aaauuucagcagcugca

SEQ ID NO: 2748820 - RNA, 18 nt, Human
aaauuucagcagcugcag

SEQ ID NO: 2748821 - RNA, 11 nt, Human
caccaguucuc

SEQ ID NO: 2748822 - RNA, 20 nt, Human
caccaguucucauggguggc

SEQ ID NO: 2748823 - RNA, 22 nt, Human
caccaggguccuuuugacacug

SEQ ID NO: 2748824 - RNA, 19 nt, Human
cacaggcaacugaggcaga

SEQ ID NO: 2748825 - RNA, 18 nt, Human
cacaggcaacugaggcag

SEQ ID NO: 2748826 - RNA, 17 nt, Human
cacaggcaacugaggca

SEQ ID NO: 2748827 - RNA, 14 nt, Human
cacaggcaacugag

SEQ ID NO: 2748828 - RNA, 13 nt, Human
cacaggcaacuga

SEQ ID NO: 2748829 - RNA, 21 nt, Human
cacaguuuucugagaaagacu

SEQ ID NO: 2748830 - RNA, 22 nt, Human
cacaguuuucugagaaagacua

SEQ ID NO: 2748831 - RNA, 20 nt, Human
cacaguuuucugagaaagac

SEQ ID NO: 2748832 - RNA, 16 nt, Human
cacaugaaguccaagc

SEQ ID NO: 2748833 - RNA, 20 nt, Human
cacaugaaguccaagcauuu

SEQ ID NO: 2748834 - RNA, 17 nt, Human
cacaugaaguccaagca

SEQ ID NO: 2748835 - RNA, 21 nt, Human
caauauccuaauaaaaaggug

SEQ ID NO: 2748836 - RNA, 20 nt, Human
caauauccuaauaaaaaggu

SEQ ID NO: 2748837 - RNA, 15 nt, Human
caauauccuaauaaa

SEQ ID NO: 2748838 - RNA, 16 nt, Human
caauauccuaauaaaa

SEQ ID NO: 2748839 - RNA, 18 nt, Human
caauauccuaauaaaaag

SEQ ID NO: 2748840 - RNA, 19 nt, Human
caauauccuaauaaaaagg

SEQ ID NO: 2748841 - RNA, 12 nt, Human
caauauccuaau

SEQ ID NO: 2748842 - RNA, 13 nt, Human
caauauccuaaua

SEQ ID NO: 2748843 - RNA, 14 nt, Human
caauauccuaauaa

SEQ ID NO: 2748844 - RNA, 18 nt, Human
cacaccaggcgcuaauuc

SEQ ID NO: 2748845 - RNA, 15 nt, Human
cacaagaaaugaaag

SEQ ID NO: 2748846 - RNA, 13 nt, Human
cacaagaaaugaa

SEQ ID NO: 2748847 - RNA, 23 nt, Human
cacaagacccaaaaggcagaagc

SEQ ID NO: 2748848 - RNA, 23 nt, Human
cacaagaaaugaaagcagggacu

SEQ ID NO: 2748849 - RNA, 23 nt, Human
caacugggguggguggggcagug

SEQ ID NO: 2748850 - RNA, 23 nt, Human
caaauuuacagagacagaaagca

SEQ ID NO: 2748851 - RNA, 17 nt, Human
caaauuuacagagacag

SEQ ID NO: 2748852 - RNA, 16 nt, Human
caaauuuacagagaca

SEQ ID NO: 2748853 - RNA, 20 nt, Human
caaggguucagagacucagg

SEQ ID NO: 2748854 - RNA, 19 nt, Human
caaggguucagagacucag

SEQ ID NO: 2748855 - RNA, 14 nt, Human
caagguacucuggu

SEQ ID NO: 2748856 - RNA, 16 nt, Human
caagguacucugguga

SEQ ID NO: 2748857 - RNA, 19 nt, Human
caagcauuuagauguauag

SEQ ID NO: 2748858 - RNA, 16 nt, Human
caagcauuuagaugua

SEQ ID NO: 2748859 - RNA, 21 nt, Human
caagcauaccaacacgagcag

SEQ ID NO: 2748860 - RNA, 16 nt, Human
caagcauaccaacacg

SEQ ID NO: 2748861 - RNA, 13 nt, Human
caagaaaugaaag

SEQ ID NO: 2748862 - RNA, 19 nt, Human
caagacugcacaucaaaau

SEQ ID NO: 2748863 - RNA, 16 nt, Human
caaagaguuaauauau

SEQ ID NO: 2748864 - RNA, 14 nt, Human
caaagaaauguaag

SEQ ID NO: 2748865 - RNA, 16 nt, Human
caaagaaaguguauug

SEQ ID NO: 2748866 - RNA, 19 nt, Human
auuuuaauaauguuucaaa

SEQ ID NO: 2748867 - RNA, 18 nt, Human
auuuuaauaauguuucaa

SEQ ID NO: 2748868 - RNA, 14 nt, Human
uuuuucuguaccag

SEQ ID NO: 2748869 - RNA, 16 nt, Human
uuuuucuguaccaguu

SEQ ID NO: 2748870 - RNA, 19 nt, Human
uuuucggccccauguaucu

SEQ ID NO: 2748871 - RNA, 13 nt, Human
uuuuccugaaaac

SEQ ID NO: 2748872 - RNA, 20 nt, Human
uuuuauaugcuucuguuuua

SEQ ID NO: 2748873 - RNA, 15 nt, Human
uuuuauaugcuucug

SEQ ID NO: 2748874 - RNA, 20 nt, Human
uuuuauaucaauuuaaaaaa

SEQ ID NO: 2748875 - RNA, 10 nt, Human
uuuuauauuu

SEQ ID NO: 2748876 - RNA, 17 nt, Human
uuucuuaacuucuugcu

SEQ ID NO: 2748877 - RNA, 18 nt, Human
uuucuuaacuucuugcuu

SEQ ID NO: 2748878 - RNA, 21 nt, Human
uuucuuaacuucuugcuucuu

SEQ ID NO: 2748879 - RNA, 21 nt, Human
uuugcauagauucccugagca

SEQ ID NO: 2748880 - RNA, 14 nt, Human
uuugucacuuuuuc

SEQ ID NO: 2748881 - RNA, 15 nt, Human
uuugucacuuuuucu

SEQ ID NO: 2748882 - RNA, 21 nt, Human
uuuguauaaaauaauuuuuau

SEQ ID NO: 2748883 - RNA, 13 nt, Human
uuuguauaauugg

SEQ ID NO: 2748884 - RNA, 21 nt, Human
uuuguauaauuggauuuccua

SEQ ID NO: 2748885 - RNA, 20 nt, Human
uuuaucuauaauuuaccuaa

SEQ ID NO: 2748886 - RNA, 14 nt, Human
uuuaucuauaauuu

SEQ ID NO: 2748887 - RNA, 19 nt, Human
uuuaucuauaauuuaccua

SEQ ID NO: 2748888 - RNA, 20 nt, Human
uuuagaaacacaacuauauu

SEQ ID NO: 2748889 - RNA, 14 nt, Human
uuuagaagccaacu

SEQ ID NO: 2748890 - RNA, 22 nt, Human
uuuagaagccaacuaugauuau

SEQ ID NO: 2748891 - RNA, 12 nt, Human
uuuagaaacaca

SEQ ID NO: 2748892 - RNA, 22 nt, Human
uuucugagaaagacuauucaaa

SEQ ID NO: 2748893 - RNA, 15 nt, Human
uuucugagaaagacu

SEQ ID NO: 2748894 - RNA, 22 nt, Human
uuucauugacuaucaaacugaa

SEQ ID NO: 2748895 - RNA, 15 nt, Human
uuucagauaaucaca

SEQ ID NO: 2748896 - RNA, 15 nt, Human
uuucagcagcugcag

SEQ ID NO: 2748897 - RNA, 21 nt, Human
uuucagauaaucacaauacau

SEQ ID NO: 2748898 - RNA, 12 nt, Human
uucucuccagcu

SEQ ID NO: 2748899 - RNA, 23 nt, Human
uucucuccucuccccaugauguu

SEQ ID NO: 2748900 - RNA, 19 nt, Human
uucucuccagcugacuaaa

SEQ ID NO: 2748901 - RNA, 18 nt, Human
uucccuugaugaagaagu

SEQ ID NO: 2748902 - RNA, 12 nt, Human
uuccuagugaaa

SEQ ID NO: 2748903 - RNA, 19 nt, Human
uucggccuccauccugagg

SEQ ID NO: 2748904 - RNA, 18 nt, Human
uucggccuccauccugag

SEQ ID NO: 2748905 - RNA, 17 nt, Human
uucauuuaucuauaauu

SEQ ID NO: 2748906 - RNA, 18 nt, Human
uucauuuaucuauaauuu

SEQ ID NO: 2748907 - RNA, 19 nt, Human
uuccacuuauaggaauuga

SEQ ID NO: 2748908 - RNA, 20 nt, Human
uucagagacucagggcccca

SEQ ID NO: 2748909 - RNA, 15 nt, Human
uucagagacucaggg

SEQ ID NO: 2748910 - RNA, 23 nt, Human
uucagagcugcccucuccugggc

SEQ ID NO: 2748911 - RNA, 22 nt, Human
uucagagcugcccucuccuggg

SEQ ID NO: 2748912 - RNA, 21 nt, Human
uucagagcugcccucuccugg

SEQ ID NO: 2748913 - RNA, 21 nt, Human
uucagagacucagggccccag

SEQ ID NO: 2748914 - RNA, 12 nt, Human
uugaugaagaag

SEQ ID NO: 2748915 - RNA, 18 nt, Human
uugcauagauucccugag

SEQ ID NO: 2748916 - RNA, 17 nt, Human
uugacuaucaaacugaa

SEQ ID NO: 2748917 - RNA, 14 nt, Human
uugaggacacugau

SEQ ID NO: 2748918 - RNA, 15 nt, Human
uugaggacacugaua

SEQ ID NO: 2748919 - RNA, 23 nt, Human
uugaaacugagaugugaacacau

SEQ ID NO: 2748920 - RNA, 16 nt, Human
uugaaaagacuccaaa

SEQ ID NO: 2748921 - RNA, 18 nt, Human
uugaaaagacuccaaaga

SEQ ID NO: 2748922 - RNA, 22 nt, Human
uugaaaagacuccaaagaaaug

SEQ ID NO: 2748923 - RNA, 23 nt, Human
uugaaaagacuccaaagaaaugu

SEQ ID NO: 2748924 - RNA, 15 nt, Human
uucuuauuucauuuc

SEQ ID NO: 2748925 - RNA, 15 nt, Human
uucugagaaagacua

SEQ ID NO: 2748926 - RNA, 14 nt, Human
uucugagcauuuaa

SEQ ID NO: 2748927 - RNA, 20 nt, Human
uugcugcaagcacagcccuu

SEQ ID NO: 2748928 - RNA, 13 nt, Human
uuggaaauaaagu

SEQ ID NO: 2748929 - RNA, 21 nt, Human
uuggaaauaaagucagaugga

SEQ ID NO: 2748930 - RNA, 16 nt, Human
uuguaaaggaauuuaa

SEQ ID NO: 2748931 - RNA, 11 nt, Human
uuguaaaugug

SEQ ID NO: 2748932 - RNA, 14 nt, Human
uuguaaaugugcuu

SEQ ID NO: 2748933 - RNA, 18 nt, Human
uuguaaaugugcuuuuaa

SEQ ID NO: 2748934 - RNA, 19 nt, Human
uuguaucacaaaucuuaac

SEQ ID NO: 2748935 - RNA, 14 nt, Human
uuguauuacaaauc

SEQ ID NO: 2748936 - RNA, 20 nt, Human
uuggccagaagucaaggcuu

SEQ ID NO: 2748937 - RNA, 12 nt, Human
uugggaggcuga

SEQ ID NO: 2748938 - RNA, 22 nt, Human
ugugaccacugcagaagacagu

SEQ ID NO: 2748939 - RNA, 22 nt, Human
ugucucaguccaugaagaugua

SEQ ID NO: 2748940 - RNA, 21 nt, Human
ugucucaguccaugaagaugu

SEQ ID NO: 2748941 - RNA, 16 nt, Human
ugucugccagccagca

SEQ ID NO: 2748942 - RNA, 15 nt, Human
ugucugccagccagc

SEQ ID NO: 2748943 - RNA, 19 nt, Human
ugucugccagccagcagcc

SEQ ID NO: 2748944 - RNA, 18 nt, Human
ugucugccagccagcagc

SEQ ID NO: 2748945 - RNA, 14 nt, Human
uguggcugcuagca

SEQ ID NO: 2748946 - RNA, 14 nt, Human
ugugcguccugucg

SEQ ID NO: 2748947 - RNA, 17 nt, Human
uguagauaauacaguuc

SEQ ID NO: 2748948 - RNA, 14 nt, Human
uguaaucacagcua

SEQ ID NO: 2748949 - RNA, 15 nt, Human
uguaaucacagcuac

SEQ ID NO: 2748950 - RNA, 16 nt, Human
uguaacuacuuuauaa

SEQ ID NO: 2748951 - RNA, 17 nt, Human
uguaacuacuuuauaac

SEQ ID NO: 2748952 - RNA, 18 nt, Human
uguaacuacuuuauaacu

SEQ ID NO: 2748953 - RNA, 12 nt, Human
uguauuuggaaa

SEQ ID NO: 2748954 - RNA, 13 nt, Human
uguauuuggaaau

SEQ ID NO: 2748955 - RNA, 21 nt, Human
uguauuuggaaauaaagucag

SEQ ID NO: 2748956 - RNA, 14 nt, Human
uguauaauuggauu

SEQ ID NO: 2748957 - RNA, 18 nt, Human
uguauaauuggauuuccu

SEQ ID NO: 2748958 - RNA, 19 nt, Human
uguauaauuggauuuccua

SEQ ID NO: 2748959 - RNA, 21 nt, Human
uguauaauuggauuuccuaau

SEQ ID NO: 2748960 - RNA, 16 nt, Human
uguaugauucccagcc

SEQ ID NO: 2748961 - RNA, 21 nt, Human
uguuggagaagaacugaaauc

SEQ ID NO: 2748962 - RNA, 13 nt, Human
uguuuaaaaucau

SEQ ID NO: 2748963 - RNA, 19 nt, Human
uguuaccaaaaauaaauau

SEQ ID NO: 2748964 - RNA, 23 nt, Human
uguuaccaaaaauaaauauaucu

SEQ ID NO: 2748965 - RNA, 12 nt, Human
uguuauaaucuu

SEQ ID NO: 2748966 - RNA, 20 nt, Human
uguuaguuaccuuauaguua

SEQ ID NO: 2748967 - RNA, 23 nt, Human
uguuaguuaccuuauaguuacug

SEQ ID NO: 2748968 - RNA, 14 nt, Human
uguuagugcaaauu

SEQ ID NO: 2748969 - RNA, 16 nt, Human
uguucacagccagacu

SEQ ID NO: 2748970 - RNA, 19 nt, Human
ugugugcguccugucggag

SEQ ID NO: 2748971 - RNA, 21 nt, Human
uuaccacuuguguuuugcaag

SEQ ID NO: 2748972 - RNA, 15 nt, Human
uuacauuuguauaaa

SEQ ID NO: 2748973 - RNA, 14 nt, Human
uuacauuuguauaa

SEQ ID NO: 2748974 - RNA, 20 nt, Human
uuacagagacagaaagcaga

SEQ ID NO: 2748975 - RNA, 22 nt, Human
uuaaugucaauucuugccaaau

SEQ ID NO: 2748976 - RNA, 16 nt, Human
uuaauaauguuucaaa

SEQ ID NO: 2748977 - RNA, 18 nt, Human
uuaauaauguuucaaaca

SEQ ID NO: 2748978 - RNA, 20 nt, Human
uguuuuuccuuguauuuaaa

SEQ ID NO: 2748979 - RNA, 20 nt, Human
uuaaagcuuauuaaaacuca

SEQ ID NO: 2748980 - RNA, 13 nt, Human
uuaaaagaaugau

SEQ ID NO: 2748981 - RNA, 19 nt, Human
uuaaaagaaugauuaugaa

SEQ ID NO: 2748982 - RNA, 19 nt, Human
uggcucuaauucacagugc

SEQ ID NO: 2748983 - RNA, 22 nt, Human
uggccuuuuucauuuaucuaua

SEQ ID NO: 2748984 - RNA, 16 nt, Human
uggccuuuuucauuua

SEQ ID NO: 2748985 - RNA, 19 nt, Human
uggccuuuuucauuuaucu

SEQ ID NO: 2748986 - RNA, 20 nt, Human
uggccuuuuucauuuaucua

SEQ ID NO: 2748987 - RNA, 18 nt, Human
uggccuucggccuccauc

SEQ ID NO: 2748988 - RNA, 17 nt, Human
uggccuucggccuccau

SEQ ID NO: 2748989 - RNA, 14 nt, Human
uggccuucggccuc

SEQ ID NO: 2748990 - RNA, 20 nt, Human
ugggacauuugcucauggaa

SEQ ID NO: 2748991 - RNA, 19 nt, Human
ugggacauuugcucaugga

SEQ ID NO: 2748992 - RNA, 21 nt, Human
ugggacagucaccucauggaa

SEQ ID NO: 2748993 - RNA, 20 nt, Human
ugggacagucaccucaugga

SEQ ID NO: 2748994 - RNA, 18 nt, Human
ugggacagucaccucaug

SEQ ID NO: 2748995 - RNA, 20 nt, Human
ugggccuccucuguccaggg

SEQ ID NO: 2748996 - RNA, 18 nt, Human
ugggccuccucuguccag

SEQ ID NO: 2748997 - RNA, 15 nt, Human
ugggcaguuuuuuga

SEQ ID NO: 2748998 - RNA, 16 nt, Human
ugggcaguuuuuugaa

SEQ ID NO: 2748999 - RNA, 23 nt, Human
uggggcagugcuuggcccaggag

SEQ ID NO: 2749000 - RNA, 20 nt, Human
uggggcagugcuuggcccag

SEQ ID NO: 2749001 - RNA, 22 nt, Human
uggggcagugcuuggcccagga

SEQ ID NO: 2749002 - RNA, 18 nt, Human
uggggcagugcuuggccc

SEQ ID NO: 2749003 - RNA, 16 nt, Human
uggguagacacacaug

SEQ ID NO: 2749004 - RNA, 17 nt, Human
uggguagacacacauga

SEQ ID NO: 2749005 - RNA, 17 nt, Human
uggccagaagucaaggc

SEQ ID NO: 2749006 - RNA, 15 nt, Human
ugcuucuuucuagaa

SEQ ID NO: 2749007 - RNA, 14 nt, Human
ugcuucuuucuaga

SEQ ID NO: 2749008 - RNA, 14 nt, Human
ugcuucuguuuuau

SEQ ID NO: 2749009 - RNA, 22 nt, Human
uggaaaaguauguuagugcaaa

SEQ ID NO: 2749010 - RNA, 14 nt, Human
uggaacucucgagc

SEQ ID NO: 2749011 - RNA, 15 nt, Human
ugcauuauauuuauu

SEQ ID NO: 2749012 - RNA, 20 nt, Human
ugcauuauauuuauuacugu

SEQ ID NO: 2749013 - RNA, 14 nt, Human
ugcauuauauuuau

SEQ ID NO: 2749014 - RNA, 19 nt, Human
ugcaucagcugcugaaaca

SEQ ID NO: 2749015 - RNA, 22 nt, Human
ugcaucagcugcugaaacaaca

SEQ ID NO: 2749016 - RNA, 20 nt, Human
ugccaucccucccuccaccu

SEQ ID NO: 2749017 - RNA, 19 nt, Human
ugccaucccucccuccacc

SEQ ID NO: 2749018 - RNA, 15 nt, Human
ugccaucccucccuc

SEQ ID NO: 2749019 - RNA, 22 nt, Human
ugccaucccucccuccaccucc

SEQ ID NO: 2749020 - RNA, 21 nt, Human
ugccaucccucccuccaccuc

SEQ ID NO: 2749021 - RNA, 15 nt, Human
ugcacaucaaaauau

SEQ ID NO: 2749022 - RNA, 16 nt, Human
ugcagauaaacaguag

SEQ ID NO: 2749023 - RNA, 13 nt, Human
ugcucuuuucucc

SEQ ID NO: 2749024 - RNA, 15 nt, Human
ugcucuuuucuccuc

SEQ ID NO: 2749025 - RNA, 21 nt, Human
ugcucuuuucuccucacugua

SEQ ID NO: 2749026 - RNA, 23 nt, Human
ugcucuuuucuccucacuguauc

SEQ ID NO: 2749027 - RNA, 20 nt, Human
ugcuagcacuuggagccaag

SEQ ID NO: 2749028 - RNA, 21 nt, Human
ugcuagaacucccuuucaaca

SEQ ID NO: 2749029 - RNA, 20 nt, Human
ugcuagaacucccuuucaac

SEQ ID NO: 2749030 - RNA, 18 nt, Human
ugcuagcacuuggagcca

SEQ ID NO: 2749031 - RNA, 18 nt, Human
ugcuagaacucccuuuca

SEQ ID NO: 2749032 - RNA, 19 nt, Human
ugcuagaacucccuuucaa

SEQ ID NO: 2749033 - RNA, 16 nt, Human
ugcgguuaauuuugaa

SEQ ID NO: 2749034 - RNA, 21 nt, Human
ugcgguuaauuuugaagugcu

SEQ ID NO: 2749035 - RNA, 17 nt, Human
ugccuucucaacuccaa

SEQ ID NO: 2749036 - RNA, 22 nt, Human
ugccuucucaacuccaaacuga

SEQ ID NO: 2749037 - RNA, 18 nt, Human
ugcccagggcucagccug

SEQ ID NO: 2749038 - RNA, 17 nt, Human
ugcccagggcucagccu

SEQ ID NO: 2749039 - RNA, 16 nt, Human
ugcccagggcucagcc

SEQ ID NO: 2749040 - RNA, 15 nt, Human
ugcccagggcucagc

SEQ ID NO: 2749041 - RNA, 14 nt, Human
ugcccagggcucag

SEQ ID NO: 2749042 - RNA, 11 nt, Human
ugcccagggcu

SEQ ID NO: 2749043 - RNA, 19 nt, Human
ugcccagggcucagccugg

SEQ ID NO: 2749044 - RNA, 23 nt, Human
ugccuccccuccucugcuugcca

SEQ ID NO: 2749045 - RNA, 22 nt, Human
ugccuccccuccucugcuugcc

SEQ ID NO: 2749046 - RNA, 19 nt, Human
ugccuccccuccucugcuu

SEQ ID NO: 2749047 - RNA, 18 nt, Human
ugccuccccuccucugcu

SEQ ID NO: 2749048 - RNA, 14 nt, Human
ucuuaguguaugau

SEQ ID NO: 2749049 - RNA, 19 nt, Human
ucuguaauaaacucauuuc

SEQ ID NO: 2749050 - RNA, 23 nt, Human
ucuguaauaaacucauuucuagc

SEQ ID NO: 2749051 - RNA, 24 nt, Human
ucuguaauaaacucauuucuagca

SEQ ID NO: 2749052 - RNA, 22 nt, Human
ucuggcucuaauucacagugcu

SEQ ID NO: 2749053 - RNA, 20 nt, Human
ucuggcucuaauucacagug

SEQ ID NO: 2749054 - RNA, 23 nt, Human
ucuggccuucggccuccauccug

SEQ ID NO: 2749055 - RNA, 12 nt, Human
ucuguaccaguu

SEQ ID NO: 2749056 - RNA, 13 nt, Human
ucuguaccaguua

SEQ ID NO: 2749057 - RNA, 22 nt, Human
ucuguaccaguuaauuuuucca

SEQ ID NO: 2749058 - RNA, 22 nt, Human
ucuguuuuauaauuuugugaag

SEQ ID NO: 2749059 - RNA, 20 nt, Human
ucuguuuuauaauuuuguga

SEQ ID NO: 2749060 - RNA, 15 nt, Human
ugaaaagacuccaaa

SEQ ID NO: 2749061 - RNA, 16 nt, Human
ugaaaagacuccaaag

SEQ ID NO: 2749062 - RNA, 17 nt, Human
ugaaaagacuccaaaga

SEQ ID NO: 2749063 - RNA, 19 nt, Human
ugaaaagacuccaaagaaa

SEQ ID NO: 2749064 - RNA, 19 nt, Human
ugaaaacuuuaugcuaagu

SEQ ID NO: 2749065 - RNA, 22 nt, Human
ugaaaagacuccaaagaaaugu

SEQ ID NO: 2749066 - RNA, 18 nt, Human
ugaaacccugucucuacu

SEQ ID NO: 2749067 - RNA, 23 nt, Human
ugaaagcagggacuugaacccau

SEQ ID NO: 2749068 - RNA, 19 nt, Human
ugaaagcagggacuugaac

SEQ ID NO: 2749069 - RNA, 18 nt, Human
ugaaagcagggacuugaa

SEQ ID NO: 2749070 - RNA, 22 nt, Human
ugaaguccaagcauuuagaugu

SEQ ID NO: 2749071 - RNA, 21 nt, Human
ugaaguccaagcauuuagaug

SEQ ID NO: 2749072 - RNA, 22 nt, Human
ugaacuuguaaaggaauuuaaa

SEQ ID NO: 2749073 - RNA, 14 nt, Human
ugaacacaucagcu

SEQ ID NO: 2749074 - RNA, 22 nt, Human
ugaacacugggggaggggacau

SEQ ID NO: 2749075 - RNA, 17 nt, Human
ugaacacugggggaggg

SEQ ID NO: 2749076 - RNA, 16 nt, Human
ugaacacugggggagg

SEQ ID NO: 2749077 - RNA, 14 nt, Human
ugaacacuggggga

SEQ ID NO: 2749078 - RNA, 17 nt, Human
ucuacacuaagagagaa

SEQ ID NO: 2749079 - RNA, 17 nt, Human
ucuacacuccagugaga

SEQ ID NO: 2749080 - RNA, 21 nt, Human
ucuacacuaagagagaaugag

SEQ ID NO: 2749081 - RNA, 23 nt, Human
uccugguccccucagcucugccu

SEQ ID NO: 2749082 - RNA, 15 nt, Human
uccuugcaucaauuu

SEQ ID NO: 2749083 - RNA, 18 nt, Human
ucuccugggcagcugccu

SEQ ID NO: 2749084 - RNA, 17 nt, Human
ucuccugggcagcugcc

SEQ ID NO: 2749085 - RNA, 16 nt, Human
ucuccugggcagcugc

SEQ ID NO: 2749086 - RNA, 15 nt, Human
ucuccugggcagcug

SEQ ID NO: 2749087 - RNA, 13 nt, Human
ucuccugggcagc

SEQ ID NO: 2749088 - RNA, 14 nt, Human
ucuccugggcagcu

SEQ ID NO: 2749089 - RNA, 21 nt, Human
ucucagugucaaugcagcccc

SEQ ID NO: 2749090 - RNA, 20 nt, Human
ucucaguaccccauggagcu

SEQ ID NO: 2749091 - RNA, 12 nt, Human
ucucucuucucu

SEQ ID NO: 2749092 - RNA, 20 nt, Human
ucuccugggcagcugccucc

SEQ ID NO: 2749093 - RNA, 19 nt, Human
ucuccugggcagcugccuc

SEQ ID NO: 2749094 - RNA, 21 nt, Human
ucuccugggcagcugccuccc

SEQ ID NO: 2749095 - RNA, 19 nt, Human
ucucuaggaaauauuuauu

SEQ ID NO: 2749096 - RNA, 13 nt, Human
ucucuaggaaaua

SEQ ID NO: 2749097 - RNA, 18 nt, Human
ucucuucacagucacauu

SEQ ID NO: 2749098 - RNA, 23 nt, Human
ucucuucucuccagcugacuaaa

SEQ ID NO: 2749099 - RNA, 12 nt, Human
ucucuucucucc

SEQ ID NO: 2749100 - RNA, 14 nt, Human
ucucuucucuccag

SEQ ID NO: 2749101 - RNA, 15 nt, Human
ucucuucucuccagc

SEQ ID NO: 2749102 - RNA, 16 nt, Human
ucucuucucuccagcu

SEQ ID NO: 2749103 - RNA, 16 nt, Human
ucauuauuugcagaga

SEQ ID NO: 2749104 - RNA, 13 nt, Human
uccacuuggucug

SEQ ID NO: 2749105 - RNA, 12 nt, Human
uccacuuggucu

SEQ ID NO: 2749106 - RNA, 17 nt, Human
uccagauccuggaaauc

SEQ ID NO: 2749107 - RNA, 16 nt, Human
uccagauccuggaaau

SEQ ID NO: 2749108 - RNA, 14 nt, Human
uccagauccuggaa

SEQ ID NO: 2749109 - RNA, 20 nt, Human
uccaagcauuuagauguaua

SEQ ID NO: 2749110 - RNA, 23 nt, Human
uccaccucccugcaauaaaaugg

SEQ ID NO: 2749111 - RNA, 14 nt, Human
uccaccuacaugag

SEQ ID NO: 2749112 - RNA, 23 nt, Human
uccaaacugacucuuaagaagac

SEQ ID NO: 2749113 - RNA, 12 nt, Human
uccaaagaaaug

SEQ ID NO: 2749114 - RNA, 16 nt, Human
ucauuucugcaucagc

SEQ ID NO: 2749115 - RNA, 22 nt, Human
ucauuucugcaucagcugcuga

SEQ ID NO: 2749116 - RNA, 14 nt, Human
ucauuucuuugagu

SEQ ID NO: 2749117 - RNA, 23 nt, Human
uccaagcauaccaacacgagcag

SEQ ID NO: 2749118 - RNA, 17 nt, Human
uccaagcauuuagaugu

SEQ ID NO: 2749119 - RNA, 17 nt, Human
ucccucccuccaccucc

SEQ ID NO: 2749120 - RNA, 16 nt, Human
ucccaaauuucauacc

SEQ ID NO: 2749121 - RNA, 17 nt, Human
ucacuuuuucugauaaa

SEQ ID NO: 2749122 - RNA, 13 nt, Human
ucacuuuuucuga

SEQ ID NO: 2749123 - RNA, 14 nt, Human
ucacuuuuucugau

SEQ ID NO: 2749124 - RNA, 16 nt, Human
ucacuuuuucugauaa

SEQ ID NO: 2749125 - RNA, 17 nt, Human
ucacuugucaauaaaau

SEQ ID NO: 2749126 - RNA, 19 nt, Human
ucagacauagaauuaacac

SEQ ID NO: 2749127 - RNA, 22 nt, Human
ucagacauagaauuaacacaug

SEQ ID NO: 2749128 - RNA, 23 nt, Human
ucagagcugcccucuccugggca

SEQ ID NO: 2749129 - RNA, 23 nt, Human
ucacaggacagcccuucuuucca

SEQ ID NO: 2749130 - RNA, 19 nt, Human
ucacaggaaguagaggagg

SEQ ID NO: 2749131 - RNA, 14 nt, Human
ucacaggaaguaga

SEQ ID NO: 2749132 - RNA, 16 nt, Human
ucaaacugaagccaga

SEQ ID NO: 2749133 - RNA, 12 nt, Human
ucaaagaaagug

SEQ ID NO: 2749134 - RNA, 14 nt, Human
ucaaagaaagugua

SEQ ID NO: 2749135 - RNA, 15 nt, Human
ucaaagaaaguguau

SEQ ID NO: 2749136 - RNA, 16 nt, Human
ucaaagaaaguguauu

SEQ ID NO: 2749137 - RNA, 19 nt, Human
ucaacuccaaacugacucu

SEQ ID NO: 2749138 - RNA, 13 nt, Human
ucaaaacugcacu

SEQ ID NO: 2749139 - RNA, 16 nt, Human
uauuuggaaauaaagu

SEQ ID NO: 2749140 - RNA, 17 nt, Human
uauuuggaaauaaaguc

SEQ ID NO: 2749141 - RNA, 19 nt, Human
uauuuggaaauaaagucag

SEQ ID NO: 2749142 - RNA, 22 nt, Human
uauuucuaugaaauauuauguu

SEQ ID NO: 2749143 - RNA, 21 nt, Human
uauuucuaugaaauauuaugu

SEQ ID NO: 2749144 - RNA, 18 nt, Human
uaaauauguuagcaaaga

SEQ ID NO: 2749145 - RNA, 21 nt, Human
uaaauauguuagcaaagaguu

SEQ ID NO: 2749146 - RNA, 14 nt, Human
uaaauauaucuacc

SEQ ID NO: 2749147 - RNA, 18 nt, Human
uaaauauaucuaccccag

SEQ ID NO: 2749148 - RNA, 20 nt, Human
uaaauauaucuaccccagac

SEQ ID NO: 2749149 - RNA, 18 nt, Human
uaaauauaugcuaagucu

SEQ ID NO: 2749150 - RNA, 17 nt, Human
uaaauaaaaauaauccu

SEQ ID NO: 2749151 - RNA, 19 nt, Human
uaaagcaguggacaccagg

SEQ ID NO: 2749152 - RNA, 18 nt, Human
uaaacuuuuuuucuguac

SEQ ID NO: 2749153 - RNA, 13 nt, Human
uaaagcaguggac

SEQ ID NO: 2749154 - RNA, 16 nt, Human
uaaacuuuuuuucugu

SEQ ID NO: 2749155 - RNA, 14 nt, Human
uaaaggaauuuaaa

SEQ ID NO: 2749156 - RNA, 17 nt, Human
uaaaauggguuuuacug

SEQ ID NO: 2749157 - RNA, 18 nt, Human
uaaaauccauacauuugu

SEQ ID NO: 2749158 - RNA, 19 nt, Human
uaaaauccauacauuugug

SEQ ID NO: 2749159 - RNA, 14 nt, Human
uaaaagaugaaaau

SEQ ID NO: 2749160 - RNA, 16 nt, Human
guuuucauuaucucaa

SEQ ID NO: 2749161 - RNA, 18 nt, Human
guuuucaggcuagaugua

SEQ ID NO: 2749162 - RNA, 16 nt, Human
uaaaaaagaaacauuu

SEQ ID NO: 2749163 - RNA, 11 nt, Human
guuucauugac

SEQ ID NO: 2749164 - RNA, 17 nt, Human
guuuagaaagcuugccc

SEQ ID NO: 2749165 - RNA, 13 nt, Human
guuuagaaagcuu

SEQ ID NO: 2749166 - RNA, 20 nt, Human
guuuaggauguugaaaaagu

SEQ ID NO: 2749167 - RNA, 21 nt, Human
uaagccagacaucaacagaua

SEQ ID NO: 2749168 - RNA, 20 nt, Human
uaagccagacaucaacagau

SEQ ID NO: 2749169 - RNA, 18 nt, Human
uaagcaucuggcucuaau

SEQ ID NO: 2749170 - RNA, 18 nt, Human
uaagcauuccaacuaucu

SEQ ID NO: 2749171 - RNA, 16 nt, Human
uaagcauuccaacuau

SEQ ID NO: 2749172 - RNA, 20 nt, Human
uaagcauuccaacuaucuca

SEQ ID NO: 2749173 - RNA, 13 nt, Human
uaagccagacauc

SEQ ID NO: 2749174 - RNA, 23 nt, Human
uaagagagaaugagagacacacu

SEQ ID NO: 2749175 - RNA, 23 nt, Human
uaagagggauuagggagagaaga

SEQ ID NO: 2749176 - RNA, 18 nt, Human
uaacagcccuccucugca

SEQ ID NO: 2749177 - RNA, 20 nt, Human
uaacagcccuccucugcacu

SEQ ID NO: 2749178 - RNA, 11 nt, Human
uaacagcccuc

SEQ ID NO: 2749179 - RNA, 17 nt, Human
uaacagcccuccucugc

SEQ ID NO: 2749180 - RNA, 23 nt, Human
uaaauugacacuuaaaaaugguu

SEQ ID NO: 2749181 - RNA, 19 nt, Human
uaacaaugcuguauuuuaa

SEQ ID NO: 2749182 - RNA, 14 nt, Human
uaauguuucaaaca

SEQ ID NO: 2749183 - RNA, 15 nt, Human
uaauguuucaaacau

SEQ ID NO: 2749184 - RNA, 20 nt, Human
uaauuaaaagaauauuuuaa

SEQ ID NO: 2749185 - RNA, 22 nt, Human
uaauuggaaaggcagcucuaaa

SEQ ID NO: 2749186 - RNA, 15 nt, Human
uaauuggauuuccua

SEQ ID NO: 2749187 - RNA, 16 nt, Human
uaauuggauuuccuaa

SEQ ID NO: 2749188 - RNA, 17 nt, Human
uaauuggauuuccuaau

SEQ ID NO: 2749189 - RNA, 23 nt, Human
uaauuggauuuccuaauacuguc

SEQ ID NO: 2749190 - RNA, 23 nt, Human
uaauuuguaguguuggagaagaa

SEQ ID NO: 2749191 - RNA, 20 nt, Human
uaauuuguaguguuggagaa

SEQ ID NO: 2749192 - RNA, 15 nt, Human
uaauaauguuucaaa

SEQ ID NO: 2749193 - RNA, 18 nt, Human
uaaucuuaguguaugauu

SEQ ID NO: 2749194 - RNA, 13 nt, Human
uaaucuuagugua

SEQ ID NO: 2749195 - RNA, 15 nt, Human
uaaucuuaguguaug

SEQ ID NO: 2749196 - RNA, 19 nt, Human
uaaugccacuaaauugaca

SEQ ID NO: 2749197 - RNA, 18 nt, Human
uaauuuugaagugcuguu

SEQ ID NO: 2749198 - RNA, 22 nt, Human
uaauuuugaagugcuguuuauu

SEQ ID NO: 2749199 - RNA, 14 nt, Human
uacaggauuugaaa

SEQ ID NO: 2749200 - RNA, 13 nt, Human
uacagaauuuuau

SEQ ID NO: 2749201 - RNA, 18 nt, Human
uacagaauucugcuaccu

SEQ ID NO: 2749202 - RNA, 21 nt, Human
uacagaauucugcuaccucac

SEQ ID NO: 2749203 - RNA, 16 nt, Human
uaccaacacgagcagg

SEQ ID NO: 2749204 - RNA, 16 nt, Human
uacauuuguauaaaau

SEQ ID NO: 2749205 - RNA, 11 nt, Human
uacauuugugu

SEQ ID NO: 2749206 - RNA, 17 nt, Human
uacauuuguauaaaaua

SEQ ID NO: 2749207 - RNA, 22 nt, Human
uacaugagguacugagagugaa

SEQ ID NO: 2749208 - RNA, 21 nt, Human
uacaugagguacugagaguga

SEQ ID NO: 2749209 - RNA, 23 nt, Human
uaccacaggaaccacaagacugc

SEQ ID NO: 2749210 - RNA, 23 nt, Human
uacuuuauaacuaacauguccug

SEQ ID NO: 2749211 - RNA, 19 nt, Human
uacuuuauaacuaacaugu

SEQ ID NO: 2749212 - RNA, 20 nt, Human
uacuuuauaacuaacauguc

SEQ ID NO: 2749213 - RNA, 16 nt, Human
uagaaagagaaacagu

SEQ ID NO: 2749214 - RNA, 13 nt, Human
uacuguguaauua

SEQ ID NO: 2749215 - RNA, 23 nt, Human
uacuguguacagaauucugcuac

SEQ ID NO: 2749216 - RNA, 22 nt, Human
uacuguguacagaauucugcua

SEQ ID NO: 2749217 - RNA, 14 nt, Human
uacuguguaauuag

SEQ ID NO: 2749218 - RNA, 18 nt, Human
uaccuugaacacuggggg

SEQ ID NO: 2749219 - RNA, 20 nt, Human
uacuaauagaauaaaggcag

SEQ ID NO: 2749220 - RNA, 23 nt, Human
uacuaauagaauaaaggcaguuu

SEQ ID NO: 2749221 - RNA, 23 nt, Human
uacugauguuccuagugaaagag

SEQ ID NO: 2749222 - RNA, 19 nt, Human
uacugagagugaacaaauu

SEQ ID NO: 2749223 - RNA, 20 nt, Human
uagcagggcauggcugggaa

SEQ ID NO: 2749224 - RNA, 16 nt, Human
uagauguauguacuuc

SEQ ID NO: 2749225 - RNA, 15 nt, Human
uagauguaguauuuu

SEQ ID NO: 2749226 - RNA, 17 nt, Human
uagauguaguauuuuuu

SEQ ID NO: 2749227 - RNA, 20 nt, Human
uagauguauguacuucaugc

SEQ ID NO: 2749228 - RNA, 13 nt, Human
uagaccucagccu

SEQ ID NO: 2749229 - RNA, 12 nt, Human
uagaccucagcc

SEQ ID NO: 2749230 - RNA, 11 nt, Human
uagaccucagc

SEQ ID NO: 2749231 - RNA, 20 nt, Human
uagaccucagccugugcugc

SEQ ID NO: 2749232 - RNA, 16 nt, Human
uagaccucagccugug

SEQ ID NO: 2749233 - RNA, 15 nt, Human
uagaccucagccugu

SEQ ID NO: 2749234 - RNA, 14 nt, Human
uagaccucagccug

SEQ ID NO: 2749235 - RNA, 22 nt, Human
uagaccucagccugugcugccc

SEQ ID NO: 2749236 - RNA, 21 nt, Human
uagaccucagccugugcugcc

SEQ ID NO: 2749237 - RNA, 18 nt, Human
uagaguuuagcuggaaaa

SEQ ID NO: 2749238 - RNA, 17 nt, Human
uagaguuuagcuggaaa

SEQ ID NO: 2749239 - RNA, 23 nt, Human
uagcucuggggugggcaguuuuu

SEQ ID NO: 2749240 - RNA, 11 nt, Human
uagcucugggg

SEQ ID NO: 2749241 - RNA, 22 nt, Human
uagcucuggggugggcaguuuu

SEQ ID NO: 2749242 - RNA, 14 nt, Human
uagccgaccucagc

SEQ ID NO: 2749243 - RNA, 13 nt, Human
uagccgaccucag

SEQ ID NO: 2749244 - RNA, 13 nt, Human
uaggccaugggac

SEQ ID NO: 2749245 - RNA, 20 nt, Human
uaggaauugacccacaagaa

SEQ ID NO: 2749246 - RNA, 23 nt, Human
uaggaauugacccacaagaaaug

SEQ ID NO: 2749247 - RNA, 15 nt, Human
uaguguaugauuacu

SEQ ID NO: 2749248 - RNA, 19 nt, Human
uaguguaugauuacuggcc

SEQ ID NO: 2749249 - RNA, 21 nt, Human
uaguuguaccgcaaugugacu

SEQ ID NO: 2749250 - RNA, 18 nt, Human
uagucaaauugugugaaa

SEQ ID NO: 2749251 - RNA, 16 nt, Human
uaggcgggaaggaggg

SEQ ID NO: 2749252 - RNA, 13 nt, Human
uauauuugaaaua

SEQ ID NO: 2749253 - RNA, 14 nt, Human
uauauuugaaauau

SEQ ID NO: 2749254 - RNA, 23 nt, Human
uauauuuauuacuguaagaaaau

SEQ ID NO: 2749255 - RNA, 20 nt, Human
uauauuuauuacuguaagaa

SEQ ID NO: 2749256 - RNA, 19 nt, Human
uauauuuuuuguuaaauga

SEQ ID NO: 2749257 - RNA, 13 nt, Human
ggggcagaacagc

SEQ ID NO: 2749258 - RNA, 21 nt, Human
ggggcagugcuuggcccagga

SEQ ID NO: 2749259 - RNA, 23 nt, Human
ggggcagugcuuggcccaggagu

SEQ ID NO: 2749260 - RNA, 22 nt, Human
ggguaaaauuccuuagcuuaga

SEQ ID NO: 2749261 - RNA, 19 nt, Human
ggguucagagacucagggc

SEQ ID NO: 2749262 - RNA, 21 nt, Human
gggugccccccuugccagaca

SEQ ID NO: 2749263 - RNA, 22 nt, Human
ggucaggagaggggcagaacag

SEQ ID NO: 2749264 - RNA, 15 nt, Human
gguuagggaggggua

SEQ ID NO: 2749265 - RNA, 13 nt, Human
gguuagggagggg

SEQ ID NO: 2749266 - RNA, 21 nt, Human
ggugcuacaaaaacacagcaa

SEQ ID NO: 2749267 - RNA, 23 nt, Human
ggugcuacaaaaacacagcaagg

SEQ ID NO: 2749268 - RNA, 22 nt, Human
gggcagaacagccgcuccuguc

SEQ ID NO: 2749269 - RNA, 23 nt, Human
gggcagugcuuggcccaggaguu

SEQ ID NO: 2749270 - RNA, 18 nt, Human
gggcagugcuuggcccag

SEQ ID NO: 2749271 - RNA, 19 nt, Human
gggcagugcuuggcccagg

SEQ ID NO: 2749272 - RNA, 20 nt, Human
gggcagugcuuggcccagga

SEQ ID NO: 2749273 - RNA, 22 nt, Human
gggcagugcuuggcccaggagu

SEQ ID NO: 2749274 - RNA, 12 nt, Human
gggcccugagcu

SEQ ID NO: 2749275 - RNA, 22 nt, Human
gggcccugagcucgguggaccc

SEQ ID NO: 2749276 - RNA, 13 nt, Human
gggcccugagcuc

SEQ ID NO: 2749277 - RNA, 14 nt, Human
gggaauugaggaca

SEQ ID NO: 2749278 - RNA, 18 nt, Human
ggcuuagacccucaugcu

SEQ ID NO: 2749279 - RNA, 16 nt, Human
ggcuuagacccucaug

SEQ ID NO: 2749280 - RNA, 22 nt, Human
ggcuugaguuuaaauuguaaua

SEQ ID NO: 2749281 - RNA, 19 nt, Human
gcuuuacuccguaacagau

SEQ ID NO: 2749282 - RNA, 23 nt, Human
gcuuggcccaggaguuuggccag

SEQ ID NO: 2749283 - RNA, 13 nt, Human
gcuuggcccagga

SEQ ID NO: 2749284 - RNA, 14 nt, Human
gcuuggcccaggag

SEQ ID NO: 2749285 - RNA, 15 nt, Human
gcuuggcccaggagu

SEQ ID NO: 2749286 - RNA, 16 nt, Human
gcuuggcccaggaguu

SEQ ID NO: 2749287 - RNA, 22 nt, Human
gcuuggcccaggaguuuggcca

SEQ ID NO: 2749288 - RNA, 20 nt, Human
ggaaaaaauaacaaugaaag

SEQ ID NO: 2749289 - RNA, 17 nt, Human
gcuuuuaaaaaaaaaua

SEQ ID NO: 2749290 - RNA, 16 nt, Human
gcuugccaucccuccc

SEQ ID NO: 2749291 - RNA, 21 nt, Human
gcuugccaucccucccuccac

SEQ ID NO: 2749292 - RNA, 18 nt, Human
gcuugccaucccucccuc

SEQ ID NO: 2749293 - RNA, 19 nt, Human
gcuugcccuggugccucac

SEQ ID NO: 2749294 - RNA, 17 nt, Human
gcuugcccuggugccuc

SEQ ID NO: 2749295 - RNA, 15 nt, Human
gcuguucacagccag

SEQ ID NO: 2749296 - RNA, 16 nt, Human
gcuguucacagccaga

SEQ ID NO: 2749297 - RNA, 23 nt, Human
gcuguucacagccagacuggcac

SEQ ID NO: 2749298 - RNA, 18 nt, Human
ggaaauauuuauuuuaau

SEQ ID NO: 2749299 - RNA, 17 nt, Human
ggaaauauuuauuuuaa

SEQ ID NO: 2749300 - RNA, 12 nt, Human
ggaaauauuuau

SEQ ID NO: 2749301 - RNA, 15 nt, Human
ggaaauauuuauuuu

SEQ ID NO: 2749302 - RNA, 13 nt, Human
ggaaauauuuauu

SEQ ID NO: 2749303 - RNA, 19 nt, Human
gcugcuagcacuuggagcc

SEQ ID NO: 2749304 - RNA, 23 nt, Human
gcugcuagcacuuggagccaagg

SEQ ID NO: 2749305 - RNA, 20 nt, Human
gcugcuagcacuuggagcca

SEQ ID NO: 2749306 - RNA, 17 nt, Human
gcuagcacuuggagcca

SEQ ID NO: 2749307 - RNA, 16 nt, Human
gcuagauguauguacu

SEQ ID NO: 2749308 - RNA, 18 nt, Human
gcuagauguauguacuuc

SEQ ID NO: 2749309 - RNA, 22 nt, Human
gcuguauuuuaaaagaaugauu

SEQ ID NO: 2749310 - RNA, 14 nt, Human
ggagaggggcagaa

SEQ ID NO: 2749311 - RNA, 20 nt, Human
ggaaggaggguuagggaggg

SEQ ID NO: 2749312 - RNA, 14 nt, Human
ggacccagggauga

SEQ ID NO: 2749313 - RNA, 21 nt, Human
ggaggacgcucucuggccuuc

SEQ ID NO: 2749314 - RNA, 20 nt, Human
ggaggacgcucucuggccuu

SEQ ID NO: 2749315 - RNA, 19 nt, Human
ggaggacgcucucuggccu

SEQ ID NO: 2749316 - RNA, 16 nt, Human
ggcagugcuuggccca

SEQ ID NO: 2749317 - RNA, 22 nt, Human
ggccaugggacagggaggacgc

SEQ ID NO: 2749318 - RNA, 23 nt, Human
ggcaacugaggcagacagcagcu

SEQ ID NO: 2749319 - RNA, 20 nt, Human
ggcaacugaggcagacagca

SEQ ID NO: 2749320 - RNA, 19 nt, Human
ggcaacugaggcagacagc

SEQ ID NO: 2749321 - RNA, 15 nt, Human
ggcaacugaggcaga

SEQ ID NO: 2749322 - RNA, 14 nt, Human
ggcaacugaggcag

SEQ ID NO: 2749323 - RNA, 13 nt, Human
ggcaacugaggca

SEQ ID NO: 2749324 - RNA, 21 nt, Human
ggcagcugccuccccuccucu

SEQ ID NO: 2749325 - RNA, 18 nt, Human
ggcagcugccuccccucc

SEQ ID NO: 2749326 - RNA, 22 nt, Human
ggcagcugccuccccuccucug

SEQ ID NO: 2749327 - RNA, 17 nt, Human
gccgaccucagccuucc

SEQ ID NO: 2749328 - RNA, 15 nt, Human
gccgaccucagccuu

SEQ ID NO: 2749329 - RNA, 14 nt, Human
gccgaccucagccu

SEQ ID NO: 2749330 - RNA, 13 nt, Human
gccgaccucagcc

SEQ ID NO: 2749331 - RNA, 12 nt, Human
gccgaccucagc

SEQ ID NO: 2749332 - RNA, 19 nt, Human
gcccuucuuuccacagaag

SEQ ID NO: 2749333 - RNA, 14 nt, Human
gccuccccuccucu

SEQ ID NO: 2749334 - RNA, 13 nt, Human
gccuccccuccuc

SEQ ID NO: 2749335 - RNA, 12 nt, Human
gccuccccuccu

SEQ ID NO: 2749336 - RNA, 11 nt, Human
gccuccccucc

SEQ ID NO: 2749337 - RNA, 19 nt, Human
gcguccugucggagcccug

SEQ ID NO: 2749338 - RNA, 13 nt, Human
gcuaccaguauuu

SEQ ID NO: 2749339 - RNA, 14 nt, Human
gcuaccaguauuua

SEQ ID NO: 2749340 - RNA, 15 nt, Human
gcuaccaguauuuag

SEQ ID NO: 2749341 - RNA, 18 nt, Human
gcuaccaguauuuagaag

SEQ ID NO: 2749342 - RNA, 19 nt, Human
gcuaccaguauuuagaagc

SEQ ID NO: 2749343 - RNA, 21 nt, Human
gcuaccaguauuuagaagcca

SEQ ID NO: 2749344 - RNA, 22 nt, Human
gcuaccaguauuuagaagccaa

SEQ ID NO: 2749345 - RNA, 22 nt, Human
gcguccugucggagcccugucu

SEQ ID NO: 2749346 - RNA, 18 nt, Human
gccuguaaucacagcuac

SEQ ID NO: 2749347 - RNA, 15 nt, Human
gccuggugggccucc

SEQ ID NO: 2749348 - RNA, 22 nt, Human
gcgacagugagacucugucuca

SEQ ID NO: 2749349 - RNA, 18 nt, Human
gccuucggccuccauccu

SEQ ID NO: 2749350 - RNA, 19 nt, Human
gccuucggccuccauccug

SEQ ID NO: 2749351 - RNA, 14 nt, Human
gccagcucucagcc

SEQ ID NO: 2749352 - RNA, 13 nt, Human
gccagcucucagc

SEQ ID NO: 2749353 - RNA, 15 nt, Human
gccagcucucagcca

SEQ ID NO: 2749354 - RNA, 22 nt, Human
gccacguucuuacuaguuuccc

SEQ ID NO: 2749355 - RNA, 14 nt, Human
gccaucccucccuc

SEQ ID NO: 2749356 - RNA, 13 nt, Human
gccaucccucccu

SEQ ID NO: 2749357 - RNA, 11 nt, Human
gccaucccucc

SEQ ID NO: 2749358 - RNA, 16 nt, Human
gccaucccucccucca

SEQ ID NO: 2749359 - RNA, 15 nt, Human
gccaucccucccucc

SEQ ID NO: 2749360 - RNA, 19 nt, Human
gccaugggacagggaggac

SEQ ID NO: 2749361 - RNA, 14 nt, Human
gccaugggacaggg

SEQ ID NO: 2749362 - RNA, 22 nt, Human
gccauuuaaagcuuauuaaaac

SEQ ID NO: 2749363 - RNA, 16 nt, Human
gcccacagcuguauga

SEQ ID NO: 2749364 - RNA, 17 nt, Human
gcccagggcucagccug

SEQ ID NO: 2749365 - RNA, 16 nt, Human
gcccagggcucagccu

SEQ ID NO: 2749366 - RNA, 15 nt, Human
gcccagggcucagcc

SEQ ID NO: 2749367 - RNA, 14 nt, Human
gcccagggcucagc

SEQ ID NO: 2749368 - RNA, 13 nt, Human
gcccagggcucag

SEQ ID NO: 2749369 - RNA, 12 nt, Human
gcccagggcuca

SEQ ID NO: 2749370 - RNA, 17 nt, Human
gccccgugggguuccuc

SEQ ID NO: 2749371 - RNA, 19 nt, Human
gccccugcacuccagccug

SEQ ID NO: 2749372 - RNA, 16 nt, Human
gcccucuccugggcag

SEQ ID NO: 2749373 - RNA, 15 nt, Human
gcccucuccugggca

SEQ ID NO: 2749374 - RNA, 14 nt, Human
gcccucuccugggc

SEQ ID NO: 2749375 - RNA, 16 nt, Human
gcccuccucugcacuc

SEQ ID NO: 2749376 - RNA, 21 nt, Human
gcccucuccugggcagcugcc

SEQ ID NO: 2749377 - RNA, 19 nt, Human
gcccucuccugggcagcug

SEQ ID NO: 2749378 - RNA, 18 nt, Human
gcccucuccugggcagcu

SEQ ID NO: 2749379 - RNA, 18 nt, Human
gcauagauucccugagca

SEQ ID NO: 2749380 - RNA, 13 nt, Human
gcaguucugaaga

SEQ ID NO: 2749381 - RNA, 15 nt, Human
gcauagcucuggggu

SEQ ID NO: 2749382 - RNA, 14 nt, Human
gcauagcucugggg

SEQ ID NO: 2749383 - RNA, 16 nt, Human
gcagugcuuggcccag

SEQ ID NO: 2749384 - RNA, 17 nt, Human
gcagugcuuggcccagg

SEQ ID NO: 2749385 - RNA, 15 nt, Human
gcaggcuacugucag

SEQ ID NO: 2749386 - RNA, 17 nt, Human
gcagaguuacaguucug

SEQ ID NO: 2749387 - RNA, 18 nt, Human
gcagaguuacaguucugu

SEQ ID NO: 2749388 - RNA, 20 nt, Human
gcagaguuacaguucugugg

SEQ ID NO: 2749389 - RNA, 17 nt, Human
gcagagacaggaccuga

SEQ ID NO: 2749390 - RNA, 21 nt, Human
gcagaguuacaguucuguggu

SEQ ID NO: 2749391 - RNA, 20 nt, Human
gcacagccucuuagaugcag

SEQ ID NO: 2749392 - RNA, 15 nt, Human
gcacugucaagauga

SEQ ID NO: 2749393 - RNA, 14 nt, Human
gcagaagacaguau

SEQ ID NO: 2749394 - RNA, 16 nt, Human
gauuacaaaucagaag

SEQ ID NO: 2749395 - RNA, 17 nt, Human
gauuacaaaucagaagu

SEQ ID NO: 2749396 - RNA, 19 nt, Human
gauuacaaaucagaaguca

SEQ ID NO: 2749397 - RNA, 20 nt, Human
gauuacaaaucagaagucau

SEQ ID NO: 2749398 - RNA, 21 nt, Human
gauuacaaaucagaagucauc

SEQ ID NO: 2749399 - RNA, 23 nt, Human
gauuacaaaucagaagucaucuu

SEQ ID NO: 2749400 - RNA, 14 nt, Human
gauuaaguaaugau

SEQ ID NO: 2749401 - RNA, 22 nt, Human
gauuaaguaaugauaacuggaa

SEQ ID NO: 2749402 - RNA, 16 nt, Human
gaugcuagaacucccu

SEQ ID NO: 2749403 - RNA, 22 nt, Human
gcaacugaggcagacagcagcu

SEQ ID NO: 2749404 - RNA, 21 nt, Human
gcaacugaggcagacagcagc

SEQ ID NO: 2749405 - RNA, 19 nt, Human
gcaacugaggcagacagca

SEQ ID NO: 2749406 - RNA, 15 nt, Human
gcaacugaggcagac

SEQ ID NO: 2749407 - RNA, 14 nt, Human
gcaacugaggcaga

SEQ ID NO: 2749408 - RNA, 13 nt, Human
gcaacugaggcag

SEQ ID NO: 2749409 - RNA, 15 nt, Human
gcaagcacagcccuu

SEQ ID NO: 2749410 - RNA, 12 nt, Human
gcaagauguggg

SEQ ID NO: 2749411 - RNA, 16 nt, Human
gcaagaugugggcagu

SEQ ID NO: 2749412 - RNA, 17 nt, Human
gauaggucagugcaaau

SEQ ID NO: 2749413 - RNA, 23 nt, Human
gaucagcuuauugucuagugaaa

SEQ ID NO: 2749414 - RNA, 17 nt, Human
gaguguguuugucaccg

SEQ ID NO: 2749415 - RNA, 13 nt, Human
gauaaacaguagu

SEQ ID NO: 2749416 - RNA, 16 nt, Human
gauaaaagauggccau

SEQ ID NO: 2749417 - RNA, 13 nt, Human
gauaaaagauggc

SEQ ID NO: 2749418 - RNA, 14 nt, Human
gauccuggaaauca

SEQ ID NO: 2749419 - RNA, 15 nt, Human
gaacauaaaauacaa

SEQ ID NO: 2749420 - RNA, 14 nt, Human
gaacaucacagcuu

SEQ ID NO: 2749421 - RNA, 20 nt, Human
gaacagugauuaccagggac

SEQ ID NO: 2749422 - RNA, 16 nt, Human
gaacagugauuaccag

SEQ ID NO: 2749423 - RNA, 18 nt, Human
gaacagccgcuccugucu

SEQ ID NO: 2749424 - RNA, 16 nt, Human
gaaauuguauuacaaa

SEQ ID NO: 2749425 - RNA, 13 nt, Human
gaagacuguggcu

SEQ ID NO: 2749426 - RNA, 17 nt, Human
gaagacugcauuauauu

SEQ ID NO: 2749427 - RNA, 12 nt, Human
gaagacuguggc

SEQ ID NO: 2749428 - RNA, 11 nt, Human
gaagacugugg

SEQ ID NO: 2749429 - RNA, 19 nt, Human
gaagacugcauuauauuua

SEQ ID NO: 2749430 - RNA, 12 nt, Human
gaagaacugaaa

SEQ ID NO: 2749431 - RNA, 18 nt, Human
gaagauguagaggagaaa

SEQ ID NO: 2749432 - RNA, 17 nt, Human
gaagauguagaggagaa

SEQ ID NO: 2749433 - RNA, 18 nt, Human
gaauucugcuaccucacu

SEQ ID NO: 2749434 - RNA, 19 nt, Human
gaauucugcuaccucacug

SEQ ID NO: 2749435 - RNA, 16 nt, Human
gaauauuuuaacuucc

SEQ ID NO: 2749436 - RNA, 22 nt, Human
gaaguccaagcauuuagaugua

SEQ ID NO: 2749437 - RNA, 12 nt, Human
gaaguccaagca

SEQ ID NO: 2749438 - RNA, 14 nt, Human
gaaguauccuucag

SEQ ID NO: 2749439 - RNA, 16 nt, Human
gaaguauccuucagcc

SEQ ID NO: 2749440 - RNA, 18 nt, Human
gaagucaucuugcuacca

SEQ ID NO: 2749441 - RNA, 15 nt, Human
gaagucaucuugcua

SEQ ID NO: 2749442 - RNA, 21 nt, Human
gacagagccccacccucagau

SEQ ID NO: 2749443 - RNA, 14 nt, Human
gacaucaacagaua

SEQ ID NO: 2749444 - RNA, 23 nt, Human
gacaggaugguucccuugaugaa

SEQ ID NO: 2749445 - RNA, 20 nt, Human
gacagcagcucaggcacacu

SEQ ID NO: 2749446 - RNA, 18 nt, Human
gacagcagcucaggcaca

SEQ ID NO: 2749447 - RNA, 16 nt, Human
gacagcagcucaggca

SEQ ID NO: 2749448 - RNA, 15 nt, Human
gacagcagcucaggc

SEQ ID NO: 2749449 - RNA, 14 nt, Human
gacagcagcucagg

SEQ ID NO: 2749450 - RNA, 13 nt, Human
gacagcagcucag

SEQ ID NO: 2749451 - RNA, 20 nt, Human
gacccaaaaggcagaagcaa

SEQ ID NO: 2749452 - RNA, 23 nt, Human
gacccacuucacacacaggcaac

SEQ ID NO: 2749453 - RNA, 19 nt, Human
gacccaaaaggcagaagca

SEQ ID NO: 2749454 - RNA, 18 nt, Human
gacccaaaaggcagaagc

SEQ ID NO: 2749455 - RNA, 18 nt, Human
gaccacugcagaagacag

SEQ ID NO: 2749456 - RNA, 16 nt, Human
gaccacugcagaagac

SEQ ID NO: 2749457 - RNA, 22 nt, Human
gacuaaacuuuuuuucuguacc

SEQ ID NO: 2749458 - RNA, 18 nt, Human
gacuaaacuuuuuuucug

SEQ ID NO: 2749459 - RNA, 19 nt, Human
gacuaaacuuuuuuucugu

SEQ ID NO: 2749460 - RNA, 20 nt, Human
gacuaaacuuuuuuucugua

SEQ ID NO: 2749461 - RNA, 22 nt, Human
gacuggauaguccgucucugcu

SEQ ID NO: 2749462 - RNA, 18 nt, Human
gacuggcacaguuuucug

SEQ ID NO: 2749463 - RNA, 22 nt, Human
gacuggcacaguuuucugagaa

SEQ ID NO: 2749464 - RNA, 14 nt, Human
gacuggcacaguuu

SEQ ID NO: 2749465 - RNA, 17 nt, Human
gacuggauaguccgucu

SEQ ID NO: 2749466 - RNA, 16 nt, Human
gacugaggggagggga

SEQ ID NO: 2749467 - RNA, 24 nt, Human
gacugcauuauauuuauuacugua

SEQ ID NO: 2749468 - RNA, 22 nt, Human
cuugcagcucuccccuucucug

SEQ ID NO: 2749469 - RNA, 14 nt, Human
cuugcccuguuaaa

SEQ ID NO: 2749470 - RNA, 18 nt, Human
cuugcccuggugccucac

SEQ ID NO: 2749471 - RNA, 23 nt, Human
cuugcccagggcucagccuggug

SEQ ID NO: 2749472 - RNA, 21 nt, Human
cuugcccagggcucagccugg

SEQ ID NO: 2749473 - RNA, 20 nt, Human
cuugcccagggcucagccug

SEQ ID NO: 2749474 - RNA, 19 nt, Human
cuugccaucccucccucca

SEQ ID NO: 2749475 - RNA, 16 nt, Human
cuugccaucccucccu

SEQ ID NO: 2749476 - RNA, 15 nt, Human
cuugccaucccuccc

SEQ ID NO: 2749477 - RNA, 17 nt, Human
cuugccaucccucccuc

SEQ ID NO: 2749478 - RNA, 14 nt, Human
cuugcccagggcuc

SEQ ID NO: 2749479 - RNA, 13 nt, Human
cuugcccagggcu

SEQ ID NO: 2749480 - RNA, 19 nt, Human
cuugcccagggcucagccu

SEQ ID NO: 2749481 - RNA, 18 nt, Human
cuugcccagggcucagcc

SEQ ID NO: 2749482 - RNA, 16 nt, Human
cuugcccagggcucag

SEQ ID NO: 2749483 - RNA, 15 nt, Human
cuugcccagggcuca

SEQ ID NO: 2749484 - RNA, 14 nt, Human
cuugccaucccucc

SEQ ID NO: 2749485 - RNA, 20 nt, Human
cuugcuugauuguauggugg

SEQ ID NO: 2749486 - RNA, 14 nt, Human
cuugcuucuuucua

SEQ ID NO: 2749487 - RNA, 15 nt, Human
cuugcuucuuucuag

SEQ ID NO: 2749488 - RNA, 18 nt, Human
cuugcuucuuucuagaaa

SEQ ID NO: 2749489 - RNA, 19 nt, Human
cuugcuucuuucuagaaag

SEQ ID NO: 2749490 - RNA, 20 nt, Human
cuugcugcaagcacagcccu

SEQ ID NO: 2749491 - RNA, 21 nt, Human
cuugcugcaagcacagcccuu

SEQ ID NO: 2749492 - RNA, 22 nt, Human
cuugcccuguuaaaagaugaaa

SEQ ID NO: 2749493 - RNA, 16 nt, Human
cuuggacucauuuuaa

SEQ ID NO: 2749494 - RNA, 16 nt, Human
cuuggggcugaugcag

SEQ ID NO: 2749495 - RNA, 18 nt, Human
cuuggggcugaugcaguu

SEQ ID NO: 2749496 - RNA, 17 nt, Human
cuuguacuuuauuuucu

SEQ ID NO: 2749497 - RNA, 19 nt, Human
cuuuccucaaaacuucaga

SEQ ID NO: 2749498 - RNA, 14 nt, Human
gaaaacaaggauga

SEQ ID NO: 2749499 - RNA, 14 nt, Human
gaaaaguauguuag

SEQ ID NO: 2749500 - RNA, 20 nt, Human
gaaaaguauguuagugcaaa

SEQ ID NO: 2749501 - RNA, 19 nt, Human
gaaaauaacaauaaaagac

SEQ ID NO: 2749502 - RNA, 18 nt, Human
cuuaaugccacuaaauug

SEQ ID NO: 2749503 - RNA, 15 nt, Human
cuuaagcaucuggcu

SEQ ID NO: 2749504 - RNA, 17 nt, Human
cuuaagcaucuggcucu

SEQ ID NO: 2749505 - RNA, 18 nt, Human
cuuaagcaucuggcucua

SEQ ID NO: 2749506 - RNA, 23 nt, Human
cuuaagcaucuggcucuaauuca

SEQ ID NO: 2749507 - RNA, 22 nt, Human
cuuaacuucuugcuucuuucua

SEQ ID NO: 2749508 - RNA, 14 nt, Human
cuuaacuucuugcu

SEQ ID NO: 2749509 - RNA, 15 nt, Human
cuuaacuucuugcuu

SEQ ID NO: 2749510 - RNA, 18 nt, Human
cuuaacuucuugcuucuu

SEQ ID NO: 2749511 - RNA, 21 nt, Human
cuuaacuucuugcuucuuucu

SEQ ID NO: 2749512 - RNA, 18 nt, Human
cuguuuauuaaucuuagu

SEQ ID NO: 2749513 - RNA, 14 nt, Human
cuguuuauuaaucu

SEQ ID NO: 2749514 - RNA, 16 nt, Human
cuguuuauuaaucuua

SEQ ID NO: 2749515 - RNA, 19 nt, Human
cuguuuuauaauuuuguga

SEQ ID NO: 2749516 - RNA, 19 nt, Human
cuuacuaguuucccuugca

SEQ ID NO: 2749517 - RNA, 17 nt, Human
cuuaauguauguuacca

SEQ ID NO: 2749518 - RNA, 14 nt, Human
cuuaauguauguua

SEQ ID NO: 2749519 - RNA, 21 nt, Human
cuuaauguauguuaccaaaaa

SEQ ID NO: 2749520 - RNA, 19 nt, Human
cuuagaugcaguucugaag

SEQ ID NO: 2749521 - RNA, 14 nt, Human
cuuagacccucaug

SEQ ID NO: 2749522 - RNA, 18 nt, Human
cuuagacccucaugcugc

SEQ ID NO: 2749523 - RNA, 14 nt, Human
cuuauaauuuaaaa

SEQ ID NO: 2749524 - RNA, 19 nt, Human
cuuauaggaauugacccac

SEQ ID NO: 2749525 - RNA, 14 nt, Human
cuuauaguuacugu

SEQ ID NO: 2749526 - RNA, 15 nt, Human
cuuauaguuacugug

SEQ ID NO: 2749527 - RNA, 16 nt, Human
cuuauaguuacugugu

SEQ ID NO: 2749528 - RNA, 18 nt, Human
cuuauaguuacuguguaa

SEQ ID NO: 2749529 - RNA, 19 nt, Human
cuuauaguuacuguguaau

SEQ ID NO: 2749530 - RNA, 21 nt, Human
cuuauaguuacuguguaauua

SEQ ID NO: 2749531 - RNA, 21 nt, Human
cuuaggguuaugauuaaguaa

SEQ ID NO: 2749532 - RNA, 13 nt, Human
cuuauaauuuaaa

SEQ ID NO: 2749533 - RNA, 19 nt, Human
cuuccagauccuggaaauc

SEQ ID NO: 2749534 - RNA, 23 nt, Human
cuuccccuugcccagggcucagc

SEQ ID NO: 2749535 - RNA, 19 nt, Human
cuuccccuugcccagggcu

SEQ ID NO: 2749536 - RNA, 16 nt, Human
cuuccccuugcccagg

SEQ ID NO: 2749537 - RNA, 23 nt, Human
cuucagccuagccgaccucagcc

SEQ ID NO: 2749538 - RNA, 16 nt, Human
cuucagcgguuuauau

SEQ ID NO: 2749539 - RNA, 18 nt, Human
cuucagcgguuuauauaa

SEQ ID NO: 2749540 - RNA, 22 nt, Human
cuucagccuagccgaccucagc

SEQ ID NO: 2749541 - RNA, 21 nt, Human
cuucagccuagccgaccucag

SEQ ID NO: 2749542 - RNA, 20 nt, Human
cuucagccuagccgaccuca

SEQ ID NO: 2749543 - RNA, 13 nt, Human
cuucagccuagcc

SEQ ID NO: 2749544 - RNA, 19 nt, Human
cuuccuuggacucauuuua

SEQ ID NO: 2749545 - RNA, 20 nt, Human
cuucgaaagcaucauuauuu

SEQ ID NO: 2749546 - RNA, 17 nt, Human
cuucggccuccauccug

SEQ ID NO: 2749547 - RNA, 18 nt, Human
cuucggccuccauccuga

SEQ ID NO: 2749548 - RNA, 19 nt, Human
cuccucacuguauccaggu

SEQ ID NO: 2749549 - RNA, 14 nt, Human
cuccucacuguauc

SEQ ID NO: 2749550 - RNA, 16 nt, Human
cuccucacuguaucca

SEQ ID NO: 2749551 - RNA, 16 nt, Human
cucccuucucuucaca

SEQ ID NO: 2749552 - RNA, 12 nt, Human
cucccuuucaac

SEQ ID NO: 2749553 - RNA, 13 nt, Human
cucccuuucaaca

SEQ ID NO: 2749554 - RNA, 14 nt, Human
cucuaacagcccuc

SEQ ID NO: 2749555 - RNA, 12 nt, Human
cucggagccuca

SEQ ID NO: 2749556 - RNA, 13 nt, Human
cucggagaagagc

SEQ ID NO: 2749557 - RNA, 20 nt, Human
cucggagaagagcuguucac

SEQ ID NO: 2749558 - RNA, 12 nt, Human
cucggagaagag

SEQ ID NO: 2749559 - RNA, 18 nt, Human
cucauuaggauggcuagu

SEQ ID NO: 2749560 - RNA, 17 nt, Human
cucauuaggauggcuag

SEQ ID NO: 2749561 - RNA, 20 nt, Human
cuccauccugaggcuccacu

SEQ ID NO: 2749562 - RNA, 21 nt, Human
cuccauccugaggcuccacuu

SEQ ID NO: 2749563 - RNA, 23 nt, Human
cuccauccugaggcuccacuugg

SEQ ID NO: 2749564 - RNA, 17 nt, Human
cucccagucauuuaaua

SEQ ID NO: 2749565 - RNA, 17 nt, Human
cuccaccucccugcaau

SEQ ID NO: 2749566 - RNA, 16 nt, Human
cuccaccucccugcaa

SEQ ID NO: 2749567 - RNA, 15 nt, Human
cuccaccucccugca

SEQ ID NO: 2749568 - RNA, 14 nt, Human
cuccaccucccugc

SEQ ID NO: 2749569 - RNA, 23 nt, Human
cucugcauacucauuaggauggc

SEQ ID NO: 2749570 - RNA, 18 nt, Human
cucuccagcugacuaaac

SEQ ID NO: 2749571 - RNA, 17 nt, Human
cucuaauucacagugcu

SEQ ID NO: 2749572 - RNA, 15 nt, Human
cucuaauucacagug

SEQ ID NO: 2749573 - RNA, 16 nt, Human
cucuaauucacagugc

SEQ ID NO: 2749574 - RNA, 21 nt, Human
cucuccugggcagcugccucc

SEQ ID NO: 2749575 - RNA, 19 nt, Human
cucuucucuccagcugacu

SEQ ID NO: 2749576 - RNA, 22 nt, Human
cucuucucuccagcugacuaaa

SEQ ID NO: 2749577 - RNA, 13 nt, Human
cucuucucuccag

SEQ ID NO: 2749578 - RNA, 14 nt, Human
cucuucucuccagc

SEQ ID NO: 2749579 - RNA, 15 nt, Human
cucuucucuccagcu

SEQ ID NO: 2749580 - RNA, 18 nt, Human
cugauaaaagauggccau

SEQ ID NO: 2749581 - RNA, 13 nt, Human
cugauguuccuag

SEQ ID NO: 2749582 - RNA, 18 nt, Human
cugauguuccuagugaaa

SEQ ID NO: 2749583 - RNA, 20 nt, Human
cugauguuccuagugaaaga

SEQ ID NO: 2749584 - RNA, 21 nt, Human
cugauguuccuagugaaagag

SEQ ID NO: 2749585 - RNA, 13 nt, Human
cugcagaagacag

SEQ ID NO: 2749586 - RNA, 23 nt, Human
cugcagaagacaguauggcagcu

SEQ ID NO: 2749587 - RNA, 19 nt, Human
cugccagccagcagccagc

SEQ ID NO: 2749588 - RNA, 18 nt, Human
cugccagccagcagccag

SEQ ID NO: 2749589 - RNA, 16 nt, Human
cugccagccagcagcc

SEQ ID NO: 2749590 - RNA, 15 nt, Human
cugccagccagcagc

SEQ ID NO: 2749591 - RNA, 14 nt, Human
cugccagccagcag

SEQ ID NO: 2749592 - RNA, 13 nt, Human
cugccagccagca

SEQ ID NO: 2749593 - RNA, 12 nt, Human
cugccagccagc

SEQ ID NO: 2749594 - RNA, 23 nt, Human
cugccagccagcagccagcucuc

SEQ ID NO: 2749595 - RNA, 20 nt, Human
cugccagccagcagccagcu

SEQ ID NO: 2749596 - RNA, 15 nt, Human
cugccuaagugcagc

SEQ ID NO: 2749597 - RNA, 13 nt, Human
cugcugaaacaac

SEQ ID NO: 2749598 - RNA, 23 nt, Human
cuggaauaauccuaaacauauga

SEQ ID NO: 2749599 - RNA, 13 nt, Human
cuggcccaccagg

SEQ ID NO: 2749600 - RNA, 14 nt, Human
cuggcccaccaggg

SEQ ID NO: 2749601 - RNA, 16 nt, Human
cuggccaacgggguga

SEQ ID NO: 2749602 - RNA, 18 nt, Human
cuggcacaguuuucugag

SEQ ID NO: 2749603 - RNA, 19 nt, Human
cuggcacaguuuucugaga

SEQ ID NO: 2749604 - RNA, 22 nt, Human
cugggaacccaaguccaagcau

SEQ ID NO: 2749605 - RNA, 16 nt, Human
cuggggugggcaguuu

SEQ ID NO: 2749606 - RNA, 18 nt, Human
cuggggugggcaguuuuu

SEQ ID NO: 2749607 - RNA, 17 nt, Human
cuggugggccuccucug

SEQ ID NO: 2749608 - RNA, 12 nt, Human
cuggugggccuc

SEQ ID NO: 2749609 - RNA, 21 nt, Human
cuggucccagccagcaguuca

SEQ ID NO: 2749610 - RNA, 15 nt, Human
ccuagagcacacugu

SEQ ID NO: 2749611 - RNA, 14 nt, Human
ccguuuugucacuu

SEQ ID NO: 2749612 - RNA, 19 nt, Human
ccguuuugucacuuuuucu

SEQ ID NO: 2749613 - RNA, 22 nt, Human
ccgggaggcagagguugcagug

SEQ ID NO: 2749614 - RNA, 16 nt, Human
cccuugaugaagaagu

SEQ ID NO: 2749615 - RNA, 15 nt, Human
cccuugaugaagaag

SEQ ID NO: 2749616 - RNA, 15 nt, Human
ccucuguccagggcc

SEQ ID NO: 2749617 - RNA, 14 nt, Human
ccucuguccagggc

SEQ ID NO: 2749618 - RNA, 23 nt, Human
ccucuguccagggcccugagcuc

SEQ ID NO: 2749619 - RNA, 21 nt, Human
ccucuguccagggcccugagc

SEQ ID NO: 2749620 - RNA, 20 nt, Human
ccucuguccagggcccugag

SEQ ID NO: 2749621 - RNA, 18 nt, Human
ccucuguccagggcccug

SEQ ID NO: 2749622 - RNA, 23 nt, Human
ccucuuagaugcaguucugaaga

SEQ ID NO: 2749623 - RNA, 13 nt, Human
ccugaaagaggaa

SEQ ID NO: 2749624 - RNA, 18 nt, Human
ccugaaagaggaaugaag

SEQ ID NO: 2749625 - RNA, 23 nt, Human
ccugaaagaggaaugaaguacuc

SEQ ID NO: 2749626 - RNA, 20 nt, Human
ccugaggcuccacuuggucu

SEQ ID NO: 2749627 - RNA, 18 nt, Human
ccugaggcuccacuuggu

SEQ ID NO: 2749628 - RNA, 17 nt, Human
ccugaggcuccacuugg

SEQ ID NO: 2749629 - RNA, 13 nt, Human
ccucuccugggca

SEQ ID NO: 2749630 - RNA, 12 nt, Human
ccucuccugggc

SEQ ID NO: 2749631 - RNA, 11 nt, Human
ccucuccuggg

SEQ ID NO: 2749632 - RNA, 16 nt, Human
ccucugcacucccacc

SEQ ID NO: 2749633 - RNA, 21 nt, Human
ccucugcuugccaucccuccc

SEQ ID NO: 2749634 - RNA, 20 nt, Human
ccucugcuugccaucccucc

SEQ ID NO: 2749635 - RNA, 17 nt, Human
ccucugcuugccauccc

SEQ ID NO: 2749636 - RNA, 20 nt, Human
ccucagaaaacaaggaugaa

SEQ ID NO: 2749637 - RNA, 14 nt, Human
ccuccccuccucug

SEQ ID NO: 2749638 - RNA, 15 nt, Human
ccuccccuccucugc

SEQ ID NO: 2749639 - RNA, 11 nt, Human
ccuccucugcu

SEQ ID NO: 2749640 - RNA, 21 nt, Human
ccuccucugcacucccaccug

SEQ ID NO: 2749641 - RNA, 16 nt, Human
ccucccugcaauaaaa

SEQ ID NO: 2749642 - RNA, 12 nt, Human
ccucccugcaau

SEQ ID NO: 2749643 - RNA, 18 nt, Human
ccuccccuccucugcuug

SEQ ID NO: 2749644 - RNA, 17 nt, Human
ccuccccuccucugcuu

SEQ ID NO: 2749645 - RNA, 23 nt, Human
ccugugcugcccgucuucagccu

SEQ ID NO: 2749646 - RNA, 21 nt, Human
ccugugcugcccgucuucagc

SEQ ID NO: 2749647 - RNA, 12 nt, Human
ccuucagccuga

SEQ ID NO: 2749648 - RNA, 20 nt, Human
ccuggacuuaagcaucuggc

SEQ ID NO: 2749649 - RNA, 24 nt, Human
ccuggacuuaagcaucuggcucua

SEQ ID NO: 2749650 - RNA, 18 nt, Human
ccugggcagcugccuccc

SEQ ID NO: 2749651 - RNA, 17 nt, Human
ccugggcagcugccucc

SEQ ID NO: 2749652 - RNA, 16 nt, Human
ccugggcagcugccuc

SEQ ID NO: 2749653 - RNA, 15 nt, Human
ccugggcagcugccu

SEQ ID NO: 2749654 - RNA, 22 nt, Human
ccugugcugcccgucuucagcc

SEQ ID NO: 2749655 - RNA, 20 nt, Human
ccugggcagcugccuccccu

SEQ ID NO: 2749656 - RNA, 11 nt, Human
cguuuugucac

SEQ ID NO: 2749657 - RNA, 17 nt, Human
cgucuggcccaccaggg

SEQ ID NO: 2749658 - RNA, 11 nt, Human
cgcaaugugac

SEQ ID NO: 2749659 - RNA, 20 nt, Human
cgcuccugucugccagccag

SEQ ID NO: 2749660 - RNA, 17 nt, Human
cgcuccugucugccagc

SEQ ID NO: 2749661 - RNA, 21 nt, Human
cgcuccugucugccagccagc

SEQ ID NO: 2749662 - RNA, 16 nt, Human
cgcuccugucugccag

SEQ ID NO: 2749663 - RNA, 17 nt, Human
cggccuccauccugagg

SEQ ID NO: 2749664 - RNA, 16 nt, Human
cggccuccauccugag

SEQ ID NO: 2749665 - RNA, 14 nt, Human
cggccuccauccug

SEQ ID NO: 2749666 - RNA, 18 nt, Human
cauuugcucauggaauug

SEQ ID NO: 2749667 - RNA, 13 nt, Human
cauuugcucaugg

SEQ ID NO: 2749668 - RNA, 17 nt, Human
cauuuaggccaugggac

SEQ ID NO: 2749669 - RNA, 23 nt, Human
ccaaggguucagagacucagggc

SEQ ID NO: 2749670 - RNA, 20 nt, Human
ccaaggguucagagacucag

SEQ ID NO: 2749671 - RNA, 22 nt, Human
ccaagcauaccaacacgagcag

SEQ ID NO: 2749672 - RNA, 17 nt, Human
ccaagcauuuagaugua

SEQ ID NO: 2749673 - RNA, 14 nt, Human
ccaagcaaguauua

SEQ ID NO: 2749674 - RNA, 22 nt, Human
ccaacccgucuggcccaccagg

SEQ ID NO: 2749675 - RNA, 23 nt, Human
ccaaauuucauaccuaucaucuu

SEQ ID NO: 2749676 - RNA, 22 nt, Human
ccaaacugacucuuaagaagac

SEQ ID NO: 2749677 - RNA, 20 nt, Human
ccacaggaaccacaagacug

SEQ ID NO: 2749678 - RNA, 16 nt, Human
ccaauauucauagcag

SEQ ID NO: 2749679 - RNA, 12 nt, Human
ccaauauccuaa

SEQ ID NO: 2749680 - RNA, 13 nt, Human
ccaauauccuaau

SEQ ID NO: 2749681 - RNA, 14 nt, Human
ccaauauccuaaua

SEQ ID NO: 2749682 - RNA, 15 nt, Human
ccaauauccuaauaa

SEQ ID NO: 2749683 - RNA, 16 nt, Human
ccaauauccuaauaaa

SEQ ID NO: 2749684 - RNA, 17 nt, Human
ccaauauccuaauaaaa

SEQ ID NO: 2749685 - RNA, 18 nt, Human
ccaauauccuaauaaaaa

SEQ ID NO: 2749686 - RNA, 19 nt, Human
ccaauauccuaauaaaaag

SEQ ID NO: 2749687 - RNA, 18 nt, Human
ccagaagucaaggcuuag

SEQ ID NO: 2749688 - RNA, 23 nt, Human
ccagaaauaaaguuggugacaga

SEQ ID NO: 2749689 - RNA, 21 nt, Human
ccagaaauaaaguuggugaca

SEQ ID NO: 2749690 - RNA, 20 nt, Human
ccacuuaauguauguuacca

SEQ ID NO: 2749691 - RNA, 15 nt, Human
ccacuuaauguaugu

SEQ ID NO: 2749692 - RNA, 17 nt, Human
ccacuuaauguauguua

SEQ ID NO: 2749693 - RNA, 18 nt, Human
ccacugcagaagacagua

SEQ ID NO: 2749694 - RNA, 13 nt, Human
ccacugcagaaga

SEQ ID NO: 2749695 - RNA, 17 nt, Human
ccaggugccaguuaugg

SEQ ID NO: 2749696 - RNA, 11 nt, Human
ccagggcucag

SEQ ID NO: 2749697 - RNA, 15 nt, Human
ccagggcucagccug

SEQ ID NO: 2749698 - RNA, 14 nt, Human
ccagggcucagccu

SEQ ID NO: 2749699 - RNA, 13 nt, Human
ccagggcucagcc

SEQ ID NO: 2749700 - RNA, 12 nt, Human
ccagggcucagc

SEQ ID NO: 2749701 - RNA, 20 nt, Human
ccagggcucagccugguggg

SEQ ID NO: 2749702 - RNA, 16 nt, Human
ccagggcucagccugg

SEQ ID NO: 2749703 - RNA, 13 nt, Human
cccaaaaggcaga

SEQ ID NO: 2749704 - RNA, 18 nt, Human
cccaaaaggcagaagcaa

SEQ ID NO: 2749705 - RNA, 16 nt, Human
ccaugauguuuagaaa

SEQ ID NO: 2749706 - RNA, 14 nt, Human
ccaugaagauguag

SEQ ID NO: 2749707 - RNA, 18 nt, Human
ccaucaaggguacacugc

SEQ ID NO: 2749708 - RNA, 19 nt, Human
cccaaguucaugcagcugu

SEQ ID NO: 2749709 - RNA, 15 nt, Human
cccaggaguuuggcc

SEQ ID NO: 2749710 - RNA, 16 nt, Human
cccaggaguuuggcca

SEQ ID NO: 2749711 - RNA, 17 nt, Human
cccaggaguuuggccag

SEQ ID NO: 2749712 - RNA, 18 nt, Human
cccaggaguuuggccaga

SEQ ID NO: 2749713 - RNA, 19 nt, Human
cccaggaguuuggccagaa

SEQ ID NO: 2749714 - RNA, 20 nt, Human
cccaggaguuuggccagaag

SEQ ID NO: 2749715 - RNA, 13 nt, Human
cccaggugccagu

SEQ ID NO: 2749716 - RNA, 18 nt, Human
cugccaauauccuaauaa

SEQ ID NO: 2749717 - RNA, 19 nt, Human
cugccaauauccuaauaaa

SEQ ID NO: 2749718 - RNA, 20 nt, Human
cugccaauauccuaauaaaa

SEQ ID NO: 2749719 - RNA, 22 nt, Human
cugccaauauccuaauaaaaag

SEQ ID NO: 2749720 - RNA, 13 nt, Human
cugccaauauccu

SEQ ID NO: 2749721 - RNA, 14 nt, Human
cugccaauauccua

SEQ ID NO: 2749722 - RNA, 16 nt, Human
cugccaauauccuaau

SEQ ID NO: 2749723 - RNA, 17 nt, Human
cugccaauauccuaaua

SEQ ID NO: 2749724 - RNA, 21 nt, Human
cuggaaaucaggguuaguauu

SEQ ID NO: 2749725 - RNA, 12 nt, Human
cugcuaccucac

SEQ ID NO: 2749726 - RNA, 14 nt, Human
cugcuaccucacug

SEQ ID NO: 2749727 - RNA, 13 nt, Human
cugcuaccucacu

SEQ ID NO: 2749728 - RNA, 15 nt, Human
cugcuaccucacugg

SEQ ID NO: 2749729 - RNA, 16 nt, Human
cugugagaugcuagaa

SEQ ID NO: 2749730 - RNA, 21 nt, Human
cugucagcuccccucggagaa

SEQ ID NO: 2749731 - RNA, 23 nt, Human
cugucagcuccccucggagaaga

SEQ ID NO: 2749732 - RNA, 22 nt, Human
cugggcagcugccuccccuccu

SEQ ID NO: 2749733 - RNA, 21 nt, Human
cugggcagcugccuccccucc

SEQ ID NO: 2749734 - RNA, 20 nt, Human
cugggcagcugccuccccuc

SEQ ID NO: 2749735 - RNA, 19 nt, Human
cugggcagcugccuccccu

SEQ ID NO: 2749736 - RNA, 16 nt, Human
cugggcagcugccucc

SEQ ID NO: 2749737 - RNA, 19 nt, Human
cuggggccucggagccuca

SEQ ID NO: 2749738 - RNA, 24 nt, Human
cuggugagucaccacuucagggcu

SEQ ID NO: 2749739 - RNA, 10 nt, Human
cugggacagg

SEQ ID NO: 2749740 - RNA, 13 nt, Human
cuugaugaagaag

SEQ ID NO: 2749741 - RNA, 12 nt, Human
cuugaugaagaa

SEQ ID NO: 2749742 - RNA, 22 nt, Human
cuucuaaguaaaaccacagcag

SEQ ID NO: 2749743 - RNA, 23 nt, Human
cuucuaaguaaaaccacagcagu

SEQ ID NO: 2749744 - RNA, 15 nt, Human
cuucacuguaaaaua

SEQ ID NO: 2749745 - RNA, 18 nt, Human
cuuaugcgguuaauuuug

SEQ ID NO: 2749746 - RNA, 16 nt, Human
cuuaugcgguuaauuu

SEQ ID NO: 2749747 - RNA, 17 nt, Human
cuuaugcgguuaauuuu

SEQ ID NO: 2749748 - RNA, 19 nt, Human
gaaaucaaauaugcaaagc

SEQ ID NO: 2749749 - RNA, 20 nt, Human
gaaaucaaauaugcaaagca

SEQ ID NO: 2749750 - RNA, 22 nt, Human
gaaauauuuauuuuaauaaugu

SEQ ID NO: 2749751 - RNA, 18 nt, Human
gaaauauuuauuuuaaua

SEQ ID NO: 2749752 - RNA, 18 nt, Human
gaaaucaaauaugcaaag

SEQ ID NO: 2749753 - RNA, 17 nt, Human
gaaaucaaauaugcaaa

SEQ ID NO: 2749754 - RNA, 17 nt, Human
gaaauauuuauuuuaau

SEQ ID NO: 2749755 - RNA, 14 nt, Human
gaaagacuauucaa

SEQ ID NO: 2749756 - RNA, 15 nt, Human
gaaagacuauucaaa

SEQ ID NO: 2749757 - RNA, 17 nt, Human
gaaagacuauucaaaca

SEQ ID NO: 2749758 - RNA, 14 nt, Human
cuuuuuuucuguac

SEQ ID NO: 2749759 - RNA, 16 nt, Human
cuuuuuuucuguacca

SEQ ID NO: 2749760 - RNA, 19 nt, Human
cuuuuuuucuguaccaguu

SEQ ID NO: 2749761 - RNA, 13 nt, Human
cuuuugugaauua

SEQ ID NO: 2749762 - RNA, 13 nt, Human
gaaaauucauuuu

SEQ ID NO: 2749763 - RNA, 14 nt, Human
gaaaauucauuuuu

SEQ ID NO: 2749764 - RNA, 22 nt, Human
cuuucuagaaagagaaacaguu

SEQ ID NO: 2749765 - RNA, 16 nt, Human
gaguuuagcuggaaaa

SEQ ID NO: 2749766 - RNA, 21 nt, Human
gagugcucaguagucagacug

SEQ ID NO: 2749767 - RNA, 12 nt, Human
gaguuuggccag

SEQ ID NO: 2749768 - RNA, 13 nt, Human
gaguuuggccaga

SEQ ID NO: 2749769 - RNA, 14 nt, Human
gaguuuggccagaa

SEQ ID NO: 2749770 - RNA, 20 nt, Human
gauauguaccuaacgaagua

SEQ ID NO: 2749771 - RNA, 17 nt, Human
gauuagggagagaagau

SEQ ID NO: 2749772 - RNA, 19 nt, Human
gauuauuaacgauguccaa

SEQ ID NO: 2749773 - RNA, 14 nt, Human
gaugugaacacauc

SEQ ID NO: 2749774 - RNA, 16 nt, Human
gaugugaacacaucag

SEQ ID NO: 2749775 - RNA, 22 nt, Human
gauuacuggccuuuuucauuua

SEQ ID NO: 2749776 - RNA, 14 nt, Human
gauuaccagggacu

SEQ ID NO: 2749777 - RNA, 19 nt, Human
gcauaaccugucucaccug

SEQ ID NO: 2749778 - RNA, 14 nt, Human
gcauaaccugucuc

SEQ ID NO: 2749779 - RNA, 12 nt, Human
gcaguuuuuuga

SEQ ID NO: 2749780 - RNA, 18 nt, Human
gcaguuuuuugaaaaugg

SEQ ID NO: 2749781 - RNA, 19 nt, Human
gcagggacuugaacccaua

SEQ ID NO: 2749782 - RNA, 22 nt, Human
gcagcugccuccccuccucugc

SEQ ID NO: 2749783 - RNA, 18 nt, Human
gcagcugccuccccuccu

SEQ ID NO: 2749784 - RNA, 17 nt, Human
gcagcugccuccccucc

SEQ ID NO: 2749785 - RNA, 16 nt, Human
gcagcugccuccccuc

SEQ ID NO: 2749786 - RNA, 15 nt, Human
gcagcugccuccccu

SEQ ID NO: 2749787 - RNA, 13 nt, Human
gcagcugccuccc

SEQ ID NO: 2749788 - RNA, 12 nt, Human
gcagcugccucc

SEQ ID NO: 2749789 - RNA, 11 nt, Human
gcagcugccuc

SEQ ID NO: 2749790 - RNA, 21 nt, Human
gcacaugagcuggcgggauug

SEQ ID NO: 2749791 - RNA, 14 nt, Human
gcacaguuuucuga

SEQ ID NO: 2749792 - RNA, 17 nt, Human
gcacaguuuucugagaa

SEQ ID NO: 2749793 - RNA, 18 nt, Human
gcacaguuuucugagaaa

SEQ ID NO: 2749794 - RNA, 21 nt, Human
gcagaacagccgcuccugucu

SEQ ID NO: 2749795 - RNA, 18 nt, Human
gcagaacagccgcuccug

SEQ ID NO: 2749796 - RNA, 15 nt, Human
gagaaucacuugaac

SEQ ID NO: 2749797 - RNA, 14 nt, Human
gagaaucacuugaa

SEQ ID NO: 2749798 - RNA, 16 nt, Human
gacucuuaagaagacu

SEQ ID NO: 2749799 - RNA, 15 nt, Human
gacucuuaagaagac

SEQ ID NO: 2749800 - RNA, 17 nt, Human
gacucuuaagaagacug

SEQ ID NO: 2749801 - RNA, 22 nt, Human
gacuaucaaacugaagccagaa

SEQ ID NO: 2749802 - RNA, 18 nt, Human
gacuaucaaacugaagcc

SEQ ID NO: 2749803 - RNA, 22 nt, Human
gacuauucaaacagucucagga

SEQ ID NO: 2749804 - RNA, 14 nt, Human
gacagugaaagaaa

SEQ ID NO: 2749805 - RNA, 17 nt, Human
gacagucaccucaugga

SEQ ID NO: 2749806 - RNA, 20 nt, Human
gacaguauggcagcuuuccu

SEQ ID NO: 2749807 - RNA, 16 nt, Human
gacacuuaaaaauggu

SEQ ID NO: 2749808 - RNA, 11 nt, Human
gaauuaguuuu

SEQ ID NO: 2749809 - RNA, 12 nt, Human
gacacacaugaa

SEQ ID NO: 2749810 - RNA, 13 nt, Human
gacacacugaaga

SEQ ID NO: 2749811 - RNA, 18 nt, Human
gacacaccaggcgcuaau

SEQ ID NO: 2749812 - RNA, 15 nt, Human
gacacaccaggcgcu

SEQ ID NO: 2749813 - RNA, 20 nt, Human
gaaugagagacacacugaag

SEQ ID NO: 2749814 - RNA, 23 nt, Human
gaaugagagacacacugaagaag

SEQ ID NO: 2749815 - RNA, 22 nt, Human
gaaugagagacacacugaagaa

SEQ ID NO: 2749816 - RNA, 18 nt, Human
gaagugcuguuuauuaau

SEQ ID NO: 2749817 - RNA, 20 nt, Human
gaagugcuguuuauuaaucu

SEQ ID NO: 2749818 - RNA, 15 nt, Human
gggugggcaguuuuu

SEQ ID NO: 2749819 - RNA, 19 nt, Human
gguaauaaguacuguguac

SEQ ID NO: 2749820 - RNA, 14 nt, Human
aaagacuauucaaa

SEQ ID NO: 2749821 - RNA, 14 nt, Human
gguccuggggccuc

SEQ ID NO: 2749822 - RNA, 12 nt, Human
gguccuggggcc

SEQ ID NO: 2749823 - RNA, 15 nt, Human
aaagacuauucaaac

SEQ ID NO: 2749824 - RNA, 17 nt, Human
aaagcagggacuugaac

SEQ ID NO: 2749825 - RNA, 18 nt, Human
gguggggcagugcuuggc

SEQ ID NO: 2749826 - RNA, 16 nt, Human
ggugugaccacugcag

SEQ ID NO: 2749827 - RNA, 12 nt, Human
gguuucuagcau

SEQ ID NO: 2749828 - RNA, 16 nt, Human
gguuuagaaagcuugc

SEQ ID NO: 2749829 - RNA, 23 nt, Human
aaaguguauuuggaaauaaaguc

SEQ ID NO: 2749830 - RNA, 22 nt, Human
aaaguguauuuggaaauaaagu

SEQ ID NO: 2749831 - RNA, 10 nt, Human
aaaguguauu

SEQ ID NO: 2749832 - RNA, 14 nt, Human
aaaguguauuugga

SEQ ID NO: 2749833 - RNA, 15 nt, Human
aaaguguauuuggaa

SEQ ID NO: 2749834 - RNA, 20 nt, Human
aaauaauuuuuauauuugaa

SEQ ID NO: 2749835 - RNA, 18 nt, Human
aaauaauuuuuauauuug

SEQ ID NO: 2749836 - RNA, 15 nt, Human
aaauaauuuuuauau

SEQ ID NO: 2749837 - RNA, 15 nt, Human
aaaaugugauaugua

SEQ ID NO: 2749838 - RNA, 22 nt, Human
aaaauuuuuucucuaggaaaua

SEQ ID NO: 2749839 - RNA, 20 nt, Human
aaacaagcacuaaacaaaga

SEQ ID NO: 2749840 - RNA, 20 nt, Human
aaacagucucaggaaaucaa

SEQ ID NO: 2749841 - RNA, 21 nt, Human
gggccuccucuguccagggcc

SEQ ID NO: 2749842 - RNA, 15 nt, Human
gggcgugguggugag

SEQ ID NO: 2749843 - RNA, 19 nt, Human
aaaaguauguuagugcaaa

SEQ ID NO: 2749844 - RNA, 17 nt, Human
gggauuguaaaauggug

SEQ ID NO: 2749845 - RNA, 16 nt, Human
gggauuguaaaauggu

SEQ ID NO: 2749846 - RNA, 13 nt, Human
aaaaccacagcag

SEQ ID NO: 2749847 - RNA, 14 nt, Human
aaaaccacagcagu

SEQ ID NO: 2749848 - RNA, 17 nt, Human
aaaagaugaaaauauuu

SEQ ID NO: 2749849 - RNA, 13 nt, Human
aaaacucauuuuu

SEQ ID NO: 2749850 - RNA, 22 nt, Human
aaaaauggaacauaaaauacaa

SEQ ID NO: 2749851 - RNA, 12 nt, Human
aaaaccacagca

SEQ ID NO: 2749852 - RNA, 20 nt, Human
gggaaggaggguuagggagg

SEQ ID NO: 2749853 - RNA, 19 nt, Human
gggacauuugcucauggaa

SEQ ID NO: 2749854 - RNA, 21 nt, Human
gggacauuugcucauggaauu

SEQ ID NO: 2749855 - RNA, 20 nt, Human
gggacauuugcucauggaau

SEQ ID NO: 2749856 - RNA, 15 nt, Human
ggccuuuuucauuua

SEQ ID NO: 2749857 - RNA, 23 nt, Human
ggccuucggccuccauccugagg

SEQ ID NO: 2749858 - RNA, 22 nt, Human
ggccuucggccuccauccugag

SEQ ID NO: 2749859 - RNA, 12 nt, Human
ggcucagccugg

SEQ ID NO: 2749860 - RNA, 10 nt, Human
ggcucagccu

SEQ ID NO: 2749861 - RNA, 11 nt, Human
ggcucagccug

SEQ ID NO: 2749862 - RNA, 13 nt, Human
ggcauagcucugg

SEQ ID NO: 2749863 - RNA, 15 nt, Human
ggcauagcucugggg

SEQ ID NO: 2749864 - RNA, 11 nt, Human
ggcccaggagu

SEQ ID NO: 2749865 - RNA, 13 nt, Human
ggcccaggaguuu

SEQ ID NO: 2749866 - RNA, 18 nt, Human
ggcccaggaguuuggcca

SEQ ID NO: 2749867 - RNA, 19 nt, Human
ggcccaggaguuuggccag

SEQ ID NO: 2749868 - RNA, 20 nt, Human
ggcccaggaguuuggccaga

SEQ ID NO: 2749869 - RNA, 13 nt, Human
ggaguuuggccag

SEQ ID NO: 2749870 - RNA, 14 nt, Human
ggaguuuggccaga

SEQ ID NO: 2749871 - RNA, 15 nt, Human
ggaguuuggccagaa

SEQ ID NO: 2749872 - RNA, 12 nt, Human
ggauggcaagau

SEQ ID NO: 2749873 - RNA, 14 nt, Human
ggagccaccaguuc

SEQ ID NO: 2749874 - RNA, 15 nt, Human
ggagccaccaguucu

SEQ ID NO: 2749875 - RNA, 23 nt, Human
ggagccaaggguucagagacuca

SEQ ID NO: 2749876 - RNA, 21 nt, Human
gccagcaguucagagcugccc

SEQ ID NO: 2749877 - RNA, 20 nt, Human
gccagcaguucagagcugcc

SEQ ID NO: 2749878 - RNA, 19 nt, Human
gccagccagcagccagcuc

SEQ ID NO: 2749879 - RNA, 16 nt, Human
gccagccagcagccag

SEQ ID NO: 2749880 - RNA, 19 nt, Human
gccagcaguucagagcugc

SEQ ID NO: 2749881 - RNA, 14 nt, Human
gccagcaguucaga

SEQ ID NO: 2749882 - RNA, 13 nt, Human
gccagcaguucag

SEQ ID NO: 2749883 - RNA, 22 nt, Human
gccaguuauggcuauaggugcu

SEQ ID NO: 2749884 - RNA, 15 nt, Human
gccccacccucagau

SEQ ID NO: 2749885 - RNA, 18 nt, Human
gccccacccucagaugca

SEQ ID NO: 2749886 - RNA, 21 nt, Human
gcccuagagcacacuguagca

SEQ ID NO: 2749887 - RNA, 13 nt, Human
gcccaggaguuug

SEQ ID NO: 2749888 - RNA, 15 nt, Human
gcccaggaguuuggc

SEQ ID NO: 2749889 - RNA, 16 nt, Human
gcccaggaguuuggcc

SEQ ID NO: 2749890 - RNA, 22 nt, Human
gccaugugcuaguaauuggaaa

SEQ ID NO: 2749891 - RNA, 17 nt, Human
gcccaggaguuuggcca

SEQ ID NO: 2749892 - RNA, 18 nt, Human
gcccaggaguuuggccag

SEQ ID NO: 2749893 - RNA, 15 nt, Human
gcuacugucagcucc

SEQ ID NO: 2749894 - RNA, 17 nt, Human
gcuacuugggaggcuga

SEQ ID NO: 2749895 - RNA, 18 nt, Human
gcuacaaaaacacagcaa

SEQ ID NO: 2749896 - RNA, 19 nt, Human
gcuacaaaaacacagcaag

SEQ ID NO: 2749897 - RNA, 17 nt, Human
gcuacaaaaacacagca

SEQ ID NO: 2749898 - RNA, 20 nt, Human
gccuccauccugaggcucca

SEQ ID NO: 2749899 - RNA, 16 nt, Human
gccuccauccugaggc

SEQ ID NO: 2749900 - RNA, 15 nt, Human
gccuccauccugagg

SEQ ID NO: 2749901 - RNA, 19 nt, Human
gcuuccuggcaauagucaa

SEQ ID NO: 2749902 - RNA, 17 nt, Human
gcuuauuuccucauuuu

SEQ ID NO: 2749903 - RNA, 12 nt, Human
gcuguauuuuaa

SEQ ID NO: 2749904 - RNA, 13 nt, Human
gcuguauuuuaaa

SEQ ID NO: 2749905 - RNA, 16 nt, Human
gcugaaacaacaaaua

SEQ ID NO: 2749906 - RNA, 12 nt, Human
gcugaacaucac

SEQ ID NO: 2749907 - RNA, 15 nt, Human
gcucugcccauccug

SEQ ID NO: 2749908 - RNA, 21 nt, Human
gcucugcccauccugccccug

SEQ ID NO: 2749909 - RNA, 20 nt, Human
gcuccacuuggucugugaga

SEQ ID NO: 2749910 - RNA, 17 nt, Human
gcucucagccaacgagu

SEQ ID NO: 2749911 - RNA, 11 nt, Human
gcucucagcca

SEQ ID NO: 2749912 - RNA, 10 nt, Human
gcucucagcc

SEQ ID NO: 2749913 - RNA, 20 nt, Human
cucuuagaugcaguucugaa

SEQ ID NO: 2749914 - RNA, 19 nt, Human
cucugcacucccaccugac

SEQ ID NO: 2749915 - RNA, 20 nt, Human
cucugcacucccaccugaca

SEQ ID NO: 2749916 - RNA, 23 nt, Human
cucugcacucccaccugacacac

SEQ ID NO: 2749917 - RNA, 15 nt, Human
cucuuagaugcaguu

SEQ ID NO: 2749918 - RNA, 23 nt, Human
cucucagccaacgaguaauuuau

SEQ ID NO: 2749919 - RNA, 11 nt, Human
cucucagccaa

SEQ ID NO: 2749920 - RNA, 11 nt, Human
cucucuggccu

SEQ ID NO: 2749921 - RNA, 12 nt, Human
cucucuggccuu

SEQ ID NO: 2749922 - RNA, 18 nt, Human
cucagccugugcugcccg

SEQ ID NO: 2749923 - RNA, 16 nt, Human
cucagccugugcugcc

SEQ ID NO: 2749924 - RNA, 22 nt, Human
cucagccuuccccuugcccagg

SEQ ID NO: 2749925 - RNA, 23 nt, Human
cucagccuuccccuugcccaggg

SEQ ID NO: 2749926 - RNA, 14 nt, Human
cucagccugugcug

SEQ ID NO: 2749927 - RNA, 13 nt, Human
cucagccugugcu

SEQ ID NO: 2749928 - RNA, 20 nt, Human
cucagccuggugggccuccu

SEQ ID NO: 2749929 - RNA, 19 nt, Human
cucagccuggugggccucc

SEQ ID NO: 2749930 - RNA, 18 nt, Human
cucagccuggugggccuc

SEQ ID NO: 2749931 - RNA, 16 nt, Human
cucagccuggugggcc

SEQ ID NO: 2749932 - RNA, 12 nt, Human
cucagccuggug

SEQ ID NO: 2749933 - RNA, 14 nt, Human
cucaugcugccaau

SEQ ID NO: 2749934 - RNA, 22 nt, Human
cucaugcugccaauauccuaau

SEQ ID NO: 2749935 - RNA, 12 nt, Human
cucaugcugcca

SEQ ID NO: 2749936 - RNA, 19 nt, Human
cucagucucucuucucucc

SEQ ID NO: 2749937 - RNA, 12 nt, Human
cucagucucucu

SEQ ID NO: 2749938 - RNA, 17 nt, Human
cucagucucucuucucu

SEQ ID NO: 2749939 - RNA, 16 nt, Human
cucccugcaauaaaau

SEQ ID NO: 2749940 - RNA, 14 nt, Human
cucccugcaauaaa

SEQ ID NO: 2749941 - RNA, 21 nt, Human
cuccagugagacagcucugca

SEQ ID NO: 2749942 - RNA, 20 nt, Human
cuagccgaccucagccuucc

SEQ ID NO: 2749943 - RNA, 19 nt, Human
cuagccgaccucagccuuc

SEQ ID NO: 2749944 - RNA, 18 nt, Human
cuagccgaccucagccuu

SEQ ID NO: 2749945 - RNA, 17 nt, Human
cuagccgaccucagccu

SEQ ID NO: 2749946 - RNA, 16 nt, Human
cuagccgaccucagcc

SEQ ID NO: 2749947 - RNA, 15 nt, Human
cuagccgaccucagc

SEQ ID NO: 2749948 - RNA, 14 nt, Human
cuagccgaccucag

SEQ ID NO: 2749949 - RNA, 13 nt, Human
cuagccgaccuca

SEQ ID NO: 2749950 - RNA, 23 nt, Human
cuaguugaucagcuuauugucua

SEQ ID NO: 2749951 - RNA, 16 nt, Human
cuagcaugaagacaga

SEQ ID NO: 2749952 - RNA, 19 nt, Human
cuagaacucccuuucaaca

SEQ ID NO: 2749953 - RNA, 18 nt, Human
cuagaacucccuuucaac

SEQ ID NO: 2749954 - RNA, 17 nt, Human
cuagaacucccuuucaa

SEQ ID NO: 2749955 - RNA, 16 nt, Human
cuagaacucccuuuca

SEQ ID NO: 2749956 - RNA, 15 nt, Human
cuacaugagguacug

SEQ ID NO: 2749957 - RNA, 23 nt, Human
cuaagugaaauaagccagacauc

SEQ ID NO: 2749958 - RNA, 20 nt, Human
cuaagugaaauaagccagac

SEQ ID NO: 2749959 - RNA, 15 nt, Human
cgaccucagccuucc

SEQ ID NO: 2749960 - RNA, 14 nt, Human
cgaccucagccuuc

SEQ ID NO: 2749961 - RNA, 13 nt, Human
cgaccucagccuu

SEQ ID NO: 2749962 - RNA, 12 nt, Human
cgaccucagccu

SEQ ID NO: 2749963 - RNA, 21 nt, Human
cggagccucauccgaggcagg

SEQ ID NO: 2749964 - RNA, 20 nt, Human
cggagccucauccgaggcag

SEQ ID NO: 2749965 - RNA, 22 nt, Human
cggagccucauccgaggcaggg

SEQ ID NO: 2749966 - RNA, 18 nt, Human
ccuugcccagggcucagc

SEQ ID NO: 2749967 - RNA, 17 nt, Human
ccuugcccagggcucag

SEQ ID NO: 2749968 - RNA, 16 nt, Human
ccuugcccagggcuca

SEQ ID NO: 2749969 - RNA, 15 nt, Human
ccuugcccagggcuc

SEQ ID NO: 2749970 - RNA, 13 nt, Human
ccuugcccagggc

SEQ ID NO: 2749971 - RNA, 20 nt, Human
ccuugcccagggcucagccu

SEQ ID NO: 2749972 - RNA, 13 nt, Human
ccuuuuucauuua

SEQ ID NO: 2749973 - RNA, 16 nt, Human
cgacagugagacucug

SEQ ID NO: 2749974 - RNA, 15 nt, Human
cgacagugagacucu

SEQ ID NO: 2749975 - RNA, 15 nt, Human
ccgaccucagccuuc

SEQ ID NO: 2749976 - RNA, 14 nt, Human
ccgaccucagccuu

SEQ ID NO: 2749977 - RNA, 13 nt, Human
ccgaccucagccu

SEQ ID NO: 2749978 - RNA, 12 nt, Human
ccgaccucagcc

SEQ ID NO: 2749979 - RNA, 13 nt, Human
cccuucucuguau

SEQ ID NO: 2749980 - RNA, 16 nt, Human
ccguagguuauuuuca

SEQ ID NO: 2749981 - RNA, 24 nt, Human
ccguagacgugcacgcacacuguc

SEQ ID NO: 2749982 - RNA, 17 nt, Human
ccgucuggcccaccagg

SEQ ID NO: 2749983 - RNA, 18 nt, Human
ccgucuggcccaccaggg

SEQ ID NO: 2749984 - RNA, 16 nt, Human
ccgucuggcccaccag

SEQ ID NO: 2749985 - RNA, 20 nt, Human
ccucauguccacugguucuu

SEQ ID NO: 2749986 - RNA, 15 nt, Human
ccucauguccacugg

SEQ ID NO: 2749987 - RNA, 13 nt, Human
ccucugcuugcca

SEQ ID NO: 2749988 - RNA, 15 nt, Human
ccagcagccagcucu

SEQ ID NO: 2749989 - RNA, 20 nt, Human
ccagcagccagcucucagcc

SEQ ID NO: 2749990 - RNA, 19 nt, Human
ccagcagccagcucucagc

SEQ ID NO: 2749991 - RNA, 18 nt, Human
ccagcagccagcucucag

SEQ ID NO: 2749992 - RNA, 16 nt, Human
ccagcagccagcucuc

SEQ ID NO: 2749993 - RNA, 15 nt, Human
ccagauccuggaaau

SEQ ID NO: 2749994 - RNA, 22 nt, Human
ccccuuuucggccccauguauc

SEQ ID NO: 2749995 - RNA, 21 nt, Human
ccccuugcccagggcucagcc

SEQ ID NO: 2749996 - RNA, 20 nt, Human
ccccuugcccagggcucagc

SEQ ID NO: 2749997 - RNA, 17 nt, Human
ccccuugcccagggcuc

SEQ ID NO: 2749998 - RNA, 23 nt, Human
ccccuugcccagggcucagccug

SEQ ID NO: 2749999 - RNA, 23 nt, Human
cccgggaggcagagguugcagug

SEQ ID NO: 2750000 - RNA, 19 nt, Human
ccccagcacuaaagcagug

SEQ ID NO: 2750001 - RNA, 11 nt, Human
ccccagcacua

SEQ ID NO: 2750002 - RNA, 23 nt, Human
cccauuguggucacaggaaguag

SEQ ID NO: 2750003 - RNA, 22 nt, Human
cccauuguggucacaggaagua

SEQ ID NO: 2750004 - RNA, 20 nt, Human
cccagccagcaguucagagc

SEQ ID NO: 2750005 - RNA, 17 nt, Human
cccagccagcaguucag

SEQ ID NO: 2750006 - RNA, 16 nt, Human
cccagccagcaguuca

SEQ ID NO: 2750007 - RNA, 20 nt, Human
cccauauuuguacaccaaua

SEQ ID NO: 2750008 - RNA, 20 nt, Human
cagccagacuggcacaguuu

SEQ ID NO: 2750009 - RNA, 22 nt, Human
cagcaguucagagcugcccucu

SEQ ID NO: 2750010 - RNA, 21 nt, Human
cagcaguucagagcugcccuc

SEQ ID NO: 2750011 - RNA, 20 nt, Human
cagcaguucagagcugcccu

SEQ ID NO: 2750012 - RNA, 19 nt, Human
cagcaguucagagcugccc

SEQ ID NO: 2750013 - RNA, 18 nt, Human
cagcaguucagagcugcc

SEQ ID NO: 2750014 - RNA, 11 nt, Human
cagccagcagc

SEQ ID NO: 2750015 - RNA, 12 nt, Human
cagccagcagcc

SEQ ID NO: 2750016 - RNA, 14 nt, Human
cagccagcagccag

SEQ ID NO: 2750017 - RNA, 19 nt, Human
cagccccgugggguuccuc

SEQ ID NO: 2750018 - RNA, 12 nt, Human
cagccgcuccug

SEQ ID NO: 2750019 - RNA, 23 nt, Human
cagccugagcgacagugagacuc

SEQ ID NO: 2750020 - RNA, 22 nt, Human
cagccugagcgacagugagacu

SEQ ID NO: 2750021 - RNA, 16 nt, Human
caguauuuagaagcca

SEQ ID NO: 2750022 - RNA, 17 nt, Human
caguauuuagaagccaa

SEQ ID NO: 2750023 - RNA, 19 nt, Human
cagggcucagccugguggg

SEQ ID NO: 2750024 - RNA, 16 nt, Human
cagggcucagccuggu

SEQ ID NO: 2750025 - RNA, 15 nt, Human
cagggcucagccugg

SEQ ID NO: 2750026 - RNA, 19 nt, Human
cagggaggacgcucucugg

SEQ ID NO: 2750027 - RNA, 22 nt, Human
cagggaggacgcucucuggccu

SEQ ID NO: 2750028 - RNA, 19 nt, Human
cagcuguggcagaguuaca

SEQ ID NO: 2750029 - RNA, 23 nt, Human
cagcuguggcagaguuacaguuc

SEQ ID NO: 2750030 - RNA, 17 nt, Human
cagcuguggcagaguua

SEQ ID NO: 2750031 - RNA, 16 nt, Human
cagcuuauucacaaga

SEQ ID NO: 2750032 - RNA, 19 nt, Human
caggaaaucaaauaugcaa

SEQ ID NO: 2750033 - RNA, 21 nt, Human
caggaaaucaaauaugcaaag

SEQ ID NO: 2750034 - RNA, 24 nt, Human
caggacagcccuucuuuccacaga

SEQ ID NO: 2750035 - RNA, 23 nt, Human
caggacagcccuucuuuccacag

SEQ ID NO: 2750036 - RNA, 14 nt, Human
ccaacuacuaauag

SEQ ID NO: 2750037 - RNA, 22 nt, Human
ccaacuacuaauagaauaaagg

SEQ ID NO: 2750038 - RNA, 14 nt, Human
ccaacuaugauuau

SEQ ID NO: 2750039 - RNA, 18 nt, Human
ccaaauguucaucaauga

SEQ ID NO: 2750040 - RNA, 16 nt, Human
ccaaaaauaaauauau

SEQ ID NO: 2750041 - RNA, 15 nt, Human
cauuaggauggcuag

SEQ ID NO: 2750042 - RNA, 17 nt, Human
cauagauucccugagca

SEQ ID NO: 2750043 - RNA, 18 nt, Human
cauagauucccugagcag

SEQ ID NO: 2750044 - RNA, 20 nt, Human
cauagcagcuuauucacaag

SEQ ID NO: 2750045 - RNA, 17 nt, Human
caucagcugcugaaaca

SEQ ID NO: 2750046 - RNA, 18 nt, Human
caucagcugcugaaacaa

SEQ ID NO: 2750047 - RNA, 15 nt, Human
caucagcugcugaaa

SEQ ID NO: 2750048 - RNA, 13 nt, Human
caucagcugcuga

SEQ ID NO: 2750049 - RNA, 20 nt, Human
caucagcuugcccuguuaaa

SEQ ID NO: 2750050 - RNA, 15 nt, Human
caugcugccaauauc

SEQ ID NO: 2750051 - RNA, 17 nt, Human
caugcugccaauauccu

SEQ ID NO: 2750052 - RNA, 19 nt, Human
caugcugccaauauccuaa

SEQ ID NO: 2750053 - RNA, 21 nt, Human
caugcugccaauauccuaaua

SEQ ID NO: 2750054 - RNA, 22 nt, Human
caugcugccaauauccuaauaa

SEQ ID NO: 2750055 - RNA, 16 nt, Human
caugaauuaguuuuau

SEQ ID NO: 2750056 - RNA, 22 nt, Human
cacugguucuucuuggucucag

SEQ ID NO: 2750057 - RNA, 15 nt, Human
cacugggguccuggg

SEQ ID NO: 2750058 - RNA, 19 nt, Human
cacugggguccuggggccu

SEQ ID NO: 2750059 - RNA, 18 nt, Human
cacugggguccuggggcc

SEQ ID NO: 2750060 - RNA, 16 nt, Human
cacuugucaauaaaau

SEQ ID NO: 2750061 - RNA, 19 nt, Human
cacuuguguuuugcaagcc

SEQ ID NO: 2750062 - RNA, 22 nt, Human
cacuuguguuuugcaagccaga

SEQ ID NO: 2750063 - RNA, 21 nt, Human
cacugggggaggggacauuga

SEQ ID NO: 2750064 - RNA, 18 nt, Human
cacugggggaggggacau

SEQ ID NO: 2750065 - RNA, 15 nt, Human
cacugggggagggga

SEQ ID NO: 2750066 - RNA, 14 nt, Human
cacugggggagggg

SEQ ID NO: 2750067 - RNA, 21 nt, Human
cacugcagaagacaguauggc

SEQ ID NO: 2750068 - RNA, 20 nt, Human
cacuagggcagggacaggau

SEQ ID NO: 2750069 - RNA, 21 nt, Human
cacuagggcagggacaggaua

SEQ ID NO: 2750070 - RNA, 14 nt, Human
caaguccaagcaua

SEQ ID NO: 2750071 - RNA, 15 nt, Human
caauucuugccaaau

SEQ ID NO: 2750072 - RNA, 17 nt, Human
caaugcuguauuuuaaa

SEQ ID NO: 2750073 - RNA, 16 nt, Human
caaugcuguauuuuaa

SEQ ID NO: 2750074 - RNA, 15 nt, Human
caaugcuguauuuua

SEQ ID NO: 2750075 - RNA, 18 nt, Human
cacaagacugcacaucaa

SEQ ID NO: 2750076 - RNA, 13 nt, Human
cacacaggcaacu

SEQ ID NO: 2750077 - RNA, 19 nt, Human
cacacaggcaacugaggca

SEQ ID NO: 2750078 - RNA, 16 nt, Human
cacacaggcaacugag

SEQ ID NO: 2750079 - RNA, 20 nt, Human
cacacaggcaacugaggcag

SEQ ID NO: 2750080 - RNA, 22 nt, Human
cacacaugaaguccaagcauuu

SEQ ID NO: 2750081 - RNA, 17 nt, Human
cacacaugaaguccaag

SEQ ID NO: 2750082 - RNA, 21 nt, Human
cacagccucuuagaugcaguu

SEQ ID NO: 2750083 - RNA, 17 nt, Human
cacagccucuuagaugc

SEQ ID NO: 2750084 - RNA, 14 nt, Human
auuguaaaauggug

SEQ ID NO: 2750085 - RNA, 13 nt, Human
auuguaaaauggu

SEQ ID NO: 2750086 - RNA, 23 nt, Human
auuguaauaggcguaacuaauuu

SEQ ID NO: 2750087 - RNA, 23 nt, Human
auuacaaaucagaagucaucuug

SEQ ID NO: 2750088 - RNA, 21 nt, Human
auuacaaaucagaagucaucu

SEQ ID NO: 2750089 - RNA, 22 nt, Human
auuacaaaucagaagucaucuu

SEQ ID NO: 2750090 - RNA, 14 nt, Human
auuacaaaucagaa

SEQ ID NO: 2750091 - RNA, 16 nt, Human
auuacaaaucagaagu

SEQ ID NO: 2750092 - RNA, 18 nt, Human
auuacaaaucagaaguca

SEQ ID NO: 2750093 - RNA, 19 nt, Human
auuacaaaucagaagucau

SEQ ID NO: 2750094 - RNA, 22 nt, Human
auucauagcagcuuauucacaa

SEQ ID NO: 2750095 - RNA, 19 nt, Human
auucauagcagcuuauuca

SEQ ID NO: 2750096 - RNA, 21 nt, Human
auucacagugcucuuuucucc

SEQ ID NO: 2750097 - RNA, 19 nt, Human
auucacagugcucuuuucu

SEQ ID NO: 2750098 - RNA, 20 nt, Human
auucacagugcucuuuucuc

SEQ ID NO: 2750099 - RNA, 18 nt, Human
auuaugaauuacauuugu

SEQ ID NO: 2750100 - RNA, 19 nt, Human
auucacaagacccaaaagg

SEQ ID NO: 2750101 - RNA, 16 nt, Human
auuagggagagaagau

SEQ ID NO: 2750102 - RNA, 17 nt, Human
auuaugaauuacauuug

SEQ ID NO: 2750103 - RNA, 14 nt, Human
auuaugaauuacau

SEQ ID NO: 2750104 - RNA, 17 nt, Human
auuuuauagcuacuaau

SEQ ID NO: 2750105 - RNA, 19 nt, Human
auuuuauagcuacuaauuu

SEQ ID NO: 2750106 - RNA, 15 nt, Human
auuuggaaauaaagu

SEQ ID NO: 2750107 - RNA, 17 nt, Human
auuuggaaauaaaguca

SEQ ID NO: 2750108 - RNA, 22 nt, Human
auuuggaaauaaagucagaugg

SEQ ID NO: 2750109 - RNA, 17 nt, Human
auuugcucauggaauug

SEQ ID NO: 2750110 - RNA, 14 nt, Human
auuugcucauggaa

SEQ ID NO: 2750111 - RNA, 13 nt, Human
caaacccaguguu

SEQ ID NO: 2750112 - RNA, 15 nt, Human
caaaaggcagaagca

SEQ ID NO: 2750113 - RNA, 20 nt, Human
caaaaaaaaaaaaaaauuag

SEQ ID NO: 2750114 - RNA, 20 nt, Human
caaagcacugacuucuaagu

SEQ ID NO: 2750115 - RNA, 22 nt, Human
caaagcacugacuucuaaguaa

SEQ ID NO: 2750116 - RNA, 23 nt, Human
caacacgagcaggcuacugucag

SEQ ID NO: 2750117 - RNA, 19 nt, Human
augagagacacacugaaga

SEQ ID NO: 2750118 - RNA, 17 nt, Human
augagagacacacugaa

SEQ ID NO: 2750119 - RNA, 14 nt, Human
augagagacacacu

SEQ ID NO: 2750120 - RNA, 13 nt, Human
augagagacacac

SEQ ID NO: 2750121 - RNA, 17 nt, Human
uuguauaaaauaauuuu

SEQ ID NO: 2750122 - RNA, 16 nt, Human
uuguaucacaaaucuu

SEQ ID NO: 2750123 - RNA, 23 nt, Human
uugguuuaaagaaaguguauuug

SEQ ID NO: 2750124 - RNA, 17 nt, Human
uugguuuaaagaaagug

SEQ ID NO: 2750125 - RNA, 18 nt, Human
uugguuuaaagaaagugu

SEQ ID NO: 2750126 - RNA, 22 nt, Human
uugguuuaaagaaaguguauuu

SEQ ID NO: 2750127 - RNA, 15 nt, Human
uuguauaaaauaauu

SEQ ID NO: 2750128 - RNA, 16 nt, Human
uuguauaaaauaauuu

SEQ ID NO: 2750129 - RNA, 13 nt, Human
augaaugaauggc

SEQ ID NO: 2750130 - RNA, 18 nt, Human
augaagauguagaggaga

SEQ ID NO: 2750131 - RNA, 17 nt, Human
augaaauauuauguuaa

SEQ ID NO: 2750132 - RNA, 13 nt, Human
augaaauauuaug

SEQ ID NO: 2750133 - RNA, 18 nt, Human
augaaauauuauguuaaa

SEQ ID NO: 2750134 - RNA, 15 nt, Human
augaaagcagggacu

SEQ ID NO: 2750135 - RNA, 13 nt, Human
aucuuuuucuaac

SEQ ID NO: 2750136 - RNA, 18 nt, Human
uugauggugguauguuuu

SEQ ID NO: 2750137 - RNA, 19 nt, Human
uugauggugguauguuuuc

SEQ ID NO: 2750138 - RNA, 23 nt, Human
aucucauuuccaagcaaguauua

SEQ ID NO: 2750139 - RNA, 21 nt, Human
aucucauuuccaagcaaguau

SEQ ID NO: 2750140 - RNA, 13 nt, Human
aucucaauauuuc

SEQ ID NO: 2750141 - RNA, 13 nt, Human
uugcccuguuaaa

SEQ ID NO: 2750142 - RNA, 22 nt, Human
uuuagcuggaaaaguauguuag

SEQ ID NO: 2750143 - RNA, 20 nt, Human
uuuagcuggaaaaguauguu

SEQ ID NO: 2750144 - RNA, 13 nt, Human
uuuauauaagcuu

SEQ ID NO: 2750145 - RNA, 15 nt, Human
augcuagaacucccu

SEQ ID NO: 2750146 - RNA, 16 nt, Human
augcuagaacucccuu

SEQ ID NO: 2750147 - RNA, 22 nt, Human
augcugucuacacuaagagaga

SEQ ID NO: 2750148 - RNA, 19 nt, Human
uuucauguuaguuaccuua

SEQ ID NO: 2750149 - RNA, 20 nt, Human
auggcuaguaucaaaagaaa

SEQ ID NO: 2750150 - RNA, 17 nt, Human
augcaguucugaagaag

SEQ ID NO: 2750151 - RNA, 15 nt, Human
augcaguucugaaga

SEQ ID NO: 2750152 - RNA, 19 nt, Human
augcaguucugaagaagau

SEQ ID NO: 2750153 - RNA, 18 nt, Human
augcaguucugaagaaga

SEQ ID NO: 2750154 - RNA, 17 nt, Human
augccacuaaauugaca

SEQ ID NO: 2750155 - RNA, 15 nt, Human
augccacuaaauuga

SEQ ID NO: 2750156 - RNA, 14 nt, Human
uuguuuucauuauc

SEQ ID NO: 2750157 - RNA, 15 nt, Human
augcaaagcacugac

SEQ ID NO: 2750158 - RNA, 12 nt, Human
augauucccagc

SEQ ID NO: 2750159 - RNA, 22 nt, Human
augauuaugaauuacauuugua

SEQ ID NO: 2750160 - RNA, 21 nt, Human
augagagacacacugaagaag

SEQ ID NO: 2750161 - RNA, 20 nt, Human
augagagacacacugaagaa

SEQ ID NO: 2750162 - RNA, 23 nt, Human
augagagacacacugaagaagca

SEQ ID NO: 2750163 - RNA, 16 nt, Human
uuguuggcauagcucu

SEQ ID NO: 2750164 - RNA, 21 nt, Human
uuguguguuauuuaaaugagu

SEQ ID NO: 2750165 - RNA, 20 nt, Human
uuguguguuauuuaaaugag

SEQ ID NO: 2750166 - RNA, 23 nt, Human
uugugugaaagguacuucaaauc

SEQ ID NO: 2750167 - RNA, 16 nt, Human
uuguguguuauuuaaa

SEQ ID NO: 2750168 - RNA, 15 nt, Human
uuguguguuauuuaa

SEQ ID NO: 2750169 - RNA, 17 nt, Human
uucuugcuucuuucuag

SEQ ID NO: 2750170 - RNA, 19 nt, Human
uucuugcuucuuucuagaa

SEQ ID NO: 2750171 - RNA, 12 nt, Human
auccuaauaaaa

SEQ ID NO: 2750172 - RNA, 14 nt, Human
auccuaauaaaaag

SEQ ID NO: 2750173 - RNA, 15 nt, Human
auccuaauaaaaagg

SEQ ID NO: 2750174 - RNA, 16 nt, Human
auccuaauaaaaaggu

SEQ ID NO: 2750175 - RNA, 17 nt, Human
auccuaauaaaaaggug

SEQ ID NO: 2750176 - RNA, 13 nt, Human
uugaacacugggg

SEQ ID NO: 2750177 - RNA, 18 nt, Human
auccuaauaaaaagguga

SEQ ID NO: 2750178 - RNA, 22 nt, Human
auccuaauaaaaaggugaccau

SEQ ID NO: 2750179 - RNA, 20 nt, Human
uugaacaaguuguuucauug

SEQ ID NO: 2750180 - RNA, 19 nt, Human
uugaaauauugacuuuuua

SEQ ID NO: 2750181 - RNA, 14 nt, Human
auccauacauuugu

SEQ ID NO: 2750182 - RNA, 13 nt, Human
uucuauaauuuaa

SEQ ID NO: 2750183 - RNA, 14 nt, Human
uucuauaauuuaaa

SEQ ID NO: 2750184 - RNA, 21 nt, Human
uucuaaguaaaaccacagcag

SEQ ID NO: 2750185 - RNA, 19 nt, Human
uucuagaaagagaaacagu

SEQ ID NO: 2750186 - RNA, 22 nt, Human
uucuagaaagagaaacaguugg

SEQ ID NO: 2750187 - RNA, 19 nt, Human
uucuaaguaaaaccacagc

SEQ ID NO: 2750188 - RNA, 20 nt, Human
uucuaaguaaaaccacagca

SEQ ID NO: 2750189 - RNA, 17 nt, Human
uucuaaguaaaaccaca

SEQ ID NO: 2750190 - RNA, 22 nt, Human
uuccccuugcccagggcucagc

SEQ ID NO: 2750191 - RNA, 23 nt, Human
uuccccuugcccagggcucagcc

SEQ ID NO: 2750192 - RNA, 21 nt, Human
uuccuuagcuuagaccucagc

SEQ ID NO: 2750193 - RNA, 20 nt, Human
uuccuuagcuuagaccucag

SEQ ID NO: 2750194 - RNA, 23 nt, Human
uuccuuagcuuagaccucagccu

SEQ ID NO: 2750195 - RNA, 22 nt, Human
uuccuuagcuuagaccucagcc

SEQ ID NO: 2750196 - RNA, 20 nt, Human
aucaaauaugcaaagcacug

SEQ ID NO: 2750197 - RNA, 12 nt, Human
uucccaaauuuc

SEQ ID NO: 2750198 - RNA, 18 nt, Human
uucccaacuccagaaagu

SEQ ID NO: 2750199 - RNA, 16 nt, Human
uucaaggaauuucuua

SEQ ID NO: 2750200 - RNA, 18 nt, Human
uucaaacagucucaggaa

SEQ ID NO: 2750201 - RNA, 14 nt, Human
uucaaacauauaua

SEQ ID NO: 2750202 - RNA, 17 nt, Human
auaggcguaacuaauuu

SEQ ID NO: 2750203 - RNA, 22 nt, Human
auaggaauugacccacaagaaa

SEQ ID NO: 2750204 - RNA, 23 nt, Human
uucacaagacccaaaaggcagaa

SEQ ID NO: 2750205 - RNA, 22 nt, Human
uucacaagacccaaaaggcaga

SEQ ID NO: 2750206 - RNA, 21 nt, Human
uucacacacaggcaacugagg

SEQ ID NO: 2750207 - RNA, 17 nt, Human
auaguuacuguguaauu

SEQ ID NO: 2750208 - RNA, 13 nt, Human
auaguuacugugu

SEQ ID NO: 2750209 - RNA, 14 nt, Human
auaguuacugugua

SEQ ID NO: 2750210 - RNA, 18 nt, Human
auaguuacuguguaauua

SEQ ID NO: 2750211 - RNA, 20 nt, Human
auaguuacuguguaauuagu

SEQ ID NO: 2750212 - RNA, 20 nt, Human
auaguuguaccgcaauguga

SEQ ID NO: 2750213 - RNA, 24 nt, Human
auauaucuaccccagacuagaugu

SEQ ID NO: 2750214 - RNA, 17 nt, Human
auauaacaaugcuguau

SEQ ID NO: 2750215 - RNA, 19 nt, Human
auauauaacaaugcuguau

SEQ ID NO: 2750216 - RNA, 18 nt, Human
auuuguaguguuggagaa

SEQ ID NO: 2750217 - RNA, 23 nt, Human
auuugguaaggggaauugaggac

SEQ ID NO: 2750218 - RNA, 22 nt, Human
auuuauuacuguaagaaaauau

SEQ ID NO: 2750219 - RNA, 15 nt, Human
auuuguaucacaaau

SEQ ID NO: 2750220 - RNA, 21 nt, Human
auuuguauaaaauaauuuuua

SEQ ID NO: 2750221 - RNA, 16 nt, Human
auuuuaauaauguuuc

SEQ ID NO: 2750222 - RNA, 15 nt, Human
auuuuaauaauguuu

SEQ ID NO: 2750223 - RNA, 14 nt, Human
auuuuaauaauguu

SEQ ID NO: 2750224 - RNA, 12 nt, Human
auuuuaauaaug

SEQ ID NO: 2750225 - RNA, 21 nt, Human
auugacccacaagaaaugaaa

SEQ ID NO: 2750226 - RNA, 20 nt, Human
auugacacuuaaaaaugguu

SEQ ID NO: 2750227 - RNA, 14 nt, Human
auuguauuacaaau

SEQ ID NO: 2750228 - RNA, 13 nt, Human
auugugccccugc

SEQ ID NO: 2750229 - RNA, 19 nt, Human
auuuaaagcuuauuaaaac

SEQ ID NO: 2750230 - RNA, 16 nt, Human
auuuacaaaugggaaa

SEQ ID NO: 2750231 - RNA, 14 nt, Human
auuuaccuaagauu

SEQ ID NO: 2750232 - RNA, 15 nt, Human
auuuaccuaagauua

SEQ ID NO: 2750233 - RNA, 17 nt, Human
auuuaccuaagauuaca

SEQ ID NO: 2750234 - RNA, 18 nt, Human
auuuaccuaagauuacaa

SEQ ID NO: 2750235 - RNA, 20 nt, Human
auuccacuuauaggaauuga

SEQ ID NO: 2750236 - RNA, 14 nt, Human
auucaaacagucuc

SEQ ID NO: 2750237 - RNA, 15 nt, Human
auucaaacagucuca

SEQ ID NO: 2750238 - RNA, 13 nt, Human
auuacauuuguau

SEQ ID NO: 2750239 - RNA, 20 nt, Human
auuacauuuguauaaaauaa

SEQ ID NO: 2750240 - RNA, 15 nt, Human
auuacauuuguauaa

SEQ ID NO: 2750241 - RNA, 23 nt, Human
uuuuuuaaaaaagaaacauuugg

SEQ ID NO: 2750242 - RNA, 15 nt, Human
auuaaguaaugauaa

SEQ ID NO: 2750243 - RNA, 13 nt, Human
auuaaguaaugau

SEQ ID NO: 2750244 - RNA, 16 nt, Human
auuaaucuuaguguau

SEQ ID NO: 2750245 - RNA, 17 nt, Human
auuaaucuuaguguaug

SEQ ID NO: 2750246 - RNA, 19 nt, Human
auuaaucuuaguguaugau

SEQ ID NO: 2750247 - RNA, 22 nt, Human
auuaaucuuaguguaugauuac

SEQ ID NO: 2750248 - RNA, 20 nt, Human
auuaaucuuaguguaugauu

SEQ ID NO: 2750249 - RNA, 21 nt, Human
auuaaucuuaguguaugauua

SEQ ID NO: 2750250 - RNA, 22 nt, Human
auuacuggccuuuuucauuuau

SEQ ID NO: 2750251 - RNA, 17 nt, Human
auuacuggccuuuuuca

SEQ ID NO: 2750252 - RNA, 21 nt, Human
auuacuggccuuuuucauuua

SEQ ID NO: 2750253 - RNA, 16 nt, Human
auuauauuuacaaaug

SEQ ID NO: 2750254 - RNA, 20 nt, Human
auuauuaccuuacagaaguu

SEQ ID NO: 2750255 - RNA, 18 nt, Human
auuaucucaaaacugcac

SEQ ID NO: 2750256 - RNA, 23 nt, Human
auuaucucaaaacugcacuguca

SEQ ID NO: 2750257 - RNA, 17 nt, Human
auuauauuuacaaaugg

SEQ ID NO: 2750258 - RNA, 15 nt, Human
auuauauuuacaaau

SEQ ID NO: 2750259 - RNA, 14 nt, Human
uuuuauaauuuugu

SEQ ID NO: 2750260 - RNA, 23 nt, Human
uuuuauggaggcuuugcauagau

SEQ ID NO: 2750261 - RNA, 19 nt, Human
uuuuauggcacuaguauuu

SEQ ID NO: 2750262 - RNA, 20 nt, Human
auguuaguuaccuuauaguu

SEQ ID NO: 2750263 - RNA, 21 nt, Human
auguuaguuaccuuauaguua

SEQ ID NO: 2750264 - RNA, 22 nt, Human
auguuaguuaccuuauaguuac

SEQ ID NO: 2750265 - RNA, 23 nt, Human
auguuaguuaccuuauaguuacu

SEQ ID NO: 2750266 - RNA, 19 nt, Human
auguucaucaaugaaugaa

SEQ ID NO: 2750267 - RNA, 15 nt, Human
auguugacaugggac

SEQ ID NO: 2750268 - RNA, 15 nt, Human
auuaacgauguccaa

SEQ ID NO: 2750269 - RNA, 15 nt, Human
auuaaaagaauauuu

SEQ ID NO: 2750270 - RNA, 16 nt, Human
auuaaaagaauauuuu

SEQ ID NO: 2750271 - RNA, 18 nt, Human
auguuucaaacauauaua

SEQ ID NO: 2750272 - RNA, 21 nt, Human
auguuucaaacauauauaaca

SEQ ID NO: 2750273 - RNA, 13 nt, Human
uuuuaaaaaagaa

SEQ ID NO: 2750274 - RNA, 14 nt, Human
uuuuaaaagaauga

SEQ ID NO: 2750275 - RNA, 12 nt, Human
auguaguauuuu

SEQ ID NO: 2750276 - RNA, 21 nt, Human
auguaguauuuuuuguauaau

SEQ ID NO: 2750277 - RNA, 22 nt, Human
auguaguauuuuuuguauaauu

SEQ ID NO: 2750278 - RNA, 23 nt, Human
auguaguauuuuuuguauaauug

SEQ ID NO: 2750279 - RNA, 21 nt, Human
augucccuacaccccuccccu

SEQ ID NO: 2750280 - RNA, 12 nt, Human
uuugcucaugga

SEQ ID NO: 2750281 - RNA, 11 nt, Human
uuugcucaugg

SEQ ID NO: 2750282 - RNA, 15 nt, Human
auggcuauaggugcu

SEQ ID NO: 2750283 - RNA, 13 nt, Human
uuugcucauggaa

SEQ ID NO: 2750284 - RNA, 12 nt, Human
uuuggccagaag

SEQ ID NO: 2750285 - RNA, 14 nt, Human
uuuggccagaaguc

SEQ ID NO: 2750286 - RNA, 10 nt, Human
uuuggccaga

SEQ ID NO: 2750287 - RNA, 18 nt, Human
uuaccuuauaguuacugu

SEQ ID NO: 2750288 - RNA, 15 nt, Human
auaaauaguuuauga

SEQ ID NO: 2750289 - RNA, 14 nt, Human
auaaauaaaaauaa

SEQ ID NO: 2750290 - RNA, 13 nt, Human
auaaauaaaaaua

SEQ ID NO: 2750291 - RNA, 22 nt, Human
auaacgauaaaagacagugaaa

SEQ ID NO: 2750292 - RNA, 22 nt, Human
auaaccugucucaccuggacuu

SEQ ID NO: 2750293 - RNA, 19 nt, Human
uuagcaaagaguuaauaua

SEQ ID NO: 2750294 - RNA, 13 nt, Human
uuagcaaagaguu

SEQ ID NO: 2750295 - RNA, 20 nt, Human
uuagcaaagaguuaauauau

SEQ ID NO: 2750296 - RNA, 23 nt, Human
auaauuuaccuaagauuacaaau

SEQ ID NO: 2750297 - RNA, 13 nt, Human
auaauuuaccuaa

SEQ ID NO: 2750298 - RNA, 16 nt, Human
auaauuuaccuaagau

SEQ ID NO: 2750299 - RNA, 18 nt, Human
auaauccuaaacauauga

SEQ ID NO: 2750300 - RNA, 16 nt, Human
aguugguaacuuuugu

SEQ ID NO: 2750301 - RNA, 20 nt, Human
aguugguaacuuuugugaau

SEQ ID NO: 2750302 - RNA, 14 nt, Human
aguuuaaauuguaa

SEQ ID NO: 2750303 - RNA, 15 nt, Human
aguugguaacuuuug

SEQ ID NO: 2750304 - RNA, 13 nt, Human
aguugguaacuuu

SEQ ID NO: 2750305 - RNA, 13 nt, Human
uguuucaaacaua

SEQ ID NO: 2750306 - RNA, 14 nt, Human
uuaaucuuagugua

SEQ ID NO: 2750307 - RNA, 16 nt, Human
uuaaucuuaguguaug

SEQ ID NO: 2750308 - RNA, 12 nt, Human
auaaaauaauuu

SEQ ID NO: 2750309 - RNA, 22 nt, Human
auaaaauaauuuuuauauuuga

SEQ ID NO: 2750310 - RNA, 19 nt, Human
aguuuucugagaaagacua

SEQ ID NO: 2750311 - RNA, 18 nt, Human
aguuuucugagaaagacu

SEQ ID NO: 2750312 - RNA, 23 nt, Human
aguuuucugagaaagacuauuca

SEQ ID NO: 2750313 - RNA, 19 nt, Human
aguucggugagcuacaaau

SEQ ID NO: 2750314 - RNA, 15 nt, Human
uguuauuuaaaugag

SEQ ID NO: 2750315 - RNA, 16 nt, Human
aguguuggagaagaac

SEQ ID NO: 2750316 - RNA, 14 nt, Human
aguguuggagaaga

SEQ ID NO: 2750317 - RNA, 18 nt, Human
aguguuggagaagaacug

SEQ ID NO: 2750318 - RNA, 17 nt, Human
aguguuggagaagaacu

SEQ ID NO: 2750319 - RNA, 11 nt, Human
aguuacugugu

SEQ ID NO: 2750320 - RNA, 19 nt, Human
aguuacuguguaauuagug

SEQ ID NO: 2750321 - RNA, 14 nt, Human
aguuacuguguaau

SEQ ID NO: 2750322 - RNA, 15 nt, Human
aguuacuguguaauu

SEQ ID NO: 2750323 - RNA, 16 nt, Human
aguuacuguguaauua

SEQ ID NO: 2750324 - RNA, 18 nt, Human
aguuacuguguaauuagu

SEQ ID NO: 2750325 - RNA, 14 nt, Human
uguggcagaguuac

SEQ ID NO: 2750326 - RNA, 15 nt, Human
uguggcagaguuaca

SEQ ID NO: 2750327 - RNA, 19 nt, Human
uguggcagaguuacaguuc

SEQ ID NO: 2750328 - RNA, 20 nt, Human
uguggcagaguuacaguucu

SEQ ID NO: 2750329 - RNA, 14 nt, Human
agugccacuuaaug

SEQ ID NO: 2750330 - RNA, 16 nt, Human
agugccacuuaaugua

SEQ ID NO: 2750331 - RNA, 21 nt, Human
agugcaaauugucacaggaca

SEQ ID NO: 2750332 - RNA, 18 nt, Human
agugcaaauugucacagg

SEQ ID NO: 2750333 - RNA, 17 nt, Human
ugugguuucauguuagu

SEQ ID NO: 2750334 - RNA, 22 nt, Human
ugugguuucauguuaguuaccu

SEQ ID NO: 2750335 - RNA, 16 nt, Human
uguguuauuuaaauga

SEQ ID NO: 2750336 - RNA, 14 nt, Human
uguguuauuuaaau

SEQ ID NO: 2750337 - RNA, 13 nt, Human
uguguuauuuaaa

SEQ ID NO: 2750338 - RNA, 20 nt, Human
agugcuuggcccaggaguuu

SEQ ID NO: 2750339 - RNA, 18 nt, Human
agugcuuggcccaggagu

SEQ ID NO: 2750340 - RNA, 19 nt, Human
agugcuuggcccaggaguu

SEQ ID NO: 2750341 - RNA, 12 nt, Human
agugcuuggccc

SEQ ID NO: 2750342 - RNA, 14 nt, Human
agugcuuggcccag

SEQ ID NO: 2750343 - RNA, 15 nt, Human
agugcuuggcccagg

SEQ ID NO: 2750344 - RNA, 16 nt, Human
agugcuuggcccagga

SEQ ID NO: 2750345 - RNA, 21 nt, Human
agugccuguaaucacagcuac

SEQ ID NO: 2750346 - RNA, 23 nt, Human
agguacuucaaauccuugaagau

SEQ ID NO: 2750347 - RNA, 16 nt, Human
aggguuagggaggggu

SEQ ID NO: 2750348 - RNA, 15 nt, Human
aggguuagggagggg

SEQ ID NO: 2750349 - RNA, 13 nt, Human
aggguuagggagg

SEQ ID NO: 2750350 - RNA, 20 nt, Human
ugguaaggggaauugaggac

SEQ ID NO: 2750351 - RNA, 17 nt, Human
uggggaagacuguggcu

SEQ ID NO: 2750352 - RNA, 16 nt, Human
uggggaagacuguggc

SEQ ID NO: 2750353 - RNA, 24 nt, Human
uggggaagacuguggcugcuagca

SEQ ID NO: 2750354 - RNA, 14 nt, Human
uggggaagacugug

SEQ ID NO: 2750355 - RNA, 17 nt, Human
agggcagggacaggaua

SEQ ID NO: 2750356 - RNA, 15 nt, Human
agucaggaaagagaa

SEQ ID NO: 2750357 - RNA, 16 nt, Human
agucaggaaagagaac

SEQ ID NO: 2750358 - RNA, 23 nt, Human
agucagacuggauaguccgucuc

SEQ ID NO: 2750359 - RNA, 22 nt, Human
ugucagcugcaagguacucugg

SEQ ID NO: 2750360 - RNA, 23 nt, Human
ugucagcugcaagguacucuggu

SEQ ID NO: 2750361 - RNA, 23 nt, Human
ugucauuugcuggagcucugccc

SEQ ID NO: 2750362 - RNA, 15 nt, Human
aguauuucuaugaaa

SEQ ID NO: 2750363 - RNA, 13 nt, Human
aguauuucuauga

SEQ ID NO: 2750364 - RNA, 22 nt, Human
aguauuucuaugaaauauuaug

SEQ ID NO: 2750365 - RNA, 20 nt, Human
ugucaaucagccuaguugau

SEQ ID NO: 2750366 - RNA, 21 nt, Human
ugucaauaaaauccauacauu

SEQ ID NO: 2750367 - RNA, 21 nt, Human
uguaauuagugccacuuaaug

SEQ ID NO: 2750368 - RNA, 23 nt, Human
uguaauuagugccacuuaaugua

SEQ ID NO: 2750369 - RNA, 23 nt, Human
uguaccaguuaauuuuuccaacu

SEQ ID NO: 2750370 - RNA, 21 nt, Human
uguaccaguuaauuuuuccaa

SEQ ID NO: 2750371 - RNA, 22 nt, Human
uguaccaguuaauuuuuccaac

SEQ ID NO: 2750372 - RNA, 11 nt, Human
uguaccaguua

SEQ ID NO: 2750373 - RNA, 12 nt, Human
uguaccaguuaa

SEQ ID NO: 2750374 - RNA, 14 nt, Human
uguaccaguuaauu

SEQ ID NO: 2750375 - RNA, 15 nt, Human
uguaccaguuaauuu

SEQ ID NO: 2750376 - RNA, 16 nt, Human
uguagaggagaaacug

SEQ ID NO: 2750377 - RNA, 18 nt, Human
uguagaggagaaacugga

SEQ ID NO: 2750378 - RNA, 15 nt, Human
aguaaaaccacagca

SEQ ID NO: 2750379 - RNA, 19 nt, Human
aguagauaggccaugggca

SEQ ID NO: 2750380 - RNA, 11 nt, Human
ugcucauggaa

SEQ ID NO: 2750381 - RNA, 14 nt, Human
ugcucauggaauug

SEQ ID NO: 2750382 - RNA, 12 nt, Human
aggaaauauuua

SEQ ID NO: 2750383 - RNA, 23 nt, Human
aggaaaucaaauaugcaaagcac

SEQ ID NO: 2750384 - RNA, 17 nt, Human
aggacacugauaugggu

SEQ ID NO: 2750385 - RNA, 22 nt, Human
ugcuguauuuuaaaagaaugau

SEQ ID NO: 2750386 - RNA, 21 nt, Human
ugcuguauuuuaaaagaauga

SEQ ID NO: 2750387 - RNA, 13 nt, Human
ugcuguauuuuaa

SEQ ID NO: 2750388 - RNA, 17 nt, Human
agcuugaaacugagaug

SEQ ID NO: 2750389 - RNA, 15 nt, Human
agcuuagaccucagc

SEQ ID NO: 2750390 - RNA, 14 nt, Human
agcuuagaccucag

SEQ ID NO: 2750391 - RNA, 19 nt, Human
agcuuagaccucagccugu

SEQ ID NO: 2750392 - RNA, 18 nt, Human
agcuuagaccucagccug

SEQ ID NO: 2750393 - RNA, 17 nt, Human
agcuuagaccucagccu

SEQ ID NO: 2750394 - RNA, 16 nt, Human
agcuuagaccucagcc

SEQ ID NO: 2750395 - RNA, 20 nt, Human
agcuuagaccucagccugug

SEQ ID NO: 2750396 - RNA, 20 nt, Human
ugcuacaaaaacacagcaag

SEQ ID NO: 2750397 - RNA, 15 nt, Human
ugcuacaaaaacaca

SEQ ID NO: 2750398 - RNA, 16 nt, Human
ugcuacaaaaacacag

SEQ ID NO: 2750399 - RNA, 17 nt, Human
ugcuacaaaaacacagc

SEQ ID NO: 2750400 - RNA, 18 nt, Human
ugcuacaaaaacacagca

SEQ ID NO: 2750401 - RNA, 19 nt, Human
ugcuacaaaaacacagcaa

SEQ ID NO: 2750402 - RNA, 16 nt, Human
agcugccuccccuccu

SEQ ID NO: 2750403 - RNA, 15 nt, Human
agcugccuccccucc

SEQ ID NO: 2750404 - RNA, 22 nt, Human
agcugcccucuccugggcagcu

SEQ ID NO: 2750405 - RNA, 16 nt, Human
agcuguucacagccag

SEQ ID NO: 2750406 - RNA, 19 nt, Human
agcuguucacagccagacu

SEQ ID NO: 2750407 - RNA, 16 nt, Human
uggcauagcucugggg

SEQ ID NO: 2750408 - RNA, 14 nt, Human
uggcauagcucugg

SEQ ID NO: 2750409 - RNA, 15 nt, Human
uggcauagcucuggg

SEQ ID NO: 2750410 - RNA, 18 nt, Human
uggcacaguuuucugaga

SEQ ID NO: 2750411 - RNA, 19 nt, Human
uggcacaguuuucugagaa

SEQ ID NO: 2750412 - RNA, 13 nt, Human
uggaaaggcagcu

SEQ ID NO: 2750413 - RNA, 18 nt, Human
uggacaccaggagucccu

SEQ ID NO: 2750414 - RNA, 14 nt, Human
uggagaagaacuga

SEQ ID NO: 2750415 - RNA, 13 nt, Human
uggagaagaacug

SEQ ID NO: 2750416 - RNA, 18 nt, Human
agccuggugggccuccuc

SEQ ID NO: 2750417 - RNA, 16 nt, Human
agccuggugggccucc

SEQ ID NO: 2750418 - RNA, 14 nt, Human
agccuggugggccu

SEQ ID NO: 2750419 - RNA, 11 nt, Human
agccugguggg

SEQ ID NO: 2750420 - RNA, 22 nt, Human
agccuggugggccuccucuguc

SEQ ID NO: 2750421 - RNA, 21 nt, Human
agccuggugggccuccucugu

SEQ ID NO: 2750422 - RNA, 14 nt, Human
ugccaauauccuaa

SEQ ID NO: 2750423 - RNA, 20 nt, Human
agccuuggggcugaugcagu

SEQ ID NO: 2750424 - RNA, 13 nt, Human
ugccagacaugug

SEQ ID NO: 2750425 - RNA, 12 nt, Human
ugccagacaugu

SEQ ID NO: 2750426 - RNA, 18 nt, Human
agcuacuugggaggcuga

SEQ ID NO: 2750427 - RNA, 17 nt, Human
agcuacuugggaggcug

SEQ ID NO: 2750428 - RNA, 18 nt, Human
agccccgugggguuccuc

SEQ ID NO: 2750429 - RNA, 18 nt, Human
agcccauggcacucuaug

SEQ ID NO: 2750430 - RNA, 15 nt, Human
agccgaccucagccu

SEQ ID NO: 2750431 - RNA, 14 nt, Human
agccgaccucagcc

SEQ ID NO: 2750432 - RNA, 16 nt, Human
agccgaccucagccuu

SEQ ID NO: 2750433 - RNA, 13 nt, Human
agccgaccucagc

SEQ ID NO: 2750434 - RNA, 12 nt, Human
agccgaccucag

SEQ ID NO: 2750435 - RNA, 21 nt, Human
agccuagccgaccucagccuu

SEQ ID NO: 2750436 - RNA, 20 nt, Human
agccuagccgaccucagccu

SEQ ID NO: 2750437 - RNA, 19 nt, Human
agccuagccgaccucagcc

SEQ ID NO: 2750438 - RNA, 18 nt, Human
agccuagccgaccucagc

SEQ ID NO: 2750439 - RNA, 17 nt, Human
agccuagccgaccucag

SEQ ID NO: 2750440 - RNA, 20 nt, Human
agccucauccgaggcagggu

SEQ ID NO: 2750441 - RNA, 20 nt, Human
agccucauguccacugguuc

SEQ ID NO: 2750442 - RNA, 15 nt, Human
agccucauguccacu

SEQ ID NO: 2750443 - RNA, 18 nt, Human
agccucauccgaggcagg

SEQ ID NO: 2750444 - RNA, 19 nt, Human
agccucauccgaggcaggg

SEQ ID NO: 2750445 - RNA, 22 nt, Human
agccugaaagaggaaugaagua

SEQ ID NO: 2750446 - RNA, 19 nt, Human
agccagacuggcacaguuu

SEQ ID NO: 2750447 - RNA, 14 nt, Human
agccagacuggcac

SEQ ID NO: 2750448 - RNA, 14 nt, Human
ugaugaucuuuaaa

SEQ ID NO: 2750449 - RNA, 17 nt, Human
ugaugaucuuuaaaaua

SEQ ID NO: 2750450 - RNA, 23 nt, Human
agccagaaauaaaguuggugaca

SEQ ID NO: 2750451 - RNA, 19 nt, Human
agccagaaauaaaguuggu

SEQ ID NO: 2750452 - RNA, 12 nt, Human
ugauuaaaccaa

SEQ ID NO: 2750453 - RNA, 14 nt, Human
ugauuaccagggac

SEQ ID NO: 2750454 - RNA, 17 nt, Human
ugaugaagaaguugaua

SEQ ID NO: 2750455 - RNA, 23 nt, Human
agcauaaauguugacaugggaca

SEQ ID NO: 2750456 - RNA, 22 nt, Human
ugaguaacugauuuguaacaag

SEQ ID NO: 2750457 - RNA, 17 nt, Human
agcauuguaaaugugcu

SEQ ID NO: 2750458 - RNA, 18 nt, Human
agcauuguaaaugugcuu

SEQ ID NO: 2750459 - RNA, 17 nt, Human
agcaugucgucaaagcu

SEQ ID NO: 2750460 - RNA, 20 nt, Human
agcaugucgucaaagcugaa

SEQ ID NO: 2750461 - RNA, 12 nt, Human
ugauaugggucu

SEQ ID NO: 2750462 - RNA, 16 nt, Human
ucuuucugaugucaaa

SEQ ID NO: 2750463 - RNA, 19 nt, Human
ugaaacucguuaauuugua

SEQ ID NO: 2750464 - RNA, 22 nt, Human
ugaaacugagaugugaacacau

SEQ ID NO: 2750465 - RNA, 22 nt, Human
ugaaaaaguucugcagauaaac

SEQ ID NO: 2750466 - RNA, 20 nt, Human
ugaaaagcuccauuuuuagu

SEQ ID NO: 2750467 - RNA, 20 nt, Human
agagacucagggccccagca

SEQ ID NO: 2750468 - RNA, 19 nt, Human
agagacucagggccccagc

SEQ ID NO: 2750469 - RNA, 21 nt, Human
agagcaguuugguuucuagca

SEQ ID NO: 2750470 - RNA, 23 nt, Human
agagcaguuugguuucuagcaug

SEQ ID NO: 2750471 - RNA, 21 nt, Human
agacauagaauuaacacauga

SEQ ID NO: 2750472 - RNA, 14 nt, Human
agacauagaauuaa

SEQ ID NO: 2750473 - RNA, 18 nt, Human
agacaucaacagauaaau

SEQ ID NO: 2750474 - RNA, 17 nt, Human
agacaucaacagauaaa

SEQ ID NO: 2750475 - RNA, 14 nt, Human
ucuucucuccagcu

SEQ ID NO: 2750476 - RNA, 18 nt, Human
ucuucucuccagcugacu

SEQ ID NO: 2750477 - RNA, 15 nt, Human
ucuucacaacagauu

SEQ ID NO: 2750478 - RNA, 14 nt, Human
agaaucacuugaac

SEQ ID NO: 2750479 - RNA, 16 nt, Human
ucuuggguaggcggga

SEQ ID NO: 2750480 - RNA, 17 nt, Human
agacucagggccccagc

SEQ ID NO: 2750481 - RNA, 16 nt, Human
agacucagggccccag

SEQ ID NO: 2750482 - RNA, 12 nt, Human
agacucagggcc

SEQ ID NO: 2750483 - RNA, 20 nt, Human
agacucagggccccagcacu

SEQ ID NO: 2750484 - RNA, 18 nt, Human
agacucagggccccagca

SEQ ID NO: 2750485 - RNA, 21 nt, Human
agacucagggccccagcacua

SEQ ID NO: 2750486 - RNA, 15 nt, Human
agacuauucaaacag

SEQ ID NO: 2750487 - RNA, 12 nt, Human
agacuauucaaa

SEQ ID NO: 2750488 - RNA, 14 nt, Human
agacuauucaaaca

SEQ ID NO: 2750489 - RNA, 16 nt, Human
agaugcaguucugaag

SEQ ID NO: 2750490 - RNA, 16 nt, Human
ugacacuuaaaaaugg

SEQ ID NO: 2750491 - RNA, 17 nt, Human
ugacacuuaaaaauggu

SEQ ID NO: 2750492 - RNA, 24 nt, Human
ugacuucuaaguaaaaccacagca

SEQ ID NO: 2750493 - RNA, 12 nt, Human
agauucauuuuu

SEQ ID NO: 2750494 - RNA, 22 nt, Human
ugacuucuaaguaaaaccacag

SEQ ID NO: 2750495 - RNA, 23 nt, Human
ugacuucuaaguaaaaccacagc

SEQ ID NO: 2750496 - RNA, 15 nt, Human
ugacuucuaaguaaa

SEQ ID NO: 2750497 - RNA, 15 nt, Human
agauucccugagcag

SEQ ID NO: 2750498 - RNA, 17 nt, Human
agauucauuuuucuuuc

SEQ ID NO: 2750499 - RNA, 23 nt, Human
agcaacgcaggcccccaggugcc

SEQ ID NO: 2750500 - RNA, 15 nt, Human
ugaauacuuuauaaa

SEQ ID NO: 2750501 - RNA, 14 nt, Human
agaagcuccaggua

SEQ ID NO: 2750502 - RNA, 13 nt, Human
agaaguugauaug

SEQ ID NO: 2750503 - RNA, 21 nt, Human
agaauaaaggcaguuuucuaa

SEQ ID NO: 2750504 - RNA, 13 nt, Human
agaauaaaggcag

SEQ ID NO: 2750505 - RNA, 14 nt, Human
agaauaaaggcagu

SEQ ID NO: 2750506 - RNA, 15 nt, Human
agaauaaaggcaguu

SEQ ID NO: 2750507 - RNA, 18 nt, Human
agaauaaaggcaguuuuc

SEQ ID NO: 2750508 - RNA, 20 nt, Human
agaauaaaggcaguuuucua

SEQ ID NO: 2750509 - RNA, 16 nt, Human
agaacucccuuucaac

SEQ ID NO: 2750510 - RNA, 15 nt, Human
agaacucccuuucaa

SEQ ID NO: 2750511 - RNA, 17 nt, Human
agaacucccuuucaaca

SEQ ID NO: 2750512 - RNA, 20 nt, Human
ucugcccauccugccccuga

SEQ ID NO: 2750513 - RNA, 19 nt, Human
agaagcaccaaucaugaau

SEQ ID NO: 2750514 - RNA, 19 nt, Human
agaagcaacccaaauguuc

SEQ ID NO: 2750515 - RNA, 15 nt, Human
ucucuccagcugacu

SEQ ID NO: 2750516 - RNA, 18 nt, Human
ucucuccagcugacuaaa

SEQ ID NO: 2750517 - RNA, 19 nt, Human
ucucuccagcugacuaaac

SEQ ID NO: 2750518 - RNA, 23 nt, Human
agaaacuuaagguuaccuuuguu

SEQ ID NO: 2750519 - RNA, 21 nt, Human
agaaacaguugguaacuuuug

SEQ ID NO: 2750520 - RNA, 22 nt, Human
agaaacaguugguaacuuuugu

SEQ ID NO: 2750521 - RNA, 16 nt, Human
agaaacacaacuauau

SEQ ID NO: 2750522 - RNA, 16 nt, Human
agaaagacuauucaaa

SEQ ID NO: 2750523 - RNA, 17 nt, Human
agaaagagaaacaguug

SEQ ID NO: 2750524 - RNA, 18 nt, Human
agaaagcagaacagugau

SEQ ID NO: 2750525 - RNA, 17 nt, Human
agaaagcagaacaguga

SEQ ID NO: 2750526 - RNA, 20 nt, Human
agaaagcagaacagugauua

SEQ ID NO: 2750527 - RNA, 20 nt, Human
acuuccagauccuggaaauc

SEQ ID NO: 2750528 - RNA, 13 nt, Human
ucuauaauuuaaa

SEQ ID NO: 2750529 - RNA, 12 nt, Human
ucuauaauuuac

SEQ ID NO: 2750530 - RNA, 16 nt, Human
ucuauaauuuaccuaa

SEQ ID NO: 2750531 - RNA, 12 nt, Human
ucuagcaugaag

SEQ ID NO: 2750532 - RNA, 18 nt, Human
acuucuaaguaaaaccac

SEQ ID NO: 2750533 - RNA, 19 nt, Human
acuucuaaguaaaaccaca

SEQ ID NO: 2750534 - RNA, 13 nt, Human
acuucuaaguaaa

SEQ ID NO: 2750535 - RNA, 21 nt, Human
acuucuaaguaaaaccacagc

SEQ ID NO: 2750536 - RNA, 17 nt, Human
ucucaaaacugcacugu

SEQ ID NO: 2750537 - RNA, 11 nt, Human
acuuggagcca

SEQ ID NO: 2750538 - RNA, 19 nt, Human
acuuggagccaaggguuca

SEQ ID NO: 2750539 - RNA, 14 nt, Human
acuuggagccaagg

SEQ ID NO: 2750540 - RNA, 21 nt, Human
acuugaacccgggaggcagag

SEQ ID NO: 2750541 - RNA, 23 nt, Human
acuugaacccgggaggcagaggu

SEQ ID NO: 2750542 - RNA, 20 nt, Human
acugggguccuggggccucg

SEQ ID NO: 2750543 - RNA, 18 nt, Human
acugggguccuggggccu

SEQ ID NO: 2750544 - RNA, 13 nt, Human
acugggggagggg

SEQ ID NO: 2750545 - RNA, 22 nt, Human
acugaagaagcaccaaucauga

SEQ ID NO: 2750546 - RNA, 18 nt, Human
acugaagccagaaauaaa

SEQ ID NO: 2750547 - RNA, 22 nt, Human
acugucagcuccccucggagaa

SEQ ID NO: 2750548 - RNA, 23 nt, Human
acugucagcuccccucggagaag

SEQ ID NO: 2750549 - RNA, 21 nt, Human
acugucauccucaaagaaagu

SEQ ID NO: 2750550 - RNA, 22 nt, Human
acugucauccucaaagaaagug

SEQ ID NO: 2750551 - RNA, 16 nt, Human
ucuaccccagacuaga

SEQ ID NO: 2750552 - RNA, 18 nt, Human
ucuaccccagacuagaug

SEQ ID NO: 2750553 - RNA, 21 nt, Human
ucuaccccagacuagauguag

SEQ ID NO: 2750554 - RNA, 23 nt, Human
ucuaccccagacuagauguagua

SEQ ID NO: 2750555 - RNA, 17 nt, Human
ucuaccaaaaaucucaa

SEQ ID NO: 2750556 - RNA, 13 nt, Human
acuguggguagac

SEQ ID NO: 2750557 - RNA, 19 nt, Human
acuguggcugcuagcacuu

SEQ ID NO: 2750558 - RNA, 12 nt, Human
acuguggcugcu

SEQ ID NO: 2750559 - RNA, 21 nt, Human
accaggguccuuuugacacug

SEQ ID NO: 2750560 - RNA, 20 nt, Human
acccaaauguucaucaauga

SEQ ID NO: 2750561 - RNA, 16 nt, Human
acccaaauguucauca

SEQ ID NO: 2750562 - RNA, 13 nt, Human
ucagcccucagaa

SEQ ID NO: 2750563 - RNA, 12 nt, Human
ucagcccucaga

SEQ ID NO: 2750564 - RNA, 20 nt, Human
ucagauggaaaauucauuuu

SEQ ID NO: 2750565 - RNA, 12 nt, Human
ucagauggaaaa

SEQ ID NO: 2750566 - RNA, 19 nt, Human
ucagauggaaaauucauuu

SEQ ID NO: 2750567 - RNA, 20 nt, Human
ucagagacucagggccccag

SEQ ID NO: 2750568 - RNA, 19 nt, Human
ucagagacucagggcccca

SEQ ID NO: 2750569 - RNA, 17 nt, Human
ucagagacucagggccc

SEQ ID NO: 2750570 - RNA, 14 nt, Human
ucagagacucaggg

SEQ ID NO: 2750571 - RNA, 14 nt, Human
ucagagcugcccuc

SEQ ID NO: 2750572 - RNA, 13 nt, Human
ucagagcugcccu

SEQ ID NO: 2750573 - RNA, 16 nt, Human
ucagagcugcccucuc

SEQ ID NO: 2750574 - RNA, 15 nt, Human
ucagagcugcccucu

SEQ ID NO: 2750575 - RNA, 17 nt, Human
ucagagcugcccucucc

SEQ ID NO: 2750576 - RNA, 13 nt, Human
ucaguagucagac

SEQ ID NO: 2750577 - RNA, 13 nt, Human
ucaaacagucuca

SEQ ID NO: 2750578 - RNA, 20 nt, Human
ucaaacagucucaggaaauc

SEQ ID NO: 2750579 - RNA, 21 nt, Human
ucaaacagucucaggaaauca

SEQ ID NO: 2750580 - RNA, 22 nt, Human
uauuuuaauaauguuucaaaca

SEQ ID NO: 2750581 - RNA, 19 nt, Human
uauuuuaauaauguuucaa

SEQ ID NO: 2750582 - RNA, 14 nt, Human
uauuuuaaaagaau

SEQ ID NO: 2750583 - RNA, 18 nt, Human
uauuuuaaaagaaugauu

SEQ ID NO: 2750584 - RNA, 14 nt, Human
accaacacgagcag

SEQ ID NO: 2750585 - RNA, 19 nt, Human
accaacacgagcaggcuac

SEQ ID NO: 2750586 - RNA, 16 nt, Human
accacaagacugcaca

SEQ ID NO: 2750587 - RNA, 22 nt, Human
ucacagcuuauuuccucauuuu

SEQ ID NO: 2750588 - RNA, 17 nt, Human
ucacagccagacuggca

SEQ ID NO: 2750589 - RNA, 23 nt, Human
ucacagccagacuggcacaguuu

SEQ ID NO: 2750590 - RNA, 16 nt, Human
ucacagaccuuugaac

SEQ ID NO: 2750591 - RNA, 13 nt, Human
ucaauuuaaaaaa

SEQ ID NO: 2750592 - RNA, 12 nt, Human
ucaauuuaaaaa

SEQ ID NO: 2750593 - RNA, 23 nt, Human
ucaauauuucagauaaucacaau

SEQ ID NO: 2750594 - RNA, 22 nt, Human
uccaugaagauguagaggagaa

SEQ ID NO: 2750595 - RNA, 14 nt, Human
uccagugagacagc

SEQ ID NO: 2750596 - RNA, 16 nt, Human
acgaguaauuuauugu

SEQ ID NO: 2750597 - RNA, 14 nt, Human
acgcucucuggccu

SEQ ID NO: 2750598 - RNA, 16 nt, Human
acgcucucuggccuuc

SEQ ID NO: 2750599 - RNA, 15 nt, Human
acgcucucuggccuu

SEQ ID NO: 2750600 - RNA, 17 nt, Human
acgcucucuggccuucg

SEQ ID NO: 2750601 - RNA, 22 nt, Human
accuggacuuaagcaucuggcu

SEQ ID NO: 2750602 - RNA, 17 nt, Human
accugagccccaaaagg

SEQ ID NO: 2750603 - RNA, 12 nt, Human
accugagcccca

SEQ ID NO: 2750604 - RNA, 19 nt, Human
accugacacaccaggcgcu

SEQ ID NO: 2750605 - RNA, 21 nt, Human
accugacacaccaggcgcuaa

SEQ ID NO: 2750606 - RNA, 16 nt, Human
ucauaauaaguugcau

SEQ ID NO: 2750607 - RNA, 17 nt, Human
uccucuccccaugaugu

SEQ ID NO: 2750608 - RNA, 22 nt, Human
uccugaaaacccuugccaugug

SEQ ID NO: 2750609 - RNA, 21 nt, Human
uccugaaaacccuugccaugu

SEQ ID NO: 2750610 - RNA, 12 nt, Human
uccucugcacuc

SEQ ID NO: 2750611 - RNA, 16 nt, Human
uccucugcacucccac

SEQ ID NO: 2750612 - RNA, 14 nt, Human
acuccagaaaguga

SEQ ID NO: 2750613 - RNA, 14 nt, Human
ucccuccaccuccc

SEQ ID NO: 2750614 - RNA, 17 nt, Human
ucccuccaccucccugc

SEQ ID NO: 2750615 - RNA, 15 nt, Human
ucccuccaccucccu

SEQ ID NO: 2750616 - RNA, 19 nt, Human
ucccuccaccucccugcaa

SEQ ID NO: 2750617 - RNA, 22 nt, Human
ucccucccagaggagccaccag

SEQ ID NO: 2750618 - RNA, 23 nt, Human
ucccucccagaggagccaccagu

SEQ ID NO: 2750619 - RNA, 20 nt, Human
acucauuuuaaaaaauggaa

SEQ ID NO: 2750620 - RNA, 21 nt, Human
acuccaaacugacucuuaaga

SEQ ID NO: 2750621 - RNA, 19 nt, Human
acuacuaauagaauaaagg

SEQ ID NO: 2750622 - RNA, 12 nt, Human
acuacuuuauaa

SEQ ID NO: 2750623 - RNA, 20 nt, Human
acuagaguuuagcuggaaaa

SEQ ID NO: 2750624 - RNA, 24 nt, Human
uccccuccucugcuugccaucccu

SEQ ID NO: 2750625 - RNA, 18 nt, Human
uccccuccucugcuugcc

SEQ ID NO: 2750626 - RNA, 15 nt, Human
uccccuccucugcuu

SEQ ID NO: 2750627 - RNA, 14 nt, Human
uccccuccucugcu

SEQ ID NO: 2750628 - RNA, 15 nt, Human
acuaugauuauuaac

SEQ ID NO: 2750629 - RNA, 13 nt, Human
acuauucaaacag

SEQ ID NO: 2750630 - RNA, 14 nt, Human
acuauucaaacagu

SEQ ID NO: 2750631 - RNA, 16 nt, Human
acuauucaaacagucu

SEQ ID NO: 2750632 - RNA, 18 nt, Human
acuauucaaacagucuca

SEQ ID NO: 2750633 - RNA, 21 nt, Human
acacaggcaacugaggcagac

SEQ ID NO: 2750634 - RNA, 13 nt, Human
acacaacuauauu

SEQ ID NO: 2750635 - RNA, 20 nt, Human
acaaaucagaagucaucuug

SEQ ID NO: 2750636 - RNA, 13 nt, Human
uaggauguugaaa

SEQ ID NO: 2750637 - RNA, 14 nt, Human
acaaaucagaaguc

SEQ ID NO: 2750638 - RNA, 15 nt, Human
acaaaucagaaguca

SEQ ID NO: 2750639 - RNA, 16 nt, Human
acaaaucagaagucau

SEQ ID NO: 2750640 - RNA, 23 nt, Human
acaaaucagaagucaucuugcua

SEQ ID NO: 2750641 - RNA, 14 nt, Human
uagaggguguguaa

SEQ ID NO: 2750642 - RNA, 14 nt, Human
acaaaaacacagca

SEQ ID NO: 2750643 - RNA, 15 nt, Human
acaaaaacacagcaa

SEQ ID NO: 2750644 - RNA, 13 nt, Human
acaaaaacacagc

SEQ ID NO: 2750645 - RNA, 15 nt, Human
uagacacuuuggaag

SEQ ID NO: 2750646 - RNA, 13 nt, Human
uagacacacauga

SEQ ID NO: 2750647 - RNA, 15 nt, Human
uagaaacacaacuau

SEQ ID NO: 2750648 - RNA, 16 nt, Human
uagaacucccuuucaa

SEQ ID NO: 2750649 - RNA, 17 nt, Human
uagaacucccuuucaac

SEQ ID NO: 2750650 - RNA, 18 nt, Human
acagcaagggugauggga

SEQ ID NO: 2750651 - RNA, 19 nt, Human
acagcccuucuuuccacag

SEQ ID NO: 2750652 - RNA, 22 nt, Human
acagcccuuaugcgguuaauuu

SEQ ID NO: 2750653 - RNA, 23 nt, Human
acagcccuuaugcgguuaauuuu

SEQ ID NO: 2750654 - RNA, 23 nt, Human
acagcuguaugauucccagccag

SEQ ID NO: 2750655 - RNA, 20 nt, Human
acagcuguaugauucccagc

SEQ ID NO: 2750656 - RNA, 19 nt, Human
acagcuguaugauucccag

SEQ ID NO: 2750657 - RNA, 14 nt, Human
acagcuguaugauu

SEQ ID NO: 2750658 - RNA, 13 nt, Human
uaucuauaauuua

SEQ ID NO: 2750659 - RNA, 14 nt, Human
uaucuauaauuuac

SEQ ID NO: 2750660 - RNA, 16 nt, Human
uaucuauaauuuaccu

SEQ ID NO: 2750661 - RNA, 19 nt, Human
uaucuauaauuuaccuaag

SEQ ID NO: 2750662 - RNA, 14 nt, Human
uaucacaaaucuua

SEQ ID NO: 2750663 - RNA, 16 nt, Human
uaucacaaaucuuaac

SEQ ID NO: 2750664 - RNA, 20 nt, Human
uaucacaaaucuuaacuuga

SEQ ID NO: 2750665 - RNA, 14 nt, Human
acagaccuuugaac

SEQ ID NO: 2750666 - RNA, 19 nt, Human
acagaaagcagaacaguga

SEQ ID NO: 2750667 - RNA, 22 nt, Human
acacuucuucuuggucuuauuu

SEQ ID NO: 2750668 - RNA, 21 nt, Human
uauaucuaccccagacuagau

SEQ ID NO: 2750669 - RNA, 12 nt, Human
uauaggaauuga

SEQ ID NO: 2750670 - RNA, 19 nt, Human
uauaggaauugacccacaa

SEQ ID NO: 2750671 - RNA, 16 nt, Human
uauaggugcuacaaaa

SEQ ID NO: 2750672 - RNA, 14 nt, Human
uauaauuuaccuaa

SEQ ID NO: 2750673 - RNA, 16 nt, Human
uauaauuuaccuaaga

SEQ ID NO: 2750674 - RNA, 20 nt, Human
uauaauuuaccuaagauuac

SEQ ID NO: 2750675 - RNA, 17 nt, Human
uauaauuuaccuaagau

SEQ ID NO: 2750676 - RNA, 18 nt, Human
uauaauuuaccuaagauu

SEQ ID NO: 2750677 - RNA, 13 nt, Human
acacucaaaucaa

SEQ ID NO: 2750678 - RNA, 18 nt, Human
acacucaaaucaagaaac

SEQ ID NO: 2750679 - RNA, 17 nt, Human
acacucaaaucaagaaa

SEQ ID NO: 2750680 - RNA, 16 nt, Human
aauucaaggaauuucu

SEQ ID NO: 2750681 - RNA, 17 nt, Human
aauucaaggaauuucuu

SEQ ID NO: 2750682 - RNA, 23 nt, Human
aauucaaggaauuucuuaacuuc

SEQ ID NO: 2750683 - RNA, 16 nt, Human
aauuagacacuuugga

SEQ ID NO: 2750684 - RNA, 17 nt, Human
aauuagacacuuuggaa

SEQ ID NO: 2750685 - RNA, 13 nt, Human
aauuacauuugua

SEQ ID NO: 2750686 - RNA, 14 nt, Human
aauuacauuuguau

SEQ ID NO: 2750687 - RNA, 16 nt, Human
uaccaugccauuuaaa

SEQ ID NO: 2750688 - RNA, 18 nt, Human
uaccaguuaauuuuucca

SEQ ID NO: 2750689 - RNA, 19 nt, Human
uaccaguuaauuuuuccaa

SEQ ID NO: 2750690 - RNA, 19 nt, Human
uaccagggacugaggggag

SEQ ID NO: 2750691 - RNA, 20 nt, Human
uaccaguauuuagaagccaa

SEQ ID NO: 2750692 - RNA, 12 nt, Human
uaccaguauuua

SEQ ID NO: 2750693 - RNA, 15 nt, Human
uaccaguauuuagaa

SEQ ID NO: 2750694 - RNA, 18 nt, Human
uaccaguauuuagaagcc

SEQ ID NO: 2750695 - RNA, 19 nt, Human
uaccaguauuuagaagcca

SEQ ID NO: 2750696 - RNA, 13 nt, Human
aauguucaucaau

SEQ ID NO: 2750697 - RNA, 20 nt, Human
aauguucaucaaugaaugaa

SEQ ID NO: 2750698 - RNA, 16 nt, Human
aauguucaucaaugaa

SEQ ID NO: 2750699 - RNA, 23 nt, Human
aaugauuaugaauuacauuugua

SEQ ID NO: 2750700 - RNA, 22 nt, Human
aaugagagacacacugaagaag

SEQ ID NO: 2750701 - RNA, 16 nt, Human
aaugauuucauucaau

SEQ ID NO: 2750702 - RNA, 21 nt, Human
uaauuuuuauauuugaaauau

SEQ ID NO: 2750703 - RNA, 19 nt, Human
uaauuuuuauauuugaaau

SEQ ID NO: 2750704 - RNA, 18 nt, Human
uaauuuuuauauuugaaa

SEQ ID NO: 2750705 - RNA, 22 nt, Human
uaauuccguagguuauuuucag

SEQ ID NO: 2750706 - RNA, 17 nt, Human
uacagagacagaaagca

SEQ ID NO: 2750707 - RNA, 20 nt, Human
aauguaagggaaacugccag

SEQ ID NO: 2750708 - RNA, 21 nt, Human
aaugcuguauuuuaaaagaau

SEQ ID NO: 2750709 - RNA, 20 nt, Human
aaugcuguauuuuaaaagaa

SEQ ID NO: 2750710 - RNA, 22 nt, Human
aaugcuguauuuuaaaagaaug

SEQ ID NO: 2750711 - RNA, 21 nt, Human
uacaaaaaaaaaaaaaaauua

SEQ ID NO: 2750712 - RNA, 13 nt, Human
uaauuuuuccaac

SEQ ID NO: 2750713 - RNA, 14 nt, Human
uaauuuuuccaacu

SEQ ID NO: 2750714 - RNA, 15 nt, Human
aauauuuauuuuaau

SEQ ID NO: 2750715 - RNA, 16 nt, Human
aaucagccuaguugau

SEQ ID NO: 2750716 - RNA, 14 nt, Human
uaagcaaaauguga

SEQ ID NO: 2750717 - RNA, 21 nt, Human
uaagcaaaaugugauauguac

SEQ ID NO: 2750718 - RNA, 15 nt, Human
uaagcaaaaugugau

SEQ ID NO: 2750719 - RNA, 22 nt, Human
uaagauuacaaaucagaaguca

SEQ ID NO: 2750720 - RNA, 19 nt, Human
uaagauuacaaaucagaag

SEQ ID NO: 2750721 - RNA, 18 nt, Human
uaaguuuuuuuuuaaaaa

SEQ ID NO: 2750722 - RNA, 12 nt, Human
uaauaaaaaggu

SEQ ID NO: 2750723 - RNA, 14 nt, Human
uaauaaaaagguga

SEQ ID NO: 2750724 - RNA, 15 nt, Human
uaauaaaaaggugac

SEQ ID NO: 2750725 - RNA, 18 nt, Human
uaagguuaccuuuguucc

SEQ ID NO: 2750726 - RNA, 13 nt, Human
uaaguaaaaccac

SEQ ID NO: 2750727 - RNA, 15 nt, Human
uaaguaaaaccacag

SEQ ID NO: 2750728 - RNA, 16 nt, Human
uaaguaaaaccacagc

SEQ ID NO: 2750729 - RNA, 17 nt, Human
uaaguaaaaccacagca

SEQ ID NO: 2750730 - RNA, 18 nt, Human
uaaguaaaaccacagcag

SEQ ID NO: 2750731 - RNA, 19 nt, Human
uaaguaaaaccacagcagu

SEQ ID NO: 2750732 - RNA, 20 nt, Human
uaaguaaugauaacuggaaa

SEQ ID NO: 2750733 - RNA, 20 nt, Human
aauccucaguuuuugugaaa

SEQ ID NO: 2750734 - RNA, 13 nt, Human
uaagaagugaaaa

SEQ ID NO: 2750735 - RNA, 21 nt, Human
uaacuuccuuggacucauuuu

SEQ ID NO: 2750736 - RNA, 22 nt, Human
uaacauguccugccuauuaucu

SEQ ID NO: 2750737 - RNA, 19 nt, Human
aauagucaaauugugugaa

SEQ ID NO: 2750738 - RNA, 18 nt, Human
aauaccaugccauuuaaa

SEQ ID NO: 2750739 - RNA, 23 nt, Human
aauaccacaggaaccacaagacu

SEQ ID NO: 2750740 - RNA, 23 nt, Human
aauacaucccuuaccugggaaag

SEQ ID NO: 2750741 - RNA, 13 nt, Human
aaguguauuugga

SEQ ID NO: 2750742 - RNA, 15 nt, Human
aaguguauuuggaaa

SEQ ID NO: 2750743 - RNA, 21 nt, Human
aaguguauuuggaaauaaagu

SEQ ID NO: 2750744 - RNA, 16 nt, Human
uaaaugugcuuuuaaa

SEQ ID NO: 2750745 - RNA, 22 nt, Human
aagcaucauuauuugcagagac

SEQ ID NO: 2750746 - RNA, 17 nt, Human
aagcaguggacaccagg

SEQ ID NO: 2750747 - RNA, 13 nt, Human
aagcauuguaaau

SEQ ID NO: 2750748 - RNA, 16 nt, Human
aagcauuuagauguau

SEQ ID NO: 2750749 - RNA, 19 nt, Human
aagcaucuggcucuaauuc

SEQ ID NO: 2750750 - RNA, 13 nt, Human
aagcaucuggcuc

SEQ ID NO: 2750751 - RNA, 17 nt, Human
aagcaucuggcucuaau

SEQ ID NO: 2750752 - RNA, 20 nt, Human
aagcucacagaccuuugaac

SEQ ID NO: 2750753 - RNA, 14 nt, Human
aagcuccagguaga

SEQ ID NO: 2750754 - RNA, 13 nt, Human
aagcuccagguag

SEQ ID NO: 2750755 - RNA, 20 nt, Human
guuauuauauuuacaaaugg

SEQ ID NO: 2750756 - RNA, 23 nt, Human
aagaggaaugaaguacucauaca

SEQ ID NO: 2750757 - RNA, 17 nt, Human
aagacugcauuauauuu

SEQ ID NO: 2750758 - RNA, 16 nt, Human
aagacugcacaucaaa

SEQ ID NO: 2750759 - RNA, 13 nt, Human
aagaugaaaauau

SEQ ID NO: 2750760 - RNA, 14 nt, Human
aagaugaaaauauu

SEQ ID NO: 2750761 - RNA, 21 nt, Human
guguauuuggaaauaaaguca

SEQ ID NO: 2750762 - RNA, 13 nt, Human
aagauguagagga

SEQ ID NO: 2750763 - RNA, 19 nt, Human
guguauuuggaaauaaagu

SEQ ID NO: 2750764 - RNA, 20 nt, Human
uaaaauaauuuuuauauuug

SEQ ID NO: 2750765 - RNA, 20 nt, Human
uaaaagacagugaaagaaaa

SEQ ID NO: 2750766 - RNA, 16 nt, Human
uaaaagaauauuuuaa

SEQ ID NO: 2750767 - RNA, 23 nt, Human
uaaaagaauauuuuaacuuccuu

SEQ ID NO: 2750768 - RNA, 12 nt, Human
uaaaagaaugau

SEQ ID NO: 2750769 - RNA, 19 nt, Human
aaguaaugauaacuggaaa

SEQ ID NO: 2750770 - RNA, 14 nt, Human
aaguaaugauaacu

SEQ ID NO: 2750771 - RNA, 13 nt, Human
aaguauuagaaua

SEQ ID NO: 2750772 - RNA, 19 nt, Human
guuuuuccuuguauuuaaa

SEQ ID NO: 2750773 - RNA, 16 nt, Human
aagucuuucacauuua

SEQ ID NO: 2750774 - RNA, 22 nt, Human
aagucuuauauauuguagauaa

SEQ ID NO: 2750775 - RNA, 19 nt, Human
aaggaggguuagggagggg

SEQ ID NO: 2750776 - RNA, 18 nt, Human
aaggaggguuagggaggg

SEQ ID NO: 2750777 - RNA, 14 nt, Human
aagguacuucaaau

SEQ ID NO: 2750778 - RNA, 19 nt, Human
aagggugaugggaaagcau

SEQ ID NO: 2750779 - RNA, 13 nt, Human
aagguacuucaaa

SEQ ID NO: 2750780 - RNA, 20 nt, Human
guauccagguucccucccag

SEQ ID NO: 2750781 - RNA, 21 nt, Human
guauaaaauaauuuuuauauu

SEQ ID NO: 2750782 - RNA, 15 nt, Human
guauaaaauaauuuu

SEQ ID NO: 2750783 - RNA, 16 nt, Human
guauauuuuauaucaa

SEQ ID NO: 2750784 - RNA, 16 nt, Human
aaauguaagggaaacu

SEQ ID NO: 2750785 - RNA, 17 nt, Human
guaguguuggagaagaa

SEQ ID NO: 2750786 - RNA, 20 nt, Human
guaguguuggagaagaacug

SEQ ID NO: 2750787 - RNA, 15 nt, Human
aaauggguuuuacug

SEQ ID NO: 2750788 - RNA, 14 nt, Human
aaauggguuuuacu

SEQ ID NO: 2750789 - RNA, 16 nt, Human
gucaaauugugugaaa

SEQ ID NO: 2750790 - RNA, 18 nt, Human
guauguacuucaugcugu

SEQ ID NO: 2750791 - RNA, 16 nt, Human
aacagauaaauaguuu

SEQ ID NO: 2750792 - RNA, 22 nt, Human
aacagugauuaccagggacuga

SEQ ID NO: 2750793 - RNA, 15 nt, Human
aacagugauuaccag

SEQ ID NO: 2750794 - RNA, 15 nt, Human
aacacagcaagggug

SEQ ID NO: 2750795 - RNA, 22 nt, Human
aacaaugcuguauuuuaaaaga

SEQ ID NO: 2750796 - RNA, 17 nt, Human
aacaaugcuguauuuua

SEQ ID NO: 2750797 - RNA, 16 nt, Human
aacacaacuauauugu

SEQ ID NO: 2750798 - RNA, 15 nt, Human
aacacaacuauauug

SEQ ID NO: 2750799 - RNA, 15 nt, Human
aacaaugcuguauuu

SEQ ID NO: 2750800 - RNA, 14 nt, Human
aacaaugcuguauu

SEQ ID NO: 2750801 - RNA, 12 nt, Human
aacaauaaaaga

SEQ ID NO: 2750802 - RNA, 20 nt, Human
aaauuuuuucucuaggaaau

SEQ ID NO: 2750803 - RNA, 21 nt, Human
gugagaugcuagaacucccuu

SEQ ID NO: 2750804 - RNA, 12 nt, Human
aacugaaaucau

SEQ ID NO: 2750805 - RNA, 19 nt, Human
aacugcacugucaagauga

SEQ ID NO: 2750806 - RNA, 19 nt, Human
aacuggacugguucaaaug

SEQ ID NO: 2750807 - RNA, 17 nt, Human
aacugggacaggggaga

SEQ ID NO: 2750808 - RNA, 15 nt, Human
gugccacuuaaugua

SEQ ID NO: 2750809 - RNA, 18 nt, Human
gugccacuuaauguaugu

SEQ ID NO: 2750810 - RNA, 12 nt, Human
aacuucuugcuu

SEQ ID NO: 2750811 - RNA, 18 nt, Human
aacuucuugcuucuuucu

SEQ ID NO: 2750812 - RNA, 17 nt, Human
gugaugggaaagcauug

SEQ ID NO: 2750813 - RNA, 18 nt, Human
aacuuccagauccuggaa

SEQ ID NO: 2750814 - RNA, 21 nt, Human
aacuucagcgguuuauauaag

SEQ ID NO: 2750815 - RNA, 17 nt, Human
aacaguugguaacuuuu

SEQ ID NO: 2750816 - RNA, 14 nt, Human
aacaguugguaacu

SEQ ID NO: 2750817 - RNA, 18 nt, Human
aacccaaguccaagcaua

SEQ ID NO: 2750818 - RNA, 23 nt, Human
aacccaaauguucaucaaugaau

SEQ ID NO: 2750819 - RNA, 18 nt, Human
aaccugagccccaaaagg

SEQ ID NO: 2750820 - RNA, 16 nt, Human
aacccgggaggcagag

SEQ ID NO: 2750821 - RNA, 15 nt, Human
gucuggcccaccagg

SEQ ID NO: 2750822 - RNA, 20 nt, Human
aaccugagccccaaaaggua

SEQ ID NO: 2750823 - RNA, 16 nt, Human
gucuuucacauuuaaa

SEQ ID NO: 2750824 - RNA, 18 nt, Human
aaccuugaaaacuuuaug

SEQ ID NO: 2750825 - RNA, 17 nt, Human
aacuacuaauagaauaa

SEQ ID NO: 2750826 - RNA, 23 nt, Human
aacuaucucauuuccaagcaagu

SEQ ID NO: 2750827 - RNA, 16 nt, Human
aacuaugauuauuaac

SEQ ID NO: 2750828 - RNA, 21 nt, Human
aacuagaguuuagcuggaaaa

SEQ ID NO: 2750829 - RNA, 12 nt, Human
aacucauuucua

SEQ ID NO: 2750830 - RNA, 19 nt, Human
acuucagcgguuuauauaa

SEQ ID NO: 2750831 - RNA, 18 nt, Human
acuucagcgguuuauaua

SEQ ID NO: 2750832 - RNA, 17 nt, Human
acuucagcgguuuauau

SEQ ID NO: 2750833 - RNA, 20 nt, Human
acuucaaauccuugaagauu

SEQ ID NO: 2750834 - RNA, 19 nt, Human
acuucaaauccuugaagau

SEQ ID NO: 2750835 - RNA, 14 nt, Human
acuuaaaaaugguu

SEQ ID NO: 2750836 - RNA, 13 nt, Human
acuuaaaaauggu

SEQ ID NO: 2750837 - RNA, 17 nt, Human
acuuuaugcuaagugaa

SEQ ID NO: 2750838 - RNA, 12 nt, Human
acuuuaugcuaa

SEQ ID NO: 2750839 - RNA, 22 nt, Human
acuugggaggcugagaugggag

SEQ ID NO: 2750840 - RNA, 17 nt, Human
acucugucucaguccau

SEQ ID NO: 2750841 - RNA, 15 nt, Human
acucugucucagucc

SEQ ID NO: 2750842 - RNA, 20 nt, Human
acucuuaagaagacugcauu

SEQ ID NO: 2750843 - RNA, 15 nt, Human
acucuuaagaagacu

SEQ ID NO: 2750844 - RNA, 14 nt, Human
acucuuaagaagac

SEQ ID NO: 2750845 - RNA, 18 nt, Human
accucugccucagaaaac

SEQ ID NO: 2750846 - RNA, 17 nt, Human
accucugccucagaaaa

SEQ ID NO: 2750847 - RNA, 18 nt, Human
acuauugaaguugcagau

SEQ ID NO: 2750848 - RNA, 18 nt, Human
acuaguauuucuaugaaa

SEQ ID NO: 2750849 - RNA, 19 nt, Human
acuaguauuucuaugaaau

SEQ ID NO: 2750850 - RNA, 19 nt, Human
acggacgaaccuugaaaac

SEQ ID NO: 2750851 - RNA, 20 nt, Human
accaaggcugauuaaaccaa

SEQ ID NO: 2750852 - RNA, 19 nt, Human
accaaggcugauuaaacca

SEQ ID NO: 2750853 - RNA, 20 nt, Human
acaucccuuaccugggaaag

SEQ ID NO: 2750854 - RNA, 21 nt, Human
acagugggugccccccuugcc

SEQ ID NO: 2750855 - RNA, 14 nt, Human
acagugggugcccc

SEQ ID NO: 2750856 - RNA, 20 nt, Human
acagugauuaccagggacug

SEQ ID NO: 2750857 - RNA, 21 nt, Human
acagugauuaccagggacuga

SEQ ID NO: 2750858 - RNA, 18 nt, Human
aauuuugugaagcaaaau

SEQ ID NO: 2750859 - RNA, 17 nt, Human
aauuuugugaagcaaaa

SEQ ID NO: 2750860 - RNA, 13 nt, Human
aauuuugugaagc

SEQ ID NO: 2750861 - RNA, 21 nt, Human
acaaggaugaauuaaguuuuu

SEQ ID NO: 2750862 - RNA, 16 nt, Human
acaagaaaugaaagca

SEQ ID NO: 2750863 - RNA, 15 nt, Human
acaagaaaugaaagc

SEQ ID NO: 2750864 - RNA, 13 nt, Human
acaagaaaugaaa

SEQ ID NO: 2750865 - RNA, 16 nt, Human
acacugggggagggga

SEQ ID NO: 2750866 - RNA, 15 nt, Human
acacugggggagggg

SEQ ID NO: 2750867 - RNA, 16 nt, Human
acagaagcuccaggua

SEQ ID NO: 2750868 - RNA, 19 nt, Human
aaaggcagaagcaacccaa

SEQ ID NO: 2750869 - RNA, 13 nt, Human
aaaggcaguuuuc

SEQ ID NO: 2750870 - RNA, 14 nt, Human
aaaggcaguuuucu

SEQ ID NO: 2750871 - RNA, 16 nt, Human
aaaggcaguuuucuaa

SEQ ID NO: 2750872 - RNA, 19 nt, Human
aaagcauuguaaaugugcu

SEQ ID NO: 2750873 - RNA, 20 nt, Human
aaagcauuguaaaugugcuu

SEQ ID NO: 2750874 - RNA, 21 nt, Human
aaacccugucucuacuaaaaa

SEQ ID NO: 2750875 - RNA, 13 nt, Human
aaagaaacauuug

SEQ ID NO: 2750876 - RNA, 13 nt, Human
aaaauucauuuuu

SEQ ID NO: 2750877 - RNA, 19 nt, Human
aaaauccauacauuugugu

SEQ ID NO: 2750878 - RNA, 12 nt, Human
aacacaucagcu

SEQ ID NO: 2750879 - RNA, 22 nt, Human
aaauugacacuuaaaaaugguu

SEQ ID NO: 2750880 - RNA, 20 nt, Human
aaauguucaucaaugaauga

SEQ ID NO: 2750881 - RNA, 17 nt, Human
aaauguucaucaaugaa

SEQ ID NO: 2750882 - RNA, 14 nt, Human
aaaucuuaacuuga

SEQ ID NO: 2750883 - RNA, 13 nt, Human
aacugaagccaga

SEQ ID NO: 2750884 - RNA, 23 nt, Human
aacugagaugugaacacaucagc

SEQ ID NO: 2750885 - RNA, 15 nt, Human
aauccaaugaaauga

SEQ ID NO: 2750886 - RNA, 16 nt, Human
aauccauacauuugug

SEQ ID NO: 2750887 - RNA, 17 nt, Human
aauccauacauuugugu

SEQ ID NO: 2750888 - RNA, 14 nt, Human
aauccauacauuug

SEQ ID NO: 2750889 - RNA, 16 nt, Human
aaugauaacuggaaac

SEQ ID NO: 2750890 - RNA, 15 nt, Human
aaugauaacuggaaa

SEQ ID NO: 2750891 - RNA, 14 nt, Human
aaugauaacuggaa

SEQ ID NO: 2750892 - RNA, 22 nt, Human
aaucauuucugcaucagcugcu

SEQ ID NO: 2750893 - RNA, 15 nt, Human
aaucaaauaugcaaa

SEQ ID NO: 2750894 - RNA, 16 nt, Human
aaucaaauaugcaaag

SEQ ID NO: 2750895 - RNA, 22 nt, Human
aaucaaauaugcaaagcacuga

SEQ ID NO: 2750896 - RNA, 12 nt, Human
aauaauguuuca

SEQ ID NO: 2750897 - RNA, 19 nt, Human
aauaauguuucaaacauau

SEQ ID NO: 2750898 - RNA, 14 nt, Human
aauaauguuucaaa

SEQ ID NO: 2750899 - RNA, 10 nt, Human
aauaaaccau

SEQ ID NO: 2750900 - RNA, 22 nt, Human
aaguugauaugccuuuucccaa

SEQ ID NO: 2750901 - RNA, 17 nt, Human
aaguucugcagauaaac

SEQ ID NO: 2750902 - RNA, 15 nt, Human
aagcagggacuugaa

SEQ ID NO: 2750903 - RNA, 15 nt, Human
aagagaacuuccaga

SEQ ID NO: 2750904 - RNA, 23 nt, Human
aagacagugaaagaaaauaacaa

SEQ ID NO: 2750905 - RNA, 14 nt, Human
aaggaauuucuuaa

SEQ ID NO: 2750906 - RNA, 23 nt, Human
aaggaauuucuuaacuucuugcu

SEQ ID NO: 2750907 - RNA, 16 nt, Human
aaggaauuucuuaacu

SEQ ID NO: 2750908 - RNA, 17 nt, Human
aaggaauuucuuaacuu

SEQ ID NO: 2750909 - RNA, 19 nt, Human
aaggaauuucuuaacuucu

SEQ ID NO: 2750910 - RNA, 20 nt, Human
aaggaauuucuuaacuucuu

SEQ ID NO: 2750911 - RNA, 19 nt, Human
aagccagauuuuccugaaa

SEQ ID NO: 2750912 - RNA, 14 nt, Human
aagggauggcaaga

SEQ ID NO: 2750913 - RNA, 17 nt, Human
aagggauggcaagaugu

SEQ ID NO: 2750914 - RNA, 15 nt, Human
aagggauuuucagcc

SEQ ID NO: 2750915 - RNA, 21 nt, Human
aagggauuuucagcccucaga

SEQ ID NO: 2750916 - RNA, 23 nt, Human
aagggauuuucagcccucagaau

SEQ ID NO: 2750917 - RNA, 12 nt, Human
aaguagaggagg

SEQ ID NO: 2750918 - RNA, 16 nt, Human
agccagcagccagcuc

SEQ ID NO: 2750919 - RNA, 14 nt, Human
agccagcagccagc

SEQ ID NO: 2750920 - RNA, 20 nt, Human
agccagcagccagcucucag

SEQ ID NO: 2750921 - RNA, 13 nt, Human
agccagcagccag

SEQ ID NO: 2750922 - RNA, 11 nt, Human
agccagcagcc

SEQ ID NO: 2750923 - RNA, 17 nt, Human
agcacuuggagccaagg

SEQ ID NO: 2750924 - RNA, 14 nt, Human
agcacuuggagcca

SEQ ID NO: 2750925 - RNA, 24 nt, Human
agcaaaauuuuuucucuaggaaau

SEQ ID NO: 2750926 - RNA, 19 nt, Human
agauguagaggagaaacug

SEQ ID NO: 2750927 - RNA, 16 nt, Human
agauguagaggagaaa

SEQ ID NO: 2750928 - RNA, 22 nt, Human
agaagagcuguucacagccaga

SEQ ID NO: 2750929 - RNA, 21 nt, Human
agaagagcuguucacagccag

SEQ ID NO: 2750930 - RNA, 18 nt, Human
agaagacugcauuauauu

SEQ ID NO: 2750931 - RNA, 22 nt, Human
agaagucaucuugcuaccagua

SEQ ID NO: 2750932 - RNA, 15 nt, Human
agaagucaucuugcu

SEQ ID NO: 2750933 - RNA, 16 nt, Human
agaagucaucuugcua

SEQ ID NO: 2750934 - RNA, 21 nt, Human
agaagugaaaaucuacacucc

SEQ ID NO: 2750935 - RNA, 17 nt, Human
agaaugauuaugaauua

SEQ ID NO: 2750936 - RNA, 22 nt, Human
agaaugagagacacacugaaga

SEQ ID NO: 2750937 - RNA, 17 nt, Human
agaaugagagacacacu

SEQ ID NO: 2750938 - RNA, 14 nt, Human
agacagcagcucag

SEQ ID NO: 2750939 - RNA, 12 nt, Human
agacagcagcuc

SEQ ID NO: 2750940 - RNA, 16 nt, Human
agacagcagcucaggc

SEQ ID NO: 2750941 - RNA, 19 nt, Human
agacccaaaaggcagaagc

SEQ ID NO: 2750942 - RNA, 17 nt, Human
agacccaaaaggcagaa

SEQ ID NO: 2750943 - RNA, 16 nt, Human
agacuggauaguccgu

SEQ ID NO: 2750944 - RNA, 20 nt, Human
agacuggauaguccgucucu

SEQ ID NO: 2750945 - RNA, 18 nt, Human
agacucugucucagucca

SEQ ID NO: 2750946 - RNA, 13 nt, Human
agaggaaugaagu

SEQ ID NO: 2750947 - RNA, 21 nt, Human
aggccaugggcacugugggua

SEQ ID NO: 2750948 - RNA, 24 nt, Human
aggcuuagacccucaugcugccaa

SEQ ID NO: 2750949 - RNA, 15 nt, Human
agggacugaggggag

SEQ ID NO: 2750950 - RNA, 15 nt, Human
aggcgggaaggaggg

SEQ ID NO: 2750951 - RNA, 14 nt, Human
aggcgggaaggagg

SEQ ID NO: 2750952 - RNA, 17 nt, Human
aggguccuuuugacacu

SEQ ID NO: 2750953 - RNA, 22 nt, Human
aggguccuuuugacacugcucu

SEQ ID NO: 2750954 - RNA, 15 nt, Human
agggauuagggagag

SEQ ID NO: 2750955 - RNA, 17 nt, Human
agggauuuucagcccuc

SEQ ID NO: 2750956 - RNA, 22 nt, Human
agggauuuucagcccucagaau

SEQ ID NO: 2750957 - RNA, 13 nt, Human
aggaaguagagga

SEQ ID NO: 2750958 - RNA, 20 nt, Human
agcuuauuuccucauuuuua

SEQ ID NO: 2750959 - RNA, 20 nt, Human
agcuccccucggagaagagc

SEQ ID NO: 2750960 - RNA, 17 nt, Human
agcuccccucggagaag

SEQ ID NO: 2750961 - RNA, 19 nt, Human
agcuccccucggagaagag

SEQ ID NO: 2750962 - RNA, 17 nt, Human
agcgacagugagacucu

SEQ ID NO: 2750963 - RNA, 18 nt, Human
augaugaucuuuaaaaua

SEQ ID NO: 2750964 - RNA, 21 nt, Human
augaugaucuuuaaaauacac

SEQ ID NO: 2750965 - RNA, 16 nt, Human
augaucuuuaaaauac

SEQ ID NO: 2750966 - RNA, 21 nt, Human
augucaaucagccuaguugau

SEQ ID NO: 2750967 - RNA, 16 nt, Human
augucaaucagccuag

SEQ ID NO: 2750968 - RNA, 15 nt, Human
augugaacacaucag

SEQ ID NO: 2750969 - RNA, 15 nt, Human
auguuccuagugaaa

SEQ ID NO: 2750970 - RNA, 16 nt, Human
auguuccuagugaaag

SEQ ID NO: 2750971 - RNA, 17 nt, Human
auguuccuagugaaaga

SEQ ID NO: 2750972 - RNA, 22 nt, Human
aucagcuugcccuguuaaaaga

SEQ ID NO: 2750973 - RNA, 13 nt, Human
aucagcuuauugu

SEQ ID NO: 2750974 - RNA, 17 nt, Human
aucaugaauuaguuuua

SEQ ID NO: 2750975 - RNA, 14 nt, Human
aucaaauaugcaaa

SEQ ID NO: 2750976 - RNA, 17 nt, Human
aucgcuccaccuugcag

SEQ ID NO: 2750977 - RNA, 21 nt, Human
aucgcuccaccuugcagcucu

SEQ ID NO: 2750978 - RNA, 19 nt, Human
auccucaguuuuugugaaa

SEQ ID NO: 2750979 - RNA, 16 nt, Human
aucuauaauuuaccua

SEQ ID NO: 2750980 - RNA, 23 nt, Human
aucuauaauuuaccuaagauuac

SEQ ID NO: 2750981 - RNA, 11 nt, Human
aucuauaauuu

SEQ ID NO: 2750982 - RNA, 13 nt, Human
aucuauaauuuac

SEQ ID NO: 2750983 - RNA, 23 nt, Human
augaaguccaagcauuuagaugu

SEQ ID NO: 2750984 - RNA, 20 nt, Human
augaaguccaagcauuuaga

SEQ ID NO: 2750985 - RNA, 21 nt, Human
augaaguacucauacauguua

SEQ ID NO: 2750986 - RNA, 13 nt, Human
augaaguacucau

SEQ ID NO: 2750987 - RNA, 19 nt, Human
aguugaaaagacuccaaag

SEQ ID NO: 2750988 - RNA, 20 nt, Human
aguugaaaagacuccaaaga

SEQ ID NO: 2750989 - RNA, 14 nt, Human
aguugaaaagacuc

SEQ ID NO: 2750990 - RNA, 18 nt, Human
aguugaaaagacuccaaa

SEQ ID NO: 2750991 - RNA, 19 nt, Human
aguucagagcugcccucuc

SEQ ID NO: 2750992 - RNA, 20 nt, Human
aguucagagcugcccucucc

SEQ ID NO: 2750993 - RNA, 22 nt, Human
aguucagagcugcccucuccug

SEQ ID NO: 2750994 - RNA, 21 nt, Human
aguucagagcugcccucuccu

SEQ ID NO: 2750995 - RNA, 23 nt, Human
aguucagagcugcccucuccugg

SEQ ID NO: 2750996 - RNA, 14 nt, Human
agugcucuuuucuc

SEQ ID NO: 2750997 - RNA, 17 nt, Human
agugcucuuuucuccuc

SEQ ID NO: 2750998 - RNA, 19 nt, Human
agugucaaugcagccccca

SEQ ID NO: 2750999 - RNA, 16 nt, Human
aguacuguguacagaa

SEQ ID NO: 2751000 - RNA, 22 nt, Human
aguauuuuuuguauaauuggau

SEQ ID NO: 2751001 - RNA, 13 nt, Human
aguauuuuuugua

SEQ ID NO: 2751002 - RNA, 19 nt, Human
aguauuuuuuguauaauug

SEQ ID NO: 2751003 - RNA, 20 nt, Human
aguauuuuuuguauaauugg

SEQ ID NO: 2751004 - RNA, 11 nt, Human
aguccaagcau

SEQ ID NO: 2751005 - RNA, 15 nt, Human
auagcagcuuauuca

SEQ ID NO: 2751006 - RNA, 14 nt, Human
auauuauguuaaaa

SEQ ID NO: 2751007 - RNA, 13 nt, Human
auauuauguuaaa

SEQ ID NO: 2751008 - RNA, 11 nt, Human
aguuuggccag

SEQ ID NO: 2751009 - RNA, 21 nt, Human
auaacaaugcuguauuuuaaa

SEQ ID NO: 2751010 - RNA, 20 nt, Human
auaacaaugcuguauuuuaa

SEQ ID NO: 2751011 - RNA, 19 nt, Human
auaacaaugcuguauuuua

SEQ ID NO: 2751012 - RNA, 17 nt, Human
auaacaaugcuguauuu

SEQ ID NO: 2751013 - RNA, 15 nt, Human
auaacaaugcuguau

SEQ ID NO: 2751014 - RNA, 14 nt, Human
auaacaaugaaagu

SEQ ID NO: 2751015 - RNA, 18 nt, Human
auaauguuucaaacauau

SEQ ID NO: 2751016 - RNA, 13 nt, Human
auaauguuucaaa

SEQ ID NO: 2751017 - RNA, 22 nt, Human
auaagccagacaucaacagaua

SEQ ID NO: 2751018 - RNA, 21 nt, Human
auaagccagacaucaacagau

SEQ ID NO: 2751019 - RNA, 14 nt, Human
auaagccagacauc

SEQ ID NO: 2751020 - RNA, 16 nt, Human
cacagugcucuuuucu

SEQ ID NO: 2751021 - RNA, 18 nt, Human
cacagugcucuuuucucc

SEQ ID NO: 2751022 - RNA, 14 nt, Human
caaaacugcacugu

SEQ ID NO: 2751023 - RNA, 17 nt, Human
caaaacugcacugucaa

SEQ ID NO: 2751024 - RNA, 18 nt, Human
caaaacugcacugucaag

SEQ ID NO: 2751025 - RNA, 16 nt, Human
caaacugacucuuaag

SEQ ID NO: 2751026 - RNA, 14 nt, Human
caaacugaagccag

SEQ ID NO: 2751027 - RNA, 15 nt, Human
caaacugaagccaga

SEQ ID NO: 2751028 - RNA, 21 nt, Human
caaacugacucuuaagaagac

SEQ ID NO: 2751029 - RNA, 17 nt, Human
caaacugacucuuaaga

SEQ ID NO: 2751030 - RNA, 19 nt, Human
caagaaaugaaagcaggga

SEQ ID NO: 2751031 - RNA, 17 nt, Human
caagaaaugaaagcagg

SEQ ID NO: 2751032 - RNA, 15 nt, Human
caagaaaugaaagca

SEQ ID NO: 2751033 - RNA, 18 nt, Human
caaauguucaucaaugaa

SEQ ID NO: 2751034 - RNA, 14 nt, Human
caaauguucaucaa

SEQ ID NO: 2751035 - RNA, 12 nt, Human
caaauaugcaaa

SEQ ID NO: 2751036 - RNA, 13 nt, Human
caaauaugcaaag

SEQ ID NO: 2751037 - RNA, 20 nt, Human
caaggaaaaaauaacaauga

SEQ ID NO: 2751038 - RNA, 18 nt, Human
caaggaaaaaauaacaau

SEQ ID NO: 2751039 - RNA, 19 nt, Human
caauagucaaauuguguga

SEQ ID NO: 2751040 - RNA, 17 nt, Human
caauagucaaauugugu

SEQ ID NO: 2751041 - RNA, 19 nt, Human
caaggcuuagacccucaug

SEQ ID NO: 2751042 - RNA, 22 nt, Human
caaggcuuagacccucaugcug

SEQ ID NO: 2751043 - RNA, 21 nt, Human
caagggugaugggaaagcauu

SEQ ID NO: 2751044 - RNA, 23 nt, Human
caagggugaugggaaagcauugu

SEQ ID NO: 2751045 - RNA, 13 nt, Human
cacacugaagaag

SEQ ID NO: 2751046 - RNA, 21 nt, Human
cacagcaguugaaaagacucc

SEQ ID NO: 2751047 - RNA, 19 nt, Human
cacagcaguugaaaagacu

SEQ ID NO: 2751048 - RNA, 23 nt, Human
cacagcccuuaugcgguuaauuu

SEQ ID NO: 2751049 - RNA, 17 nt, Human
cacagccagacuggcac

SEQ ID NO: 2751050 - RNA, 18 nt, Human
cacagccagacuggcaca

SEQ ID NO: 2751051 - RNA, 18 nt, Human
cacaagaaaugaaagcag

SEQ ID NO: 2751052 - RNA, 21 nt, Human
cacaagaaaugaaagcaggga

SEQ ID NO: 2751053 - RNA, 20 nt, Human
cacaagaaaugaaagcaggg

SEQ ID NO: 2751054 - RNA, 21 nt, Human
caauaucuuuuuuuuaauaaa

SEQ ID NO: 2751055 - RNA, 22 nt, Human
caauauccuaauaaaaagguga

SEQ ID NO: 2751056 - RNA, 22 nt, Human
caauuuuucuuauuucauuucu

SEQ ID NO: 2751057 - RNA, 21 nt, Human
uguuaaaagaugaaaauauuu

SEQ ID NO: 2751058 - RNA, 22 nt, Human
ugugugaaagguacuucaaauc

SEQ ID NO: 2751059 - RNA, 21 nt, Human
ugugugaaagguacuucaaau

SEQ ID NO: 2751060 - RNA, 20 nt, Human
ugugugaaagguacuucaaa

SEQ ID NO: 2751061 - RNA, 19 nt, Human
uguguuuugcaagccagau

SEQ ID NO: 2751062 - RNA, 13 nt, Human
uguguuuugcaag

SEQ ID NO: 2751063 - RNA, 17 nt, Human
uguuggcauagcucugg

SEQ ID NO: 2751064 - RNA, 17 nt, Human
uguuuaaaaucauuucu

SEQ ID NO: 2751065 - RNA, 18 nt, Human
uguuuaaaaucauuucug

SEQ ID NO: 2751066 - RNA, 14 nt, Human
uguuuaaaaucauu

SEQ ID NO: 2751067 - RNA, 20 nt, Human
uguuggagaagaacugaaau

SEQ ID NO: 2751068 - RNA, 19 nt, Human
uguuggagaagaacugaaa

SEQ ID NO: 2751069 - RNA, 14 nt, Human
uguuggagaagaac

SEQ ID NO: 2751070 - RNA, 17 nt, Human
uguuggagaagaacuga

SEQ ID NO: 2751071 - RNA, 16 nt, Human
uguuggagaagaacug

SEQ ID NO: 2751072 - RNA, 20 nt, Human
uguugacaugggacauuugc

SEQ ID NO: 2751073 - RNA, 22 nt, Human
uuaagcaucuggcucuaauuca

SEQ ID NO: 2751074 - RNA, 20 nt, Human
uuacauuuguauaaaauaau

SEQ ID NO: 2751075 - RNA, 22 nt, Human
uuaaaaaaaaaccugagcccca

SEQ ID NO: 2751076 - RNA, 21 nt, Human
uuaaauauguuagcaaagagu

SEQ ID NO: 2751077 - RNA, 18 nt, Human
uuaaaauacacacucaaa

SEQ ID NO: 2751078 - RNA, 15 nt, Human
uguaccgcaauguga

SEQ ID NO: 2751079 - RNA, 16 nt, Human
uguaccgcaaugugac

SEQ ID NO: 2751080 - RNA, 20 nt, Human
uguaauaaacucauuucuag

SEQ ID NO: 2751081 - RNA, 22 nt, Human
uguaguguuggagaagaacuga

SEQ ID NO: 2751082 - RNA, 19 nt, Human
uguccagggcccugagcuc

SEQ ID NO: 2751083 - RNA, 17 nt, Human
uguccagggcccugagc

SEQ ID NO: 2751084 - RNA, 13 nt, Human
uguccagggcccu

SEQ ID NO: 2751085 - RNA, 13 nt, Human
uguauuuaaauau

SEQ ID NO: 2751086 - RNA, 22 nt, Human
uguaugauuacuggccuuuuuc

SEQ ID NO: 2751087 - RNA, 15 nt, Human
uguaugauucccagc

SEQ ID NO: 2751088 - RNA, 12 nt, Human
uguaugauuacu

SEQ ID NO: 2751089 - RNA, 13 nt, Human
uguaugauuacug

SEQ ID NO: 2751090 - RNA, 24 nt, Human
ugugaauuaggcuguaacuacuuu

SEQ ID NO: 2751091 - RNA, 19 nt, Human
ugugaauuaggcuguaacu

SEQ ID NO: 2751092 - RNA, 22 nt, Human
ugugaauuaggcuguaacuacu

SEQ ID NO: 2751093 - RNA, 23 nt, Human
ugugaauuaggcuguaacuacuu

SEQ ID NO: 2751094 - RNA, 21 nt, Human
uguguaauuagugccacuuaa

SEQ ID NO: 2751095 - RNA, 23 nt, Human
uguguacagaauucugcuaccuc

SEQ ID NO: 2751096 - RNA, 21 nt, Human
uguguacagaauucugcuacc

SEQ ID NO: 2751097 - RNA, 19 nt, Human
ugugcuaguaauuggaaag

SEQ ID NO: 2751098 - RNA, 22 nt, Human
uggaauaauccuaaacauauga

SEQ ID NO: 2751099 - RNA, 15 nt, Human
uggaaaauucauuuu

SEQ ID NO: 2751100 - RNA, 23 nt, Human
uggaaacuucagcgguuuauaua

SEQ ID NO: 2751101 - RNA, 20 nt, Human
uggaacauaaaauacaaugu

SEQ ID NO: 2751102 - RNA, 21 nt, Human
uggaacauaaaauacaauguu

SEQ ID NO: 2751103 - RNA, 13 nt, Human
uggcccaggaguu

SEQ ID NO: 2751104 - RNA, 14 nt, Human
uggcccaggaguuu

SEQ ID NO: 2751105 - RNA, 19 nt, Human
uggcccaggaguuuggcca

SEQ ID NO: 2751106 - RNA, 22 nt, Human
uggcccaggaguuuggccagaa

SEQ ID NO: 2751107 - RNA, 20 nt, Human
uggcccaggaguuuggccag

SEQ ID NO: 2751108 - RNA, 21 nt, Human
uggcccaggaguuuggccaga

SEQ ID NO: 2751109 - RNA, 15 nt, Human
uggauuuccuaauac

SEQ ID NO: 2751110 - RNA, 21 nt, Human
uggauuuccuaauacugucau

SEQ ID NO: 2751111 - RNA, 11 nt, Human
uggagggaagc

SEQ ID NO: 2751112 - RNA, 21 nt, Human
ugguauguuuucaggcuagau

SEQ ID NO: 2751113 - RNA, 16 nt, Human
uggcuuccuggcaaua

SEQ ID NO: 2751114 - RNA, 21 nt, Human
uggcuugaguuuaaauuguaa

SEQ ID NO: 2751115 - RNA, 14 nt, Human
ugggaguacaaaag

SEQ ID NO: 2751116 - RNA, 19 nt, Human
ugccaaauauaaauaaaaa

SEQ ID NO: 2751117 - RNA, 22 nt, Human
ugccaaauauaaauaaaaauaa

SEQ ID NO: 2751118 - RNA, 17 nt, Human
ugccaaauauaaauaaa

SEQ ID NO: 2751119 - RNA, 18 nt, Human
ugccaaauauaaauaaaa

SEQ ID NO: 2751120 - RNA, 20 nt, Human
ugccacuaaauugacacuua

SEQ ID NO: 2751121 - RNA, 23 nt, Human
ugcccagggcucagccugguggg

SEQ ID NO: 2751122 - RNA, 21 nt, Human
ugcccagggcucagccuggug

SEQ ID NO: 2751123 - RNA, 20 nt, Human
ugcccagggcucagccuggu

SEQ ID NO: 2751124 - RNA, 12 nt, Human
ugccaucccucc

SEQ ID NO: 2751125 - RNA, 11 nt, Human
ugccaucccuc

SEQ ID NO: 2751126 - RNA, 14 nt, Human
ugccaucccucccu

SEQ ID NO: 2751127 - RNA, 22 nt, Human
ugcaguucugaagaagauggua

SEQ ID NO: 2751128 - RNA, 19 nt, Human
ugcaguucugaagaagaug

SEQ ID NO: 2751129 - RNA, 14 nt, Human
ugcaguucugaaga

SEQ ID NO: 2751130 - RNA, 18 nt, Human
ugcaguucugaagaagau

SEQ ID NO: 2751131 - RNA, 17 nt, Human
ugcaguucugaagaaga

SEQ ID NO: 2751132 - RNA, 16 nt, Human
ugcaguucugaagaag

SEQ ID NO: 2751133 - RNA, 15 nt, Human
ugcaguucugaagaa

SEQ ID NO: 2751134 - RNA, 19 nt, Human
ugcagugagccgagauugu

SEQ ID NO: 2751135 - RNA, 19 nt, Human
ugcacgcacacugucugcc

SEQ ID NO: 2751136 - RNA, 19 nt, Human
ugcugcaagcacagcccuu

SEQ ID NO: 2751137 - RNA, 17 nt, Human
ugcugaaacaacaaaua

SEQ ID NO: 2751138 - RNA, 19 nt, Human
ugcuaagcauuccaacuau

SEQ ID NO: 2751139 - RNA, 15 nt, Human
ugcuaagcauuccaa

SEQ ID NO: 2751140 - RNA, 16 nt, Human
ugcucaguagucagac

SEQ ID NO: 2751141 - RNA, 15 nt, Human
ugccuucucaacucc

SEQ ID NO: 2751142 - RNA, 18 nt, Human
ugccuguaaucacagcua

SEQ ID NO: 2751143 - RNA, 14 nt, Human
uccgaggcaggguc

SEQ ID NO: 2751144 - RNA, 13 nt, Human
uccgaggcagggu

SEQ ID NO: 2751145 - RNA, 12 nt, Human
uccgaggcaggg

SEQ ID NO: 2751146 - RNA, 17 nt, Human
uccucugcuugccaucc

SEQ ID NO: 2751147 - RNA, 16 nt, Human
uccucugcuugccauc

SEQ ID NO: 2751148 - RNA, 15 nt, Human
uccucugcuugccau

SEQ ID NO: 2751149 - RNA, 14 nt, Human
uccucugcuugcca

SEQ ID NO: 2751150 - RNA, 21 nt, Human
uccugaggcuccacuuggucu

SEQ ID NO: 2751151 - RNA, 13 nt, Human
uccucuguccagg

SEQ ID NO: 2751152 - RNA, 17 nt, Human
uccugaggcuccacuug

SEQ ID NO: 2751153 - RNA, 16 nt, Human
uccugaggcuccacuu

SEQ ID NO: 2751154 - RNA, 15 nt, Human
uccugaggcuccacu

SEQ ID NO: 2751155 - RNA, 23 nt, Human
uccuuagcuuagaccucagccug

SEQ ID NO: 2751156 - RNA, 17 nt, Human
uccuugcaucaauuuuu

SEQ ID NO: 2751157 - RNA, 20 nt, Human
uccuuuugacacugcucuaa

SEQ ID NO: 2751158 - RNA, 22 nt, Human
uccuuuugacacugcucuaaca

SEQ ID NO: 2751159 - RNA, 13 nt, Human
uccuuuugacacu

SEQ ID NO: 2751160 - RNA, 14 nt, Human
uccuuuugacacug

SEQ ID NO: 2751161 - RNA, 16 nt, Human
uccuuuugacacugcu

SEQ ID NO: 2751162 - RNA, 18 nt, Human
uccuuuugacacugcucu

SEQ ID NO: 2751163 - RNA, 14 nt, Human
ucggagcccugucu

SEQ ID NO: 2751164 - RNA, 15 nt, Human
ucggagcccugucuc

SEQ ID NO: 2751165 - RNA, 22 nt, Human
ucggagccucauccgaggcagg

SEQ ID NO: 2751166 - RNA, 23 nt, Human
ucggagccucauccgaggcaggg

SEQ ID NO: 2751167 - RNA, 16 nt, Human
ucggccuccauccuga

SEQ ID NO: 2751168 - RNA, 15 nt, Human
ucggccuccauccug

SEQ ID NO: 2751169 - RNA, 15 nt, Human
ucuacuaaaaauaca

SEQ ID NO: 2751170 - RNA, 19 nt, Human
ucuacuaaaaauacaaaaa

SEQ ID NO: 2751171 - RNA, 12 nt, Human
ucuacuaaaaau

SEQ ID NO: 2751172 - RNA, 13 nt, Human
uccagggcccuga

SEQ ID NO: 2751173 - RNA, 17 nt, Human
uccagggcccugagcuc

SEQ ID NO: 2751174 - RNA, 16 nt, Human
uccagggcccugagcu

SEQ ID NO: 2751175 - RNA, 20 nt, Human
uccagggcccugagcucggu

SEQ ID NO: 2751176 - RNA, 19 nt, Human
ucauggaauuggagcucgu

SEQ ID NO: 2751177 - RNA, 21 nt, Human
ucauggaauuggagcucgugg

SEQ ID NO: 2751178 - RNA, 20 nt, Human
ucagucucucuucucuccag

SEQ ID NO: 2751179 - RNA, 18 nt, Human
ucaguccaugaagaugua

SEQ ID NO: 2751180 - RNA, 22 nt, Human
ucagccuagccgaccucagccu

SEQ ID NO: 2751181 - RNA, 23 nt, Human
ucagccuagccgaccucagccuu

SEQ ID NO: 2751182 - RNA, 22 nt, Human
ucagcuccccucggagaagagc

SEQ ID NO: 2751183 - RNA, 21 nt, Human
ucagcuccccucggagaagag

SEQ ID NO: 2751184 - RNA, 20 nt, Human
ucaggagaggggcagaacag

SEQ ID NO: 2751185 - RNA, 18 nt, Human
ucaggagaggggcagaac

SEQ ID NO: 2751186 - RNA, 17 nt, Human
ucaggagaggggcagaa

SEQ ID NO: 2751187 - RNA, 15 nt, Human
ucaggagaggggcag

SEQ ID NO: 2751188 - RNA, 16 nt, Human
ucagcugcugaaacaa

SEQ ID NO: 2751189 - RNA, 16 nt, Human
ucuucuuggucucagu

SEQ ID NO: 2751190 - RNA, 19 nt, Human
ucuugccaaauauaaauaa

SEQ ID NO: 2751191 - RNA, 22 nt, Human
ucuuaggguuaugauuaaguaa

SEQ ID NO: 2751192 - RNA, 13 nt, Human
ucuuauaauuuaa

SEQ ID NO: 2751193 - RNA, 14 nt, Human
ucuuauaauuuaaa

SEQ ID NO: 2751194 - RNA, 17 nt, Human
ucuuuccacagaagcuc

SEQ ID NO: 2751195 - RNA, 21 nt, Human
ucugcacucccaccugacaca

SEQ ID NO: 2751196 - RNA, 18 nt, Human
ucugcacucccaccugac

SEQ ID NO: 2751197 - RNA, 14 nt, Human
ucugucucagucca

SEQ ID NO: 2751198 - RNA, 24 nt, Human
ugaggcagacagcagcucaggcac

SEQ ID NO: 2751199 - RNA, 23 nt, Human
ugaggcagacagcagcucaggca

SEQ ID NO: 2751200 - RNA, 20 nt, Human
ugaggcagacagcagcucag

SEQ ID NO: 2751201 - RNA, 17 nt, Human
ugaggcagacagcagcu

SEQ ID NO: 2751202 - RNA, 16 nt, Human
ugaggcagacagcagc

SEQ ID NO: 2751203 - RNA, 15 nt, Human
ugaggcagacagcag

SEQ ID NO: 2751204 - RNA, 14 nt, Human
ugaggcagacagca

SEQ ID NO: 2751205 - RNA, 13 nt, Human
ugaggcagacagc

SEQ ID NO: 2751206 - RNA, 12 nt, Human
ugaggcagacag

SEQ ID NO: 2751207 - RNA, 15 nt, Human
ugagcaggauuuuaa

SEQ ID NO: 2751208 - RNA, 20 nt, Human
ugagcaggauuuuaaucuuu

SEQ ID NO: 2751209 - RNA, 15 nt, Human
ugagaaagacuauuc

SEQ ID NO: 2751210 - RNA, 12 nt, Human
ugacuaaacuuu

SEQ ID NO: 2751211 - RNA, 18 nt, Human
ugacuaaacuuuuuuucu

SEQ ID NO: 2751212 - RNA, 19 nt, Human
ugacuaaacuuuuuuucug

SEQ ID NO: 2751213 - RNA, 21 nt, Human
ugacuaaacuuuuuuucugua

SEQ ID NO: 2751214 - RNA, 13 nt, Human
ugacucuuaagaa

SEQ ID NO: 2751215 - RNA, 16 nt, Human
ugacucuuaagaagac

SEQ ID NO: 2751216 - RNA, 15 nt, Human
ugacucuuaagaaga

SEQ ID NO: 2751217 - RNA, 14 nt, Human
ugacucuuaagaag

SEQ ID NO: 2751218 - RNA, 15 nt, Human
ugaaugaauggcuaa

SEQ ID NO: 2751219 - RNA, 18 nt, Human
ugaccacugcagaagaca

SEQ ID NO: 2751220 - RNA, 17 nt, Human
ugaccacugcagaagac

SEQ ID NO: 2751221 - RNA, 16 nt, Human
ugaccacugcagaaga

SEQ ID NO: 2751222 - RNA, 14 nt, Human
ugaauuaaguuuuu

SEQ ID NO: 2751223 - RNA, 13 nt, Human
ugaauuacauuug

SEQ ID NO: 2751224 - RNA, 20 nt, Human
uaccuaagauuacaaaucag

SEQ ID NO: 2751225 - RNA, 22 nt, Human
uaccuaagauuacaaaucagaa

SEQ ID NO: 2751226 - RNA, 17 nt, Human
uaccuaagauuacaaau

SEQ ID NO: 2751227 - RNA, 16 nt, Human
uaccuaucaucuuaag

SEQ ID NO: 2751228 - RNA, 15 nt, Human
uaccucacugggguc

SEQ ID NO: 2751229 - RNA, 15 nt, Human
uaccaaaaauaaaua

SEQ ID NO: 2751230 - RNA, 22 nt, Human
uaccaaaaaucucaauauuuca

SEQ ID NO: 2751231 - RNA, 22 nt, Human
uaccuaacgaaguauccuucag

SEQ ID NO: 2751232 - RNA, 23 nt, Human
uaccuuuguucccaaauuucaua

SEQ ID NO: 2751233 - RNA, 18 nt, Human
uaccuuauaguuacugug

SEQ ID NO: 2751234 - RNA, 16 nt, Human
uaccuuauaguuacug

SEQ ID NO: 2751235 - RNA, 17 nt, Human
uaccuuauaguuacugu

SEQ ID NO: 2751236 - RNA, 23 nt, Human
uacugucauccucaaagaaagug

SEQ ID NO: 2751237 - RNA, 23 nt, Human
uacugucagcuccccucggagaa

SEQ ID NO: 2751238 - RNA, 21 nt, Human
uacaguucugugguuucaugu

SEQ ID NO: 2751239 - RNA, 14 nt, Human
uacaguucuguggu

SEQ ID NO: 2751240 - RNA, 15 nt, Human
uacaguucugugguu

SEQ ID NO: 2751241 - RNA, 23 nt, Human
uacaguucggugagcuacaaaug

SEQ ID NO: 2751242 - RNA, 14 nt, Human
uacacuccagugag

SEQ ID NO: 2751243 - RNA, 17 nt, Human
uacacacucaaaucaag

SEQ ID NO: 2751244 - RNA, 16 nt, Human
uacacacucaaaucaa

SEQ ID NO: 2751245 - RNA, 22 nt, Human
uacaaaucagaagucaucuugc

SEQ ID NO: 2751246 - RNA, 20 nt, Human
uacaaaucagaagucaucuu

SEQ ID NO: 2751247 - RNA, 21 nt, Human
uacaaaucagaagucaucuug

SEQ ID NO: 2751248 - RNA, 16 nt, Human
uacaaaucagaaguca

SEQ ID NO: 2751249 - RNA, 17 nt, Human
uacaaaucagaagucau

SEQ ID NO: 2751250 - RNA, 19 nt, Human
uacaaaucagaagucaucu

SEQ ID NO: 2751251 - RNA, 12 nt, Human
uaauuuuuauau

SEQ ID NO: 2751252 - RNA, 18 nt, Human
uaauuuugugaagcaaaa

SEQ ID NO: 2751253 - RNA, 17 nt, Human
uaauuuuuauauuugaa

SEQ ID NO: 2751254 - RNA, 16 nt, Human
uaauuuuuauauuuga

SEQ ID NO: 2751255 - RNA, 13 nt, Human
uaauuuugugaag

SEQ ID NO: 2751256 - RNA, 14 nt, Human
uaauuagugccacu

SEQ ID NO: 2751257 - RNA, 19 nt, Human
uaauuagugccacuuaaug

SEQ ID NO: 2751258 - RNA, 21 nt, Human
uaauuagugccacuuaaugua

SEQ ID NO: 2751259 - RNA, 22 nt, Human
uaauuagugccacuuaauguau

SEQ ID NO: 2751260 - RNA, 23 nt, Human
uagacccucaugcugccaauauc

SEQ ID NO: 2751261 - RNA, 19 nt, Human
uagacccucaugcugccaa

SEQ ID NO: 2751262 - RNA, 17 nt, Human
uagacccucaugcugcc

SEQ ID NO: 2751263 - RNA, 18 nt, Human
uagacccucaugcugcca

SEQ ID NO: 2751264 - RNA, 23 nt, Human
uagaauaccacaggaaccacaag

SEQ ID NO: 2751265 - RNA, 19 nt, Human
uagaauaaaggcaguuuuc

SEQ ID NO: 2751266 - RNA, 21 nt, Human
uagaauaaaggcaguuuucua

SEQ ID NO: 2751267 - RNA, 22 nt, Human
uagaauaaaggcaguuuucuaa

SEQ ID NO: 2751268 - RNA, 18 nt, Human
uagaauuaacacaugauc

SEQ ID NO: 2751269 - RNA, 16 nt, Human
uagaauuaacacauga

SEQ ID NO: 2751270 - RNA, 15 nt, Human
uagaauuaacacaug

SEQ ID NO: 2751271 - RNA, 16 nt, Human
uagcaugaagacagag

SEQ ID NO: 2751272 - RNA, 17 nt, Human
uagccgaccucagccuu

SEQ ID NO: 2751273 - RNA, 16 nt, Human
uagccgaccucagccu

SEQ ID NO: 2751274 - RNA, 15 nt, Human
uagccgaccucagcc

SEQ ID NO: 2751275 - RNA, 14 nt, Human
uagauaggccaugg

SEQ ID NO: 2751276 - RNA, 20 nt, Human
uaggugcuacaaaaacacag

SEQ ID NO: 2751277 - RNA, 22 nt, Human
uaggugcuacaaaaacacagca

SEQ ID NO: 2751278 - RNA, 23 nt, Human
uaggugcuacaaaaacacagcaa

SEQ ID NO: 2751279 - RNA, 18 nt, Human
uaggugcuacaaaaacac

SEQ ID NO: 2751280 - RNA, 21 nt, Human
uaggcuguaacuacuuuauaa

SEQ ID NO: 2751281 - RNA, 19 nt, Human
uaggcuguaacuacuuuau

SEQ ID NO: 2751282 - RNA, 17 nt, Human
uaguauuguccaggucu

SEQ ID NO: 2751283 - RNA, 19 nt, Human
uauauaacaaugcuguauu

SEQ ID NO: 2751284 - RNA, 17 nt, Human
uauauaacaaugcugua

SEQ ID NO: 2751285 - RNA, 16 nt, Human
uaucaaacugaagcca

SEQ ID NO: 2751286 - RNA, 13 nt, Human
uaucaaacugaag

SEQ ID NO: 2751287 - RNA, 14 nt, Human
uaucaaaagaaaga

SEQ ID NO: 2751288 - RNA, 21 nt, Human
uauauuuuuuguuaaaugauu

SEQ ID NO: 2751289 - RNA, 20 nt, Human
uauauuugaaauauugacuu

SEQ ID NO: 2751290 - RNA, 16 nt, Human
uauaugcuucuguuuu

SEQ ID NO: 2751291 - RNA, 14 nt, Human
uauaugcuucuguu

SEQ ID NO: 2751292 - RNA, 17 nt, Human
uaaccaggggccaugaa

SEQ ID NO: 2751293 - RNA, 21 nt, Human
uaagaaaauaucacuugucaa

SEQ ID NO: 2751294 - RNA, 14 nt, Human
uaagagagaaugag

SEQ ID NO: 2751295 - RNA, 13 nt, Human
uaagagagaauga

SEQ ID NO: 2751296 - RNA, 16 nt, Human
uaacuuuugugaauua

SEQ ID NO: 2751297 - RNA, 22 nt, Human
uaacuuuugugaauuaggcugu

SEQ ID NO: 2751298 - RNA, 12 nt, Human
uaacuuuuguga

SEQ ID NO: 2751299 - RNA, 15 nt, Human
uaacuggaaacuuca

SEQ ID NO: 2751300 - RNA, 20 nt, Human
uaaauggcuuccuggcaaua

SEQ ID NO: 2751301 - RNA, 20 nt, Human
uaaauugacacuuaaaaaug

SEQ ID NO: 2751302 - RNA, 18 nt, Human
uaaauucccguuuuguca

SEQ ID NO: 2751303 - RNA, 19 nt, Human
uaaauucccguuuugucac

SEQ ID NO: 2751304 - RNA, 16 nt, Human
uaaaugugccuucauu

SEQ ID NO: 2751305 - RNA, 13 nt, Human
uaagugaaauaag

SEQ ID NO: 2751306 - RNA, 14 nt, Human
uaauaauguuucaa

SEQ ID NO: 2751307 - RNA, 22 nt, Human
uaauguuucaaacauauauaac

SEQ ID NO: 2751308 - RNA, 22 nt, Human
uaaugauaacuggaaacuucag

SEQ ID NO: 2751309 - RNA, 17 nt, Human
uaaugauaacuggaaac

SEQ ID NO: 2751310 - RNA, 23 nt, Human
uaaugauaacuggaaacuucagc

SEQ ID NO: 2751311 - RNA, 20 nt, Human
uaaacuuuuuuucuguacca

SEQ ID NO: 2751312 - RNA, 17 nt, Human
uaaaggcaguuuucuaa

SEQ ID NO: 2751313 - RNA, 14 nt, Human
uaaaggcaguuuuc

SEQ ID NO: 2751314 - RNA, 14 nt, Human
uaaaguguuugaaa

SEQ ID NO: 2751315 - RNA, 18 nt, Human
uaaaaaugguuuaaaugg

SEQ ID NO: 2751316 - RNA, 15 nt, Human
uaaaaaugguuuaaa

SEQ ID NO: 2751317 - RNA, 19 nt, Human
uaaaaaugguuuaaauggu

SEQ ID NO: 2751318 - RNA, 22 nt, Human
uaaaacaagcacuaaacaaaga

SEQ ID NO: 2751319 - RNA, 18 nt, Human
uaaaaucauuucugcauc

SEQ ID NO: 2751320 - RNA, 22 nt, Human
uaaaaucauuucugcaucagcu

SEQ ID NO: 2751321 - RNA, 17 nt, Human
uaaaauccauacauuug

SEQ ID NO: 2751322 - RNA, 15 nt, Human
uaaaauccauacauu

SEQ ID NO: 2751323 - RNA, 10 nt, Human
uaaaaucauu

SEQ ID NO: 2751324 - RNA, 13 nt, Human
uaaaaucauuucu

SEQ ID NO: 2751325 - RNA, 20 nt, Human
guuuauauaagcuuguauuc

SEQ ID NO: 2751326 - RNA, 21 nt, Human
guuuagcuggaaaaguauguu

SEQ ID NO: 2751327 - RNA, 20 nt, Human
guuuagcuggaaaaguaugu

SEQ ID NO: 2751328 - RNA, 21 nt, Human
guuucauguuaguuaccuuau

SEQ ID NO: 2751329 - RNA, 17 nt, Human
guuucauguuaguuacc

SEQ ID NO: 2751330 - RNA, 14 nt, Human
guggggcagugcuu

SEQ ID NO: 2751331 - RNA, 23 nt, Human
guggggcagugcuuggcccagga

SEQ ID NO: 2751332 - RNA, 23 nt, Human
gugggccuccucuguccagggcc

SEQ ID NO: 2751333 - RNA, 20 nt, Human
gugggccuccucuguccagg

SEQ ID NO: 2751334 - RNA, 15 nt, Human
gugggccuccucugu

SEQ ID NO: 2751335 - RNA, 17 nt, Human
guggcugcuagcacuug

SEQ ID NO: 2751336 - RNA, 19 nt, Human
guggcugcuagcacuugga

SEQ ID NO: 2751337 - RNA, 15 nt, Human
gugcuacaaaaacac

SEQ ID NO: 2751338 - RNA, 20 nt, Human
gugcuacaaaaacacagcaa

SEQ ID NO: 2751339 - RNA, 18 nt, Human
guguacagaauucugcua

SEQ ID NO: 2751340 - RNA, 21 nt, Human
guguaaguagauaggccaugg

SEQ ID NO: 2751341 - RNA, 16 nt, Human
gugugcguccugucgg

SEQ ID NO: 2751342 - RNA, 14 nt, Human
gugugcguccuguc

SEQ ID NO: 2751343 - RNA, 17 nt, Human
guguuauuuaaaugagu

SEQ ID NO: 2751344 - RNA, 20 nt, Human
guuaaaagaugaaaauauuu

SEQ ID NO: 2751345 - RNA, 14 nt, Human
guuaaaagaugaaa

SEQ ID NO: 2751346 - RNA, 16 nt, Human
guuaaaagaugaaaau

SEQ ID NO: 2751347 - RNA, 16 nt, Human
guucaugcagcugugg

SEQ ID NO: 2751348 - RNA, 15 nt, Human
guucaugcagcugug

SEQ ID NO: 2751349 - RNA, 16 nt, Human
guucaucaaugaauga

SEQ ID NO: 2751350 - RNA, 19 nt, Human
guucagagcugcccucucc

SEQ ID NO: 2751351 - RNA, 17 nt, Human
guucagagcugcccucu

SEQ ID NO: 2751352 - RNA, 16 nt, Human
guucagagcugcccuc

SEQ ID NO: 2751353 - RNA, 15 nt, Human
guucagagcugcccu

SEQ ID NO: 2751354 - RNA, 22 nt, Human
guucagagcugcccucuccugg

SEQ ID NO: 2751355 - RNA, 20 nt, Human
guucagagcugcccucuccu

SEQ ID NO: 2751356 - RNA, 23 nt, Human
guucagagcugcccucuccuggg

SEQ ID NO: 2751357 - RNA, 22 nt, Human
guucagagacucagggccccag

SEQ ID NO: 2751358 - RNA, 14 nt, Human
guucagagcugccc

SEQ ID NO: 2751359 - RNA, 13 nt, Human
guucagagcugcc

SEQ ID NO: 2751360 - RNA, 17 nt, Human
guucagagacucagggc

SEQ ID NO: 2751361 - RNA, 16 nt, Human
guucagagacucaggg

SEQ ID NO: 2751362 - RNA, 15 nt, Human
guuaccuuauaguua

SEQ ID NO: 2751363 - RNA, 18 nt, Human
guuaccuuauaguuacug

SEQ ID NO: 2751364 - RNA, 20 nt, Human
guuaccuuauaguuacugug

SEQ ID NO: 2751365 - RNA, 22 nt, Human
guuaccuuauaguuacugugua

SEQ ID NO: 2751366 - RNA, 13 nt, Human
guuacaguucugu

SEQ ID NO: 2751367 - RNA, 14 nt, Human
guuacaguucugug

SEQ ID NO: 2751368 - RNA, 15 nt, Human
guuacaguucugugg

SEQ ID NO: 2751369 - RNA, 23 nt, Human
guuaccucugccucagaaaacaa

SEQ ID NO: 2751370 - RNA, 19 nt, Human
guuggcauagcucuggggu

SEQ ID NO: 2751371 - RNA, 15 nt, Human
guuggcauagcucug

SEQ ID NO: 2751372 - RNA, 18 nt, Human
guuggcauagcucugggg

SEQ ID NO: 2751373 - RNA, 20 nt, Human
guugauggugguauguuuuc

SEQ ID NO: 2751374 - RNA, 21 nt, Human
guugauggugguauguuuuca

SEQ ID NO: 2751375 - RNA, 17 nt, Human
guugaaaagacuccaaa

SEQ ID NO: 2751376 - RNA, 22 nt, Human
guugaaaagacuccaaagaaau

SEQ ID NO: 2751377 - RNA, 23 nt, Human
guugaaaagacuccaaagaaaug

SEQ ID NO: 2751378 - RNA, 13 nt, Human
guucugaagaaga

SEQ ID NO: 2751379 - RNA, 12 nt, Human
guucugaagaag

SEQ ID NO: 2751380 - RNA, 15 nt, Human
guucugaagaagaug

SEQ ID NO: 2751381 - RNA, 14 nt, Human
guucugaagaagau

SEQ ID NO: 2751382 - RNA, 16 nt, Human
gugacaagcucacaga

SEQ ID NO: 2751383 - RNA, 13 nt, Human
gugaacacaucag

SEQ ID NO: 2751384 - RNA, 21 nt, Human
gugaacaaauuuacagagaca

SEQ ID NO: 2751385 - RNA, 20 nt, Human
gugccccccuugccagacau

SEQ ID NO: 2751386 - RNA, 13 nt, Human
gugccccccuugc

SEQ ID NO: 2751387 - RNA, 13 nt, Human
gugcguccugucg

SEQ ID NO: 2751388 - RNA, 19 nt, Human
gucucaccuggacuuaagc

SEQ ID NO: 2751389 - RNA, 13 nt, Human
gucugacuguuuc

SEQ ID NO: 2751390 - RNA, 14 nt, Human
gucucucuucucuc

SEQ ID NO: 2751391 - RNA, 15 nt, Human
gucucucuucucucc

SEQ ID NO: 2751392 - RNA, 19 nt, Human
gucucucuucucuccagcu

SEQ ID NO: 2751393 - RNA, 20 nt, Human
gucucucuucucuccagcug

SEQ ID NO: 2751394 - RNA, 23 nt, Human
gucucucuucucuccagcugacu

SEQ ID NO: 2751395 - RNA, 23 nt, Human
gucggguuuuauuguuuaaaauc

SEQ ID NO: 2751396 - RNA, 12 nt, Human
gucggagcccug

SEQ ID NO: 2751397 - RNA, 16 nt, Human
gucggagcccugucuc

SEQ ID NO: 2751398 - RNA, 18 nt, Human
gucgucaaagcugaaaug

SEQ ID NO: 2751399 - RNA, 23 nt, Human
gucugugagaugcuagaacuccc

SEQ ID NO: 2751400 - RNA, 22 nt, Human
gucugugagaugcuagaacucc

SEQ ID NO: 2751401 - RNA, 21 nt, Human
gucugugagaugcuagaacuc

SEQ ID NO: 2751402 - RNA, 17 nt, Human
gucugugagaugcuaga

SEQ ID NO: 2751403 - RNA, 16 nt, Human
gucugugagaugcuag

SEQ ID NO: 2751404 - RNA, 15 nt, Human
gucugugagaugcua

SEQ ID NO: 2751405 - RNA, 18 nt, Human
gucugccagccagcagcc

SEQ ID NO: 2751406 - RNA, 17 nt, Human
gucugccagccagcagc

SEQ ID NO: 2751407 - RNA, 16 nt, Human
gucugccagccagcag

SEQ ID NO: 2751408 - RNA, 17 nt, Human
guauguuagugcaaauu

SEQ ID NO: 2751409 - RNA, 15 nt, Human
guagcauuacagugg

SEQ ID NO: 2751410 - RNA, 18 nt, Human
gcuauaggugcuacaaaa

SEQ ID NO: 2751411 - RNA, 15 nt, Human
guaguauuuuuugua

SEQ ID NO: 2751412 - RNA, 19 nt, Human
guaguauuuuuuguauaau

SEQ ID NO: 2751413 - RNA, 20 nt, Human
guaguauuuuuuguauaauu

SEQ ID NO: 2751414 - RNA, 23 nt, Human
guaguauuuuuuguauaauugga

SEQ ID NO: 2751415 - RNA, 20 nt, Human
guauaauuggauuuccuaau

SEQ ID NO: 2751416 - RNA, 18 nt, Human
guauaauuggauuuccua

SEQ ID NO: 2751417 - RNA, 19 nt, Human
guauaauuggauuuccuaa

SEQ ID NO: 2751418 - RNA, 15 nt, Human
guaguguuggagaag

SEQ ID NO: 2751419 - RNA, 14 nt, Human
guaguguuggagaa

SEQ ID NO: 2751420 - RNA, 19 nt, Human
gucagcuccccucggagaa

SEQ ID NO: 2751421 - RNA, 20 nt, Human
guauuuuaaaagaaugauua

SEQ ID NO: 2751422 - RNA, 13 nt, Human
guauuuuaaucac

SEQ ID NO: 2751423 - RNA, 18 nt, Human
guauuuuaaaagaaugau

SEQ ID NO: 2751424 - RNA, 15 nt, Human
gucaaugcagccccc

SEQ ID NO: 2751425 - RNA, 16 nt, Human
gucaaggcuuagaccc

SEQ ID NO: 2751426 - RNA, 18 nt, Human
gucaaggcuuagacccuc

SEQ ID NO: 2751427 - RNA, 20 nt, Human
gucaaggcuuagacccucau

SEQ ID NO: 2751428 - RNA, 22 nt, Human
gucaauaaaauccauacauuug

SEQ ID NO: 2751429 - RNA, 23 nt, Human
gucaauaaaauccauacauuugu

SEQ ID NO: 2751430 - RNA, 21 nt, Human
gucccuacaccccuccccugc

SEQ ID NO: 2751431 - RNA, 16 nt, Human
gucccuacaccccucc

SEQ ID NO: 2751432 - RNA, 20 nt, Human
guccagggcccugagcucgg

SEQ ID NO: 2751433 - RNA, 17 nt, Human
guccagggcccugagcu

SEQ ID NO: 2751434 - RNA, 23 nt, Human
gucagcuccccucggagaagagc

SEQ ID NO: 2751435 - RNA, 21 nt, Human
gucagcuccccucggagaaga

SEQ ID NO: 2751436 - RNA, 22 nt, Human
gucagcuccccucggagaagag

SEQ ID NO: 2751437 - RNA, 24 nt, Human
uuuuguauaauuggauuuccuaau

SEQ ID NO: 2751438 - RNA, 14 nt, Human
uuuuguauaauugg

SEQ ID NO: 2751439 - RNA, 16 nt, Human
uuuuguauaauuggau

SEQ ID NO: 2751440 - RNA, 23 nt, Human
uuuuguauaauuggauuuccuaa

SEQ ID NO: 2751441 - RNA, 18 nt, Human
uuuugucacuuuuucuga

SEQ ID NO: 2751442 - RNA, 18 nt, Human
uuuuuaaaaaagaaacau

SEQ ID NO: 2751443 - RNA, 18 nt, Human
uuuuggucuggagggaag

SEQ ID NO: 2751444 - RNA, 14 nt, Human
uuuuccugaaaacc

SEQ ID NO: 2751445 - RNA, 17 nt, Human
uuuuuccuuguauuuaa

SEQ ID NO: 2751446 - RNA, 19 nt, Human
uuuuucucuaggaaauauu

SEQ ID NO: 2751447 - RNA, 13 nt, Human
uuuuucugauaaa

SEQ ID NO: 2751448 - RNA, 17 nt, Human
uuuuucugauaaaagau

SEQ ID NO: 2751449 - RNA, 17 nt, Human
uuucuuauuucauuucu

SEQ ID NO: 2751450 - RNA, 18 nt, Human
uuugaaucaucaagucuu

SEQ ID NO: 2751451 - RNA, 21 nt, Human
uuaccaaaaauaaauauaucu

SEQ ID NO: 2751452 - RNA, 18 nt, Human
uuuccucauuuuuauaau

SEQ ID NO: 2751453 - RNA, 22 nt, Human
uuuccucaaaacuucagacaua

SEQ ID NO: 2751454 - RNA, 13 nt, Human
uuucuagaaagag

SEQ ID NO: 2751455 - RNA, 13 nt, Human
uuucugagaaaga

SEQ ID NO: 2751456 - RNA, 13 nt, Human
uuugguuucuagc

SEQ ID NO: 2751457 - RNA, 16 nt, Human
uuuguauaaaauaauu

SEQ ID NO: 2751458 - RNA, 14 nt, Human
uuuguauaaaauaa

SEQ ID NO: 2751459 - RNA, 13 nt, Human
uuuguauaaaaua

SEQ ID NO: 2751460 - RNA, 15 nt, Human
uuuuaaaagaaugau

SEQ ID NO: 2751461 - RNA, 21 nt, Human
uuuuaaaagaaugauuaugaa

SEQ ID NO: 2751462 - RNA, 20 nt, Human
uuuuaaauucccguuuuguc

SEQ ID NO: 2751463 - RNA, 20 nt, Human
uuuuaauaauguuucaaaca

SEQ ID NO: 2751464 - RNA, 18 nt, Human
gcccagggcucagccugg

SEQ ID NO: 2751465 - RNA, 23 nt, Human
gccccagcacuaaagcaguggac

SEQ ID NO: 2751466 - RNA, 19 nt, Human
gccccagcacuaaagcagu

SEQ ID NO: 2751467 - RNA, 17 nt, Human
gccccagcacuaaagca

SEQ ID NO: 2751468 - RNA, 12 nt, Human
gccccagcacua

SEQ ID NO: 2751469 - RNA, 16 nt, Human
gcccugagcucggugg

SEQ ID NO: 2751470 - RNA, 15 nt, Human
gcccugagcucggug

SEQ ID NO: 2751471 - RNA, 13 nt, Human
gcccugagcucgg

SEQ ID NO: 2751472 - RNA, 22 nt, Human
gcccugagcucgguggacccag

SEQ ID NO: 2751473 - RNA, 23 nt, Human
gccaucccucccuccaccucccu

SEQ ID NO: 2751474 - RNA, 18 nt, Human
gccaucccucccuccacc

SEQ ID NO: 2751475 - RNA, 19 nt, Human
gccaugggcacugugggua

SEQ ID NO: 2751476 - RNA, 22 nt, Human
gccuccccuccucugcuugcca

SEQ ID NO: 2751477 - RNA, 20 nt, Human
gccuccccuccucugcuugc

SEQ ID NO: 2751478 - RNA, 23 nt, Human
gccuccccuccucugcuugccau

SEQ ID NO: 2751479 - RNA, 16 nt, Human
gccuccccuccucugc

SEQ ID NO: 2751480 - RNA, 19 nt, Human
gccuccccuccucugcuug

SEQ ID NO: 2751481 - RNA, 17 nt, Human
gccuccccuccucugcu

SEQ ID NO: 2751482 - RNA, 11 nt, Human
gccgaccucag

SEQ ID NO: 2751483 - RNA, 20 nt, Human
gccgggcgugguggugagug

SEQ ID NO: 2751484 - RNA, 21 nt, Human
gccuauuaucugucagcugca

SEQ ID NO: 2751485 - RNA, 22 nt, Human
gccgugugugugcguccugucg

SEQ ID NO: 2751486 - RNA, 23 nt, Human
gccguggugauuuagcaggaagc

SEQ ID NO: 2751487 - RNA, 13 nt, Human
gccuggugggccu

SEQ ID NO: 2751488 - RNA, 22 nt, Human
gccuuuuucauuuaucuauaau

SEQ ID NO: 2751489 - RNA, 14 nt, Human
gccuuuuucauuua

SEQ ID NO: 2751490 - RNA, 15 nt, Human
gccuuuuucauuuau

SEQ ID NO: 2751491 - RNA, 17 nt, Human
gccuuuuucauuuaucu

SEQ ID NO: 2751492 - RNA, 18 nt, Human
gccuuuuucauuuaucua

SEQ ID NO: 2751493 - RNA, 19 nt, Human
gccuuuuucauuuaucuau

SEQ ID NO: 2751494 - RNA, 13 nt, Human
gcuauaggugcua

SEQ ID NO: 2751495 - RNA, 19 nt, Human
gcuagaacucccuuucaac

SEQ ID NO: 2751496 - RNA, 14 nt, Human
gcuaccucacuggg

SEQ ID NO: 2751497 - RNA, 22 nt, Human
gcgcuaauucaaggaauuucuu

SEQ ID NO: 2751498 - RNA, 12 nt, Human
gcgacagugaga

SEQ ID NO: 2751499 - RNA, 19 nt, Human
gcagauucauuuuucuuuc

SEQ ID NO: 2751500 - RNA, 20 nt, Human
gcagauucauuuuucuuucu

SEQ ID NO: 2751501 - RNA, 18 nt, Human
gcagauaaacaguaguga

SEQ ID NO: 2751502 - RNA, 20 nt, Human
gcagccccgugggguuccuc

SEQ ID NO: 2751503 - RNA, 12 nt, Human
gcaucagcugcu

SEQ ID NO: 2751504 - RNA, 13 nt, Human
gcauuauauuuau

SEQ ID NO: 2751505 - RNA, 15 nt, Human
gcaguggacaccagg

SEQ ID NO: 2751506 - RNA, 18 nt, Human
gcagugcuuggcccagga

SEQ ID NO: 2751507 - RNA, 19 nt, Human
gcagugcuuggcccaggag

SEQ ID NO: 2751508 - RNA, 20 nt, Human
gcagugcuuggcccaggagu

SEQ ID NO: 2751509 - RNA, 17 nt, Human
gcauagguuuaauaauu

SEQ ID NO: 2751510 - RNA, 13 nt, Human
gcauagaaguaaa

SEQ ID NO: 2751511 - RNA, 17 nt, Human
gcaguucugaagaagau

SEQ ID NO: 2751512 - RNA, 14 nt, Human
gcaguucugaagaa

SEQ ID NO: 2751513 - RNA, 18 nt, Human
gcaguucagagcugcccu

SEQ ID NO: 2751514 - RNA, 17 nt, Human
gcaguucagagcugccc

SEQ ID NO: 2751515 - RNA, 15 nt, Human
gcaguucugaagaag

SEQ ID NO: 2751516 - RNA, 16 nt, Human
gcaguucagagcugcc

SEQ ID NO: 2751517 - RNA, 15 nt, Human
gauuuuccugaaaac

SEQ ID NO: 2751518 - RNA, 11 nt, Human
gauuuucagcc

SEQ ID NO: 2751519 - RNA, 15 nt, Human
gauuuucagcccuca

SEQ ID NO: 2751520 - RNA, 19 nt, Human
gauuuucagcccucagaau

SEQ ID NO: 2751521 - RNA, 23 nt, Human
gcaaagcacugacuucuaaguaa

SEQ ID NO: 2751522 - RNA, 15 nt, Human
gcaagguacucuggu

SEQ ID NO: 2751523 - RNA, 17 nt, Human
gcaagguacucugguga

SEQ ID NO: 2751524 - RNA, 10 nt, Human
gcaagccaga

SEQ ID NO: 2751525 - RNA, 14 nt, Human
gcaagggugauggg

SEQ ID NO: 2751526 - RNA, 22 nt, Human
gauaaauaguuuaugauuccac

SEQ ID NO: 2751527 - RNA, 23 nt, Human
gauagauaggucagugcaaauac

SEQ ID NO: 2751528 - RNA, 21 nt, Human
gauggcuaguaucaaaagaaa

SEQ ID NO: 2751529 - RNA, 14 nt, Human
gaugaaaauauuug

SEQ ID NO: 2751530 - RNA, 13 nt, Human
gauccuggaaauc

SEQ ID NO: 2751531 - RNA, 13 nt, Human
gagaaagacuauu

SEQ ID NO: 2751532 - RNA, 15 nt, Human
gagaaagacuauuca

SEQ ID NO: 2751533 - RNA, 17 nt, Human
gagaaagacuauucaaa

SEQ ID NO: 2751534 - RNA, 18 nt, Human
gagaaagacuauucaaac

SEQ ID NO: 2751535 - RNA, 21 nt, Human
gagaaacaguugguaacuuuu

SEQ ID NO: 2751536 - RNA, 22 nt, Human
gagaaacaguugguaacuuuug

SEQ ID NO: 2751537 - RNA, 17 nt, Human
gagaaacaguugguaac

SEQ ID NO: 2751538 - RNA, 18 nt, Human
gagaaacaguugguaacu

SEQ ID NO: 2751539 - RNA, 19 nt, Human
gagaaacaguugguaacuu

SEQ ID NO: 2751540 - RNA, 16 nt, Human
gagaagaacugaaauc

SEQ ID NO: 2751541 - RNA, 14 nt, Human
gagaagaacugaaa

SEQ ID NO: 2751542 - RNA, 13 nt, Human
gagaagaacugaa

SEQ ID NO: 2751543 - RNA, 15 nt, Human
gagaagagcuguuca

SEQ ID NO: 2751544 - RNA, 22 nt, Human
gagaagagcuguucacagccag

SEQ ID NO: 2751545 - RNA, 13 nt, Human
gagaagagcuguu

SEQ ID NO: 2751546 - RNA, 18 nt, Human
gagacacacugaagaagc

SEQ ID NO: 2751547 - RNA, 13 nt, Human
gagacagcucugc

SEQ ID NO: 2751548 - RNA, 18 nt, Human
gagacagcucugcauacu

SEQ ID NO: 2751549 - RNA, 15 nt, Human
gagacagcucugcau

SEQ ID NO: 2751550 - RNA, 17 nt, Human
gagauacagaauuuuau

SEQ ID NO: 2751551 - RNA, 19 nt, Human
gagagugaacaaauuuaca

SEQ ID NO: 2751552 - RNA, 15 nt, Human
gagagugaacaaauu

SEQ ID NO: 2751553 - RNA, 19 nt, Human
gagagacacacugaagaag

SEQ ID NO: 2751554 - RNA, 20 nt, Human
gagccucauccgaggcaggg

SEQ ID NO: 2751555 - RNA, 19 nt, Human
gagccucauccgaggcagg

SEQ ID NO: 2751556 - RNA, 18 nt, Human
gagccucauccgaggcag

SEQ ID NO: 2751557 - RNA, 17 nt, Human
gagccucauccgaggca

SEQ ID NO: 2751558 - RNA, 17 nt, Human
gagcugcccucuccugg

SEQ ID NO: 2751559 - RNA, 16 nt, Human
gagcucgugggacagu

SEQ ID NO: 2751560 - RNA, 15 nt, Human
gagcucgguggaccc

SEQ ID NO: 2751561 - RNA, 23 nt, Human
gagcugcccucuccugggcagcu

SEQ ID NO: 2751562 - RNA, 21 nt, Human
gagcugcccucuccugggcag

SEQ ID NO: 2751563 - RNA, 19 nt, Human
gagcugcccucuccugggc

SEQ ID NO: 2751564 - RNA, 18 nt, Human
gagcugcccucuccuggg

SEQ ID NO: 2751565 - RNA, 15 nt, Human
gacaggaccugacua

SEQ ID NO: 2751566 - RNA, 13 nt, Human
gacaggaccugac

SEQ ID NO: 2751567 - RNA, 22 nt, Human
gacaugggacauuugcucaugg

SEQ ID NO: 2751568 - RNA, 17 nt, Human
gacaugggacauuugcu

SEQ ID NO: 2751569 - RNA, 18 nt, Human
gacuccaaagaaauguaa

SEQ ID NO: 2751570 - RNA, 20 nt, Human
gacucagggccccagcacua

SEQ ID NO: 2751571 - RNA, 18 nt, Human
gacucagggccccagcac

SEQ ID NO: 2751572 - RNA, 17 nt, Human
gacucagggccccagca

SEQ ID NO: 2751573 - RNA, 15 nt, Human
gacucagggccccag

SEQ ID NO: 2751574 - RNA, 14 nt, Human
gacucagggcccca

SEQ ID NO: 2751575 - RNA, 22 nt, Human
gacccacaagaaaugaaagcag

SEQ ID NO: 2751576 - RNA, 20 nt, Human
gaccucagccuuccccuugc

SEQ ID NO: 2751577 - RNA, 14 nt, Human
gaccucagccuucc

SEQ ID NO: 2751578 - RNA, 13 nt, Human
gaccucagccuuc

SEQ ID NO: 2751579 - RNA, 19 nt, Human
gaccucagccugugcugcc

SEQ ID NO: 2751580 - RNA, 16 nt, Human
gaccucagccugugcu

SEQ ID NO: 2751581 - RNA, 14 nt, Human
gaccucagccugug

SEQ ID NO: 2751582 - RNA, 13 nt, Human
gaccucagccugu

SEQ ID NO: 2751583 - RNA, 12 nt, Human
gaccucagccug

SEQ ID NO: 2751584 - RNA, 11 nt, Human
gaccucagccu

SEQ ID NO: 2751585 - RNA, 10 nt, Human
gaccucagcc

SEQ ID NO: 2751586 - RNA, 23 nt, Human
gaccugauuucugagcauuuaau

SEQ ID NO: 2751587 - RNA, 12 nt, Human
cuuuuucauuua

SEQ ID NO: 2751588 - RNA, 23 nt, Human
cuuuuucauuuaucuauaauuua

SEQ ID NO: 2751589 - RNA, 13 nt, Human
cuuuuucauuuau

SEQ ID NO: 2751590 - RNA, 15 nt, Human
cuuuuucauuuaucu

SEQ ID NO: 2751591 - RNA, 13 nt, Human
cuucuuuccacag

SEQ ID NO: 2751592 - RNA, 19 nt, Human
cuucuuuccacagaagcuc

SEQ ID NO: 2751593 - RNA, 16 nt, Human
cuucuuucuagaaaga

SEQ ID NO: 2751594 - RNA, 14 nt, Human
cuugaacccgggag

SEQ ID NO: 2751595 - RNA, 20 nt, Human
cuugaacccgggaggcagag

SEQ ID NO: 2751596 - RNA, 19 nt, Human
cuugaacccgggaggcaga

SEQ ID NO: 2751597 - RNA, 16 nt, Human
cuugagugcucaguag

SEQ ID NO: 2751598 - RNA, 23 nt, Human
cuugcaucaauuuuucuuauuuc

SEQ ID NO: 2751599 - RNA, 21 nt, Human
cuugcaugguuuagaaagcuu

SEQ ID NO: 2751600 - RNA, 20 nt, Human
cuuguauuuaaauauuaaau

SEQ ID NO: 2751601 - RNA, 18 nt, Human
cuuguauuuaaauauuaa

SEQ ID NO: 2751602 - RNA, 12 nt, Human
cuuguauuuaaa

SEQ ID NO: 2751603 - RNA, 18 nt, Human
cuuguaaaggaauuuaaa

SEQ ID NO: 2751604 - RNA, 17 nt, Human
cuugccaaauauaaaua

SEQ ID NO: 2751605 - RNA, 23 nt, Human
gaaaguguauuuggaaauaaagu

SEQ ID NO: 2751606 - RNA, 11 nt, Human
gaaaguguauu

SEQ ID NO: 2751607 - RNA, 15 nt, Human
gaaaguguauuugga

SEQ ID NO: 2751608 - RNA, 21 nt, Human
gaaagcuugcccuggugccuc

SEQ ID NO: 2751609 - RNA, 13 nt, Human
gaaacugccagca

SEQ ID NO: 2751610 - RNA, 15 nt, Human
gaaacugccagcaac

SEQ ID NO: 2751611 - RNA, 16 nt, Human
gaaacugacacaugcu

SEQ ID NO: 2751612 - RNA, 14 nt, Human
gaaagcagaacagu

SEQ ID NO: 2751613 - RNA, 13 nt, Human
gaaagcagaacag

SEQ ID NO: 2751614 - RNA, 22 nt, Human
gaaagacuauucaaacagucuc

SEQ ID NO: 2751615 - RNA, 23 nt, Human
gaaagacuauucaaacagucuca

SEQ ID NO: 2751616 - RNA, 19 nt, Human
gaaagacuauucaaacagu

SEQ ID NO: 2751617 - RNA, 24 nt, Human
gaacaguuaccucugccucagaaa

SEQ ID NO: 2751618 - RNA, 22 nt, Human
gaaauguaagggaaacugccag

SEQ ID NO: 2751619 - RNA, 13 nt, Human
gaaauauuuauuu

SEQ ID NO: 2751620 - RNA, 16 nt, Human
gaaauauuuauuuuaa

SEQ ID NO: 2751621 - RNA, 15 nt, Human
gaaauauuuauuuua

SEQ ID NO: 2751622 - RNA, 14 nt, Human
gaaggaugcugucu

SEQ ID NO: 2751623 - RNA, 19 nt, Human
gaaggaggguuagggaggg

SEQ ID NO: 2751624 - RNA, 18 nt, Human
gaagucaaggcuuagacc

SEQ ID NO: 2751625 - RNA, 23 nt, Human
gaaguccaagcauuuagauguau

SEQ ID NO: 2751626 - RNA, 23 nt, Human
gaagagcuguucacagccagacu

SEQ ID NO: 2751627 - RNA, 13 nt, Human
gaagagcuguuca

SEQ ID NO: 2751628 - RNA, 15 nt, Human
gaagagcuguucaca

SEQ ID NO: 2751629 - RNA, 20 nt, Human
gaagagcuguucacagccag

SEQ ID NO: 2751630 - RNA, 22 nt, Human
gaacuuguaaaggaauuuaaaa

SEQ ID NO: 2751631 - RNA, 15 nt, Human
gaaccacaagacugc

SEQ ID NO: 2751632 - RNA, 14 nt, Human
gaaccacaagacug

SEQ ID NO: 2751633 - RNA, 15 nt, Human
gaacucccuuucaac

SEQ ID NO: 2751634 - RNA, 16 nt, Human
gaacucccuuucaaca

SEQ ID NO: 2751635 - RNA, 15 nt, Human
cuguaugauucccag

SEQ ID NO: 2751636 - RNA, 16 nt, Human
cuguauuuuaaaagaa

SEQ ID NO: 2751637 - RNA, 13 nt, Human
cuguauuuuaaaa

SEQ ID NO: 2751638 - RNA, 20 nt, Human
cugucuccucucucuguaau

SEQ ID NO: 2751639 - RNA, 17 nt, Human
cugucuccucucucugu

SEQ ID NO: 2751640 - RNA, 18 nt, Human
cugucucuacuaaaaaua

SEQ ID NO: 2751641 - RNA, 17 nt, Human
cuguaccaguuaauuuu

SEQ ID NO: 2751642 - RNA, 18 nt, Human
cuguaccaguuaauuuuu

SEQ ID NO: 2751643 - RNA, 12 nt, Human
cuguaccaguua

SEQ ID NO: 2751644 - RNA, 16 nt, Human
cuguaccaguuaauuu

SEQ ID NO: 2751645 - RNA, 22 nt, Human
cuguaauaaacucauuucuagc

SEQ ID NO: 2751646 - RNA, 15 nt, Human
cuggccuucggccuc

SEQ ID NO: 2751647 - RNA, 21 nt, Human
cuggccuucggccuccauccu

SEQ ID NO: 2751648 - RNA, 18 nt, Human
cuggccuucggccuccau

SEQ ID NO: 2751649 - RNA, 17 nt, Human
cuggccuucggccucca

SEQ ID NO: 2751650 - RNA, 16 nt, Human
cuggccuucggccucc

SEQ ID NO: 2751651 - RNA, 20 nt, Human
cuggccuuuuucauuuaucu

SEQ ID NO: 2751652 - RNA, 21 nt, Human
cuggccuuuuucauuuaucua

SEQ ID NO: 2751653 - RNA, 17 nt, Human
cuggccuuuuucauuua

SEQ ID NO: 2751654 - RNA, 19 nt, Human
cuggccuuuuucauuuauc

SEQ ID NO: 2751655 - RNA, 20 nt, Human
cugggaaagggauuuucagc

SEQ ID NO: 2751656 - RNA, 21 nt, Human
cugcccgucuucagccuagcc

SEQ ID NO: 2751657 - RNA, 18 nt, Human
cugcccgucuucagccua

SEQ ID NO: 2751658 - RNA, 17 nt, Human
cugcccgucuucagccu

SEQ ID NO: 2751659 - RNA, 16 nt, Human
cugcccgucuucagcc

SEQ ID NO: 2751660 - RNA, 15 nt, Human
cugcccgucuucagc

SEQ ID NO: 2751661 - RNA, 15 nt, Human
cugccagcaacgcag

SEQ ID NO: 2751662 - RNA, 18 nt, Human
cugcacucccaccugaca

SEQ ID NO: 2751663 - RNA, 19 nt, Human
cugcacucccaccugacac

SEQ ID NO: 2751664 - RNA, 16 nt, Human
cugcacucccaccuga

SEQ ID NO: 2751665 - RNA, 22 nt, Human
cugcacucccaccugacacacc

SEQ ID NO: 2751666 - RNA, 12 nt, Human
cugcacugucaa

SEQ ID NO: 2751667 - RNA, 15 nt, Human
cugcuugccaucccu

SEQ ID NO: 2751668 - RNA, 16 nt, Human
cugcuugccaucccuc

SEQ ID NO: 2751669 - RNA, 22 nt, Human
cugcuugccaucccucccucca

SEQ ID NO: 2751670 - RNA, 20 nt, Human
cugcuugccaucccucccuc

SEQ ID NO: 2751671 - RNA, 19 nt, Human
cugcuugccaucccucccu

SEQ ID NO: 2751672 - RNA, 18 nt, Human
cugcuugccaucccuccc

SEQ ID NO: 2751673 - RNA, 12 nt, Human
cugcucuaacag

SEQ ID NO: 2751674 - RNA, 17 nt, Human
cugcucuaacagcccuc

SEQ ID NO: 2751675 - RNA, 15 nt, Human
cugcccucuccuggg

SEQ ID NO: 2751676 - RNA, 14 nt, Human
cugcccucuccugg

SEQ ID NO: 2751677 - RNA, 13 nt, Human
cugcccucuccug

SEQ ID NO: 2751678 - RNA, 12 nt, Human
cugcccucuccu

SEQ ID NO: 2751679 - RNA, 23 nt, Human
cugaagaagcaccaaucaugaau

SEQ ID NO: 2751680 - RNA, 17 nt, Human
cugaacaucacagcuua

SEQ ID NO: 2751681 - RNA, 22 nt, Human
cucuucuuuaaagggauggcaa

SEQ ID NO: 2751682 - RNA, 20 nt, Human
cucugcuugccaucccuccc

SEQ ID NO: 2751683 - RNA, 17 nt, Human
cucugcuugccaucccu

SEQ ID NO: 2751684 - RNA, 14 nt, Human
cucugcuugccauc

SEQ ID NO: 2751685 - RNA, 12 nt, Human
cucugcuugcca

SEQ ID NO: 2751686 - RNA, 12 nt, Human
cucuggccuucg

SEQ ID NO: 2751687 - RNA, 19 nt, Human
cucuggccuucggccucca

SEQ ID NO: 2751688 - RNA, 17 nt, Human
cugacucuuaagaagac

SEQ ID NO: 2751689 - RNA, 16 nt, Human
cugacuucuaaguaaa

SEQ ID NO: 2751690 - RNA, 13 nt, Human
cugacuucuaagu

SEQ ID NO: 2751691 - RNA, 15 nt, Human
cugacuucuaaguaa

SEQ ID NO: 2751692 - RNA, 22 nt, Human
cugagaaagacuauucaaacag

SEQ ID NO: 2751693 - RNA, 23 nt, Human
cugagaaagacuauucaaacagu

SEQ ID NO: 2751694 - RNA, 17 nt, Human
cugaggcagacagcagc

SEQ ID NO: 2751695 - RNA, 16 nt, Human
cugaggcagacagcag

SEQ ID NO: 2751696 - RNA, 15 nt, Human
cugaggcagacagca

SEQ ID NO: 2751697 - RNA, 14 nt, Human
cugaggcagacagc

SEQ ID NO: 2751698 - RNA, 22 nt, Human
cugaggcagacagcagcucagg

SEQ ID NO: 2751699 - RNA, 18 nt, Human
cugaggcagacagcagcu

SEQ ID NO: 2751700 - RNA, 13 nt, Human
cugaggcagacag

SEQ ID NO: 2751701 - RNA, 22 nt, Human
cugagcucgguggacccaggga

SEQ ID NO: 2751702 - RNA, 20 nt, Human
cugagcgacagugagacucu

SEQ ID NO: 2751703 - RNA, 16 nt, Human
cugagcgacagugaga

SEQ ID NO: 2751704 - RNA, 20 nt, Human
cugagcucgguggacccagg

SEQ ID NO: 2751705 - RNA, 18 nt, Human
cugagcucgguggaccca

SEQ ID NO: 2751706 - RNA, 17 nt, Human
cugagcucgguggaccc

SEQ ID NO: 2751707 - RNA, 18 nt, Human
cuccauccugaggcucca

SEQ ID NO: 2751708 - RNA, 16 nt, Human
cuccauccugaggcuc

SEQ ID NO: 2751709 - RNA, 14 nt, Human
cuccauccugaggc

SEQ ID NO: 2751710 - RNA, 23 nt, Human
cuccugucugccagccagcagcc

SEQ ID NO: 2751711 - RNA, 22 nt, Human
cuccugucugccagccagcagc

SEQ ID NO: 2751712 - RNA, 19 nt, Human
cuccugucugccagccagc

SEQ ID NO: 2751713 - RNA, 17 nt, Human
cuccugucugccagcca

SEQ ID NO: 2751714 - RNA, 17 nt, Human
cucccuccaccucccug

SEQ ID NO: 2751715 - RNA, 15 nt, Human
cucccuccaccuccc

SEQ ID NO: 2751716 - RNA, 20 nt, Human
cucuaauucacagugcucuu

SEQ ID NO: 2751717 - RNA, 23 nt, Human
cucggagccucauccgaggcagg

SEQ ID NO: 2751718 - RNA, 22 nt, Human
cucggagccucauccgaggcag

SEQ ID NO: 2751719 - RNA, 16 nt, Human
cucggagccucauccg

SEQ ID NO: 2751720 - RNA, 13 nt, Human
cucggagccucau

SEQ ID NO: 2751721 - RNA, 17 nt, Human
cucuaggaaauauuuau

SEQ ID NO: 2751722 - RNA, 15 nt, Human
cucuaggaaauauuu

SEQ ID NO: 2751723 - RNA, 15 nt, Human
cucuccagcugacua

SEQ ID NO: 2751724 - RNA, 16 nt, Human
cucuccagcugacuaa

SEQ ID NO: 2751725 - RNA, 14 nt, Human
cucuccagcugacu

SEQ ID NO: 2751726 - RNA, 12 nt, Human
cucuccugggca

SEQ ID NO: 2751727 - RNA, 19 nt, Human
cucuccugggcagcugccu

SEQ ID NO: 2751728 - RNA, 18 nt, Human
cucuccugggcagcugcc

SEQ ID NO: 2751729 - RNA, 16 nt, Human
cucuccugggcagcug

SEQ ID NO: 2751730 - RNA, 15 nt, Human
cucuccugggcagcu

SEQ ID NO: 2751731 - RNA, 20 nt, Human
cucuccugggcagcugccuc

SEQ ID NO: 2751732 - RNA, 17 nt, Human
cggugagcuacaaaugc

SEQ ID NO: 2751733 - RNA, 22 nt, Human
cggucggguuuuauuguuuaaa

SEQ ID NO: 2751734 - RNA, 21 nt, Human
cggguuuuauuguuuaaaauc

SEQ ID NO: 2751735 - RNA, 12 nt, Human
cggccuccaucc

SEQ ID NO: 2751736 - RNA, 23 nt, Human
cgcuaauucaaggaauuucuuaa

SEQ ID NO: 2751737 - RNA, 15 nt, Human
cgcucucuggccuuc

SEQ ID NO: 2751738 - RNA, 14 nt, Human
cgcucucuggccuu

SEQ ID NO: 2751739 - RNA, 18 nt, Human
cgcucucuggccuucggc

SEQ ID NO: 2751740 - RNA, 14 nt, Human
cgucuucagccuag

SEQ ID NO: 2751741 - RNA, 13 nt, Human
cgucuucagccua

SEQ ID NO: 2751742 - RNA, 15 nt, Human
cgucuucagccuagc

SEQ ID NO: 2751743 - RNA, 18 nt, Human
cgugcacgcacacugucu

SEQ ID NO: 2751744 - RNA, 23 nt, Human
cuaaauugacacuuaaaaauggu

SEQ ID NO: 2751745 - RNA, 13 nt, Human
cuaccaguauuua

SEQ ID NO: 2751746 - RNA, 19 nt, Human
cuaccaguauuuagaagcc

SEQ ID NO: 2751747 - RNA, 20 nt, Human
cuaccaguauuuagaagcca

SEQ ID NO: 2751748 - RNA, 17 nt, Human
cuacacuccagugagac

SEQ ID NO: 2751749 - RNA, 16 nt, Human
cuacacuccagugaga

SEQ ID NO: 2751750 - RNA, 17 nt, Human
cuaacauguccugccua

SEQ ID NO: 2751751 - RNA, 14 nt, Human
cuaagcaaaaugug

SEQ ID NO: 2751752 - RNA, 18 nt, Human
cuaagcaaaaugugauau

SEQ ID NO: 2751753 - RNA, 15 nt, Human
cuaagcaaaauguga

SEQ ID NO: 2751754 - RNA, 23 nt, Human
cuagauguaguauuuuuuguaua

SEQ ID NO: 2751755 - RNA, 20 nt, Human
cuagauguaguauuuuuugu

SEQ ID NO: 2751756 - RNA, 22 nt, Human
cuagauguaguauuuuuuguau

SEQ ID NO: 2751757 - RNA, 16 nt, Human
cuagauguaguauuuu

SEQ ID NO: 2751758 - RNA, 18 nt, Human
cuacuugggaggcugaga

SEQ ID NO: 2751759 - RNA, 15 nt, Human
cuacuugggaggcug

SEQ ID NO: 2751760 - RNA, 19 nt, Human
cuacuugggaggcugagau

SEQ ID NO: 2751761 - RNA, 19 nt, Human
cuacuuuauaacuaacaug

SEQ ID NO: 2751762 - RNA, 14 nt, Human
cuacuuuauaacua

SEQ ID NO: 2751763 - RNA, 18 nt, Human
cuacuuuauaacuaacau

SEQ ID NO: 2751764 - RNA, 17 nt, Human
cucaccccuugccauaa

SEQ ID NO: 2751765 - RNA, 13 nt, Human
cucacauuuauau

SEQ ID NO: 2751766 - RNA, 21 nt, Human
cuaucaaacugaagccagaaa

SEQ ID NO: 2751767 - RNA, 20 nt, Human
cuaucaaacugaagccagaa

SEQ ID NO: 2751768 - RNA, 16 nt, Human
cuaucaaacugaagcc

SEQ ID NO: 2751769 - RNA, 22 nt, Human
cuauauuuuuuguuaaaugauu

SEQ ID NO: 2751770 - RNA, 13 nt, Human
cuaucaaacugaa

SEQ ID NO: 2751771 - RNA, 13 nt, Human
cuaugaaauauua

SEQ ID NO: 2751772 - RNA, 20 nt, Human
cuauauuuuuuguuaaauga

SEQ ID NO: 2751773 - RNA, 19 nt, Human
cuauauuguuugcuaagca

SEQ ID NO: 2751774 - RNA, 22 nt, Human
cuaggaaauauuuauuuuaaua

SEQ ID NO: 2751775 - RNA, 16 nt, Human
cuagcacuuggagcca

SEQ ID NO: 2751776 - RNA, 20 nt, Human
cuaguauuucuaugaaauau

SEQ ID NO: 2751777 - RNA, 19 nt, Human
cuaguauuucuaugaaaua

SEQ ID NO: 2751778 - RNA, 22 nt, Human
cuaguauuucuaugaaauauua

SEQ ID NO: 2751779 - RNA, 23 nt, Human
cuaguaucaaaagaaagaaaauc

SEQ ID NO: 2751780 - RNA, 17 nt, Human
cuaguaucaaaagaaag

SEQ ID NO: 2751781 - RNA, 15 nt, Human
cuaguaucaaaagaa

SEQ ID NO: 2751782 - RNA, 15 nt, Human
cccugcaauaaaaug

SEQ ID NO: 2751783 - RNA, 14 nt, Human
cccugcaauaaaau

SEQ ID NO: 2751784 - RNA, 14 nt, Human
ccccaggugccagu

SEQ ID NO: 2751785 - RNA, 13 nt, Human
cccguuuugucac

SEQ ID NO: 2751786 - RNA, 18 nt, Human
cccgucuucagccuagcc

SEQ ID NO: 2751787 - RNA, 12 nt, Human
cccgucuucagc

SEQ ID NO: 2751788 - RNA, 17 nt, Human
cccgucuucagccuagc

SEQ ID NO: 2751789 - RNA, 16 nt, Human
cccgucuucagccuag

SEQ ID NO: 2751790 - RNA, 15 nt, Human
cccgucuucagccua

SEQ ID NO: 2751791 - RNA, 14 nt, Human
cccgucuucagccu

SEQ ID NO: 2751792 - RNA, 13 nt, Human
cccgucuucagcc

SEQ ID NO: 2751793 - RNA, 17 nt, Human
cccucaugcugccaaua

SEQ ID NO: 2751794 - RNA, 14 nt, Human
cccucaugcugcca

SEQ ID NO: 2751795 - RNA, 12 nt, Human
cccucccuccac

SEQ ID NO: 2751796 - RNA, 13 nt, Human
cccucccuccacc

SEQ ID NO: 2751797 - RNA, 20 nt, Human
cccucccuccaccucccugc

SEQ ID NO: 2751798 - RNA, 13 nt, Human
ccuccauccugag

SEQ ID NO: 2751799 - RNA, 12 nt, Human
ccuccauccuga

SEQ ID NO: 2751800 - RNA, 14 nt, Human
ccuccccugcccua

SEQ ID NO: 2751801 - RNA, 13 nt, Human
ccuccccuccucu

SEQ ID NO: 2751802 - RNA, 12 nt, Human
ccuccccuccuc

SEQ ID NO: 2751803 - RNA, 17 nt, Human
ccuauuaucugucagcu

SEQ ID NO: 2751804 - RNA, 20 nt, Human
ccucagaugcacaugagcug

SEQ ID NO: 2751805 - RNA, 23 nt, Human
ccucacugggguccuggggccuc

SEQ ID NO: 2751806 - RNA, 20 nt, Human
ccucacugggguccuggggc

SEQ ID NO: 2751807 - RNA, 19 nt, Human
ccucacugggguccugggg

SEQ ID NO: 2751808 - RNA, 20 nt, Human
ccucacuguauccagguucc

SEQ ID NO: 2751809 - RNA, 17 nt, Human
cccuucuuuccacagaa

SEQ ID NO: 2751810 - RNA, 13 nt, Human
ccuaaacauauga

SEQ ID NO: 2751811 - RNA, 14 nt, Human
ccagcugacuaaac

SEQ ID NO: 2751812 - RNA, 17 nt, Human
ccagcugacuaaacuuu

SEQ ID NO: 2751813 - RNA, 23 nt, Human
ccagcugacuaaacuuuuuuucu

SEQ ID NO: 2751814 - RNA, 12 nt, Human
ccagcucucagc

SEQ ID NO: 2751815 - RNA, 15 nt, Human
ccagcucucagccaa

SEQ ID NO: 2751816 - RNA, 14 nt, Human
ccagcucucagcca

SEQ ID NO: 2751817 - RNA, 13 nt, Human
ccagcucucagcc

SEQ ID NO: 2751818 - RNA, 15 nt, Human
ccauccugaggcucc

SEQ ID NO: 2751819 - RNA, 16 nt, Human
ccauccugaggcucca

SEQ ID NO: 2751820 - RNA, 20 nt, Human
cccagaggagccaccaguuc

SEQ ID NO: 2751821 - RNA, 20 nt, Human
cccagacuagauguaguauu

SEQ ID NO: 2751822 - RNA, 23 nt, Human
cccagacuagauguaguauuuuu

SEQ ID NO: 2751823 - RNA, 23 nt, Human
ccauggcacucuauguucuaaga

SEQ ID NO: 2751824 - RNA, 16 nt, Human
cccaguguuuuaggag

SEQ ID NO: 2751825 - RNA, 17 nt, Human
cccaguguuuuaggagc

SEQ ID NO: 2751826 - RNA, 14 nt, Human
cauuugcucaugga

SEQ ID NO: 2751827 - RNA, 15 nt, Human
cauuugcucauggaa

SEQ ID NO: 2751828 - RNA, 16 nt, Human
cauuugcucauggaau

SEQ ID NO: 2751829 - RNA, 17 nt, Human
ccaaagaaauguaaggg

SEQ ID NO: 2751830 - RNA, 18 nt, Human
cauugacuaucaaacuga

SEQ ID NO: 2751831 - RNA, 22 nt, Human
cauugacuaucaaacugaagcc

SEQ ID NO: 2751832 - RNA, 19 nt, Human
cauugacuaucaaacugaa

SEQ ID NO: 2751833 - RNA, 23 nt, Human
cauuucugcaucagcugcugaaa

SEQ ID NO: 2751834 - RNA, 12 nt, Human
cauuuccaagca

SEQ ID NO: 2751835 - RNA, 19 nt, Human
cauuuaaagcuuauuaaaa

SEQ ID NO: 2751836 - RNA, 18 nt, Human
ccaaggcuagaaccaccu

SEQ ID NO: 2751837 - RNA, 19 nt, Human
ccaaggcugauuaaaccaa

SEQ ID NO: 2751838 - RNA, 20 nt, Human
ccaauauucauagcagcuua

SEQ ID NO: 2751839 - RNA, 22 nt, Human
ccacaagaaaugaaagcaggga

SEQ ID NO: 2751840 - RNA, 16 nt, Human
ccacaagaaaugaaag

SEQ ID NO: 2751841 - RNA, 14 nt, Human
ccaacacgagcagg

SEQ ID NO: 2751842 - RNA, 21 nt, Human
ccaacacgagcaggcuacugu

SEQ ID NO: 2751843 - RNA, 21 nt, Human
cauguggugggacagggaccc

SEQ ID NO: 2751844 - RNA, 12 nt, Human
caugugguggga

SEQ ID NO: 2751845 - RNA, 17 nt, Human
caugggacagggaggac

SEQ ID NO: 2751846 - RNA, 23 nt, Human
caugcugucuacacuaagagaga

SEQ ID NO: 2751847 - RNA, 20 nt, Human
cauauauaacaaugcuguau

SEQ ID NO: 2751848 - RNA, 22 nt, Human
caucaagucuuucacauuuaaa

SEQ ID NO: 2751849 - RNA, 18 nt, Human
caucaaugaaugaaugaa

SEQ ID NO: 2751850 - RNA, 13 nt, Human
caucccucccucc

SEQ ID NO: 2751851 - RNA, 12 nt, Human
caucccucccuc

SEQ ID NO: 2751852 - RNA, 14 nt, Human
caucccucccucca

SEQ ID NO: 2751853 - RNA, 20 nt, Human
caucuugcuaccaguauuua

SEQ ID NO: 2751854 - RNA, 22 nt, Human
caucuugcuaccaguauuuaga

SEQ ID NO: 2751855 - RNA, 14 nt, Human
caucuugcuaccag

SEQ ID NO: 2751856 - RNA, 16 nt, Human
caucuugcuaccagua

SEQ ID NO: 2751857 - RNA, 17 nt, Human
caucuugcuaccaguau

SEQ ID NO: 2751858 - RNA, 18 nt, Human
caucuugcuaccaguauu

SEQ ID NO: 2751859 - RNA, 23 nt, Human
caucuugcuaccaguauuuagaa

SEQ ID NO: 2751860 - RNA, 12 nt, Human
caucuugcuacc

SEQ ID NO: 2751861 - RNA, 22 nt, Human
cauccucaaagaaaguguauug

SEQ ID NO: 2751862 - RNA, 14 nt, Human
cauccucaaagaaa

SEQ ID NO: 2751863 - RNA, 20 nt, Human
cauccucaaagaaaguguau

SEQ ID NO: 2751864 - RNA, 14 nt, Human
caucuagugagcag

SEQ ID NO: 2751865 - RNA, 22 nt, Human
caucuagugagcagucaggaaa

SEQ ID NO: 2751866 - RNA, 14 nt, Human
caguuuucugagaa

SEQ ID NO: 2751867 - RNA, 15 nt, Human
caguuuucugagaaa

SEQ ID NO: 2751868 - RNA, 17 nt, Human
caguugguaacuuuugu

SEQ ID NO: 2751869 - RNA, 14 nt, Human
caguugguaacuuu

SEQ ID NO: 2751870 - RNA, 16 nt, Human
caguugguaacuuuug

SEQ ID NO: 2751871 - RNA, 19 nt, Human
caguuuucugagaaagacu

SEQ ID NO: 2751872 - RNA, 20 nt, Human
caguuuucugagaaagacua

SEQ ID NO: 2751873 - RNA, 21 nt, Human
caguugaaaagacuccaaaga

SEQ ID NO: 2751874 - RNA, 22 nt, Human
caguugaaaagacuccaaagaa

SEQ ID NO: 2751875 - RNA, 23 nt, Human
caguugaaaagacuccaaagaaa

SEQ ID NO: 2751876 - RNA, 14 nt, Human
caguugaaaagacu

SEQ ID NO: 2751877 - RNA, 18 nt, Human
caguugaaaagacuccaa

SEQ ID NO: 2751878 - RNA, 12 nt, Human
cauaaccugucu

SEQ ID NO: 2751879 - RNA, 23 nt, Human
cauaaccugucucaccuggacuu

SEQ ID NO: 2751880 - RNA, 17 nt, Human
cauaccaacacgagcag

SEQ ID NO: 2751881 - RNA, 20 nt, Human
caguucugugguuucauguu

SEQ ID NO: 2751882 - RNA, 22 nt, Human
caguucggugagcuacaaaugc

SEQ ID NO: 2751883 - RNA, 16 nt, Human
caguucugaagaagau

SEQ ID NO: 2751884 - RNA, 15 nt, Human
caguucugaagaaga

SEQ ID NO: 2751885 - RNA, 22 nt, Human
caguucugaagaagaugguacc

SEQ ID NO: 2751886 - RNA, 20 nt, Human
caguucucauggguggcacu

SEQ ID NO: 2751887 - RNA, 14 nt, Human
caguucugaagaag

SEQ ID NO: 2751888 - RNA, 13 nt, Human
caguucugaagaa

SEQ ID NO: 2751889 - RNA, 12 nt, Human
caguucugaaga

SEQ ID NO: 2751890 - RNA, 12 nt, Human
caguuaauuuuu

SEQ ID NO: 2751891 - RNA, 13 nt, Human
caguuaauuuuuc

SEQ ID NO: 2751892 - RNA, 14 nt, Human
caguuaauuuuucc

SEQ ID NO: 2751893 - RNA, 16 nt, Human
caguuaauuuuuccaa

SEQ ID NO: 2751894 - RNA, 19 nt, Human
caguuaauuuuuccaacua

SEQ ID NO: 2751895 - RNA, 21 nt, Human
caguuaccucugccucagaaa

SEQ ID NO: 2751896 - RNA, 16 nt, Human
caguguuuuaggagca

SEQ ID NO: 2751897 - RNA, 20 nt, Human
caguguuuuaggagcaugag

SEQ ID NO: 2751898 - RNA, 22 nt, Human
caguggacaccaggagucccug

SEQ ID NO: 2751899 - RNA, 13 nt, Human
caguggacaccag

SEQ ID NO: 2751900 - RNA, 17 nt, Human
cagugcuuggcccagga

SEQ ID NO: 2751901 - RNA, 18 nt, Human
cagugcuuggcccaggag

SEQ ID NO: 2751902 - RNA, 19 nt, Human
cagugcuuggcccaggagu

SEQ ID NO: 2751903 - RNA, 20 nt, Human
cagugcuuggcccaggaguu

SEQ ID NO: 2751904 - RNA, 13 nt, Human
cagugcuuggccc

SEQ ID NO: 2751905 - RNA, 14 nt, Human
cagugcuuggccca

SEQ ID NO: 2751906 - RNA, 15 nt, Human
cagugcuuggcccag

SEQ ID NO: 2751907 - RNA, 16 nt, Human
cagugcuuggcccagg

SEQ ID NO: 2751908 - RNA, 14 nt, Human
cagugucaaugcag

SEQ ID NO: 2751909 - RNA, 16 nt, Human
acagucacauuccaag

SEQ ID NO: 2751910 - RNA, 16 nt, Human
acuuuaugcuaaguga

SEQ ID NO: 2751911 - RNA, 13 nt, Human
gugcuacaaaaac

SEQ ID NO: 2751912 - RNA, 23 nt, Human
ucaugcugccaauauccuaauaa

SEQ ID NO: 2751913 - RNA, 18 nt, Human
cuggcaaagaugaucagu

SEQ ID NO: 2751914 - RNA, 10 nt, Human
aaaagaugaa

SEQ ID NO: 2751915 - RNA, 21 nt, Human
aaagguauuuuaaucaccaag

SEQ ID NO: 2751916 - RNA, 18 nt, Human
gcugcugaaacaacaaau

SEQ ID NO: 2751917 - RNA, 22 nt, Human
uuggauuuccuaauacugucau

SEQ ID NO: 2751918 - RNA, 15 nt, Human
aacagugauuaccag

SEQ ID NO: 2751919 - RNA, 22 nt, Human
aaaacugcacugucaagaugau

SEQ ID NO: 2751920 - RNA, 17 nt, Human
gacucauuuuaaaaaau

SEQ ID NO: 2751921 - RNA, 14 nt, Human
cuuggucucagugu

SEQ ID NO: 2751922 - RNA, 16 nt, Human
cuccaugaauaucagu

SEQ ID NO: 2751923 - RNA, 22 nt, Human
uauugguuuaaagaaaguguau

SEQ ID NO: 2751924 - RNA, 22 nt, Human
cugagguaaccucauuaucagu

SEQ ID NO: 2751925 - RNA, 20 nt, Human respiratory syncytial virus
gcagagcaacucaaagaaaa

SEQ ID NO: 2751926 - RNA, 17 nt, Human respiratory syncytial virus
uaccaagcaacaaacca

SEQ ID NO: 2751927 - RNA, 19 nt, Human respiratory syncytial virus
gcagauuguuggaaaucaa

SEQ ID NO: 2751928 - RNA, 17 nt, Human respiratory syncytial virus
uaauagguauguuauau

SEQ ID NO: 2751929 - RNA, 16 nt, Human respiratory syncytial virus
acaucaugaacaucua

SEQ ID NO: 2751930 - RNA, 20 nt, Human respiratory syncytial virus
aagaauuggaagccauaaag

SEQ ID NO: 2751931 - RNA, 14 nt, Human respiratory syncytial virus
cauguccaaacaca

SEQ ID NO: 2751932 - RNA, 17 nt, Human respiratory syncytial virus
accauguccaaacacaa

SEQ ID NO: 2751933 - RNA, 22 nt, Human respiratory syncytial virus
uaccaaauacaagaaauacacu

SEQ ID NO: 2751934 - RNA, 19 nt, Human respiratory syncytial virus
cugcugucauccagcaaau

SEQ ID NO: 2751935 - RNA, 13 nt, Human respiratory syncytial virus
guacgccaagaaa

SEQ ID NO: 2751936 - RNA, 13 nt, Human respiratory syncytial virus
auuaacucaagaa

SEQ ID NO: 2751937 - RNA, 14 nt, Human respiratory syncytial virus
cauguuaacaaaca

SEQ ID NO: 2751938 - RNA, 14 nt, Human respiratory syncytial virus
accaccaaaaccac

SEQ ID NO: 2751939 - RNA, 15 nt, Human respiratory syncytial virus
aggauauagcuaaca

SEQ ID NO: 2751940 - RNA, 17 nt, Human respiratory syncytial virus
ccaaccaccaaaaccac

SEQ ID NO: 2751941 - RNA, 20 nt, Human respiratory syncytial virus
auggcucuuagcaaagucaa

SEQ ID NO: 2751942 - RNA, 18 nt, Human respiratory syncytial virus
gugaucaacucacucagc

SEQ ID NO: 2751943 - RNA, 19 nt, Human respiratory syncytial virus
aaaacacacuccuauaaua

SEQ ID NO: 2751944 - RNA, 17 nt, Human respiratory syncytial virus
aagcuacugcacaaagu

SEQ ID NO: 2751945 - RNA, 18 nt, Human respiratory syncytial virus
caaauuagcagcaggaga

SEQ ID NO: 2751946 - RNA, 19 nt, Human respiratory syncytial virus
aauagguaaauaaaaccaa

SEQ ID NO: 2751947 - RNA, 11 nt, Human respiratory syncytial virus
aguaauuacuu

SEQ ID NO: 2751948 - RNA, 20 nt, Human respiratory syncytial virus
gcuaagugaacauaaaacau

SEQ ID NO: 2751949 - RNA, 18 nt, Human respiratory syncytial virus
aucaggucuuacagcagu

SEQ ID NO: 2751950 - RNA, 22 nt, Human respiratory syncytial virus
gucaaugaaaaaaucaaucaaa

SEQ ID NO: 2751951 - RNA, 15 nt, Human respiratory syncytial virus
ccaaaaccacaaaca

SEQ ID NO: 2751952 - RNA, 16 nt, Human respiratory syncytial virus
aaccaacccaaccaaa

SEQ ID NO: 2751953 - RNA, 11 nt, Human respiratory syncytial virus
auaaaaguaaa

SEQ ID NO: 2751954 - RNA, 15 nt, Human respiratory syncytial virus
ggcaaauaagucaac

SEQ ID NO: 2751955 - RNA, 14 nt, Human respiratory syncytial virus
accuagaaaaagag

SEQ ID NO: 2751956 - RNA, 13 nt, Human respiratory syncytial virus
cagaaauggagca

SEQ ID NO: 2751957 - RNA, 13 nt, Human respiratory syncytial virus
aauauacaaauau

SEQ ID NO: 2751958 - RNA, 17 nt, Human respiratory syncytial virus
aauuagcagcaggagac

SEQ ID NO: 2751959 - RNA, 15 nt, Human respiratory syncytial virus
augcuauguccaggu

SEQ ID NO: 2751960 - RNA, 21 nt, Human respiratory syncytial virus
acaagccgagcacaaaaccac

SEQ ID NO: 2751961 - RNA, 15 nt, Human respiratory syncytial virus
caaaaccacaaacaa

SEQ ID NO: 2751962 - RNA, 23 nt, Human respiratory syncytial virus
caaauacacuauucaacguagua

SEQ ID NO: 2751963 - RNA, 12 nt, Human respiratory syncytial virus
aaagaagaucuc

SEQ ID NO: 2751964 - RNA, 22 nt, Human respiratory syncytial virus
ucaacucaacccuaaagaagau

SEQ ID NO: 2751965 - RNA, 13 nt, Human respiratory syncytial virus
cuaccuagaaaaa

SEQ ID NO: 2751966 - RNA, 22 nt, Human respiratory syncytial virus
caaagaaaucaucacacacaaa

SEQ ID NO: 2751967 - RNA, 19 nt, Human respiratory syncytial virus
caacguaguacaggagaua

SEQ ID NO: 2751968 - RNA, 12 nt, Human respiratory syncytial virus
acaaacaaaugu

SEQ ID NO: 2751969 - RNA, 13 nt, Human respiratory syncytial virus
gaaucaacucaac

SEQ ID NO: 2751970 - RNA, 15 nt, Human respiratory syncytial virus
caacuccacacaaac

SEQ ID NO: 2751971 - RNA, 15 nt, Human respiratory syncytial virus
gcaaagauuaaugau

SEQ ID NO: 2751972 - RNA, 14 nt, Human respiratory syncytial virus
uggcaccaacauca

SEQ ID NO: 2751973 - RNA, 17 nt, Human respiratory syncytial virus
agcaacucaaagaaaau

SEQ ID NO: 2751974 - RNA, 15 nt, Human respiratory syncytial virus
uacauauacuauaaa

SEQ ID NO: 2751975 - RNA, 16 nt, Human respiratory syncytial virus
acagaaguugggagga

SEQ ID NO: 2751976 - RNA, 13 nt, Human respiratory syncytial virus
guuaauauaaaaa

SEQ ID NO: 2751977 - RNA, 17 nt, Human respiratory syncytial virus
ggcaugauucuccagac

SEQ ID NO: 2751978 - RNA, 15 nt, Human respiratory syncytial virus
agcaaagucaaguua

SEQ ID NO: 2751979 - RNA, 21 nt, Human respiratory syncytial virus
uacacugaauauaauacaaaa

SEQ ID NO: 2751980 - RNA, 21 nt, Human respiratory syncytial virus
aaaaaacaacaagcaaacaau

SEQ ID NO: 2751981 - RNA, 16 nt, Human respiratory syncytial virus
accacacaacagcaca

SEQ ID NO: 2751982 - RNA, 12 nt, Human respiratory syncytial virus
uaauuuagcuua

SEQ ID NO: 2751983 - RNA, 15 nt, Human respiratory syncytial virus
gaaguggcuccagaa

SEQ ID NO: 2751984 - RNA, 20 nt, Human respiratory syncytial virus
cacaacagcacaaaccaaag

SEQ ID NO: 2751985 - RNA, 21 nt, Human respiratory syncytial virus
agacaacgauagugacaauga

SEQ ID NO: 2751986 - RNA, 21 nt, Human respiratory syncytial virus
uagguaaauaaaaccaaaaua

SEQ ID NO: 2751987 - RNA, 21 nt, Human respiratory syncytial virus
auacuugauaaacaaugaaug

SEQ ID NO: 2751988 - RNA, 12 nt, Human respiratory syncytial virus
cacgccaacuau

SEQ ID NO: 2751989 - RNA, 23 nt, Human respiratory syncytial virus
caacucaacccuaaagaagauga

SEQ ID NO: 2751990 - RNA, 13 nt, Human respiratory syncytial virus
aaacuacacacua

SEQ ID NO: 2751991 - RNA, 19 nt, Human respiratory syncytial virus
cauggugucgcaaaaccac

SEQ ID NO: 2751992 - RNA, 22 nt, Human respiratory syncytial virus
acagaaguugggaggagaagcu

SEQ ID NO: 2751993 - RNA, 18 nt, Human respiratory syncytial virus
aauaagucaacauggaga

SEQ ID NO: 2751994 - RNA, 19 nt, Human respiratory syncytial virus
aaaauccaccaaaaaaacc

SEQ ID NO: 2751995 - RNA, 18 nt, Human respiratory syncytial virus
aaauacggggcaaauaag

SEQ ID NO: 2751996 - RNA, 16 nt, Human respiratory syncytial virus
ugauacaugugcauuu

SEQ ID NO: 2751997 - RNA, 17 nt, Human respiratory syncytial virus
caaacaucaugaacauc

SEQ ID NO: 2751998 - RNA, 11 nt, Human respiratory syncytial virus
aagaaaugaua

SEQ ID NO: 2751999 - RNA, 20 nt, Human respiratory syncytial virus
aacacacaauccaacagcaa

SEQ ID NO: 2752000 - RNA, 20 nt, Human respiratory syncytial virus
caguaccccagaaaccaaag

SEQ ID NO: 2752001 - RNA, 15 nt, Human respiratory syncytial virus
aaacaauaaaaaacc

SEQ ID NO: 2752002 - RNA, 17 nt, Human respiratory syncytial virus
acaucucucaccaaaga

SEQ ID NO: 2752003 - RNA, 22 nt, Human respiratory syncytial virus
caguucaaacaauaaaaaacca

SEQ ID NO: 2752004 - RNA, 14 nt, Human respiratory syncytial virus
aaguguuugaaaaa

SEQ ID NO: 2752005 - RNA, 16 nt, Human respiratory syncytial virus
ucaacauggagaaguu

SEQ ID NO: 2752006 - RNA, 13 nt, Human respiratory syncytial virus
agaugcaaaucau

SEQ ID NO: 2752007 - RNA, 20 nt, Human respiratory syncytial virus
aacacacccaacuccacaca

SEQ ID NO: 2752008 - RNA, 13 nt, Human respiratory syncytial virus
uccuaagaagaaa

SEQ ID NO: 2752009 - RNA, 22 nt, Human respiratory syncytial virus
gaugaagcuacugcacaaagua

SEQ ID NO: 2752010 - RNA, 13 nt, Human respiratory syncytial virus
uuucauggagaag

SEQ ID NO: 2752011 - RNA, 20 nt, Human respiratory syncytial virus
auauaaaaacucaucaaagg

SEQ ID NO: 2752012 - RNA, 20 nt, Human respiratory syncytial virus
aauacacugaauauaauaca

SEQ ID NO: 2752013 - RNA, 13 nt, Human respiratory syncytial virus
ugauucuccagac

SEQ ID NO: 2752014 - RNA, 13 nt, Human respiratory syncytial virus
aauucaaaaaugc

SEQ ID NO: 2752015 - RNA, 15 nt, Human respiratory syncytial virus
agugucaaaaacaag

SEQ ID NO: 2752016 - RNA, 16 nt, Human respiratory syncytial virus
aucuuaaaaaacuaac

SEQ ID NO: 2752017 - RNA, 20 nt, Human respiratory syncytial virus
gagacccaaaaacaccagcc

SEQ ID NO: 2752018 - RNA, 22 nt, Human respiratory syncytial virus
aagaaugcagugacagaauuac

SEQ ID NO: 2752019 - RNA, 20 nt, Human respiratory syncytial virus
caguuacugacaauaaagga

SEQ ID NO: 2752020 - RNA, 14 nt, Human respiratory syncytial virus
gcaaaaacaccuaa

SEQ ID NO: 2752021 - RNA, 15 nt, Human respiratory syncytial virus
ccaacccaacaaaaa

SEQ ID NO: 2752022 - RNA, 14 nt, Human respiratory syncytial virus
caaccuacaaccac

SEQ ID NO: 2752023 - RNA, 19 nt, Human respiratory syncytial virus
auaaauuggggcaaauaca

SEQ ID NO: 2752024 - RNA, 20 nt, Human respiratory syncytial virus
cagcaaucaacaacaucaau

SEQ ID NO: 2752025 - RNA, 16 nt, Human respiratory syncytial virus
gugucgcaaaaccacg

SEQ ID NO: 2752026 - RNA, 13 nt, Human respiratory syncytial virus
caaauacaaagau

SEQ ID NO: 2752027 - RNA, 22 nt, Human respiratory syncytial virus
aagaaaugauagaaaaaauaag

SEQ ID NO: 2752028 - RNA, 9 nt, Human respiratory syncytial virus
ccacaaaca

SEQ ID NO: 2752029 - RNA, 20 nt, Human respiratory syncytial virus
auaaaacauucuguaacaau

SEQ ID NO: 2752030 - RNA, 15 nt, Human respiratory syncytial virus
augacugcaaaauua

SEQ ID NO: 2752031 - RNA, 15 nt, Human respiratory syncytial virus
acaauagaauucaca

SEQ ID NO: 2752032 - RNA, 18 nt, Human respiratory syncytial virus
uaugcaaagauuaaugau

SEQ ID NO: 2752033 - RNA, 21 nt, Human respiratory syncytial virus
uguuaacuacagucaaagauc

SEQ ID NO: 2752034 - RNA, 16 nt, Human respiratory syncytial virus
caccaauccacacaaa

SEQ ID NO: 2752035 - RNA, 22 nt, Human respiratory syncytial virus
aacaaugauacaugugcauuua

SEQ ID NO: 2752036 - RNA, 17 nt, Human respiratory syncytial virus
cacaacagcacaaacca

SEQ ID NO: 2752037 - RNA, 15 nt, Human respiratory syncytial virus
acuacuaugcaaaga

SEQ ID NO: 2752038 - RNA, 19 nt, Human respiratory syncytial virus
aagaugcuggauaucaugu

SEQ ID NO: 2752039 - RNA, 22 nt, Human respiratory syncytial virus
ucaugcuaguguccaggcagaa

SEQ ID NO: 2752040 - RNA, 22 nt, Human respiratory syncytial virus
uaagaaaacuugaugaaagaca

SEQ ID NO: 2752041 - RNA, 17 nt, Human respiratory syncytial virus
gacccaaaaacaccagc

SEQ ID NO: 2752042 - RNA, 16 nt, Human respiratory syncytial virus
ccaacaaaaaaaccaa

SEQ ID NO: 2752043 - RNA, 14 nt, Human respiratory syncytial virus
acucaaaauccaaa

SEQ ID NO: 2752044 - RNA, 18 nt, Human respiratory syncytial virus
uagggaguaccaaauaca

SEQ ID NO: 2752045 - RNA, 20 nt, Human respiratory syncytial virus
aaagaacuugcaagcaucaa

SEQ ID NO: 2752046 - RNA, 15 nt, Human respiratory syncytial virus
cuauuuuacacuaau

SEQ ID NO: 2752047 - RNA, 11 nt, Human respiratory syncytial virus
cagcacaaacc

SEQ ID NO: 2752048 - RNA, 14 nt, Human respiratory syncytial virus
uugcucauaaaaga

SEQ ID NO: 2752049 - RNA, 13 nt, Human respiratory syncytial virus
ugagcacuacaaa

SEQ ID NO: 2752050 - RNA, 13 nt, Human respiratory syncytial virus
accucucucauaa

SEQ ID NO: 2752051 - RNA, 15 nt, Human respiratory syncytial virus
aaauacauccaucac

SEQ ID NO: 2752052 - RNA, 17 nt, Human respiratory syncytial virus
augaugcagccaaagca

SEQ ID NO: 2752053 - RNA, 22 nt, Human respiratory syncytial virus
aacuacacacuauauccaaaca

SEQ ID NO: 2752054 - RNA, 14 nt, Human respiratory syncytial virus
caacauaacaaaac

SEQ ID NO: 2752055 - RNA, 12 nt, Human respiratory syncytial virus
aucauuaacaag

SEQ ID NO: 2752056 - RNA, 13 nt, Human respiratory syncytial virus
auuaugacaucaa

SEQ ID NO: 2752057 - RNA, 17 nt, Human respiratory syncytial virus
uaaauuggggcaaauac

SEQ ID NO: 2752058 - RNA, 18 nt, Human respiratory syncytial virus
aaaucaauaugguuguau

SEQ ID NO: 2752059 - RNA, 15 nt, Human respiratory syncytial virus
ucauccaaagauccu

SEQ ID NO: 2752060 - RNA, 15 nt, Human respiratory syncytial virus
acaauaaaaaaccac

SEQ ID NO: 2752061 - RNA, 15 nt, Human respiratory syncytial virus
caaaucuguaaaaaa

SEQ ID NO: 2752062 - RNA, 13 nt, Human respiratory syncytial virus
uuacaacacaacg

SEQ ID NO: 2752063 - RNA, 23 nt, Human respiratory syncytial virus
acuauaaaucuuaaaaugggaaa

SEQ ID NO: 2752064 - RNA, 21 nt, Human respiratory syncytial virus
acagcagaagaauuggaagcc

SEQ ID NO: 2752065 - RNA, 19 nt, Human respiratory syncytial virus
gcaaacaaugucuuaaaaa

SEQ ID NO: 2752066 - RNA, 17 nt, Human respiratory syncytial virus
acccaaaaacaccagcc

SEQ ID NO: 2752067 - RNA, 15 nt, Human respiratory syncytial virus
uagggaguaccaaau

SEQ ID NO: 2752068 - RNA, 13 nt, Human respiratory syncytial virus
aaugaagaagaau

SEQ ID NO: 2752069 - RNA, 18 nt, Human respiratory syncytial virus
aaugucuuaaaaaaugaa

SEQ ID NO: 2752070 - RNA, 16 nt, Human respiratory syncytial virus
acuauaaagauacuua

SEQ ID NO: 2752071 - RNA, 16 nt, Human respiratory syncytial virus
acuguguauagcagca

SEQ ID NO: 2752072 - RNA, 16 nt, Human respiratory syncytial virus
ccaccaaaaccacaaa

SEQ ID NO: 2752073 - RNA, 22 nt, Human respiratory syncytial virus
aucaacauacuagugaagcaga

SEQ ID NO: 2752074 - RNA, 16 nt, Human respiratory syncytial virus
aaucucaacaaccauu

SEQ ID NO: 2752075 - RNA, 17 nt, Human respiratory syncytial virus
cugaauauaauacaaaa

SEQ ID NO: 2752076 - RNA, 22 nt, Human respiratory syncytial virus
gaaaauccuacaaaaaaaugcu

SEQ ID NO: 2752077 - RNA, 21 nt, Human respiratory syncytial virus
agugucauaacaauagaauua

SEQ ID NO: 2752078 - RNA, 13 nt, Human respiratory syncytial virus
caucacacaaacc

SEQ ID NO: 2752079 - RNA, 14 nt, Human respiratory syncytial virus
gaccgaacaaacaa

SEQ ID NO: 2752080 - RNA, 21 nt, Human respiratory syncytial virus
gaugcagccaaagcauaugca

SEQ ID NO: 2752081 - RNA, 13 nt, Human respiratory syncytial virus
auauacaaaauua

SEQ ID NO: 2752082 - RNA, 13 nt, Human respiratory syncytial virus
uaaccaauuauua

SEQ ID NO: 2752083 - RNA, 14 nt, Human respiratory syncytial virus
gucauuaacucaau

SEQ ID NO: 2752084 - RNA, 19 nt, Human respiratory syncytial virus
acagaaguugggaggagaa

SEQ ID NO: 2752085 - RNA, 15 nt, Human respiratory syncytial virus
cugaacucacuagaa

SEQ ID NO: 2752086 - RNA, 18 nt, Human respiratory syncytial virus
ucagggcaaguaaugcua

SEQ ID NO: 2752087 - RNA, 14 nt, Human respiratory syncytial virus
ucaaaucaacacau

SEQ ID NO: 2752088 - RNA, 13 nt, Human respiratory syncytial virus
auucacaagcaaa

SEQ ID NO: 2752089 - RNA, 17 nt, Human respiratory syncytial virus
caccaauccacacaaau

SEQ ID NO: 2752090 - RNA, 23 nt, Human respiratory syncytial virus
caggauuguuuaugaaugccuau

SEQ ID NO: 2752091 - RNA, 18 nt, Human respiratory syncytial virus
cuugugaaaucaaagcau

SEQ ID NO: 2752092 - RNA, 16 nt, Human respiratory syncytial virus
auaguaaggcaacaaa

SEQ ID NO: 2752093 - RNA, 17 nt, Human respiratory syncytial virus
aagugugguccuaggca

SEQ ID NO: 2752094 - RNA, 14 nt, Human respiratory syncytial virus
agcaggucuaggca

SEQ ID NO: 2752095 - RNA, 16 nt, Human respiratory syncytial virus
acaagaaauacacuga

SEQ ID NO: 2752096 - RNA, 15 nt, Human respiratory syncytial virus
auaccaagcaacaaa

SEQ ID NO: 2752097 - RNA, 15 nt, Human respiratory syncytial virus
cuauauccaaacauc

SEQ ID NO: 2752098 - RNA, 16 nt, Human respiratory syncytial virus
acucaucaaagggaaa

SEQ ID NO: 2752099 - RNA, 18 nt, Human respiratory syncytial virus
ugguccuaggcaaugcag

SEQ ID NO: 2752100 - RNA, 16 nt, Human respiratory syncytial virus
caacacuacuaugcaa

SEQ ID NO: 2752101 - RNA, 15 nt, Human respiratory syncytial virus
aaacuugaugaaaga

SEQ ID NO: 2752102 - RNA, 15 nt, Human respiratory syncytial virus
aggcauaaugggaga

SEQ ID NO: 2752103 - RNA, 17 nt, Human respiratory syncytial virus
gaauauaauacaaaaua

SEQ ID NO: 2752104 - RNA, 23 nt, Human respiratory syncytial virus
cuaggucaugcuaguguccaggc

SEQ ID NO: 2752105 - RNA, 15 nt, Human respiratory syncytial virus
cagcaagacuagaua

SEQ ID NO: 2752106 - RNA, 14 nt, Human respiratory syncytial virus
aagccuacaaaaca

SEQ ID NO: 2752107 - RNA, 17 nt, Human respiratory syncytial virus
uaguaagcuucaaagaa

SEQ ID NO: 2752108 - RNA, 15 nt, Human respiratory syncytial virus
acgaaauuaacaaua

SEQ ID NO: 2752109 - RNA, 15 nt, Human respiratory syncytial virus
guaccaaauacaaga

SEQ ID NO: 2752110 - RNA, 18 nt, Human respiratory syncytial virus
caagcuauuccucaaaca

SEQ ID NO: 2752111 - RNA, 13 nt, Human respiratory syncytial virus
aucuauagcacaa

SEQ ID NO: 2752112 - RNA, 20 nt, Human respiratory syncytial virus
ugucauccagcaaauacacu

SEQ ID NO: 2752113 - RNA, 21 nt, Human respiratory syncytial virus
acagauuaaauuuaaaaucua

SEQ ID NO: 2752114 - RNA, 23 nt, Human respiratory syncytial virus
aauaagucaacauggagaaguuu

SEQ ID NO: 2752115 - RNA, 10 nt, Human respiratory syncytial virus
aaaacacacc

SEQ ID NO: 2752116 - RNA, 14 nt, Human respiratory syncytial virus
caaaaacaccagcc

SEQ ID NO: 2752117 - RNA, 17 nt, Human respiratory syncytial virus
aacuugaugaaagacaa

SEQ ID NO: 2752118 - RNA, 23 nt, Human respiratory syncytial virus
ugacaauaaaggagcauucaaau

SEQ ID NO: 2752119 - RNA, 11 nt, Human respiratory syncytial virus
auacaaagaug

SEQ ID NO: 2752120 - RNA, 11 nt, Human respiratory syncytial virus
caguaaaucaa

SEQ ID NO: 2752121 - RNA, 20 nt, Human respiratory syncytial virus
uagaaacauuugauaacaau

SEQ ID NO: 2752122 - RNA, 18 nt, Human respiratory syncytial virus
caaucaaucauauacaaa

SEQ ID NO: 2752123 - RNA, 13 nt, Human respiratory syncytial virus
uguucuagaaaaa

SEQ ID NO: 2752124 - RNA, 19 nt, Human respiratory syncytial virus
ucaauaucucaagucaaug

SEQ ID NO: 2752125 - RNA, 17 nt, Human respiratory syncytial virus
uaucauugaucaaugau

SEQ ID NO: 2752126 - RNA, 16 nt, Human respiratory syncytial virus
gucuuaaaaaaugaaa

SEQ ID NO: 2752127 - RNA, 21 nt, Human respiratory syncytial virus
auaaaugaucaaacaaaugac

SEQ ID NO: 2752128 - RNA, 15 nt, Human respiratory syncytial virus
uagaugaaagaagca

SEQ ID NO: 2752129 - RNA, 19 nt, Human respiratory syncytial virus
ucagggcaaguaaugcuaa

SEQ ID NO: 2752130 - RNA, 12 nt, Human respiratory syncytial virus
uucaacaucaca

SEQ ID NO: 2752131 - RNA, 23 nt, Human respiratory syncytial virus
agaugauguagagcuuuaaguua

SEQ ID NO: 2752132 - RNA, 17 nt, Human respiratory syncytial virus
gacuugcucauaaaaga

SEQ ID NO: 2752133 - RNA, 15 nt, Human respiratory syncytial virus
cgaacaaacaaaugu

SEQ ID NO: 2752134 - RNA, 17 nt, Human respiratory syncytial virus
uuaguuuuugacacuuu

SEQ ID NO: 2752135 - RNA, 18 nt, Human respiratory syncytial virus
aggaucuuuaugaugcag

SEQ ID NO: 2752136 - RNA, 14 nt, Human respiratory syncytial virus
uacugaaauuauuu

SEQ ID NO: 2752137 - RNA, 15 nt, Human respiratory syncytial virus
agagacccaaaaaca

SEQ ID NO: 2752138 - RNA, 13 nt, Human respiratory syncytial virus
auccuacaaaaaa

SEQ ID NO: 2752139 - RNA, 22 nt, Human respiratory syncytial virus
augauaauacuguguauagcag

SEQ ID NO: 2752140 - RNA, 16 nt, Human respiratory syncytial virus
caauagaaaaaacaac

SEQ ID NO: 2752141 - RNA, 18 nt, Human respiratory syncytial virus
agcaaucaacaacaucaa

SEQ ID NO: 2752142 - RNA, 23 nt, Human respiratory syncytial virus
caaucaaccaacugauccaucag

SEQ ID NO: 2752143 - RNA, 12 nt, Human respiratory syncytial virus
acaauagaauuc

SEQ ID NO: 2752144 - RNA, 13 nt, Human respiratory syncytial virus
aauaaaagcuuag

SEQ ID NO: 2752145 - RNA, 22 nt, Human respiratory syncytial virus
aacucaccuaaucaaucaaacu

SEQ ID NO: 2752146 - RNA, 15 nt, Human respiratory syncytial virus
uaacuacaauuauua

SEQ ID NO: 2752147 - RNA, 23 nt, Human respiratory syncytial virus
acucaccuaaucaaucaaacuau

SEQ ID NO: 2752148 - RNA, 19 nt, Human respiratory syncytial virus
ugaacaucuacacuacaca

SEQ ID NO: 2752149 - RNA, 20 nt, Human respiratory syncytial virus
caaauagacaaaaaaccacc

SEQ ID NO: 2752150 - RNA, 21 nt, Human respiratory syncytial virus
caagccgagcacaaaaccacg

SEQ ID NO: 2752151 - RNA, 21 nt, Human respiratory syncytial virus
ucaacaacaucaauaaaacag

SEQ ID NO: 2752152 - RNA, 16 nt, Human respiratory syncytial virus
cuuuaaguuaacaaaa

SEQ ID NO: 2752153 - RNA, 17 nt, Human respiratory syncytial virus
gcuacucauaugaagag

SEQ ID NO: 2752154 - RNA, 19 nt, Human respiratory syncytial virus
caaacacuucaacaucaca

SEQ ID NO: 2752155 - RNA, 15 nt, Human respiratory syncytial virus
uaaucauuguaguau

SEQ ID NO: 2752156 - RNA, 15 nt, Human respiratory syncytial virus
gccucuuaauccaac

SEQ ID NO: 2752157 - RNA, 22 nt, Human respiratory syncytial virus
aaaacaccuaaacaaacuaugu

SEQ ID NO: 2752158 - RNA, 15 nt, Human respiratory syncytial virus
augugcaaaaacacc

SEQ ID NO: 2752159 - RNA, 24 nt, Human respiratory syncytial virus
ugaacaucuacacuacacacuuca

SEQ ID NO: 2752160 - RNA, 20 nt, Human respiratory syncytial virus
ccuguauauauaaacaaaca

SEQ ID NO: 2752161 - RNA, 15 nt, Human respiratory syncytial virus
gauacucucaaucau

SEQ ID NO: 2752162 - RNA, 11 nt, Human respiratory syncytial virus
uaguaaaucaa

SEQ ID NO: 2752163 - RNA, 17 nt, Human respiratory syncytial virus
ugcagcaggucuaggca

SEQ ID NO: 2752164 - RNA, 15 nt, Human respiratory syncytial virus
gaaaaagaugaugau

SEQ ID NO: 2752165 - RNA, 23 nt, Human respiratory syncytial virus
cucuaccaucaugcugugucaaa

SEQ ID NO: 2752166 - RNA, 17 nt, Human respiratory syncytial virus
augcacagaaguuggga

SEQ ID NO: 2752167 - RNA, 22 nt, Human respiratory syncytial virus
aauuuaaaaucuauagcacaaa

SEQ ID NO: 2752168 - RNA, 13 nt, Human respiratory syncytial virus
uauaaacaaacaa

SEQ ID NO: 2752169 - RNA, 12 nt, Human respiratory syncytial virus
ucaaaacaacac

SEQ ID NO: 2752170 - RNA, 20 nt, Human respiratory syncytial virus
guagagcuuuaaguuaacaa

SEQ ID NO: 2752171 - RNA, 15 nt, Human respiratory syncytial virus
gaaaugauagaaaaa

SEQ ID NO: 2752172 - RNA, 20 nt, Human respiratory syncytial virus
acacaaauucauauacuuga

SEQ ID NO: 2752173 - RNA, 21 nt, Human respiratory syncytial virus
aaccugacgaaauuaacaaua

SEQ ID NO: 2752174 - RNA, 14 nt, Human respiratory syncytial virus
guaacaaaaaaaga

SEQ ID NO: 2752175 - RNA, 18 nt, Human respiratory syncytial virus
ccuaggcaaugcagcagg

SEQ ID NO: 2752176 - RNA, 23 nt, Human respiratory syncytial virus
cuaacaaugauacaugugcauuu

SEQ ID NO: 2752177 - RNA, 21 nt, Human respiratory syncytial virus
auaaaacauucuguaacaaua

SEQ ID NO: 2752178 - RNA, 13 nt, Human respiratory syncytial virus
accaaucaaucaa

SEQ ID NO: 2752179 - RNA, 17 nt, Human respiratory syncytial virus
ucaaagaaaauggagua

SEQ ID NO: 2752180 - RNA, 20 nt, Human respiratory syncytial virus
aacaucuacacuacacacuu

SEQ ID NO: 2752181 - RNA, 18 nt, Human respiratory syncytial virus
acaucaccaauccacaca

SEQ ID NO: 2752182 - RNA, 16 nt, Human respiratory syncytial virus
augaagcuacugcaca

SEQ ID NO: 2752183 - RNA, 19 nt, Human respiratory syncytial virus
cauccagcaaauacacuau

SEQ ID NO: 2752184 - RNA, 20 nt, Human respiratory syncytial virus
uuggucaaauuuagaugcua

SEQ ID NO: 2752185 - RNA, 19 nt, Human respiratory syncytial virus
caaucaaacacuaaaucaa

SEQ ID NO: 2752186 - RNA, 16 nt, Human respiratory syncytial virus
auggagcaaguugugg

SEQ ID NO: 2752187 - RNA, 15 nt, Human respiratory syncytial virus
uggauucuaccauau

SEQ ID NO: 2752188 - RNA, 15 nt, Human respiratory syncytial virus
ccaccaacccaacaa

SEQ ID NO: 2752189 - RNA, 15 nt, Human respiratory syncytial virus
aaaacucaguacuua

SEQ ID NO: 2752190 - RNA, 16 nt, Human respiratory syncytial virus
cacuaccagccacuau

SEQ ID NO: 2752191 - RNA, 13 nt, Human respiratory syncytial virus
caaccacaucacc

SEQ ID NO: 2752192 - RNA, 17 nt, Human respiratory syncytial virus
aguacuuacaacuauaa

SEQ ID NO: 2752193 - RNA, 14 nt, Human respiratory syncytial virus
caaaaaugcuauca

SEQ ID NO: 2752194 - RNA, 17 nt, Human respiratory syncytial virus
aaauccaccaaaaaaac

SEQ ID NO: 2752195 - RNA, 15 nt, Human respiratory syncytial virus
agacaauaaaaaaca

SEQ ID NO: 2752196 - RNA, 18 nt, Human respiratory syncytial virus
auugguuugcuguuguau

SEQ ID NO: 2752197 - RNA, 20 nt, Human respiratory syncytial virus
cucaagugugguccuaggca

SEQ ID NO: 2752198 - RNA, 17 nt, Human respiratory syncytial virus
aagaugcaaauaacaaa

SEQ ID NO: 2752199 - RNA, 18 nt, Human respiratory syncytial virus
cuuuaaguuaacaaaaaa

SEQ ID NO: 2752200 - RNA, 14 nt, Human respiratory syncytial virus
uauaaaaacucauc

SEQ ID NO: 2752201 - RNA, 16 nt, Human respiratory syncytial virus
aucauaaauucacagg

SEQ ID NO: 2752202 - RNA, 22 nt, Human respiratory syncytial virus
guucaguacaauguucuagaaa

SEQ ID NO: 2752203 - RNA, 12 nt, Human respiratory syncytial virus
aacuaccaccaa

SEQ ID NO: 2752204 - RNA, 21 nt, Human respiratory syncytial virus
ucaaccaacugauccaucagc

SEQ ID NO: 2752205 - RNA, 15 nt, Human respiratory syncytial virus
uggaagacaacgaua

SEQ ID NO: 2752206 - RNA, 16 nt, Human respiratory syncytial virus
acuugauaaacaauga

SEQ ID NO: 2752207 - RNA, 22 nt, Human respiratory syncytial virus
gcaaauaagucaacauggagaa

SEQ ID NO: 2752208 - RNA, 14 nt, Human respiratory syncytial virus
aaaacuaacuauaa

SEQ ID NO: 2752209 - RNA, 15 nt, Human respiratory syncytial virus
cuagaaucaauaaag

SEQ ID NO: 2752210 - RNA, 21 nt, Human respiratory syncytial virus
uauuccucaaacaacaaugcu

SEQ ID NO: 2752211 - RNA, 21 nt, Human respiratory syncytial virus
aagucuaugaguaugcacaga

SEQ ID NO: 2752212 - RNA, 13 nt, Human respiratory syncytial virus
ccuaucaagcaag

SEQ ID NO: 2752213 - RNA, 14 nt, Human respiratory syncytial virus
aaagaaucaacuca

SEQ ID NO: 2752214 - RNA, 17 nt, Human respiratory syncytial virus
caacguaguacaggaga

SEQ ID NO: 2752215 - RNA, 18 nt, Human respiratory syncytial virus
acagaaguugggaggaga

SEQ ID NO: 2752216 - RNA, 23 nt, Human respiratory syncytial virus
cuaggacagaugcaucaaaucaa

SEQ ID NO: 2752217 - RNA, 22 nt, Human respiratory syncytial virus
auaacaucucucaccaaagaaa

SEQ ID NO: 2752218 - RNA, 15 nt, Human respiratory syncytial virus
ucaaguuaaaugaua

SEQ ID NO: 2752219 - RNA, 15 nt, Human respiratory syncytial virus
uaugagcacuacaaa

SEQ ID NO: 2752220 - RNA, 15 nt, Human respiratory syncytial virus
aauuaugaugugcaa

SEQ ID NO: 2752221 - RNA, 17 nt, Human respiratory syncytial virus
caaccaccaaaaccaca

SEQ ID NO: 2752222 - RNA, 18 nt, Human respiratory syncytial virus
cacugcauccaacaaaaa

SEQ ID NO: 2752223 - RNA, 20 nt, Human respiratory syncytial virus
uguauuagacuuaacagcag

SEQ ID NO: 2752224 - RNA, 13 nt, Human respiratory syncytial virus
ucgacacaaccac

SEQ ID NO: 2752225 - RNA, 14 nt, Human respiratory syncytial virus
uaaaaaauaugcaa

SEQ ID NO: 2752226 - RNA, 21 nt, Human respiratory syncytial virus
agcaaauagacaaaaaaccac

SEQ ID NO: 2752227 - RNA, 19 nt, Human respiratory syncytial virus
ccaaagaagaaaccaacca

SEQ ID NO: 2752228 - RNA, 12 nt, Human respiratory syncytial virus
gagcaacucaaa

SEQ ID NO: 2752229 - RNA, 21 nt, Human respiratory syncytial virus
aucaucucugccaaucacaaa

SEQ ID NO: 2752230 - RNA, 15 nt, Human respiratory syncytial virus
acuaauacauaugau

SEQ ID NO: 2752231 - RNA, 16 nt, Human respiratory syncytial virus
aacacugacauauuca

SEQ ID NO: 2752232 - RNA, 22 nt, Human respiratory syncytial virus
ccaaagccaacuacccaagaaa

SEQ ID NO: 2752233 - RNA, 21 nt, Human respiratory syncytial virus
cuaagugaacauaaaacauuc

SEQ ID NO: 2752234 - RNA, 20 nt, Human respiratory syncytial virus
cauuaagccuacaaaacaca

SEQ ID NO: 2752235 - RNA, 22 nt, Human respiratory syncytial virus
aaccaggaucuuuaugaugcag

SEQ ID NO: 2752236 - RNA, 13 nt, Human respiratory syncytial virus
aaguaaccaaaga

SEQ ID NO: 2752237 - RNA, 16 nt, Human respiratory syncytial virus
agcaauagaaaaaaca

SEQ ID NO: 2752238 - RNA, 14 nt, Human respiratory syncytial virus
caggacucuagaaa

SEQ ID NO: 2752239 - RNA, 18 nt, Human respiratory syncytial virus
uuacacuaauacauauga

SEQ ID NO: 2752240 - RNA, 18 nt, Human respiratory syncytial virus
ugauaacuacaauuauua

SEQ ID NO: 2752241 - RNA, 20 nt, Human respiratory syncytial virus
cacagaaguugggaggagaa

SEQ ID NO: 2752242 - RNA, 17 nt, Human respiratory syncytial virus
aagaugcuggauaucau

SEQ ID NO: 2752243 - RNA, 23 nt, Human respiratory syncytial virus
caaauucagccacaacaucaccc

SEQ ID NO: 2752244 - RNA, 14 nt, Human respiratory syncytial virus
uuaaucacugaaga

SEQ ID NO: 2752245 - RNA, 21 nt, Human respiratory syncytial virus
ugccagaccgaacaaacaaau

SEQ ID NO: 2752246 - RNA, 13 nt, Human respiratory syncytial virus
auaucauguuaaa

SEQ ID NO: 2752247 - RNA, 15 nt, Human respiratory syncytial virus
caaaugacaacacua

SEQ ID NO: 2752248 - RNA, 17 nt, Human respiratory syncytial virus
auggaacugacacuaaa

SEQ ID NO: 2752249 - RNA, 19 nt, Human respiratory syncytial virus
caaaucuacuacaaauauu

SEQ ID NO: 2752250 - RNA, 14 nt, Human respiratory syncytial virus
ucaucacacaaacc

SEQ ID NO: 2752251 - RNA, 14 nt, Human respiratory syncytial virus
aauuacuacauaau

SEQ ID NO: 2752252 - RNA, 15 nt, Human respiratory syncytial virus
uuaaguuaacaaaaa

SEQ ID NO: 2752253 - RNA, 19 nt, Human respiratory syncytial virus
caaaaaaaugcuaaaagag

SEQ ID NO: 2752254 - RNA, 23 nt, Human respiratory syncytial virus
gcugaucaccaaucccaaaucaa

SEQ ID NO: 2752255 - RNA, 14 nt, Human respiratory syncytial virus
accaaaaaaaccaa

SEQ ID NO: 2752256 - RNA, 24 nt, Human respiratory syncytial virus
aauaaccaaauuagcagcaggaga

SEQ ID NO: 2752257 - RNA, 15 nt, Human respiratory syncytial virus
caaaguuacacuaac

SEQ ID NO: 2752258 - RNA, 23 nt, Human respiratory syncytial virus
uugacacucccaauuaugaugug

SEQ ID NO: 2752259 - RNA, 17 nt, Human respiratory syncytial virus
gaucagaaaaaauuaau

SEQ ID NO: 2752260 - RNA, 16 nt, Human respiratory syncytial virus
ucaaacccacaaacaa

SEQ ID NO: 2752261 - RNA, 20 nt, Human respiratory syncytial virus
cacucaaaauccaaaaucac

SEQ ID NO: 2752262 - RNA, 19 nt, Human respiratory syncytial virus
ccacacaacagcacaaacc

SEQ ID NO: 2752263 - RNA, 16 nt, Human respiratory syncytial virus
cuacauuuacauucuu

SEQ ID NO: 2752264 - RNA, 21 nt, Human respiratory syncytial virus
gauacauuaaauaaggaucag

SEQ ID NO: 2752265 - RNA, 19 nt, Human respiratory syncytial virus
uccaaacaaccuacaacca

SEQ ID NO: 2752266 - RNA, 16 nt, Human respiratory syncytial virus
uuacacuaauacauau

SEQ ID NO: 2752267 - RNA, 16 nt, Human respiratory syncytial virus
auccaaucuucucaca

SEQ ID NO: 2752268 - RNA, 13 nt, Human respiratory syncytial virus
ggcagaaauggag

SEQ ID NO: 2752269 - RNA, 21 nt, Human respiratory syncytial virus
cacaauagaauucacaagcaa

SEQ ID NO: 2752270 - RNA, 17 nt, Human respiratory syncytial virus
caaaauccaaaaucacu

SEQ ID NO: 2752271 - RNA, 14 nt, Human respiratory syncytial virus
aauacaaaauaugg

SEQ ID NO: 2752272 - RNA, 19 nt, Human respiratory syncytial virus
aaauaaaaguaaagccaau

SEQ ID NO: 2752273 - RNA, 21 nt, Human respiratory syncytial virus
caguaauuaggagggcaaaca

SEQ ID NO: 2752274 - RNA, 15 nt, Human respiratory syncytial virus
aucaauaaaacagac

SEQ ID NO: 2752275 - RNA, 22 nt, Human respiratory syncytial virus
accauuuauaccgccaauucaa

SEQ ID NO: 2752276 - RNA, 20 nt, Human respiratory syncytial virus
gcaaacaaugucuuaaaaaa

SEQ ID NO: 2752277 - RNA, 17 nt, Human respiratory syncytial virus
uggaauaagagaugcua

SEQ ID NO: 2752278 - RNA, 16 nt, Human respiratory syncytial virus
aacuaacaaugauaca

SEQ ID NO: 2752279 - RNA, 14 nt, Human respiratory syncytial virus
uauuccucaaacaa

SEQ ID NO: 2752280 - RNA, 18 nt, Human respiratory syncytial virus
auaaacucaccuaaucaa

SEQ ID NO: 2752281 - RNA, 16 nt, Human respiratory syncytial virus
uuaacauuaucaagcu

SEQ ID NO: 2752282 - RNA, 13 nt, Human respiratory syncytial virus
ucaaaaacaacau

SEQ ID NO: 2752283 - RNA, 17 nt, Human respiratory syncytial virus
aucucucaccaaagaaa

SEQ ID NO: 2752284 - RNA, 18 nt, Human respiratory syncytial virus
augcagcaggucuaggca

SEQ ID NO: 2752285 - RNA, 22 nt, Human respiratory syncytial virus
gcggaaccaccaaccaaucaau

SEQ ID NO: 2752286 - RNA, 23 nt, Human respiratory syncytial virus
cacauauauccucaaacuacaca

SEQ ID NO: 2752287 - RNA, 18 nt, Human respiratory syncytial virus
cuaguaagcuucaaagaa

SEQ ID NO: 2752288 - RNA, 19 nt, Human respiratory syncytial virus
augagcacuacaaaugaca

SEQ ID NO: 2752289 - RNA, 15 nt, Human respiratory syncytial virus
auauguggcaacaau

SEQ ID NO: 2752290 - RNA, 21 nt, Human respiratory syncytial virus
aucauaagcgcaaauguauca

SEQ ID NO: 2752291 - RNA, 16 nt, Human respiratory syncytial virus
guuagaguucaaucaa

SEQ ID NO: 2752292 - RNA, 20 nt, Human respiratory syncytial virus
uuuaaguuaacaaaaaauac

SEQ ID NO: 2752293 - RNA, 18 nt, Human respiratory syncytial virus
uggagaagaugcaaauaa

SEQ ID NO: 2752294 - RNA, 17 nt, Human respiratory syncytial virus
cauaaaagaacuugcaa

SEQ ID NO: 2752295 - RNA, 13 nt, Human respiratory syncytial virus
acaucaaaaagag

SEQ ID NO: 2752296 - RNA, 18 nt, Human respiratory syncytial virus
ucaacaacaucaauaaaa

SEQ ID NO: 2752297 - RNA, 21 nt, Human respiratory syncytial virus
uccagcaaauacacuauucaa

SEQ ID NO: 2752298 - RNA, 14 nt, Human respiratory syncytial virus
ccaagcaacaaacc

SEQ ID NO: 2752299 - RNA, 11 nt, Human respiratory syncytial virus
cauaacaaaca

SEQ ID NO: 2752300 - RNA, 16 nt, Human respiratory syncytial virus
cacugcauccaacaaa

SEQ ID NO: 2752301 - RNA, 18 nt, Human respiratory syncytial virus
auaucuguuaacucaaua

SEQ ID NO: 2752302 - RNA, 13 nt, Human respiratory syncytial virus
gaaagcaaucaau

SEQ ID NO: 2752303 - RNA, 13 nt, Human respiratory syncytial virus
ugcaagcaucaac

SEQ ID NO: 2752304 - RNA, 19 nt, Human respiratory syncytial virus
aggauuguuuaugaaugcc

SEQ ID NO: 2752305 - RNA, 22 nt, Human respiratory syncytial virus
cgccaagaaaccaggaucuuua

SEQ ID NO: 2752306 - RNA, 13 nt, Human respiratory syncytial virus
agaauuacauaaa

SEQ ID NO: 2752307 - RNA, 16 nt, Human respiratory syncytial virus
caaccauguccaaaca

SEQ ID NO: 2752308 - RNA, 18 nt, Human respiratory syncytial virus
gcugucauccagcaaaua

SEQ ID NO: 2752309 - RNA, 14 nt, Human respiratory syncytial virus
caaacccacaaaca

SEQ ID NO: 2752310 - RNA, 14 nt, Human respiratory syncytial virus
caucacacacaaau

SEQ ID NO: 2752311 - RNA, 16 nt, Human respiratory syncytial virus
ugcuaguguccaggca

SEQ ID NO: 2752312 - RNA, 20 nt, Human respiratory syncytial virus
uaauauaaaaacucaucaaa

SEQ ID NO: 2752313 - RNA, 17 nt, Human respiratory syncytial virus
uacauguuaacaaacag

SEQ ID NO: 2752314 - RNA, 15 nt, Human respiratory syncytial virus
aaagagaugggagaa

SEQ ID NO: 2752315 - RNA, 17 nt, Human respiratory syncytial virus
uagaguugaaggaaucu

SEQ ID NO: 2752316 - RNA, 12 nt, Human respiratory syncytial virus
ucuagaaaaucc

SEQ ID NO: 2752317 - RNA, 20 nt, Human respiratory syncytial virus
acuauaaagauacuuaaaga

SEQ ID NO: 2752318 - RNA, 18 nt, Human respiratory syncytial virus
ugaauaaaagucuaaaac

SEQ ID NO: 2752319 - RNA, 18 nt, Human respiratory syncytial virus
auguuugcuuaauuacuu

SEQ ID NO: 2752320 - RNA, 20 nt, Human respiratory syncytial virus
aguguccaggcagaaaugga

SEQ ID NO: 2752321 - RNA, 13 nt, Human respiratory syncytial virus
aaugaucaaacaa

SEQ ID NO: 2752322 - RNA, 18 nt, Human respiratory syncytial virus
caacaauaauucagguga

SEQ ID NO: 2752323 - RNA, 22 nt, Human respiratory syncytial virus
uuaguuaauauaaaaacucauc

SEQ ID NO: 2752324 - RNA, 16 nt, Human respiratory syncytial virus
aagaacuugcaagcau

SEQ ID NO: 2752325 - RNA, 16 nt, Human respiratory syncytial virus
aacaaaaaaagaacaa

SEQ ID NO: 2752326 - RNA, 16 nt, Human respiratory syncytial virus
cuaggcaaugcagcag

SEQ ID NO: 2752327 - RNA, 21 nt, Human respiratory syncytial virus
guacaauguucuagaaaaaga

SEQ ID NO: 2752328 - RNA, 18 nt, Human respiratory syncytial virus
uuaaucacugaagaugca

SEQ ID NO: 2752329 - RNA, 21 nt, Human respiratory syncytial virus
gacaagcuacauuuacauucu

SEQ ID NO: 2752330 - RNA, 18 nt, Human respiratory syncytial virus
acaugcuuaaaagugaaa

SEQ ID NO: 2752331 - RNA, 23 nt, Human respiratory syncytial virus
cacucaaccacccccgaaaacac

SEQ ID NO: 2752332 - RNA, 21 nt, Human respiratory syncytial virus
gcacugccaggacucuagaaa

SEQ ID NO: 2752333 - RNA, 21 nt, Human respiratory syncytial virus
auguccagguuaggaagggaa

SEQ ID NO: 2752334 - RNA, 21 nt, Human respiratory syncytial virus
caaagagagcccgauaacauc

SEQ ID NO: 2752335 - RNA, 17 nt, Human respiratory syncytial virus
agaauugaugaaaaauu

SEQ ID NO: 2752336 - RNA, 14 nt, Human respiratory syncytial virus
agauauaaauggaa

SEQ ID NO: 2752337 - RNA, 18 nt, Human respiratory syncytial virus
aaaucaacacaucauuca

SEQ ID NO: 2752338 - RNA, 14 nt, Human respiratory syncytial virus
caauaaaaaacaca

SEQ ID NO: 2752339 - RNA, 19 nt, Human respiratory syncytial virus
aagauggcucuuagcaaag

SEQ ID NO: 2752340 - RNA, 15 nt, Human respiratory syncytial virus
aaaucaaagcaugca

SEQ ID NO: 2752341 - RNA, 17 nt, Human respiratory syncytial virus
cauuggggcaaaugcaa

SEQ ID NO: 2752342 - RNA, 17 nt, Human respiratory syncytial virus
aagacacuauaaagaua

SEQ ID NO: 2752343 - RNA, 18 nt, Human respiratory syncytial virus
cucaaucaucuaauugua

SEQ ID NO: 2752344 - RNA, 17 nt, Human respiratory syncytial virus
aacauucuguaacaaua

SEQ ID NO: 2752345 - RNA, 21 nt, Human respiratory syncytial virus
aggaagaaguccuugcauaug

SEQ ID NO: 2752346 - RNA, 13 nt, Human respiratory syncytial virus
cuuaaaaaaugaa

SEQ ID NO: 2752347 - RNA, 15 nt, Human respiratory syncytial virus
auuaugauugcaaua

SEQ ID NO: 2752348 - RNA, 16 nt, Human respiratory syncytial virus
cuuguaauaaccaaau

SEQ ID NO: 2752349 - RNA, 22 nt, Human respiratory syncytial virus
aacacaagaaucaacgcacugc

SEQ ID NO: 2752350 - RNA, 13 nt, Human respiratory syncytial virus
uccacacaaacac

SEQ ID NO: 2752351 - RNA, 12 nt, Human respiratory syncytial virus
aaauaaggauca

SEQ ID NO: 2752352 - RNA, 18 nt, Human respiratory syncytial virus
agcuuuaaguuaacaaaa

SEQ ID NO: 2752353 - RNA, 14 nt, Human respiratory syncytial virus
gcagagcaacucaa

SEQ ID NO: 2752354 - RNA, 15 nt, Human respiratory syncytial virus
acuuccaaaaaauug

SEQ ID NO: 2752355 - RNA, 16 nt, Human respiratory syncytial virus
aaguaucacaaucaaa

SEQ ID NO: 2752356 - RNA, 17 nt, Human respiratory syncytial virus
gcaagaacgaaauuaaa

SEQ ID NO: 2752357 - RNA, 16 nt, Human respiratory syncytial virus
gaauucaaaaaugcua

SEQ ID NO: 2752358 - RNA, 20 nt, Human respiratory syncytial virus
caccaacccaacaaaaaaac

SEQ ID NO: 2752359 - RNA, 22 nt, Human respiratory syncytial virus
acaagggucucauaccaaagga

SEQ ID NO: 2752360 - RNA, 22 nt, Human respiratory syncytial virus
aaccacaucaccaauccacaca

SEQ ID NO: 2752361 - RNA, 14 nt, Human respiratory syncytial virus
aaugaucugucacu

SEQ ID NO: 2752362 - RNA, 15 nt, Human respiratory syncytial virus
aaacacaccacacaa

SEQ ID NO: 2752363 - RNA, 15 nt, Human respiratory syncytial virus
uaaugucaagcaaug

SEQ ID NO: 2752364 - RNA, 15 nt, Human respiratory syncytial virus
aacuuccaaaaaauu

SEQ ID NO: 2752365 - RNA, 15 nt, Human respiratory syncytial virus
cagguuaggaaggga

SEQ ID NO: 2752366 - RNA, 18 nt, Human respiratory syncytial virus
aguuaaaugauacauuaa

SEQ ID NO: 2752367 - RNA, 20 nt, Human respiratory syncytial virus
aauucaaaaaugcuaucacc

SEQ ID NO: 2752368 - RNA, 20 nt, Human respiratory syncytial virus
uaugcaaagauuaaugauca

SEQ ID NO: 2752369 - RNA, 15 nt, Human respiratory syncytial virus
gaagaaaugauagaa

SEQ ID NO: 2752370 - RNA, 13 nt, Human respiratory syncytial virus
gaucaaaaacaac

SEQ ID NO: 2752371 - RNA, 18 nt, Human respiratory syncytial virus
aguguccaggcagaaaug

SEQ ID NO: 2752372 - RNA, 20 nt, Human respiratory syncytial virus
auugcaaagccaaaaacaca

SEQ ID NO: 2752373 - RNA, 14 nt, Human respiratory syncytial virus
gcaaugauaaucuc

SEQ ID NO: 2752374 - RNA, 19 nt, Human respiratory syncytial virus
uggaagccauaaagaauca

SEQ ID NO: 2752375 - RNA, 15 nt, Human respiratory syncytial virus
caauaaaaaaccaca

SEQ ID NO: 2752376 - RNA, 14 nt, Human respiratory syncytial virus
cagacaucaaucca

SEQ ID NO: 2752377 - RNA, 18 nt, Human respiratory syncytial virus
accaaccaccaaaaccac

SEQ ID NO: 2752378 - RNA, 17 nt, Human respiratory syncytial virus
gagaaguggcuccagaa

SEQ ID NO: 2752379 - RNA, 18 nt, Human respiratory syncytial virus
gaaaucaucacacacaaa

SEQ ID NO: 2752380 - RNA, 12 nt, Human respiratory syncytial virus
caccagccaaaa

SEQ ID NO: 2752381 - RNA, 22 nt, Human respiratory syncytial virus
augcaaccauguccaaacacaa

SEQ ID NO: 2752382 - RNA, 22 nt, Human respiratory syncytial virus
auaguuauuaaaaaauaugcaa

SEQ ID NO: 2752383 - RNA, 16 nt, Human respiratory syncytial virus
gaauauaauacaaaau

SEQ ID NO: 2752384 - RNA, 21 nt, Human respiratory syncytial virus
cuuuaugaugcagccaaagca

SEQ ID NO: 2752385 - RNA, 15 nt, Human respiratory syncytial virus
gucaacauggagaag

SEQ ID NO: 2752386 - RNA, 12 nt, Human respiratory syncytial virus
guucuagaaaaa

SEQ ID NO: 2752387 - RNA, 23 nt, Human respiratory syncytial virus
uacacacuucaucacacaaacca

SEQ ID NO: 2752388 - RNA, 14 nt, Human respiratory syncytial virus
aauaaccaaauuag

SEQ ID NO: 2752389 - RNA, 23 nt, Human respiratory syncytial virus
aaaugcaaccauguccaaacaca

SEQ ID NO: 2752390 - RNA, 14 nt, Human respiratory syncytial virus
cuuagcaaagucaa

SEQ ID NO: 2752391 - RNA, 13 nt, Human respiratory syncytial virus
ucuagaaaaagau

SEQ ID NO: 2752392 - RNA, 12 nt, Human respiratory syncytial virus
cuauguccaggu

SEQ ID NO: 2752393 - RNA, 12 nt, Human respiratory syncytial virus
aacaaauccaau

SEQ ID NO: 2752394 - RNA, 15 nt, Human respiratory syncytial virus
ugcuaacacaucauu

SEQ ID NO: 2752395 - RNA, 18 nt, Human respiratory syncytial virus
auuaaucacugaagaugc

SEQ ID NO: 2752396 - RNA, 21 nt, Human respiratory syncytial virus
agccauaaagaaucaacucaa

SEQ ID NO: 2752397 - RNA, 14 nt, Human respiratory syncytial virus
cuaugcaccaccaa

SEQ ID NO: 2752398 - RNA, 13 nt, Human respiratory syncytial virus
gacacuauaaaga

SEQ ID NO: 2752399 - RNA, 22 nt, Human respiratory syncytial virus
auaaugaaggcuucuacauaau

SEQ ID NO: 2752400 - RNA, 18 nt, Human respiratory syncytial virus
acaaugaagaagaaucua

SEQ ID NO: 2752401 - RNA, 23 nt, Human respiratory syncytial virus
uaguacaggagauaauauugaca

SEQ ID NO: 2752402 - RNA, 16 nt, Human respiratory syncytial virus
acaucaccaauccaca

SEQ ID NO: 2752403 - RNA, 13 nt, Human respiratory syncytial virus
auaauacaaaaua

SEQ ID NO: 2752404 - RNA, 14 nt, Human respiratory syncytial virus
aacacaccagcugc

SEQ ID NO: 2752405 - RNA, 15 nt, Human respiratory syncytial virus
cuaugaguaugcaca

SEQ ID NO: 2752406 - RNA, 18 nt, Human respiratory syncytial virus
auucaauaauaacaucuc

SEQ ID NO: 2752407 - RNA, 13 nt, Human respiratory syncytial virus
aucauccaaagau

SEQ ID NO: 2752408 - RNA, 22 nt, Human respiratory syncytial virus
cuaaucucuuuacuaauuauaa

SEQ ID NO: 2752409 - RNA, 20 nt, Human respiratory syncytial virus
uaggaagggaagacacuaua

SEQ ID NO: 2752410 - RNA, 22 nt, Human respiratory syncytial virus
accaaucaaucaaccaacugau

SEQ ID NO: 2752411 - RNA, 20 nt, Human respiratory syncytial virus
augaguaugcacagaaguug

SEQ ID NO: 2752412 - RNA, 17 nt, Human respiratory syncytial virus
agcuauuccucaaacaa

SEQ ID NO: 2752413 - RNA, 21 nt, Human respiratory syncytial virus
aucucucaccaaagaaaucau

SEQ ID NO: 2752414 - RNA, 10 nt, Human respiratory syncytial virus
caaaaccaca

SEQ ID NO: 2752415 - RNA, 12 nt, Human respiratory syncytial virus
augucaagcaau

SEQ ID NO: 2752416 - RNA, 22 nt, Human respiratory syncytial virus
aacacacuccuauaauauacaa

SEQ ID NO: 2752417 - RNA, 14 nt, Human respiratory syncytial virus
aaaagagacccaaa

SEQ ID NO: 2752418 - RNA, 18 nt, Human respiratory syncytial virus
uaagucaacauggagaag

SEQ ID NO: 2752419 - RNA, 12 nt, Human respiratory syncytial virus
acacuacacacu

SEQ ID NO: 2752420 - RNA, 20 nt, Human respiratory syncytial virus
aacuugcaagcaucaacaua

SEQ ID NO: 2752421 - RNA, 14 nt, Human respiratory syncytial virus
gacaaaaaaccacc

SEQ ID NO: 2752422 - RNA, 20 nt, Human respiratory syncytial virus
gaauuucauggagaagaugc

SEQ ID NO: 2752423 - RNA, 23 nt, Human respiratory syncytial virus
aagaacaagauggggcaaauaug

SEQ ID NO: 2752424 - RNA, 20 nt, Human respiratory syncytial virus
caagaaucaacgcacugcca

SEQ ID NO: 2752425 - RNA, 17 nt, Human respiratory syncytial virus
agcauauauuaugugac

SEQ ID NO: 2752426 - RNA, 23 nt, Human respiratory syncytial virus
ccgucagcggaaccaccaaccaa

SEQ ID NO: 2752427 - RNA, 18 nt, Human respiratory syncytial virus
uucagccacaacaucacc

SEQ ID NO: 2752428 - RNA, 14 nt, Human respiratory syncytial virus
aauuaugaugugca

SEQ ID NO: 2752429 - RNA, 18 nt, Human respiratory syncytial virus
aagaugcaaauaacaaag

SEQ ID NO: 2752430 - RNA, 20 nt, Human respiratory syncytial virus
caaaaccacgccaacuauca

SEQ ID NO: 2752431 - RNA, 17 nt, Human respiratory syncytial virus
ugaauauaauacaaaau

SEQ ID NO: 2752432 - RNA, 14 nt, Human respiratory syncytial virus
gaagccauaaagaa

SEQ ID NO: 2752433 - RNA, 18 nt, Human respiratory syncytial virus
ugaguaugcacagaaguu

SEQ ID NO: 2752434 - RNA, 16 nt, Human respiratory syncytial virus
aguuauuuaaaaauua

SEQ ID NO: 2752435 - RNA, 14 nt, Human respiratory syncytial virus
auuucauggagaag

SEQ ID NO: 2752436 - RNA, 12 nt, Human respiratory syncytial virus
cacuacacacuu

SEQ ID NO: 2752437 - RNA, 12 nt, Human respiratory syncytial virus
aacacaccagcu

SEQ ID NO: 2752438 - RNA, 21 nt, Human respiratory syncytial virus
caaauaagucaacauggagaa

SEQ ID NO: 2752439 - RNA, 20 nt, Human respiratory syncytial virus
uuaacaauauaguaacaaaa

SEQ ID NO: 2752440 - RNA, 11 nt, Human respiratory syncytial virus
ccaaaccaaaa

SEQ ID NO: 2752441 - RNA, 16 nt, Human respiratory syncytial virus
gcgaauagguaaauaa

SEQ ID NO: 2752442 - RNA, 22 nt, Human respiratory syncytial virus
caaggaucugaacucacuagaa

SEQ ID NO: 2752443 - RNA, 18 nt, Human respiratory syncytial virus
uuacauguuaacaaacag

SEQ ID NO: 2752444 - RNA, 19 nt, Human respiratory syncytial virus
agaucaggucuuacagcag

SEQ ID NO: 2752445 - RNA, 12 nt, Human respiratory syncytial virus
aaucaaucucaa

SEQ ID NO: 2752446 - RNA, 13 nt, Human respiratory syncytial virus
gcauaaugggaga

SEQ ID NO: 2752447 - RNA, 14 nt, Human respiratory syncytial virus
agucauaauuacuu

SEQ ID NO: 2752448 - RNA, 22 nt, Human respiratory syncytial virus
cuuaacucauaguuacauaaaa

SEQ ID NO: 2752449 - RNA, 13 nt, Human respiratory syncytial virus
caaucaaaccacu

SEQ ID NO: 2752450 - RNA, 22 nt, Human respiratory syncytial virus
ucagcaaauagacaaaaaacca

SEQ ID NO: 2752451 - RNA, 17 nt, Human respiratory syncytial virus
uacaagaaauacacuga

SEQ ID NO: 2752452 - RNA, 18 nt, Human respiratory syncytial virus
cuagaggauuaaauuuaa

SEQ ID NO: 2752453 - RNA, 22 nt, Human respiratory syncytial virus
ggaucugaacucacuagaaaac

SEQ ID NO: 2752454 - RNA, 15 nt, Human respiratory syncytial virus
cuggcaaugauaauc

SEQ ID NO: 2752455 - RNA, 15 nt, Human respiratory syncytial virus
augggaucaaaaaca

SEQ ID NO: 2752456 - RNA, 21 nt, Human respiratory syncytial virus
aguaauuaggagggcaaacaa

SEQ ID NO: 2752457 - RNA, 13 nt, Human respiratory syncytial virus
agcagaagaacag

SEQ ID NO: 2752458 - RNA, 13 nt, Human respiratory syncytial virus
acaacaucaauaa

SEQ ID NO: 2752459 - RNA, 20 nt, Human respiratory syncytial virus
ucauggugucgcaaaaccac

SEQ ID NO: 2752460 - RNA, 16 nt, Human respiratory syncytial virus
augaucaaacaaauga

SEQ ID NO: 2752461 - RNA, 21 nt, Human respiratory syncytial virus
ccaaaccaagcuauuccucaa

SEQ ID NO: 2752462 - RNA, 22 nt, Human respiratory syncytial virus
augucuuaaaaaaugaaauaaa

SEQ ID NO: 2752463 - RNA, 13 nt, Human respiratory syncytial virus
acaucauucacaa

SEQ ID NO: 2752464 - RNA, 23 nt, Human respiratory syncytial virus
acugacaauaaaggagcauucaa

SEQ ID NO: 2752465 - RNA, 13 nt, Human respiratory syncytial virus
cuuacagcaguaa

SEQ ID NO: 2752466 - RNA, 18 nt, Human respiratory syncytial virus
ucuaaguuguacaaagaa

SEQ ID NO: 2752467 - RNA, 16 nt, Human respiratory syncytial virus
cucaaacuacacacua

SEQ ID NO: 2752468 - RNA, 21 nt, Human respiratory syncytial virus
gaucuuggugccuaccuagaa

SEQ ID NO: 2752469 - RNA, 19 nt, Human respiratory syncytial virus
guaucauuagaugaaagaa

SEQ ID NO: 2752470 - RNA, 15 nt, Human respiratory syncytial virus
auacaaaauauggca

SEQ ID NO: 2752471 - RNA, 14 nt, Human respiratory syncytial virus
aaauaaaaguaaag

SEQ ID NO: 2752472 - RNA, 21 nt, Human respiratory syncytial virus
auuaaucacugaagaugcaaa

SEQ ID NO: 2752473 - RNA, 22 nt, Human respiratory syncytial virus
caaauucagccacaacaucacc

SEQ ID NO: 2752474 - RNA, 23 nt, Human respiratory syncytial virus
auuaacaaguuuggucaaauuua

SEQ ID NO: 2752475 - RNA, 17 nt, Human respiratory syncytial virus
uauaaaagaaaccaaau

SEQ ID NO: 2752476 - RNA, 13 nt, Human respiratory syncytial virus
aagagaugggaga

SEQ ID NO: 2752477 - RNA, 15 nt, Human respiratory syncytial virus
aaggcuccacauaca

SEQ ID NO: 2752478 - RNA, 23 nt, Human respiratory syncytial virus
gcuauuaaucacugaagaugcaa

SEQ ID NO: 2752479 - RNA, 18 nt, Human respiratory syncytial virus
aauuaacauaaugaugaa

SEQ ID NO: 2752480 - RNA, 13 nt, Human respiratory syncytial virus
agaaguugggagg

SEQ ID NO: 2752481 - RNA, 24 nt, Human respiratory syncytial virus
aaaauaugggguaaauagacauua

SEQ ID NO: 2752482 - RNA, 16 nt, Human respiratory syncytial virus
gaugaaagacaagcua

SEQ ID NO: 2752483 - RNA, 22 nt, Human respiratory syncytial virus
aaauacggggcaaauaagucaa

SEQ ID NO: 2752484 - RNA, 13 nt, Human respiratory syncytial virus
uguauagcagcac

SEQ ID NO: 2752485 - RNA, 21 nt, Human respiratory syncytial virus
acaaucagcauguguugcuau

SEQ ID NO: 2752486 - RNA, 11 nt, Human respiratory syncytial virus
ucuacaaacaa

SEQ ID NO: 2752487 - RNA, 18 nt, Human respiratory syncytial virus
cacugaauauaauacaaa

SEQ ID NO: 2752488 - RNA, 20 nt, Human respiratory syncytial virus
cucuaaucucuuuacuaauu

SEQ ID NO: 2752489 - RNA, 19 nt, Human respiratory syncytial virus
ucaaacaauaaaaaaccac

SEQ ID NO: 2752490 - RNA, 14 nt, Human respiratory syncytial virus
aagagcggaagcau

SEQ ID NO: 2752491 - RNA, 19 nt, Human respiratory syncytial virus
caaccacaucaccaaucca

SEQ ID NO: 2752492 - RNA, 18 nt, Human respiratory syncytial virus
aaaauaucauuaacaagu

SEQ ID NO: 2752493 - RNA, 16 nt, Human respiratory syncytial virus
agacacuauaaagaua

SEQ ID NO: 2752494 - RNA, 14 nt, Human respiratory syncytial virus
uauuuaucaaucau

SEQ ID NO: 2752495 - RNA, 22 nt, Human respiratory syncytial virus
uccaucacaauagaauucacaa

SEQ ID NO: 2752496 - RNA, 19 nt, Human respiratory syncytial virus
uguauauauaaacaaacaa

SEQ ID NO: 2752497 - RNA, 16 nt, Human respiratory syncytial virus
aaacaacaaugcucaa

SEQ ID NO: 2752498 - RNA, 18 nt, Human respiratory syncytial virus
caaacaaauguccgucag

SEQ ID NO: 2752499 - RNA, 15 nt, Human respiratory syncytial virus
aaucaaucauauaca

SEQ ID NO: 2752500 - RNA, 23 nt, Human respiratory syncytial virus
ugacaacacuacuaugcaaagau

SEQ ID NO: 2752501 - RNA, 15 nt, Human respiratory syncytial virus
uaaagccaauaacau

SEQ ID NO: 2752502 - RNA, 21 nt, Human respiratory syncytial virus
caaaaaauacggggcaaauaa

SEQ ID NO: 2752503 - RNA, 14 nt, Human respiratory syncytial virus
gccaauaacauaaa

SEQ ID NO: 2752504 - RNA, 22 nt, Human respiratory syncytial virus
ugggaaauacauccaucacaau

SEQ ID NO: 2752505 - RNA, 17 nt, Human respiratory syncytial virus
cuaucaccaaugcgaaa

SEQ ID NO: 2752506 - RNA, 18 nt, Human respiratory syncytial virus
ucaacguaguacaggaga

SEQ ID NO: 2752507 - RNA, 22 nt, Human respiratory syncytial virus
aaaugacaacauuacagcaaga

SEQ ID NO: 2752508 - RNA, 16 nt, Human respiratory syncytial virus
caacaucaucaaucca

SEQ ID NO: 2752509 - RNA, 18 nt, Human respiratory syncytial virus
uucaaagaagaucucacc

SEQ ID NO: 2752510 - RNA, 15 nt, Human respiratory syncytial virus
acaacauuacagcaa

SEQ ID NO: 2752511 - RNA, 17 nt, Human respiratory syncytial virus
uacuaauuauaaucacu

SEQ ID NO: 2752512 - RNA, 19 nt, Human respiratory syncytial virus
cacagaaguugggaggaga

SEQ ID NO: 2752513 - RNA, 15 nt, Human respiratory syncytial virus
gugcuuuaagaacag

SEQ ID NO: 2752514 - RNA, 13 nt, Human respiratory syncytial virus
ccaaaaaaaccaa

SEQ ID NO: 2752515 - RNA, 22 nt, Human respiratory syncytial virus
auaugcaaacuuuucaauaauu

SEQ ID NO: 2752516 - RNA, 20 nt, Human respiratory syncytial virus
ugauaacaaugaagaagaau

SEQ ID NO: 2752517 - RNA, 21 nt, Human respiratory syncytial virus
aucuggcaccaacaucaucaa

SEQ ID NO: 2752518 - RNA, 23 nt, Human respiratory syncytial virus
aagaccaauuagugucaaaaaca

SEQ ID NO: 2752519 - RNA, 14 nt, Human respiratory syncytial virus
aagaugcaaauaac

SEQ ID NO: 2752520 - RNA, 16 nt, Human respiratory syncytial virus
guucaaacaauaaaaa

SEQ ID NO: 2752521 - RNA, 19 nt, Human respiratory syncytial virus
acaucaccaauccacacaa

SEQ ID NO: 2752522 - RNA, 17 nt, Human respiratory syncytial virus
ucaugcuacccacacaa

SEQ ID NO: 2752523 - RNA, 14 nt, Human respiratory syncytial virus
cacagaccaacaag

SEQ ID NO: 2752524 - RNA, 23 nt, Human respiratory syncytial virus
acuauucaacguaguacaggaga

SEQ ID NO: 2752525 - RNA, 19 nt, Human respiratory syncytial virus
aucuaauuguaauauccuc

SEQ ID NO: 2752526 - RNA, 21 nt, Human respiratory syncytial virus
caaagauccuaagaagaaaga

SEQ ID NO: 2752527 - RNA, 22 nt, Human respiratory syncytial virus
gaagaugcaaauaacaaagcua

SEQ ID NO: 2752528 - RNA, 20 nt, Human respiratory syncytial virus
uggauaucauguuaaagcua

SEQ ID NO: 2752529 - RNA, 12 nt, Human respiratory syncytial virus
gcaaagccaaaa

SEQ ID NO: 2752530 - RNA, 21 nt, Human respiratory syncytial virus
aucaacucaacccuaaagaag

SEQ ID NO: 2752531 - RNA, 14 nt, Human respiratory syncytial virus
guauaguuggagug

SEQ ID NO: 2752532 - RNA, 15 nt, Human respiratory syncytial virus
caaaccaaccaccaa

SEQ ID NO: 2752533 - RNA, 14 nt, Human respiratory syncytial virus
aucuguaaaacaau

SEQ ID NO: 2752534 - RNA, 17 nt, Human respiratory syncytial virus
ugcaaauaacaaagcua

SEQ ID NO: 2752535 - RNA, 15 nt, Human respiratory syncytial virus
uuagacuuaacagca

SEQ ID NO: 2752536 - RNA, 15 nt, Human respiratory syncytial virus
uauuaugacaucaaa

SEQ ID NO: 2752537 - RNA, 21 nt, Human respiratory syncytial virus
uuucggcuguggaaagcaauc

SEQ ID NO: 2752538 - RNA, 18 nt, Human respiratory syncytial virus
gauaacaaugaagaagaa

SEQ ID NO: 2752539 - RNA, 21 nt, Human respiratory syncytial virus
agcaacucaaagaaaauggag

SEQ ID NO: 2752540 - RNA, 17 nt, Human respiratory syncytial virus
aauggaaaggaaaugaa

SEQ ID NO: 2752541 - RNA, 21 nt, Human respiratory syncytial virus
gcagccaaagcauaugcagag

SEQ ID NO: 2752542 - RNA, 16 nt, Human respiratory syncytial virus
gagaagaaaugauaga

SEQ ID NO: 2752543 - RNA, 13 nt, Human respiratory syncytial virus
acugaaauuauuu

SEQ ID NO: 2752544 - RNA, 15 nt, Human respiratory syncytial virus
gcaaauacaaagaug

SEQ ID NO: 2752545 - RNA, 15 nt, Human respiratory syncytial virus
cuacacuacacacuu

SEQ ID NO: 2752546 - RNA, 16 nt, Human respiratory syncytial virus
guuuauuuuaaaucaa

SEQ ID NO: 2752547 - RNA, 21 nt, Human respiratory syncytial virus
acuaugagcacuacaaaugac

SEQ ID NO: 2752548 - RNA, 12 nt, Human respiratory syncytial virus
ugcaucacuaac

SEQ ID NO: 2752549 - RNA, 13 nt, Human respiratory syncytial virus
caaacaacaaugc

SEQ ID NO: 2752550 - RNA, 23 nt, Human respiratory syncytial virus
gcaaguucgcaucauccaaagau

SEQ ID NO: 2752551 - RNA, 18 nt, Human respiratory syncytial virus
agaucuuaccaugaagac

SEQ ID NO: 2752552 - RNA, 16 nt, Human respiratory syncytial virus
agauccuaagaagaaa

SEQ ID NO: 2752553 - RNA, 24 nt, Human respiratory syncytial virus
aguaccaaauacaagaaauacacu

SEQ ID NO: 2752554 - RNA, 12 nt, Human respiratory syncytial virus
uccacacaaaca

SEQ ID NO: 2752555 - RNA, 14 nt, Human respiratory syncytial virus
gaucaaacaaauga

SEQ ID NO: 2752556 - RNA, 14 nt, Human respiratory syncytial virus
gauaaccaccagcg

SEQ ID NO: 2752557 - RNA, 18 nt, Human respiratory syncytial virus
aacauuacagcaagacua

SEQ ID NO: 2752558 - RNA, 19 nt, Human respiratory syncytial virus
agacuuaggaaugaggaaa

SEQ ID NO: 2752559 - RNA, 20 nt, Human respiratory syncytial virus
auagaaucuagaaaauccua

SEQ ID NO: 2752560 - RNA, 21 nt, Human respiratory syncytial virus
uuaguuaauauaaaaacucau

SEQ ID NO: 2752561 - RNA, 20 nt, Human respiratory syncytial virus
uaaauguaucaauaagcaag

SEQ ID NO: 2752562 - RNA, 15 nt, Human respiratory syncytial virus
aagcaacaaaccaaa

SEQ ID NO: 2752563 - RNA, 19 nt, Human respiratory syncytial virus
cugaagauauauauacaau

SEQ ID NO: 2752564 - RNA, 20 nt, Human respiratory syncytial virus
gaaaucaucacacacaaauu

SEQ ID NO: 2752565 - RNA, 22 nt, Human respiratory syncytial virus
ugaacaucuacacuacacacuu

SEQ ID NO: 2752566 - RNA, 15 nt, Human respiratory syncytial virus
caaaacacaccagcu

SEQ ID NO: 2752567 - RNA, 23 nt, Human respiratory syncytial virus
uauugaacaauccaaaagcauca

SEQ ID NO: 2752568 - RNA, 18 nt, Human respiratory syncytial virus
agaaaauggaguaauaaa

SEQ ID NO: 2752569 - RNA, 19 nt, Human respiratory syncytial virus
aagcuugacaucagaaaua

SEQ ID NO: 2752570 - RNA, 21 nt, Human respiratory syncytial virus
guucuagaaaaagaugaugau

SEQ ID NO: 2752571 - RNA, 12 nt, Human respiratory syncytial virus
aucaaaaacaac

SEQ ID NO: 2752572 - RNA, 12 nt, Human respiratory syncytial virus
aucuuuaugaug

SEQ ID NO: 2752573 - RNA, 20 nt, Human respiratory syncytial virus
aucauaaaggugaacugaaa

SEQ ID NO: 2752574 - RNA, 19 nt, Human respiratory syncytial virus
acacacaauccaacagcaa

SEQ ID NO: 2752575 - RNA, 18 nt, Human respiratory syncytial virus
aagaaacaauagaaacau

SEQ ID NO: 2752576 - RNA, 12 nt, Human respiratory syncytial virus
uuaaagaugcug

SEQ ID NO: 2752577 - RNA, 19 nt, Human respiratory syncytial virus
agcaaauagacaaaaaacc

SEQ ID NO: 2752578 - RNA, 15 nt, Human respiratory syncytial virus
uaauauaaaaacuca

SEQ ID NO: 2752579 - RNA, 17 nt, Human respiratory syncytial virus
acacuucaucacacaaa

SEQ ID NO: 2752580 - RNA, 21 nt, Human respiratory syncytial virus
ugccaacaaccgggccagaag

SEQ ID NO: 2752581 - RNA, 15 nt, Human respiratory syncytial virus
augaugcagccaaag

SEQ ID NO: 2752582 - RNA, 15 nt, Human respiratory syncytial virus
gaaauacaagucaau

SEQ ID NO: 2752583 - RNA, 16 nt, Human respiratory syncytial virus
caccagcugccaacaa

SEQ ID NO: 2752584 - RNA, 20 nt, Human respiratory syncytial virus
caagccgagcacaaaaccac

SEQ ID NO: 2752585 - RNA, 16 nt, Human respiratory syncytial virus
cacccccgaaaacaca

SEQ ID NO: 2752586 - RNA, 18 nt, Human respiratory syncytial virus
ccaccaaaaaaaccaaaa

SEQ ID NO: 2752587 - RNA, 13 nt, Human respiratory syncytial virus
cucucaccaaaga

SEQ ID NO: 2752588 - RNA, 13 nt, Human respiratory syncytial virus
uaaauaaaaccaa

SEQ ID NO: 2752589 - RNA, 21 nt, Human respiratory syncytial virus
agaaacauuugauaacaauga

SEQ ID NO: 2752590 - RNA, 20 nt, Human respiratory syncytial virus
agaugcuggauaucauguua

SEQ ID NO: 2752591 - RNA, 13 nt, Human respiratory syncytial virus
aucacucaguaaa

SEQ ID NO: 2752592 - RNA, 21 nt, Human respiratory syncytial virus
uaacaucuggcaccaacauca

SEQ ID NO: 2752593 - RNA, 14 nt, Human respiratory syncytial virus
gcaauacuaaauaa

SEQ ID NO: 2752594 - RNA, 19 nt, Human respiratory syncytial virus
aacuugcaagcaucaacau

SEQ ID NO: 2752595 - RNA, 12 nt, Human respiratory syncytial virus
aacaucuacacu

SEQ ID NO: 2752596 - RNA, 18 nt, Human respiratory syncytial virus
auguccagguuaggaagg

SEQ ID NO: 2752597 - RNA, 24 nt, Human respiratory syncytial virus
auggcaaaagacaccucagaugaa

SEQ ID NO: 2752598 - RNA, 22 nt, Human respiratory syncytial virus
ucauaaaagaacuugcaagcau

SEQ ID NO: 2752599 - RNA, 19 nt, Human respiratory syncytial virus
gcuaccaaauuccuagaau

SEQ ID NO: 2752600 - RNA, 19 nt, Human respiratory syncytial virus
agagaagaaaugauagaaa

SEQ ID NO: 2752601 - RNA, 17 nt, Human respiratory syncytial virus
uagaucucaagaauuac

SEQ ID NO: 2752602 - RNA, 17 nt, Human respiratory syncytial virus
aaaucuguaaaaaauau

SEQ ID NO: 2752603 - RNA, 19 nt, Human respiratory syncytial virus
aauaagucaacauggagaa

SEQ ID NO: 2752604 - RNA, 11 nt, Human respiratory syncytial virus
accaauuauua

SEQ ID NO: 2752605 - RNA, 18 nt, Human respiratory syncytial virus
uaccauuuuaguuaauau

SEQ ID NO: 2752606 - RNA, 16 nt, Human respiratory syncytial virus
cuaggacagaugcauc

SEQ ID NO: 2752607 - RNA, 16 nt, Human respiratory syncytial virus
uauccaaacaucauga

SEQ ID NO: 2752608 - RNA, 20 nt, Human respiratory syncytial virus
cacugaauauaauacaaaau

SEQ ID NO: 2752609 - RNA, 13 nt, Human respiratory syncytial virus
cacaaacaaacca

SEQ ID NO: 2752610 - RNA, 21 nt, Human respiratory syncytial virus
caacuacuacuuacaaucaau

SEQ ID NO: 2752611 - RNA, 13 nt, Human respiratory syncytial virus
auucacaaaauua

SEQ ID NO: 2752612 - RNA, 18 nt, Human respiratory syncytial virus
aauuagcauaugauguaa

SEQ ID NO: 2752613 - RNA, 15 nt, Human respiratory syncytial virus
aaagcgaaaaaaugg

SEQ ID NO: 2752614 - RNA, 21 nt, Human respiratory syncytial virus
cagcagauuguuggaaaucaa

SEQ ID NO: 2752615 - RNA, 24 nt, Human respiratory syncytial virus
cacuacaaaugacaacacuacuau

SEQ ID NO: 2752616 - RNA, 21 nt, Human respiratory syncytial virus
acaaaccaaucccacucaaaa

SEQ ID NO: 2752617 - RNA, 17 nt, Human respiratory syncytial virus
auuccuagaaucaauaa

SEQ ID NO: 2752618 - RNA, 18 nt, Human respiratory syncytial virus
aaccacgccaacuaucau

SEQ ID NO: 2752619 - RNA, 21 nt, Human respiratory syncytial virus
ucacaguuacugacaauaaag

SEQ ID NO: 2752620 - RNA, 15 nt, Human respiratory syncytial virus
ugaaauucgaaguau

SEQ ID NO: 2752621 - RNA, 20 nt, Human respiratory syncytial virus
uugugauaaugcaggaucag

SEQ ID NO: 2752622 - RNA, 15 nt, Human respiratory syncytial virus
gauaacaaugaagaa

SEQ ID NO: 2752623 - RNA, 13 nt, Human respiratory syncytial virus
auaguuacauaaa

SEQ ID NO: 2752624 - RNA, 18 nt, Human respiratory syncytial virus
aucgucaagauauaaaug

SEQ ID NO: 2752625 - RNA, 15 nt, Human respiratory syncytial virus
cagcggaaccaccaa

SEQ ID NO: 2752626 - RNA, 15 nt, Human respiratory syncytial virus
acgacgaaaaaagaa

SEQ ID NO: 2752627 - RNA, 15 nt, Human respiratory syncytial virus
gcagagcaacucaaa

SEQ ID NO: 2752628 - RNA, 23 nt, Human respiratory syncytial virus
agcauauauuaugugacuacuaa

SEQ ID NO: 2752629 - RNA, 23 nt, Human respiratory syncytial virus
ucgcaaaaccacgccaacuauca

SEQ ID NO: 2752630 - RNA, 13 nt, Human respiratory syncytial virus
agagaagaaauga

SEQ ID NO: 2752631 - RNA, 19 nt, Human respiratory syncytial virus
caaagcauaugcagagcaa

SEQ ID NO: 2752632 - RNA, 16 nt, Human respiratory syncytial virus
cuauaucauccaacca

SEQ ID NO: 2752633 - RNA, 19 nt, Human respiratory syncytial virus
aacaacauaacaaaacaau

SEQ ID NO: 2752634 - RNA, 15 nt, Human respiratory syncytial virus
ggaaaggaaaugaaa

SEQ ID NO: 2752635 - RNA, 15 nt, Human respiratory syncytial virus
aacacccacagcauc

SEQ ID NO: 2752636 - RNA, 20 nt, Human respiratory syncytial virus
augaaguguuugaaaaacac

SEQ ID NO: 2752637 - RNA, 19 nt, Human respiratory syncytial virus
ugaacucacuagaaaacau

SEQ ID NO: 2752638 - RNA, 15 nt, Human respiratory syncytial virus
ugcaagcaucaacau

SEQ ID NO: 2752639 - RNA, 14 nt, Human respiratory syncytial virus
agcaaagucaaguu

SEQ ID NO: 2752640 - RNA, 17 nt, Human respiratory syncytial virus
aaauuacacacaucacc

SEQ ID NO: 2752641 - RNA, 12 nt, Human respiratory syncytial virus
uaaccaccagcg

SEQ ID NO: 2752642 - RNA, 15 nt, Human respiratory syncytial virus
cuucaucacacaaac

SEQ ID NO: 2752643 - RNA, 17 nt, Human respiratory syncytial virus
cugccagaccgaacaaa

SEQ ID NO: 2752644 - RNA, 23 nt, Human respiratory syncytial virus
uggaaaucaacagagaauucagu

SEQ ID NO: 2752645 - RNA, 12 nt, Human respiratory syncytial virus
uuuauuaaauaa

SEQ ID NO: 2752646 - RNA, 18 nt, Human respiratory syncytial virus
aacauuggggcaaaugca

SEQ ID NO: 2752647 - RNA, 15 nt, Human respiratory syncytial virus
aaaagcaucauugcu

SEQ ID NO: 2752648 - RNA, 21 nt, Human respiratory syncytial virus
agcuacucauaugaagagaua

SEQ ID NO: 2752649 - RNA, 13 nt, Human respiratory syncytial virus
ucaacacaucauu

SEQ ID NO: 2752650 - RNA, 16 nt, Human respiratory syncytial virus
acaaauaugaccucaa

SEQ ID NO: 2752651 - RNA, 16 nt, Human respiratory syncytial virus
gcauuuacaacacaac

SEQ ID NO: 2752652 - RNA, 19 nt, Human respiratory syncytial virus
caagccgagcacaaaacca

SEQ ID NO: 2752653 - RNA, 19 nt, Human respiratory syncytial virus
ugaauuucauggagaagau

SEQ ID NO: 2752654 - RNA, 14 nt, Human respiratory syncytial virus
aauacauuaaauaa

SEQ ID NO: 2752655 - RNA, 13 nt, Human respiratory syncytial virus
acauaaugaugaa

SEQ ID NO: 2752656 - RNA, 15 nt, Human respiratory syncytial virus
aaauauggaaacaua

SEQ ID NO: 2752657 - RNA, 22 nt, Human respiratory syncytial virus
aucauggcggguuucuagaaug

SEQ ID NO: 2752658 - RNA, 13 nt, Human respiratory syncytial virus
aagcaagaagagg

SEQ ID NO: 2752659 - RNA, 19 nt, Human respiratory syncytial virus
ccaaaaccacaaacaaaag

SEQ ID NO: 2752660 - RNA, 17 nt, Human respiratory syncytial virus
cagaugcaucaaaucaa

SEQ ID NO: 2752661 - RNA, 17 nt, Human respiratory syncytial virus
cacucccaauuaugaug

SEQ ID NO: 2752662 - RNA, 19 nt, Human respiratory syncytial virus
auuaugacaucaaaaagag

SEQ ID NO: 2752663 - RNA, 22 nt, Human respiratory syncytial virus
guucaaacaauaaaaaaccaca

SEQ ID NO: 2752664 - RNA, 20 nt, Human respiratory syncytial virus
gauauaaauggaaaggaaau

SEQ ID NO: 2752665 - RNA, 23 nt, Human respiratory syncytial virus
aauagguauguuauaugcuaugu

SEQ ID NO: 2752666 - RNA, 19 nt, Human respiratory syncytial virus
caaacuaugagcacuacaa

SEQ ID NO: 2752667 - RNA, 22 nt, Human respiratory syncytial virus
cuggaaauuacacacaucaccu

SEQ ID NO: 2752668 - RNA, 21 nt, Human respiratory syncytial virus
ugcagagcaacucaaagaaaa

SEQ ID NO: 2752669 - RNA, 17 nt, Human respiratory syncytial virus
cugaaaaaaacaucacc

SEQ ID NO: 2752670 - RNA, 18 nt, Human respiratory syncytial virus
acuacagucaaagaucuu

SEQ ID NO: 2752671 - RNA, 22 nt, Human respiratory syncytial virus
aaagcauaugcagagcaacuca

SEQ ID NO: 2752672 - RNA, 15 nt, Human respiratory syncytial virus
acauaaauuggggca

SEQ ID NO: 2752673 - RNA, 12 nt, Human respiratory syncytial virus
ugucauccagca

SEQ ID NO: 2752674 - RNA, 15 nt, Human respiratory syncytial virus
cacccccgaaaacac

SEQ ID NO: 2752675 - RNA, 16 nt, Human respiratory syncytial virus
uaaaaguaaagccaau

SEQ ID NO: 2752676 - RNA, 16 nt, Human respiratory syncytial virus
ucuaaaacuaacaaug

SEQ ID NO: 2752677 - RNA, 20 nt, Human respiratory syncytial virus
uagcuuacugauuccaaaau

SEQ ID NO: 2752678 - RNA, 13 nt, Human respiratory syncytial virus
cuuaacagcagaa

SEQ ID NO: 2752679 - RNA, 17 nt, Human respiratory syncytial virus
aagccaauaacauaaau

SEQ ID NO: 2752680 - RNA, 23 nt, Human respiratory syncytial virus
uagcaaccaccgaauucaaaaau

SEQ ID NO: 2752681 - RNA, 22 nt, Human respiratory syncytial virus
ccaaacaucaugaacaucuaca

SEQ ID NO: 2752682 - RNA, 16 nt, Human respiratory syncytial virus
caagccgagcacaaaa

SEQ ID NO: 2752683 - RNA, 21 nt, Human respiratory syncytial virus
cagccaaagcauaugcagagc

SEQ ID NO: 2752684 - RNA, 13 nt, Human respiratory syncytial virus
auacauuaaauaa

SEQ ID NO: 2752685 - RNA, 20 nt, Human respiratory syncytial virus
ucacaguucaaacaauaaaa

SEQ ID NO: 2752686 - RNA, 21 nt, Human respiratory syncytial virus
agauggcucuuagcaaaguca

SEQ ID NO: 2752687 - RNA, 12 nt, Human respiratory syncytial virus
uucaauacauau

SEQ ID NO: 2752688 - RNA, 20 nt, Human respiratory syncytial virus
gucacaguucaaacaauaaa

SEQ ID NO: 2752689 - RNA, 18 nt, Human respiratory syncytial virus
cauuuggauaaccaccag

SEQ ID NO: 2752690 - RNA, 16 nt, Human respiratory syncytial virus
acuacaccuugugaaa

SEQ ID NO: 2752691 - RNA, 15 nt, Human respiratory syncytial virus
ugaaauaaaacgcua

SEQ ID NO: 2752692 - RNA, 20 nt, Human respiratory syncytial virus
cauggugucgcaaaaccacg

SEQ ID NO: 2752693 - RNA, 14 nt, Human respiratory syncytial virus
auaauaaauuacua

SEQ ID NO: 2752694 - RNA, 15 nt, Human respiratory syncytial virus
agggcaaguaaugcu

SEQ ID NO: 2752695 - RNA, 18 nt, Human respiratory syncytial virus
ucauccagcaaauacacu

SEQ ID NO: 2752696 - RNA, 18 nt, Human respiratory syncytial virus
ggauaucauguuaaagcu

SEQ ID NO: 2752697 - RNA, 21 nt, Human respiratory syncytial virus
aaauauggaaacauacgugaa

SEQ ID NO: 2752698 - RNA, 19 nt, Human respiratory syncytial virus
uaguuagaguucaaucaau

SEQ ID NO: 2752699 - RNA, 21 nt, Human respiratory syncytial virus
caacaaccgggccagaagaga

SEQ ID NO: 2752700 - RNA, 18 nt, Human respiratory syncytial virus
caaaggcagaaccaccac

SEQ ID NO: 2752701 - RNA, 19 nt, Human respiratory syncytial virus
uaacaaugauacaugugca

SEQ ID NO: 2752702 - RNA, 23 nt, Human respiratory syncytial virus
gauuaauagguauguuauaugcu

SEQ ID NO: 2752703 - RNA, 21 nt, Human respiratory syncytial virus
agggaagacacuauaaagaua

SEQ ID NO: 2752704 - RNA, 20 nt, Human respiratory syncytial virus
caagauauaaauggaaagga

SEQ ID NO: 2752705 - RNA, 21 nt, Human respiratory syncytial virus
aaguugggaggagaagcugga

SEQ ID NO: 2752706 - RNA, 21 nt, Human respiratory syncytial virus
aaucacugaagaugcaaauca

SEQ ID NO: 2752707 - RNA, 12 nt, Human respiratory syncytial virus
uaugcaaagauu

SEQ ID NO: 2752708 - RNA, 21 nt, Human respiratory syncytial virus
ggauucaauaauaacaucucu

SEQ ID NO: 2752709 - RNA, 17 nt, Human respiratory syncytial virus
uaaauaaccaauuauua

SEQ ID NO: 2752710 - RNA, 16 nt, Human respiratory syncytial virus
acccuaaagaagauga

SEQ ID NO: 2752711 - RNA, 18 nt, Human respiratory syncytial virus
aucaagcuugacaucaga

SEQ ID NO: 2752712 - RNA, 18 nt, Human respiratory syncytial virus
ccacaaacaaaccaacca

SEQ ID NO: 2752713 - RNA, 15 nt, Human respiratory syncytial virus
auugaugaaaaauua

SEQ ID NO: 2752714 - RNA, 15 nt, Human respiratory syncytial virus
uaauauacaaauaug

SEQ ID NO: 2752715 - RNA, 19 nt, Human respiratory syncytial virus
gaucugaacucacuagaaa

SEQ ID NO: 2752716 - RNA, 14 nt, Human respiratory syncytial virus
augauacaugugca

SEQ ID NO: 2752717 - RNA, 23 nt, Human respiratory syncytial virus
aaacaauaaaaaaccacacugaa

SEQ ID NO: 2752718 - RNA, 15 nt, Human respiratory syncytial virus
caauuuauauacaaa

SEQ ID NO: 2752719 - RNA, 17 nt, Human respiratory syncytial virus
ugagagaagaaaugaua

SEQ ID NO: 2752720 - RNA, 18 nt, Human respiratory syncytial virus
acaagauggggcaaauau

SEQ ID NO: 2752721 - RNA, 22 nt, Human respiratory syncytial virus
caagcuauuccucaaacaacaa

SEQ ID NO: 2752722 - RNA, 15 nt, Human respiratory syncytial virus
gggcaaauaagucaa

SEQ ID NO: 2752723 - RNA, 17 nt, Human respiratory syncytial virus
cagagcaacucaaagaa

SEQ ID NO: 2752724 - RNA, 15 nt, Human respiratory syncytial virus
uucaucacacaaacc

SEQ ID NO: 2752725 - RNA, 19 nt, Human respiratory syncytial virus
guuuuucaaucaaaccacu

SEQ ID NO: 2752726 - RNA, 17 nt, Human respiratory syncytial virus
aagacuagauagaauug

SEQ ID NO: 2752727 - RNA, 20 nt, Human respiratory syncytial virus
auuucauggagaagaugcaa

SEQ ID NO: 2752728 - RNA, 14 nt, Human respiratory syncytial virus
aaaugaucaaacaa

SEQ ID NO: 2752729 - RNA, 19 nt, Human respiratory syncytial virus
aaugaucaaacaaaugaca

SEQ ID NO: 2752730 - RNA, 13 nt, Human respiratory syncytial virus
acaaaaaaaccaa

SEQ ID NO: 2752731 - RNA, 15 nt, Human respiratory syncytial virus
aauuaacauaaugau

SEQ ID NO: 2752732 - RNA, 20 nt, Human respiratory syncytial virus
caaauuagcagcaggagaca

SEQ ID NO: 2752733 - RNA, 15 nt, Human respiratory syncytial virus
cagacuugcucauaa

SEQ ID NO: 2752734 - RNA, 23 nt, Human respiratory syncytial virus
uuuaugaaguguuugaaaaacac

SEQ ID NO: 2752735 - RNA, 14 nt, Human respiratory syncytial virus
uuaaaaauaaaagu

SEQ ID NO: 2752736 - RNA, 21 nt, Human respiratory syncytial virus
caaaacacacuccuauaauau

SEQ ID NO: 2752737 - RNA, 19 nt, Human respiratory syncytial virus
uuaagcccaacaauaauuc

SEQ ID NO: 2752738 - RNA, 21 nt, Human respiratory syncytial virus
gcagacuugcucauaaaagaa

SEQ ID NO: 2752739 - RNA, 22 nt, Human respiratory syncytial virus
auguccagguuaggaagggaag

SEQ ID NO: 2752740 - RNA, 15 nt, Human respiratory syncytial virus
uacuaugcaaagauu

SEQ ID NO: 2752741 - RNA, 14 nt, Human respiratory syncytial virus
augaacuauacaau

SEQ ID NO: 2752742 - RNA, 13 nt, Human respiratory syncytial virus
cagcugcugucau

SEQ ID NO: 2752743 - RNA, 14 nt, Human respiratory syncytial virus
gugaacauaaaaca

SEQ ID NO: 2752744 - RNA, 14 nt, Human respiratory syncytial virus
agucaacauggaga

SEQ ID NO: 2752745 - RNA, 18 nt, Human respiratory syncytial virus
uaaaacuuauaaaacaag

SEQ ID NO: 2752746 - RNA, 18 nt, Human respiratory syncytial virus
acauuggggcaaaugcaa

SEQ ID NO: 2752747 - RNA, 16 nt, Human respiratory syncytial virus
aguuaacaaaaaauac

SEQ ID NO: 2752748 - RNA, 17 nt, Human respiratory syncytial virus
aagauccuaagaagaaa

SEQ ID NO: 2752749 - RNA, 18 nt, Human respiratory syncytial virus
aaacaaacuaugugguau

SEQ ID NO: 2752750 - RNA, 19 nt, Human respiratory syncytial virus
caauuaugagaugaagcua

SEQ ID NO: 2752751 - RNA, 17 nt, Human respiratory syncytial virus
caaaccaaccaccaaaa

SEQ ID NO: 2752752 - RNA, 19 nt, Human respiratory syncytial virus
cauagugcucuaccaucau

SEQ ID NO: 2752753 - RNA, 15 nt, Human respiratory syncytial virus
ggcauaaugggagag

SEQ ID NO: 2752754 - RNA, 18 nt, Human respiratory syncytial virus
acuuaugcaaaacacacc

SEQ ID NO: 2752755 - RNA, 19 nt, Human respiratory syncytial virus
uuaaguuaacaaaaaauac

SEQ ID NO: 2752756 - RNA, 21 nt, Human respiratory syncytial virus
guuaaaugauacauuaaauaa

SEQ ID NO: 2752757 - RNA, 18 nt, Human respiratory syncytial virus
aaauaaaaguaaagccaa

SEQ ID NO: 2752758 - RNA, 19 nt, Human respiratory syncytial virus
ugcaaaucauaaauucaca

SEQ ID NO: 2752759 - RNA, 14 nt, Human respiratory syncytial virus
cuaauacauaugau

SEQ ID NO: 2752760 - RNA, 11 nt, Human respiratory syncytial virus
caaucaaucaa

SEQ ID NO: 2752761 - RNA, 16 nt, Human respiratory syncytial virus
auagacauguguuuau

SEQ ID NO: 2752762 - RNA, 18 nt, Human respiratory syncytial virus
uagaaguaaccaaagaga

SEQ ID NO: 2752763 - RNA, 20 nt, Human respiratory syncytial virus
ccaggaucuuuaugaugcag

SEQ ID NO: 2752764 - RNA, 15 nt, Human respiratory syncytial virus
gaaguaaccaaagag

SEQ ID NO: 2752765 - RNA, 20 nt, Human respiratory syncytial virus
cacugugcucgacacaacca

SEQ ID NO: 2752766 - RNA, 16 nt, Human respiratory syncytial virus
aguaacaaaaaaagaa

SEQ ID NO: 2752767 - RNA, 11 nt, Human respiratory syncytial virus
gccuacaaaac

SEQ ID NO: 2752768 - RNA, 21 nt, Human respiratory syncytial virus
gaugcaucaaaucaacacaua

SEQ ID NO: 2752769 - RNA, 14 nt, Human respiratory syncytial virus
uauguuauaugcua

SEQ ID NO: 2752770 - RNA, 18 nt, Human respiratory syncytial virus
auuagacuuaacagcaga

SEQ ID NO: 2752771 - RNA, 20 nt, Human respiratory syncytial virus
ugcuauuaaucacugaagau

SEQ ID NO: 2752772 - RNA, 15 nt, Human respiratory syncytial virus
auauaaauggaaagg

SEQ ID NO: 2752773 - RNA, 18 nt, Human respiratory syncytial virus
cagcaggagacagaucag

SEQ ID NO: 2752774 - RNA, 14 nt, Human respiratory syncytial virus
uaauccguuuuagu

SEQ ID NO: 2752775 - RNA, 15 nt, Human respiratory syncytial virus
uagaauucacaagca

SEQ ID NO: 2752776 - RNA, 19 nt, Human respiratory syncytial virus
agauauagaaguaaccaaa

SEQ ID NO: 2752777 - RNA, 12 nt, Human respiratory syncytial virus
augcuaaaagag

SEQ ID NO: 2752778 - RNA, 14 nt, Human respiratory syncytial virus
gaugcaaauaacaa

SEQ ID NO: 2752779 - RNA, 19 nt, Human respiratory syncytial virus
aaauccuacaaaaaaaugc

SEQ ID NO: 2752780 - RNA, 17 nt, Human respiratory syncytial virus
aaucacuaccagccacu

SEQ ID NO: 2752781 - RNA, 20 nt, Human respiratory syncytial virus
aaucuagcuacucauaugaa

SEQ ID NO: 2752782 - RNA, 12 nt, Human respiratory syncytial virus
ucgcaaaaccac

SEQ ID NO: 2752783 - RNA, 22 nt, Human respiratory syncytial virus
auucuuagucaauuaugagaug

SEQ ID NO: 2752784 - RNA, 16 nt, Human respiratory syncytial virus
acauuaaaaagcugag

SEQ ID NO: 2752785 - RNA, 13 nt, Human respiratory syncytial virus
gaucaaacaaaug

SEQ ID NO: 2752786 - RNA, 14 nt, Human respiratory syncytial virus
auaucgaucaaaug

SEQ ID NO: 2752787 - RNA, 14 nt, Human respiratory syncytial virus
uaaguauaagaaug

SEQ ID NO: 2752788 - RNA, 22 nt, Human respiratory syncytial virus
aauggaguagauauaacaacau

SEQ ID NO: 2752789 - RNA, 22 nt, Human respiratory syncytial virus
uuaagcccaacaauaauucagg

SEQ ID NO: 2752790 - RNA, 20 nt, Human respiratory syncytial virus
uggaguagauauaacaacau

SEQ ID NO: 2752791 - RNA, 22 nt, Human respiratory syncytial virus
caaguucgcaucauccaaagau

SEQ ID NO: 2752792 - RNA, 21 nt, Human respiratory syncytial virus
aauaacaucucucaccaaaga

SEQ ID NO: 2752793 - RNA, 13 nt, Human respiratory syncytial virus
aucaaacacuaaa

SEQ ID NO: 2752794 - RNA, 21 nt, Human respiratory syncytial virus
aacacaccacacaacagcaca

SEQ ID NO: 2752795 - RNA, 17 nt, Human respiratory syncytial virus
ucauguuucaacaacag

SEQ ID NO: 2752796 - RNA, 17 nt, Human respiratory syncytial virus
ugaugcagccaaagcau

SEQ ID NO: 2752797 - RNA, 22 nt, Human respiratory syncytial virus
aacugccagaccgaacaaacaa

SEQ ID NO: 2752798 - RNA, 21 nt, Human respiratory syncytial virus
auuagacuuaacagcagaaga

SEQ ID NO: 2752799 - RNA, 14 nt, Human respiratory syncytial virus
cuacaaaaaaaugc

SEQ ID NO: 2752800 - RNA, 18 nt, Human respiratory syncytial virus
agcaagacuagauagaau

SEQ ID NO: 2752801 - RNA, 16 nt, Human respiratory syncytial virus
aacuacagucaaagau

SEQ ID NO: 2752802 - RNA, 12 nt, Human respiratory syncytial virus
ucagcaaucaac

SEQ ID NO: 2752803 - RNA, 12 nt, Human respiratory syncytial virus
auuccaaaauua

SEQ ID NO: 2752804 - RNA, 18 nt, Human respiratory syncytial virus
ccaggcagaaauggagca

SEQ ID NO: 2752805 - RNA, 19 nt, Human respiratory syncytial virus
gcaauagaaaaaacaacaa

SEQ ID NO: 2752806 - RNA, 21 nt, Human respiratory syncytial virus
aaauuggggcaaauacaaaga

SEQ ID NO: 2752807 - RNA, 17 nt, Human respiratory syncytial virus
agcuacucauaugaaga

SEQ ID NO: 2752808 - RNA, 21 nt, Human respiratory syncytial virus
gcauaauaucuguuaacucaa

SEQ ID NO: 2752809 - RNA, 16 nt, Human respiratory syncytial virus
agaaauacacugaaua

SEQ ID NO: 2752810 - RNA, 12 nt, Human respiratory syncytial virus
ucacaauuauuu

SEQ ID NO: 2752811 - RNA, 20 nt, Human respiratory syncytial virus
gaaugacagguccacauaua

SEQ ID NO: 2752812 - RNA, 15 nt, Human respiratory syncytial virus
caggcagaaauggag

SEQ ID NO: 2752813 - RNA, 17 nt, Human respiratory syncytial virus
aucaacaacaucaauaa

SEQ ID NO: 2752814 - RNA, 20 nt, Human respiratory syncytial virus
caaaccaaaggcagaaccac

SEQ ID NO: 2752815 - RNA, 17 nt, Human respiratory syncytial virus
aaucacugaagaugcaa

SEQ ID NO: 2752816 - RNA, 14 nt, Human respiratory syncytial virus
ucaacauggagaag

SEQ ID NO: 2752817 - RNA, 14 nt, Human respiratory syncytial virus
cagauuaaauuuaa

SEQ ID NO: 2752818 - RNA, 14 nt, Human respiratory syncytial virus
aaguaaugcuaaga

SEQ ID NO: 2752819 - RNA, 19 nt, Human respiratory syncytial virus
agaccgaacaaacaaaugu

SEQ ID NO: 2752820 - RNA, 15 nt, Human respiratory syncytial virus
uuucuucacaucaug

SEQ ID NO: 2752821 - RNA, 17 nt, Human respiratory syncytial virus
ugucauccagcaaauac

SEQ ID NO: 2752822 - RNA, 22 nt, Human respiratory syncytial virus
agcauaugaaucuuaaaaaacu

SEQ ID NO: 2752823 - RNA, 22 nt, Human respiratory syncytial virus
caacaacaucaauaaaacagac

SEQ ID NO: 2752824 - RNA, 16 nt, Human respiratory syncytial virus
caaauauaucaagcca

SEQ ID NO: 2752825 - RNA, 17 nt, Human respiratory syncytial virus
cugcaucacuaacaaua

SEQ ID NO: 2752826 - RNA, 18 nt, Human respiratory syncytial virus
ugcucaauaguuaagaag

SEQ ID NO: 2752827 - RNA, 14 nt, Human respiratory syncytial virus
auuaaugaucacgg

SEQ ID NO: 2752828 - RNA, 14 nt, Human respiratory syncytial virus
acauacacagcagc

SEQ ID NO: 2752829 - RNA, 18 nt, Human respiratory syncytial virus
auagaaguaaccaaagag

SEQ ID NO: 2752830 - RNA, 13 nt, Human respiratory syncytial virus
auauaaauggaaa

SEQ ID NO: 2752831 - RNA, 14 nt, Human respiratory syncytial virus
auaaugaugaauua

SEQ ID NO: 2752832 - RNA, 18 nt, Human respiratory syncytial virus
ucaaacaaaugacaacau

SEQ ID NO: 2752833 - RNA, 17 nt, Human respiratory syncytial virus
ucaaaaugaccaaacca

SEQ ID NO: 2752834 - RNA, 12 nt, Human respiratory syncytial virus
auuucauggaga

SEQ ID NO: 2752835 - RNA, 18 nt, Human respiratory syncytial virus
ucaaguaucacaaucaaa

SEQ ID NO: 2752836 - RNA, 14 nt, Human respiratory syncytial virus
ggacucuagaaaag

SEQ ID NO: 2752837 - RNA, 12 nt, Human respiratory syncytial virus
gcaucaaaucaa

SEQ ID NO: 2752838 - RNA, 14 nt, Human respiratory syncytial virus
cugacgaaauuaac

SEQ ID NO: 2752839 - RNA, 20 nt, Human respiratory syncytial virus
uaauacuguguauagcagca

SEQ ID NO: 2752840 - RNA, 21 nt, Human respiratory syncytial virus
aaaaccccuaguaagcuucaa

SEQ ID NO: 2752841 - RNA, 17 nt, Human respiratory syncytial virus
uauagaaguaaccaaag

SEQ ID NO: 2752842 - RNA, 18 nt, Human respiratory syncytial virus
guuacugacaauaaagga

SEQ ID NO: 2752843 - RNA, 18 nt, Human respiratory syncytial virus
aacacuacuaugcaaaga

SEQ ID NO: 2752844 - RNA, 15 nt, Human respiratory syncytial virus
auucgaaguauuaac

SEQ ID NO: 2752845 - RNA, 15 nt, Human respiratory syncytial virus
ucaaacccacaaaca

SEQ ID NO: 2752846 - RNA, 15 nt, Human respiratory syncytial virus
aaaacaccuaaacaa

SEQ ID NO: 2752847 - RNA, 23 nt, Human respiratory syncytial virus
ugaacucacuagaaaacauagca

SEQ ID NO: 2752848 - RNA, 22 nt, Human respiratory syncytial virus
auagcuaacaguuuuuaugaag

SEQ ID NO: 2752849 - RNA, 20 nt, Human respiratory syncytial virus
ugaucaacucacucagcaau

SEQ ID NO: 2752850 - RNA, 14 nt, Human respiratory syncytial virus
ucaucacacacaaa

SEQ ID NO: 2752851 - RNA, 16 nt, Human respiratory syncytial virus
uuaggagggcaaacaa

SEQ ID NO: 2752852 - RNA, 17 nt, Human respiratory syncytial virus
cacacaaaccaauccca

SEQ ID NO: 2752853 - RNA, 20 nt, Human respiratory syncytial virus
gcuacacguuuuucaaucaa

SEQ ID NO: 2752854 - RNA, 16 nt, Human respiratory syncytial virus
uacacacuucaucaca

SEQ ID NO: 2752855 - RNA, 18 nt, Human respiratory syncytial virus
aucacaauagaauucaca

SEQ ID NO: 2752856 - RNA, 13 nt, Human respiratory syncytial virus
uaaauaaggauca

SEQ ID NO: 2752857 - RNA, 21 nt, Human respiratory syncytial virus
uacuaugcaaagauuaaugau

SEQ ID NO: 2752858 - RNA, 22 nt, Human respiratory syncytial virus
cugaaucauuucuucacaucau

SEQ ID NO: 2752859 - RNA, 14 nt, Human respiratory syncytial virus
auacaaauaugacc

SEQ ID NO: 2752860 - RNA, 17 nt, Human respiratory syncytial virus
gaaagauagcauaauau

SEQ ID NO: 2752861 - RNA, 22 nt, Human respiratory syncytial virus
acugaaugacagguccacauau

SEQ ID NO: 2752862 - RNA, 16 nt, Human respiratory syncytial virus
cagaccgaacaaacaa

SEQ ID NO: 2752863 - RNA, 17 nt, Human respiratory syncytial virus
agucagucuaucaaaug

SEQ ID NO: 2752864 - RNA, 22 nt, Human respiratory syncytial virus
agauggggaguuuuagccaaau

SEQ ID NO: 2752865 - RNA, 15 nt, Human respiratory syncytial virus
aauaaacuaggacua

SEQ ID NO: 2752866 - RNA, 23 nt, Human respiratory syncytial virus
gagauagaaucuagaaaauccua

SEQ ID NO: 2752867 - RNA, 17 nt, Human respiratory syncytial virus
augauacauuaaauaag

SEQ ID NO: 2752868 - RNA, 22 nt, Human respiratory syncytial virus
aucgucaagauauaaauggaaa

SEQ ID NO: 2752869 - RNA, 16 nt, Human respiratory syncytial virus
aggauauagcuaacag

SEQ ID NO: 2752870 - RNA, 17 nt, Human respiratory syncytial virus
cuacaaccacaucacca

SEQ ID NO: 2752871 - RNA, 15 nt, Human respiratory syncytial virus
agucagaaacacacc

SEQ ID NO: 2752872 - RNA, 17 nt, Human respiratory syncytial virus
ccacaaacaaaagagac

SEQ ID NO: 2752873 - RNA, 17 nt, Human respiratory syncytial virus
ugaaaucaaagcaugca

SEQ ID NO: 2752874 - RNA, 18 nt, Human respiratory syncytial virus
aggaagggaagacacuau

SEQ ID NO: 2752875 - RNA, 13 nt, Human respiratory syncytial virus
aucacuaacaaua

SEQ ID NO: 2752876 - RNA, 13 nt, Human respiratory syncytial virus
auaaguggagcug

SEQ ID NO: 2752877 - RNA, 15 nt, Human respiratory syncytial virus
gucugagagaagaaa

SEQ ID NO: 2752878 - RNA, 19 nt, Human respiratory syncytial virus
auuuuugaucagugaucaa

SEQ ID NO: 2752879 - RNA, 23 nt, Human respiratory syncytial virus
gauuaaauuuaauuaucaacacu

SEQ ID NO: 2752880 - RNA, 22 nt, Human respiratory syncytial virus
auagcaagugguauagcuguau

SEQ ID NO: 2752881 - RNA, 15 nt, Human respiratory syncytial virus
cagcaaauacacuau

SEQ ID NO: 2752882 - RNA, 14 nt, Human respiratory syncytial virus
auacucucaaucau

SEQ ID NO: 2752883 - RNA, 17 nt, Human respiratory syncytial virus
caaaaaucacucaguaa

SEQ ID NO: 2752884 - RNA, 20 nt, Human respiratory syncytial virus
gucuaggcauaaugggagag

SEQ ID NO: 2752885 - RNA, 16 nt, Human respiratory syncytial virus
uaaagaagaugaugua

SEQ ID NO: 2752886 - RNA, 17 nt, Human respiratory syncytial virus
cacguuuuucaaucaaa

SEQ ID NO: 2752887 - RNA, 15 nt, Human respiratory syncytial virus
ggaagccauaaagaa

SEQ ID NO: 2752888 - RNA, 24 nt, Human respiratory syncytial virus
auuuauaccgccaauucaauacau

SEQ ID NO: 2752889 - RNA, 21 nt, Human respiratory syncytial virus
aaaucaucacacacaaauuca

SEQ ID NO: 2752890 - RNA, 13 nt, Human respiratory syncytial virus
aaaaagaacaaga

SEQ ID NO: 2752891 - RNA, 15 nt, Human respiratory syncytial virus
auuuacaacacaacg

SEQ ID NO: 2752892 - RNA, 12 nt, Human respiratory syncytial virus
gcaacaaucaac

SEQ ID NO: 2752893 - RNA, 21 nt, Human respiratory syncytial virus
ugcuuuguuaucuacaaacaa

SEQ ID NO: 2752894 - RNA, 15 nt, Human respiratory syncytial virus
aauuggaagccauaa

SEQ ID NO: 2752895 - RNA, 19 nt, Human respiratory syncytial virus
cuuaccaugaagacauuca

SEQ ID NO: 2752896 - RNA, 16 nt, Human respiratory syncytial virus
aacaucaucaauccaa

SEQ ID NO: 2752897 - RNA, 22 nt, Human respiratory syncytial virus
acaaaguagggaguaccaaaua

SEQ ID NO: 2752898 - RNA, 15 nt, Human respiratory syncytial virus
acuugcaagcaucaa

SEQ ID NO: 2752899 - RNA, 22 nt, Human respiratory syncytial virus
aaacacacccaacuccacacaa

SEQ ID NO: 2752900 - RNA, 23 nt, Human respiratory syncytial virus
uacauaggaucuauaaacaacau

SEQ ID NO: 2752901 - RNA, 23 nt, Human respiratory syncytial virus
aaaguguuagaucucaagaauua

SEQ ID NO: 2752902 - RNA, 23 nt, Human respiratory syncytial virus
caaaaaugcuaucaccaaugcga

SEQ ID NO: 2752903 - RNA, 15 nt, Human respiratory syncytial virus
agaaaccaaagccaa

SEQ ID NO: 2752904 - RNA, 22 nt, Human respiratory syncytial virus
gauggcucuuagcaaagucaag

SEQ ID NO: 2752905 - RNA, 23 nt, Human respiratory syncytial virus
ucaaagggaaauggggcaaauaa

SEQ ID NO: 2752906 - RNA, 19 nt, Human respiratory syncytial virus
cugccagaccgaacaaaca

SEQ ID NO: 2752907 - RNA, 14 nt, Human respiratory syncytial virus
augauaugccuaua

SEQ ID NO: 2752908 - RNA, 17 nt, Human respiratory syncytial virus
uuaaagcuaauggagua

SEQ ID NO: 2752909 - RNA, 14 nt, Human respiratory syncytial virus
ugguaugcuauuaa

SEQ ID NO: 2752910 - RNA, 18 nt, Human respiratory syncytial virus
gccgagcacaaaaccacg

SEQ ID NO: 2752911 - RNA, 21 nt, Human respiratory syncytial virus
acaucacccaacacaaaguca

SEQ ID NO: 2752912 - RNA, 19 nt, Human respiratory syncytial virus
auucuaccauauauugaac

SEQ ID NO: 2752913 - RNA, 14 nt, Human respiratory syncytial virus
caacagcacaaacc

SEQ ID NO: 2752914 - RNA, 21 nt, Human respiratory syncytial virus
uuauguuuagucuaacucaau

SEQ ID NO: 2752915 - RNA, 18 nt, Human respiratory syncytial virus
caacguaguacaggagau

SEQ ID NO: 2752916 - RNA, 12 nt, Human respiratory syncytial virus
aagaagaaagau

SEQ ID NO: 2752917 - RNA, 15 nt, Human respiratory syncytial virus
auuaugaugugcaaa

SEQ ID NO: 2752918 - RNA, 20 nt, Human respiratory syncytial virus
cauuuggauaaccaccagcg

SEQ ID NO: 2752919 - RNA, 19 nt, Human respiratory syncytial virus
caaaaaaagaacaagaugg

SEQ ID NO: 2752920 - RNA, 12 nt, Human respiratory syncytial virus
caaaaaaaccaa

SEQ ID NO: 2752921 - RNA, 18 nt, Human respiratory syncytial virus
acacucccaauuaugaug

SEQ ID NO: 2752922 - RNA, 19 nt, Human respiratory syncytial virus
aauuacuuggauaaguaau

SEQ ID NO: 2752923 - RNA, 17 nt, Human respiratory syncytial virus
caggacucuagaaaaga

SEQ ID NO: 2752924 - RNA, 16 nt, Human respiratory syncytial virus
accaaccaaucaauca

SEQ ID NO: 2752925 - RNA, 23 nt, Human respiratory syncytial virus
ugcgaauagguaaauaaaaccaa

SEQ ID NO: 2752926 - RNA, 17 nt, Human respiratory syncytial virus
aucaacucacucagcaa

SEQ ID NO: 2752927 - RNA, 17 nt, Human respiratory syncytial virus
acacuacuaugcaaaga

SEQ ID NO: 2752928 - RNA, 15 nt, Human respiratory syncytial virus
uacaaccacaucacc

SEQ ID NO: 2752929 - RNA, 23 nt, Human respiratory syncytial virus
caaagaaaucaucacacacaaau

SEQ ID NO: 2752930 - RNA, 20 nt, Human respiratory syncytial virus
gcaaagucaaguuaaaugau

SEQ ID NO: 2752931 - RNA, 15 nt, Human respiratory syncytial virus
auaaccauggagcug

SEQ ID NO: 2752932 - RNA, 20 nt, Human respiratory syncytial virus
cacuaaaucaacacaucauu

SEQ ID NO: 2752933 - RNA, 14 nt, Human respiratory syncytial virus
caucaaaaacagac

SEQ ID NO: 2752934 - RNA, 14 nt, Human respiratory syncytial virus
aauuggaagccaua

SEQ ID NO: 2752935 - RNA, 17 nt, Human respiratory syncytial virus
uucauggagaagaugca

SEQ ID NO: 2752936 - RNA, 17 nt, Human respiratory syncytial virus
caauuuauauacaaaau

SEQ ID NO: 2752937 - RNA, 15 nt, Human respiratory syncytial virus
cagaccgaacaaaca

SEQ ID NO: 2752938 - RNA, 21 nt, Human respiratory syncytial virus
aaacaacauuggggcaaaugc

SEQ ID NO: 2752939 - RNA, 16 nt, Human respiratory syncytial virus
aauuaucaacacugaa

SEQ ID NO: 2752940 - RNA, 17 nt, Human respiratory syncytial virus
ucaaacuaugagcacua

SEQ ID NO: 2752941 - RNA, 20 nt, Human respiratory syncytial virus
gaacaauccaaaagcaucau

SEQ ID NO: 2752942 - RNA, 15 nt, Human respiratory syncytial virus
aucuguaccagcaga

SEQ ID NO: 2752943 - RNA, 23 nt, Human respiratory syncytial virus
caauaauaacaucucucaccaaa

SEQ ID NO: 2752944 - RNA, 17 nt, Human respiratory syncytial virus
gcaaauuagcauaugau

SEQ ID NO: 2752945 - RNA, 13 nt, Human respiratory syncytial virus
guuuuuaugaagu

SEQ ID NO: 2752946 - RNA, 17 nt, Human respiratory syncytial virus
cuaugagcacuacaaau

SEQ ID NO: 2752947 - RNA, 16 nt, Human respiratory syncytial virus
cuaacaaugauacaug

SEQ ID NO: 2752948 - RNA, 18 nt, Human respiratory syncytial virus
uggcauuaagccuacaaa

SEQ ID NO: 2752949 - RNA, 17 nt, Human respiratory syncytial virus
ucaccaauccacacaaa

SEQ ID NO: 2752950 - RNA, 14 nt, Human respiratory syncytial virus
ccacagaaagagac

SEQ ID NO: 2752951 - RNA, 17 nt, Human respiratory syncytial virus
uauuagacuuaacagca

SEQ ID NO: 2752952 - RNA, 18 nt, Human respiratory syncytial virus
caaauuuagaugcuaaca

SEQ ID NO: 2752953 - RNA, 18 nt, Human respiratory syncytial virus
cugaaaaaaacaucacca

SEQ ID NO: 2752954 - RNA, 18 nt, Human respiratory syncytial virus
gaagccauaaagaaucaa

SEQ ID NO: 2752955 - RNA, 23 nt, Human respiratory syncytial virus
caauaccaagcaacaaaccaaag

SEQ ID NO: 2752956 - RNA, 12 nt, Human respiratory syncytial virus
aaacuacacacu

SEQ ID NO: 2752957 - RNA, 15 nt, Human respiratory syncytial virus
aaacaaggaucugaa

SEQ ID NO: 2752958 - RNA, 15 nt, Human respiratory syncytial virus
auauauccucaaacu

SEQ ID NO: 2752959 - RNA, 19 nt, Human respiratory syncytial virus
ucauggagaagaugcaaau

SEQ ID NO: 2752960 - RNA, 17 nt, Human respiratory syncytial virus
aaaauuaacauaaugau

SEQ ID NO: 2752961 - RNA, 21 nt, Human respiratory syncytial virus
agcauaugcagagcaacucaa

SEQ ID NO: 2752962 - RNA, 19 nt, Human respiratory syncytial virus
acuaugcaaagauuaauga

SEQ ID NO: 2752963 - RNA, 20 nt, Human respiratory syncytial virus
agauccuaagaagaaagaua

SEQ ID NO: 2752964 - RNA, 18 nt, Human respiratory syncytial virus
aagucaaguuaaaugaua

SEQ ID NO: 2752965 - RNA, 14 nt, Human respiratory syncytial virus
guauguuauaugcu

SEQ ID NO: 2752966 - RNA, 13 nt, Human respiratory syncytial virus
auuagaacacaca

SEQ ID NO: 2752967 - RNA, 19 nt, Human respiratory syncytial virus
cuaaagaagaugauguaga

SEQ ID NO: 2752968 - RNA, 16 nt, Human respiratory syncytial virus
aucugaugaauuacua

SEQ ID NO: 2752969 - RNA, 18 nt, Human respiratory syncytial virus
uaaaagaacuugcaagca

SEQ ID NO: 2752970 - RNA, 24 nt, Human respiratory syncytial virus
gugcaaaaacaccuaaacaaacua

SEQ ID NO: 2752971 - RNA, 22 nt, Human respiratory syncytial virus
acugccagaccgaacaaacaaa

SEQ ID NO: 2752972 - RNA, 16 nt, Human respiratory syncytial virus
agguauguuauaugcu

SEQ ID NO: 2752973 - RNA, 15 nt, Human respiratory syncytial virus
aauucaaaaaugcua

SEQ ID NO: 2752974 - RNA, 19 nt, Human respiratory syncytial virus
caaagucaaguuaaaugau

SEQ ID NO: 2752975 - RNA, 20 nt, Human respiratory syncytial virus
ugccucuuaauccaacuucc

SEQ ID NO: 2752976 - RNA, 20 nt, Human respiratory syncytial virus
uaauaaccaaauuagcagca

SEQ ID NO: 2752977 - RNA, 13 nt, Human respiratory syncytial virus
aaagaaaauggag

SEQ ID NO: 2752978 - RNA, 15 nt, Human respiratory syncytial virus
auauuuaucaaucau

SEQ ID NO: 2752979 - RNA, 19 nt, Human respiratory syncytial virus
gcaaaaacaccuaaacaaa

SEQ ID NO: 2752980 - RNA, 14 nt, Human respiratory syncytial virus
acaggauuaauagg

SEQ ID NO: 2752981 - RNA, 23 nt, Human respiratory syncytial virus
ucagcaaauagacaaaaaaccac

SEQ ID NO: 2752982 - RNA, 21 nt, Human respiratory syncytial virus
uuggaagccauaaagaaucaa

SEQ ID NO: 2752983 - RNA, 22 nt, Human respiratory syncytial virus
auaugaagagauaaaugaucaa

SEQ ID NO: 2752984 - RNA, 13 nt, Human respiratory syncytial virus
acagcagaagaau

SEQ ID NO: 2752985 - RNA, 22 nt, Human respiratory syncytial virus
gucuaugaguaugcacagaagu

SEQ ID NO: 2752986 - RNA, 13 nt, Human respiratory syncytial virus
auacucucaauca

SEQ ID NO: 2752987 - RNA, 21 nt, Human respiratory syncytial virus
aacuacaauuauuauaguaau

SEQ ID NO: 2752988 - RNA, 13 nt, Human respiratory syncytial virus
acaauagaauuaa

SEQ ID NO: 2752989 - RNA, 19 nt, Human respiratory syncytial virus
acauaagcagcucaguaau

SEQ ID NO: 2752990 - RNA, 16 nt, Human respiratory syncytial virus
ugacgaaauuaacaau

SEQ ID NO: 2752991 - RNA, 12 nt, Human respiratory syncytial virus
gaguucaaucaa

SEQ ID NO: 2752992 - RNA, 15 nt, Human respiratory syncytial virus
uaaaacuaacaauga

SEQ ID NO: 2752993 - RNA, 18 nt, Human respiratory syncytial virus
uggggcaaauaaacucac

SEQ ID NO: 2752994 - RNA, 17 nt, Human respiratory syncytial virus
aauaucuguuaacucaa

SEQ ID NO: 2752995 - RNA, 22 nt, Human respiratory syncytial virus
uaugcacagaaguugggaggag

SEQ ID NO: 2752996 - RNA, 16 nt, Human respiratory syncytial virus
auaauauacaaauaug

SEQ ID NO: 2752997 - RNA, 17 nt, Human respiratory syncytial virus
aaauuccacccaaaaua

SEQ ID NO: 2752998 - RNA, 23 nt, Human respiratory syncytial virus
aucaaucauggcggguuucuaga

SEQ ID NO: 2752999 - RNA, 22 nt, Human respiratory syncytial virus
cuagaaaagaccugggauacuc

SEQ ID NO: 2753000 - RNA, 20 nt, Human respiratory syncytial virus
auuuaaaaauuaacauaaug

SEQ ID NO: 2753001 - RNA, 16 nt, Human respiratory syncytial virus
caccaguuacacuaag

SEQ ID NO: 2753002 - RNA, 15 nt, Human respiratory syncytial virus
aaguuaaaugauaca

SEQ ID NO: 2753003 - RNA, 14 nt, Human respiratory syncytial virus
caauaccaagcaac

SEQ ID NO: 2753004 - RNA, 20 nt, Human respiratory syncytial virus
ucuagaaaauccuacaaaaa

SEQ ID NO: 2753005 - RNA, 14 nt, Human respiratory syncytial virus
auuaagccuacaaa

SEQ ID NO: 2753006 - RNA, 16 nt, Human respiratory syncytial virus
auaaaacaagaauuag

SEQ ID NO: 2753007 - RNA, 12 nt, Human respiratory syncytial virus
augcaaaacaca

SEQ ID NO: 2753008 - RNA, 19 nt, Human respiratory syncytial virus
agcacuuguaauaaccaaa

SEQ ID NO: 2753009 - RNA, 14 nt, Human respiratory syncytial virus
acaauccaaaagca

SEQ ID NO: 2753010 - RNA, 19 nt, Human respiratory syncytial virus
guaccaaauacaagaaaua

SEQ ID NO: 2753011 - RNA, 19 nt, Human respiratory syncytial virus
uuuauuuuaaaucaauaug

SEQ ID NO: 2753012 - RNA, 12 nt, Human respiratory syncytial virus
aaccacaaacaa

SEQ ID NO: 2753013 - RNA, 16 nt, Human respiratory syncytial virus
uaaaaaauaucaugcu

SEQ ID NO: 2753014 - RNA, 16 nt, Human respiratory syncytial virus
augcuaguguccaggc

SEQ ID NO: 2753015 - RNA, 12 nt, Human respiratory syncytial virus
aaauaaacucac

SEQ ID NO: 2753016 - RNA, 18 nt, Human respiratory syncytial virus
ucaacccauaacaaacac

SEQ ID NO: 2753017 - RNA, 21 nt, Human respiratory syncytial virus
ucaagugugguccuaggcaau

SEQ ID NO: 2753018 - RNA, 16 nt, Human respiratory syncytial virus
caaauuagcauaugau

SEQ ID NO: 2753019 - RNA, 17 nt, Human respiratory syncytial virus
caaccaacugauccauc

SEQ ID NO: 2753020 - RNA, 14 nt, Human respiratory syncytial virus
cugaagaugcaaau

SEQ ID NO: 2753021 - RNA, 16 nt, Human respiratory syncytial virus
caccagccaaaacgac

SEQ ID NO: 2753022 - RNA, 14 nt, Human respiratory syncytial virus
auaauacuguguau

SEQ ID NO: 2753023 - RNA, 24 nt, Human respiratory syncytial virus
ggaaacauacgugaacaagcuuca

SEQ ID NO: 2753024 - RNA, 20 nt, Human respiratory syncytial virus
agagcaauagaaaaaacaac

SEQ ID NO: 2753025 - RNA, 20 nt, Human respiratory syncytial virus
caacaucacccaacacaaag

SEQ ID NO: 2753026 - RNA, 19 nt, Human respiratory syncytial virus
caauagaauucacaagcaa

SEQ ID NO: 2753027 - RNA, 23 nt, Human respiratory syncytial virus
aaucacugaagaugcaaaucaua

SEQ ID NO: 2753028 - RNA, 21 nt, Human respiratory syncytial virus
auaaagauacuuaaagaugcu

SEQ ID NO: 2753029 - RNA, 16 nt, Human respiratory syncytial virus
aacacacaauccaaca

SEQ ID NO: 2753030 - RNA, 13 nt, Human respiratory syncytial virus
caucuuauagaug

SEQ ID NO: 2753031 - RNA, 23 nt, Human respiratory syncytial virus
cuguauauauaaacaaacaaauc

SEQ ID NO: 2753032 - RNA, 15 nt, Human respiratory syncytial virus
uaaauuuaaaaucua

SEQ ID NO: 2753033 - RNA, 13 nt, Human respiratory syncytial virus
caaaaaaaugcua

SEQ ID NO: 2753034 - RNA, 16 nt, Human respiratory syncytial virus
aucaugaacaucuaca

SEQ ID NO: 2753035 - RNA, 23 nt, Human respiratory syncytial virus
aacaguuauagaauuccagcaga

SEQ ID NO: 2753036 - RNA, 14 nt, Human respiratory syncytial virus
acuaauuauaauca

SEQ ID NO: 2753037 - RNA, 17 nt, Human respiratory syncytial virus
ggaaauggggcaaauaa

SEQ ID NO: 2753038 - RNA, 22 nt, Human respiratory syncytial virus
uacuuaugcaaaacacaccagc

SEQ ID NO: 2753039 - RNA, 20 nt, Human respiratory syncytial virus
auuuagaugcuaacacauca

SEQ ID NO: 2753040 - RNA, 12 nt, Human respiratory syncytial virus
cauugcugucau

SEQ ID NO: 2753041 - RNA, 18 nt, Human respiratory syncytial virus
accauuuuaguuaauaua

SEQ ID NO: 2753042 - RNA, 14 nt, Human respiratory syncytial virus
auaaagauacuuaa

SEQ ID NO: 2753043 - RNA, 18 nt, Human respiratory syncytial virus
gcaauacuaaauaagcua

SEQ ID NO: 2753044 - RNA, 15 nt, Human respiratory syncytial virus
accuugugaaaucaa

SEQ ID NO: 2753045 - RNA, 13 nt, Human respiratory syncytial virus
gaccgaacaaaca

SEQ ID NO: 2753046 - RNA, 16 nt, Human respiratory syncytial virus
auucuuagucaauuau

SEQ ID NO: 2753047 - RNA, 11 nt, Human respiratory syncytial virus
ucccacucaaa

SEQ ID NO: 2753048 - RNA, 17 nt, Human respiratory syncytial virus
aauuaugaugugcaaaa

SEQ ID NO: 2753049 - RNA, 14 nt, Human respiratory syncytial virus
aucuuuaugaugca

SEQ ID NO: 2753050 - RNA, 22 nt, Human respiratory syncytial virus
acauuaguuagaguucaaucaa

SEQ ID NO: 2753051 - RNA, 21 nt, Human respiratory syncytial virus
ucaaucauauacaaauucaga

SEQ ID NO: 2753052 - RNA, 18 nt, Human respiratory syncytial virus
ucgcaucauccaaagauc

SEQ ID NO: 2753053 - RNA, 12 nt, Human respiratory syncytial virus
aagcauaugcag

SEQ ID NO: 2753054 - RNA, 20 nt, Human respiratory syncytial virus
aagauggcucuuagcaaagu

SEQ ID NO: 2753055 - RNA, 14 nt, Human respiratory syncytial virus
auauacaaauauga

SEQ ID NO: 2753056 - RNA, 20 nt, Human respiratory syncytial virus
gccauaaagaaucaacucaa

SEQ ID NO: 2753057 - RNA, 16 nt, Human respiratory syncytial virus
cacguuuuucaaucaa

SEQ ID NO: 2753058 - RNA, 18 nt, Human respiratory syncytial virus
uaggaagggaagacacua

SEQ ID NO: 2753059 - RNA, 13 nt, Human respiratory syncytial virus
auccugcaucacu

SEQ ID NO: 2753060 - RNA, 16 nt, Human respiratory syncytial virus
agaaauggagcaaguu

SEQ ID NO: 2753061 - RNA, 20 nt, Human respiratory syncytial virus
aguaccccagaaaccaaagc

SEQ ID NO: 2753062 - RNA, 20 nt, Human respiratory syncytial virus
caaaucauaaauucacagga

SEQ ID NO: 2753063 - RNA, 17 nt, Human respiratory syncytial virus
aauacuaaauaagcuaa

SEQ ID NO: 2753064 - RNA, 23 nt, Human respiratory syncytial virus
ugcuggaaauuacacacaucacc

SEQ ID NO: 2753065 - RNA, 18 nt, Human respiratory syncytial virus
ccucaaacuacacacuau

SEQ ID NO: 2753066 - RNA, 14 nt, Human respiratory syncytial virus
augugcaaaaacac

SEQ ID NO: 2753067 - RNA, 13 nt, Human respiratory syncytial virus
caaaauuaaauaa

SEQ ID NO: 2753068 - RNA, 19 nt, Human respiratory syncytial virus
uaaaaugggaaauacaucc

SEQ ID NO: 2753069 - RNA, 16 nt, Human respiratory syncytial virus
caacuccacacaaaca

SEQ ID NO: 2753070 - RNA, 16 nt, Human respiratory syncytial virus
ccgagcacaaaaccac

SEQ ID NO: 2753071 - RNA, 16 nt, Human respiratory syncytial virus
gcaaauaaacucaccu

SEQ ID NO: 2753072 - RNA, 16 nt, Human respiratory syncytial virus
cugugucaaauuauaa

SEQ ID NO: 2753073 - RNA, 23 nt, Human respiratory syncytial virus
cgaauagguaaauaaaaccaaaa

SEQ ID NO: 2753074 - RNA, 19 nt, Human respiratory syncytial virus
gugacuuguuggaagacaa

SEQ ID NO: 2753075 - RNA, 12 nt, Human respiratory syncytial virus
auaugaagagau

SEQ ID NO: 2753076 - RNA, 20 nt, Human respiratory syncytial virus
guaguuauuuaaaaauuaac

SEQ ID NO: 2753077 - RNA, 16 nt, Human respiratory syncytial virus
acaaacaaagcuguag

SEQ ID NO: 2753078 - RNA, 23 nt, Human respiratory syncytial virus
aaccaaauuagcagcaggagaca

SEQ ID NO: 2753079 - RNA, 12 nt, Human respiratory syncytial virus
auauugaacaau

SEQ ID NO: 2753080 - RNA, 21 nt, Human respiratory syncytial virus
ccaacaucaucaauccaacaa

SEQ ID NO: 2753081 - RNA, 21 nt, Human respiratory syncytial virus
aacuauaacacagucauuaau

SEQ ID NO: 2753082 - RNA, 12 nt, Human respiratory syncytial virus
gagacaccagca

SEQ ID NO: 2753083 - RNA, 23 nt, Human respiratory syncytial virus
aacaacggucacaguucaaacaa

SEQ ID NO: 2753084 - RNA, 15 nt, Human respiratory syncytial virus
aacacacaauccaac

SEQ ID NO: 2753085 - RNA, 14 nt, Human respiratory syncytial virus
uaucacaauuauuu

SEQ ID NO: 2753086 - RNA, 15 nt, Human respiratory syncytial virus
aacuuauaaaacaag

SEQ ID NO: 2753087 - RNA, 23 nt, Human respiratory syncytial virus
ugucauccagcaaauacacuauu

SEQ ID NO: 2753088 - RNA, 22 nt, Human respiratory syncytial virus
uccaaacaaccuacaaccacau

SEQ ID NO: 2753089 - RNA, 16 nt, Human respiratory syncytial virus
aacaguuauagaauuc

SEQ ID NO: 2753090 - RNA, 22 nt, Human respiratory syncytial virus
gaccacagaaagagacaccagc

SEQ ID NO: 2753091 - RNA, 16 nt, Human respiratory syncytial virus
auugcucuaugugaau

SEQ ID NO: 2753092 - RNA, 22 nt, Human respiratory syncytial virus
auuaugauaacuacaauuauua

SEQ ID NO: 2753093 - RNA, 16 nt, Human respiratory syncytial virus
agaagaaccaacuuau

SEQ ID NO: 2753094 - RNA, 23 nt, Human respiratory syncytial virus
acaugcuuaguuauucaaaaacu

SEQ ID NO: 2753095 - RNA, 22 nt, Human respiratory syncytial virus
auugcaaagccaaaaacacacc

SEQ ID NO: 2753096 - RNA, 15 nt, Human respiratory syncytial virus
ccaacccaaccaaac

SEQ ID NO: 2753097 - RNA, 18 nt, Human respiratory syncytial virus
aacacacaauccaacagc

SEQ ID NO: 2753098 - RNA, 17 nt, Human respiratory syncytial virus
gugccuaccuagaaaaa

SEQ ID NO: 2753099 - RNA, 14 nt, Human respiratory syncytial virus
gcagcaggagacag

SEQ ID NO: 2753100 - RNA, 23 nt, Human respiratory syncytial virus
auguuguguuaucacaauuauuu

SEQ ID NO: 2753101 - RNA, 14 nt, Human respiratory syncytial virus
aagacacuauaaag

SEQ ID NO: 2753102 - RNA, 22 nt, Human respiratory syncytial virus
agaugcaucaaaucaacacaua

SEQ ID NO: 2753103 - RNA, 16 nt, Human respiratory syncytial virus
caucuguaccagcaga

SEQ ID NO: 2753104 - RNA, 17 nt, Human respiratory syncytial virus
ucaaucucaacaaccau

SEQ ID NO: 2753105 - RNA, 15 nt, Human respiratory syncytial virus
aguggcuccagaaua

SEQ ID NO: 2753106 - RNA, 15 nt, Human respiratory syncytial virus
agcucauccaaacaa

SEQ ID NO: 2753107 - RNA, 22 nt, Human respiratory syncytial virus
accauauauugaacaauccaaa

SEQ ID NO: 2753108 - RNA, 18 nt, Human respiratory syncytial virus
gauuaaauuuaaaaucua

SEQ ID NO: 2753109 - RNA, 19 nt, Human respiratory syncytial virus
gcaaccaccgaauucaaaa

SEQ ID NO: 2753110 - RNA, 19 nt, Human respiratory syncytial virus
ggaagccauaaagaaucaa

SEQ ID NO: 2753111 - RNA, 14 nt, Human respiratory syncytial virus
caaacuacacacua

SEQ ID NO: 2753112 - RNA, 21 nt, Human respiratory syncytial virus
ucucaagugugguccuaggca

SEQ ID NO: 2753113 - RNA, 19 nt, Human respiratory syncytial virus
aauaguuaagaaggagcua

SEQ ID NO: 2753114 - RNA, 17 nt, Human respiratory syncytial virus
aaugucuuaaaaaauga

SEQ ID NO: 2753115 - RNA, 11 nt, Human respiratory syncytial virus
cagggcaagua

SEQ ID NO: 2753116 - RNA, 16 nt, Human respiratory syncytial virus
ucauggagaagaugca

SEQ ID NO: 2753117 - RNA, 23 nt, Human respiratory syncytial virus
aucugaugaauuacuacauaaug

SEQ ID NO: 2753118 - RNA, 16 nt, Human respiratory syncytial virus
aaaaucaaucaaaguu

SEQ ID NO: 2753119 - RNA, 22 nt, Human respiratory syncytial virus
aaaagucuaaaacuaacaauga

SEQ ID NO: 2753120 - RNA, 16 nt, Human respiratory syncytial virus
ccaaauuagcagcagg

SEQ ID NO: 2753121 - RNA, 14 nt, Human respiratory syncytial virus
auuguuuaugaaug

SEQ ID NO: 2753122 - RNA, 14 nt, Human respiratory syncytial virus
guauauauaaacaa

SEQ ID NO: 2753123 - RNA, 15 nt, Human respiratory syncytial virus
cugaaaaaaacauca

SEQ ID NO: 2753124 - RNA, 13 nt, Human respiratory syncytial virus
auuagaugaaaga

SEQ ID NO: 2753125 - RNA, 20 nt, Human respiratory syncytial virus
gaaacaauagaaacauuuga

SEQ ID NO: 2753126 - RNA, 15 nt, Human respiratory syncytial virus
guuggucugagagaa

SEQ ID NO: 2753127 - RNA, 13 nt, Human respiratory syncytial virus
aacucaaagaaaa

SEQ ID NO: 2753128 - RNA, 15 nt, Human respiratory syncytial virus
augcuauuaaucacu

SEQ ID NO: 2753129 - RNA, 13 nt, Human respiratory syncytial virus
aaauaacauauua

SEQ ID NO: 2753130 - RNA, 18 nt, Human respiratory syncytial virus
gcagagcaacucaaagaa

SEQ ID NO: 2753131 - RNA, 20 nt, Human respiratory syncytial virus
auauaguaacaaaaaaagaa

SEQ ID NO: 2753132 - RNA, 19 nt, Human respiratory syncytial virus
cuaaacaaacuauguggua

SEQ ID NO: 2753133 - RNA, 16 nt, Human respiratory syncytial virus
acaaauagcacuauca

SEQ ID NO: 2753134 - RNA, 21 nt, Human respiratory syncytial virus
augucacuacagucauaauua

SEQ ID NO: 2753135 - RNA, 21 nt, Human respiratory syncytial virus
aacccuaaagaagaugaugua

SEQ ID NO: 2753136 - RNA, 20 nt, Human respiratory syncytial virus
uuagaugcuaacacaucauu

SEQ ID NO: 2753137 - RNA, 19 nt, Human respiratory syncytial virus
cacaaaguuacacuaacaa

SEQ ID NO: 2753138 - RNA, 16 nt, Human respiratory syncytial virus
auccaaacaucaugaa

SEQ ID NO: 2753139 - RNA, 18 nt, Human respiratory syncytial virus
gucagcggaaccaccaac

SEQ ID NO: 2753140 - RNA, 15 nt, Human respiratory syncytial virus
caacccucacgacca

SEQ ID NO: 2753141 - RNA, 18 nt, Human respiratory syncytial virus
ccagcguuuauuaaauaa

SEQ ID NO: 2753142 - RNA, 17 nt, Human respiratory syncytial virus
caaauauggaaacauac

SEQ ID NO: 2753143 - RNA, 19 nt, Human respiratory syncytial virus
aacaucaauaaaacagaca

SEQ ID NO: 2753144 - RNA, 15 nt, Human respiratory syncytial virus
aaauuccuagaauca

SEQ ID NO: 2753145 - RNA, 13 nt, Human respiratory syncytial virus
agaauauaggcau

SEQ ID NO: 2753146 - RNA, 17 nt, Human respiratory syncytial virus
aaacgacgaaaaaagaa

SEQ ID NO: 2753147 - RNA, 18 nt, Human respiratory syncytial virus
cagaaagagacaccagca

SEQ ID NO: 2753148 - RNA, 13 nt, Human respiratory syncytial virus
aagaugauguaga

SEQ ID NO: 2753149 - RNA, 19 nt, Human respiratory syncytial virus
ucaacguaguacaggagau

SEQ ID NO: 2753150 - RNA, 11 nt, Human respiratory syncytial virus
gagagaagaaa

SEQ ID NO: 2753151 - RNA, 17 nt, Human respiratory syncytial virus
ugcagguguaacaacac

SEQ ID NO: 2753152 - RNA, 15 nt, Human respiratory syncytial virus
caaagcauaugcaga

SEQ ID NO: 2753153 - RNA, 17 nt, Human respiratory syncytial virus
cguaaauuccaacaaaa

SEQ ID NO: 2753154 - RNA, 22 nt, Human respiratory syncytial virus
agucaaguuaaaugauacauua

SEQ ID NO: 2753155 - RNA, 16 nt, Human respiratory syncytial virus
aagaaaccaggaucuu

SEQ ID NO: 2753156 - RNA, 13 nt, Human respiratory syncytial virus
auauccaaacauc

SEQ ID NO: 2753157 - RNA, 17 nt, Human respiratory syncytial virus
gagcaacucaaagaaaa

SEQ ID NO: 2753158 - RNA, 19 nt, Human respiratory syncytial virus
aucaaucaaacuaugagca

SEQ ID NO: 2753159 - RNA, 17 nt, Human respiratory syncytial virus
agcagaagaacagcaga

SEQ ID NO: 2753160 - RNA, 23 nt, Human respiratory syncytial virus
uaaauuggggcaaauacaaagau

SEQ ID NO: 2753161 - RNA, 22 nt, Human respiratory syncytial virus
gacuagauagaauugaugaaaa

SEQ ID NO: 2753162 - RNA, 21 nt, Human respiratory syncytial virus
gcaagacuuaggaaugaggaa

SEQ ID NO: 2753163 - RNA, 21 nt, Human respiratory syncytial virus
caaaccaaccaccaaaaccac

SEQ ID NO: 2753164 - RNA, 22 nt, Human respiratory syncytial virus
agcauaugcagagcaacucaaa

SEQ ID NO: 2753165 - RNA, 13 nt, Human respiratory syncytial virus
aaauacaagucaa

SEQ ID NO: 2753166 - RNA, 15 nt, Human respiratory syncytial virus
uacaagaaauacacu

SEQ ID NO: 2753167 - RNA, 17 nt, Human respiratory syncytial virus
caagaaauacacugaau

SEQ ID NO: 2753168 - RNA, 13 nt, Human respiratory syncytial virus
cucuuagcaaagu

SEQ ID NO: 2753169 - RNA, 18 nt, Human respiratory syncytial virus
aauguucuagaaaaagau

SEQ ID NO: 2753170 - RNA, 21 nt, Human respiratory syncytial virus
aguguccaggcagaaauggag

SEQ ID NO: 2753171 - RNA, 23 nt, Human respiratory syncytial virus
gaaggagaagugaacaagaucaa

SEQ ID NO: 2753172 - RNA, 21 nt, Human respiratory syncytial virus
cacaaagucagaaacacacca

SEQ ID NO: 2753173 - RNA, 16 nt, Human respiratory syncytial virus
aguauaugaacuauac

SEQ ID NO: 2753174 - RNA, 16 nt, Human respiratory syncytial virus
acuuuggcauugcaca

SEQ ID NO: 2753175 - RNA, 16 nt, Human respiratory syncytial virus
caccuugugaaaucaa

SEQ ID NO: 2753176 - RNA, 18 nt, Human respiratory syncytial virus
gagcaacucaaagaaaau

SEQ ID NO: 2753177 - RNA, 17 nt, Human respiratory syncytial virus
caaagaaacaauagaaa

SEQ ID NO: 2753178 - RNA, 14 nt, Human respiratory syncytial virus
ucauguuaaagcua

SEQ ID NO: 2753179 - RNA, 13 nt, Human respiratory syncytial virus
ccacaaacaaacc

SEQ ID NO: 2753180 - RNA, 14 nt, Human respiratory syncytial virus
gcaaucaacaacau

SEQ ID NO: 2753181 - RNA, 19 nt, Human respiratory syncytial virus
aagaucuuaccaugaagac

SEQ ID NO: 2753182 - RNA, 17 nt, Human respiratory syncytial virus
cuaaguuguacaaagaa

SEQ ID NO: 2753183 - RNA, 21 nt, Human respiratory syncytial virus
aagcuugacaucagaaauaca

SEQ ID NO: 2753184 - RNA, 12 nt, Human respiratory syncytial virus
acaucaaaaaca

SEQ ID NO: 2753185 - RNA, 20 nt, Human respiratory syncytial virus
acuugaugaaagacaagcua

SEQ ID NO: 2753186 - RNA, 18 nt, Human respiratory syncytial virus
uagguauguuauaugcua

SEQ ID NO: 2753187 - RNA, 20 nt, Human respiratory syncytial virus
auuaggagggcaaacaaugu

SEQ ID NO: 2753188 - RNA, 16 nt, Human respiratory syncytial virus
aaagacuaccagcaga

SEQ ID NO: 2753189 - RNA, 22 nt, Human respiratory syncytial virus
ugcaagugcaggacccacuuca

SEQ ID NO: 2753190 - RNA, 18 nt, Human respiratory syncytial virus
gcaaaaacaccuaaacaa

SEQ ID NO: 2753191 - RNA, 19 nt, Human respiratory syncytial virus
caagucccaccagaaaggg

SEQ ID NO: 2753192 - RNA, 13 nt, Human respiratory syncytial virus
accaacaucauca

SEQ ID NO: 2753193 - RNA, 18 nt, Human respiratory syncytial virus
auauacaaaauuaaauaa

SEQ ID NO: 2753194 - RNA, 19 nt, Human respiratory syncytial virus
ugaugcagccaaagcauau

SEQ ID NO: 2753195 - RNA, 18 nt, Human respiratory syncytial virus
uugugacacuaugaacag

SEQ ID NO: 2753196 - RNA, 13 nt, Human respiratory syncytial virus
aagaagaugaugu

SEQ ID NO: 2753197 - RNA, 13 nt, Human respiratory syncytial virus
ggagaagaugcaa

SEQ ID NO: 2753198 - RNA, 15 nt, Human respiratory syncytial virus
uagacaaaaaaccac

SEQ ID NO: 2753199 - RNA, 17 nt, Human respiratory syncytial virus
acaaugaucugucacuu

SEQ ID NO: 2753200 - RNA, 22 nt, Human respiratory syncytial virus
guauaugaacuauacaaucaau

SEQ ID NO: 2753201 - RNA, 12 nt, Human respiratory syncytial virus
aagccaaaaaca

SEQ ID NO: 2753202 - RNA, 20 nt, Human respiratory syncytial virus
gcacugcauccaacaaaaau

SEQ ID NO: 2753203 - RNA, 19 nt, Human respiratory syncytial virus
ucauccaaagauccuaaga

SEQ ID NO: 2753204 - RNA, 20 nt, Human respiratory syncytial virus
cacuuguaaaguacagucca

SEQ ID NO: 2753205 - RNA, 13 nt, Human respiratory syncytial virus
agaaaaagaugau

SEQ ID NO: 2753206 - RNA, 20 nt, Human respiratory syncytial virus
cacugaauauaauacaaaau

SEQ ID NO: 2753207 - RNA, 22 nt, Human respiratory syncytial virus
cacuccuauaauauacaaauau

SEQ ID NO: 2753208 - RNA, 20 nt, Human respiratory syncytial virus
aacaguuugacauuaccaag

SEQ ID NO: 2753209 - RNA, 14 nt, Human respiratory syncytial virus
auuccaacaaaaaa

SEQ ID NO: 2753210 - RNA, 17 nt, Human respiratory syncytial virus
uaaaugaucaaacaaau

SEQ ID NO: 2753211 - RNA, 15 nt, Human respiratory syncytial virus
uacaaagaaacaaua

SEQ ID NO: 2753212 - RNA, 17 nt, Human respiratory syncytial virus
ucacaguucaaacaaua

SEQ ID NO: 2753213 - RNA, 12 nt, Human respiratory syncytial virus
uauuagugucau

SEQ ID NO: 2753214 - RNA, 18 nt, Human respiratory syncytial virus
uugguauaccagugucau

SEQ ID NO: 2753215 - RNA, 22 nt, Human respiratory syncytial virus
uuaauccaacuuccaaaaaauu

SEQ ID NO: 2753216 - RNA, 13 nt, Human respiratory syncytial virus
uugaugaaaaauu

SEQ ID NO: 2753217 - RNA, 19 nt, Human respiratory syncytial virus
uuccuagaaucaauaaagg

SEQ ID NO: 2753218 - RNA, 20 nt, Human respiratory syncytial virus
ucuuggagcuauagugucau

SEQ ID NO: 2753219 - RNA, 20 nt, Human respiratory syncytial virus
cuugaugauuuuugaucagu

SEQ ID NO: 2753220 - RNA, 16 nt, Human respiratory syncytial virus
aaaaagaacaagaugg

SEQ ID NO: 2753221 - RNA, 21 nt, Human
cuccagugagacagcucugca

SEQ ID NO: 2753222 - RNA, 13 nt, Human
cuccuuucucuuu

SEQ ID NO: 2753223 - RNA, 19 nt, Human
cucucuggccuucggccuc

SEQ ID NO: 2753224 - RNA, 22 nt, Human
cucucuggccuucggccuccau

SEQ ID NO: 2753225 - RNA, 17 nt, Human
cucucuggccuucggcc

SEQ ID NO: 2753226 - RNA, 13 nt, Human
cugaaagaggaau

SEQ ID NO: 2753227 - RNA, 17 nt, Human
cugaaagaggaaugaag

SEQ ID NO: 2753228 - RNA, 18 nt, Human
cugaggaauucuguauag

SEQ ID NO: 2753229 - RNA, 19 nt, Human
cugaggaauucuguauaga

SEQ ID NO: 2753230 - RNA, 15 nt, Human
cugaggaauucugua

SEQ ID NO: 2753231 - RNA, 16 nt, Human
cugaggaauucuguau

SEQ ID NO: 2753232 - RNA, 24 nt, Human
cggagaagagcuguucacagccag

SEQ ID NO: 2753233 - RNA, 23 nt, Human
cggagaagagcuguucacagcca

SEQ ID NO: 2753234 - RNA, 15 nt, Human
cgguuuauauaagcu

SEQ ID NO: 2753235 - RNA, 14 nt, Human
cuaacuggacuggu

SEQ ID NO: 2753236 - RNA, 15 nt, Human
cuaaacuuuucugau

SEQ ID NO: 2753237 - RNA, 16 nt, Human
cuaaacuuuucugaua

SEQ ID NO: 2753238 - RNA, 19 nt, Human
cucagaaaacaaggaugaa

SEQ ID NO: 2753239 - RNA, 23 nt, Human
cucagaaaacaaggaugaauuaa

SEQ ID NO: 2753240 - RNA, 13 nt, Human
cucaaaacugcac

SEQ ID NO: 2753241 - RNA, 14 nt, Human
ccucggagaagagc

SEQ ID NO: 2753242 - RNA, 12 nt, Human
ccucggagaaga

SEQ ID NO: 2753243 - RNA, 16 nt, Human
ccucccuucucuucac

SEQ ID NO: 2753244 - RNA, 17 nt, Human
ccugucucuacuaaaaa

SEQ ID NO: 2753245 - RNA, 13 nt, Human
cccaacuccagaa

SEQ ID NO: 2753246 - RNA, 13 nt, Human
ccaucccucccuc

SEQ ID NO: 2753247 - RNA, 14 nt, Human
ccaucccucccucc

SEQ ID NO: 2753248 - RNA, 15 nt, Human
ccaucccucccucca

SEQ ID NO: 2753249 - RNA, 13 nt, Human
cccuccucugcuu

SEQ ID NO: 2753250 - RNA, 22 nt, Human
cccuccucugcuugccaucccu

SEQ ID NO: 2753251 - RNA, 13 nt, Human
ccccugcacucca

SEQ ID NO: 2753252 - RNA, 24 nt, Human
cccagccagcaguucagagcugcc

SEQ ID NO: 2753253 - RNA, 20 nt, Human
cccauauuuguacaccaaua

SEQ ID NO: 2753254 - RNA, 23 nt, Human
caggaaaucaaauaugcaaagca

SEQ ID NO: 2753255 - RNA, 22 nt, Human
caggaaaucaaauaugcaaagc

SEQ ID NO: 2753256 - RNA, 20 nt, Human
caggaaagagaacuuccaga

SEQ ID NO: 2753257 - RNA, 16 nt, Human
cagcuccccucggaga

SEQ ID NO: 2753258 - RNA, 18 nt, Human
cagcuccccucggagaag

SEQ ID NO: 2753259 - RNA, 17 nt, Human
cagcuccccucggagaa

SEQ ID NO: 2753260 - RNA, 23 nt, Human
cagcugccuccccuccucugcuu

SEQ ID NO: 2753261 - RNA, 24 nt, Human
cagcugccuccccuccucugcuug

SEQ ID NO: 2753262 - RNA, 21 nt, Human
cagcugccuccccuccucugc

SEQ ID NO: 2753263 - RNA, 22 nt, Human
cagcugccuccccuccucugcu

SEQ ID NO: 2753264 - RNA, 15 nt, Human
cagcccuucuuucca

SEQ ID NO: 2753265 - RNA, 19 nt, Human
cagcccuucuuuccacaga

SEQ ID NO: 2753266 - RNA, 20 nt, Human
cagcccuucuuuccacagaa

SEQ ID NO: 2753267 - RNA, 19 nt, Human
cagccugagcgacagugag

SEQ ID NO: 2753268 - RNA, 18 nt, Human
cagccugagcgacaguga

SEQ ID NO: 2753269 - RNA, 22 nt, Human
cagcaguugaaaagacuccaaa

SEQ ID NO: 2753270 - RNA, 17 nt, Human
cagcaguugaaaagacu

SEQ ID NO: 2753271 - RNA, 21 nt, Human
cagcaguugaaaagacuccaa

SEQ ID NO: 2753272 - RNA, 20 nt, Human
cagcaguugaaaagacucca

SEQ ID NO: 2753273 - RNA, 22 nt, Human
cagccagcaguucagagcugcc

SEQ ID NO: 2753274 - RNA, 15 nt, Human
cagccagcaguucag

SEQ ID NO: 2753275 - RNA, 21 nt, Human
cagccagcaguucagagcugc

SEQ ID NO: 2753276 - RNA, 14 nt, Human
cagccagcaguuca

SEQ ID NO: 2753277 - RNA, 22 nt, Human
cagcacagccucuuagaugcag

SEQ ID NO: 2753278 - RNA, 13 nt, Human
cagagcugcccuc

SEQ ID NO: 2753279 - RNA, 15 nt, Human
cagagcugcccucuc

SEQ ID NO: 2753280 - RNA, 15 nt, Human
cagucucaggaaauc

SEQ ID NO: 2753281 - RNA, 16 nt, Human
caguauuguacaaagu

SEQ ID NO: 2753282 - RNA, 17 nt, Human
caguauuguacaaagua

SEQ ID NO: 2753283 - RNA, 18 nt, Human
caguauuguacaaaguau

SEQ ID NO: 2753284 - RNA, 19 nt, Human
caguauuguacaaaguauu

SEQ ID NO: 2753285 - RNA, 12 nt, Human
caguauuguaca

SEQ ID NO: 2753286 - RNA, 13 nt, Human
caguauuguacaa

SEQ ID NO: 2753287 - RNA, 21 nt, Human
caguauuguacaaaguauuaa

SEQ ID NO: 2753288 - RNA, 17 nt, Human
cagggaggacgcucucu

SEQ ID NO: 2753289 - RNA, 18 nt, Human
cagggaggacgcucucug

SEQ ID NO: 2753290 - RNA, 12 nt, Human
cauuaucucaaa

SEQ ID NO: 2753291 - RNA, 13 nt, Human
cauuaucucaaaa

SEQ ID NO: 2753292 - RNA, 16 nt, Human
ccacagaagcuccagg

SEQ ID NO: 2753293 - RNA, 18 nt, Human
ccaccagucugacuguuu

SEQ ID NO: 2753294 - RNA, 18 nt, Human
ccacagaagcuccaggua

SEQ ID NO: 2753295 - RNA, 22 nt, Human
cauuuggaaaucuuuaaaaaaa

SEQ ID NO: 2753296 - RNA, 16 nt, Human
auuuaauaaaugugcc

SEQ ID NO: 2753297 - RNA, 14 nt, Human
auuucuaugaaaua

SEQ ID NO: 2753298 - RNA, 17 nt, Human
auuucuauauuuucauu

SEQ ID NO: 2753299 - RNA, 18 nt, Human
auuucuauauuuucauuc

SEQ ID NO: 2753300 - RNA, 15 nt, Human
auuucuauauuuuca

SEQ ID NO: 2753301 - RNA, 16 nt, Human
auuucuauauuuucau

SEQ ID NO: 2753302 - RNA, 20 nt, Human
auuucauaccuaucaucuua

SEQ ID NO: 2753303 - RNA, 19 nt, Human
auuucuauauuuucauucu

SEQ ID NO: 2753304 - RNA, 19 nt, Human
auuucuaugcugaguuugu

SEQ ID NO: 2753305 - RNA, 21 nt, Human
auuucuaugcugaguuugugc

SEQ ID NO: 2753306 - RNA, 22 nt, Human
auuucuaugcugaguuugugcu

SEQ ID NO: 2753307 - RNA, 15 nt, Human
auuguuuaaaaucau

SEQ ID NO: 2753308 - RNA, 21 nt, Human
auuguaauuauaucugaggaa

SEQ ID NO: 2753309 - RNA, 16 nt, Human
auuguacaaaguauua

SEQ ID NO: 2753310 - RNA, 17 nt, Human
auuguacaaaguauuaa

SEQ ID NO: 2753311 - RNA, 19 nt, Human
auuguacaaaguauuaagc

SEQ ID NO: 2753312 - RNA, 16 nt, Human
auuguaauuauaucug

SEQ ID NO: 2753313 - RNA, 17 nt, Human
auuguaauuauaucuga

SEQ ID NO: 2753314 - RNA, 15 nt, Human
auuguaauuauaucu

SEQ ID NO: 2753315 - RNA, 19 nt, Human
auuaugaauuacauuugua

SEQ ID NO: 2753316 - RNA, 20 nt, Human
auuaugaauuacauuuguau

SEQ ID NO: 2753317 - RNA, 22 nt, Human
auuaugaauuacauuuguauaa

SEQ ID NO: 2753318 - RNA, 21 nt, Human
caaaucuuaacuugaaggagu

SEQ ID NO: 2753319 - RNA, 19 nt, Human
caagacccaaaaggcagaa

SEQ ID NO: 2753320 - RNA, 21 nt, Human
auuuuauaucaauuuaaaaaa

SEQ ID NO: 2753321 - RNA, 15 nt, Human
auuuuuauauuugaa

SEQ ID NO: 2753322 - RNA, 15 nt, Human
auuuuuauauuuacu

SEQ ID NO: 2753323 - RNA, 16 nt, Human
auuuuuauauuuacua

SEQ ID NO: 2753324 - RNA, 13 nt, Human
auuuuuuuguugu

SEQ ID NO: 2753325 - RNA, 21 nt, Human
caaaaggauaaugaauacuuu

SEQ ID NO: 2753326 - RNA, 15 nt, Human
caaacagucucagga

SEQ ID NO: 2753327 - RNA, 17 nt, Human
caaacagucucaggaaa

SEQ ID NO: 2753328 - RNA, 16 nt, Human
caaacagucucaggaa

SEQ ID NO: 2753329 - RNA, 15 nt, Human
caauaaaauggguuu

SEQ ID NO: 2753330 - RNA, 20 nt, Human
caauaaaauccauacauuug

SEQ ID NO: 2753331 - RNA, 23 nt, Human
caauaaaauccauacauuugugu

SEQ ID NO: 2753332 - RNA, 15 nt, Human
cacuuaaaaaugguu

SEQ ID NO: 2753333 - RNA, 17 nt, Human
cacuuguguuuugcaag

SEQ ID NO: 2753334 - RNA, 12 nt, Human
cagaacagugau

SEQ ID NO: 2753335 - RNA, 17 nt, Human
cagaacagugauuacca

SEQ ID NO: 2753336 - RNA, 11 nt, Human
cagaacaguga

SEQ ID NO: 2753337 - RNA, 12 nt, Human
cacuccagccug

SEQ ID NO: 2753338 - RNA, 13 nt, Human
cacuccagccuga

SEQ ID NO: 2753339 - RNA, 23 nt, Human
cacuccagccugagcgacaguga

SEQ ID NO: 2753340 - RNA, 21 nt, Human
cuuaaaaaugguuuaaauggu

SEQ ID NO: 2753341 - RNA, 15 nt, Human
cuuaaaguugaauuu

SEQ ID NO: 2753342 - RNA, 18 nt, Human
cuuaaaguugaauuuauu

SEQ ID NO: 2753343 - RNA, 14 nt, Human
cuuaaaguugaauu

SEQ ID NO: 2753344 - RNA, 22 nt, Human
cuuaaaguugaauuuauuggcu

SEQ ID NO: 2753345 - RNA, 13 nt, Human
cuguuauaaucuu

SEQ ID NO: 2753346 - RNA, 19 nt, Human
cuguuauaaucuuucacag

SEQ ID NO: 2753347 - RNA, 15 nt, Human
cuguacuuuuuggca

SEQ ID NO: 2753348 - RNA, 21 nt, Human
cugccuccccuccucugcuug

SEQ ID NO: 2753349 - RNA, 17 nt, Human
cuucuaaguaaaaccac

SEQ ID NO: 2753350 - RNA, 13 nt, Human
cuucuaaguaaaa

SEQ ID NO: 2753351 - RNA, 21 nt, Human
cuucuaaguaaaaccacagca

SEQ ID NO: 2753352 - RNA, 20 nt, Human
cuucucacauuuauauuuuu

SEQ ID NO: 2753353 - RNA, 13 nt, Human
cuucucacauuua

SEQ ID NO: 2753354 - RNA, 15 nt, Human
cuuucagauacugga

SEQ ID NO: 2753355 - RNA, 17 nt, Human
cuuucagauacuggauu

SEQ ID NO: 2753356 - RNA, 22 nt, Human
cuuucagauacuggauuguacu

SEQ ID NO: 2753357 - RNA, 14 nt, Human
cuuucagauacugg

SEQ ID NO: 2753358 - RNA, 19 nt, Human
cuuggucugugagaugcua

SEQ ID NO: 2753359 - RNA, 16 nt, Human
cuuggucugugagaug

SEQ ID NO: 2753360 - RNA, 14 nt, Human
cuugucucagauuu

SEQ ID NO: 2753361 - RNA, 17 nt, Human
cuugucucagauuuuau

SEQ ID NO: 2753362 - RNA, 13 nt, Human
cuugucucagauu

SEQ ID NO: 2753363 - RNA, 18 nt, Human
cuugucucagauuuuauu

SEQ ID NO: 2753364 - RNA, 17 nt, Human
gaacccgggaggcagag

SEQ ID NO: 2753365 - RNA, 17 nt, Human
gaacccaaguccaagca

SEQ ID NO: 2753366 - RNA, 16 nt, Human
gaacccaaguccaagc

SEQ ID NO: 2753367 - RNA, 21 nt, Human
gaaaacuuuaugcuaagugaa

SEQ ID NO: 2753368 - RNA, 14 nt, Human
gaaaagacuccaaa

SEQ ID NO: 2753369 - RNA, 17 nt, Human
gaaaagacuccaaagaa

SEQ ID NO: 2753370 - RNA, 16 nt, Human
gaaaagacuccaaaga

SEQ ID NO: 2753371 - RNA, 18 nt, Human
gaaagaaaaucaggcugg

SEQ ID NO: 2753372 - RNA, 12 nt, Human
gaaaucuuuaaa

SEQ ID NO: 2753373 - RNA, 15 nt, Human
gaaaucuuuaaaaaa

SEQ ID NO: 2753374 - RNA, 17 nt, Human
gcaaaaauauuuuauga

SEQ ID NO: 2753375 - RNA, 22 nt, Human
gcaaaaauauuuuaugauccag

SEQ ID NO: 2753376 - RNA, 23 nt, Human
gcaaaaauauuuuaugauccagc

SEQ ID NO: 2753377 - RNA, 16 nt, Human
gcaaaaauauuuuaug

SEQ ID NO: 2753378 - RNA, 16 nt, Human
gauucuuaaaguugaa

SEQ ID NO: 2753379 - RNA, 17 nt, Human
gauucuuaaaguugaau

SEQ ID NO: 2753380 - RNA, 21 nt, Human
gauucuuaaaguugaauuuau

SEQ ID NO: 2753381 - RNA, 15 nt, Human
gauucuuaaaguuga

SEQ ID NO: 2753382 - RNA, 18 nt, Human
gcaauagucaaauugugu

SEQ ID NO: 2753383 - RNA, 16 nt, Human
gcaauaaaauggguuu

SEQ ID NO: 2753384 - RNA, 16 nt, Human
gcauuguaaaugugcu

SEQ ID NO: 2753385 - RNA, 15 nt, Human
gcagcuuauucacaa

SEQ ID NO: 2753386 - RNA, 22 nt, Human
gcaguugaaaagacuccaaaga

SEQ ID NO: 2753387 - RNA, 13 nt, Human
gcauaacauaaau

SEQ ID NO: 2753388 - RNA, 13 nt, Human
gagcgacagugag

SEQ ID NO: 2753389 - RNA, 15 nt, Human
gagcgacagugagac

SEQ ID NO: 2753390 - RNA, 17 nt, Human
gacuguggugacuuugg

SEQ ID NO: 2753391 - RNA, 19 nt, Human
gacuuuggauaauaaggaa

SEQ ID NO: 2753392 - RNA, 16 nt, Human
gacuauucaaacaguc

SEQ ID NO: 2753393 - RNA, 15 nt, Human
gacuauucaaacagu

SEQ ID NO: 2753394 - RNA, 14 nt, Human
gacagaaagcagaa

SEQ ID NO: 2753395 - RNA, 20 nt, Human
gacagaaagcagaacaguga

SEQ ID NO: 2753396 - RNA, 21 nt, Human
gacagcccuucuuuccacaga

SEQ ID NO: 2753397 - RNA, 14 nt, Human
ggcuccacuugguc

SEQ ID NO: 2753398 - RNA, 20 nt, Human
gggacagucaccucauggaa

SEQ ID NO: 2753399 - RNA, 21 nt, Human
gggacagucaccucauggaau

SEQ ID NO: 2753400 - RNA, 22 nt, Human
gggacagucaccucauggaauu

SEQ ID NO: 2753401 - RNA, 20 nt, Human
gggaacccaaguccaagcau

SEQ ID NO: 2753402 - RNA, 14 nt, Human
aaaaauaacaauga

SEQ ID NO: 2753403 - RNA, 15 nt, Human
ggcuguacccaggaa

SEQ ID NO: 2753404 - RNA, 15 nt, Human
aaaacuucagacaua

SEQ ID NO: 2753405 - RNA, 17 nt, Human
aaaaaugguuuaaaugg

SEQ ID NO: 2753406 - RNA, 17 nt, Human
aaaaccaguauuguaca

SEQ ID NO: 2753407 - RNA, 16 nt, Human
ggcauaacauaaaucu

SEQ ID NO: 2753408 - RNA, 17 nt, Human
ggcauaacauaaaucug

SEQ ID NO: 2753409 - RNA, 14 nt, Human
ggccuccauccuga

SEQ ID NO: 2753410 - RNA, 15 nt, Human
ggccuccauccugag

SEQ ID NO: 2753411 - RNA, 13 nt, Human
ggccuccauccug

SEQ ID NO: 2753412 - RNA, 21 nt, Human
ggcacaguuuucugagaaaga

SEQ ID NO: 2753413 - RNA, 15 nt, Human
guacuucaugcuguc

SEQ ID NO: 2753414 - RNA, 21 nt, Human
guacuucaaauccuugaagau

SEQ ID NO: 2753415 - RNA, 22 nt, Human
guacuucaaauccuugaagauu

SEQ ID NO: 2753416 - RNA, 23 nt, Human
aaaucauuucugcaucagcugcu

SEQ ID NO: 2753417 - RNA, 22 nt, Human
aaaucauuucugcaucagcugc

SEQ ID NO: 2753418 - RNA, 21 nt, Human
aaaucauuucugcaucagcug

SEQ ID NO: 2753419 - RNA, 19 nt, Human
aaaucauuucugcaucagc

SEQ ID NO: 2753420 - RNA, 11 nt, Human
aaaucauuucu

SEQ ID NO: 2753421 - RNA, 12 nt, Human
aaaucauuucug

SEQ ID NO: 2753422 - RNA, 17 nt, Human
aaauauuauguuaaaac

SEQ ID NO: 2753423 - RNA, 15 nt, Human
aaauccauacauuug

SEQ ID NO: 2753424 - RNA, 20 nt, Human
guaauaggcguaacuaauuu

SEQ ID NO: 2753425 - RNA, 23 nt, Human
guacacugccuucucaacuccaa

SEQ ID NO: 2753426 - RNA, 21 nt, Human
aaauaauuuuuauauuugaaa

SEQ ID NO: 2753427 - RNA, 15 nt, Human
aaauacacacucaaa

SEQ ID NO: 2753428 - RNA, 21 nt, Human
aaauacaauuuuguuucugua

SEQ ID NO: 2753429 - RNA, 22 nt, Human
aaauacaauuuuguuucuguac

SEQ ID NO: 2753430 - RNA, 14 nt, Human
aaauacaauuuugu

SEQ ID NO: 2753431 - RNA, 17 nt, Human
aaauacaauuuuguuuc

SEQ ID NO: 2753432 - RNA, 18 nt, Human
aaauacaauuuuguuucu

SEQ ID NO: 2753433 - RNA, 20 nt, Human
aaauacaauuuuguuucugu

SEQ ID NO: 2753434 - RNA, 22 nt, Human
aaauaauuuuuauauuugaaau

SEQ ID NO: 2753435 - RNA, 23 nt, Human
aaauaauuuuuauauuugaaaua

SEQ ID NO: 2753436 - RNA, 13 nt, Human
aaauacaauuuug

SEQ ID NO: 2753437 - RNA, 19 nt, Human
aaauacacacucaaaucaa

SEQ ID NO: 2753438 - RNA, 18 nt, Human
aaaguauguuagugcaaa

SEQ ID NO: 2753439 - RNA, 20 nt, Human
aaagguauuuuaaucaccaa

SEQ ID NO: 2753440 - RNA, 23 nt, Human
aaaguucugcagauaaacaguag

SEQ ID NO: 2753441 - RNA, 13 nt, Human
aaaguugccuaaa

SEQ ID NO: 2753442 - RNA, 14 nt, Human
aaaguugccuaaau

SEQ ID NO: 2753443 - RNA, 17 nt, Human
aaaguauguuagugcaa

SEQ ID NO: 2753444 - RNA, 13 nt, Human
aaaguauuaagca

SEQ ID NO: 2753445 - RNA, 18 nt, Human
aaaguauuaagcauauau

SEQ ID NO: 2753446 - RNA, 19 nt, Human
aaaguauuaagcauauauu

SEQ ID NO: 2753447 - RNA, 20 nt, Human
aaaguauuaagcauauauuu

SEQ ID NO: 2753448 - RNA, 23 nt, Human
aaaguugccuaaauccauuugga

SEQ ID NO: 2753449 - RNA, 16 nt, Human
aaaguugccuaaaucc

SEQ ID NO: 2753450 - RNA, 17 nt, Human
aaaguugccuaaaucca

SEQ ID NO: 2753451 - RNA, 12 nt, Human
aaaguuuaauau

SEQ ID NO: 2753452 - RNA, 14 nt, Human
aaaguuuaauauua

SEQ ID NO: 2753453 - RNA, 15 nt, Human
aaagaggaaugaagu

SEQ ID NO: 2753454 - RNA, 15 nt, Human
aaagaggcagcuuga

SEQ ID NO: 2753455 - RNA, 14 nt, Human
aaagacuccaaaga

SEQ ID NO: 2753456 - RNA, 21 nt, Human
aaagacuccaaagaaauguaa

SEQ ID NO: 2753457 - RNA, 15 nt, Human
aaagacuccaaagaa

SEQ ID NO: 2753458 - RNA, 21 nt, Human
aaagacuauucaaacagucuc

SEQ ID NO: 2753459 - RNA, 17 nt, Human
aaagacuauucaaacag

SEQ ID NO: 2753460 - RNA, 19 nt, Human
aaagacuauucaaacaguc

SEQ ID NO: 2753461 - RNA, 18 nt, Human
aaagacuauucaaacagu

SEQ ID NO: 2753462 - RNA, 13 nt, Human
aaagacagugaaa

SEQ ID NO: 2753463 - RNA, 11 nt, Human
aaacuuuucug

SEQ ID NO: 2753464 - RNA, 19 nt, Human
aaacuucagacauagaauu

SEQ ID NO: 2753465 - RNA, 23 nt, Human
aaacuucagcgguuuauauaagc

SEQ ID NO: 2753466 - RNA, 14 nt, Human
aaagguacuucaaa

SEQ ID NO: 2753467 - RNA, 21 nt, Human
aaagcacugacuucuaaguaa

SEQ ID NO: 2753468 - RNA, 17 nt, Human
aaagcacugacuucuaa

SEQ ID NO: 2753469 - RNA, 15 nt, Human
aaacucguuaauuug

SEQ ID NO: 2753470 - RNA, 12 nt, Human
aaaccacagcag

SEQ ID NO: 2753471 - RNA, 14 nt, Human
aaacaguagugaua

SEQ ID NO: 2753472 - RNA, 15 nt, Human
aaacagucucaggaa

SEQ ID NO: 2753473 - RNA, 19 nt, Human
ggggaauugaggacacuga

SEQ ID NO: 2753474 - RNA, 14 nt, Human
aaacacagcaaggg

SEQ ID NO: 2753475 - RNA, 12 nt, Human
aaacacagcaag

SEQ ID NO: 2753476 - RNA, 11 nt, Human
aaacacagcaa

SEQ ID NO: 2753477 - RNA, 22 nt, Human
ggacucauuuuaaaaaauggaa

SEQ ID NO: 2753478 - RNA, 13 nt, Human
ggagaaacuggaa

SEQ ID NO: 2753479 - RNA, 12 nt, Human
ggacuuguuaga

SEQ ID NO: 2753480 - RNA, 15 nt, Human
ggacuuguuagaucu

SEQ ID NO: 2753481 - RNA, 21 nt, Human
ggacuucuuuaauuuuggaau

SEQ ID NO: 2753482 - RNA, 18 nt, Human
ggacuucuuuaauuuugg

SEQ ID NO: 2753483 - RNA, 22 nt, Human
ggacuucuuuaauuuuggaauu

SEQ ID NO: 2753484 - RNA, 22 nt, Human
gcugggguuaucugaagucaga

SEQ ID NO: 2753485 - RNA, 23 nt, Human
gcugggguuaucugaagucagau

SEQ ID NO: 2753486 - RNA, 14 nt, Human
gcugggguuaucug

SEQ ID NO: 2753487 - RNA, 22 nt, Human
gcuauuucuauauuuucauucu

SEQ ID NO: 2753488 - RNA, 16 nt, Human
gcuagaacucccuuuc

SEQ ID NO: 2753489 - RNA, 18 nt, Human
gcuagaacucccuuucaa

SEQ ID NO: 2753490 - RNA, 12 nt, Human
gcuagaacuccc

SEQ ID NO: 2753491 - RNA, 13 nt, Human
gcuagaacucccu

SEQ ID NO: 2753492 - RNA, 14 nt, Human
gcuagaacucccuu

SEQ ID NO: 2753493 - RNA, 15 nt, Human
gcuagaacucccuuu

SEQ ID NO: 2753494 - RNA, 15 nt, Human
gcuccacuuggucug

SEQ ID NO: 2753495 - RNA, 21 nt, Human
gcuccccucggagaagagcug

SEQ ID NO: 2753496 - RNA, 18 nt, Human
gcuccacuuggucuguga

SEQ ID NO: 2753497 - RNA, 19 nt, Human
gcuccacuuggucugugag

SEQ ID NO: 2753498 - RNA, 21 nt, Human
gccuucggccuccauccugag

SEQ ID NO: 2753499 - RNA, 20 nt, Human
gccuucggccuccauccuga

SEQ ID NO: 2753500 - RNA, 15 nt, Human
gccucuuagaugcag

SEQ ID NO: 2753501 - RNA, 14 nt, Human
aauacacacucaaa

SEQ ID NO: 2753502 - RNA, 22 nt, Human
aauacaauuuuguuucuguacu

SEQ ID NO: 2753503 - RNA, 23 nt, Human
aauacaauuuuguuucuguacuu

SEQ ID NO: 2753504 - RNA, 15 nt, Human
aauacaauuuuguuu

SEQ ID NO: 2753505 - RNA, 17 nt, Human
aauacaauuuuguuucu

SEQ ID NO: 2753506 - RNA, 18 nt, Human
aauacaauuuuguuucug

SEQ ID NO: 2753507 - RNA, 20 nt, Human
aauacaauuuuguuucugua

SEQ ID NO: 2753508 - RNA, 12 nt, Human
aauacaauuuug

SEQ ID NO: 2753509 - RNA, 13 nt, Human
aauacaauuuugu

SEQ ID NO: 2753510 - RNA, 23 nt, Human
uaaaucccauuauucaaaguugc

SEQ ID NO: 2753511 - RNA, 19 nt, Human
uaaaucccauuauucaaag

SEQ ID NO: 2753512 - RNA, 23 nt, Human
uaaauagcuagacuggugacuga

SEQ ID NO: 2753513 - RNA, 23 nt, Human
uaaauacaauuuuguuucuguac

SEQ ID NO: 2753514 - RNA, 19 nt, Human
uaaauagcuagacugguga

SEQ ID NO: 2753515 - RNA, 15 nt, Human
uaaauacaauuuugu

SEQ ID NO: 2753516 - RNA, 22 nt, Human
uaaauacaauuuuguuucugua

SEQ ID NO: 2753517 - RNA, 13 nt, Human
uaaauacaauuuu

SEQ ID NO: 2753518 - RNA, 15 nt, Human
uaacaaugcuguauu

SEQ ID NO: 2753519 - RNA, 17 nt, Human
uaacaaugcuguauuuu

SEQ ID NO: 2753520 - RNA, 13 nt, Human
uaacaaugcugua

SEQ ID NO: 2753521 - RNA, 16 nt, Human
uaacaacagcuggugc

SEQ ID NO: 2753522 - RNA, 17 nt, Human
uaaaugauuucauucaa

SEQ ID NO: 2753523 - RNA, 15 nt, Human
uaaauguugacaugg

SEQ ID NO: 2753524 - RNA, 12 nt, Human
aauaaaaauaau

SEQ ID NO: 2753525 - RNA, 22 nt, Human
aauaaaauccauacauuugugu

SEQ ID NO: 2753526 - RNA, 15 nt, Human
aauaaaaaauuauga

SEQ ID NO: 2753527 - RNA, 16 nt, Human
aauaaaaaauuaugac

SEQ ID NO: 2753528 - RNA, 14 nt, Human
aauaaaaaauuaug

SEQ ID NO: 2753529 - RNA, 15 nt, Human
aauaacgauaaaaga

SEQ ID NO: 2753530 - RNA, 15 nt, Human
aauaacaauaaaaga

SEQ ID NO: 2753531 - RNA, 21 nt, Human
aauaaaugugccuucauuuuu

SEQ ID NO: 2753532 - RNA, 12 nt, Human
aauaaaugugcc

SEQ ID NO: 2753533 - RNA, 21 nt, Human
aauaaauagcuagacugguga

SEQ ID NO: 2753534 - RNA, 20 nt, Human
aauaauuauaugcuauuucu

SEQ ID NO: 2753535 - RNA, 21 nt, Human
aauaauuauaugcuauuucua

SEQ ID NO: 2753536 - RNA, 22 nt, Human
aauaauuauaugcuauuucuau

SEQ ID NO: 2753537 - RNA, 23 nt, Human
aauaauuauaugcuauuucuaua

SEQ ID NO: 2753538 - RNA, 14 nt, Human
aauaauuauaugcu

SEQ ID NO: 2753539 - RNA, 15 nt, Human
aauaauuauaugcua

SEQ ID NO: 2753540 - RNA, 16 nt, Human
aauaaggaaaaguuua

SEQ ID NO: 2753541 - RNA, 19 nt, Human
aauaaggaaaaguuuaaua

SEQ ID NO: 2753542 - RNA, 22 nt, Human
aauaaggaaaaguuuaauauua

SEQ ID NO: 2753543 - RNA, 13 nt, Human
aauaaggaaaagu

SEQ ID NO: 2753544 - RNA, 15 nt, Human
aauaaggaaaaguuu

SEQ ID NO: 2753545 - RNA, 19 nt, Human
uaaaccaaggcuagaacca

SEQ ID NO: 2753546 - RNA, 19 nt, Human
aaguuuaauauuaaagcca

SEQ ID NO: 2753547 - RNA, 20 nt, Human
aaguuuaauauuaaagccau

SEQ ID NO: 2753548 - RNA, 21 nt, Human
aaguuuaauauuaaagccaug

SEQ ID NO: 2753549 - RNA, 18 nt, Human
aaguuuaauauuaaagcc

SEQ ID NO: 2753550 - RNA, 18 nt, Human
uaaaccaugggauaaaug

SEQ ID NO: 2753551 - RNA, 20 nt, Human
uaaaccaugggauaaaugcc

SEQ ID NO: 2753552 - RNA, 21 nt, Human
uaaaccaugggauaaaugcca

SEQ ID NO: 2753553 - RNA, 22 nt, Human
uaaaccaugggauaaaugccau

SEQ ID NO: 2753554 - RNA, 19 nt, Human
aaggaaaaaauaacaauga

SEQ ID NO: 2753555 - RNA, 16 nt, Human
aaggaaaaaauaacaa

SEQ ID NO: 2753556 - RNA, 13 nt, Human
aaggauaaugaau

SEQ ID NO: 2753557 - RNA, 23 nt, Human
guuuuuuuuuaaaaaagaaacau

SEQ ID NO: 2753558 - RNA, 23 nt, Human
aaguauguuagugcaaauuguca

SEQ ID NO: 2753559 - RNA, 21 nt, Human
aaguauguuagugcaaauugu

SEQ ID NO: 2753560 - RNA, 13 nt, Human
aaguauuaagcau

SEQ ID NO: 2753561 - RNA, 22 nt, Human
guuuucugagaaagacuauuca

SEQ ID NO: 2753562 - RNA, 17 nt, Human
guuuucugagaaagacu

SEQ ID NO: 2753563 - RNA, 16 nt, Human
guuuucugagaaagac

SEQ ID NO: 2753564 - RNA, 21 nt, Human
aagggugaugggaaagcauug

SEQ ID NO: 2753565 - RNA, 16 nt, Human
aaguaaaaccacagca

SEQ ID NO: 2753566 - RNA, 15 nt, Human
aaguaaaaccacagc

SEQ ID NO: 2753567 - RNA, 14 nt, Human
aaguaaaaccacag

SEQ ID NO: 2753568 - RNA, 18 nt, Human
aaguaaaaccacagcagu

SEQ ID NO: 2753569 - RNA, 17 nt, Human
aaguaaaaccacagcag

SEQ ID NO: 2753570 - RNA, 15 nt, Human
guuuuauaauuuugu

SEQ ID NO: 2753571 - RNA, 22 nt, Human
guuuuauaauuuugugaagcaa

SEQ ID NO: 2753572 - RNA, 15 nt, Human
guuuucugagaaaga

SEQ ID NO: 2753573 - RNA, 15 nt, Human
guuucuguacuuuuu

SEQ ID NO: 2753574 - RNA, 10 nt, Human
guuucuguac

SEQ ID NO: 2753575 - RNA, 13 nt, Human
aagaauauuuuaa

SEQ ID NO: 2753576 - RNA, 13 nt, Human
aagacccaaaagg

SEQ ID NO: 2753577 - RNA, 19 nt, Human
gugcugguguaugugugaa

SEQ ID NO: 2753578 - RNA, 22 nt, Human
gugcugggguuaucugaaguca

SEQ ID NO: 2753579 - RNA, 13 nt, Human
aagaaaauaucac

SEQ ID NO: 2753580 - RNA, 22 nt, Human
aagaagcaccaaucaugaauua

SEQ ID NO: 2753581 - RNA, 15 nt, Human
aacuuguguaaauac

SEQ ID NO: 2753582 - RNA, 20 nt, Human
aacuuguguaaauacaauuu

SEQ ID NO: 2753583 - RNA, 14 nt, Human
aacuuguguaaaua

SEQ ID NO: 2753584 - RNA, 19 nt, Human
aagauguagaggagaaacu

SEQ ID NO: 2753585 - RNA, 13 nt, Human
aagcaaaauguga

SEQ ID NO: 2753586 - RNA, 22 nt, Human
aagauguagaggagaaacugga

SEQ ID NO: 2753587 - RNA, 19 nt, Human
aagcaaaauuuuuucucua

SEQ ID NO: 2753588 - RNA, 16 nt, Human
aagcaaguauuagaau

SEQ ID NO: 2753589 - RNA, 21 nt, Human
guguugaaacggaugauuucu

SEQ ID NO: 2753590 - RNA, 23 nt, Human
guguugaaacggaugauuucuau

SEQ ID NO: 2753591 - RNA, 13 nt, Human
aagacuauucaaa

SEQ ID NO: 2753592 - RNA, 14 nt, Human
aagacuauucaaac

SEQ ID NO: 2753593 - RNA, 14 nt, Human
aagacuccaaagaa

SEQ ID NO: 2753594 - RNA, 17 nt, Human
aagacuccaaagaaaug

SEQ ID NO: 2753595 - RNA, 16 nt, Human
aagacuccaaagaaau

SEQ ID NO: 2753596 - RNA, 18 nt, Human
aagagcuguucacagcca

SEQ ID NO: 2753597 - RNA, 14 nt, Human
guggguagacacac

SEQ ID NO: 2753598 - RNA, 19 nt, Human
aacagucucaggaaaucaa

SEQ ID NO: 2753599 - RNA, 17 nt, Human
aacagucucaggaaauc

SEQ ID NO: 2753600 - RNA, 19 nt, Human
aacagauuauuaccuuaca

SEQ ID NO: 2753601 - RNA, 16 nt, Human
aacauauauaacaaug

SEQ ID NO: 2753602 - RNA, 23 nt, Human
aacauguuaaaccaugggauaaa

SEQ ID NO: 2753603 - RNA, 15 nt, Human
aacauaaaucuguga

SEQ ID NO: 2753604 - RNA, 12 nt, Human
aacauaaaucug

SEQ ID NO: 2753605 - RNA, 14 nt, Human
aacauaaaucugug

SEQ ID NO: 2753606 - RNA, 23 nt, Human
guccaugaagauguagaggagaa

SEQ ID NO: 2753607 - RNA, 23 nt, Human
gucucaguccaugaagauguaga

SEQ ID NO: 2753608 - RNA, 13 nt, Human
gucuucacaacag

SEQ ID NO: 2753609 - RNA, 13 nt, Human
aacugaaaucaua

SEQ ID NO: 2753610 - RNA, 20 nt, Human
aacugaaaucauacuucuua

SEQ ID NO: 2753611 - RNA, 13 nt, Human
aacuauauuguuu

SEQ ID NO: 2753612 - RNA, 20 nt, Human
aacuaucucauuuccaagca

SEQ ID NO: 2753613 - RNA, 15 nt, Human
aaugaaugaaugaau

SEQ ID NO: 2753614 - RNA, 18 nt, Human
uacaaaaacacagcaagg

SEQ ID NO: 2753615 - RNA, 17 nt, Human
uacaaaaacacagcaag

SEQ ID NO: 2753616 - RNA, 16 nt, Human
uacaaaaacacagcaa

SEQ ID NO: 2753617 - RNA, 21 nt, Human
uaauuauaugcuauuucuaua

SEQ ID NO: 2753618 - RNA, 20 nt, Human
uaauuauaugcuauuucuau

SEQ ID NO: 2753619 - RNA, 13 nt, Human
uaauuauaucuga

SEQ ID NO: 2753620 - RNA, 17 nt, Human
uaauuauaucugaggaa

SEQ ID NO: 2753621 - RNA, 16 nt, Human
aaugguuuaaaugguc

SEQ ID NO: 2753622 - RNA, 18 nt, Human
aauguugacaugggacau

SEQ ID NO: 2753623 - RNA, 13 nt, Human
aauuaacauguua

SEQ ID NO: 2753624 - RNA, 14 nt, Human
aauuaacauguuaa

SEQ ID NO: 2753625 - RNA, 18 nt, Human
aauuaacauguuaaacca

SEQ ID NO: 2753626 - RNA, 13 nt, Human
aauugacccacaa

SEQ ID NO: 2753627 - RNA, 16 nt, Human
aauugacccacaagaa

SEQ ID NO: 2753628 - RNA, 19 nt, Human
aauugacccacaagaaaug

SEQ ID NO: 2753629 - RNA, 21 nt, Human
aauucuugccaaauauaaaua

SEQ ID NO: 2753630 - RNA, 13 nt, Human
uacucaauuuuaa

SEQ ID NO: 2753631 - RNA, 14 nt, Human
uacucaauuuuaac

SEQ ID NO: 2753632 - RNA, 12 nt, Human
uacucaauuuua

SEQ ID NO: 2753633 - RNA, 23 nt, Human
aauugugugaaagguacuucaaa

SEQ ID NO: 2753634 - RNA, 20 nt, Human
aauuucucccagucauuuaa

SEQ ID NO: 2753635 - RNA, 14 nt, Human
uacuucaaauccuu

SEQ ID NO: 2753636 - RNA, 19 nt, Human
uacuucaaauccuugaaga

SEQ ID NO: 2753637 - RNA, 13 nt, Human
aauuugaauuuug

SEQ ID NO: 2753638 - RNA, 16 nt, Human
aauuugaauuuugugu

SEQ ID NO: 2753639 - RNA, 18 nt, Human
aauuugaauuuuguguua

SEQ ID NO: 2753640 - RNA, 19 nt, Human
aauuuuuucucuaggaaau

SEQ ID NO: 2753641 - RNA, 16 nt, Human
acaaaaacacagcaag

SEQ ID NO: 2753642 - RNA, 19 nt, Human
aauuuuuauauuugaaaua

SEQ ID NO: 2753643 - RNA, 18 nt, Human
uagaacucccuuucaaca

SEQ ID NO: 2753644 - RNA, 21 nt, Human
uacuucaaauccuugaagauu

SEQ ID NO: 2753645 - RNA, 15 nt, Human
uagaacucccuuuca

SEQ ID NO: 2753646 - RNA, 14 nt, Human
uagaaccucuuugu

SEQ ID NO: 2753647 - RNA, 22 nt, Human
acaagaaaugaaagcagggacu

SEQ ID NO: 2753648 - RNA, 18 nt, Human
acaagcacuaaacaaaga

SEQ ID NO: 2753649 - RNA, 18 nt, Human
uagcaugucgucaaagcu

SEQ ID NO: 2753650 - RNA, 21 nt, Human
uagcaugucgucaaagcugaa

SEQ ID NO: 2753651 - RNA, 17 nt, Human
uagaugcaguucugaag

SEQ ID NO: 2753652 - RNA, 19 nt, Human
uagaugcaguucugaagaa

SEQ ID NO: 2753653 - RNA, 16 nt, Human
uagaugcaguucugaa

SEQ ID NO: 2753654 - RNA, 21 nt, Human
uagaggaagccugauuaaaga

SEQ ID NO: 2753655 - RNA, 14 nt, Human
uauuuauuuuaaua

SEQ ID NO: 2753656 - RNA, 16 nt, Human
uauuuauuuuaauaau

SEQ ID NO: 2753657 - RNA, 18 nt, Human
uauuuauuuuaauaaugu

SEQ ID NO: 2753658 - RNA, 18 nt, Human
uauuuacuaaaauggacu

SEQ ID NO: 2753659 - RNA, 17 nt, Human
uauugucuagugaaacu

SEQ ID NO: 2753660 - RNA, 15 nt, Human
uauuguacaaaguau

SEQ ID NO: 2753661 - RNA, 16 nt, Human
uauuguacaaaguauu

SEQ ID NO: 2753662 - RNA, 21 nt, Human
uauuguacaaaguauuaagca

SEQ ID NO: 2753663 - RNA, 22 nt, Human
uauuguacaaaguauuaagcau

SEQ ID NO: 2753664 - RNA, 23 nt, Human
uauuguacaaaguauuaagcaua

SEQ ID NO: 2753665 - RNA, 23 nt, Human
acaguucggugagcuacaaaugc

SEQ ID NO: 2753666 - RNA, 22 nt, Human
acaguucggugagcuacaaaug

SEQ ID NO: 2753667 - RNA, 19 nt, Human
acaguucggugagcuacaa

SEQ ID NO: 2753668 - RNA, 21 nt, Human
uauuggcuuuucugauccagu

SEQ ID NO: 2753669 - RNA, 22 nt, Human
uauuggcuuuucugauccaguu

SEQ ID NO: 2753670 - RNA, 15 nt, Human
uauuggcuuuucuga

SEQ ID NO: 2753671 - RNA, 16 nt, Human
uauuggcuuuucugau

SEQ ID NO: 2753672 - RNA, 17 nt, Human
uauuggcuuuucugauc

SEQ ID NO: 2753673 - RNA, 18 nt, Human
uauuggcuuuucugaucc

SEQ ID NO: 2753674 - RNA, 14 nt, Human
uauuggcuuuucug

SEQ ID NO: 2753675 - RNA, 23 nt, Human
uauucauagcagcuuauucacaa

SEQ ID NO: 2753676 - RNA, 21 nt, Human
uauucaaaguugccuaaaucc

SEQ ID NO: 2753677 - RNA, 22 nt, Human
uauucaaaguugccuaaaucca

SEQ ID NO: 2753678 - RNA, 18 nt, Human
uauucaaaguugccuaaa

SEQ ID NO: 2753679 - RNA, 23 nt, Human
uauucaaaguugccuaaauccau

SEQ ID NO: 2753680 - RNA, 19 nt, Human
uauucacugauuugacaua

SEQ ID NO: 2753681 - RNA, 22 nt, Human
uauucacugauuugacauaguc

SEQ ID NO: 2753682 - RNA, 13 nt, Human
uauucacugauuu

SEQ ID NO: 2753683 - RNA, 15 nt, Human
uauuagaauaccaca

SEQ ID NO: 2753684 - RNA, 12 nt, Human
uauuaaaacuca

SEQ ID NO: 2753685 - RNA, 13 nt, Human
uauuaaagccaug

SEQ ID NO: 2753686 - RNA, 14 nt, Human
uauuaaagccaugu

SEQ ID NO: 2753687 - RNA, 12 nt, Human
uauuaaagccau

SEQ ID NO: 2753688 - RNA, 16 nt, Human
uauuacaguauaauua

SEQ ID NO: 2753689 - RNA, 18 nt, Human
uauuacaguauaauuaac

SEQ ID NO: 2753690 - RNA, 20 nt, Human
uauuacaguauaauuaacau

SEQ ID NO: 2753691 - RNA, 21 nt, Human
uauuacaguauaauuaacaug

SEQ ID NO: 2753692 - RNA, 14 nt, Human
uauuacaguauaau

SEQ ID NO: 2753693 - RNA, 17 nt, Human
uauuaaagccauguuua

SEQ ID NO: 2753694 - RNA, 18 nt, Human
uauuaaagccauguuuau

SEQ ID NO: 2753695 - RNA, 20 nt, Human
uauuaaagccauguuuauua

SEQ ID NO: 2753696 - RNA, 17 nt, Human
acagcuggugcccugcu

SEQ ID NO: 2753697 - RNA, 20 nt, Human
acagcuggugcccugcuuuc

SEQ ID NO: 2753698 - RNA, 16 nt, Human
acagucucaggaaauc

SEQ ID NO: 2753699 - RNA, 15 nt, Human
acagucucaggaaau

SEQ ID NO: 2753700 - RNA, 14 nt, Human
acagucucaggaaa

SEQ ID NO: 2753701 - RNA, 13 nt, Human
acagucucaggaa

SEQ ID NO: 2753702 - RNA, 20 nt, Human
acagugaaagaaaauaacaa

SEQ ID NO: 2753703 - RNA, 17 nt, Human
acagucucaggaaauca

SEQ ID NO: 2753704 - RNA, 14 nt, Human
acagugagacucug

SEQ ID NO: 2753705 - RNA, 18 nt, Human
acagugagacucugucuc

SEQ ID NO: 2753706 - RNA, 21 nt, Human
acaguuaccucugccucagaa

SEQ ID NO: 2753707 - RNA, 21 nt, Human
acaguauggcagcuuuccuca

SEQ ID NO: 2753708 - RNA, 23 nt, Human
acaguauaauuaacauguuaaac

SEQ ID NO: 2753709 - RNA, 21 nt, Human
acaguauaauuaacauguuaa

SEQ ID NO: 2753710 - RNA, 15 nt, Human
uauauuuacaaaugg

SEQ ID NO: 2753711 - RNA, 14 nt, Human
uauauuuacaaaug

SEQ ID NO: 2753712 - RNA, 20 nt, Human
uaucaccugucuugccuuuu

SEQ ID NO: 2753713 - RNA, 17 nt, Human
uauggcuauaggugcua

SEQ ID NO: 2753714 - RNA, 16 nt, Human
uauggcuauaggugcu

SEQ ID NO: 2753715 - RNA, 20 nt, Human
uaugauccagcagauuauuc

SEQ ID NO: 2753716 - RNA, 21 nt, Human
uaugauccagcagauuauuca

SEQ ID NO: 2753717 - RNA, 22 nt, Human
uaugauccagcagauuauucac

SEQ ID NO: 2753718 - RNA, 11 nt, Human
uaugauccagc

SEQ ID NO: 2753719 - RNA, 19 nt, Human
uaugauccagcagauuauu

SEQ ID NO: 2753720 - RNA, 10 nt, Human
uaugauccag

SEQ ID NO: 2753721 - RNA, 14 nt, Human
uauaggaauugacc

SEQ ID NO: 2753722 - RNA, 13 nt, Human
uauaggaauugac

SEQ ID NO: 2753723 - RNA, 23 nt, Human
uauaggugcuacaaaaacacagc

SEQ ID NO: 2753724 - RNA, 20 nt, Human
uauaggugcuacaaaaacac

SEQ ID NO: 2753725 - RNA, 21 nt, Human
uauaggugcuacaaaaacaca

SEQ ID NO: 2753726 - RNA, 18 nt, Human
uauaacaaugcuguauuu

SEQ ID NO: 2753727 - RNA, 14 nt, Human
uauaauuuugugaa

SEQ ID NO: 2753728 - RNA, 19 nt, Human
uauagauuagagaguguug

SEQ ID NO: 2753729 - RNA, 22 nt, Human
uauagauuagagaguguugaaa

SEQ ID NO: 2753730 - RNA, 20 nt, Human
uauagauuagaauucuguau

SEQ ID NO: 2753731 - RNA, 19 nt, Human
uauagauuagaauucugua

SEQ ID NO: 2753732 - RNA, 15 nt, Human
uaguuuuauaugcuu

SEQ ID NO: 2753733 - RNA, 16 nt, Human
uaguuuuauaugcuuc

SEQ ID NO: 2753734 - RNA, 22 nt, Human
uagugagcagucaggaaagaga

SEQ ID NO: 2753735 - RNA, 22 nt, Human
acacaucagcuugcccuguuaa

SEQ ID NO: 2753736 - RNA, 21 nt, Human
uauaaaauaauuuuuauauuu

SEQ ID NO: 2753737 - RNA, 22 nt, Human
uauaaaauaauuuuuauauuug

SEQ ID NO: 2753738 - RNA, 20 nt, Human
uccucaaaacuucagacaua

SEQ ID NO: 2753739 - RNA, 22 nt, Human
acucuccauuuaauaauuauau

SEQ ID NO: 2753740 - RNA, 14 nt, Human
uccgugcuaaggac

SEQ ID NO: 2753741 - RNA, 15 nt, Human
uccgugcuaaggacu

SEQ ID NO: 2753742 - RNA, 12 nt, Human
uccccuccucug

SEQ ID NO: 2753743 - RNA, 13 nt, Human
acuaaaaauacaa

SEQ ID NO: 2753744 - RNA, 13 nt, Human
uccuucagccuga

SEQ ID NO: 2753745 - RNA, 22 nt, Human
acuggcacaguuuucugagaaa

SEQ ID NO: 2753746 - RNA, 21 nt, Human
acuggcacaguuuucugagaa

SEQ ID NO: 2753747 - RNA, 20 nt, Human
acugccuucucaacuccaaa

SEQ ID NO: 2753748 - RNA, 22 nt, Human
acugccuucucaacuccaaacu

SEQ ID NO: 2753749 - RNA, 13 nt, Human
acuggauuguacu

SEQ ID NO: 2753750 - RNA, 16 nt, Human
acuggauuguacuuug

SEQ ID NO: 2753751 - RNA, 18 nt, Human
uccugggcagcugccucc

SEQ ID NO: 2753752 - RNA, 19 nt, Human
uccugggcagcugccuccc

SEQ ID NO: 2753753 - RNA, 22 nt, Human
uccugggcagcugccuccccuc

SEQ ID NO: 2753754 - RNA, 23 nt, Human
uccugggcagcugccuccccucc

SEQ ID NO: 2753755 - RNA, 14 nt, Human
uccugggcagcugc

SEQ ID NO: 2753756 - RNA, 15 nt, Human
uccugggcagcugcc

SEQ ID NO: 2753757 - RNA, 16 nt, Human
uccugggcagcugccu

SEQ ID NO: 2753758 - RNA, 17 nt, Human
uccugggcagcugccuc

SEQ ID NO: 2753759 - RNA, 17 nt, Human
acugaggggaggggagc

SEQ ID NO: 2753760 - RNA, 22 nt, Human
acugaggggaggggagcauggg

SEQ ID NO: 2753761 - RNA, 20 nt, Human
uccagccugagcgacaguga

SEQ ID NO: 2753762 - RNA, 21 nt, Human
uccagccugagcgacagugag

SEQ ID NO: 2753763 - RNA, 22 nt, Human
ucaugaauuaguuuuauaugcu

SEQ ID NO: 2753764 - RNA, 21 nt, Human
ucaugaauuaguuuuauaugc

SEQ ID NO: 2753765 - RNA, 14 nt, Human
ucagauuuuauuau

SEQ ID NO: 2753766 - RNA, 15 nt, Human
ucagauuuuauuaug

SEQ ID NO: 2753767 - RNA, 13 nt, Human
ucagauuuuauua

SEQ ID NO: 2753768 - RNA, 21 nt, Human
ucagaucugccuaaggacuuc

SEQ ID NO: 2753769 - RNA, 16 nt, Human
ucagauuuuauuaugu

SEQ ID NO: 2753770 - RNA, 19 nt, Human
ucagauuuuauuauguaaa

SEQ ID NO: 2753771 - RNA, 20 nt, Human
ucagauuuuauuauguaaau

SEQ ID NO: 2753772 - RNA, 13 nt, Human
acccaaaaggcag

SEQ ID NO: 2753773 - RNA, 15 nt, Human
acccaaaaggcagaa

SEQ ID NO: 2753774 - RNA, 21 nt, Human
acccaaauguucaucaaugaa

SEQ ID NO: 2753775 - RNA, 18 nt, Human
acccaaaaggcagaagca

SEQ ID NO: 2753776 - RNA, 12 nt, Human
uauuucauuucu

SEQ ID NO: 2753777 - RNA, 11 nt, Human
accacagcagu

SEQ ID NO: 2753778 - RNA, 14 nt, Human
accacugcagaaga

SEQ ID NO: 2753779 - RNA, 19 nt, Human
accacugcagaagacagua

SEQ ID NO: 2753780 - RNA, 13 nt, Human
accacugcagaag

SEQ ID NO: 2753781 - RNA, 19 nt, Human
accacuuguguuuugcaag

SEQ ID NO: 2753782 - RNA, 23 nt, Human
accacuuguguuuugcaagccag

SEQ ID NO: 2753783 - RNA, 16 nt, Human
agcaccaaucaugaau

SEQ ID NO: 2753784 - RNA, 22 nt, Human
agcacagccucuuagaugcagu

SEQ ID NO: 2753785 - RNA, 14 nt, Human
agcaacgcaggccc

SEQ ID NO: 2753786 - RNA, 14 nt, Human
agcagaacagugau

SEQ ID NO: 2753787 - RNA, 13 nt, Human
ugagcgacaguga

SEQ ID NO: 2753788 - RNA, 14 nt, Human
ugagcgacagugag

SEQ ID NO: 2753789 - RNA, 16 nt, Human
ugagcgacagugagac

SEQ ID NO: 2753790 - RNA, 20 nt, Human
ugagcgacagugagacucug

SEQ ID NO: 2753791 - RNA, 22 nt, Human
ugagguacugagagugaacaaa

SEQ ID NO: 2753792 - RNA, 17 nt, Human
ugagguacugagaguga

SEQ ID NO: 2753793 - RNA, 15 nt, Human
agcagauuauucacu

SEQ ID NO: 2753794 - RNA, 16 nt, Human
agcagauuauucacug

SEQ ID NO: 2753795 - RNA, 14 nt, Human
agcagauuauucac

SEQ ID NO: 2753796 - RNA, 19 nt, Human
agcagauuauucacugauu

SEQ ID NO: 2753797 - RNA, 20 nt, Human
agcagauuauucacugauuu

SEQ ID NO: 2753798 - RNA, 15 nt, Human
ugaggacacugauau

SEQ ID NO: 2753799 - RNA, 18 nt, Human
ugaggaauucuguauaga

SEQ ID NO: 2753800 - RNA, 19 nt, Human
ugaggaauucuguauagau

SEQ ID NO: 2753801 - RNA, 15 nt, Human
ugaggaauucuguau

SEQ ID NO: 2753802 - RNA, 16 nt, Human
ugaggaauucuguaua

SEQ ID NO: 2753803 - RNA, 14 nt, Human
ugaggaauucugua

SEQ ID NO: 2753804 - RNA, 14 nt, Human
ugagcuacaaaugc

SEQ ID NO: 2753805 - RNA, 13 nt, Human
ugagcuacaaaug

SEQ ID NO: 2753806 - RNA, 16 nt, Human
ugagcuacaaaugcau

SEQ ID NO: 2753807 - RNA, 22 nt, Human
agagugaacaaauuuacagaga

SEQ ID NO: 2753808 - RNA, 14 nt, Human
agagugaacaaauu

SEQ ID NO: 2753809 - RNA, 18 nt, Human
ugaagauguagaggagaa

SEQ ID NO: 2753810 - RNA, 17 nt, Human
ugaagauguagaggaga

SEQ ID NO: 2753811 - RNA, 14 nt, Human
ugaagaagauggua

SEQ ID NO: 2753812 - RNA, 20 nt, Human
ugaagaagcaccaaucauga

SEQ ID NO: 2753813 - RNA, 23 nt, Human
agaugcuagaacucccuuucaac

SEQ ID NO: 2753814 - RNA, 22 nt, Human
agaugcuagaacucccuuucaa

SEQ ID NO: 2753815 - RNA, 19 nt, Human
agaugaugaugaucuuuaa

SEQ ID NO: 2753816 - RNA, 14 nt, Human
agauccuggaaauc

SEQ ID NO: 2753817 - RNA, 15 nt, Human
ugaauuuauuggcuu

SEQ ID NO: 2753818 - RNA, 16 nt, Human
ugaauuuauuggcuuu

SEQ ID NO: 2753819 - RNA, 12 nt, Human
ugaauuuauugg

SEQ ID NO: 2753820 - RNA, 15 nt, Human
ugacuguuuccauca

SEQ ID NO: 2753821 - RNA, 16 nt, Human
agauuauucacugauu

SEQ ID NO: 2753822 - RNA, 16 nt, Human
agauugugccccugca

SEQ ID NO: 2753823 - RNA, 16 nt, Human
agauuuaccacuugug

SEQ ID NO: 2753824 - RNA, 21 nt, Human
agauuuuauuauguaaauccc

SEQ ID NO: 2753825 - RNA, 20 nt, Human
agauuuuauuauguaaaucc

SEQ ID NO: 2753826 - RNA, 22 nt, Human
agauuuuauuauguaaauccca

SEQ ID NO: 2753827 - RNA, 15 nt, Human
agcaaaaauauuuua

SEQ ID NO: 2753828 - RNA, 17 nt, Human
agcaaaaauauuuuaug

SEQ ID NO: 2753829 - RNA, 18 nt, Human
agcaaaaauauuuuauga

SEQ ID NO: 2753830 - RNA, 19 nt, Human
agcaaaaauauuuuaugau

SEQ ID NO: 2753831 - RNA, 23 nt, Human
agcaaaaauauuuuaugauccag

SEQ ID NO: 2753832 - RNA, 16 nt, Human
ucucuggccuucggcc

SEQ ID NO: 2753833 - RNA, 17 nt, Human
ucucuggccuucggccu

SEQ ID NO: 2753834 - RNA, 13 nt, Human
ucucuggccuucg

SEQ ID NO: 2753835 - RNA, 12 nt, Human
ucucuucuuuaa

SEQ ID NO: 2753836 - RNA, 13 nt, Human
ucucuucuuuaaa

SEQ ID NO: 2753837 - RNA, 13 nt, Human
agaaacuggaacu

SEQ ID NO: 2753838 - RNA, 15 nt, Human
agaaacuggaacucu

SEQ ID NO: 2753839 - RNA, 14 nt, Human
agaaagaaaaucag

SEQ ID NO: 2753840 - RNA, 15 nt, Human
agaaacauuugguaa

SEQ ID NO: 2753841 - RNA, 19 nt, Human
agaaaacaaggaugaauua

SEQ ID NO: 2753842 - RNA, 16 nt, Human
agaaaacaaggaugaa

SEQ ID NO: 2753843 - RNA, 22 nt, Human
acuuuuuauggcacuaguauuu

SEQ ID NO: 2753844 - RNA, 21 nt, Human
acuuguguaaauacaauuuug

SEQ ID NO: 2753845 - RNA, 22 nt, Human
acuuguguaaauacaauuuugu

SEQ ID NO: 2753846 - RNA, 23 nt, Human
acuuguguaaauacaauuuuguu

SEQ ID NO: 2753847 - RNA, 15 nt, Human
ucucccagucauuua

SEQ ID NO: 2753848 - RNA, 12 nt, Human
ucuccauuuaau

SEQ ID NO: 2753849 - RNA, 16 nt, Human
ucuccauuuaauaauu

SEQ ID NO: 2753850 - RNA, 19 nt, Human
ucuccauuuaauaauuaua

SEQ ID NO: 2753851 - RNA, 12 nt, Human
ucugcuugccau

SEQ ID NO: 2753852 - RNA, 11 nt, Human
ucugcuugcca

SEQ ID NO: 2753853 - RNA, 21 nt, Human
agaagaacugaaaucauacuu

SEQ ID NO: 2753854 - RNA, 14 nt, Human
ucugccuaaggacu

SEQ ID NO: 2753855 - RNA, 15 nt, Human
ucugccuaaggacuu

SEQ ID NO: 2753856 - RNA, 16 nt, Human
ucugccuaaggacuuc

SEQ ID NO: 2753857 - RNA, 13 nt, Human
ucugccuaaggac

SEQ ID NO: 2753858 - RNA, 14 nt, Human
agaacucccuuuca

SEQ ID NO: 2753859 - RNA, 22 nt, Human
agaaccucuuugucuacaccau

SEQ ID NO: 2753860 - RNA, 22 nt, Human
ucugagaaagacuauucaaaca

SEQ ID NO: 2753861 - RNA, 21 nt, Human
ucugagaaagacuauucaaac

SEQ ID NO: 2753862 - RNA, 23 nt, Human
ucugagaaagacuauucaaacag

SEQ ID NO: 2753863 - RNA, 20 nt, Human
ucugagaaagacuauucaaa

SEQ ID NO: 2753864 - RNA, 19 nt, Human
ucugagaaagacuauucaa

SEQ ID NO: 2753865 - RNA, 15 nt, Human
ucugagaaagacuau

SEQ ID NO: 2753866 - RNA, 14 nt, Human
ucugagaaagacua

SEQ ID NO: 2753867 - RNA, 21 nt, Human
ucugacuguuuccaucaaggg

SEQ ID NO: 2753868 - RNA, 23 nt, Human
agaaagacuauucaaacagucuc

SEQ ID NO: 2753869 - RNA, 20 nt, Human
agaaagacuauucaaacagu

SEQ ID NO: 2753870 - RNA, 18 nt, Human
agaaagacuauucaaaca

SEQ ID NO: 2753871 - RNA, 19 nt, Human
agaaagacuauucaaacag

SEQ ID NO: 2753872 - RNA, 21 nt, Human
agacuauucaaacagucucag

SEQ ID NO: 2753873 - RNA, 20 nt, Human
agacuauucaaacagucuca

SEQ ID NO: 2753874 - RNA, 18 nt, Human
agacuauucaaacagucu

SEQ ID NO: 2753875 - RNA, 12 nt, Human
agacuccaaaga

SEQ ID NO: 2753876 - RNA, 14 nt, Human
agacuccaaagaaa

SEQ ID NO: 2753877 - RNA, 13 nt, Human
agacuccaaagaa

SEQ ID NO: 2753878 - RNA, 16 nt, Human
agacuauucaaacagu

SEQ ID NO: 2753879 - RNA, 19 nt, Human
agacuccaaagaaauguaa

SEQ ID NO: 2753880 - RNA, 16 nt, Human
agacuccaaagaaaug

SEQ ID NO: 2753881 - RNA, 21 nt, Human
ucuuuaaagggauggcaagau

SEQ ID NO: 2753882 - RNA, 13 nt, Human
ucuuuaauuuugg

SEQ ID NO: 2753883 - RNA, 17 nt, Human
ucuuuaaaauacacacu

SEQ ID NO: 2753884 - RNA, 14 nt, Human
ucuuuaauuuugga

SEQ ID NO: 2753885 - RNA, 15 nt, Human
ucuuuaauuuuggaa

SEQ ID NO: 2753886 - RNA, 16 nt, Human
ucuuuaauuuuggaau

SEQ ID NO: 2753887 - RNA, 17 nt, Human
ucuuuaauuuuggaauu

SEQ ID NO: 2753888 - RNA, 18 nt, Human
ucuuuaauuuuggaauuu

SEQ ID NO: 2753889 - RNA, 18 nt, Human
agagacacacugaagaag

SEQ ID NO: 2753890 - RNA, 20 nt, Human
agagacacacugaagaagca

SEQ ID NO: 2753891 - RNA, 15 nt, Human
agagaaugagagaca

SEQ ID NO: 2753892 - RNA, 17 nt, Human
agagacacacugaagaa

SEQ ID NO: 2753893 - RNA, 15 nt, Human
agacuggcacaguuu

SEQ ID NO: 2753894 - RNA, 14 nt, Human
agacuggcacaguu

SEQ ID NO: 2753895 - RNA, 18 nt, Human
agacuggcacaguuuucu

SEQ ID NO: 2753896 - RNA, 14 nt, Human
ucuuaauuaaaaga

SEQ ID NO: 2753897 - RNA, 21 nt, Human
ucuuaauuaaaagaauauuuu

SEQ ID NO: 2753898 - RNA, 18 nt, Human
ucuuaauuaaaagaauau

SEQ ID NO: 2753899 - RNA, 18 nt, Human
ucuguuuuauaauuuugu

SEQ ID NO: 2753900 - RNA, 16 nt, Human
ucuguauagauuagag

SEQ ID NO: 2753901 - RNA, 17 nt, Human
ucuguauagauuagaau

SEQ ID NO: 2753902 - RNA, 19 nt, Human
agcuacuaauuuuaaaaug

SEQ ID NO: 2753903 - RNA, 18 nt, Human
agcccuucuuuccacaga

SEQ ID NO: 2753904 - RNA, 19 nt, Human
agcccuucuuuccacagaa

SEQ ID NO: 2753905 - RNA, 17 nt, Human
agcccuucuuuccacag

SEQ ID NO: 2753906 - RNA, 18 nt, Human
agccugagcgacagugag

SEQ ID NO: 2753907 - RNA, 14 nt, Human
ugcagugagccgag

SEQ ID NO: 2753908 - RNA, 16 nt, Human
agccugcacggugaau

SEQ ID NO: 2753909 - RNA, 18 nt, Human
agccugcacggugaaugg

SEQ ID NO: 2753910 - RNA, 14 nt, Human
agccugauuaaaga

SEQ ID NO: 2753911 - RNA, 13 nt, Human
agcuggaaaagua

SEQ ID NO: 2753912 - RNA, 17 nt, Human
agcugccuccccuccuc

SEQ ID NO: 2753913 - RNA, 18 nt, Human
agcugccuccccuccucu

SEQ ID NO: 2753914 - RNA, 19 nt, Human
agcugccuccccuccucug

SEQ ID NO: 2753915 - RNA, 20 nt, Human
agcugccuccccuccucugc

SEQ ID NO: 2753916 - RNA, 21 nt, Human
agcugccuccccuccucugcu

SEQ ID NO: 2753917 - RNA, 22 nt, Human
agcugccuccccuccucugcuu

SEQ ID NO: 2753918 - RNA, 23 nt, Human
agcugccuccccuccucugcuug

SEQ ID NO: 2753919 - RNA, 13 nt, Human
ugccuuuuucauu

SEQ ID NO: 2753920 - RNA, 14 nt, Human
ugccuuuuucauua

SEQ ID NO: 2753921 - RNA, 15 nt, Human
ugccuuuuucauuau

SEQ ID NO: 2753922 - RNA, 16 nt, Human
ugccuuuuucauuauu

SEQ ID NO: 2753923 - RNA, 17 nt, Human
ugccuuuuucauuauuu

SEQ ID NO: 2753924 - RNA, 21 nt, Human
ugccuuuuucauuauuuuauu

SEQ ID NO: 2753925 - RNA, 16 nt, Human
ugcuaguaauuggaaa

SEQ ID NO: 2753926 - RNA, 14 nt, Human
ugcuaguaauugga

SEQ ID NO: 2753927 - RNA, 13 nt, Human
aggaaagagaacu

SEQ ID NO: 2753928 - RNA, 19 nt, Human
aggaaagagaacuuccaga

SEQ ID NO: 2753929 - RNA, 23 nt, Human
aggaaaaguuuaauauuaaagcc

SEQ ID NO: 2753930 - RNA, 24 nt, Human
aggaaaaguuuaauauuaaagcca

SEQ ID NO: 2753931 - RNA, 21 nt, Human
aggaaaaguuuaauauuaaag

SEQ ID NO: 2753932 - RNA, 15 nt, Human
agcuuauuaaaacuc

SEQ ID NO: 2753933 - RNA, 20 nt, Human
agcuuauuaaaacucauuuu

SEQ ID NO: 2753934 - RNA, 21 nt, Human
agcuuauugucuagugaaacu

SEQ ID NO: 2753935 - RNA, 19 nt, Human
aggaauugacccacaagaa

SEQ ID NO: 2753936 - RNA, 23 nt, Human
aggaauucuguauagauuagaau

SEQ ID NO: 2753937 - RNA, 17 nt, Human
aggaauucuguauagau

SEQ ID NO: 2753938 - RNA, 22 nt, Human
aggaauucuguauagauuagaa

SEQ ID NO: 2753939 - RNA, 16 nt, Human
aggaauucuguauaga

SEQ ID NO: 2753940 - RNA, 15 nt, Human
aggaauucuguauag

SEQ ID NO: 2753941 - RNA, 14 nt, Human
aggaaauauuuauu

SEQ ID NO: 2753942 - RNA, 18 nt, Human
aggaaauauuuauuuuaa

SEQ ID NO: 2753943 - RNA, 13 nt, Human
aggaaauauuuau

SEQ ID NO: 2753944 - RNA, 16 nt, Human
uggagaagaacugaaa

SEQ ID NO: 2753945 - RNA, 14 nt, Human
uggagaagaacuga

SEQ ID NO: 2753946 - RNA, 21 nt, Human
uggagcucgugggacagucac

SEQ ID NO: 2753947 - RNA, 23 nt, Human
uggagccugcacggugaauggcu

SEQ ID NO: 2753948 - RNA, 17 nt, Human
uggaauuuuccuccuuu

SEQ ID NO: 2753949 - RNA, 21 nt, Human
uggaauuuuccuccuuucucu

SEQ ID NO: 2753950 - RNA, 11 nt, Human
aggcuccacuu

SEQ ID NO: 2753951 - RNA, 17 nt, Human
aggcuccacuuggucug

SEQ ID NO: 2753952 - RNA, 21 nt, Human
aggcuccacuuggucugugag

SEQ ID NO: 2753953 - RNA, 22 nt, Human
aggcuccacuuggucugugaga

SEQ ID NO: 2753954 - RNA, 19 nt, Human
uggcuauaggugcuacaaa

SEQ ID NO: 2753955 - RNA, 15 nt, Human
uggcuauaggugcua

SEQ ID NO: 2753956 - RNA, 18 nt, Human
uggcuaagcaaaauguga

SEQ ID NO: 2753957 - RNA, 23 nt, Human
uggcuauaggugcuacaaaaaca

SEQ ID NO: 2753958 - RNA, 18 nt, Human
ugggaaacaaaaggauaa

SEQ ID NO: 2753959 - RNA, 18 nt, Human
ugggaaagcauuguaaau

SEQ ID NO: 2753960 - RNA, 17 nt, Human
ugggaaagcauuguaaa

SEQ ID NO: 2753961 - RNA, 16 nt, Human
ugggaaagcauuguaa

SEQ ID NO: 2753962 - RNA, 14 nt, Human
ugggaaagcauugu

SEQ ID NO: 2753963 - RNA, 15 nt, Human
agggaaacugccagc

SEQ ID NO: 2753964 - RNA, 14 nt, Human
agggaaacugccag

SEQ ID NO: 2753965 - RNA, 23 nt, Human
agggaaacugccagcaacgcagg

SEQ ID NO: 2753966 - RNA, 21 nt, Human
agggaaacugccagcaacgca

SEQ ID NO: 2753967 - RNA, 19 nt, Human
agggaaacugccagcaacg

SEQ ID NO: 2753968 - RNA, 16 nt, Human
agggaaacugccagca

SEQ ID NO: 2753969 - RNA, 20 nt, Human
ugggaacccaaguccaagca

SEQ ID NO: 2753970 - RNA, 22 nt, Human
agggcuguuauaaucuuucaca

SEQ ID NO: 2753971 - RNA, 23 nt, Human
agggacuucugucuucacaacag

SEQ ID NO: 2753972 - RNA, 14 nt, Human
agggagagaagaua

SEQ ID NO: 2753973 - RNA, 13 nt, Human
agggagagaagau

SEQ ID NO: 2753974 - RNA, 19 nt, Human
ugggaggcugagaugggag

SEQ ID NO: 2753975 - RNA, 12 nt, Human
aguauuaagcau

SEQ ID NO: 2753976 - RNA, 14 nt, Human
aguauuaagcauau

SEQ ID NO: 2753977 - RNA, 13 nt, Human
aguauaauuaaca

SEQ ID NO: 2753978 - RNA, 14 nt, Human
aguauaauuaacau

SEQ ID NO: 2753979 - RNA, 16 nt, Human
aguauaauuaacaugu

SEQ ID NO: 2753980 - RNA, 23 nt, Human
aguauaauuaacauguuaaacca

SEQ ID NO: 2753981 - RNA, 14 nt, Human
agucaggaaagaga

SEQ ID NO: 2753982 - RNA, 13 nt, Human
agucucaggaaau

SEQ ID NO: 2753983 - RNA, 16 nt, Human
aggugcuacaaaaaca

SEQ ID NO: 2753984 - RNA, 14 nt, Human
agguugcagugagc

SEQ ID NO: 2753985 - RNA, 19 nt, Human
uguaagggaaacugccagc

SEQ ID NO: 2753986 - RNA, 18 nt, Human
uguaagggaaacugccag

SEQ ID NO: 2753987 - RNA, 13 nt, Human
uguaagggaaacu

SEQ ID NO: 2753988 - RNA, 17 nt, Human
uguaguguuggagaaga

SEQ ID NO: 2753989 - RNA, 18 nt, Human
uguaguguuggagaagaa

SEQ ID NO: 2753990 - RNA, 16 nt, Human
uguaguguuggagaag

SEQ ID NO: 2753991 - RNA, 20 nt, Human
aguaaaaccacagcaguuga

SEQ ID NO: 2753992 - RNA, 19 nt, Human
aguaaaaccacagcaguug

SEQ ID NO: 2753993 - RNA, 17 nt, Human
aguaaaaccacagcagu

SEQ ID NO: 2753994 - RNA, 16 nt, Human
aguaaaaccacagcag

SEQ ID NO: 2753995 - RNA, 12 nt, Human
aguaauuggaaa

SEQ ID NO: 2753996 - RNA, 13 nt, Human
aguaauuggaaag

SEQ ID NO: 2753997 - RNA, 23 nt, Human
aguguuggagaagaacugaaauc

SEQ ID NO: 2753998 - RNA, 15 nt, Human
uguucuaagaaguga

SEQ ID NO: 2753999 - RNA, 22 nt, Human
uguugcccacagcuguaugauu

SEQ ID NO: 2754000 - RNA, 16 nt, Human
uguguuagagauuuuu

SEQ ID NO: 2754001 - RNA, 21 nt, Human
agugaacaaauuuacagagac

SEQ ID NO: 2754002 - RNA, 16 nt, Human
agucuuucacauuuaa

SEQ ID NO: 2754003 - RNA, 20 nt, Human
agucuugucucagauuuuau

SEQ ID NO: 2754004 - RNA, 21 nt, Human
agucuugucucagauuuuauu

SEQ ID NO: 2754005 - RNA, 22 nt, Human
agugaacaaauuuacagagaca

SEQ ID NO: 2754006 - RNA, 23 nt, Human
agugaacaaauuuacagagacag

SEQ ID NO: 2754007 - RNA, 17 nt, Human
agucuugucucagauuu

SEQ ID NO: 2754008 - RNA, 19 nt, Human
agucuugucucagauuuua

SEQ ID NO: 2754009 - RNA, 16 nt, Human
agucuugucucagauu

SEQ ID NO: 2754010 - RNA, 22 nt, Human
agugcaaauugucacaggacag

SEQ ID NO: 2754011 - RNA, 21 nt, Human
agugaguuggguguauugugc

SEQ ID NO: 2754012 - RNA, 20 nt, Human
agugaguuggguguauugug

SEQ ID NO: 2754013 - RNA, 19 nt, Human
ugugcugggguuaucugaa

SEQ ID NO: 2754014 - RNA, 20 nt, Human
ugugcugguguaugugugaa

SEQ ID NO: 2754015 - RNA, 17 nt, Human
auacuauggaauuucuc

SEQ ID NO: 2754016 - RNA, 15 nt, Human
uuauauuugaaauau

SEQ ID NO: 2754017 - RNA, 19 nt, Human
uuauauuugaaauauugac

SEQ ID NO: 2754018 - RNA, 22 nt, Human
auaccacaggaaccacaagacu

SEQ ID NO: 2754019 - RNA, 14 nt, Human
uuaugaauuacauu

SEQ ID NO: 2754020 - RNA, 16 nt, Human
uuaugaauuacauuug

SEQ ID NO: 2754021 - RNA, 17 nt, Human
uuaugaauuacauuugu

SEQ ID NO: 2754022 - RNA, 21 nt, Human
uuaugaauuacauuuguauaa

SEQ ID NO: 2754023 - RNA, 13 nt, Human
uuaugauccagca

SEQ ID NO: 2754024 - RNA, 18 nt, Human
uuaugauccagcagauua

SEQ ID NO: 2754025 - RNA, 16 nt, Human
uuaugaaacuugugua

SEQ ID NO: 2754026 - RNA, 18 nt, Human
uuaugaaacuuguguaaa

SEQ ID NO: 2754027 - RNA, 13 nt, Human
uuaugaaacuugu

SEQ ID NO: 2754028 - RNA, 19 nt, Human
uuaugaaacuuguguaaau

SEQ ID NO: 2754029 - RNA, 19 nt, Human
uuaugauuaaguaaugaua

SEQ ID NO: 2754030 - RNA, 22 nt, Human
uuaugauccagcagauuauuca

SEQ ID NO: 2754031 - RNA, 23 nt, Human
uuaugauccagcagauuauucac

SEQ ID NO: 2754032 - RNA, 19 nt, Human
uuauguaaaucccauuauu

SEQ ID NO: 2754033 - RNA, 21 nt, Human
uuauguaaaucccauuauuca

SEQ ID NO: 2754034 - RNA, 22 nt, Human
uuauguaaaucccauuauucaa

SEQ ID NO: 2754035 - RNA, 23 nt, Human
uuauguaaaucccauuauucaaa

SEQ ID NO: 2754036 - RNA, 12 nt, Human
uuauguaaaucc

SEQ ID NO: 2754037 - RNA, 13 nt, Human
uuauguaaauccc

SEQ ID NO: 2754038 - RNA, 11 nt, Human
uuauguaaauc

SEQ ID NO: 2754039 - RNA, 16 nt, Human
uuaugugcgcugauaa

SEQ ID NO: 2754040 - RNA, 13 nt, Human
auagaaguaaaaa

SEQ ID NO: 2754041 - RNA, 20 nt, Human
auagaaccucuuugucuaca

SEQ ID NO: 2754042 - RNA, 14 nt, Human
auagaaccucuuug

SEQ ID NO: 2754043 - RNA, 17 nt, Human
auagaauuaacacauga

SEQ ID NO: 2754044 - RNA, 18 nt, Human
auagauaggucagugcaa

SEQ ID NO: 2754045 - RNA, 21 nt, Human
auagaggaagccugauuaaag

SEQ ID NO: 2754046 - RNA, 22 nt, Human
auagaggaagccugauuaaaga

SEQ ID NO: 2754047 - RNA, 22 nt, Human
auagauuagagaguguugaaac

SEQ ID NO: 2754048 - RNA, 13 nt, Human
auagauuagaauu

SEQ ID NO: 2754049 - RNA, 15 nt, Human
auagauuagaauucu

SEQ ID NO: 2754050 - RNA, 16 nt, Human
auagauuagaauucug

SEQ ID NO: 2754051 - RNA, 21 nt, Human
auagauuagagaguguugaaa

SEQ ID NO: 2754052 - RNA, 16 nt, Human
auacucauuaggaugg

SEQ ID NO: 2754053 - RNA, 15 nt, Human
auacuggauuguacu

SEQ ID NO: 2754054 - RNA, 19 nt, Human
uuauguuaaaacugggaca

SEQ ID NO: 2754055 - RNA, 14 nt, Human
uuauuauauuuaca

SEQ ID NO: 2754056 - RNA, 15 nt, Human
uuauuauauuuacaa

SEQ ID NO: 2754057 - RNA, 11 nt, Human
uuauuaugaaa

SEQ ID NO: 2754058 - RNA, 17 nt, Human
uuauuaugaaacuugug

SEQ ID NO: 2754059 - RNA, 20 nt, Human
uuauuaugaaacuuguguaa

SEQ ID NO: 2754060 - RNA, 21 nt, Human
uuauuaugaaacuuguguaaa

SEQ ID NO: 2754061 - RNA, 22 nt, Human
uuauuaugaaacuuguguaaau

SEQ ID NO: 2754062 - RNA, 23 nt, Human
uuauuaugaaacuuguguaaaua

SEQ ID NO: 2754063 - RNA, 14 nt, Human
uuauucacugauuu

SEQ ID NO: 2754064 - RNA, 16 nt, Human
uuauuauguaaauccc

SEQ ID NO: 2754065 - RNA, 22 nt, Human
uuauuauguaaaucccauuauu

SEQ ID NO: 2754066 - RNA, 13 nt, Human
uuauuauguaaau

SEQ ID NO: 2754067 - RNA, 14 nt, Human
uuauuauguaaauc

SEQ ID NO: 2754068 - RNA, 13 nt, Human
uuauucaaaguug

SEQ ID NO: 2754069 - RNA, 15 nt, Human
uuauucaaaguugcc

SEQ ID NO: 2754070 - RNA, 19 nt, Human
uuauucaaaguugccuaaa

SEQ ID NO: 2754071 - RNA, 16 nt, Human
aguuuuauaugcuucu

SEQ ID NO: 2754072 - RNA, 14 nt, Human
aguuuuguuuggac

SEQ ID NO: 2754073 - RNA, 16 nt, Human
aguuuuguuuggacca

SEQ ID NO: 2754074 - RNA, 12 nt, Human
aguuuuguuugg

SEQ ID NO: 2754075 - RNA, 18 nt, Human
aguuuuguuuggaccaaa

SEQ ID NO: 2754076 - RNA, 14 nt, Human
uuaauuuuggaauu

SEQ ID NO: 2754077 - RNA, 15 nt, Human
uuaauuuuggaauuu

SEQ ID NO: 2754078 - RNA, 13 nt, Human
uuaauuuuggaau

SEQ ID NO: 2754079 - RNA, 20 nt, Human
aguuuaaauuguaauaggcg

SEQ ID NO: 2754080 - RNA, 17 nt, Human
aguuuaaauuguaauag

SEQ ID NO: 2754081 - RNA, 15 nt, Human
aguuuagcuggaaaa

SEQ ID NO: 2754082 - RNA, 19 nt, Human
uuaaaaaagaaacauuugg

SEQ ID NO: 2754083 - RNA, 16 nt, Human
uuaaaaaauggaacau

SEQ ID NO: 2754084 - RNA, 14 nt, Human
uuaaaaucauuucu

SEQ ID NO: 2754085 - RNA, 22 nt, Human
uuaaaaucauuucugcaucagc

SEQ ID NO: 2754086 - RNA, 17 nt, Human
uuaaaccaugggauaaa

SEQ ID NO: 2754087 - RNA, 19 nt, Human
aguuugugcugguguaugu

SEQ ID NO: 2754088 - RNA, 13 nt, Human
uuaaaguugaauu

SEQ ID NO: 2754089 - RNA, 16 nt, Human
uuaaaguugaauuuau

SEQ ID NO: 2754090 - RNA, 17 nt, Human
uuaaaguugaauuuauu

SEQ ID NO: 2754091 - RNA, 22 nt, Human
uuaaaguugaauuuauuggcuu

SEQ ID NO: 2754092 - RNA, 21 nt, Human
uuaaaccaugggauaaaugcc

SEQ ID NO: 2754093 - RNA, 22 nt, Human
uuaaaccaugggauaaaugcca

SEQ ID NO: 2754094 - RNA, 23 nt, Human
uuaaaccaugggauaaaugccau

SEQ ID NO: 2754095 - RNA, 14 nt, Human
uuaggguuaugauu

SEQ ID NO: 2754096 - RNA, 16 nt, Human
uuaggguuaugauuaa

SEQ ID NO: 2754097 - RNA, 14 nt, Human
uuagggagagaaga

SEQ ID NO: 2754098 - RNA, 15 nt, Human
uuagggagagaagau

SEQ ID NO: 2754099 - RNA, 14 nt, Human
auaaucuuucacag

SEQ ID NO: 2754100 - RNA, 15 nt, Human
auaaaucugugaacu

SEQ ID NO: 2754101 - RNA, 16 nt, Human
auaaaucugugaacuu

SEQ ID NO: 2754102 - RNA, 19 nt, Human
auaaaucugugaacuugaa

SEQ ID NO: 2754103 - RNA, 17 nt, Human
auaaaugccaucaauaa

SEQ ID NO: 2754104 - RNA, 18 nt, Human
auaaaugccaucaauaaa

SEQ ID NO: 2754105 - RNA, 14 nt, Human
uuagaauucuguau

SEQ ID NO: 2754106 - RNA, 15 nt, Human
uuagaauucuguaua

SEQ ID NO: 2754107 - RNA, 17 nt, Human
uuagaauucuguauaga

SEQ ID NO: 2754108 - RNA, 23 nt, Human
augaauggcuaagcaaaauguga

SEQ ID NO: 2754109 - RNA, 15 nt, Human
augaauuaaguuuuu

SEQ ID NO: 2754110 - RNA, 15 nt, Human
augaauuacauuugu

SEQ ID NO: 2754111 - RNA, 16 nt, Human
augaauuacauuugua

SEQ ID NO: 2754112 - RNA, 11 nt, Human
aucugccuaag

SEQ ID NO: 2754113 - RNA, 21 nt, Human
aucugccuaaggacuucuuua

SEQ ID NO: 2754114 - RNA, 22 nt, Human
aucugccuaaggacuucuuuaa

SEQ ID NO: 2754115 - RNA, 23 nt, Human
aucugccuaaggacuucuuuaau

SEQ ID NO: 2754116 - RNA, 19 nt, Human
aucuacacuccagugagac

SEQ ID NO: 2754117 - RNA, 18 nt, Human
aucuacacuccagugaga

SEQ ID NO: 2754118 - RNA, 17 nt, Human
uugaagggaaauuucag

SEQ ID NO: 2754119 - RNA, 22 nt, Human
uugcaagccagauuuuccugaa

SEQ ID NO: 2754120 - RNA, 13 nt, Human
uugcaucaauuuu

SEQ ID NO: 2754121 - RNA, 19 nt, Human
uugaacccgggaggcagag

SEQ ID NO: 2754122 - RNA, 18 nt, Human
uugaacccgggaggcaga

SEQ ID NO: 2754123 - RNA, 15 nt, Human
uugaaauuguaauua

SEQ ID NO: 2754124 - RNA, 17 nt, Human
uugaaauuguaauuaua

SEQ ID NO: 2754125 - RNA, 17 nt, Human
uugaaauuguauuacaa

SEQ ID NO: 2754126 - RNA, 13 nt, Human
uugaaauuguaau

SEQ ID NO: 2754127 - RNA, 14 nt, Human
uugaaauuguaauu

SEQ ID NO: 2754128 - RNA, 12 nt, Human
uucucuaggaaa

SEQ ID NO: 2754129 - RNA, 20 nt, Human
auccauuuggaaaucuuuaa

SEQ ID NO: 2754130 - RNA, 21 nt, Human
auccauuuggaaaucuuuaaa

SEQ ID NO: 2754131 - RNA, 19 nt, Human
uuccguagguuauuuucag

SEQ ID NO: 2754132 - RNA, 20 nt, Human
auauuuuuuguuaaaugauu

SEQ ID NO: 2754133 - RNA, 18 nt, Human
auauuuuuuguuaaauga

SEQ ID NO: 2754134 - RNA, 14 nt, Human
aucaacagauaaau

SEQ ID NO: 2754135 - RNA, 23 nt, Human
aucaccugucuugccuuuuucau

SEQ ID NO: 2754136 - RNA, 22 nt, Human
aucaccugucuugccuuuuuca

SEQ ID NO: 2754137 - RNA, 22 nt, Human
aucacuugucaauaaaauccau

SEQ ID NO: 2754138 - RNA, 17 nt, Human
aucaggguuaguauugu

SEQ ID NO: 2754139 - RNA, 16 nt, Human
uucuaaguaaaaccac

SEQ ID NO: 2754140 - RNA, 15 nt, Human
uucuaaguaaaacca

SEQ ID NO: 2754141 - RNA, 23 nt, Human
uucuaagaagugaaaaucuacac

SEQ ID NO: 2754142 - RNA, 13 nt, Human
uucuaagaaguga

SEQ ID NO: 2754143 - RNA, 15 nt, Human
uucggccuccauccu

SEQ ID NO: 2754144 - RNA, 14 nt, Human
uucggccuccaucc

SEQ ID NO: 2754145 - RNA, 19 nt, Human
uuuguaguguuggagaaga

SEQ ID NO: 2754146 - RNA, 21 nt, Human
uuuguaguguuggagaagaac

SEQ ID NO: 2754147 - RNA, 17 nt, Human
uuugugaagcaaaauuu

SEQ ID NO: 2754148 - RNA, 19 nt, Human
uuugugcugguguaugugu

SEQ ID NO: 2754149 - RNA, 16 nt, Human
auguccacugguucuu

SEQ ID NO: 2754150 - RNA, 17 nt, Human
auguccacugguucuuc

SEQ ID NO: 2754151 - RNA, 21 nt, Human
uuuggcauaacauaaaucugu

SEQ ID NO: 2754152 - RNA, 20 nt, Human
uuuggcauaacauaaaucug

SEQ ID NO: 2754153 - RNA, 12 nt, Human
auguagaggaga

SEQ ID NO: 2754154 - RNA, 13 nt, Human
auguagaggagaa

SEQ ID NO: 2754155 - RNA, 17 nt, Human
auguagaggagaaacug

SEQ ID NO: 2754156 - RNA, 19 nt, Human
auguagaggagaaacugga

SEQ ID NO: 2754157 - RNA, 16 nt, Human
auguacuucaugcugu

SEQ ID NO: 2754158 - RNA, 14 nt, Human
uuugcaagccagau

SEQ ID NO: 2754159 - RNA, 21 nt, Human
augguucccuugaugaagaag

SEQ ID NO: 2754160 - RNA, 14 nt, Human
auguaaaucccauu

SEQ ID NO: 2754161 - RNA, 20 nt, Human
auguaaaucccauuauucaa

SEQ ID NO: 2754162 - RNA, 22 nt, Human
auguaaaucccauuauucaaag

SEQ ID NO: 2754163 - RNA, 23 nt, Human
auguaaaucccauuauucaaagu

SEQ ID NO: 2754164 - RNA, 17 nt, Human
uuucucccagucauuua

SEQ ID NO: 2754165 - RNA, 18 nt, Human
uuucucccagucauuuaa

SEQ ID NO: 2754166 - RNA, 15 nt, Human
augggauaaaugcca

SEQ ID NO: 2754167 - RNA, 16 nt, Human
augggauaaaugccau

SEQ ID NO: 2754168 - RNA, 20 nt, Human
augggauaaaugccaucaau

SEQ ID NO: 2754169 - RNA, 19 nt, Human
uuucuguacuuuuuggcau

SEQ ID NO: 2754170 - RNA, 20 nt, Human
uuucuguacuuuuuggcaua

SEQ ID NO: 2754171 - RNA, 15 nt, Human
uuugaaauauugacu

SEQ ID NO: 2754172 - RNA, 18 nt, Human
uuuaaauauaugcuaagu

SEQ ID NO: 2754173 - RNA, 21 nt, Human
uuuaaauaaauaaauagcuag

SEQ ID NO: 2754174 - RNA, 13 nt, Human
augcaguucugaa

SEQ ID NO: 2754175 - RNA, 21 nt, Human
augccauuuaaagcuuauuaa

SEQ ID NO: 2754176 - RNA, 17 nt, Human
augccauuuaaagcuua

SEQ ID NO: 2754177 - RNA, 18 nt, Human
augauuaaguaaugauaa

SEQ ID NO: 2754178 - RNA, 14 nt, Human
augauuaaguaaug

SEQ ID NO: 2754179 - RNA, 22 nt, Human
augauccagcagauuauucacu

SEQ ID NO: 2754180 - RNA, 19 nt, Human
augauccagcagauuauuc

SEQ ID NO: 2754181 - RNA, 20 nt, Human
augauccagcagauuauuca

SEQ ID NO: 2754182 - RNA, 10 nt, Human
augauccagc

SEQ ID NO: 2754183 - RNA, 15 nt, Human
augauaacuggaaac

SEQ ID NO: 2754184 - RNA, 14 nt, Human
auggcacuaguauu

SEQ ID NO: 2754185 - RNA, 16 nt, Human
auggcacuaguauuuc

SEQ ID NO: 2754186 - RNA, 19 nt, Human
auggcuaagcaaaauguga

SEQ ID NO: 2754187 - RNA, 23 nt, Human
auggcuauaggugcuacaaaaac

SEQ ID NO: 2754188 - RNA, 14 nt, Human
augggauaaaugcc

SEQ ID NO: 2754189 - RNA, 19 nt, Human
uuucauuauuuuauuauga

SEQ ID NO: 2754190 - RNA, 20 nt, Human
uuucauuauuuuauuaugaa

SEQ ID NO: 2754191 - RNA, 13 nt, Human
uuucauuauuuua

SEQ ID NO: 2754192 - RNA, 15 nt, Human
uuucauuauuuuauu

SEQ ID NO: 2754193 - RNA, 17 nt, Human
auggacuguggugacuu

SEQ ID NO: 2754194 - RNA, 22 nt, Human
auggacuguggugacuuuggau

SEQ ID NO: 2754195 - RNA, 16 nt, Human
auggacuguggugacu

SEQ ID NO: 2754196 - RNA, 16 nt, Human
uuucaaacauauauaa

SEQ ID NO: 2754197 - RNA, 18 nt, Human
auggaacgcguugaaauu

SEQ ID NO: 2754198 - RNA, 19 nt, Human
auggaacgcguugaaauug

SEQ ID NO: 2754199 - RNA, 16 nt, Human
auggaacgcguugaaa

SEQ ID NO: 2754200 - RNA, 17 nt, Human
auggaacgcguugaaau

SEQ ID NO: 2754201 - RNA, 15 nt, Human
auggaacgcguugaa

SEQ ID NO: 2754202 - RNA, 20 nt, Human
augcuagaacucccuuucaa

SEQ ID NO: 2754203 - RNA, 21 nt, Human
augcuagaacucccuuucaac

SEQ ID NO: 2754204 - RNA, 19 nt, Human
augcuagaacucccuuuca

SEQ ID NO: 2754205 - RNA, 22 nt, Human
augcuagaacucccuuucaaca

SEQ ID NO: 2754206 - RNA, 14 nt, Human
uuuauuacaguaua

SEQ ID NO: 2754207 - RNA, 18 nt, Human
uuuauuacaguauaauua

SEQ ID NO: 2754208 - RNA, 13 nt, Human
augcuauuucuau

SEQ ID NO: 2754209 - RNA, 14 nt, Human
augcuauuucuaua

SEQ ID NO: 2754210 - RNA, 15 nt, Human
augcuauuucuauau

SEQ ID NO: 2754211 - RNA, 20 nt, Human
augcuauuucuauauuuuca

SEQ ID NO: 2754212 - RNA, 11 nt, Human
augcuauuucu

SEQ ID NO: 2754213 - RNA, 21 nt, Human
augcuauuucuauauuuucau

SEQ ID NO: 2754214 - RNA, 22 nt, Human
augcuauuucuauauuuucauu

SEQ ID NO: 2754215 - RNA, 23 nt, Human
augcuauuucuauauuuucauuc

SEQ ID NO: 2754216 - RNA, 13 nt, Human
uuuauauuuacua

SEQ ID NO: 2754217 - RNA, 16 nt, Human
uuuauauuuacuaaaa

SEQ ID NO: 2754218 - RNA, 19 nt, Human
auuggacaguaaaauccac

SEQ ID NO: 2754219 - RNA, 19 nt, Human
auuggagcucgugggacag

SEQ ID NO: 2754220 - RNA, 13 nt, Human
auugacuuuuuau

SEQ ID NO: 2754221 - RNA, 16 nt, Human
auuggcuuuucugauc

SEQ ID NO: 2754222 - RNA, 19 nt, Human
auuggcuuuucugauccag

SEQ ID NO: 2754223 - RNA, 20 nt, Human
auuggcuuuucugauccagu

SEQ ID NO: 2754224 - RNA, 13 nt, Human
auuggcuuuucug

SEQ ID NO: 2754225 - RNA, 15 nt, Human
auuggcuuuucugau

SEQ ID NO: 2754226 - RNA, 13 nt, Human
auugucuagugaa

SEQ ID NO: 2754227 - RNA, 14 nt, Human
auuuauuuuaauaa

SEQ ID NO: 2754228 - RNA, 16 nt, Human
auuugacauagucugg

SEQ ID NO: 2754229 - RNA, 17 nt, Human
auuugacauagucuggc

SEQ ID NO: 2754230 - RNA, 21 nt, Human
auuugacauagucuggcugua

SEQ ID NO: 2754231 - RNA, 15 nt, Human
auuugaauuuugugu

SEQ ID NO: 2754232 - RNA, 19 nt, Human
auuuguaguguuggagaag

SEQ ID NO: 2754233 - RNA, 22 nt, Human
auuuguaguguuggagaagaac

SEQ ID NO: 2754234 - RNA, 14 nt, Human
auuuguauaaaaua

SEQ ID NO: 2754235 - RNA, 23 nt, Human
auuuuaaaagaaugauuaugaau

SEQ ID NO: 2754236 - RNA, 16 nt, Human
auuuuaaaagaaugau

SEQ ID NO: 2754237 - RNA, 15 nt, Human
auuuucuauaauuua

SEQ ID NO: 2754238 - RNA, 14 nt, Human
auuuucuauaauuu

SEQ ID NO: 2754239 - RNA, 14 nt, Human
auuuuccugaaaac

SEQ ID NO: 2754240 - RNA, 11 nt, Human
auuuuguuucu

SEQ ID NO: 2754241 - RNA, 12 nt, Human
auuuuggaauuu

SEQ ID NO: 2754242 - RNA, 15 nt, Human
auuuuucuuauuuca

SEQ ID NO: 2754243 - RNA, 20 nt, Human
auuuuucuuauuucauuucu

SEQ ID NO: 2754244 - RNA, 19 nt, Human
auuuuucuuauuucauuuc

SEQ ID NO: 2754245 - RNA, 14 nt, Human
auuuuguuucugua

SEQ ID NO: 2754246 - RNA, 15 nt, Human
auuuuguuucuguac

SEQ ID NO: 2754247 - RNA, 22 nt, Human
auuuuugugauuuugugauuga

SEQ ID NO: 2754248 - RNA, 21 nt, Human
auuuuuguuuucauuaucuca

SEQ ID NO: 2754249 - RNA, 18 nt, Human
auuuuuuguuaaaugauu

SEQ ID NO: 2754250 - RNA, 20 nt, Human
auuuuuucucuaggaaauau

SEQ ID NO: 2754251 - RNA, 23 nt, Human
auuuuuucucuaggaaauauuua

SEQ ID NO: 2754252 - RNA, 15 nt, Human
auugacacuuaaaaa

SEQ ID NO: 2754253 - RNA, 17 nt, Human
auugacacuuaaaaaug

SEQ ID NO: 2754254 - RNA, 19 nt, Human
auugacacuuaaaaauggu

SEQ ID NO: 2754255 - RNA, 19 nt, Human
auucuuaaaguugaauuua

SEQ ID NO: 2754256 - RNA, 20 nt, Human
auucuuaaaguugaauuuau

SEQ ID NO: 2754257 - RNA, 21 nt, Human
auucuuaaaguugaauuuauu

SEQ ID NO: 2754258 - RNA, 11 nt, Human
auucuguauag

SEQ ID NO: 2754259 - RNA, 12 nt, Human
auucuguauaga

SEQ ID NO: 2754260 - RNA, 13 nt, Human
auucuguauagau

SEQ ID NO: 2754261 - RNA, 20 nt, Human
auucaaacagucucaggaaa

SEQ ID NO: 2754262 - RNA, 19 nt, Human
auucaaacagucucaggaa

SEQ ID NO: 2754263 - RNA, 18 nt, Human
auucaaacagucucagga

SEQ ID NO: 2754264 - RNA, 16 nt, Human
auucaaacagucucag

SEQ ID NO: 2754265 - RNA, 14 nt, Human
auuauucaaaguug

SEQ ID NO: 2754266 - RNA, 15 nt, Human
auuauucaaaguugc

SEQ ID NO: 2754267 - RNA, 13 nt, Human
auuauucaaaguu

SEQ ID NO: 2754268 - RNA, 17 nt, Human
auuauucaaaguugccu

SEQ ID NO: 2754269 - RNA, 21 nt, Human
auuauguuaaaacugggacag

SEQ ID NO: 2754270 - RNA, 15 nt, Human
auuauauuuauuacu

SEQ ID NO: 2754271 - RNA, 18 nt, Human
auuauauuuauuacugua

SEQ ID NO: 2754272 - RNA, 13 nt, Human
aaaaacacagcaa

SEQ ID NO: 2754273 - RNA, 18 nt, Human
aaaaaauuggggauucuu

SEQ ID NO: 2754274 - RNA, 18 nt, Human
aaaaacacagcaagggug

SEQ ID NO: 2754275 - RNA, 12 nt, Human
aaaaacacagca

SEQ ID NO: 2754276 - RNA, 20 nt, Human
aaaaaccaguauuguacaaa

SEQ ID NO: 2754277 - RNA, 17 nt, Human
acucuauguucuaagaa

SEQ ID NO: 2754278 - RNA, 20 nt, Human
acuaguauuucuaugaaaua

SEQ ID NO: 2754279 - RNA, 21 nt, Human
acuauucaaacagucucagga

SEQ ID NO: 2754280 - RNA, 14 nt, Human
acucaaaucaagaa

SEQ ID NO: 2754281 - RNA, 22 nt, Human
acgcaggcccccaggugccagu

SEQ ID NO: 2754282 - RNA, 19 nt, Human
acgcaggcccccaggugcc

SEQ ID NO: 2754283 - RNA, 13 nt, Human
acuaagagagaau

SEQ ID NO: 2754284 - RNA, 14 nt, Human
agaaaauaacaaua

SEQ ID NO: 2754285 - RNA, 16 nt, Human
agaaaaucaggcuggc

SEQ ID NO: 2754286 - RNA, 22 nt, Human
acuuuauuuucuauaauuuaaa

SEQ ID NO: 2754287 - RNA, 22 nt, Human
acuguaagaaaauaucacuugu

SEQ ID NO: 2754288 - RNA, 19 nt, Human
acuguaagaaaauaucacu

SEQ ID NO: 2754289 - RNA, 13 nt, Human
acuguaagaaaau

SEQ ID NO: 2754290 - RNA, 14 nt, Human
acuggugacugauu

SEQ ID NO: 2754291 - RNA, 20 nt, Human
acucugucucaguccaugaa

SEQ ID NO: 2754292 - RNA, 18 nt, Human
acucugucucaguccaug

SEQ ID NO: 2754293 - RNA, 13 nt, Human
acugccagcaacg

SEQ ID NO: 2754294 - RNA, 12 nt, Human
acuucagacaua

SEQ ID NO: 2754295 - RNA, 21 nt, Human
acuucugucuucacaacagau

SEQ ID NO: 2754296 - RNA, 22 nt, Human
acuucugucuucacaacagauu

SEQ ID NO: 2754297 - RNA, 21 nt, Human
acuuggucugugagaugcuag

SEQ ID NO: 2754298 - RNA, 21 nt, Human
acccacaagaaaugaaagcag

SEQ ID NO: 2754299 - RNA, 17 nt, Human
acccacaagaaaugaaa

SEQ ID NO: 2754300 - RNA, 21 nt, Human
acagcaguugaaaagacucca

SEQ ID NO: 2754301 - RNA, 23 nt, Human
acagcaguugaaaagacuccaaa

SEQ ID NO: 2754302 - RNA, 22 nt, Human
acagcaguugaaaagacuccaa

SEQ ID NO: 2754303 - RNA, 21 nt, Human
acacgagcaggcuacugucag

SEQ ID NO: 2754304 - RNA, 19 nt, Human
acacgagcaggcuacuguc

SEQ ID NO: 2754305 - RNA, 14 nt, Human
acacgagcaggcua

SEQ ID NO: 2754306 - RNA, 14 nt, Human
aauuuuguuucugu

SEQ ID NO: 2754307 - RNA, 13 nt, Human
aauuuuguuucug

SEQ ID NO: 2754308 - RNA, 14 nt, Human
aaaggcagaagcaa

SEQ ID NO: 2754309 - RNA, 10 nt, Human
aaauaaauaa

SEQ ID NO: 2754310 - RNA, 15 nt, Human
aaauauuuauuuuaa

SEQ ID NO: 2754311 - RNA, 13 nt, Human
aaauauuuauuuu

SEQ ID NO: 2754312 - RNA, 20 nt, Human
aaauauuuauuuuaauaaug

SEQ ID NO: 2754313 - RNA, 14 nt, Human
aaaucaaauaugca

SEQ ID NO: 2754314 - RNA, 12 nt, Human
aaaucaaauaug

SEQ ID NO: 2754315 - RNA, 15 nt, Human
aaaucaaauaugcaa

SEQ ID NO: 2754316 - RNA, 15 nt, Human
aaaucugugaacuug

SEQ ID NO: 2754317 - RNA, 16 nt, Human
aaaucugugaacuuga

SEQ ID NO: 2754318 - RNA, 18 nt, Human
aaaucugugaacuugaaa

SEQ ID NO: 2754319 - RNA, 18 nt, Human
aaauagcuagacugguga

SEQ ID NO: 2754320 - RNA, 15 nt, Human
aaagaaauguaaggg

SEQ ID NO: 2754321 - RNA, 23 nt, Human
aaacugagaugugaacacaucag

SEQ ID NO: 2754322 - RNA, 21 nt, Human
aaacugagaugugaacacauc

SEQ ID NO: 2754323 - RNA, 15 nt, Human
aaaccaugggauaaa

SEQ ID NO: 2754324 - RNA, 20 nt, Human
aaaccaugggauaaaugcca

SEQ ID NO: 2754325 - RNA, 16 nt, Human
aaaaucucaauauuuc

SEQ ID NO: 2754326 - RNA, 21 nt, Human
aaaaucuacacuccagugaga

SEQ ID NO: 2754327 - RNA, 18 nt, Human
aaaaguucugcagauaaa

SEQ ID NO: 2754328 - RNA, 16 nt, Human
aaaaagaaacauuugg

SEQ ID NO: 2754329 - RNA, 21 nt, Human
aacuuuaugcuaagugaaaua

SEQ ID NO: 2754330 - RNA, 20 nt, Human
aacuuuaugcuaagugaaau

SEQ ID NO: 2754331 - RNA, 20 nt, Human
aacugagaugugaacacauc

SEQ ID NO: 2754332 - RNA, 19 nt, Human
aacugacucuuaagaagac

SEQ ID NO: 2754333 - RNA, 20 nt, Human
aacugacucuuaagaagacu

SEQ ID NO: 2754334 - RNA, 15 nt, Human
aacugacucuuaaga

SEQ ID NO: 2754335 - RNA, 18 nt, Human
aacugacucuuaagaaga

SEQ ID NO: 2754336 - RNA, 14 nt, Human
aacggaugauuucu

SEQ ID NO: 2754337 - RNA, 15 nt, Human
aacggaugauuucua

SEQ ID NO: 2754338 - RNA, 16 nt, Human
aacggaugauuucuau

SEQ ID NO: 2754339 - RNA, 17 nt, Human
aacggaugauuucuaug

SEQ ID NO: 2754340 - RNA, 17 nt, Human
aaccuagggugauauua

SEQ ID NO: 2754341 - RNA, 16 nt, Human
aacccgggaggcagag

SEQ ID NO: 2754342 - RNA, 22 nt, Human
aaccacuggaaaguuuaugguu

SEQ ID NO: 2754343 - RNA, 19 nt, Human
aacagcuggugcccugcuu

SEQ ID NO: 2754344 - RNA, 17 nt, Human
aacagcuggugcccugc

SEQ ID NO: 2754345 - RNA, 20 nt, Human
aacagcuggugcccugcuuu

SEQ ID NO: 2754346 - RNA, 21 nt, Human
aacagcuggugcccugcuuuc

SEQ ID NO: 2754347 - RNA, 18 nt, Human
aacaaauuuacagagaca

SEQ ID NO: 2754348 - RNA, 16 nt, Human
aacacaucagcuugcc

SEQ ID NO: 2754349 - RNA, 22 nt, Human
aaauguuguucucuucuuuaaa

SEQ ID NO: 2754350 - RNA, 17 nt, Human
aaaucuuauaauuuaaa

SEQ ID NO: 2754351 - RNA, 19 nt, Human
aaauugacacuuaaaaaug

SEQ ID NO: 2754352 - RNA, 17 nt, Human
aagggaaacugccagca

SEQ ID NO: 2754353 - RNA, 16 nt, Human
aagggaaacugccagc

SEQ ID NO: 2754354 - RNA, 23 nt, Human
aagggaaacugccagcaacgcag

SEQ ID NO: 2754355 - RNA, 21 nt, Human
aaguagggacuucugucuuca

SEQ ID NO: 2754356 - RNA, 17 nt, Human
aaguccaagcauaccaa

SEQ ID NO: 2754357 - RNA, 18 nt, Human
aaguccaagcauuuagau

SEQ ID NO: 2754358 - RNA, 12 nt, Human
aaguugccuaaa

SEQ ID NO: 2754359 - RNA, 20 nt, Human
aaggcagcucuaaaugucaa

SEQ ID NO: 2754360 - RNA, 14 nt, Human
aaggacuucuuuaa

SEQ ID NO: 2754361 - RNA, 15 nt, Human
aaggacuucuuuaau

SEQ ID NO: 2754362 - RNA, 20 nt, Human
aaggacuucuuuaauuuugg

SEQ ID NO: 2754363 - RNA, 21 nt, Human
aaggacuucuuuaauuuugga

SEQ ID NO: 2754364 - RNA, 15 nt, Human
aaugauuaugaauua

SEQ ID NO: 2754365 - RNA, 21 nt, Human
aaugauuaugaauuacauuug

SEQ ID NO: 2754366 - RNA, 15 nt, Human
aaguugccuaaaucc

SEQ ID NO: 2754367 - RNA, 16 nt, Human
aaguugccuaaaucca

SEQ ID NO: 2754368 - RNA, 17 nt, Human
aaguugccuaaauccau

SEQ ID NO: 2754369 - RNA, 18 nt, Human
aaguugccuaaauccauu

SEQ ID NO: 2754370 - RNA, 19 nt, Human
aaguugccuaaauccauuu

SEQ ID NO: 2754371 - RNA, 23 nt, Human
aauguuucaaacauauauaacaa

SEQ ID NO: 2754372 - RNA, 16 nt, Human
agcaguugaaaagacu

SEQ ID NO: 2754373 - RNA, 13 nt, Human
agcaguugaaaag

SEQ ID NO: 2754374 - RNA, 23 nt, Human
agcaguucagagcugcccucucc

SEQ ID NO: 2754375 - RNA, 20 nt, Human
agcaguucagagcugcccuc

SEQ ID NO: 2754376 - RNA, 16 nt, Human
agcacugacuucuaag

SEQ ID NO: 2754377 - RNA, 21 nt, Human
agacugcauuauauuuauuac

SEQ ID NO: 2754378 - RNA, 17 nt, Human
agagaacuuccagaucc

SEQ ID NO: 2754379 - RNA, 13 nt, Human
agaguguugaaac

SEQ ID NO: 2754380 - RNA, 23 nt, Human
aggaugguucccuugaugaagaa

SEQ ID NO: 2754381 - RNA, 17 nt, Human
aggauguugaaaaaguu

SEQ ID NO: 2754382 - RNA, 22 nt, Human
agcuccccucggagaagagcug

SEQ ID NO: 2754383 - RNA, 18 nt, Human
aggugcuacaaaaacaca

SEQ ID NO: 2754384 - RNA, 22 nt, Human
aggugcuacaaaaacacagcaa

SEQ ID NO: 2754385 - RNA, 21 nt, Human
aggugcuacaaaaacacagca

SEQ ID NO: 2754386 - RNA, 20 nt, Human
aggugcuacaaaaacacagc

SEQ ID NO: 2754387 - RNA, 19 nt, Human
aggugcuacaaaaacacag

SEQ ID NO: 2754388 - RNA, 20 nt, Human
agguaaaagcaucacaugaa

SEQ ID NO: 2754389 - RNA, 24 nt, Human
aggugcuacaaaaacacagcaagg

SEQ ID NO: 2754390 - RNA, 23 nt, Human
aggugcuacaaaaacacagcaag

SEQ ID NO: 2754391 - RNA, 21 nt, Human
aggcuagaaccaccugccuau

SEQ ID NO: 2754392 - RNA, 17 nt, Human
aggcuacugucagcucc

SEQ ID NO: 2754393 - RNA, 17 nt, Human
aggcuagauguauguac

SEQ ID NO: 2754394 - RNA, 15 nt, Human
aggcuagauguaugu

SEQ ID NO: 2754395 - RNA, 16 nt, Human
aggcuagauguaugua

SEQ ID NO: 2754396 - RNA, 14 nt, Human
auagucaaauugug

SEQ ID NO: 2754397 - RNA, 15 nt, Human
auagguuuaauaauu

SEQ ID NO: 2754398 - RNA, 14 nt, Human
auaggugcuacaaa

SEQ ID NO: 2754399 - RNA, 23 nt, Human
auaggugcuacaaaaacacagca

SEQ ID NO: 2754400 - RNA, 21 nt, Human
auaggugcuacaaaaacacag

SEQ ID NO: 2754401 - RNA, 15 nt, Human
auaggugcuacaaaa

SEQ ID NO: 2754402 - RNA, 18 nt, Human
auagcagcuuauucacaa

SEQ ID NO: 2754403 - RNA, 20 nt, Human
auaugcuucuguuuuauaau

SEQ ID NO: 2754404 - RNA, 22 nt, Human
auaugcuucuguuuuauaauuu

SEQ ID NO: 2754405 - RNA, 22 nt, Human
auaugcuauuucuauauuuuca

SEQ ID NO: 2754406 - RNA, 23 nt, Human
auaugcuauuucuauauuuucau

SEQ ID NO: 2754407 - RNA, 15 nt, Human
auaugcuauuucuau

SEQ ID NO: 2754408 - RNA, 16 nt, Human
auaugcuauuucuaua

SEQ ID NO: 2754409 - RNA, 18 nt, Human
auaugcuauuucuauauu

SEQ ID NO: 2754410 - RNA, 19 nt, Human
auaugcuauuucuauauuu

SEQ ID NO: 2754411 - RNA, 21 nt, Human
auaugcuauuucuauauuuuc

SEQ ID NO: 2754412 - RNA, 16 nt, Human
auauuauguuaaaacu

SEQ ID NO: 2754413 - RNA, 22 nt, Human
auauuuauuacuguaagaaaau

SEQ ID NO: 2754414 - RNA, 13 nt, Human
auauuuauuuuaa

SEQ ID NO: 2754415 - RNA, 18 nt, Human
auauuuacuaaaauggac

SEQ ID NO: 2754416 - RNA, 20 nt, Human
auauuuacuaaaauggacug

SEQ ID NO: 2754417 - RNA, 18 nt, Human
auaaaggauuaaugucaa

SEQ ID NO: 2754418 - RNA, 14 nt, Human
auaacauaaaucug

SEQ ID NO: 2754419 - RNA, 15 nt, Human
auaacauaaaucugu

SEQ ID NO: 2754420 - RNA, 17 nt, Human
auaacauaaaucuguga

SEQ ID NO: 2754421 - RNA, 18 nt, Human
auaacauaaaucugugaa

SEQ ID NO: 2754422 - RNA, 19 nt, Human
auaacauaaaucugugaac

SEQ ID NO: 2754423 - RNA, 18 nt, Human
auacacacucaaaucaag

SEQ ID NO: 2754424 - RNA, 17 nt, Human
auacacacucaaaucaa

SEQ ID NO: 2754425 - RNA, 23 nt, Human
auaauguuucaaacauauauaac

SEQ ID NO: 2754426 - RNA, 15 nt, Human
auaauuaacauguua

SEQ ID NO: 2754427 - RNA, 16 nt, Human
auaaggaaaaguuuaa

SEQ ID NO: 2754428 - RNA, 15 nt, Human
auaaggaaaaguuua

SEQ ID NO: 2754429 - RNA, 15 nt, Human
agugucuuaauuaaa

SEQ ID NO: 2754430 - RNA, 18 nt, Human
agugucuuaauuaaaaga

SEQ ID NO: 2754431 - RNA, 17 nt, Human
agugucuuaauuaaaag

SEQ ID NO: 2754432 - RNA, 23 nt, Human
aguugaaaaucuuauaauuuaaa

SEQ ID NO: 2754433 - RNA, 22 nt, Human
aguugaaaagacuccaaagaaa

SEQ ID NO: 2754434 - RNA, 21 nt, Human
aguugaaaagacuccaaagaa

SEQ ID NO: 2754435 - RNA, 22 nt, Human
aguugaaaaucuuauaauuuaa

SEQ ID NO: 2754436 - RNA, 23 nt, Human
agucaaauugugugaaagguacu

SEQ ID NO: 2754437 - RNA, 19 nt, Human
agucaaauugugugaaagg

SEQ ID NO: 2754438 - RNA, 12 nt, Human
aguccuguaaug

SEQ ID NO: 2754439 - RNA, 19 nt, Human
auguaagggaaacugccag

SEQ ID NO: 2754440 - RNA, 16 nt, Human
auguaagggaaacugc

SEQ ID NO: 2754441 - RNA, 14 nt, Human
auguaagggaaacu

SEQ ID NO: 2754442 - RNA, 20 nt, Human
augguccgugcuaaggacuu

SEQ ID NO: 2754443 - RNA, 21 nt, Human
augguccgugcuaaggacuug

SEQ ID NO: 2754444 - RNA, 19 nt, Human
augguccgugcuaaggacu

SEQ ID NO: 2754445 - RNA, 17 nt, Human
auguucuaagaagugaa

SEQ ID NO: 2754446 - RNA, 18 nt, Human
augugggcagugauguca

SEQ ID NO: 2754447 - RNA, 13 nt, Human
augugugaaguga

SEQ ID NO: 2754448 - RNA, 23 nt, Human
aucagcugcugaaacaacaaaua

SEQ ID NO: 2754449 - RNA, 22 nt, Human
aucagcugcugaaacaacaaau

SEQ ID NO: 2754450 - RNA, 17 nt, Human
auauuuauuuuaauaau

SEQ ID NO: 2754451 - RNA, 14 nt, Human
auauuuauuuuaau

SEQ ID NO: 2754452 - RNA, 15 nt, Human
auauuuauuuuaaua

SEQ ID NO: 2754453 - RNA, 21 nt, Human
aucagcugcugaaacaacaaa

SEQ ID NO: 2754454 - RNA, 22 nt, Human
caaugaaugaaugaauggcuaa

SEQ ID NO: 2754455 - RNA, 21 nt, Human
caauaucuuuuuuuuaauaaa

SEQ ID NO: 2754456 - RNA, 11 nt, Human
cacaacagauu

SEQ ID NO: 2754457 - RNA, 19 nt, Human
cacacucaaaucaagaaac

SEQ ID NO: 2754458 - RNA, 14 nt, Human
cacacugaagaagc

SEQ ID NO: 2754459 - RNA, 13 nt, Human
cacaacuauauug

SEQ ID NO: 2754460 - RNA, 22 nt, Human
cacagcaguugaaaagacucca

SEQ ID NO: 2754461 - RNA, 15 nt, Human
cacaggaaguagagg

SEQ ID NO: 2754462 - RNA, 20 nt, Human
cacaggaaccacaagacugc

SEQ ID NO: 2754463 - RNA, 19 nt, Human
cacaggaaccacaagacug

SEQ ID NO: 2754464 - RNA, 14 nt, Human
cacaguuuucugag

SEQ ID NO: 2754465 - RNA, 20 nt, Human
cacauugguguuguacucaa

SEQ ID NO: 2754466 - RNA, 17 nt, Human
caaauaugcaaagcacu

SEQ ID NO: 2754467 - RNA, 16 nt, Human
caaauaugcaaagcac

SEQ ID NO: 2754468 - RNA, 18 nt, Human
caaauaugcaaagcacug

SEQ ID NO: 2754469 - RNA, 21 nt, Human
caaauguucaucaaugaauga

SEQ ID NO: 2754470 - RNA, 20 nt, Human
caaauguucaucaaugaaug

SEQ ID NO: 2754471 - RNA, 14 nt, Human
caaauaugcaaagc

SEQ ID NO: 2754472 - RNA, 19 nt, Human
caaaguugccuaaauccau

SEQ ID NO: 2754473 - RNA, 14 nt, Human
caaauuuacagaga

SEQ ID NO: 2754474 - RNA, 15 nt, Human
caaauugugugaaag

SEQ ID NO: 2754475 - RNA, 15 nt, Human
caaauuuacagagac

SEQ ID NO: 2754476 - RNA, 17 nt, Human
caagcacuaaacaaaga

SEQ ID NO: 2754477 - RNA, 15 nt, Human
cacccacccuuuuuu

SEQ ID NO: 2754478 - RNA, 19 nt, Human
ccaccucccugcaauaaaa

SEQ ID NO: 2754479 - RNA, 21 nt, Human
ccaccucccugcaauaaaaug

SEQ ID NO: 2754480 - RNA, 15 nt, Human
ccaccucccugcaau

SEQ ID NO: 2754481 - RNA, 14 nt, Human
ccagacaucaacag

SEQ ID NO: 2754482 - RNA, 15 nt, Human
ccacugguucuucuu

SEQ ID NO: 2754483 - RNA, 19 nt, Human
ccagccugagcgacaguga

SEQ ID NO: 2754484 - RNA, 20 nt, Human
ccagguagaggguguguaag

SEQ ID NO: 2754485 - RNA, 20 nt, Human
ccauccugaggcuccacuug

SEQ ID NO: 2754486 - RNA, 18 nt, Human
ccauccugaggcuccacu

SEQ ID NO: 2754487 - RNA, 13 nt, Human
ccaggugccaguu

SEQ ID NO: 2754488 - RNA, 12 nt, Human
ccaggugccagu

SEQ ID NO: 2754489 - RNA, 11 nt, Human
ccauuauucaa

SEQ ID NO: 2754490 - RNA, 13 nt, Human
ccauuuggaaauc

SEQ ID NO: 2754491 - RNA, 23 nt, Human
cccucuccugggcagcugccucc

SEQ ID NO: 2754492 - RNA, 20 nt, Human
cccucuccugggcagcugcc

SEQ ID NO: 2754493 - RNA, 21 nt, Human
cccucuccugggcagcugccu

SEQ ID NO: 2754494 - RNA, 22 nt, Human
cccucuccugggcagcugccuc

SEQ ID NO: 2754495 - RNA, 15 nt, Human
ccuaacgaaguaucc

SEQ ID NO: 2754496 - RNA, 15 nt, Human
ccccucggagaagag

SEQ ID NO: 2754497 - RNA, 13 nt, Human
ccccuccucugcu

SEQ ID NO: 2754498 - RNA, 14 nt, Human
ccccuccucugcuu

SEQ ID NO: 2754499 - RNA, 17 nt, Human
ccccuccucugcuugcc

SEQ ID NO: 2754500 - RNA, 12 nt, Human
cccauuauucaa

SEQ ID NO: 2754501 - RNA, 16 nt, Human
ccccacccugccucac

SEQ ID NO: 2754502 - RNA, 18 nt, Human
cccauuauucaaaguugc

SEQ ID NO: 2754503 - RNA, 23 nt, Human
cccauuauucaaaguugccuaaa

SEQ ID NO: 2754504 - RNA, 17 nt, Human
cucauuuccaagcaagu

SEQ ID NO: 2754505 - RNA, 13 nt, Human
cucauuuccaagc

SEQ ID NO: 2754506 - RNA, 14 nt, Human
cucauuuccaagca

SEQ ID NO: 2754507 - RNA, 12 nt, Human
cucauuuccaag

SEQ ID NO: 2754508 - RNA, 14 nt, Human
cuccccucggagaa

SEQ ID NO: 2754509 - RNA, 13 nt, Human
cuccauuuaauaa

SEQ ID NO: 2754510 - RNA, 20 nt, Human
cuccauuuaauaauuauaug

SEQ ID NO: 2754511 - RNA, 22 nt, Human
cucaggaaaucaaauaugcaaa

SEQ ID NO: 2754512 - RNA, 22 nt, Human
cucagauuuuauuauguaaauc

SEQ ID NO: 2754513 - RNA, 23 nt, Human
cucagauuuuauuauguaaaucc

SEQ ID NO: 2754514 - RNA, 13 nt, Human
cuauaauuuaaau

SEQ ID NO: 2754515 - RNA, 12 nt, Human
cuauaauuuaaa

SEQ ID NO: 2754516 - RNA, 18 nt, Human
cuaugaaauauuauguua

SEQ ID NO: 2754517 - RNA, 19 nt, Human
cuaugaaauauuauguuaa

SEQ ID NO: 2754518 - RNA, 14 nt, Human
cuaugcugaguuug

SEQ ID NO: 2754519 - RNA, 15 nt, Human
cuaugcugaguuugu

SEQ ID NO: 2754520 - RNA, 13 nt, Human
cuaugcugaguuu

SEQ ID NO: 2754521 - RNA, 20 nt, Human
cuauuucuauauuuucauuc

SEQ ID NO: 2754522 - RNA, 19 nt, Human
cuauuucuauauuuucauu

SEQ ID NO: 2754523 - RNA, 18 nt, Human
cuagaguuuagcuggaaa

SEQ ID NO: 2754524 - RNA, 19 nt, Human
cuagaguuuagcuggaaaa

SEQ ID NO: 2754525 - RNA, 19 nt, Human
cuagacuggugacugauuc

SEQ ID NO: 2754526 - RNA, 22 nt, Human
cuagacuggugacugauucuuc

SEQ ID NO: 2754527 - RNA, 23 nt, Human
cuagacuggugacugauucuuca

SEQ ID NO: 2754528 - RNA, 14 nt, Human
cuagacuggugacu

SEQ ID NO: 2754529 - RNA, 15 nt, Human
cuagacuggugacug

SEQ ID NO: 2754530 - RNA, 17 nt, Human
cuagacuggugacugau

SEQ ID NO: 2754531 - RNA, 18 nt, Human
cuagacuggugacugauu

SEQ ID NO: 2754532 - RNA, 14 nt, Human
cuaggaaauauuua

SEQ ID NO: 2754533 - RNA, 15 nt, Human
cuaggaaauauuuau

SEQ ID NO: 2754534 - RNA, 19 nt, Human
cuaggaaauauuuauuuua

SEQ ID NO: 2754535 - RNA, 20 nt, Human
cuaggaaauauuuauuuuaa

SEQ ID NO: 2754536 - RNA, 19 nt, Human
cuaaguaaaaccacagcag

SEQ ID NO: 2754537 - RNA, 18 nt, Human
cuaaguaaaaccacagca

SEQ ID NO: 2754538 - RNA, 14 nt, Human
cuaaguaaaaccac

SEQ ID NO: 2754539 - RNA, 21 nt, Human
cuaagcuucacuguaaaauaa

SEQ ID NO: 2754540 - RNA, 14 nt, Human
cuaaggacuucuuu

SEQ ID NO: 2754541 - RNA, 15 nt, Human
cuaaggacuucuuua

SEQ ID NO: 2754542 - RNA, 16 nt, Human
cuaaggacuucuuuaa

SEQ ID NO: 2754543 - RNA, 23 nt, Human
cuacacgagauacagaauuuuau

SEQ ID NO: 2754544 - RNA, 14 nt, Human
cuacacuaagagag

SEQ ID NO: 2754545 - RNA, 20 nt, Human
cgggaggcagagguugcagu

SEQ ID NO: 2754546 - RNA, 22 nt, Human
cuaaaauggacuguggugacuu

SEQ ID NO: 2754547 - RNA, 21 nt, Human
cuaaaauggacuguggugacu

SEQ ID NO: 2754548 - RNA, 14 nt, Human
cuaagagagaauga

SEQ ID NO: 2754549 - RNA, 15 nt, Human
cuaagagagaaugag

SEQ ID NO: 2754550 - RNA, 19 nt, Human
cuaaauugacacuuaaaaa

SEQ ID NO: 2754551 - RNA, 18 nt, Human
ccuucggccuccauccug

SEQ ID NO: 2754552 - RNA, 16 nt, Human
ccuucggccuccaucc

SEQ ID NO: 2754553 - RNA, 17 nt, Human
ccuucggccuccauccu

SEQ ID NO: 2754554 - RNA, 15 nt, Human
ccuuggacucauuuu

SEQ ID NO: 2754555 - RNA, 24 nt, Human
cgcguugaaauuguaauuauaucu

SEQ ID NO: 2754556 - RNA, 22 nt, Human
cgcguugaaauuguaauuauau

SEQ ID NO: 2754557 - RNA, 17 nt, Human
cgcuaaacuuuucugau

SEQ ID NO: 2754558 - RNA, 18 nt, Human
cgcuaaacuuuucugaua

SEQ ID NO: 2754559 - RNA, 19 nt, Human
cgcuaaacuuuucugauag

SEQ ID NO: 2754560 - RNA, 13 nt, Human
ccugggcagcugc

SEQ ID NO: 2754561 - RNA, 14 nt, Human
ccugggcagcugcc

SEQ ID NO: 2754562 - RNA, 17 nt, Human
ccugccccugagcccau

SEQ ID NO: 2754563 - RNA, 13 nt, Human
ccugaggcuccac

SEQ ID NO: 2754564 - RNA, 14 nt, Human
ccugaggcuccacu

SEQ ID NO: 2754565 - RNA, 16 nt, Human
gaaacacaacuauauu

SEQ ID NO: 2754566 - RNA, 11 nt, Human
gaaacauuugg

SEQ ID NO: 2754567 - RNA, 23 nt, Human
gaaacucguuaauuuguaguguu

SEQ ID NO: 2754568 - RNA, 17 nt, Human
gaaacggaugauuucua

SEQ ID NO: 2754569 - RNA, 18 nt, Human
gaaacggaugauuucuau

SEQ ID NO: 2754570 - RNA, 14 nt, Human
gaaacccugucucu

SEQ ID NO: 2754571 - RNA, 17 nt, Human
gaaagagaacuuccaga

SEQ ID NO: 2754572 - RNA, 21 nt, Human
gaaagaggaaugaaguacuca

SEQ ID NO: 2754573 - RNA, 20 nt, Human
gaaagaggcagcuugaaacu

SEQ ID NO: 2754574 - RNA, 22 nt, Human
gaaagcagaacagugauuacca

SEQ ID NO: 2754575 - RNA, 17 nt, Human
gaaagcagaacagugau

SEQ ID NO: 2754576 - RNA, 14 nt, Human
gaaagcagggacuu

SEQ ID NO: 2754577 - RNA, 18 nt, Human
gaaaaucuuauaauuuaa

SEQ ID NO: 2754578 - RNA, 22 nt, Human
gaaaaucuacacuccagugaga

SEQ ID NO: 2754579 - RNA, 18 nt, Human
gaaaauauuuguaucaca

SEQ ID NO: 2754580 - RNA, 23 nt, Human
gaaaaguuuaauauuaaagccau

SEQ ID NO: 2754581 - RNA, 19 nt, Human
gaaaaguuuaauauuaaag

SEQ ID NO: 2754582 - RNA, 20 nt, Human
gaaaaguuuaauauuaaagc

SEQ ID NO: 2754583 - RNA, 21 nt, Human
gaaaaguuuaauauuaaagcc

SEQ ID NO: 2754584 - RNA, 22 nt, Human
gaaaaguuuaauauuaaagcca

SEQ ID NO: 2754585 - RNA, 15 nt, Human
gaaaaguuuaauauu

SEQ ID NO: 2754586 - RNA, 22 nt, Human
cuuuuuggcauaacauaaaucu

SEQ ID NO: 2754587 - RNA, 16 nt, Human
cuuuuuggcauaacau

SEQ ID NO: 2754588 - RNA, 20 nt, Human
cuuuuuggcauaacauaaau

SEQ ID NO: 2754589 - RNA, 19 nt, Human
cuugaguuuaaauuguaau

SEQ ID NO: 2754590 - RNA, 23 nt, Human
cuugucaauaaaauccauacauu

SEQ ID NO: 2754591 - RNA, 14 nt, Human
cuuguguaaauaca

SEQ ID NO: 2754592 - RNA, 16 nt, Human
cuuguguaaauacaau

SEQ ID NO: 2754593 - RNA, 21 nt, Human
cuuguguaaauacaauuuugu

SEQ ID NO: 2754594 - RNA, 12 nt, Human
cuuguguaaaua

SEQ ID NO: 2754595 - RNA, 22 nt, Human
cuuguuagaucuaguucacucu

SEQ ID NO: 2754596 - RNA, 16 nt, Human
cuuucucuuucguuac

SEQ ID NO: 2754597 - RNA, 15 nt, Human
cuuugugcugggguu

SEQ ID NO: 2754598 - RNA, 20 nt, Human
cuuugugcugggguuaucug

SEQ ID NO: 2754599 - RNA, 22 nt, Human
cuuugugcugggguuaucugaa

SEQ ID NO: 2754600 - RNA, 23 nt, Human
cuuugucuacaccauuaugugcg

SEQ ID NO: 2754601 - RNA, 20 nt, Human
cuuugucuacaccauuaugu

SEQ ID NO: 2754602 - RNA, 14 nt, Human
cuuauuucauuucu

SEQ ID NO: 2754603 - RNA, 15 nt, Human
cuuauuucauuucuu

SEQ ID NO: 2754604 - RNA, 20 nt, Human
cuuagaugcaguucugaaga

SEQ ID NO: 2754605 - RNA, 22 nt, Human
cuuagaugcaguucugaagaag

SEQ ID NO: 2754606 - RNA, 18 nt, Human
cuucugucuucacaacag

SEQ ID NO: 2754607 - RNA, 22 nt, Human
cuucugucuucacaacagauua

SEQ ID NO: 2754608 - RNA, 21 nt, Human
cuucugucuucacaacagauu

SEQ ID NO: 2754609 - RNA, 15 nt, Human
cuucuuuaauuuugg

SEQ ID NO: 2754610 - RNA, 16 nt, Human
cuucuuuaauuuugga

SEQ ID NO: 2754611 - RNA, 17 nt, Human
cuucuuuaauuuuggaa

SEQ ID NO: 2754612 - RNA, 18 nt, Human
cuucuuuaauuuuggaau

SEQ ID NO: 2754613 - RNA, 19 nt, Human
cuucuuuaauuuuggaauu

SEQ ID NO: 2754614 - RNA, 20 nt, Human
cugcccucuccugggcagcu

SEQ ID NO: 2754615 - RNA, 21 nt, Human
cugcccucuccugggcagcug

SEQ ID NO: 2754616 - RNA, 16 nt, Human
cugcccucuccugggc

SEQ ID NO: 2754617 - RNA, 18 nt, Human
cugcccucuccugggcag

SEQ ID NO: 2754618 - RNA, 19 nt, Human
cugcccucuccugggcagc

SEQ ID NO: 2754619 - RNA, 13 nt, Human
cugccuccccucc

SEQ ID NO: 2754620 - RNA, 15 nt, Human
cugccuaaggacuuc

SEQ ID NO: 2754621 - RNA, 13 nt, Human
cugccuaaggacu

SEQ ID NO: 2754622 - RNA, 14 nt, Human
cugccuaaggacuu

SEQ ID NO: 2754623 - RNA, 12 nt, Human
cugccuaaggac

SEQ ID NO: 2754624 - RNA, 18 nt, Human
cugcugaaacaacaaaua

SEQ ID NO: 2754625 - RNA, 20 nt, Human
cuggcacaguuuucugagaa

SEQ ID NO: 2754626 - RNA, 22 nt, Human
cuggcacaguuuucugagaaag

SEQ ID NO: 2754627 - RNA, 21 nt, Human
cuggcacaguuuucugagaaa

SEQ ID NO: 2754628 - RNA, 22 nt, Human
cuggccuucggccuccauccug

SEQ ID NO: 2754629 - RNA, 23 nt, Human
cuggccuucggccuccauccuga

SEQ ID NO: 2754630 - RNA, 12 nt, Human
cuggagcucugc

SEQ ID NO: 2754631 - RNA, 13 nt, Human
cuggagcucugcc

SEQ ID NO: 2754632 - RNA, 16 nt, Human
cuggagcucugcccau

SEQ ID NO: 2754633 - RNA, 20 nt, Human
cuguauuuuaaaagaaugau

SEQ ID NO: 2754634 - RNA, 19 nt, Human
cuguauuuuaaaagaauga

SEQ ID NO: 2754635 - RNA, 22 nt, Human
cuguauuuuaaaagaaugauua

SEQ ID NO: 2754636 - RNA, 16 nt, Human
cuguauagauuagaau

SEQ ID NO: 2754637 - RNA, 20 nt, Human
cugucuacacuaagagagaa

SEQ ID NO: 2754638 - RNA, 23 nt, Human
cuguaaucacagcuacuugggag

SEQ ID NO: 2754639 - RNA, 22 nt, Human
cugggggggauuguaaaauggu

SEQ ID NO: 2754640 - RNA, 20 nt, Human
cuguuaaaagaugaaaauau

SEQ ID NO: 2754641 - RNA, 23 nt, Human
cuguuaaaagaugaaaauauuug

SEQ ID NO: 2754642 - RNA, 21 nt, Human
cuguuaaaagaugaaaauauu

SEQ ID NO: 2754643 - RNA, 16 nt, Human
gaauugacccacaaga

SEQ ID NO: 2754644 - RNA, 21 nt, Human
gaauugacccacaagaaauga

SEQ ID NO: 2754645 - RNA, 16 nt, Human
gaauuggagcucgugg

SEQ ID NO: 2754646 - RNA, 14 nt, Human
gaauucuguauaga

SEQ ID NO: 2754647 - RNA, 21 nt, Human
gaauucuguauagauuagaau

SEQ ID NO: 2754648 - RNA, 22 nt, Human
gaauucuguauagauuagaauu

SEQ ID NO: 2754649 - RNA, 13 nt, Human
gaauucuguauag

SEQ ID NO: 2754650 - RNA, 11 nt, Human
gaauucuguau

SEQ ID NO: 2754651 - RNA, 17 nt, Human
gaauggcuuuguauaga

SEQ ID NO: 2754652 - RNA, 14 nt, Human
gaauggcuuuguau

SEQ ID NO: 2754653 - RNA, 16 nt, Human
gaauggcuuuguauag

SEQ ID NO: 2754654 - RNA, 15 nt, Human
gacaagcucacagac

SEQ ID NO: 2754655 - RNA, 16 nt, Human
gacaaggaaaaaauaa

SEQ ID NO: 2754656 - RNA, 16 nt, Human
gacccaaaaggcagaa

SEQ ID NO: 2754657 - RNA, 15 nt, Human
gacccacaagaaaug

SEQ ID NO: 2754658 - RNA, 21 nt, Human
gaccacugcagaagacaguau

SEQ ID NO: 2754659 - RNA, 16 nt, Human
gacaugggacauuugc

SEQ ID NO: 2754660 - RNA, 18 nt, Human
gacagggaggacgcucuc

SEQ ID NO: 2754661 - RNA, 17 nt, Human
gacagggaggacgcucu

SEQ ID NO: 2754662 - RNA, 20 nt, Human
gacauagaauuaacacauga

SEQ ID NO: 2754663 - RNA, 14 nt, Human
gacugcauuauauu

SEQ ID NO: 2754664 - RNA, 16 nt, Human
gacugcauuauauuua

SEQ ID NO: 2754665 - RNA, 15 nt, Human
gacuccaaagaaaug

SEQ ID NO: 2754666 - RNA, 12 nt, Human
gacuccaaagaa

SEQ ID NO: 2754667 - RNA, 11 nt, Human
gacuccaaaga

SEQ ID NO: 2754668 - RNA, 21 nt, Human
gacucauuuuaaaaaauggaa

SEQ ID NO: 2754669 - RNA, 16 nt, Human
gacuccaaagaaaugu

SEQ ID NO: 2754670 - RNA, 24 nt, Human
gacuucuaaguaaaaccacagcag

SEQ ID NO: 2754671 - RNA, 23 nt, Human
gacuucuaaguaaaaccacagca

SEQ ID NO: 2754672 - RNA, 19 nt, Human
gacuucuaaguaaaaccac

SEQ ID NO: 2754673 - RNA, 23 nt, Human
gacuucugucuucacaacagauu

SEQ ID NO: 2754674 - RNA, 20 nt, Human
gacuucugucuucacaacag

SEQ ID NO: 2754675 - RNA, 18 nt, Human
gacuucuaaguaaaacca

SEQ ID NO: 2754676 - RNA, 17 nt, Human
gacuucuaaguaaaacc

SEQ ID NO: 2754677 - RNA, 16 nt, Human
gacuucuaaguaaaac

SEQ ID NO: 2754678 - RNA, 17 nt, Human
gacuucuuuaauuuugg

SEQ ID NO: 2754679 - RNA, 18 nt, Human
gacuucuuuaauuuugga

SEQ ID NO: 2754680 - RNA, 16 nt, Human
gacuucuuuaauuuug

SEQ ID NO: 2754681 - RNA, 19 nt, Human
gacuucuuuaauuuuggaa

SEQ ID NO: 2754682 - RNA, 20 nt, Human
gacuucuuuaauuuuggaau

SEQ ID NO: 2754683 - RNA, 21 nt, Human
gacuucuuuaauuuuggaauu

SEQ ID NO: 2754684 - RNA, 17 nt, Human
gagaaugagagacacac

SEQ ID NO: 2754685 - RNA, 22 nt, Human
gagaacuuccagauccuggaaa

SEQ ID NO: 2754686 - RNA, 23 nt, Human
gagaacuuccagauccuggaaau

SEQ ID NO: 2754687 - RNA, 21 nt, Human
gagaaccuagggugauauuaa

SEQ ID NO: 2754688 - RNA, 22 nt, Human
gagaaccuagggugauauuaac

SEQ ID NO: 2754689 - RNA, 20 nt, Human
gagacagcucugcauacuca

SEQ ID NO: 2754690 - RNA, 20 nt, Human
gagaaugagagacacacuga

SEQ ID NO: 2754691 - RNA, 21 nt, Human
gagaaugagagacacacugaa

SEQ ID NO: 2754692 - RNA, 13 nt, Human
gagaguguugaaa

SEQ ID NO: 2754693 - RNA, 22 nt, Human
gauaaauggcuuccuggcaaua

SEQ ID NO: 2754694 - RNA, 20 nt, Human
gauaaaugccaucaauaaaa

SEQ ID NO: 2754695 - RNA, 11 nt, Human
gauaaaugcca

SEQ ID NO: 2754696 - RNA, 15 nt, Human
gauaaaugccaucaa

SEQ ID NO: 2754697 - RNA, 16 nt, Human
gaguguugaaacggau

SEQ ID NO: 2754698 - RNA, 12 nt, Human
gaguguugaaac

SEQ ID NO: 2754699 - RNA, 23 nt, Human
gagugaacaaauuuacagagaca

SEQ ID NO: 2754700 - RNA, 15 nt, Human
gcacugacuucuaag

SEQ ID NO: 2754701 - RNA, 18 nt, Human
gcacugacuucuaaguaa

SEQ ID NO: 2754702 - RNA, 20 nt, Human
gaugcuagaacucccuuuca

SEQ ID NO: 2754703 - RNA, 22 nt, Human
gaugcuagaacucccuuucaac

SEQ ID NO: 2754704 - RNA, 18 nt, Human
gaugcuagaacucccuuu

SEQ ID NO: 2754705 - RNA, 19 nt, Human
gauguugaaaaaguucugc

SEQ ID NO: 2754706 - RNA, 16 nt, Human
gcaaauugucacagga

SEQ ID NO: 2754707 - RNA, 15 nt, Human
ggauuguaaaauggu

SEQ ID NO: 2754708 - RNA, 20 nt, Human
ggauucuuaaaguugaauuu

SEQ ID NO: 2754709 - RNA, 18 nt, Human
ggauucuuaaaguugaau

SEQ ID NO: 2754710 - RNA, 19 nt, Human
ggauucuuaaaguugaauu

SEQ ID NO: 2754711 - RNA, 16 nt, Human
ggauucuuaaaguuga

SEQ ID NO: 2754712 - RNA, 14 nt, Human
ggcauggcugggaa

SEQ ID NO: 2754713 - RNA, 13 nt, Human
ggacgcucucugg

SEQ ID NO: 2754714 - RNA, 14 nt, Human
ggacgcucucuggc

SEQ ID NO: 2754715 - RNA, 14 nt, Human
ggacuguggugacu

SEQ ID NO: 2754716 - RNA, 15 nt, Human
ggagaaucacuugaa

SEQ ID NO: 2754717 - RNA, 19 nt, Human
ggagaaucacuugaacccg

SEQ ID NO: 2754718 - RNA, 15 nt, Human
ggacuguggugacuu

SEQ ID NO: 2754719 - RNA, 17 nt, Human
ggacuguggugacuuug

SEQ ID NO: 2754720 - RNA, 21 nt, Human
ggacuguggugacuuuggaua

SEQ ID NO: 2754721 - RNA, 22 nt, Human
ggacuguggugacuuuggauaa

SEQ ID NO: 2754722 - RNA, 16 nt, Human
ggaccaaaaaccagua

SEQ ID NO: 2754723 - RNA, 23 nt, Human
ggaccaaaaaccaguauuguaca

SEQ ID NO: 2754724 - RNA, 14 nt, Human
ggaccaaaaaccag

SEQ ID NO: 2754725 - RNA, 23 nt, Human
ggaauuucucccagucauuuaau

SEQ ID NO: 2754726 - RNA, 16 nt, Human
ggaauuggagcucgug

SEQ ID NO: 2754727 - RNA, 22 nt, Human
ggaauuggagcucgugggacag

SEQ ID NO: 2754728 - RNA, 12 nt, Human
ggaauucuguau

SEQ ID NO: 2754729 - RNA, 15 nt, Human
ggaauucuguauaga

SEQ ID NO: 2754730 - RNA, 17 nt, Human
ggaauucuguauagauu

SEQ ID NO: 2754731 - RNA, 20 nt, Human
ggaagugacgguuuaauggg

SEQ ID NO: 2754732 - RNA, 14 nt, Human
ggaaaaguuuaaua

SEQ ID NO: 2754733 - RNA, 17 nt, Human
ggaaaucaaauaugcaa

SEQ ID NO: 2754734 - RNA, 16 nt, Human
ggaaaucaaauaugca

SEQ ID NO: 2754735 - RNA, 23 nt, Human
gcuuucagauacuggauuguacu

SEQ ID NO: 2754736 - RNA, 20 nt, Human
gcuuuguauagaaccucuuu

SEQ ID NO: 2754737 - RNA, 14 nt, Human
gcuuucagauacug

SEQ ID NO: 2754738 - RNA, 18 nt, Human
gcuuucagauacuggauu

SEQ ID NO: 2754739 - RNA, 20 nt, Human
gcugucuacacuaagagaga

SEQ ID NO: 2754740 - RNA, 22 nt, Human
gccuauauuuuuuguuaaauga

SEQ ID NO: 2754741 - RNA, 17 nt, Human
gccuaagugcagccccg

SEQ ID NO: 2754742 - RNA, 23 nt, Human
gccugcacggugaauggcuuugu

SEQ ID NO: 2754743 - RNA, 16 nt, Human
gccugauuaaagaaug

SEQ ID NO: 2754744 - RNA, 13 nt, Human
gccugauuaaaga

SEQ ID NO: 2754745 - RNA, 12 nt, Human
gcccucuccugg

SEQ ID NO: 2754746 - RNA, 13 nt, Human
gcccucuccuggg

SEQ ID NO: 2754747 - RNA, 22 nt, Human
gcccucuccugggcagcugccu

SEQ ID NO: 2754748 - RNA, 23 nt, Human
gcccucuccugggcagcugccuc

SEQ ID NO: 2754749 - RNA, 14 nt, Human
gcuaagcauuccaa

SEQ ID NO: 2754750 - RNA, 17 nt, Human
gcuaagcaaaaugugau

SEQ ID NO: 2754751 - RNA, 12 nt, Human
gcucucuggccu

SEQ ID NO: 2754752 - RNA, 13 nt, Human
gcucucuggccuu

SEQ ID NO: 2754753 - RNA, 11 nt, Human
gcucucuggcc

SEQ ID NO: 2754754 - RNA, 14 nt, Human
gcucucuggccuuc

SEQ ID NO: 2754755 - RNA, 15 nt, Human
gcucucuggccuucg

SEQ ID NO: 2754756 - RNA, 19 nt, Human
gcucucuggccuucggccu

SEQ ID NO: 2754757 - RNA, 20 nt, Human
gcucucuggccuucggccuc

SEQ ID NO: 2754758 - RNA, 19 nt, Human
guaaugauaacuggaaacu

SEQ ID NO: 2754759 - RNA, 15 nt, Human
guaauuggaaaggca

SEQ ID NO: 2754760 - RNA, 13 nt, Human
guaauuauaucug

SEQ ID NO: 2754761 - RNA, 15 nt, Human
guaccgcaaugugac

SEQ ID NO: 2754762 - RNA, 15 nt, Human
guagaggagaaacug

SEQ ID NO: 2754763 - RNA, 12 nt, Human
guacuuuuuggc

SEQ ID NO: 2754764 - RNA, 21 nt, Human
guacuuuuuggcauaacauaa

SEQ ID NO: 2754765 - RNA, 23 nt, Human
guacuuuauuuucuauaauuuaa

SEQ ID NO: 2754766 - RNA, 18 nt, Human
guaagggaaacugccagc

SEQ ID NO: 2754767 - RNA, 17 nt, Human
guaagggaaacugccag

SEQ ID NO: 2754768 - RNA, 22 nt, Human
guaaauacaauuuuguuucugu

SEQ ID NO: 2754769 - RNA, 23 nt, Human
guaaauacaauuuuguuucugua

SEQ ID NO: 2754770 - RNA, 15 nt, Human
guaaaucccauuauu

SEQ ID NO: 2754771 - RNA, 21 nt, Human
guaaauacaauuuuguuucug

SEQ ID NO: 2754772 - RNA, 16 nt, Human
guaaaucccauuauuc

SEQ ID NO: 2754773 - RNA, 17 nt, Human
guaaaucccauuauuca

SEQ ID NO: 2754774 - RNA, 18 nt, Human
guaaaucccauuauucaa

SEQ ID NO: 2754775 - RNA, 19 nt, Human
guaaaucccauuauucaaa

SEQ ID NO: 2754776 - RNA, 20 nt, Human
guaaaucccauuauucaaag

SEQ ID NO: 2754777 - RNA, 21 nt, Human
guaaaucccauuauucaaagu

SEQ ID NO: 2754778 - RNA, 18 nt, Human
guaaaaccacagcaguug

SEQ ID NO: 2754779 - RNA, 16 nt, Human
guaaaaccacagcagu

SEQ ID NO: 2754780 - RNA, 15 nt, Human
guaaaaccacagcag

SEQ ID NO: 2754781 - RNA, 14 nt, Human
guaaaaccacagca

SEQ ID NO: 2754782 - RNA, 23 nt, Human
guaaaaccacagcaguugaaaag

SEQ ID NO: 2754783 - RNA, 15 nt, Human
gguagacacacauga

SEQ ID NO: 2754784 - RNA, 22 nt, Human
gguagacacacaugaaguccaa

SEQ ID NO: 2754785 - RNA, 22 nt, Human
gguacuucaaauccuugaagau

SEQ ID NO: 2754786 - RNA, 19 nt, Human
ggugcuacaaaaacacagc

SEQ ID NO: 2754787 - RNA, 19 nt, Human
ggugcccugcuuucagaua

SEQ ID NO: 2754788 - RNA, 17 nt, Human
ggugaauggcuuuguau

SEQ ID NO: 2754789 - RNA, 20 nt, Human
ggugaauggcuuuguauaga

SEQ ID NO: 2754790 - RNA, 14 nt, Human
ggugaauggcuuug

SEQ ID NO: 2754791 - RNA, 16 nt, Human
gguccgugcuaaggac

SEQ ID NO: 2754792 - RNA, 17 nt, Human
gguccgugcuaaggacu

SEQ ID NO: 2754793 - RNA, 18 nt, Human
gguccgugcuaaggacuu

SEQ ID NO: 2754794 - RNA, 22 nt, Human
guauuucuaugaaauauuaugu

SEQ ID NO: 2754795 - RNA, 17 nt, Human
guauuucuaugaaauau

SEQ ID NO: 2754796 - RNA, 16 nt, Human
guauuuuaaaagaaug

SEQ ID NO: 2754797 - RNA, 17 nt, Human
guauuuuaaaagaauga

SEQ ID NO: 2754798 - RNA, 14 nt, Human
gucaccucauggaa

SEQ ID NO: 2754799 - RNA, 15 nt, Human
gucaauaaaauccau

SEQ ID NO: 2754800 - RNA, 21 nt, Human
gucaauaaaauccauacauuu

SEQ ID NO: 2754801 - RNA, 20 nt, Human
gucccagccagcaguucaga

SEQ ID NO: 2754802 - RNA, 23 nt, Human
gucuacacuaagagagaaugaga

SEQ ID NO: 2754803 - RNA, 17 nt, Human
gucuacacuaagagaga

SEQ ID NO: 2754804 - RNA, 13 nt, Human
gucucagauuuua

SEQ ID NO: 2754805 - RNA, 18 nt, Human
gugcaaauugucacagga

SEQ ID NO: 2754806 - RNA, 20 nt, Human
gugaaacucguuaauuugua

SEQ ID NO: 2754807 - RNA, 19 nt, Human
gugaaagaaaauaacaaua

SEQ ID NO: 2754808 - RNA, 17 nt, Human
gugaauggcuuuguaua

SEQ ID NO: 2754809 - RNA, 18 nt, Human
gugaauggcuuuguauag

SEQ ID NO: 2754810 - RNA, 19 nt, Human
gugaauggcuuuguauaga

SEQ ID NO: 2754811 - RNA, 13 nt, Human
gugaauggcuuug

SEQ ID NO: 2754812 - RNA, 14 nt, Human
gugaauggcuuugu

SEQ ID NO: 2754813 - RNA, 16 nt, Human
gugagcagucaggaaa

SEQ ID NO: 2754814 - RNA, 14 nt, Human
gugagcuacaaaug

SEQ ID NO: 2754815 - RNA, 17 nt, Human
ucaaacauauauaacaa

SEQ ID NO: 2754816 - RNA, 22 nt, Human
ucaaacagucucaggaaaucaa

SEQ ID NO: 2754817 - RNA, 16 nt, Human
ucaaauccuugaagau

SEQ ID NO: 2754818 - RNA, 15 nt, Human
ucaaauccuugaaga

SEQ ID NO: 2754819 - RNA, 19 nt, Human
ucaaauaugcaaagcacug

SEQ ID NO: 2754820 - RNA, 18 nt, Human
ucaaauaugcaaagcacu

SEQ ID NO: 2754821 - RNA, 17 nt, Human
ucaaauaugcaaagcac

SEQ ID NO: 2754822 - RNA, 16 nt, Human
ucaaauaugcaaagca

SEQ ID NO: 2754823 - RNA, 22 nt, Human
ucaacuccaaacugacucuuaa

SEQ ID NO: 2754824 - RNA, 14 nt, Human
ucaauaaaaaauua

SEQ ID NO: 2754825 - RNA, 16 nt, Human
ucaauaaaaaauuaug

SEQ ID NO: 2754826 - RNA, 13 nt, Human
ucaauaaaaaauu

SEQ ID NO: 2754827 - RNA, 12 nt, Human
ucacauuuaaau

SEQ ID NO: 2754828 - RNA, 18 nt, Human
ucacauugguguuguacu

SEQ ID NO: 2754829 - RNA, 22 nt, Human
ucacaagacccaaaaggcagaa

SEQ ID NO: 2754830 - RNA, 14 nt, Human
ucaauaaaauccau

SEQ ID NO: 2754831 - RNA, 19 nt, Human
ucaauaaaaaauuaugaca

SEQ ID NO: 2754832 - RNA, 17 nt, Human
uauuguuuaaaaucauu

SEQ ID NO: 2754833 - RNA, 16 nt, Human
uauuguuuaaaaucau

SEQ ID NO: 2754834 - RNA, 15 nt, Human
uauuguuuaaaauca

SEQ ID NO: 2754835 - RNA, 19 nt, Human
uauugugcgcuaaacuuuu

SEQ ID NO: 2754836 - RNA, 22 nt, Human
uauugugcgcuaaacuuuucug

SEQ ID NO: 2754837 - RNA, 23 nt, Human
uauugugcgcuaaacuuuucuga

SEQ ID NO: 2754838 - RNA, 14 nt, Human
uauuuauuacugua

SEQ ID NO: 2754839 - RNA, 13 nt, Human
uauuucuaugaaa

SEQ ID NO: 2754840 - RNA, 13 nt, Human
uauuuauuacugu

SEQ ID NO: 2754841 - RNA, 14 nt, Human
uauuucuaugaaau

SEQ ID NO: 2754842 - RNA, 15 nt, Human
uauuucuaugaaaua

SEQ ID NO: 2754843 - RNA, 20 nt, Human
uauuguuuaaaaucauuucu

SEQ ID NO: 2754844 - RNA, 16 nt, Human
uauuauguuaaaacug

SEQ ID NO: 2754845 - RNA, 22 nt, Human
uauuauguaaaucccauuauuc

SEQ ID NO: 2754846 - RNA, 12 nt, Human
uauuauguaaau

SEQ ID NO: 2754847 - RNA, 15 nt, Human
uauuauguaaauccc

SEQ ID NO: 2754848 - RNA, 12 nt, Human
uauuaugaaacu

SEQ ID NO: 2754849 - RNA, 20 nt, Human
uauuaugaaacuuguguaaa

SEQ ID NO: 2754850 - RNA, 21 nt, Human
uauuaugaaacuuguguaaau

SEQ ID NO: 2754851 - RNA, 22 nt, Human
uauuaugaaacuuguguaaaua

SEQ ID NO: 2754852 - RNA, 17 nt, Human
uauuauauuuacaaaug

SEQ ID NO: 2754853 - RNA, 16 nt, Human
uauuaagcauauauuu

SEQ ID NO: 2754854 - RNA, 19 nt, Human
uauguuagugcaaauuguc

SEQ ID NO: 2754855 - RNA, 12 nt, Human
uauguuaaaacu

SEQ ID NO: 2754856 - RNA, 19 nt, Human
uauggaggcuuugcauaga

SEQ ID NO: 2754857 - RNA, 17 nt, Human
uauguucuaagaaguga

SEQ ID NO: 2754858 - RNA, 15 nt, Human
uauccuucagccuga

SEQ ID NO: 2754859 - RNA, 14 nt, Human
uauccuucagccug

SEQ ID NO: 2754860 - RNA, 17 nt, Human
uaucugaggaauucugu

SEQ ID NO: 2754861 - RNA, 16 nt, Human
uaucugaggaauucug

SEQ ID NO: 2754862 - RNA, 18 nt, Human
uaucugaggaauucugua

SEQ ID NO: 2754863 - RNA, 19 nt, Human
uaucugaggaauucuguau

SEQ ID NO: 2754864 - RNA, 21 nt, Human
uaucugaggaauucuguauag

SEQ ID NO: 2754865 - RNA, 22 nt, Human
uaucugaggaauucuguauaga

SEQ ID NO: 2754866 - RNA, 23 nt, Human
uaugaauuacauuuguauaaaau

SEQ ID NO: 2754867 - RNA, 17 nt, Human
uaugaauuacauuugua

SEQ ID NO: 2754868 - RNA, 12 nt, Human
uaugcaaagcac

SEQ ID NO: 2754869 - RNA, 14 nt, Human
uaugcaaagcacug

SEQ ID NO: 2754870 - RNA, 13 nt, Human
uaugcaaagcacu

SEQ ID NO: 2754871 - RNA, 15 nt, Human
uaugcaaagcacuga

SEQ ID NO: 2754872 - RNA, 16 nt, Human
uaugauucccagccag

SEQ ID NO: 2754873 - RNA, 15 nt, Human
uaugcuucuguuuua

SEQ ID NO: 2754874 - RNA, 16 nt, Human
uaugcuucuguuuuau

SEQ ID NO: 2754875 - RNA, 13 nt, Human
uauaugcuucugu

SEQ ID NO: 2754876 - RNA, 13 nt, Human
uauauaacaaugc

SEQ ID NO: 2754877 - RNA, 19 nt, Human
uauaucugaggaauucugu

SEQ ID NO: 2754878 - RNA, 20 nt, Human
uauaucugaggaauucugua

SEQ ID NO: 2754879 - RNA, 21 nt, Human
uauaucugaggaauucuguau

SEQ ID NO: 2754880 - RNA, 22 nt, Human
uauaucugaggaauucuguaua

SEQ ID NO: 2754881 - RNA, 18 nt, Human
uauaucugaggaauucug

SEQ ID NO: 2754882 - RNA, 22 nt, Human
uauaauuaacauguuaaaccau

SEQ ID NO: 2754883 - RNA, 15 nt, Human
uauaauuaacauguu

SEQ ID NO: 2754884 - RNA, 16 nt, Human
uauaauuaacauguua

SEQ ID NO: 2754885 - RNA, 18 nt, Human
uauaauuaacauguuaaa

SEQ ID NO: 2754886 - RNA, 19 nt, Human
uauaauuaacauguuaaac

SEQ ID NO: 2754887 - RNA, 13 nt, Human
uauaauuaacaug

SEQ ID NO: 2754888 - RNA, 14 nt, Human
uauaauuaacaugu

SEQ ID NO: 2754889 - RNA, 12 nt, Human
uauaauuaacau

SEQ ID NO: 2754890 - RNA, 13 nt, Human
uaguaucaaaaga

SEQ ID NO: 2754891 - RNA, 18 nt, Human
uaguauuucuaugaaaua

SEQ ID NO: 2754892 - RNA, 19 nt, Human
uaguauuucuaugaaauau

SEQ ID NO: 2754893 - RNA, 16 nt, Human
uaguauuucuaugaaa

SEQ ID NO: 2754894 - RNA, 13 nt, Human
uagucaaauugug

SEQ ID NO: 2754895 - RNA, 14 nt, Human
uagugcaaauuguc

SEQ ID NO: 2754896 - RNA, 15 nt, Human
uagugcaaauuguca

SEQ ID NO: 2754897 - RNA, 12 nt, Human
uaggaauugacc

SEQ ID NO: 2754898 - RNA, 16 nt, Human
uaggccaugggacagg

SEQ ID NO: 2754899 - RNA, 18 nt, Human
uaggccaugggacaggga

SEQ ID NO: 2754900 - RNA, 16 nt, Human
uaggucagugcaaaua

SEQ ID NO: 2754901 - RNA, 16 nt, Human
ucauuaggauggcuag

SEQ ID NO: 2754902 - RNA, 17 nt, Human
uccaaagaaauguaagg

SEQ ID NO: 2754903 - RNA, 14 nt, Human
uccaaagaaaugua

SEQ ID NO: 2754904 - RNA, 11 nt, Human
ucauagcagcu

SEQ ID NO: 2754905 - RNA, 12 nt, Human
ucauagcagcuu

SEQ ID NO: 2754906 - RNA, 17 nt, Human
ucaucaaugaaugaaug

SEQ ID NO: 2754907 - RNA, 21 nt, Human
ucauggaacgcguugaaauug

SEQ ID NO: 2754908 - RNA, 22 nt, Human
ucauggaacgcguugaaauugu

SEQ ID NO: 2754909 - RNA, 20 nt, Human
ucauggaacgcguugaaauu

SEQ ID NO: 2754910 - RNA, 21 nt, Human
uccacuuggucugugagaugc

SEQ ID NO: 2754911 - RNA, 17 nt, Human
uccacuuggucugugag

SEQ ID NO: 2754912 - RNA, 23 nt, Human
uccacuuggucugugagaugcua

SEQ ID NO: 2754913 - RNA, 15 nt, Human
uccagcagauuauuc

SEQ ID NO: 2754914 - RNA, 16 nt, Human
uccagcagauuauuca

SEQ ID NO: 2754915 - RNA, 14 nt, Human
uccagcagauuauu

SEQ ID NO: 2754916 - RNA, 20 nt, Human
uccaugggccauaugaaaag

SEQ ID NO: 2754917 - RNA, 15 nt, Human
uccauacauuugugu

SEQ ID NO: 2754918 - RNA, 19 nt, Human
uccagguagagggugugua

SEQ ID NO: 2754919 - RNA, 12 nt, Human
uccauacauuug

SEQ ID NO: 2754920 - RNA, 20 nt, Human
uccaguuuuguuuggaccaa

SEQ ID NO: 2754921 - RNA, 15 nt, Human
uccaguuuuguuugg

SEQ ID NO: 2754922 - RNA, 17 nt, Human
uccaguuuuguuuggac

SEQ ID NO: 2754923 - RNA, 16 nt, Human
ucccauuauucaaagu

SEQ ID NO: 2754924 - RNA, 18 nt, Human
ucccauuauucaaaguug

SEQ ID NO: 2754925 - RNA, 19 nt, Human
ucccauuauucaaaguugc

SEQ ID NO: 2754926 - RNA, 13 nt, Human
ucccauuauucaa

SEQ ID NO: 2754927 - RNA, 14 nt, Human
ucccauuauucaaa

SEQ ID NO: 2754928 - RNA, 23 nt, Human
uccuagugaaagaggcagcuuga

SEQ ID NO: 2754929 - RNA, 14 nt, Human
uccuagugaaagag

SEQ ID NO: 2754930 - RNA, 20 nt, Human
uccuaucaccugucuugccu

SEQ ID NO: 2754931 - RNA, 17 nt, Human
uccugccccugagccca

SEQ ID NO: 2754932 - RNA, 18 nt, Human
uccugccccugagcccau

SEQ ID NO: 2754933 - RNA, 19 nt, Human
uccugaggcuccacuuggu

SEQ ID NO: 2754934 - RNA, 20 nt, Human
uccugaggcuccacuugguc

SEQ ID NO: 2754935 - RNA, 18 nt, Human
ucuaugaaauauuauguu

SEQ ID NO: 2754936 - RNA, 12 nt, Human
ucggagaagagc

SEQ ID NO: 2754937 - RNA, 16 nt, Human
ucggagaagagcuguu

SEQ ID NO: 2754938 - RNA, 14 nt, Human
ucggagaagagcug

SEQ ID NO: 2754939 - RNA, 23 nt, Human
ucucaguccaugaagauguagag

SEQ ID NO: 2754940 - RNA, 12 nt, Human
ugacaagcucac

SEQ ID NO: 2754941 - RNA, 15 nt, Human
ugacaagcucacaga

SEQ ID NO: 2754942 - RNA, 20 nt, Human
ugacaagcucacagaccuuu

SEQ ID NO: 2754943 - RNA, 20 nt, Human
ugaccacugcagaagacagu

SEQ ID NO: 2754944 - RNA, 16 nt, Human
ugacaugggacauuug

SEQ ID NO: 2754945 - RNA, 17 nt, Human
ugacaugggacauuugc

SEQ ID NO: 2754946 - RNA, 16 nt, Human
ugacauagucuggcug

SEQ ID NO: 2754947 - RNA, 17 nt, Human
ugacauagucuggcugu

SEQ ID NO: 2754948 - RNA, 18 nt, Human
ugacaugggacauuugcu

SEQ ID NO: 2754949 - RNA, 11 nt, Human
ugaaguccaag

SEQ ID NO: 2754950 - RNA, 23 nt, Human
ugaagucagaucugccuaaggac

SEQ ID NO: 2754951 - RNA, 20 nt, Human
ugaagucagaucugccuaag

SEQ ID NO: 2754952 - RNA, 13 nt, Human
ugaaguccaagca

SEQ ID NO: 2754953 - RNA, 20 nt, Human
ugaaugaauggcuaagcaaa

SEQ ID NO: 2754954 - RNA, 14 nt, Human
ugaauuacauuugu

SEQ ID NO: 2754955 - RNA, 15 nt, Human
ugaauuacauuugua

SEQ ID NO: 2754956 - RNA, 16 nt, Human
ugaauuacauuuguau

SEQ ID NO: 2754957 - RNA, 18 nt, Human
ugaauuacauuuguauaa

SEQ ID NO: 2754958 - RNA, 15 nt, Human
ugaaagguacuucaa

SEQ ID NO: 2754959 - RNA, 16 nt, Human
ugaaagguacuucaaa

SEQ ID NO: 2754960 - RNA, 18 nt, Human
ugaaagaggcagcuugaa

SEQ ID NO: 2754961 - RNA, 22 nt, Human
ugaaacaacaaauaggaauugu

SEQ ID NO: 2754962 - RNA, 19 nt, Human
ugaaauggacuuuuguaca

SEQ ID NO: 2754963 - RNA, 16 nt, Human
ugaaauauugacuuuu

SEQ ID NO: 2754964 - RNA, 17 nt, Human
ucuuucacauuuaaaua

SEQ ID NO: 2754965 - RNA, 19 nt, Human
ucuugccuuuuucauuauu

SEQ ID NO: 2754966 - RNA, 16 nt, Human
ucuugccuuuuucauu

SEQ ID NO: 2754967 - RNA, 17 nt, Human
ucuugccuuuuucauua

SEQ ID NO: 2754968 - RNA, 15 nt, Human
ucuugccuuuuucau

SEQ ID NO: 2754969 - RNA, 19 nt, Human
ucuuuccacagaagcucca

SEQ ID NO: 2754970 - RNA, 12 nt, Human
ucuuugccaagu

SEQ ID NO: 2754971 - RNA, 16 nt, Human
ugauuaccagggacug

SEQ ID NO: 2754972 - RNA, 22 nt, Human
ugauguuuagaaacacaacuau

SEQ ID NO: 2754973 - RNA, 13 nt, Human
ugauuauauguca

SEQ ID NO: 2754974 - RNA, 17 nt, Human
ugauuaugaauuacauu

SEQ ID NO: 2754975 - RNA, 19 nt, Human
ugauuaugaauuacauuug

SEQ ID NO: 2754976 - RNA, 21 nt, Human
ugauuaugaauuacauuugua

SEQ ID NO: 2754977 - RNA, 22 nt, Human
ugauuaugaauuacauuuguau

SEQ ID NO: 2754978 - RNA, 21 nt, Human
ugauucuucagcaaaaauauu

SEQ ID NO: 2754979 - RNA, 15 nt, Human
ugauggugguauguu

SEQ ID NO: 2754980 - RNA, 20 nt, Human
ugaugcuacaggauuugaaa

SEQ ID NO: 2754981 - RNA, 23 nt, Human
ugaugcuacaggauuugaaauug

SEQ ID NO: 2754982 - RNA, 17 nt, Human
ugaucuuuaaaauacac

SEQ ID NO: 2754983 - RNA, 14 nt, Human
ugaucuuuaaaaua

SEQ ID NO: 2754984 - RNA, 24 nt, Human
ugaucagcuuauugucuagugaaa

SEQ ID NO: 2754985 - RNA, 17 nt, Human
ugaucagcuuauugucu

SEQ ID NO: 2754986 - RNA, 15 nt, Human
ugauagaggaagccu

SEQ ID NO: 2754987 - RNA, 16 nt, Human
ugagagugaacaaauu

SEQ ID NO: 2754988 - RNA, 13 nt, Human
ugagccccaaaag

SEQ ID NO: 2754989 - RNA, 16 nt, Human
ugauaacuggaaacuu

SEQ ID NO: 2754990 - RNA, 18 nt, Human
ugaggcuccacuuggucu

SEQ ID NO: 2754991 - RNA, 20 nt, Human
ugaggcuccacuuggucugu

SEQ ID NO: 2754992 - RNA, 13 nt, Human
ugcuagaacuccc

SEQ ID NO: 2754993 - RNA, 14 nt, Human
ugcuagaacucccu

SEQ ID NO: 2754994 - RNA, 15 nt, Human
ugcuagaacucccuu

SEQ ID NO: 2754995 - RNA, 17 nt, Human
ugcuagaacucccuuuc

SEQ ID NO: 2754996 - RNA, 19 nt, Human
ugcgcuaaacuuuucugau

SEQ ID NO: 2754997 - RNA, 20 nt, Human
ugcgcuaaacuuuucugaua

SEQ ID NO: 2754998 - RNA, 21 nt, Human
ugcgcuaaacuuuucugauag

SEQ ID NO: 2754999 - RNA, 20 nt, Human
ugcugggggggauuguaaaa

SEQ ID NO: 2755000 - RNA, 17 nt, Human
ugcugggguuaucugaa

SEQ ID NO: 2755001 - RNA, 20 nt, Human
ugcugggguuaucugaaguc

SEQ ID NO: 2755002 - RNA, 13 nt, Human
ugcugguguaugu

SEQ ID NO: 2755003 - RNA, 22 nt, Human
ugcugguguaugugugaaguga

SEQ ID NO: 2755004 - RNA, 22 nt, Human
ugcaucaauuuuucuuauuuca

SEQ ID NO: 2755005 - RNA, 12 nt, Human
ugcaguucugaa

SEQ ID NO: 2755006 - RNA, 13 nt, Human
ugcaucagcugcu

SEQ ID NO: 2755007 - RNA, 16 nt, Human
ugccacuaaauugaca

SEQ ID NO: 2755008 - RNA, 20 nt, Human
ugccuaaauccauuuggaaa

SEQ ID NO: 2755009 - RNA, 22 nt, Human
ugccuaaauccauuuggaaauc

SEQ ID NO: 2755010 - RNA, 23 nt, Human
ugccuaaauccauuuggaaaucu

SEQ ID NO: 2755011 - RNA, 23 nt, Human
ugccucacccacccuuuuuuaaa

SEQ ID NO: 2755012 - RNA, 20 nt, Human
ugccucacccacccuuuuuu

SEQ ID NO: 2755013 - RNA, 15 nt, Human
ugccuaaauccauuu

SEQ ID NO: 2755014 - RNA, 19 nt, Human
ugccuaaauccauuuggaa

SEQ ID NO: 2755015 - RNA, 13 nt, Human
ugccuaaauccau

SEQ ID NO: 2755016 - RNA, 15 nt, Human
uggcacuaguauuuc

SEQ ID NO: 2755017 - RNA, 20 nt, Human
uggcaauagucaaauugugu

SEQ ID NO: 2755018 - RNA, 20 nt, Human
uggauaauaaggaaaaguuu

SEQ ID NO: 2755019 - RNA, 17 nt, Human
uggaccaaaaaccagua

SEQ ID NO: 2755020 - RNA, 22 nt, Human
uggaccaaaaaccaguauugua

SEQ ID NO: 2755021 - RNA, 13 nt, Human
ugguauguuuuca

SEQ ID NO: 2755022 - RNA, 22 nt, Human
uggucacaggaaguagaggagg

SEQ ID NO: 2755023 - RNA, 17 nt, Human
uggucacaggaaguaga

SEQ ID NO: 2755024 - RNA, 16 nt, Human
uggucccagccagcag

SEQ ID NO: 2755025 - RNA, 17 nt, Human
ugguccgugcuaaggac

SEQ ID NO: 2755026 - RNA, 18 nt, Human
ugguccgugcuaaggacu

SEQ ID NO: 2755027 - RNA, 19 nt, Human
ugguccgugcuaaggacuu

SEQ ID NO: 2755028 - RNA, 20 nt, Human
ugguccgugcuaaggacuug

SEQ ID NO: 2755029 - RNA, 15 nt, Human
uggugacugauucuu

SEQ ID NO: 2755030 - RNA, 16 nt, Human
uggugacugauucuuc

SEQ ID NO: 2755031 - RNA, 19 nt, Human
uggugacugauucuucagc

SEQ ID NO: 2755032 - RNA, 17 nt, Human
ugggcagcugccucccc

SEQ ID NO: 2755033 - RNA, 19 nt, Human
ugggcagcugccuccccuc

SEQ ID NO: 2755034 - RNA, 12 nt, Human
ugggcagcugcc

SEQ ID NO: 2755035 - RNA, 13 nt, Human
ugggcagcugccu

SEQ ID NO: 2755036 - RNA, 14 nt, Human
ugggcagcugccuc

SEQ ID NO: 2755037 - RNA, 15 nt, Human
ugggcagcugccucc

SEQ ID NO: 2755038 - RNA, 19 nt, Human
uuaaaauacacacucaaau

SEQ ID NO: 2755039 - RNA, 18 nt, Human
uuaaaagaugaaaauauu

SEQ ID NO: 2755040 - RNA, 15 nt, Human
uuaaaagaugaaaau

SEQ ID NO: 2755041 - RNA, 22 nt, Human
uuaaaagaauauuuuaacuucc

SEQ ID NO: 2755042 - RNA, 21 nt, Human
uuaaaagaauauuuuaacuuc

SEQ ID NO: 2755043 - RNA, 19 nt, Human
uguuucaaacauauauaac

SEQ ID NO: 2755044 - RNA, 21 nt, Human
uguuucaaacauauauaacaa

SEQ ID NO: 2755045 - RNA, 22 nt, Human
uguuucaaacauauauaacaau

SEQ ID NO: 2755046 - RNA, 21 nt, Human
uuaauauuaaagccauguuua

SEQ ID NO: 2755047 - RNA, 22 nt, Human
uuaauauuaaagccauguuuau

SEQ ID NO: 2755048 - RNA, 20 nt, Human
uuaauauuaaagccauguuu

SEQ ID NO: 2755049 - RNA, 15 nt, Human
uuaagcauauauuuu

SEQ ID NO: 2755050 - RNA, 18 nt, Human
uuaagcauauauuuuuau

SEQ ID NO: 2755051 - RNA, 13 nt, Human
uuaagcauauauu

SEQ ID NO: 2755052 - RNA, 19 nt, Human
uuaagcauauauuuuuaua

SEQ ID NO: 2755053 - RNA, 18 nt, Human
uuaggauguugaaaaagu

SEQ ID NO: 2755054 - RNA, 20 nt, Human
uuagaugcaguucugaagaa

SEQ ID NO: 2755055 - RNA, 21 nt, Human
uuagaugcaguucugaagaag

SEQ ID NO: 2755056 - RNA, 13 nt, Human
uuagaucuaguuc

SEQ ID NO: 2755057 - RNA, 14 nt, Human
uuagaucuaguuca

SEQ ID NO: 2755058 - RNA, 18 nt, Human
uuagagaguguugaaacg

SEQ ID NO: 2755059 - RNA, 12 nt, Human
uuagagauuuuu

SEQ ID NO: 2755060 - RNA, 12 nt, Human
uuagcuggaaaa

SEQ ID NO: 2755061 - RNA, 13 nt, Human
uuagcuggaaaag

SEQ ID NO: 2755062 - RNA, 19 nt, Human
uuagaaacacaacuauauu

SEQ ID NO: 2755063 - RNA, 16 nt, Human
uuagagaguguugaaa

SEQ ID NO: 2755064 - RNA, 17 nt, Human
uuagagaguguugaaac

SEQ ID NO: 2755065 - RNA, 14 nt, Human
uuagagaguguuga

SEQ ID NO: 2755066 - RNA, 17 nt, Human
uuacuaguuucccuugc

SEQ ID NO: 2755067 - RNA, 17 nt, Human
uucccuugaugaagaag

SEQ ID NO: 2755068 - RNA, 20 nt, Human
uuccuuggacucauuuuaaa

SEQ ID NO: 2755069 - RNA, 17 nt, Human
uuccuuggacucauuuu

SEQ ID NO: 2755070 - RNA, 22 nt, Human
uucggccuccauccugaggcuc

SEQ ID NO: 2755071 - RNA, 19 nt, Human
uuccagauccuggaaauca

SEQ ID NO: 2755072 - RNA, 17 nt, Human
uucaaauccuugaagau

SEQ ID NO: 2755073 - RNA, 11 nt, Human
uucaaaguugc

SEQ ID NO: 2755074 - RNA, 15 nt, Human
uucaaaguugccuaa

SEQ ID NO: 2755075 - RNA, 16 nt, Human
uucaaaguugccuaaa

SEQ ID NO: 2755076 - RNA, 17 nt, Human
uucaaaguugccuaaau

SEQ ID NO: 2755077 - RNA, 23 nt, Human
uucaaaguugccuaaauccauuu

SEQ ID NO: 2755078 - RNA, 13 nt, Human
uuauuuuauuaug

SEQ ID NO: 2755079 - RNA, 15 nt, Human
uuauugucuagugaa

SEQ ID NO: 2755080 - RNA, 15 nt, Human
uuauuuuaauaaugu

SEQ ID NO: 2755081 - RNA, 16 nt, Human
uuauuuuaauaauguu

SEQ ID NO: 2755082 - RNA, 12 nt, Human
uuauuggcuuuu

SEQ ID NO: 2755083 - RNA, 16 nt, Human
uuauuggcuuuucuga

SEQ ID NO: 2755084 - RNA, 18 nt, Human
uuauuggcuuuucugauc

SEQ ID NO: 2755085 - RNA, 22 nt, Human
uuauuggcuuuucugauccagu

SEQ ID NO: 2755086 - RNA, 13 nt, Human
uucagagcugccc

SEQ ID NO: 2755087 - RNA, 14 nt, Human
uucagagcugcccu

SEQ ID NO: 2755088 - RNA, 21 nt, Human
uucacucuccauuuaauaauu

SEQ ID NO: 2755089 - RNA, 20 nt, Human
uucagacauagaauuaacac

SEQ ID NO: 2755090 - RNA, 16 nt, Human
uucagacauagaauua

SEQ ID NO: 2755091 - RNA, 17 nt, Human
uuauuacuguaagaaaa

SEQ ID NO: 2755092 - RNA, 18 nt, Human
uuauuacuguaagaaaau

SEQ ID NO: 2755093 - RNA, 16 nt, Human
uuauuacuguaagaaa

SEQ ID NO: 2755094 - RNA, 14 nt, Human
uuauuacaguauaa

SEQ ID NO: 2755095 - RNA, 17 nt, Human
uuauggcuauaggugcu

SEQ ID NO: 2755096 - RNA, 21 nt, Human
uuauggcacuaguauuucuau

SEQ ID NO: 2755097 - RNA, 17 nt, Human
uuaucugaagucagauc

SEQ ID NO: 2755098 - RNA, 13 nt, Human
uuuaauaaaccau

SEQ ID NO: 2755099 - RNA, 14 nt, Human
uuuaauaauguuuc

SEQ ID NO: 2755100 - RNA, 15 nt, Human
uuuaauaauguuuca

SEQ ID NO: 2755101 - RNA, 19 nt, Human
uuuaauaauguuucaaaca

SEQ ID NO: 2755102 - RNA, 14 nt, Human
uuuaauaauuauau

SEQ ID NO: 2755103 - RNA, 13 nt, Human
uuuacagagacag

SEQ ID NO: 2755104 - RNA, 15 nt, Human
uuuaauauuaaagcc

SEQ ID NO: 2755105 - RNA, 17 nt, Human
uuuaauauuaaagccau

SEQ ID NO: 2755106 - RNA, 20 nt, Human
uuuaauauuaaagccauguu

SEQ ID NO: 2755107 - RNA, 21 nt, Human
uuuaauauuaaagccauguuu

SEQ ID NO: 2755108 - RNA, 14 nt, Human
uuuaauauuaaagc

SEQ ID NO: 2755109 - RNA, 19 nt, Human
uuuaaaauacacacucaaa

SEQ ID NO: 2755110 - RNA, 16 nt, Human
uuuaaaaucauuucug

SEQ ID NO: 2755111 - RNA, 14 nt, Human
uuuaaaagaaugau

SEQ ID NO: 2755112 - RNA, 17 nt, Human
uuuaaaagaaugauuau

SEQ ID NO: 2755113 - RNA, 12 nt, Human
uuuaaaaugucu

SEQ ID NO: 2755114 - RNA, 17 nt, Human
uuguuuaaaaucauuuc

SEQ ID NO: 2755115 - RNA, 18 nt, Human
uuguuuaaaaucauuucu

SEQ ID NO: 2755116 - RNA, 13 nt, Human
uuguuuguuuagu

SEQ ID NO: 2755117 - RNA, 14 nt, Human
uuguuuguuuaguc

SEQ ID NO: 2755118 - RNA, 14 nt, Human
uuguuucuguacuu

SEQ ID NO: 2755119 - RNA, 12 nt, Human
uuguuucuguac

SEQ ID NO: 2755120 - RNA, 21 nt, Human
uuugaaauuguauuacaaauc

SEQ ID NO: 2755121 - RNA, 18 nt, Human
uuugguaaggggaauuga

SEQ ID NO: 2755122 - RNA, 12 nt, Human
uuucucuaggaa

SEQ ID NO: 2755123 - RNA, 15 nt, Human
uuucugauccaguuu

SEQ ID NO: 2755124 - RNA, 16 nt, Human
uuucugauccaguuuu

SEQ ID NO: 2755125 - RNA, 20 nt, Human
uuucugauccaguuuuguuu

SEQ ID NO: 2755126 - RNA, 22 nt, Human
uuucugauccaguuuuguuugg

SEQ ID NO: 2755127 - RNA, 13 nt, Human
uuucugauccagu

SEQ ID NO: 2755128 - RNA, 21 nt, Human
uugaaaaucuuauaauuuaaa

SEQ ID NO: 2755129 - RNA, 18 nt, Human
uucuuuccacagaagcuc

SEQ ID NO: 2755130 - RNA, 17 nt, Human
uucuuuaauuuuggaau

SEQ ID NO: 2755131 - RNA, 18 nt, Human
uucuuuaauuuuggaauu

SEQ ID NO: 2755132 - RNA, 12 nt, Human
uucuuuaauuuu

SEQ ID NO: 2755133 - RNA, 16 nt, Human
uugaaacggaugauuu

SEQ ID NO: 2755134 - RNA, 19 nt, Human
uugaaacggaugauuucua

SEQ ID NO: 2755135 - RNA, 19 nt, Human
uucuuaggguuaugauuaa

SEQ ID NO: 2755136 - RNA, 24 nt, Human
uucuaaguaaaaccacagcaguug

SEQ ID NO: 2755137 - RNA, 11 nt, Human
uucuguauaga

SEQ ID NO: 2755138 - RNA, 13 nt, Human
uucuguauagauu

SEQ ID NO: 2755139 - RNA, 14 nt, Human
uucuguauagauua

SEQ ID NO: 2755140 - RNA, 22 nt, Human
uugccaucccucccuccaccuc

SEQ ID NO: 2755141 - RNA, 23 nt, Human
uugccaucccucccuccaccucc

SEQ ID NO: 2755142 - RNA, 14 nt, Human
uugccaucccuccc

SEQ ID NO: 2755143 - RNA, 16 nt, Human
uugccaucccucccuc

SEQ ID NO: 2755144 - RNA, 17 nt, Human
uugccaucccucccucc

SEQ ID NO: 2755145 - RNA, 18 nt, Human
uugccaucccucccucca

SEQ ID NO: 2755146 - RNA, 13 nt, Human
uugccaucccucc

SEQ ID NO: 2755147 - RNA, 20 nt, Human
uugauaugccuuuucccaac

SEQ ID NO: 2755148 - RNA, 12 nt, Human
uuguaaaauggu

SEQ ID NO: 2755149 - RNA, 13 nt, Human
uuguaaaauggug

SEQ ID NO: 2755150 - RNA, 20 nt, Human
uugguaaggggaauugagga

SEQ ID NO: 2755151 - RNA, 19 nt, Human
uuggcauaacauaaaucug

SEQ ID NO: 2755152 - RNA, 20 nt, Human
uuggcauaacauaaaucugu

SEQ ID NO: 2755153 - RNA, 22 nt, Human
uuggcauaacauaaaucuguga

SEQ ID NO: 2755154 - RNA, 23 nt, Human
uuggcauaacauaaaucugugaa

SEQ ID NO: 2755155 - RNA, 18 nt, Human
uuggcauaacauaaaucu

SEQ ID NO: 2755156 - RNA, 20 nt, Human
uuguaaaauggugugaccac

SEQ ID NO: 2755157 - RNA, 16 nt, Human
uuguaccgcaauguga

SEQ ID NO: 2755158 - RNA, 18 nt, Human
uugcuaagcauuccaacu

SEQ ID NO: 2755159 - RNA, 16 nt, Human
uugcuaagcauuccaa

SEQ ID NO: 2755160 - RNA, 14 nt, Human
uugccuuuuucauu

SEQ ID NO: 2755161 - RNA, 15 nt, Human
uugccuuuuucauua

SEQ ID NO: 2755162 - RNA, 16 nt, Human
uugccuuuuucauuau

SEQ ID NO: 2755163 - RNA, 17 nt, Human
uugccuuuuucauuauu

SEQ ID NO: 2755164 - RNA, 12 nt, Human
uugccuuuuuca

SEQ ID NO: 2755165 - RNA, 13 nt, Human
uugccuuuuucau

SEQ ID NO: 2755166 - RNA, 22 nt, Human
cucuuagaugcaguucugaaga

SEQ ID NO: 2755167 - RNA, 21 nt, Human
cucuuagaugcaguucugaag

SEQ ID NO: 2755168 - RNA, 15 nt, Human
cugaaacaacaaaua

SEQ ID NO: 2755169 - RNA, 14 nt, Human
cucguuaauuugua

SEQ ID NO: 2755170 - RNA, 12 nt, Human
cuccucugcuug

SEQ ID NO: 2755171 - RNA, 14 nt, Human
cuccucugcuugcc

SEQ ID NO: 2755172 - RNA, 21 nt, Human
cuccucugcuugccaucccuc

SEQ ID NO: 2755173 - RNA, 15 nt, Human
cuccucugcuugcca

SEQ ID NO: 2755174 - RNA, 16 nt, Human
cuccucugcuugccau

SEQ ID NO: 2755175 - RNA, 17 nt, Human
cuccucugcuugccauc

SEQ ID NO: 2755176 - RNA, 20 nt, Human
cuccucugcuugccaucccu

SEQ ID NO: 2755177 - RNA, 22 nt, Human
cuccugggcagcugccuccccu

SEQ ID NO: 2755178 - RNA, 18 nt, Human
cuccugggcagcugccuc

SEQ ID NO: 2755179 - RNA, 19 nt, Human
cuccugggcagcugccucc

SEQ ID NO: 2755180 - RNA, 14 nt, Human
cuccugggcagcug

SEQ ID NO: 2755181 - RNA, 15 nt, Human
cuccugggcagcugc

SEQ ID NO: 2755182 - RNA, 16 nt, Human
cuccugggcagcugcc

SEQ ID NO: 2755183 - RNA, 17 nt, Human
cuccugggcagcugccu

SEQ ID NO: 2755184 - RNA, 12 nt, Human
cuccugggcagc

SEQ ID NO: 2755185 - RNA, 23 nt, Human
cuccacuuggucugugagaugcu

SEQ ID NO: 2755186 - RNA, 19 nt, Human
cuccccaugauguuuagaa

SEQ ID NO: 2755187 - RNA, 16 nt, Human
cuccacuuggucugug

SEQ ID NO: 2755188 - RNA, 17 nt, Human
cuccacuuggucuguga

SEQ ID NO: 2755189 - RNA, 21 nt, Human
cuccacuuggucugugagaug

SEQ ID NO: 2755190 - RNA, 22 nt, Human
cuccacuuggucugugagaugc

SEQ ID NO: 2755191 - RNA, 13 nt, Human
cuccacuuggucu

SEQ ID NO: 2755192 - RNA, 15 nt, Human
cuccacuuggucugu

SEQ ID NO: 2755193 - RNA, 19 nt, Human
cgcugauaagcguucaugg

SEQ ID NO: 2755194 - RNA, 18 nt, Human
cgcaggcccccaggugcc

SEQ ID NO: 2755195 - RNA, 16 nt, Human
ccuuuuuuaaauaaau

SEQ ID NO: 2755196 - RNA, 17 nt, Human
cucaaaacugcacuguc

SEQ ID NO: 2755197 - RNA, 23 nt, Human
cucaaaauaccaugccauuuaaa

SEQ ID NO: 2755198 - RNA, 15 nt, Human
cuacaaaaacacagc

SEQ ID NO: 2755199 - RNA, 18 nt, Human
cuacaaaaacacagcaag

SEQ ID NO: 2755200 - RNA, 17 nt, Human
cuacaaaaacacagcaa

SEQ ID NO: 2755201 - RNA, 16 nt, Human
cuacaaaaacacagca

SEQ ID NO: 2755202 - RNA, 18 nt, Human
cuacauacuauggaauuu

SEQ ID NO: 2755203 - RNA, 20 nt, Human
cuacaugagguacugagagu

SEQ ID NO: 2755204 - RNA, 18 nt, Human
cuacaugagguacugaga

SEQ ID NO: 2755205 - RNA, 20 nt, Human
cuaaguaaaaccacagcagu

SEQ ID NO: 2755206 - RNA, 23 nt, Human
cuaaguaaaaccacagcaguuga

SEQ ID NO: 2755207 - RNA, 22 nt, Human
cuaaguaaaaccacagcaguug

SEQ ID NO: 2755208 - RNA, 12 nt, Human
cuagaacucccu

SEQ ID NO: 2755209 - RNA, 13 nt, Human
cuagaacucccuu

SEQ ID NO: 2755210 - RNA, 19 nt, Human
ccugucuugccuuuuucau

SEQ ID NO: 2755211 - RNA, 20 nt, Human
ccugucuugccuuuuucauu

SEQ ID NO: 2755212 - RNA, 17 nt, Human
ccugucuugccuuuuuc

SEQ ID NO: 2755213 - RNA, 15 nt, Human
ccuguaaucacagcu

SEQ ID NO: 2755214 - RNA, 23 nt, Human
ccucauggaauuggagcucgugg

SEQ ID NO: 2755215 - RNA, 22 nt, Human
ccauuuaaagcuuauuaaaacu

SEQ ID NO: 2755216 - RNA, 13 nt, Human
ccauacauuugug

SEQ ID NO: 2755217 - RNA, 14 nt, Human
ccauacauuugugu

SEQ ID NO: 2755218 - RNA, 16 nt, Human
ccaguuuuguuuggac

SEQ ID NO: 2755219 - RNA, 19 nt, Human
ccaguuuuguuuggaccaa

SEQ ID NO: 2755220 - RNA, 20 nt, Human
ccaguauuguacaaaguauu

SEQ ID NO: 2755221 - RNA, 22 nt, Human
ccaguauuguacaaaguauuaa

SEQ ID NO: 2755222 - RNA, 15 nt, Human
ccagcagauuauuca

SEQ ID NO: 2755223 - RNA, 18 nt, Human
ccccugcacuccagccug

SEQ ID NO: 2755224 - RNA, 18 nt, Human
cccaggaauggagccugc

SEQ ID NO: 2755225 - RNA, 19 nt, Human
cccaggaauggagccugca

SEQ ID NO: 2755226 - RNA, 20 nt, Human
cccaggaauggagccugcac

SEQ ID NO: 2755227 - RNA, 22 nt, Human
cccaggaauggagccugcacgg

SEQ ID NO: 2755228 - RNA, 17 nt, Human
ccaaauguucaucaaug

SEQ ID NO: 2755229 - RNA, 19 nt, Human
cauuuguauaaaauaauuu

SEQ ID NO: 2755230 - RNA, 20 nt, Human
cauuuguauaaaauaauuuu

SEQ ID NO: 2755231 - RNA, 17 nt, Human
cauuuguauaaaauaau

SEQ ID NO: 2755232 - RNA, 12 nt, Human
ccacagcaguug

SEQ ID NO: 2755233 - RNA, 18 nt, Human
ccacagcaguugaaaaga

SEQ ID NO: 2755234 - RNA, 17 nt, Human
ccacagcaguugaaaag

SEQ ID NO: 2755235 - RNA, 23 nt, Human
ccacagcaguugaaaagacucca

SEQ ID NO: 2755236 - RNA, 14 nt, Human
caugauguuuagaa

SEQ ID NO: 2755237 - RNA, 20 nt, Human
cagcuccccucggagaagag

SEQ ID NO: 2755238 - RNA, 22 nt, Human
cagcuccccucggagaagagcu

SEQ ID NO: 2755239 - RNA, 21 nt, Human
cagcuccccucggagaagagc

SEQ ID NO: 2755240 - RNA, 12 nt, Human
cagauccuggaa

SEQ ID NO: 2755241 - RNA, 17 nt, Human
cagagguugcagugagc

SEQ ID NO: 2755242 - RNA, 16 nt, Human
cagagguugcagugag

SEQ ID NO: 2755243 - RNA, 13 nt, Human
cagcaguucagag

SEQ ID NO: 2755244 - RNA, 20 nt, Human
cagucugacuguuuccauca

SEQ ID NO: 2755245 - RNA, 19 nt, Human
cagucaccucauggaauug

SEQ ID NO: 2755246 - RNA, 15 nt, Human
cagucaccucaugga

SEQ ID NO: 2755247 - RNA, 15 nt, Human
cagucacauuccaag

SEQ ID NO: 2755248 - RNA, 16 nt, Human
cagucaccucauggaa

SEQ ID NO: 2755249 - RNA, 19 nt, Human
caggugccaguuauggcua

SEQ ID NO: 2755250 - RNA, 20 nt, Human
auuucuaugaaauauuaugu

SEQ ID NO: 2755251 - RNA, 15 nt, Human
auuucuaugaaauau

SEQ ID NO: 2755252 - RNA, 18 nt, Human
auuucuaugaaauauuau

SEQ ID NO: 2755253 - RNA, 19 nt, Human
auuguuuaaaaucauuucu

SEQ ID NO: 2755254 - RNA, 22 nt, Human
auuguacaaaguauuaagcaua

SEQ ID NO: 2755255 - RNA, 20 nt, Human
auuguacaaaguauuaagca

SEQ ID NO: 2755256 - RNA, 23 nt, Human
auuguacaaaguauuaagcauau

SEQ ID NO: 2755257 - RNA, 17 nt, Human
auuguaaaugugcuuuu

SEQ ID NO: 2755258 - RNA, 15 nt, Human
auuguaaaugugcuu

SEQ ID NO: 2755259 - RNA, 14 nt, Human
auuguaaaugugcu

SEQ ID NO: 2755260 - RNA, 18 nt, Human
auucacaagacccaaaag

SEQ ID NO: 2755261 - RNA, 18 nt, Human
auugacuuuuuauggcac

SEQ ID NO: 2755262 - RNA, 17 nt, Human
auucuugccaaauauaa

SEQ ID NO: 2755263 - RNA, 15 nt, Human
caaauccuugaagau

SEQ ID NO: 2755264 - RNA, 16 nt, Human
caaaguauuaagcaua

SEQ ID NO: 2755265 - RNA, 17 nt, Human
caaaguauuaagcauau

SEQ ID NO: 2755266 - RNA, 19 nt, Human
caaaguauuaagcauauau

SEQ ID NO: 2755267 - RNA, 21 nt, Human
caaaguauuaagcauauauuu

SEQ ID NO: 2755268 - RNA, 14 nt, Human
caaaguauuaagca

SEQ ID NO: 2755269 - RNA, 15 nt, Human
caaaguauuaagcau

SEQ ID NO: 2755270 - RNA, 19 nt, Human
caacccaaauguucaucaa

SEQ ID NO: 2755271 - RNA, 21 nt, Human
caacuaucucauuuccaagca

SEQ ID NO: 2755272 - RNA, 17 nt, Human
cacuuggucugugagau

SEQ ID NO: 2755273 - RNA, 20 nt, Human
cacuuggucugugagaugcu

SEQ ID NO: 2755274 - RNA, 21 nt, Human
caccuacaugagguacugaga

SEQ ID NO: 2755275 - RNA, 23 nt, Human
caccucaaaauaccaugccauuu

SEQ ID NO: 2755276 - RNA, 14 nt, Human
caaguauuagaaua

SEQ ID NO: 2755277 - RNA, 20 nt, Human
caaguauuagaauaccacag

SEQ ID NO: 2755278 - RNA, 16 nt, Human
caauaaaaaauuauga

SEQ ID NO: 2755279 - RNA, 17 nt, Human
caauaaaaaauuaugac

SEQ ID NO: 2755280 - RNA, 13 nt, Human
caauaaaaaauua

SEQ ID NO: 2755281 - RNA, 12 nt, Human
caauauuucaga

SEQ ID NO: 2755282 - RNA, 20 nt, Human
caauauuucagauaaucaca

SEQ ID NO: 2755283 - RNA, 14 nt, Human
caaugcuguauuuu

SEQ ID NO: 2755284 - RNA, 23 nt, Human
caaugcuguauuuuaaaagaaug

SEQ ID NO: 2755285 - RNA, 12 nt, Human
caauuuaaaaaa

SEQ ID NO: 2755286 - RNA, 16 nt, Human
cacaagacugcacauc

SEQ ID NO: 2755287 - RNA, 18 nt, Human
ggccuucggccuccaucc

SEQ ID NO: 2755288 - RNA, 16 nt, Human
ggccuucggccuccau

SEQ ID NO: 2755289 - RNA, 20 nt, Human
ggcuaagcuucacuguaaaa

SEQ ID NO: 2755290 - RNA, 13 nt, Human
aaaaauacaaaaa

SEQ ID NO: 2755291 - RNA, 19 nt, Human
gguuuuauuguuuaaaauc

SEQ ID NO: 2755292 - RNA, 19 nt, Human
gguguuguacucaauuuua

SEQ ID NO: 2755293 - RNA, 20 nt, Human
gguguuguacucaauuuuaa

SEQ ID NO: 2755294 - RNA, 20 nt, Human
aaagggauggcaagaugugg

SEQ ID NO: 2755295 - RNA, 20 nt, Human
aaagggcuguuauaaucuuu

SEQ ID NO: 2755296 - RNA, 22 nt, Human
aaagggcuguuauaaucuuuca

SEQ ID NO: 2755297 - RNA, 12 nt, Human
aaacuuuaugcu

SEQ ID NO: 2755298 - RNA, 19 nt, Human
aaacuuuaugcuaagugaa

SEQ ID NO: 2755299 - RNA, 16 nt, Human
aaagcagaacagugau

SEQ ID NO: 2755300 - RNA, 20 nt, Human
guacaaaguauuaagcauau

SEQ ID NO: 2755301 - RNA, 21 nt, Human
guacaaaguauuaagcauaua

SEQ ID NO: 2755302 - RNA, 22 nt, Human
aaauaucacuugucaauaaaau

SEQ ID NO: 2755303 - RNA, 18 nt, Human
aaauauaugcuaagucuu

SEQ ID NO: 2755304 - RNA, 21 nt, Human
aaauaccaugccauuuaaagc

SEQ ID NO: 2755305 - RNA, 17 nt, Human
aaauaugcaaagcacug

SEQ ID NO: 2755306 - RNA, 16 nt, Human
aaauaugcaaagcacu

SEQ ID NO: 2755307 - RNA, 15 nt, Human
aaauaugcaaagcac

SEQ ID NO: 2755308 - RNA, 13 nt, Human
aaauaugcaaagc

SEQ ID NO: 2755309 - RNA, 20 nt, Human
ggguuuuauuguuuaaaauc

SEQ ID NO: 2755310 - RNA, 14 nt, Human
ggucagugcaaaua

SEQ ID NO: 2755311 - RNA, 14 nt, Human
aaaauacacacuca

SEQ ID NO: 2755312 - RNA, 16 nt, Human
aaaauaauuuuuauau

SEQ ID NO: 2755313 - RNA, 17 nt, Human
aaaauaauuuuuauauu

SEQ ID NO: 2755314 - RNA, 11 nt, Human
aaaauaauuuu

SEQ ID NO: 2755315 - RNA, 17 nt, Human
aaaaucucaauauuuca

SEQ ID NO: 2755316 - RNA, 18 nt, Human
aaaauauuuuaugaucca

SEQ ID NO: 2755317 - RNA, 15 nt, Human
aaaauauuuuaugau

SEQ ID NO: 2755318 - RNA, 16 nt, Human
aaaaugguuuaaaugg

SEQ ID NO: 2755319 - RNA, 18 nt, Human
aaaaugguuuaaaugguc

SEQ ID NO: 2755320 - RNA, 16 nt, Human
aaaauggguuuuacug

SEQ ID NO: 2755321 - RNA, 11 nt, Human
gcuauuucuau

SEQ ID NO: 2755322 - RNA, 13 nt, Human
gcuauuucuauau

SEQ ID NO: 2755323 - RNA, 15 nt, Human
gcuauuucuauauuu

SEQ ID NO: 2755324 - RNA, 16 nt, Human
gcuauuucuauauuuu

SEQ ID NO: 2755325 - RNA, 18 nt, Human
gcuauuucuauauuuuca

SEQ ID NO: 2755326 - RNA, 19 nt, Human
gcuauuucuauauuuucau

SEQ ID NO: 2755327 - RNA, 20 nt, Human
gcuauuucuauauuuucauu

SEQ ID NO: 2755328 - RNA, 23 nt, Human
gccuucggccuccauccugaggc

SEQ ID NO: 2755329 - RNA, 11 nt, Human
gcuaaggacuu

SEQ ID NO: 2755330 - RNA, 12 nt, Human
gcuaaggacuug

SEQ ID NO: 2755331 - RNA, 12 nt, Human
gcguugaaauug

SEQ ID NO: 2755332 - RNA, 23 nt, Human
gcuaaggacuuguuagaucuagu

SEQ ID NO: 2755333 - RNA, 22 nt, Human
gcguucauggaacgcguugaaa

SEQ ID NO: 2755334 - RNA, 22 nt, Human
gccucauguccacugguucuuc

SEQ ID NO: 2755335 - RNA, 13 nt, Human
gccuccauccuga

SEQ ID NO: 2755336 - RNA, 14 nt, Human
gccuccauccugag

SEQ ID NO: 2755337 - RNA, 12 nt, Human
gccuccauccug

SEQ ID NO: 2755338 - RNA, 11 nt, Human
gccccaaaagg

SEQ ID NO: 2755339 - RNA, 12 nt, Human
gcauuuagaugu

SEQ ID NO: 2755340 - RNA, 19 nt, Human
gcauuuaggccaugggaca

SEQ ID NO: 2755341 - RNA, 13 nt, Human
gcauuuagaugua

SEQ ID NO: 2755342 - RNA, 14 nt, Human
gccauguuuauuac

SEQ ID NO: 2755343 - RNA, 18 nt, Human
gccauguuuauuacagua

SEQ ID NO: 2755344 - RNA, 22 nt, Human
gccauguuuauuacaguauaau

SEQ ID NO: 2755345 - RNA, 13 nt, Human
gccauguuuauua

SEQ ID NO: 2755346 - RNA, 11 nt, Human
gccauguuuau

SEQ ID NO: 2755347 - RNA, 16 nt, Human
ggaaaaaauaacaaug

SEQ ID NO: 2755348 - RNA, 13 nt, Human
ggaaacugccagc

SEQ ID NO: 2755349 - RNA, 19 nt, Human
ggaaaucaggguuaguauu

SEQ ID NO: 2755350 - RNA, 17 nt, Human
ggacagucaccucaugg

SEQ ID NO: 2755351 - RNA, 18 nt, Human
ggacagucaccucaugga

SEQ ID NO: 2755352 - RNA, 21 nt, Human
ggacagucaccucauggaauu

SEQ ID NO: 2755353 - RNA, 15 nt, Human
ggaagccugauuaaa

SEQ ID NO: 2755354 - RNA, 14 nt, Human
gcugccuccccucc

SEQ ID NO: 2755355 - RNA, 21 nt, Human
gcuguauuuuaaaagaaugau

SEQ ID NO: 2755356 - RNA, 20 nt, Human
gcuguauuuuaaaagaauga

SEQ ID NO: 2755357 - RNA, 18 nt, Human
gcuguauuuuaaaagaau

SEQ ID NO: 2755358 - RNA, 13 nt, Human
gcugcugaaacaa

SEQ ID NO: 2755359 - RNA, 12 nt, Human
gcagaacaguga

SEQ ID NO: 2755360 - RNA, 13 nt, Human
gcagaacagugau

SEQ ID NO: 2755361 - RNA, 18 nt, Human
gcagaacagugauuacca

SEQ ID NO: 2755362 - RNA, 22 nt, Human
gcagaacagugauuaccaggga

SEQ ID NO: 2755363 - RNA, 13 nt, Human
gcagugaugucac

SEQ ID NO: 2755364 - RNA, 22 nt, Human
gcaguuguugcccacagcugua

SEQ ID NO: 2755365 - RNA, 16 nt, Human
gauacuggauuguacu

SEQ ID NO: 2755366 - RNA, 20 nt, Human
gauacuggauuguacuuugu

SEQ ID NO: 2755367 - RNA, 13 nt, Human
gaugauuucuaug

SEQ ID NO: 2755368 - RNA, 23 nt, Human
gaugauuucuaugcugaguuugu

SEQ ID NO: 2755369 - RNA, 12 nt, Human
gaugauuucuau

SEQ ID NO: 2755370 - RNA, 19 nt, Human
gauccagcagauuauucac

SEQ ID NO: 2755371 - RNA, 18 nt, Human
gauccagcagauuauuca

SEQ ID NO: 2755372 - RNA, 16 nt, Human
gaucugccuaaggacu

SEQ ID NO: 2755373 - RNA, 12 nt, Human
gaucugccuaag

SEQ ID NO: 2755374 - RNA, 15 nt, Human
gaucugccuaaggac

SEQ ID NO: 2755375 - RNA, 17 nt, Human
gaggcuccacuuggucu

SEQ ID NO: 2755376 - RNA, 18 nt, Human
gaggcugagaugggagaa

SEQ ID NO: 2755377 - RNA, 15 nt, Human
gaggcuccacuuggu

SEQ ID NO: 2755378 - RNA, 12 nt, Human
gaggcuccacuu

SEQ ID NO: 2755379 - RNA, 21 nt, Human
gaggacgcucucuggccuucg

SEQ ID NO: 2755380 - RNA, 20 nt, Human
gaggacgcucucuggccuuc

SEQ ID NO: 2755381 - RNA, 12 nt, Human
gaggagaaacug

SEQ ID NO: 2755382 - RNA, 14 nt, Human
gaggagaaacugga

SEQ ID NO: 2755383 - RNA, 14 nt, Human
gagcagucaggaaa

SEQ ID NO: 2755384 - RNA, 22 nt, Human
gagcuguucacagccagacugg

SEQ ID NO: 2755385 - RNA, 20 nt, Human
gagcuguucacagccagacu

SEQ ID NO: 2755386 - RNA, 17 nt, Human
gagcuguucacagccag

SEQ ID NO: 2755387 - RNA, 21 nt, Human
gagauugugccccugcacucc

SEQ ID NO: 2755388 - RNA, 16 nt, Human
gagaugcuagaacucc

SEQ ID NO: 2755389 - RNA, 20 nt, Human
gagaugcuagaacucccuuu

SEQ ID NO: 2755390 - RNA, 22 nt, Human
gacuuuuuauggcacuaguauu

SEQ ID NO: 2755391 - RNA, 14 nt, Human
gaaugaauggcuaa

SEQ ID NO: 2755392 - RNA, 15 nt, Human
gaaugaauggcuaag

SEQ ID NO: 2755393 - RNA, 20 nt, Human
gaaugaauggcuaagcaaaa

SEQ ID NO: 2755394 - RNA, 14 nt, Human
gaaugauuaugaau

SEQ ID NO: 2755395 - RNA, 22 nt, Human
gaaugauuaugaauuacauuug

SEQ ID NO: 2755396 - RNA, 14 nt, Human
gaauuaacacauga

SEQ ID NO: 2755397 - RNA, 15 nt, Human
gaauuaacacaugau

SEQ ID NO: 2755398 - RNA, 13 nt, Human
gaauuacauuugu

SEQ ID NO: 2755399 - RNA, 15 nt, Human
gaauuacauuuguau

SEQ ID NO: 2755400 - RNA, 18 nt, Human
gaauuacauuuguauaaa

SEQ ID NO: 2755401 - RNA, 20 nt, Human
gaauuacauuuguauaaaau

SEQ ID NO: 2755402 - RNA, 12 nt, Human
gacagcucugca

SEQ ID NO: 2755403 - RNA, 18 nt, Human
gacagucaccucauggaa

SEQ ID NO: 2755404 - RNA, 14 nt, Human
gacgcucucuggcc

SEQ ID NO: 2755405 - RNA, 15 nt, Human
cuggugcccugcuuu

SEQ ID NO: 2755406 - RNA, 16 nt, Human
cuggugcccugcuuuc

SEQ ID NO: 2755407 - RNA, 19 nt, Human
cuggugcccugcuuucaga

SEQ ID NO: 2755408 - RNA, 21 nt, Human
cuggugcccugcuuucagaua

SEQ ID NO: 2755409 - RNA, 23 nt, Human
cuggugcccugcuuucagauacu

SEQ ID NO: 2755410 - RNA, 13 nt, Human
cuggugacugauu

SEQ ID NO: 2755411 - RNA, 14 nt, Human
cuggugacugauuc

SEQ ID NO: 2755412 - RNA, 15 nt, Human
cuggugacugauucu

SEQ ID NO: 2755413 - RNA, 17 nt, Human
cuggugacugauucuuc

SEQ ID NO: 2755414 - RNA, 20 nt, Human
cuguaagaaaauaucacuug

SEQ ID NO: 2755415 - RNA, 21 nt, Human
cugugagaugcuagaacuccc

SEQ ID NO: 2755416 - RNA, 23 nt, Human
cugugagaugcuagaacucccuu

SEQ ID NO: 2755417 - RNA, 16 nt, Human
cugugaacuugaaauu

SEQ ID NO: 2755418 - RNA, 17 nt, Human
cugugaacuugaaauuu

SEQ ID NO: 2755419 - RNA, 15 nt, Human
cugugaacuugaaau

SEQ ID NO: 2755420 - RNA, 19 nt, Human
cuguucacagccagacugg

SEQ ID NO: 2755421 - RNA, 12 nt, Human
cuguucacagcc

SEQ ID NO: 2755422 - RNA, 22 nt, Human
cuguucacagccagacuggcac

SEQ ID NO: 2755423 - RNA, 13 nt, Human
cuuaaaaaugguu

SEQ ID NO: 2755424 - RNA, 20 nt, Human
cuuaaaaaugguuuaaaugg

SEQ ID NO: 2755425 - RNA, 12 nt, Human
cuuaaaaauggu

SEQ ID NO: 2755426 - RNA, 23 nt, Human
cuggaaaaguauguuagugcaaa

SEQ ID NO: 2755427 - RNA, 17 nt, Human
cugccuccccuccucug

SEQ ID NO: 2755428 - RNA, 18 nt, Human
cugccuccccuccucugc

SEQ ID NO: 2755429 - RNA, 14 nt, Human
cugccuccccuccu

SEQ ID NO: 2755430 - RNA, 19 nt, Human
cugccuccccuccucugcu

SEQ ID NO: 2755431 - RNA, 20 nt, Human
cugccuccccuccucugcuu

SEQ ID NO: 2755432 - RNA, 23 nt, Human
cuuggucucagugucaaugcagc

SEQ ID NO: 2755433 - RNA, 21 nt, Human
cuugucucagauuuuauuaug

SEQ ID NO: 2755434 - RNA, 23 nt, Human
gaaacuucagcgguuuauauaag

SEQ ID NO: 2755435 - RNA, 14 nt, Human
gaaacuuguguaaa

SEQ ID NO: 2755436 - RNA, 16 nt, Human
gaaacuuguguaaaua

SEQ ID NO: 2755437 - RNA, 20 nt, Human
gaaacuuguguaaauacaau

SEQ ID NO: 2755438 - RNA, 16 nt, Human
gaaaucaaauaugcaa

SEQ ID NO: 2755439 - RNA, 21 nt, Human
gaaaucaaauaugcaaagcac

SEQ ID NO: 2755440 - RNA, 17 nt, Human
gaaaugaaagcagggac

SEQ ID NO: 2755441 - RNA, 23 nt, Human
gaaaucaaauaugcaaagcacug

SEQ ID NO: 2755442 - RNA, 18 nt, Human
gaaaugaaagcagggacu

SEQ ID NO: 2755443 - RNA, 17 nt, Human
gaacaaauuuacagaga

SEQ ID NO: 2755444 - RNA, 18 nt, Human
gaacaaauuuacagagac

SEQ ID NO: 2755445 - RNA, 23 nt, Human
gaacaaauuuacagagacagaaa

SEQ ID NO: 2755446 - RNA, 18 nt, Human
gaaaagacuccaaagaaa

SEQ ID NO: 2755447 - RNA, 20 nt, Human
gaaaagacuccaaagaaaug

SEQ ID NO: 2755448 - RNA, 21 nt, Human
gaaaagacuccaaagaaaugu

SEQ ID NO: 2755449 - RNA, 17 nt, Human
aagggcuguuauaaucu

SEQ ID NO: 2755450 - RNA, 17 nt, Human
aaggggaauugaggaca

SEQ ID NO: 2755451 - RNA, 15 nt, Human
aagggcuguuauaau

SEQ ID NO: 2755452 - RNA, 14 nt, Human
guuuaugauuccac

SEQ ID NO: 2755453 - RNA, 13 nt, Human
guuuaauauuaaa

SEQ ID NO: 2755454 - RNA, 14 nt, Human
guuuaauauuaaag

SEQ ID NO: 2755455 - RNA, 15 nt, Human
guuuaauauuaaagc

SEQ ID NO: 2755456 - RNA, 18 nt, Human
guuuaauauuaaagccau

SEQ ID NO: 2755457 - RNA, 13 nt, Human
guuuauuacagua

SEQ ID NO: 2755458 - RNA, 17 nt, Human
guuuauuacaguauaau

SEQ ID NO: 2755459 - RNA, 12 nt, Human
guuguuuguuua

SEQ ID NO: 2755460 - RNA, 12 nt, Human
aaggaaaaguuu

SEQ ID NO: 2755461 - RNA, 18 nt, Human
aaguauguuagugcaaau

SEQ ID NO: 2755462 - RNA, 19 nt, Human
aaguauguuagugcaaauu

SEQ ID NO: 2755463 - RNA, 19 nt, Human
aaguaaugauaacuggaaa

SEQ ID NO: 2755464 - RNA, 21 nt, Human
aagucagaucugccuaaggac

SEQ ID NO: 2755465 - RNA, 22 nt, Human
aagucagaucugccuaaggacu

SEQ ID NO: 2755466 - RNA, 18 nt, Human
aagucagaucugccuaag

SEQ ID NO: 2755467 - RNA, 18 nt, Human
guuuggaccaaaaaccag

SEQ ID NO: 2755468 - RNA, 9 nt, Human
uaaaauggu

SEQ ID NO: 2755469 - RNA, 22 nt, Human
uaaaauaauuuuuauauuugaa

SEQ ID NO: 2755470 - RNA, 21 nt, Human
uaaaauacacacucaaaucaa

SEQ ID NO: 2755471 - RNA, 20 nt, Human
uaaaauaauuuuuauauuug

SEQ ID NO: 2755472 - RNA, 13 nt, Human
uaaaagaauauuu

SEQ ID NO: 2755473 - RNA, 21 nt, Human
uaaaaaaaaaccugagcccca

SEQ ID NO: 2755474 - RNA, 14 nt, Human
uaaaaaaaaaauug

SEQ ID NO: 2755475 - RNA, 18 nt, Human
uaaaaaaaaaauugggga

SEQ ID NO: 2755476 - RNA, 23 nt, Human
aagucagaucugccuaaggacuu

SEQ ID NO: 2755477 - RNA, 15 nt, Human
uaaaaccacagcagu

SEQ ID NO: 2755478 - RNA, 13 nt, Human
uaaaaccacagca

SEQ ID NO: 2755479 - RNA, 14 nt, Human
uaaaaccacagcag

SEQ ID NO: 2755480 - RNA, 16 nt, Human
aagcacuaaacaaaga

SEQ ID NO: 2755481 - RNA, 17 nt, Human
aagcacugacuucuaag

SEQ ID NO: 2755482 - RNA, 16 nt, Human
aagcacugacuucuaa

SEQ ID NO: 2755483 - RNA, 19 nt, Human
aagcauuguaaaugugcuu

SEQ ID NO: 2755484 - RNA, 16 nt, Human
aagccauguuuauuac

SEQ ID NO: 2755485 - RNA, 17 nt, Human
aagccauguuuauuaca

SEQ ID NO: 2755486 - RNA, 15 nt, Human
aagccauguuuauua

SEQ ID NO: 2755487 - RNA, 20 nt, Human
aagcacugacuucuaaguaa

SEQ ID NO: 2755488 - RNA, 19 nt, Human
aagcacugacuucuaagua

SEQ ID NO: 2755489 - RNA, 23 nt, Human
aagcauauauuuuuauauuuacu

SEQ ID NO: 2755490 - RNA, 18 nt, Human
aagcauuguaaaugugcu

SEQ ID NO: 2755491 - RNA, 17 nt, Human
aagcaacccaaauguuc

SEQ ID NO: 2755492 - RNA, 22 nt, Human
gugucuuaauuaaaagaauauu

SEQ ID NO: 2755493 - RNA, 14 nt, Human
aagauagcagggca

SEQ ID NO: 2755494 - RNA, 15 nt, Human
aagauagcagggcau

SEQ ID NO: 2755495 - RNA, 18 nt, Human
guguaaauacaauuuugu

SEQ ID NO: 2755496 - RNA, 21 nt, Human
guguaaauacaauuuuguuuc

SEQ ID NO: 2755497 - RNA, 22 nt, Human
guguaaauacaauuuuguuucu

SEQ ID NO: 2755498 - RNA, 19 nt, Human
guuauuauauuuacaaaug

SEQ ID NO: 2755499 - RNA, 18 nt, Human
guuagagauuuuuuuguu

SEQ ID NO: 2755500 - RNA, 17 nt, Human
guuauuauauuuacaaa

SEQ ID NO: 2755501 - RNA, 20 nt, Human
aagccauguuuauuacagua

SEQ ID NO: 2755502 - RNA, 21 nt, Human
aagccauguuuauuacaguau

SEQ ID NO: 2755503 - RNA, 22 nt, Human
aagccauguuuauuacaguaua

SEQ ID NO: 2755504 - RNA, 23 nt, Human
aagccauguuuauuacaguauaa

SEQ ID NO: 2755505 - RNA, 21 nt, Human
aagccuuggggcugaugcagu

SEQ ID NO: 2755506 - RNA, 18 nt, Human
guucccuugaugaagaag

SEQ ID NO: 2755507 - RNA, 18 nt, Human
aagcuuauuaaaacucau

SEQ ID NO: 2755508 - RNA, 15 nt, Human
aaaugugcuuuuaaa

SEQ ID NO: 2755509 - RNA, 18 nt, Human
aaaugugccuucauuuuu

SEQ ID NO: 2755510 - RNA, 17 nt, Human
aaauuguauuacaaauc

SEQ ID NO: 2755511 - RNA, 17 nt, Human
aaauuccaagugauuga

SEQ ID NO: 2755512 - RNA, 19 nt, Human
guauuguacaaaguauuaa

SEQ ID NO: 2755513 - RNA, 21 nt, Human
guauuguacaaaguauuaagc

SEQ ID NO: 2755514 - RNA, 22 nt, Human
guauuguacaaaguauuaagca

SEQ ID NO: 2755515 - RNA, 23 nt, Human
guauuguacaaaguauuaagcau

SEQ ID NO: 2755516 - RNA, 14 nt, Human
gucaggaaagagaa

SEQ ID NO: 2755517 - RNA, 13 nt, Human
gucaggaaagaga

SEQ ID NO: 2755518 - RNA, 20 nt, Human
gucacaggaaguagaggagg

SEQ ID NO: 2755519 - RNA, 21 nt, Human
gucaauuuuguuauguauauu

SEQ ID NO: 2755520 - RNA, 13 nt, Human
gucacaggaagua

SEQ ID NO: 2755521 - RNA, 15 nt, Human
gucacaggaaguaga

SEQ ID NO: 2755522 - RNA, 13 nt, Human
aacagucucagga

SEQ ID NO: 2755523 - RNA, 16 nt, Human
guccgugcuaaggacu

SEQ ID NO: 2755524 - RNA, 17 nt, Human
guccgugcuaaggacuu

SEQ ID NO: 2755525 - RNA, 15 nt, Human
guccgugcuaaggac

SEQ ID NO: 2755526 - RNA, 14 nt, Human
aacauaaaauacaa

SEQ ID NO: 2755527 - RNA, 14 nt, Human
aacagucucaggaa

SEQ ID NO: 2755528 - RNA, 12 nt, Human
aacauauauaac

SEQ ID NO: 2755529 - RNA, 14 nt, Human
aacauguuaaacca

SEQ ID NO: 2755530 - RNA, 15 nt, Human
aacauguuaaaccau

SEQ ID NO: 2755531 - RNA, 16 nt, Human
aacauguuaaaccaug

SEQ ID NO: 2755532 - RNA, 18 nt, Human
aacacagcaagggugaug

SEQ ID NO: 2755533 - RNA, 20 nt, Human
aacacagcaagggugauggg

SEQ ID NO: 2755534 - RNA, 17 nt, Human
aacacaacuauauuguu

SEQ ID NO: 2755535 - RNA, 12 nt, Human
aaauuugaauuu

SEQ ID NO: 2755536 - RNA, 15 nt, Human
aaauuugaauuuugu

SEQ ID NO: 2755537 - RNA, 22 nt, Human
aaauuugaauuuuguguuagag

SEQ ID NO: 2755538 - RNA, 22 nt, Human
guccaugaagauguagaggaga

SEQ ID NO: 2755539 - RNA, 13 nt, Human
aacuucagacaua

SEQ ID NO: 2755540 - RNA, 18 nt, Human
aacuucagcgguuuauau

SEQ ID NO: 2755541 - RNA, 22 nt, Human
aacuuccuuggacucauuuuaa

SEQ ID NO: 2755542 - RNA, 23 nt, Human
aacuuccuuggacucauuuuaaa

SEQ ID NO: 2755543 - RNA, 12 nt, Human
aacuugaaauuu

SEQ ID NO: 2755544 - RNA, 13 nt, Human
aacuugaaauuug

SEQ ID NO: 2755545 - RNA, 18 nt, Human
aacuugaaauuugaauuu

SEQ ID NO: 2755546 - RNA, 19 nt, Human
aacuugaaauuugaauuuu

SEQ ID NO: 2755547 - RNA, 17 nt, Human
gugauuaccagggacug

SEQ ID NO: 2755548 - RNA, 11 nt, Human
gugauuaccag

SEQ ID NO: 2755549 - RNA, 16 nt, Human
gugauuaccagggacu

SEQ ID NO: 2755550 - RNA, 22 nt, Human
gugcuacaaaaacacagcaagg

SEQ ID NO: 2755551 - RNA, 21 nt, Human
gugcuacaaaaacacagcaag

SEQ ID NO: 2755552 - RNA, 14 nt, Human
aagaaagaaaauca

SEQ ID NO: 2755553 - RNA, 13 nt, Human
aagaaagaaaauc

SEQ ID NO: 2755554 - RNA, 16 nt, Human
aagaaagaaaaucagg

SEQ ID NO: 2755555 - RNA, 11 nt, Human
aagaaacauuu

SEQ ID NO: 2755556 - RNA, 19 nt, Human
gucuuauauauuguagaua

SEQ ID NO: 2755557 - RNA, 14 nt, Human
gucuuaauuaaaag

SEQ ID NO: 2755558 - RNA, 23 nt, Human
gucuugucucagauuuuauuaug

SEQ ID NO: 2755559 - RNA, 21 nt, Human
aacucauuuuuguuuucauua

SEQ ID NO: 2755560 - RNA, 24 nt, Human
aacucauuuuuguuuucauuaucu

SEQ ID NO: 2755561 - RNA, 15 nt, Human
gugacuuuggauaau

SEQ ID NO: 2755562 - RNA, 12 nt, Human
gugacuuuggau

SEQ ID NO: 2755563 - RNA, 15 nt, Human
uagggagagaagaua

SEQ ID NO: 2755564 - RNA, 14 nt, Human
uagggagagaagau

SEQ ID NO: 2755565 - RNA, 18 nt, Human
uaggaaauauuuauuuua

SEQ ID NO: 2755566 - RNA, 19 nt, Human
uaggaaauauuuauuuuaa

SEQ ID NO: 2755567 - RNA, 23 nt, Human
acaauacaucccuuaccugggaa

SEQ ID NO: 2755568 - RNA, 13 nt, Human
acaagacugcaca

SEQ ID NO: 2755569 - RNA, 14 nt, Human
acaagacugcacau

SEQ ID NO: 2755570 - RNA, 21 nt, Human
uagcuagacuggugacugauu

SEQ ID NO: 2755571 - RNA, 22 nt, Human
uagcuagacuggugacugauuc

SEQ ID NO: 2755572 - RNA, 18 nt, Human
acaaaaggauaaugaaua

SEQ ID NO: 2755573 - RNA, 19 nt, Human
uagaggagaaacuggaacu

SEQ ID NO: 2755574 - RNA, 23 nt, Human
uagagauuuuuuuguuguuuguu

SEQ ID NO: 2755575 - RNA, 22 nt, Human
uagaggagaaacuggaacucuc

SEQ ID NO: 2755576 - RNA, 15 nt, Human
uagaugcaguucuga

SEQ ID NO: 2755577 - RNA, 20 nt, Human
acaagacccaaaaggcagaa

SEQ ID NO: 2755578 - RNA, 18 nt, Human
acaaauuuacagagacag

SEQ ID NO: 2755579 - RNA, 19 nt, Human
acaaauuuacagagacaga

SEQ ID NO: 2755580 - RNA, 22 nt, Human
uagugaaacucguuaauuugua

SEQ ID NO: 2755581 - RNA, 23 nt, Human
uaguguuggagaagaacugaaau

SEQ ID NO: 2755582 - RNA, 15 nt, Human
acacacucaaaucaa

SEQ ID NO: 2755583 - RNA, 18 nt, Human
acaaugcuguauuuuaaa

SEQ ID NO: 2755584 - RNA, 22 nt, Human
acaaugcuguauuuuaaaagaa

SEQ ID NO: 2755585 - RNA, 19 nt, Human
acacucaaaucaagaaacu

SEQ ID NO: 2755586 - RNA, 13 nt, Human
acacuaagagaga

SEQ ID NO: 2755587 - RNA, 18 nt, Human
acacucaaaucaagaaac

SEQ ID NO: 2755588 - RNA, 18 nt, Human
acacaugauccugcaauu

SEQ ID NO: 2755589 - RNA, 15 nt, Human
acacaugaaguccaa

SEQ ID NO: 2755590 - RNA, 15 nt, Human
acacaucagcuugcc

SEQ ID NO: 2755591 - RNA, 21 nt, Human
acaccauuaugugcgcugaua

SEQ ID NO: 2755592 - RNA, 17 nt, Human
acaccauuaugugcgcu

SEQ ID NO: 2755593 - RNA, 15 nt, Human
uauauuguuugcuaa

SEQ ID NO: 2755594 - RNA, 19 nt, Human
uauauuuacuaaaauggac

SEQ ID NO: 2755595 - RNA, 20 nt, Human
uauauuuacuaaaauggacu

SEQ ID NO: 2755596 - RNA, 21 nt, Human
uauauuuacuaaaauggacug

SEQ ID NO: 2755597 - RNA, 19 nt, Human
uauaauuuugugaagcaaa

SEQ ID NO: 2755598 - RNA, 16 nt, Human
acagccucuuagaugc

SEQ ID NO: 2755599 - RNA, 15 nt, Human
uaugcugaguuugug

SEQ ID NO: 2755600 - RNA, 19 nt, Human
uaugccccauucaacaucu

SEQ ID NO: 2755601 - RNA, 15 nt, Human
uaugccccauucaac

SEQ ID NO: 2755602 - RNA, 21 nt, Human
uaugauuaaguaaugauaacu

SEQ ID NO: 2755603 - RNA, 16 nt, Human
uaugauuaaguaauga

SEQ ID NO: 2755604 - RNA, 20 nt, Human
uaugauuaaguaaugauaac

SEQ ID NO: 2755605 - RNA, 21 nt, Human
uaugaaauauuauguuaaaac

SEQ ID NO: 2755606 - RNA, 20 nt, Human
acagggaggacgcucucugg

SEQ ID NO: 2755607 - RNA, 21 nt, Human
acagggaggacgcucucuggc

SEQ ID NO: 2755608 - RNA, 17 nt, Human
acagucaccucauggaa

SEQ ID NO: 2755609 - RNA, 18 nt, Human
acagucaccucauggaau

SEQ ID NO: 2755610 - RNA, 16 nt, Human
acagucaccucaugga

SEQ ID NO: 2755611 - RNA, 15 nt, Human
acaguauaauuaaca

SEQ ID NO: 2755612 - RNA, 20 nt, Human
acaguauaauuaacauguua

SEQ ID NO: 2755613 - RNA, 13 nt, Human
acaguauaauuaa

SEQ ID NO: 2755614 - RNA, 14 nt, Human
uauuacuguaagaa

SEQ ID NO: 2755615 - RNA, 15 nt, Human
uauucaaacagucuc

SEQ ID NO: 2755616 - RNA, 23 nt, Human
uauucaaacagucucaggaaauc

SEQ ID NO: 2755617 - RNA, 12 nt, Human
uauucaaaguug

SEQ ID NO: 2755618 - RNA, 13 nt, Human
uauucaaaguugc

SEQ ID NO: 2755619 - RNA, 16 nt, Human
uauucaaaguugccua

SEQ ID NO: 2755620 - RNA, 17 nt, Human
acaggaaguagaggagg

SEQ ID NO: 2755621 - RNA, 22 nt, Human
acaggaaccacaagacugcaca

SEQ ID NO: 2755622 - RNA, 21 nt, Human
uauguuuucaggcuagaugua

SEQ ID NO: 2755623 - RNA, 12 nt, Human
uaugugugaagu

SEQ ID NO: 2755624 - RNA, 14 nt, Human
uaugugugaaguga

SEQ ID NO: 2755625 - RNA, 16 nt, Human
uauuaaaacucauuuu

SEQ ID NO: 2755626 - RNA, 21 nt, Human
aauugacccacaagaaaugaa

SEQ ID NO: 2755627 - RNA, 22 nt, Human
aauugacccacaagaaaugaaa

SEQ ID NO: 2755628 - RNA, 13 nt, Human
uacuguaagaaaa

SEQ ID NO: 2755629 - RNA, 14 nt, Human
uacuguaagaaaau

SEQ ID NO: 2755630 - RNA, 14 nt, Human
uacuggauuguacu

SEQ ID NO: 2755631 - RNA, 22 nt, Human
aauuccacuuauaggaauugac

SEQ ID NO: 2755632 - RNA, 18 nt, Human
aauuccaagugauugaaa

SEQ ID NO: 2755633 - RNA, 16 nt, Human
aaugcuguauuuuaaa

SEQ ID NO: 2755634 - RNA, 16 nt, Human
aaugccaucaauaaaa

SEQ ID NO: 2755635 - RNA, 21 nt, Human
aaugccaucaauaaaaaauua

SEQ ID NO: 2755636 - RNA, 23 nt, Human
aaugccaucaauaaaaaauuaug

SEQ ID NO: 2755637 - RNA, 14 nt, Human
uacacuaagagaga

SEQ ID NO: 2755638 - RNA, 16 nt, Human
aauggacuguggugac

SEQ ID NO: 2755639 - RNA, 20 nt, Human
uacaucccuuaccugggaaa

SEQ ID NO: 2755640 - RNA, 18 nt, Human
uaccaccagucugacugu

SEQ ID NO: 2755641 - RNA, 19 nt, Human
aauuaacauguuaaaccau

SEQ ID NO: 2755642 - RNA, 20 nt, Human
aauuaacauguuaaaccaug

SEQ ID NO: 2755643 - RNA, 19 nt, Human
aaucuuauaauuuaaaaua

SEQ ID NO: 2755644 - RNA, 19 nt, Human
aaucuacacuccagugaga

SEQ ID NO: 2755645 - RNA, 20 nt, Human
aaucugugaacuugaaauuu

SEQ ID NO: 2755646 - RNA, 21 nt, Human
aaucugugaacuugaaauuug

SEQ ID NO: 2755647 - RNA, 22 nt, Human
aaucugugaacuugaaauuuga

SEQ ID NO: 2755648 - RNA, 19 nt, Human
uaaguaaugauaacuggaa

SEQ ID NO: 2755649 - RNA, 16 nt, Human
uaaggaaaaguuuaau

SEQ ID NO: 2755650 - RNA, 16 nt, Human
uaagcuuguauuccuu

SEQ ID NO: 2755651 - RNA, 12 nt, Human
aaucaugaauua

SEQ ID NO: 2755652 - RNA, 15 nt, Human
aaucaugaauuaguu

SEQ ID NO: 2755653 - RNA, 13 nt, Human
uaaucuuucacag

SEQ ID NO: 2755654 - RNA, 22 nt, Human
aaugaauggcuaagcaaaaugu

SEQ ID NO: 2755655 - RNA, 18 nt, Human
aauauuuauuuuaauaau

SEQ ID NO: 2755656 - RNA, 19 nt, Human
aauauuuauuuuaauaaug

SEQ ID NO: 2755657 - RNA, 15 nt, Human
aauauuuauuuuaau

SEQ ID NO: 2755658 - RNA, 21 nt, Human
aauaugccccauucaacaucu

SEQ ID NO: 2755659 - RNA, 24 nt, Human
aauaugccccauucaacaucuagu

SEQ ID NO: 2755660 - RNA, 22 nt, Human
aaucaggguuaguauuguccag

SEQ ID NO: 2755661 - RNA, 16 nt, Human
aaucaggguuaguauu

SEQ ID NO: 2755662 - RNA, 21 nt, Human
aaucaggguuaguauugucca

SEQ ID NO: 2755663 - RNA, 20 nt, Human
aauaucacuugucaauaaaa

SEQ ID NO: 2755664 - RNA, 22 nt, Human
aauaucacuugucaauaaaauc

SEQ ID NO: 2755665 - RNA, 12 nt, Human
uaacauaaaucu

SEQ ID NO: 2755666 - RNA, 16 nt, Human
aauagucaaauugugu

SEQ ID NO: 2755667 - RNA, 18 nt, Human
uaagaagugaaaaucuac

SEQ ID NO: 2755668 - RNA, 20 nt, Human
uaacgauaaaagacagugaa

SEQ ID NO: 2755669 - RNA, 14 nt, Human
accagucugacugu

SEQ ID NO: 2755670 - RNA, 23 nt, Human
accaguauuguacaaaguauuaa

SEQ ID NO: 2755671 - RNA, 23 nt, Human
ucacuugaacccgggaggcagag

SEQ ID NO: 2755672 - RNA, 14 nt, Human
accaguauuguaca

SEQ ID NO: 2755673 - RNA, 15 nt, Human
accaguauuguacaa

SEQ ID NO: 2755674 - RNA, 20 nt, Human
accaguauuguacaaaguau

SEQ ID NO: 2755675 - RNA, 22 nt, Human
accaguauuguacaaaguauua

SEQ ID NO: 2755676 - RNA, 12 nt, Human
ucaccucaugga

SEQ ID NO: 2755677 - RNA, 13 nt, Human
ucaccucauggaa

SEQ ID NO: 2755678 - RNA, 14 nt, Human
ucaccucauggaau

SEQ ID NO: 2755679 - RNA, 19 nt, Human
ucaccugucuugccuuuuu

SEQ ID NO: 2755680 - RNA, 20 nt, Human
ucaccugucuugccuuuuuc

SEQ ID NO: 2755681 - RNA, 21 nt, Human
ucacaacagauuauuaccuua

SEQ ID NO: 2755682 - RNA, 16 nt, Human
ucaauucuugccaaau

SEQ ID NO: 2755683 - RNA, 22 nt, Human
ucaauaucuuuuuuuuaauaaa

SEQ ID NO: 2755684 - RNA, 23 nt, Human
ucaaugaaugaaugaauggcuaa

SEQ ID NO: 2755685 - RNA, 15 nt, Human
ucaauauuucagaua

SEQ ID NO: 2755686 - RNA, 19 nt, Human
ucaauauuucagauaauca

SEQ ID NO: 2755687 - RNA, 23 nt, Human
accaaaaaucucaauauuucaga

SEQ ID NO: 2755688 - RNA, 18 nt, Human
ucaaauugugugaaaggu

SEQ ID NO: 2755689 - RNA, 15 nt, Human
ucaaauugugugaaa

SEQ ID NO: 2755690 - RNA, 23 nt, Human
acaugagguacugagagugaaca

SEQ ID NO: 2755691 - RNA, 16 nt, Human
acaugagguacugaga

SEQ ID NO: 2755692 - RNA, 20 nt, Human
acaugagguacugagaguga

SEQ ID NO: 2755693 - RNA, 16 nt, Human
acaugaaguccaagca

SEQ ID NO: 2755694 - RNA, 21 nt, Human
acaugggacauuugcucaugg

SEQ ID NO: 2755695 - RNA, 15 nt, Human
acaugggacauuugc

SEQ ID NO: 2755696 - RNA, 20 nt, Human
acaugggacauuugcucaug

SEQ ID NO: 2755697 - RNA, 11 nt, Human
acaugggacau

SEQ ID NO: 2755698 - RNA, 14 nt, Human
acaugggacauuug

SEQ ID NO: 2755699 - RNA, 17 nt, Human
ucaguuuuugugaaaag

SEQ ID NO: 2755700 - RNA, 15 nt, Human
ucaguuuuugugaaa

SEQ ID NO: 2755701 - RNA, 15 nt, Human
acccgggaggcagag

SEQ ID NO: 2755702 - RNA, 17 nt, Human
acccgggaggcagaggu

SEQ ID NO: 2755703 - RNA, 23 nt, Human
ucagauuuuauuauguaaauccc

SEQ ID NO: 2755704 - RNA, 22 nt, Human
ucagauuuuauuauguaaaucc

SEQ ID NO: 2755705 - RNA, 19 nt, Human
ucagcaaaaauauuuuaug

SEQ ID NO: 2755706 - RNA, 20 nt, Human
ucagcaaaaauauuuuauga

SEQ ID NO: 2755707 - RNA, 19 nt, Human
acuccagugagacagcucu

SEQ ID NO: 2755708 - RNA, 21 nt, Human
acucuuaagaagacugcauua

SEQ ID NO: 2755709 - RNA, 16 nt, Human
uccuggaaaucagggu

SEQ ID NO: 2755710 - RNA, 17 nt, Human
acugagaugugaacaca

SEQ ID NO: 2755711 - RNA, 22 nt, Human
acugagaugugaacacaucagc

SEQ ID NO: 2755712 - RNA, 18 nt, Human
acugagagugaacaaauu

SEQ ID NO: 2755713 - RNA, 22 nt, Human
acugacuucuaaguaaaaccac

SEQ ID NO: 2755714 - RNA, 16 nt, Human
acugacuucuaaguaa

SEQ ID NO: 2755715 - RNA, 15 nt, Human
acugacuucuaagua

SEQ ID NO: 2755716 - RNA, 13 nt, Human
acugacuucuaag

SEQ ID NO: 2755717 - RNA, 17 nt, Human
acugacucuuaagaaga

SEQ ID NO: 2755718 - RNA, 18 nt, Human
acugacucuuaagaagac

SEQ ID NO: 2755719 - RNA, 20 nt, Human
acugacucuuaagaagacug

SEQ ID NO: 2755720 - RNA, 13 nt, Human
acugacucuuaag

SEQ ID NO: 2755721 - RNA, 14 nt, Human
acugacucuuaaga

SEQ ID NO: 2755722 - RNA, 15 nt, Human
acugacucuuaagaa

SEQ ID NO: 2755723 - RNA, 16 nt, Human
acugacucuuaagaag

SEQ ID NO: 2755724 - RNA, 12 nt, Human
acugaagaagca

SEQ ID NO: 2755725 - RNA, 22 nt, Human
uccugaaaacccuugccaugug

SEQ ID NO: 2755726 - RNA, 19 nt, Human
accuugaaaacuuuaugcu

SEQ ID NO: 2755727 - RNA, 22 nt, Human
uccacugguucuucuuggucuc

SEQ ID NO: 2755728 - RNA, 20 nt, Human
accuuuuggucuggagggaa

SEQ ID NO: 2755729 - RNA, 11 nt, Human
acgcucucugg

SEQ ID NO: 2755730 - RNA, 18 nt, Human
uccagugagacagcucug

SEQ ID NO: 2755731 - RNA, 13 nt, Human
acggaugauuucu

SEQ ID NO: 2755732 - RNA, 11 nt, Human
uccauccugag

SEQ ID NO: 2755733 - RNA, 12 nt, Human
uccauccugagg

SEQ ID NO: 2755734 - RNA, 15 nt, Human
uccauccugaggcuc

SEQ ID NO: 2755735 - RNA, 16 nt, Human
acggugaauggcuuug

SEQ ID NO: 2755736 - RNA, 19 nt, Human
acggugaauggcuuuguau

SEQ ID NO: 2755737 - RNA, 20 nt, Human
acggugaauggcuuuguaua

SEQ ID NO: 2755738 - RNA, 15 nt, Human
acuaauuuuaaaaug

SEQ ID NO: 2755739 - RNA, 16 nt, Human
acuaucucauuuccaa

SEQ ID NO: 2755740 - RNA, 17 nt, Human
acuaucucauuuccaag

SEQ ID NO: 2755741 - RNA, 15 nt, Human
acuaucucauuucca

SEQ ID NO: 2755742 - RNA, 22 nt, Human
acuauauuguuugcuaagcauu

SEQ ID NO: 2755743 - RNA, 17 nt, Human
acuauauuguuugcuaa

SEQ ID NO: 2755744 - RNA, 12 nt, Human
acucaauuuuaa

SEQ ID NO: 2755745 - RNA, 15 nt, Human
acucaauuuuaacaa

SEQ ID NO: 2755746 - RNA, 23 nt, Human
ucucaggaaaucaaauaugcaaa

SEQ ID NO: 2755747 - RNA, 21 nt, Human
ucucaggaaaucaaauaugca

SEQ ID NO: 2755748 - RNA, 14 nt, Human
ucucaggaaaucaa

SEQ ID NO: 2755749 - RNA, 12 nt, Human
ucucaggaaauc

SEQ ID NO: 2755750 - RNA, 22 nt, Human
ucucagauuuuauuauguaaau

SEQ ID NO: 2755751 - RNA, 23 nt, Human
ucucagauuuuauuauguaaauc

SEQ ID NO: 2755752 - RNA, 15 nt, Human
ucucauuuccaagca

SEQ ID NO: 2755753 - RNA, 15 nt, Human
acuugucaauaaaau

SEQ ID NO: 2755754 - RNA, 13 nt, Human
acuuguguaaaua

SEQ ID NO: 2755755 - RNA, 17 nt, Human
acuuuggauaauaagga

SEQ ID NO: 2755756 - RNA, 19 nt, Human
acuuuggauaauaaggaaa

SEQ ID NO: 2755757 - RNA, 12 nt, Human
acuuuggauaau

SEQ ID NO: 2755758 - RNA, 16 nt, Human
ucuaggaaauauuuau

SEQ ID NO: 2755759 - RNA, 17 nt, Human
ucuaggaaauauuuauu

SEQ ID NO: 2755760 - RNA, 12 nt, Human
uccugggcagcu

SEQ ID NO: 2755761 - RNA, 13 nt, Human
uccugggcagcug

SEQ ID NO: 2755762 - RNA, 19 nt, Human
ucuaaguaaaaccacagca

SEQ ID NO: 2755763 - RNA, 15 nt, Human
ucuaaguaaaaccac

SEQ ID NO: 2755764 - RNA, 14 nt, Human
ucuaaguaaaacca

SEQ ID NO: 2755765 - RNA, 15 nt, Human
agaauuaacacauga

SEQ ID NO: 2755766 - RNA, 21 nt, Human
agaaugguccgugcuaaggac

SEQ ID NO: 2755767 - RNA, 23 nt, Human
agaaugguccgugcuaaggacuu

SEQ ID NO: 2755768 - RNA, 23 nt, Human
ucugugagaugcuagaacucccu

SEQ ID NO: 2755769 - RNA, 17 nt, Human
ucugugagaugcuagaa

SEQ ID NO: 2755770 - RNA, 22 nt, Human
ucugugagaugcuagaacuccc

SEQ ID NO: 2755771 - RNA, 14 nt, Human
ucugugagaugcua

SEQ ID NO: 2755772 - RNA, 18 nt, Human
ucugugaacuugaaauuu

SEQ ID NO: 2755773 - RNA, 14 nt, Human
ucugugaacuugaa

SEQ ID NO: 2755774 - RNA, 17 nt, Human
ucugugaacuugaaauu

SEQ ID NO: 2755775 - RNA, 12 nt, Human
agaauucuguau

SEQ ID NO: 2755776 - RNA, 14 nt, Human
agaauucuguauag

SEQ ID NO: 2755777 - RNA, 12 nt, Human
agacacacauga

SEQ ID NO: 2755778 - RNA, 18 nt, Human
ucugcagauaaacaguag

SEQ ID NO: 2755779 - RNA, 15 nt, Human
ucugcagauaaacag

SEQ ID NO: 2755780 - RNA, 14 nt, Human
ucugauccaguuuu

SEQ ID NO: 2755781 - RNA, 21 nt, Human
ucugauccaguuuuguuugga

SEQ ID NO: 2755782 - RNA, 11 nt, Human
ucugauccagu

SEQ ID NO: 2755783 - RNA, 14 nt, Human
agaaaugaaagcag

SEQ ID NO: 2755784 - RNA, 13 nt, Human
agaagaacugaaa

SEQ ID NO: 2755785 - RNA, 14 nt, Human
agaagaacugaaau

SEQ ID NO: 2755786 - RNA, 18 nt, Human
agaagaugguaccaccag

SEQ ID NO: 2755787 - RNA, 16 nt, Human
ucugcuugccaucccu

SEQ ID NO: 2755788 - RNA, 17 nt, Human
ucugcuugccaucccuc

SEQ ID NO: 2755789 - RNA, 20 nt, Human
ucugcuugccaucccucccu

SEQ ID NO: 2755790 - RNA, 23 nt, Human
ucugcuugccaucccucccucca

SEQ ID NO: 2755791 - RNA, 14 nt, Human
ucugcuugccaucc

SEQ ID NO: 2755792 - RNA, 13 nt, Human
agauccuggaaau

SEQ ID NO: 2755793 - RNA, 21 nt, Human
agaugcuagaacucccuuuca

SEQ ID NO: 2755794 - RNA, 15 nt, Human
agaugcuagaacucc

SEQ ID NO: 2755795 - RNA, 19 nt, Human
agaugcuagaacucccuuu

SEQ ID NO: 2755796 - RNA, 21 nt, Human
agaugcaguucugaagaagau

SEQ ID NO: 2755797 - RNA, 20 nt, Human
agaugcaguucugaagaaga

SEQ ID NO: 2755798 - RNA, 15 nt, Human
ugacacuuaaaaaug

SEQ ID NO: 2755799 - RNA, 22 nt, Human
agauguauguacuucaugcugu

SEQ ID NO: 2755800 - RNA, 17 nt, Human
agaugugaacacaucag

SEQ ID NO: 2755801 - RNA, 22 nt, Human
agaugugaacacaucagcuugc

SEQ ID NO: 2755802 - RNA, 21 nt, Human
agauugugccccugcacucca

SEQ ID NO: 2755803 - RNA, 15 nt, Human
agauuagaauucugu

SEQ ID NO: 2755804 - RNA, 16 nt, Human
agauuagaauucugua

SEQ ID NO: 2755805 - RNA, 22 nt, Human
agauuagaauucuguauagauu

SEQ ID NO: 2755806 - RNA, 23 nt, Human
agauuagaauucuguauagauua

SEQ ID NO: 2755807 - RNA, 21 nt, Human
agauuagagaguguugaaacg

SEQ ID NO: 2755808 - RNA, 16 nt, Human
agcaagggugauggga

SEQ ID NO: 2755809 - RNA, 22 nt, Human
agcaagggugaugggaaagcau

SEQ ID NO: 2755810 - RNA, 20 nt, Human
agcaagggugaugggaaagc

SEQ ID NO: 2755811 - RNA, 16 nt, Human
agauuuuccugaaaac

SEQ ID NO: 2755812 - RNA, 15 nt, Human
agauuuuccugaaaa

SEQ ID NO: 2755813 - RNA, 14 nt, Human
agauuuuccugaaa

SEQ ID NO: 2755814 - RNA, 20 nt, Human
ugagacucugucucagucca

SEQ ID NO: 2755815 - RNA, 12 nt, Human
ugagacagcucu

SEQ ID NO: 2755816 - RNA, 16 nt, Human
ugagagacacacugaa

SEQ ID NO: 2755817 - RNA, 17 nt, Human
ugagagacacacugaag

SEQ ID NO: 2755818 - RNA, 19 nt, Human
ugagagacacacugaagaa

SEQ ID NO: 2755819 - RNA, 20 nt, Human
ugagagacacacugaagaag

SEQ ID NO: 2755820 - RNA, 21 nt, Human
ugagagacacacugaagaagc

SEQ ID NO: 2755821 - RNA, 22 nt, Human
ugagagacacacugaagaagca

SEQ ID NO: 2755822 - RNA, 13 nt, Human
ugagaugugaaca

SEQ ID NO: 2755823 - RNA, 19 nt, Human
ugagaugugaacacaucag

SEQ ID NO: 2755824 - RNA, 18 nt, Human
ugagaugugaacacauca

SEQ ID NO: 2755825 - RNA, 24 nt, Human
ugagaugugaacacaucagcuugc

SEQ ID NO: 2755826 - RNA, 13 nt, Human
ugaaagaaaauaa

SEQ ID NO: 2755827 - RNA, 22 nt, Human
ugaaaauauuuguaucacaaau

SEQ ID NO: 2755828 - RNA, 21 nt, Human
ugaaaauauuuguaucacaaa

SEQ ID NO: 2755829 - RNA, 20 nt, Human
ugaaaaucuuauaauuuaaa

SEQ ID NO: 2755830 - RNA, 17 nt, Human
ugaaaauauuuguauca

SEQ ID NO: 2755831 - RNA, 18 nt, Human
ugaaagaggaaugaagua

SEQ ID NO: 2755832 - RNA, 17 nt, Human
ugaaagaggaaugaagu

SEQ ID NO: 2755833 - RNA, 16 nt, Human
agagaguguugaaacg

SEQ ID NO: 2755834 - RNA, 15 nt, Human
agagaguguugaaac

SEQ ID NO: 2755835 - RNA, 14 nt, Human
agagacagaaagca

SEQ ID NO: 2755836 - RNA, 16 nt, Human
agagacacacugaaga

SEQ ID NO: 2755837 - RNA, 17 nt, Human
ucuuugucuacaccauu

SEQ ID NO: 2755838 - RNA, 19 nt, Human
agacuggugacugauucuu

SEQ ID NO: 2755839 - RNA, 20 nt, Human
agacuggugacugauucuuc

SEQ ID NO: 2755840 - RNA, 21 nt, Human
agacuggugacugauucuuca

SEQ ID NO: 2755841 - RNA, 22 nt, Human
agacuccaaagaaauguaaggg

SEQ ID NO: 2755842 - RNA, 21 nt, Human
agacuggcacaguuuucugag

SEQ ID NO: 2755843 - RNA, 20 nt, Human
agacuggcacaguuuucuga

SEQ ID NO: 2755844 - RNA, 23 nt, Human
agacuggcacaguuuucugagaa

SEQ ID NO: 2755845 - RNA, 18 nt, Human
agagcuguucacagccag

SEQ ID NO: 2755846 - RNA, 17 nt, Human
ugaagauuuaccacuug

SEQ ID NO: 2755847 - RNA, 20 nt, Human
ugaagauuuaccacuugugu

SEQ ID NO: 2755848 - RNA, 17 nt, Human
ugaaguacucauacaug

SEQ ID NO: 2755849 - RNA, 22 nt, Human
ugaagaagcaccaaucaugaau

SEQ ID NO: 2755850 - RNA, 22 nt, Human
ugaacccauauuuguacaccaa

SEQ ID NO: 2755851 - RNA, 18 nt, Human
ugaacccgggaggcagag

SEQ ID NO: 2755852 - RNA, 13 nt, Human
ugaacaaauuuac

SEQ ID NO: 2755853 - RNA, 16 nt, Human
agagcugcccucuccu

SEQ ID NO: 2755854 - RNA, 17 nt, Human
agagcugcccucuccug

SEQ ID NO: 2755855 - RNA, 18 nt, Human
agagcugcccucuccugg

SEQ ID NO: 2755856 - RNA, 19 nt, Human
agagcugcccucuccuggg

SEQ ID NO: 2755857 - RNA, 20 nt, Human
agagcugcccucuccugggc

SEQ ID NO: 2755858 - RNA, 14 nt, Human
ugaaauaagccaga

SEQ ID NO: 2755859 - RNA, 13 nt, Human
ugaaauuguaauu

SEQ ID NO: 2755860 - RNA, 14 nt, Human
ugaaauuguaauua

SEQ ID NO: 2755861 - RNA, 15 nt, Human
ugaaauuguaauuau

SEQ ID NO: 2755862 - RNA, 16 nt, Human
ugaaauuguaauuaua

SEQ ID NO: 2755863 - RNA, 19 nt, Human
ugaaauuguaauuauaucu

SEQ ID NO: 2755864 - RNA, 17 nt, Human
uguaagaaaauaucacu

SEQ ID NO: 2755865 - RNA, 18 nt, Human
uguaagaaaauaucacuu

SEQ ID NO: 2755866 - RNA, 14 nt, Human
uguacaaaguauua

SEQ ID NO: 2755867 - RNA, 13 nt, Human
uguacaaaguauu

SEQ ID NO: 2755868 - RNA, 16 nt, Human
uguaaauacaauuuug

SEQ ID NO: 2755869 - RNA, 17 nt, Human
uguaaauacaauuuugu

SEQ ID NO: 2755870 - RNA, 18 nt, Human
uguaaauacaauuuuguu

SEQ ID NO: 2755871 - RNA, 19 nt, Human
uguaaauacaauuuuguuu

SEQ ID NO: 2755872 - RNA, 21 nt, Human
uguaaauacaauuuuguuucu

SEQ ID NO: 2755873 - RNA, 10 nt, Human
uguaaauccc

SEQ ID NO: 2755874 - RNA, 23 nt, Human
uggugugaccacugcagaagaca

SEQ ID NO: 2755875 - RNA, 22 nt, Human
agggugaugggaaagcauugua

SEQ ID NO: 2755876 - RNA, 21 nt, Human
agggugaugggaaagcauugu

SEQ ID NO: 2755877 - RNA, 16 nt, Human
aggggaauugaggaca

SEQ ID NO: 2755878 - RNA, 22 nt, Human
ugguccaugggccauaugaaaa

SEQ ID NO: 2755879 - RNA, 22 nt, Human
uggucugugagaugcuagaacu

SEQ ID NO: 2755880 - RNA, 17 nt, Human
aggguuaugauuaagua

SEQ ID NO: 2755881 - RNA, 20 nt, Human
aggguuuauguuuaggaugu

SEQ ID NO: 2755882 - RNA, 15 nt, Human
aggucagugcaaaua

SEQ ID NO: 2755883 - RNA, 22 nt, Human
ugugagaugcuagaacucccuu

SEQ ID NO: 2755884 - RNA, 14 nt, Human
ugugaagcaaaauu

SEQ ID NO: 2755885 - RNA, 17 nt, Human
agugaaagaaaauaaca

SEQ ID NO: 2755886 - RNA, 16 nt, Human
agugaaagaggcagcu

SEQ ID NO: 2755887 - RNA, 14 nt, Human
agugagacagcucu

SEQ ID NO: 2755888 - RNA, 22 nt, Human
agugaaagaggcagcuugaaac

SEQ ID NO: 2755889 - RNA, 21 nt, Human
agugagcagucaggaaagaga

SEQ ID NO: 2755890 - RNA, 16 nt, Human
agugagccgagauugu

SEQ ID NO: 2755891 - RNA, 14 nt, Human
ugucuucacaacag

SEQ ID NO: 2755892 - RNA, 15 nt, Human
ugucuugccuuuuuc

SEQ ID NO: 2755893 - RNA, 16 nt, Human
ugucuugccuuuuuca

SEQ ID NO: 2755894 - RNA, 17 nt, Human
ugucuugccuuuuucau

SEQ ID NO: 2755895 - RNA, 21 nt, Human
ugucuugccuuuuucauuauu

SEQ ID NO: 2755896 - RNA, 17 nt, Human
ugucucuacuaaaaaua

SEQ ID NO: 2755897 - RNA, 14 nt, Human
ugucuuaauuaaaa

SEQ ID NO: 2755898 - RNA, 12 nt, Human
ugucuuaauuaa

SEQ ID NO: 2755899 - RNA, 21 nt, Human
aguauuagaauaccacaggaa

SEQ ID NO: 2755900 - RNA, 18 nt, Human
aguauguuagugcaaauu

SEQ ID NO: 2755901 - RNA, 21 nt, Human
aguauguuagugcaaauuguc

SEQ ID NO: 2755902 - RNA, 15 nt, Human
aguauuguacaaagu

SEQ ID NO: 2755903 - RNA, 20 nt, Human
aguauuguacaaaguauuaa

SEQ ID NO: 2755904 - RNA, 22 nt, Human
aguauuguacaaaguauuaagc

SEQ ID NO: 2755905 - RNA, 23 nt, Human
aguauuguacaaaguauuaagca

SEQ ID NO: 2755906 - RNA, 11 nt, Human
aguauuguaca

SEQ ID NO: 2755907 - RNA, 20 nt, Human
agucacauuccaagccucau

SEQ ID NO: 2755908 - RNA, 15 nt, Human
aguauuguccagguc

SEQ ID NO: 2755909 - RNA, 16 nt, Human
aguauuguccaggucu

SEQ ID NO: 2755910 - RNA, 12 nt, Human
uguaugugugaa

SEQ ID NO: 2755911 - RNA, 23 nt, Human
ugucagcuccccucggagaagag

SEQ ID NO: 2755912 - RNA, 21 nt, Human
ugucagcuccccucggagaag

SEQ ID NO: 2755913 - RNA, 20 nt, Human
ugucagcuccccucggagaa

SEQ ID NO: 2755914 - RNA, 23 nt, Human
agucagaucugccuaaggacuuc

SEQ ID NO: 2755915 - RNA, 21 nt, Human
agucagaucugccuaaggacu

SEQ ID NO: 2755916 - RNA, 22 nt, Human
agucagaucugccuaaggacuu

SEQ ID NO: 2755917 - RNA, 20 nt, Human
agucagaucugccuaaggac

SEQ ID NO: 2755918 - RNA, 17 nt, Human
agucagaucugccuaag

SEQ ID NO: 2755919 - RNA, 23 nt, Human
uuagaugcaguucugaagaagau

SEQ ID NO: 2755920 - RNA, 22 nt, Human
uuagaugcaguucugaagaaga

SEQ ID NO: 2755921 - RNA, 14 nt, Human
auaaugaauacuuu

SEQ ID NO: 2755922 - RNA, 17 nt, Human
auaauuauaugcuauuu

SEQ ID NO: 2755923 - RNA, 19 nt, Human
auaauuauaugcuauuucu

SEQ ID NO: 2755924 - RNA, 21 nt, Human
auaauuauaugcuauuucuau

SEQ ID NO: 2755925 - RNA, 23 nt, Human
auaauuauaugcuauuucuauau

SEQ ID NO: 2755926 - RNA, 21 nt, Human
auaaucuuucacaggggacag

SEQ ID NO: 2755927 - RNA, 17 nt, Human
auaauaaggaaaaguuu

SEQ ID NO: 2755928 - RNA, 18 nt, Human
auaauaaggaaaaguuua

SEQ ID NO: 2755929 - RNA, 19 nt, Human
auaauaaggaaaaguuuaa

SEQ ID NO: 2755930 - RNA, 22 nt, Human
auaauaaggaaaaguuuaauau

SEQ ID NO: 2755931 - RNA, 16 nt, Human
auaauaaggaaaaguu

SEQ ID NO: 2755932 - RNA, 12 nt, Human
auaacuggaaac

SEQ ID NO: 2755933 - RNA, 19 nt, Human
auaaaugugccuucauuuu

SEQ ID NO: 2755934 - RNA, 17 nt, Human
aguuuucugagaaagac

SEQ ID NO: 2755935 - RNA, 14 nt, Human
aguuuucugagaaa

SEQ ID NO: 2755936 - RNA, 13 nt, Human
aguuuucugagaa

SEQ ID NO: 2755937 - RNA, 12 nt, Human
aguuuucugaga

SEQ ID NO: 2755938 - RNA, 18 nt, Human
uuauauaagcuuguauuc

SEQ ID NO: 2755939 - RNA, 14 nt, Human
auaauuuuuauauu

SEQ ID NO: 2755940 - RNA, 16 nt, Human
auaauuuuuauauuug

SEQ ID NO: 2755941 - RNA, 19 nt, Human
auaauuuuuauauuugaaa

SEQ ID NO: 2755942 - RNA, 13 nt, Human
auaauuuugugaa

SEQ ID NO: 2755943 - RNA, 14 nt, Human
auaauuuugugaag

SEQ ID NO: 2755944 - RNA, 15 nt, Human
auaauuuugugaagc

SEQ ID NO: 2755945 - RNA, 20 nt, Human
auaauuuugugaagcaaaau

SEQ ID NO: 2755946 - RNA, 22 nt, Human
auacaaaaaaaaaaaaaaauua

SEQ ID NO: 2755947 - RNA, 21 nt, Human
auaauuuuuauauuugaaaua

SEQ ID NO: 2755948 - RNA, 22 nt, Human
auaauuuuuauauuugaaauau

SEQ ID NO: 2755949 - RNA, 20 nt, Human
auacaucccuuaccugggaa

SEQ ID NO: 2755950 - RNA, 21 nt, Human
auacaguucggugagcuacaa

SEQ ID NO: 2755951 - RNA, 20 nt, Human
aguucggugagcuacaaaug

SEQ ID NO: 2755952 - RNA, 14 nt, Human
aguucagagcugcc

SEQ ID NO: 2755953 - RNA, 15 nt, Human
aguucagagcugccc

SEQ ID NO: 2755954 - RNA, 16 nt, Human
aguucagagcugcccu

SEQ ID NO: 2755955 - RNA, 17 nt, Human
aguucagagcugcccuc

SEQ ID NO: 2755956 - RNA, 18 nt, Human
aguucagagcugcccucu

SEQ ID NO: 2755957 - RNA, 21 nt, Human
uguuguacucaauuuuaacaa

SEQ ID NO: 2755958 - RNA, 19 nt, Human
aguuauggcuauaggugcu

SEQ ID NO: 2755959 - RNA, 20 nt, Human
aguuauuauauuuacaaaug

SEQ ID NO: 2755960 - RNA, 15 nt, Human
uuaaaaaagaaacau

SEQ ID NO: 2755961 - RNA, 18 nt, Human
uuaaaaaagaaacauuug

SEQ ID NO: 2755962 - RNA, 22 nt, Human
aguugcauagguuuaauaauuu

SEQ ID NO: 2755963 - RNA, 20 nt, Human
uuaaaaaugguuuaaauggu

SEQ ID NO: 2755964 - RNA, 15 nt, Human
aguucugaagaagau

SEQ ID NO: 2755965 - RNA, 13 nt, Human
aguucugaagaag

SEQ ID NO: 2755966 - RNA, 14 nt, Human
aguucugaagaaga

SEQ ID NO: 2755967 - RNA, 21 nt, Human
aguugauaugccuuuucccaa

SEQ ID NO: 2755968 - RNA, 13 nt, Human
uguuuuauaauuu

SEQ ID NO: 2755969 - RNA, 20 nt, Human
uguuuuauaauuuugugaag

SEQ ID NO: 2755970 - RNA, 15 nt, Human
uguuugcuaagcauu

SEQ ID NO: 2755971 - RNA, 19 nt, Human
uguuugcuaagcauuccaa

SEQ ID NO: 2755972 - RNA, 18 nt, Human
ugccucagaaaacaagga

SEQ ID NO: 2755973 - RNA, 16 nt, Human
ugccuccccuccucug

SEQ ID NO: 2755974 - RNA, 12 nt, Human
ugccuccccucc

SEQ ID NO: 2755975 - RNA, 13 nt, Human
ugccuccccuccu

SEQ ID NO: 2755976 - RNA, 14 nt, Human
ugccuccccuccuc

SEQ ID NO: 2755977 - RNA, 15 nt, Human
ugccuccccuccucu

SEQ ID NO: 2755978 - RNA, 11 nt, Human
ugccuccccuc

SEQ ID NO: 2755979 - RNA, 15 nt, Human
ugccucaccccuugc

SEQ ID NO: 2755980 - RNA, 21 nt, Human
agcugcccucuccugggcagc

SEQ ID NO: 2755981 - RNA, 19 nt, Human
agcugcccucuccugggca

SEQ ID NO: 2755982 - RNA, 20 nt, Human
agcugcccucuccugggcag

SEQ ID NO: 2755983 - RNA, 17 nt, Human
agcugcccucuccuggg

SEQ ID NO: 2755984 - RNA, 18 nt, Human
agcugcccucuccugggc

SEQ ID NO: 2755985 - RNA, 16 nt, Human
agcugcccucuccugg

SEQ ID NO: 2755986 - RNA, 23 nt, Human
agcucugcccauccugccccuga

SEQ ID NO: 2755987 - RNA, 22 nt, Human
ugcccucuccugggcagcugcc

SEQ ID NO: 2755988 - RNA, 23 nt, Human
ugcccucuccugggcagcugccu

SEQ ID NO: 2755989 - RNA, 16 nt, Human
ugcccucuccugggca

SEQ ID NO: 2755990 - RNA, 17 nt, Human
ugcccucuccugggcag

SEQ ID NO: 2755991 - RNA, 18 nt, Human
ugcccucuccugggcagc

SEQ ID NO: 2755992 - RNA, 20 nt, Human
ugcccucuccugggcagcug

SEQ ID NO: 2755993 - RNA, 13 nt, Human
ugcccucuccugg

SEQ ID NO: 2755994 - RNA, 14 nt, Human
ugcccucuccuggg

SEQ ID NO: 2755995 - RNA, 15 nt, Human
ugcccucuccugggc

SEQ ID NO: 2755996 - RNA, 12 nt, Human
ugcccucuccug

SEQ ID NO: 2755997 - RNA, 22 nt, Human
ugccauuuaaagcuuauuaaaa

SEQ ID NO: 2755998 - RNA, 19 nt, Human
agcuauggugucauaggcu

SEQ ID NO: 2755999 - RNA, 16 nt, Human
ugccccauucaacauc

SEQ ID NO: 2756000 - RNA, 14 nt, Human
ugcagaagacagua

SEQ ID NO: 2756001 - RNA, 15 nt, Human
ugcagaagacaguau

SEQ ID NO: 2756002 - RNA, 12 nt, Human
ugauuucuaugc

SEQ ID NO: 2756003 - RNA, 15 nt, Human
ugauuucuaugcuga

SEQ ID NO: 2756004 - RNA, 16 nt, Human
ugauuucuaugcugag

SEQ ID NO: 2756005 - RNA, 19 nt, Human
ugaugggaaagcauuguaa

SEQ ID NO: 2756006 - RNA, 14 nt, Human
ugaugggaaagcau

SEQ ID NO: 2756007 - RNA, 11 nt, Human
ugaugaagaag

SEQ ID NO: 2756008 - RNA, 12 nt, Human
ugaugaagaagu

SEQ ID NO: 2756009 - RNA, 23 nt, Human
ugauuaaguaaugauaacuggaa

SEQ ID NO: 2756010 - RNA, 18 nt, Human
ugauuaaguaaugauaac

SEQ ID NO: 2756011 - RNA, 15 nt, Human
agccagcaguucaga

SEQ ID NO: 2756012 - RNA, 17 nt, Human
agccagcaguucagagc

SEQ ID NO: 2756013 - RNA, 19 nt, Human
agccagcaguucagagcug

SEQ ID NO: 2756014 - RNA, 22 nt, Human
agccagcaguucagagcugccc

SEQ ID NO: 2756015 - RNA, 20 nt, Human
agccagcaguucagagcugc

SEQ ID NO: 2756016 - RNA, 21 nt, Human
agccagcaguucagagcugcc

SEQ ID NO: 2756017 - RNA, 18 nt, Human
uggaauuggagcucgugg

SEQ ID NO: 2756018 - RNA, 22 nt, Human
uggaauuucucccagucauuua

SEQ ID NO: 2756019 - RNA, 16 nt, Human
ugcuugccaucccucc

SEQ ID NO: 2756020 - RNA, 15 nt, Human
ugcuugccaucccuc

SEQ ID NO: 2756021 - RNA, 11 nt, Human
aggagaaacug

SEQ ID NO: 2756022 - RNA, 17 nt, Human
aggacuuguuagaucua

SEQ ID NO: 2756023 - RNA, 14 nt, Human
aggacuuguuagau

SEQ ID NO: 2756024 - RNA, 16 nt, Human
aggacuuguuagaucu

SEQ ID NO: 2756025 - RNA, 14 nt, Human
aggacacugauaug

SEQ ID NO: 2756026 - RNA, 23 nt, Human
aggacagcccuucuuuccacaga

SEQ ID NO: 2756027 - RNA, 13 nt, Human
ugcuggagcucug

SEQ ID NO: 2756028 - RNA, 14 nt, Human
ugcuggagcucugc

SEQ ID NO: 2756029 - RNA, 23 nt, Human
ugcuguauuuuaaaagaaugauu

SEQ ID NO: 2756030 - RNA, 23 nt, Human
aggaauugacccacaagaaauga

SEQ ID NO: 2756031 - RNA, 11 nt, Human
aggaauuuaaa

SEQ ID NO: 2756032 - RNA, 14 nt, Human
ugcuauuucuauau

SEQ ID NO: 2756033 - RNA, 20 nt, Human
ugcuauuucuauauuuucau

SEQ ID NO: 2756034 - RNA, 12 nt, Human
ugcuauuucuau

SEQ ID NO: 2756035 - RNA, 13 nt, Human
ugcuauuucuaua

SEQ ID NO: 2756036 - RNA, 21 nt, Human
ugggaaagcauuguaaaugug

SEQ ID NO: 2756037 - RNA, 18 nt, Human
uggacgagaaaacaauaa

SEQ ID NO: 2756038 - RNA, 20 nt, Human
uggcacaguuuucugagaaa

SEQ ID NO: 2756039 - RNA, 22 nt, Human
uggcacaguuuucugagaaaga

SEQ ID NO: 2756040 - RNA, 16 nt, Human
auccugcaauuccacu

SEQ ID NO: 2756041 - RNA, 22 nt, Human
auccugaggcuccacuuggucu

SEQ ID NO: 2756042 - RNA, 13 nt, Human
auccugccccuga

SEQ ID NO: 2756043 - RNA, 11 nt, Human
auccugaggcu

SEQ ID NO: 2756044 - RNA, 13 nt, Human
auccugaggcucc

SEQ ID NO: 2756045 - RNA, 16 nt, Human
auccugaggcuccacu

SEQ ID NO: 2756046 - RNA, 18 nt, Human
auccugaggcuccacuug

SEQ ID NO: 2756047 - RNA, 17 nt, Human
uugacacuuaaaaaugg

SEQ ID NO: 2756048 - RNA, 19 nt, Human
uugacacuuaaaaaugguu

SEQ ID NO: 2756049 - RNA, 14 nt, Human
uugacauagucugg

SEQ ID NO: 2756050 - RNA, 17 nt, Human
uugacauagucuggcug

SEQ ID NO: 2756051 - RNA, 14 nt, Human
aucccucccuccac

SEQ ID NO: 2756052 - RNA, 16 nt, Human
aucccucccuccaccu

SEQ ID NO: 2756053 - RNA, 17 nt, Human
aucccucccuccaccuc

SEQ ID NO: 2756054 - RNA, 18 nt, Human
aucccucccuccaccucc

SEQ ID NO: 2756055 - RNA, 20 nt, Human
aucccucccuccaccucccu

SEQ ID NO: 2756056 - RNA, 21 nt, Human
aucccucccuccaccucccug

SEQ ID NO: 2756057 - RNA, 16 nt, Human
uucuguuuuauaauuu

SEQ ID NO: 2756058 - RNA, 17 nt, Human
uucuguuuuauaauuuu

SEQ ID NO: 2756059 - RNA, 13 nt, Human
uucuuaaaguuga

SEQ ID NO: 2756060 - RNA, 23 nt, Human
aucacuugaacccgggaggcaga

SEQ ID NO: 2756061 - RNA, 14 nt, Human
aucaauuuuucuua

SEQ ID NO: 2756062 - RNA, 13 nt, Human
aucaauuuaaaaa

SEQ ID NO: 2756063 - RNA, 21 nt, Human
aucaaggguacacugccuucu

SEQ ID NO: 2756064 - RNA, 18 nt, Human
aucaaauaugcaaagcac

SEQ ID NO: 2756065 - RNA, 17 nt, Human
aucaaauaugcaaagca

SEQ ID NO: 2756066 - RNA, 16 nt, Human
aucaaauaugcaaagc

SEQ ID NO: 2756067 - RNA, 16 nt, Human
aucaaggguacacugc

SEQ ID NO: 2756068 - RNA, 15 nt, Human
aucaaauaugcaaag

SEQ ID NO: 2756069 - RNA, 13 nt, Human
auauuuacaaaug

SEQ ID NO: 2756070 - RNA, 14 nt, Human
auauuguuugcuaa

SEQ ID NO: 2756071 - RNA, 12 nt, Human
auauuaaagcca

SEQ ID NO: 2756072 - RNA, 17 nt, Human
uucagcgguuuauauaa

SEQ ID NO: 2756073 - RNA, 19 nt, Human
uucagcaaaaauauuuuau

SEQ ID NO: 2756074 - RNA, 17 nt, Human
uucagcaaaaauauuuu

SEQ ID NO: 2756075 - RNA, 15 nt, Human
uucaucaaugaauga

SEQ ID NO: 2756076 - RNA, 13 nt, Human
auauaugcuaagu

SEQ ID NO: 2756077 - RNA, 23 nt, Human
auauguaccuaacgaaguauccu

SEQ ID NO: 2756078 - RNA, 21 nt, Human
uucauggaacgcguugaaauu

SEQ ID NO: 2756079 - RNA, 22 nt, Human
uucauggaacgcguugaaauug

SEQ ID NO: 2756080 - RNA, 19 nt, Human
uucauggaacgcguugaaa

SEQ ID NO: 2756081 - RNA, 20 nt, Human
uucauggaacgcguugaaau

SEQ ID NO: 2756082 - RNA, 14 nt, Human
auaugcaaagcacu

SEQ ID NO: 2756083 - RNA, 13 nt, Human
auaugcaaagcac

SEQ ID NO: 2756084 - RNA, 13 nt, Human
auauauuuuuaua

SEQ ID NO: 2756085 - RNA, 14 nt, Human
uucauuaucucaaa

SEQ ID NO: 2756086 - RNA, 22 nt, Human
uucauuauuuuauuaugaaacu

SEQ ID NO: 2756087 - RNA, 22 nt, Human
augggacauuugcucauggaau

SEQ ID NO: 2756088 - RNA, 21 nt, Human
augggacauuugcucauggaa

SEQ ID NO: 2756089 - RNA, 21 nt, Human
auggcuauaggugcuacaaaa

SEQ ID NO: 2756090 - RNA, 19 nt, Human
auggcuauaggugcuacaa

SEQ ID NO: 2756091 - RNA, 16 nt, Human
auggcuauaggugcua

SEQ ID NO: 2756092 - RNA, 17 nt, Human
auggaauuucucccagu

SEQ ID NO: 2756093 - RNA, 14 nt, Human
uuugaaauauugac

SEQ ID NO: 2756094 - RNA, 14 nt, Human
uuucugcaucagcu

SEQ ID NO: 2756095 - RNA, 14 nt, Human
uuucuaugaaauau

SEQ ID NO: 2756096 - RNA, 20 nt, Human
uuucuaugaaauauuauguu

SEQ ID NO: 2756097 - RNA, 13 nt, Human
uuucuaugaaaua

SEQ ID NO: 2756098 - RNA, 21 nt, Human
uuucuaugcugaguuugugcu

SEQ ID NO: 2756099 - RNA, 15 nt, Human
uuucuauauuuucau

SEQ ID NO: 2756100 - RNA, 18 nt, Human
uuucuauauuuucauucu

SEQ ID NO: 2756101 - RNA, 13 nt, Human
uuucuauauuuuc

SEQ ID NO: 2756102 - RNA, 13 nt, Human
augcuaagugaaa

SEQ ID NO: 2756103 - RNA, 24 nt, Human
uuuaaagcuuauuaaaacucauuu

SEQ ID NO: 2756104 - RNA, 17 nt, Human
uuuacuaaaauggacug

SEQ ID NO: 2756105 - RNA, 15 nt, Human
uuuacuaaaauggac

SEQ ID NO: 2756106 - RNA, 16 nt, Human
uuuauuacuguaagaa

SEQ ID NO: 2756107 - RNA, 17 nt, Human
uuuauaugcuucuguuu

SEQ ID NO: 2756108 - RNA, 23 nt, Human
auggaauuggagcucgugggaca

SEQ ID NO: 2756109 - RNA, 14 nt, Human
augcuguauuuuaa

SEQ ID NO: 2756110 - RNA, 23 nt, Human
augcugucuacacuaagagagaa

SEQ ID NO: 2756111 - RNA, 19 nt, Human
uuuauuacuguaagaaaau

SEQ ID NO: 2756112 - RNA, 13 nt, Human
uuuauuaugaaac

SEQ ID NO: 2756113 - RNA, 21 nt, Human
uuuauuaugaaacuuguguaa

SEQ ID NO: 2756114 - RNA, 16 nt, Human
uuuauuuuaauaaugu

SEQ ID NO: 2756115 - RNA, 16 nt, Human
auggaacauaaaauac

SEQ ID NO: 2756116 - RNA, 14 nt, Human
augauaacuggaaa

SEQ ID NO: 2756117 - RNA, 18 nt, Human
uugugaagcaaaauuuuu

SEQ ID NO: 2756118 - RNA, 20 nt, Human
uuuaaaaaagaaacauuugg

SEQ ID NO: 2756119 - RNA, 17 nt, Human
uuuaaaaaaaaaauugg

SEQ ID NO: 2756120 - RNA, 18 nt, Human
augaauuacauuuguaua

SEQ ID NO: 2756121 - RNA, 19 nt, Human
augaauuacauuuguauaa

SEQ ID NO: 2756122 - RNA, 17 nt, Human
augaauuacauuuguau

SEQ ID NO: 2756123 - RNA, 19 nt, Human
uuguauaaaauaauuuuua

SEQ ID NO: 2756124 - RNA, 13 nt, Human
uuguauaaaauaa

SEQ ID NO: 2756125 - RNA, 23 nt, Human
uuguaguguuggagaagaacuga

SEQ ID NO: 2756126 - RNA, 15 nt, Human
uuguaauuauaucug

SEQ ID NO: 2756127 - RNA, 22 nt, Human
augaauuacauuuguauaaaau

SEQ ID NO: 2756128 - RNA, 21 nt, Human
augaauuaguuuuauaugcuu

SEQ ID NO: 2756129 - RNA, 23 nt, Human
augaauuaguuuuauaugcuucu

SEQ ID NO: 2756130 - RNA, 12 nt, Human
uugcucauggaa

SEQ ID NO: 2756131 - RNA, 11 nt, Human
uugcucaugga

SEQ ID NO: 2756132 - RNA, 21 nt, Human
augaaauauuauguuaaaacu

SEQ ID NO: 2756133 - RNA, 20 nt, Human
augaaauauuauguuaaaac

SEQ ID NO: 2756134 - RNA, 13 nt, Human
auuuagauguaua

SEQ ID NO: 2756135 - RNA, 17 nt, Human
auuuauuuuaauaaugu

SEQ ID NO: 2756136 - RNA, 12 nt, Human
auuucauuucuu

SEQ ID NO: 2756137 - RNA, 19 nt, Human
auuuauuuuaauaauguuu

SEQ ID NO: 2756138 - RNA, 20 nt, Human
auuuauuuuaauaauguuuc

SEQ ID NO: 2756139 - RNA, 14 nt, Human
auuugaaauauuga

SEQ ID NO: 2756140 - RNA, 18 nt, Human
auugacccacaagaaaug

SEQ ID NO: 2756141 - RNA, 21 nt, Human
auucuguauagauuagaauuc

SEQ ID NO: 2756142 - RNA, 15 nt, Human
auucuguauagauua

SEQ ID NO: 2756143 - RNA, 13 nt, Human
auucuuaaaguug

SEQ ID NO: 2756144 - RNA, 14 nt, Human
auucuuaaaguuga

SEQ ID NO: 2756145 - RNA, 15 nt, Human
auucuuaaaguugaa

SEQ ID NO: 2756146 - RNA, 16 nt, Human
auucuuaaaguugaau

SEQ ID NO: 2756147 - RNA, 18 nt, Human
auucuuaaaguugaauuu

SEQ ID NO: 2756148 - RNA, 15 nt, Human
auucuucagcaaaaa

SEQ ID NO: 2756149 - RNA, 23 nt, Human
auucuucagcaaaaauauuuuau

SEQ ID NO: 2756150 - RNA, 15 nt, Human
auuguauuacaaauc

SEQ ID NO: 2756151 - RNA, 23 nt, Human
auugguguuguacucaauuuuaa

SEQ ID NO: 2756152 - RNA, 14 nt, Human
auugguguuguacu

SEQ ID NO: 2756153 - RNA, 22 nt, Human
auugguguuguacucaauuuua

SEQ ID NO: 2756154 - RNA, 17 nt, Human
auuuuaaaagaaugauu

SEQ ID NO: 2756155 - RNA, 19 nt, Human
auuuguauaaaauaauuuu

SEQ ID NO: 2756156 - RNA, 15 nt, Human
auuuguauaaaauaa

SEQ ID NO: 2756157 - RNA, 18 nt, Human
auuuguauaaaauaauuu

SEQ ID NO: 2756158 - RNA, 18 nt, Human
auuuuaaaagaaugauua

SEQ ID NO: 2756159 - RNA, 22 nt, Human
auuuuaaaagaaugauuaugaa

SEQ ID NO: 2756160 - RNA, 22 nt, Human
auuuucaguuauuauauuuaca

SEQ ID NO: 2756161 - RNA, 13 nt, Human
auuuuccuccuuu

SEQ ID NO: 2756162 - RNA, 17 nt, Human
auuuuccuccuuucucu

SEQ ID NO: 2756163 - RNA, 20 nt, Human
auuuuauuauguaaauccca

SEQ ID NO: 2756164 - RNA, 21 nt, Human
auuuuauuauguaaaucccau

SEQ ID NO: 2756165 - RNA, 16 nt, Human
auuuuauuauguaaau

SEQ ID NO: 2756166 - RNA, 17 nt, Human
auuuuauuauguaaauc

SEQ ID NO: 2756167 - RNA, 18 nt, Human
auuuuauuauguaaaucc

SEQ ID NO: 2756168 - RNA, 19 nt, Human
auuuuauuauguaaauccc

SEQ ID NO: 2756169 - RNA, 15 nt, Human
auuuuauuauguaaa

SEQ ID NO: 2756170 - RNA, 14 nt, Human
uuuucucuaggaaa

SEQ ID NO: 2756171 - RNA, 18 nt, Human
uuuucugagaaagacuau

SEQ ID NO: 2756172 - RNA, 15 nt, Human
uuuucugagaaagac

SEQ ID NO: 2756173 - RNA, 15 nt, Human
uuuucugauccaguu

SEQ ID NO: 2756174 - RNA, 12 nt, Human
uuuuauuaugaa

SEQ ID NO: 2756175 - RNA, 21 nt, Human
uuuuauuaugaaacuugugua

SEQ ID NO: 2756176 - RNA, 22 nt, Human
uuuuauuaugaaacuuguguaa

SEQ ID NO: 2756177 - RNA, 17 nt, Human
auguuuucaggcuagau

SEQ ID NO: 2756178 - RNA, 21 nt, Human
auguuuucaggcuagauguau

SEQ ID NO: 2756179 - RNA, 15 nt, Human
auguuuucaggcuag

SEQ ID NO: 2756180 - RNA, 18 nt, Human
auguucaucaaugaauga

SEQ ID NO: 2756181 - RNA, 12 nt, Human
auguuaaaccau

SEQ ID NO: 2756182 - RNA, 13 nt, Human
auguuaaaccaug

SEQ ID NO: 2756183 - RNA, 20 nt, Human
auguuaaaccaugggauaaa

SEQ ID NO: 2756184 - RNA, 19 nt, Human
augugcuaguaauuggaaa

SEQ ID NO: 2756185 - RNA, 16 nt, Human
uuuuaauaauguuuca

SEQ ID NO: 2756186 - RNA, 12 nt, Human
uuuuaauaaugu

SEQ ID NO: 2756187 - RNA, 13 nt, Human
uuuuaauaauguu

SEQ ID NO: 2756188 - RNA, 14 nt, Human
uuuuaauaauguuu

SEQ ID NO: 2756189 - RNA, 19 nt, Human
uuuuuauauuugaaauauu

SEQ ID NO: 2756190 - RNA, 17 nt, Human
uuuuuauauuugaaaua

SEQ ID NO: 2756191 - RNA, 23 nt, Human
uuuuguuuggaccaaaaaccagu

SEQ ID NO: 2756192 - RNA, 18 nt, Human
uuuuguuguuuguuuagu

SEQ ID NO: 2756193 - RNA, 12 nt, Human
uuuuguuuggac

SEQ ID NO: 2756194 - RNA, 22 nt, Human
uuuuguuuggaccaaaaaccag

SEQ ID NO: 2756195 - RNA, 13 nt, Human
uuuuguuucugua

SEQ ID NO: 2756196 - RNA, 12 nt, Human
uuuuguuucugu

SEQ ID NO: 2756197 - RNA, 15 nt, Human
auuaagcauauauuu

SEQ ID NO: 2756198 - RNA, 21 nt, Human
auuaagcauauauuuuuauau

SEQ ID NO: 2756199 - RNA, 14 nt, Human
auuaagcauauauu

SEQ ID NO: 2756200 - RNA, 12 nt, Human
auuaccagggac

SEQ ID NO: 2756201 - RNA, 16 nt, Human
auuacauuuguauaaa

SEQ ID NO: 2756202 - RNA, 18 nt, Human
auuacauuuguauaaaau

SEQ ID NO: 2756203 - RNA, 17 nt, Human
auuacauuuguauaaaa

SEQ ID NO: 2756204 - RNA, 19 nt, Human
uuuuugugaaaagcuccau

SEQ ID NO: 2756205 - RNA, 21 nt, Human
auuaaguaaugauaacuggaa

SEQ ID NO: 2756206 - RNA, 23 nt, Human
auuaaguaaugauaacuggaaac

SEQ ID NO: 2756207 - RNA, 15 nt, Human
auuagaauucuguau

SEQ ID NO: 2756208 - RNA, 16 nt, Human
auuagaauucuguaua

SEQ ID NO: 2756209 - RNA, 17 nt, Human
auuagaauucuguauag

SEQ ID NO: 2756210 - RNA, 18 nt, Human
auuagaauucuguauaga

SEQ ID NO: 2756211 - RNA, 13 nt, Human
auuagaauucugu

SEQ ID NO: 2756212 - RNA, 14 nt, Human
auuagaauucugua

SEQ ID NO: 2756213 - RNA, 12 nt, Human
auuagaauucug

SEQ ID NO: 2756214 - RNA, 21 nt, Human
auucuccuaucaccugucuug

SEQ ID NO: 2756215 - RNA, 23 nt, Human
aaaaaauuggggauucuuaaagu

SEQ ID NO: 2756216 - RNA, 14 nt, Human
aaaacaaggaugaa

SEQ ID NO: 2756217 - RNA, 18 nt, Human
aaaacacagcaaggguga

SEQ ID NO: 2756218 - RNA, 13 nt, Human
aaaacacagcaag

SEQ ID NO: 2756219 - RNA, 12 nt, Human
aaaacacagcaa

SEQ ID NO: 2756220 - RNA, 17 nt, Human
aaaacaaggaugaauua

SEQ ID NO: 2756221 - RNA, 17 nt, Human
aaaaauuggggauucuu

SEQ ID NO: 2756222 - RNA, 18 nt, Human
aaaaauuggggauucuua

SEQ ID NO: 2756223 - RNA, 19 nt, Human
aaaaauuggggauucuuaa

SEQ ID NO: 2756224 - RNA, 20 nt, Human
aaaaauuggggauucuuaaa

SEQ ID NO: 2756225 - RNA, 16 nt, Human
aaaaaccaguauugua

SEQ ID NO: 2756226 - RNA, 18 nt, Human
aaaaaccaguauuguaca

SEQ ID NO: 2756227 - RNA, 16 nt, Human
aagauuuaccacuugu

SEQ ID NO: 2756228 - RNA, 13 nt, Human
aagccagauuuuc

SEQ ID NO: 2756229 - RNA, 13 nt, Human
aagccauguuuau

SEQ ID NO: 2756230 - RNA, 21 nt, Human
aauaauccuaaacauaugaau

SEQ ID NO: 2756231 - RNA, 14 nt, Human
aauaaaauggguuu

SEQ ID NO: 2756232 - RNA, 19 nt, Human
aauaaaauggguuuuacug

SEQ ID NO: 2756233 - RNA, 20 nt, Human
aaugauaacuggaaacuuca

SEQ ID NO: 2756234 - RNA, 17 nt, Human
aaugauaacuggaaacu

SEQ ID NO: 2756235 - RNA, 13 nt, Human
aauccauacauuu

SEQ ID NO: 2756236 - RNA, 17 nt, Human
aauccauuuggaaaucu

SEQ ID NO: 2756237 - RNA, 18 nt, Human
aauccauuuggaaaucuu

SEQ ID NO: 2756238 - RNA, 22 nt, Human
aauccauuuggaaaucuuuaaa

SEQ ID NO: 2756239 - RNA, 14 nt, Human
aauccauuuggaaa

SEQ ID NO: 2756240 - RNA, 15 nt, Human
aauccauuuggaaau

SEQ ID NO: 2756241 - RNA, 15 nt, Human
aaucaagaaacuuaa

SEQ ID NO: 2756242 - RNA, 13 nt, Human
aaucacaauacau

SEQ ID NO: 2756243 - RNA, 16 nt, Human
aauauuauguuaaaac

SEQ ID NO: 2756244 - RNA, 14 nt, Human
aauuaguuuuauau

SEQ ID NO: 2756245 - RNA, 17 nt, Human
aauuaguuuuauaugcu

SEQ ID NO: 2756246 - RNA, 20 nt, Human
aauuaguuuuauaugcuucu

SEQ ID NO: 2756247 - RNA, 15 nt, Human
aauggcuuuguauag

SEQ ID NO: 2756248 - RNA, 16 nt, Human
aauggcuuuguauaga

SEQ ID NO: 2756249 - RNA, 18 nt, Human
aauggcuuuguauagaac

SEQ ID NO: 2756250 - RNA, 13 nt, Human
aauggcuuuguau

SEQ ID NO: 2756251 - RNA, 22 nt, Human
aaugguccgugcuaaggacuug

SEQ ID NO: 2756252 - RNA, 19 nt, Human
aaaucaaauaugcaaagca

SEQ ID NO: 2756253 - RNA, 18 nt, Human
aaaucaaauaugcaaagc

SEQ ID NO: 2756254 - RNA, 16 nt, Human
aaaucaaauaugcaaa

SEQ ID NO: 2756255 - RNA, 19 nt, Human
aaauggacuguggugacuu

SEQ ID NO: 2756256 - RNA, 18 nt, Human
aaauauuuuaugauccag

SEQ ID NO: 2756257 - RNA, 19 nt, Human
aaauauuuuaugauccagc

SEQ ID NO: 2756258 - RNA, 14 nt, Human
aaauauuuuaugau

SEQ ID NO: 2756259 - RNA, 12 nt, Human
aaauaacaauga

SEQ ID NO: 2756260 - RNA, 16 nt, Human
aaagaugaaaauauuu

SEQ ID NO: 2756261 - RNA, 13 nt, Human
aaagaugaaaaua

SEQ ID NO: 2756262 - RNA, 17 nt, Human
aaagaugaaaauauuug

SEQ ID NO: 2756263 - RNA, 19 nt, Human
aaacugccagcaacgcagg

SEQ ID NO: 2756264 - RNA, 17 nt, Human
aaacugacucuuaagaa

SEQ ID NO: 2756265 - RNA, 15 nt, Human
aaacugccagcaacg

SEQ ID NO: 2756266 - RNA, 14 nt, Human
aaacugccagcaac

SEQ ID NO: 2756267 - RNA, 16 nt, Human
aaacugacucuuaaga

SEQ ID NO: 2756268 - RNA, 18 nt, Human
aaaauuggggauucuuaa

SEQ ID NO: 2756269 - RNA, 19 nt, Human
aaaauuggggauucuuaaa

SEQ ID NO: 2756270 - RNA, 17 nt, Human
aaaauuggggauucuua

SEQ ID NO: 2756271 - RNA, 14 nt, Human
aagaaauguaaggg

SEQ ID NO: 2756272 - RNA, 13 nt, Human
aagaaauguaagg

SEQ ID NO: 2756273 - RNA, 13 nt, Human
aacuuuucugaua

SEQ ID NO: 2756274 - RNA, 14 nt, Human
aacuuuucugauag

SEQ ID NO: 2756275 - RNA, 12 nt, Human
aacuuuucugau

SEQ ID NO: 2756276 - RNA, 15 nt, Human
aacacgagcaggcua

SEQ ID NO: 2756277 - RNA, 16 nt, Human
aaauuggggauucuua

SEQ ID NO: 2756278 - RNA, 21 nt, Human
aaccaguauuguacaaaguau

SEQ ID NO: 2756279 - RNA, 22 nt, Human
aaccaguauuguacaaaguauu

SEQ ID NO: 2756280 - RNA, 20 nt, Human
aaccaguauuguacaaagua

SEQ ID NO: 2756281 - RNA, 15 nt, Human
aaccaguauuguaca

SEQ ID NO: 2756282 - RNA, 13 nt, Human
acaacuauauugu

SEQ ID NO: 2756283 - RNA, 15 nt, Human
acaauuuuguuucug

SEQ ID NO: 2756284 - RNA, 17 nt, Human
acaauuuuguuucugua

SEQ ID NO: 2756285 - RNA, 14 nt, Human
acaauuuuguuucu

SEQ ID NO: 2756286 - RNA, 20 nt, Human
acagcucugcauacucauua

SEQ ID NO: 2756287 - RNA, 15 nt, Human
acagccagacuggca

SEQ ID NO: 2756288 - RNA, 13 nt, Human
acagccagacugg

SEQ ID NO: 2756289 - RNA, 16 nt, Human
acagccagacuggcac

SEQ ID NO: 2756290 - RNA, 18 nt, Human
acagcaguugaaaagacu

SEQ ID NO: 2756291 - RNA, 15 nt, Human
acagcaguugaaaag

SEQ ID NO: 2756292 - RNA, 13 nt, Human
acauguuacaaca

SEQ ID NO: 2756293 - RNA, 15 nt, Human
acauaaaucugugaa

SEQ ID NO: 2756294 - RNA, 18 nt, Human
acauaaaucugugaacuu

SEQ ID NO: 2756295 - RNA, 14 nt, Human
acauaaaucuguga

SEQ ID NO: 2756296 - RNA, 18 nt, Human
acauuugcucauggaauu

SEQ ID NO: 2756297 - RNA, 16 nt, Human
acauuugcucauggaa

SEQ ID NO: 2756298 - RNA, 14 nt, Human
acauuuguauaaaa

SEQ ID NO: 2756299 - RNA, 15 nt, Human
acccacaagaaauga

SEQ ID NO: 2756300 - RNA, 16 nt, Human
acccaaguccaagcau

SEQ ID NO: 2756301 - RNA, 14 nt, Human
acuuggucugugag

SEQ ID NO: 2756302 - RNA, 13 nt, Human
acuuggucuguga

SEQ ID NO: 2756303 - RNA, 15 nt, Human
acuuggucugugaga

SEQ ID NO: 2756304 - RNA, 18 nt, Human
acuuguaaaggaauuuaa

SEQ ID NO: 2756305 - RNA, 20 nt, Human
acuuguaaaggaauuuaaaa

SEQ ID NO: 2756306 - RNA, 19 nt, Human
acuuguaaaggaauuuaaa

SEQ ID NO: 2756307 - RNA, 21 nt, Human
acuucuuuaauuuuggaauuu

SEQ ID NO: 2756308 - RNA, 12 nt, Human
acuggaacucuc

SEQ ID NO: 2756309 - RNA, 12 nt, Human
acuuuucugaua

SEQ ID NO: 2756310 - RNA, 14 nt, Human
acuagcuauggugu

SEQ ID NO: 2756311 - RNA, 12 nt, Human
acucccuuucaa

SEQ ID NO: 2756312 - RNA, 13 nt, Human
acucccuuucaac

SEQ ID NO: 2756313 - RNA, 15 nt, Human
acuaagagagaauga

SEQ ID NO: 2756314 - RNA, 16 nt, Human
acuaagagagaaugag

SEQ ID NO: 2756315 - RNA, 14 nt, Human
auaauuacuauguc

SEQ ID NO: 2756316 - RNA, 19 nt, Human
auacaauuuuguuucugua

SEQ ID NO: 2756317 - RNA, 20 nt, Human
auacaauuuuguuucuguac

SEQ ID NO: 2756318 - RNA, 20 nt, Human
auaauuaacauguuaaacca

SEQ ID NO: 2756319 - RNA, 21 nt, Human
auaauuaacauguuaaaccau

SEQ ID NO: 2756320 - RNA, 22 nt, Human
auaauuaacauguuaaaccaug

SEQ ID NO: 2756321 - RNA, 17 nt, Human
auaauuaacauguuaaa

SEQ ID NO: 2756322 - RNA, 15 nt, Human
auaucaauuuaaaaa

SEQ ID NO: 2756323 - RNA, 18 nt, Human
auaucacuugucaauaaa

SEQ ID NO: 2756324 - RNA, 23 nt, Human
auaugcuucuguuuuauaauuuu

SEQ ID NO: 2756325 - RNA, 14 nt, Human
auaugcuauuucua

SEQ ID NO: 2756326 - RNA, 18 nt, Human
auauuuauuuuaauaaug

SEQ ID NO: 2756327 - RNA, 14 nt, Human
auauuuauuacugu

SEQ ID NO: 2756328 - RNA, 19 nt, Human
auauuuauuacuguaagaa

SEQ ID NO: 2756329 - RNA, 19 nt, Human
aguuguaccgcaaugugac

SEQ ID NO: 2756330 - RNA, 18 nt, Human
aguuguaccgcaauguga

SEQ ID NO: 2756331 - RNA, 20 nt, Human
aguugaauuuauuggcuuuu

SEQ ID NO: 2756332 - RNA, 11 nt, Human
aguugaauuua

SEQ ID NO: 2756333 - RNA, 13 nt, Human
aguugaauuuauu

SEQ ID NO: 2756334 - RNA, 17 nt, Human
aguugaauuuauuggcu

SEQ ID NO: 2756335 - RNA, 19 nt, Human
aguugaauuuauuggcuuu

SEQ ID NO: 2756336 - RNA, 18 nt, Human
agugauuaccagggacug

SEQ ID NO: 2756337 - RNA, 15 nt, Human
agugauuaccaggga

SEQ ID NO: 2756338 - RNA, 21 nt, Human
agugucuuaauuaaaagaaua

SEQ ID NO: 2756339 - RNA, 13 nt, Human
agucaaauugugu

SEQ ID NO: 2756340 - RNA, 15 nt, Human
agucaaauuguguga

SEQ ID NO: 2756341 - RNA, 17 nt, Human
agucaaauugugugaaa

SEQ ID NO: 2756342 - RNA, 16 nt, Human
aguccaagcauuuaga

SEQ ID NO: 2756343 - RNA, 21 nt, Human
aguccaagcauuuagauguau

SEQ ID NO: 2756344 - RNA, 17 nt, Human
aucagcugcugaaacaa

SEQ ID NO: 2756345 - RNA, 21 nt, Human
aucaccugucuugccuuuuuc

SEQ ID NO: 2756346 - RNA, 12 nt, Human
aucaccugucuu

SEQ ID NO: 2756347 - RNA, 22 nt, Human
aucuuauaauuuaaaauaugcu

SEQ ID NO: 2756348 - RNA, 20 nt, Human
auguaagggaaacugccagc

SEQ ID NO: 2756349 - RNA, 22 nt, Human
auguaagggaaacugccagcaa

SEQ ID NO: 2756350 - RNA, 21 nt, Human
auguaagggaaacugccagca

SEQ ID NO: 2756351 - RNA, 18 nt, Human
auggagccugcacgguga

SEQ ID NO: 2756352 - RNA, 22 nt, Human
auggagccugcacggugaaugg

SEQ ID NO: 2756353 - RNA, 18 nt, Human
agcuucacuguaaaauaa

SEQ ID NO: 2756354 - RNA, 14 nt, Human
aggauguugaaaaa

SEQ ID NO: 2756355 - RNA, 17 nt, Human
agacugcauuauauuua

SEQ ID NO: 2756356 - RNA, 21 nt, Human
agauaggucagugcaaauacu

SEQ ID NO: 2756357 - RNA, 14 nt, Human
agaguguugaaacg

SEQ ID NO: 2756358 - RNA, 21 nt, Human
agccgggcgugguggugagug

SEQ ID NO: 2756359 - RNA, 14 nt, Human
agauguagaggaga

SEQ ID NO: 2756360 - RNA, 21 nt, Human
agaugggagaaucacuugaac

SEQ ID NO: 2756361 - RNA, 21 nt, Human
agcaguugaaaagacuccaaa

SEQ ID NO: 2756362 - RNA, 23 nt, Human
agcaguugaaaagacuccaaaga

SEQ ID NO: 2756363 - RNA, 16 nt, Human
agcaguucagagcugc

SEQ ID NO: 2756364 - RNA, 15 nt, Human
agcaguucagagcug

SEQ ID NO: 2756365 - RNA, 17 nt, Human
agcaguucagagcugcc

SEQ ID NO: 2756366 - RNA, 18 nt, Human
agcaguucagagcugccc

SEQ ID NO: 2756367 - RNA, 19 nt, Human
agcaguucagagcugcccu

SEQ ID NO: 2756368 - RNA, 15 nt, Human
agccagauuuuccug

SEQ ID NO: 2756369 - RNA, 19 nt, Human
agccagauuuuccugaaaa

SEQ ID NO: 2756370 - RNA, 22 nt, Human
agccauguuuauuacaguauaa

SEQ ID NO: 2756371 - RNA, 17 nt, Human
agccauguuuauuacag

SEQ ID NO: 2756372 - RNA, 17 nt, Human
caaggcugauuaaacca

SEQ ID NO: 2756373 - RNA, 21 nt, Human
caagccagauuuuccugaaaa

SEQ ID NO: 2756374 - RNA, 22 nt, Human
caaugugacuuaaugccacuaa

SEQ ID NO: 2756375 - RNA, 23 nt, Human
caauacaucccuuaccugggaaa

SEQ ID NO: 2756376 - RNA, 23 nt, Human
caaaacuucagacauagaauuaa

SEQ ID NO: 2756377 - RNA, 19 nt, Human
caaaaaucucaauauuuca

SEQ ID NO: 2756378 - RNA, 22 nt, Human
caaaaauauuuuaugauccagc

SEQ ID NO: 2756379 - RNA, 23 nt, Human
caaaaauauuuuaugauccagca

SEQ ID NO: 2756380 - RNA, 14 nt, Human
caaaaauauuuuau

SEQ ID NO: 2756381 - RNA, 15 nt, Human
caaaaauauuuuaug

SEQ ID NO: 2756382 - RNA, 17 nt, Human
caaaaauauuuuaugau

SEQ ID NO: 2756383 - RNA, 21 nt, Human
caaaaauauuuuaugauccag

SEQ ID NO: 2756384 - RNA, 13 nt, Human
auuuuccugaaaa

SEQ ID NO: 2756385 - RNA, 17 nt, Human
caaaaacacagcaaggg

SEQ ID NO: 2756386 - RNA, 15 nt, Human
caaaaacacagcaag

SEQ ID NO: 2756387 - RNA, 14 nt, Human
caaaaacacagcaa

SEQ ID NO: 2756388 - RNA, 13 nt, Human
caaaaacacagca

SEQ ID NO: 2756389 - RNA, 19 nt, Human
caaaaaccaguauuguaca

SEQ ID NO: 2756390 - RNA, 20 nt, Human
caaaaaccaguauuguacaa

SEQ ID NO: 2756391 - RNA, 18 nt, Human
caaaaaccaguauuguac

SEQ ID NO: 2756392 - RNA, 21 nt, Human
caaauaugcaaagcacugacu

SEQ ID NO: 2756393 - RNA, 19 nt, Human
caaauaugcaaagcacuga

SEQ ID NO: 2756394 - RNA, 16 nt, Human
caaaauuuuuucucua

SEQ ID NO: 2756395 - RNA, 21 nt, Human
caaaauuuuuucucuaggaaa

SEQ ID NO: 2756396 - RNA, 22 nt, Human
caaaauuuuuucucuaggaaau

SEQ ID NO: 2756397 - RNA, 19 nt, Human
cacaguuuucugagaaaga

SEQ ID NO: 2756398 - RNA, 15 nt, Human
cacaguuuucugaga

SEQ ID NO: 2756399 - RNA, 17 nt, Human
cacaguuuucugagaaa

SEQ ID NO: 2756400 - RNA, 16 nt, Human
cacaguuuucugagaa

SEQ ID NO: 2756401 - RNA, 20 nt, Human
cacuugaacccgggaggcag

SEQ ID NO: 2756402 - RNA, 21 nt, Human
cacuugaacccgggaggcaga

SEQ ID NO: 2756403 - RNA, 23 nt, Human
cacuugaacccgggaggcagagg

SEQ ID NO: 2756404 - RNA, 15 nt, Human
cacuuggucugugag

SEQ ID NO: 2756405 - RNA, 19 nt, Human
cacuguggguagacacaca

SEQ ID NO: 2756406 - RNA, 22 nt, Human
cacuguggguagacacacauga

SEQ ID NO: 2756407 - RNA, 24 nt, Human
cacuguggguagacacacaugaag

SEQ ID NO: 2756408 - RNA, 14 nt, Human
cacugucaagauga

SEQ ID NO: 2756409 - RNA, 20 nt, Human
cacugacuucuaaguaaaac

SEQ ID NO: 2756410 - RNA, 16 nt, Human
cacugacuucuaagua

SEQ ID NO: 2756411 - RNA, 15 nt, Human
cacugacuucuaagu

SEQ ID NO: 2756412 - RNA, 14 nt, Human
cacugacuucuaag

SEQ ID NO: 2756413 - RNA, 21 nt, Human
cacugacuucuaaguaaaacc

SEQ ID NO: 2756414 - RNA, 21 nt, Human
cacugauuugacauagucugg

SEQ ID NO: 2756415 - RNA, 23 nt, Human
cacugauuugacauagucuggcu

SEQ ID NO: 2756416 - RNA, 20 nt, Human
cacugccuucucaacuccaa

SEQ ID NO: 2756417 - RNA, 22 nt, Human
cacguucuuacuaguuucccuu

SEQ ID NO: 2756418 - RNA, 13 nt, Human
cacuaaacaaaga

SEQ ID NO: 2756419 - RNA, 20 nt, Human
cacggugaauggcuuuguau

SEQ ID NO: 2756420 - RNA, 23 nt, Human
cacggugaauggcuuuguauaga

SEQ ID NO: 2756421 - RNA, 20 nt, Human
cacgagcaggcuacugucag

SEQ ID NO: 2756422 - RNA, 19 nt, Human
cacgagcaggcuacuguca

SEQ ID NO: 2756423 - RNA, 17 nt, Human
cacgagcaggcuacugu

SEQ ID NO: 2756424 - RNA, 22 nt, Human
cacgagcaggcuacugucagcu

SEQ ID NO: 2756425 - RNA, 17 nt, Human
caccugucuugccuuuu

SEQ ID NO: 2756426 - RNA, 20 nt, Human
caccugucuugccuuuuuca

SEQ ID NO: 2756427 - RNA, 16 nt, Human
cacucaaaucaagaaa

SEQ ID NO: 2756428 - RNA, 21 nt, Human
cacuaaauugacacuuaaaaa

SEQ ID NO: 2756429 - RNA, 17 nt, Human
cacuaagagagaaugag

SEQ ID NO: 2756430 - RNA, 14 nt, Human
cacuaguauuucua

SEQ ID NO: 2756431 - RNA, 19 nt, Human
cacuaguauuucuaugaaa

SEQ ID NO: 2756432 - RNA, 15 nt, Human
cacucuccauuuaau

SEQ ID NO: 2756433 - RNA, 17 nt, Human
cacucuccauuuaauaa

SEQ ID NO: 2756434 - RNA, 13 nt, Human
caccucccugcaa

SEQ ID NO: 2756435 - RNA, 14 nt, Human
caccucccugcaau

SEQ ID NO: 2756436 - RNA, 10 nt, Human
caccucccug

SEQ ID NO: 2756437 - RNA, 11 nt, Human
caccucaugga

SEQ ID NO: 2756438 - RNA, 12 nt, Human
caccucauggaa

SEQ ID NO: 2756439 - RNA, 14 nt, Human
caccucauggaauu

SEQ ID NO: 2756440 - RNA, 17 nt, Human
cagacauagaauuaaca

SEQ ID NO: 2756441 - RNA, 19 nt, Human
cagacauagaauuaacaca

SEQ ID NO: 2756442 - RNA, 19 nt, Human
cagaagcaacccaaauguu

SEQ ID NO: 2756443 - RNA, 20 nt, Human
cagaagcaacccaaauguuc

SEQ ID NO: 2756444 - RNA, 18 nt, Human
cagaaagcagaacaguga

SEQ ID NO: 2756445 - RNA, 23 nt, Human
cagaacagugauuaccagggacu

SEQ ID NO: 2756446 - RNA, 18 nt, Human
cagaacagugauuaccag

SEQ ID NO: 2756447 - RNA, 19 nt, Human
cagaaagcagaacagugau

SEQ ID NO: 2756448 - RNA, 14 nt, Human
cagauaaucacaau

SEQ ID NO: 2756449 - RNA, 14 nt, Human
cagauaaacaguag

SEQ ID NO: 2756450 - RNA, 23 nt, Human
cagauaaauaguuuaugauucca

SEQ ID NO: 2756451 - RNA, 14 nt, Human
cagauccuggaaau

SEQ ID NO: 2756452 - RNA, 13 nt, Human
cagauccuggaaa

SEQ ID NO: 2756453 - RNA, 19 nt, Human
cagaucugccuaaggacuu

SEQ ID NO: 2756454 - RNA, 20 nt, Human
cagaucugccuaaggacuuc

SEQ ID NO: 2756455 - RNA, 21 nt, Human
cagaucugccuaaggacuucu

SEQ ID NO: 2756456 - RNA, 23 nt, Human
cagaucugccuaaggacuucuuu

SEQ ID NO: 2756457 - RNA, 16 nt, Human
cagaucugccuaagga

SEQ ID NO: 2756458 - RNA, 17 nt, Human
cagaucugccuaaggac

SEQ ID NO: 2756459 - RNA, 14 nt, Human
cagaucugccuaag

SEQ ID NO: 2756460 - RNA, 16 nt, Human
caggaaguagaggagg

SEQ ID NO: 2756461 - RNA, 15 nt, Human
caggaaguagaggag

SEQ ID NO: 2756462 - RNA, 17 nt, Human
caggaauggagccugca

SEQ ID NO: 2756463 - RNA, 23 nt, Human
caggaauggagccugcacgguga

SEQ ID NO: 2756464 - RNA, 18 nt, Human
cagcuugaaacugagaug

SEQ ID NO: 2756465 - RNA, 23 nt, Human
cagcuuuccucaaaacuucagac

SEQ ID NO: 2756466 - RNA, 18 nt, Human
caggaaccacaagacugc

SEQ ID NO: 2756467 - RNA, 18 nt, Human
cagcuguaugauucccag

SEQ ID NO: 2756468 - RNA, 19 nt, Human
cagcuggugcccugcuuuc

SEQ ID NO: 2756469 - RNA, 20 nt, Human
cagcuggugcccugcuuuca

SEQ ID NO: 2756470 - RNA, 21 nt, Human
cagcuggugcccugcuuucag

SEQ ID NO: 2756471 - RNA, 23 nt, Human
cagcuggugcccugcuuucagau

SEQ ID NO: 2756472 - RNA, 18 nt, Human
cagcuggugcccugcuuu

SEQ ID NO: 2756473 - RNA, 21 nt, Human
cagcugcugaaacaacaaaua

SEQ ID NO: 2756474 - RNA, 20 nt, Human
cagcugcugaaacaacaaau

SEQ ID NO: 2756475 - RNA, 20 nt, Human
cagcucugcauacucauuag

SEQ ID NO: 2756476 - RNA, 16 nt, Human
cagccuaguugaucag

SEQ ID NO: 2756477 - RNA, 19 nt, Human
cagcuacuugggaggcuga

SEQ ID NO: 2756478 - RNA, 23 nt, Human
cagcaacgcaggcccccaggugc

SEQ ID NO: 2756479 - RNA, 14 nt, Human
cagauuuuccugaa

SEQ ID NO: 2756480 - RNA, 15 nt, Human
cagauuuuccugaaa

SEQ ID NO: 2756481 - RNA, 17 nt, Human
cagcaaaaauauuuuau

SEQ ID NO: 2756482 - RNA, 13 nt, Human
cagauuuuauuau

SEQ ID NO: 2756483 - RNA, 15 nt, Human
cagauuuuauuaugu

SEQ ID NO: 2756484 - RNA, 16 nt, Human
cagauuuuauuaugua

SEQ ID NO: 2756485 - RNA, 18 nt, Human
cagauuuuauuauguaaa

SEQ ID NO: 2756486 - RNA, 20 nt, Human
cagauuuuauuauguaaauc

SEQ ID NO: 2756487 - RNA, 21 nt, Human
cagauuuuauuauguaaaucc

SEQ ID NO: 2756488 - RNA, 22 nt, Human
cagauuuuauuauguaaauccc

SEQ ID NO: 2756489 - RNA, 12 nt, Human
cagauuauucac

SEQ ID NO: 2756490 - RNA, 18 nt, Human
cagauuauucacugauuu

SEQ ID NO: 2756491 - RNA, 23 nt, Human
cagauuauucacugauuugacau

SEQ ID NO: 2756492 - RNA, 23 nt, Human
cagcaagggugaugggaaagcau

SEQ ID NO: 2756493 - RNA, 22 nt, Human
cagcaagggugaugggaaagca

SEQ ID NO: 2756494 - RNA, 19 nt, Human
cagcaagggugaugggaaa

SEQ ID NO: 2756495 - RNA, 15 nt, Human
cagcagauuauucac

SEQ ID NO: 2756496 - RNA, 19 nt, Human
cagcagauuauucacugau

SEQ ID NO: 2756497 - RNA, 14 nt, Human
cagcagauuauuca

SEQ ID NO: 2756498 - RNA, 13 nt, Human
caggcuagaugua

SEQ ID NO: 2756499 - RNA, 19 nt, Human
caggcuagauguauguacu

SEQ ID NO: 2756500 - RNA, 14 nt, Human
caggcuacugucag

SEQ ID NO: 2756501 - RNA, 11 nt, Human
caggggacagg

SEQ ID NO: 2756502 - RNA, 16 nt, Human
caggggacaggauggu

SEQ ID NO: 2756503 - RNA, 17 nt, Human
cagggcauggcugggaa

SEQ ID NO: 2756504 - RNA, 18 nt, Human
cagggacaggauaagagg

SEQ ID NO: 2756505 - RNA, 19 nt, Human
caggcccccaggugccagu

SEQ ID NO: 2756506 - RNA, 14 nt, Human
caggcccccaggug

SEQ ID NO: 2756507 - RNA, 20 nt, Human
caggcccccaggugccaguu

SEQ ID NO: 2756508 - RNA, 16 nt, Human
caggauuuuaaucuuu

SEQ ID NO: 2756509 - RNA, 21 nt, Human
caggaugguucccuugaugaa

SEQ ID NO: 2756510 - RNA, 23 nt, Human
caggaugguucccuugaugaaga

SEQ ID NO: 2756511 - RNA, 18 nt, Human
cagugauuaccagggacu

SEQ ID NO: 2756512 - RNA, 17 nt, Human
cagugauuaccagggac

SEQ ID NO: 2756513 - RNA, 20 nt, Human
cagugaaagaaaauaacaau

SEQ ID NO: 2756514 - RNA, 16 nt, Human
cagugaaagaaaauaa

SEQ ID NO: 2756515 - RNA, 15 nt, Human
cagugagacagcucu

SEQ ID NO: 2756516 - RNA, 12 nt, Human
caguauggcagc

SEQ ID NO: 2756517 - RNA, 12 nt, Human
caguagugauag

SEQ ID NO: 2756518 - RNA, 14 nt, Human
caguauaauuaaca

SEQ ID NO: 2756519 - RNA, 15 nt, Human
caguauaauuaacau

SEQ ID NO: 2756520 - RNA, 17 nt, Human
caguauaauuaacaugu

SEQ ID NO: 2756521 - RNA, 21 nt, Human
caguauaauuaacauguuaaa

SEQ ID NO: 2756522 - RNA, 22 nt, Human
cagucaggaaagagaacuucca

SEQ ID NO: 2756523 - RNA, 15 nt, Human
cagucaggaaagaga

SEQ ID NO: 2756524 - RNA, 18 nt, Human
cagucaggaaagagaacu

SEQ ID NO: 2756525 - RNA, 13 nt, Human
caguccaugaaga

SEQ ID NO: 2756526 - RNA, 22 nt, Human
cauuccaacuaucucauuucca

SEQ ID NO: 2756527 - RNA, 18 nt, Human
cauuauucaaaguugccu

SEQ ID NO: 2756528 - RNA, 21 nt, Human
cauuauucaaaguugccuaaa

SEQ ID NO: 2756529 - RNA, 22 nt, Human
cauuauucaaaguugccuaaau

SEQ ID NO: 2756530 - RNA, 16 nt, Human
cauuauucaaaguugc

SEQ ID NO: 2756531 - RNA, 17 nt, Human
cauuauuuuauuaugaa

SEQ ID NO: 2756532 - RNA, 13 nt, Human
cauucuggaauaa

SEQ ID NO: 2756533 - RNA, 21 nt, Human
cauuguaaaugugcuuuuaaa

SEQ ID NO: 2756534 - RNA, 17 nt, Human
cauuuggaaaucuuuaa

SEQ ID NO: 2756535 - RNA, 18 nt, Human
cauuuggaaaucuuuaaa

SEQ ID NO: 2756536 - RNA, 11 nt, Human
cauuuggaaau

SEQ ID NO: 2756537 - RNA, 20 nt, Human
caugugcuaguaauuggaaa

SEQ ID NO: 2756538 - RNA, 13 nt, Human
cauguuaaaccau

SEQ ID NO: 2756539 - RNA, 22 nt, Human
cauguuaaaccaugggauaaau

SEQ ID NO: 2756540 - RNA, 23 nt, Human
cauguuuauuacaguauaauuaa

SEQ ID NO: 2756541 - RNA, 20 nt, Human
cauggaauuggagcucgugg

SEQ ID NO: 2756542 - RNA, 23 nt, Human
caugggacagggaggacgcucuc

SEQ ID NO: 2756543 - RNA, 18 nt, Human
caugggauaaaugccauc

SEQ ID NO: 2756544 - RNA, 23 nt, Human
caugggauaaaugccaucaauaa

SEQ ID NO: 2756545 - RNA, 16 nt, Human
caugggauaaaugcca

SEQ ID NO: 2756546 - RNA, 17 nt, Human
caugggauaaaugccau

SEQ ID NO: 2756547 - RNA, 20 nt, Human
caucccucccuccaccuccc

SEQ ID NO: 2756548 - RNA, 18 nt, Human
caucccuuaccugggaaa

SEQ ID NO: 2756549 - RNA, 22 nt, Human
caucccucccuccaccucccug

SEQ ID NO: 2756550 - RNA, 23 nt, Human
caucccucccuccaccucccugc

SEQ ID NO: 2756551 - RNA, 13 nt, Human
cauauauaacaau

SEQ ID NO: 2756552 - RNA, 19 nt, Human
cauagucuggcuguaccca

SEQ ID NO: 2756553 - RNA, 15 nt, Human
cauauauaacaaugc

SEQ ID NO: 2756554 - RNA, 18 nt, Human
cauauauuuuuauauuua

SEQ ID NO: 2756555 - RNA, 20 nt, Human
cauauauuuuuauauuuacu

SEQ ID NO: 2756556 - RNA, 21 nt, Human
cauauauuuuuauauuuacua

SEQ ID NO: 2756557 - RNA, 19 nt, Human
caugaagauguagaggaga

SEQ ID NO: 2756558 - RNA, 18 nt, Human
caugaagauguagaggag

SEQ ID NO: 2756559 - RNA, 16 nt, Human
caugagguacugagag

SEQ ID NO: 2756560 - RNA, 19 nt, Human
caugagguacugagaguga

SEQ ID NO: 2756561 - RNA, 14 nt, Human
ccaccucccugcaa

SEQ ID NO: 2756562 - RNA, 13 nt, Human
ccagcaguucaga

SEQ ID NO: 2756563 - RNA, 18 nt, Human
ccagcaguucagagcugc

SEQ ID NO: 2756564 - RNA, 19 nt, Human
ccagcaguucagagcugcc

SEQ ID NO: 2756565 - RNA, 20 nt, Human
ccagcaguucagagcugccc

SEQ ID NO: 2756566 - RNA, 21 nt, Human
ccagcaguucagagcugcccu

SEQ ID NO: 2756567 - RNA, 22 nt, Human
ccagcaguucagagcugcccuc

SEQ ID NO: 2756568 - RNA, 23 nt, Human
ccagcaguucagagcugcccucu

SEQ ID NO: 2756569 - RNA, 22 nt, Human
ccagccagcaguucagagcugc

SEQ ID NO: 2756570 - RNA, 16 nt, Human
ccaugggacagggagg

SEQ ID NO: 2756571 - RNA, 19 nt, Human
ccaugggacagggaggacg

SEQ ID NO: 2756572 - RNA, 13 nt, Human
ccaugggauaaau

SEQ ID NO: 2756573 - RNA, 13 nt, Human
ccauguuuauuac

SEQ ID NO: 2756574 - RNA, 20 nt, Human
ccauguuuauuacaguauaa

SEQ ID NO: 2756575 - RNA, 14 nt, Human
ccauuauucaaagu

SEQ ID NO: 2756576 - RNA, 17 nt, Human
ccauuauucaaaguugc

SEQ ID NO: 2756577 - RNA, 22 nt, Human
ccauuauucaaaguugccuaaa

SEQ ID NO: 2756578 - RNA, 21 nt, Human
ccaguuauggcuauaggugcu

SEQ ID NO: 2756579 - RNA, 14 nt, Human
ccaguuauggcuau

SEQ ID NO: 2756580 - RNA, 19 nt, Human
ccuuggggcugaugcaguu

SEQ ID NO: 2756581 - RNA, 14 nt, Human
ccuugaugaagaag

SEQ ID NO: 2756582 - RNA, 20 nt, Human
ccuugaaaacuuuaugcuaa

SEQ ID NO: 2756583 - RNA, 14 nt, Human
ccuucggccuccau

SEQ ID NO: 2756584 - RNA, 19 nt, Human
ccuucggccuccauccuga

SEQ ID NO: 2756585 - RNA, 20 nt, Human
ccuucggccuccauccugag

SEQ ID NO: 2756586 - RNA, 21 nt, Human
ccuguuaaaagaugaaaauau

SEQ ID NO: 2756587 - RNA, 20 nt, Human
ccuguuaaaagaugaaaaua

SEQ ID NO: 2756588 - RNA, 18 nt, Human
cgagcaggcuacugucag

SEQ ID NO: 2756589 - RNA, 16 nt, Human
ccugcaauaaaauggg

SEQ ID NO: 2756590 - RNA, 21 nt, Human
ccugcacggugaauggcuuug

SEQ ID NO: 2756591 - RNA, 20 nt, Human
ccugcacggugaauggcuuu

SEQ ID NO: 2756592 - RNA, 11 nt, Human
ccugagcccca

SEQ ID NO: 2756593 - RNA, 23 nt, Human
ccuggaaaucaggguuaguauug

SEQ ID NO: 2756594 - RNA, 22 nt, Human
ccugggcagcugccuccccucc

SEQ ID NO: 2756595 - RNA, 15 nt, Human
cccgugggguuccuc

SEQ ID NO: 2756596 - RNA, 11 nt, Human
cccucuccugg

SEQ ID NO: 2756597 - RNA, 12 nt, Human
cccucuccuggg

SEQ ID NO: 2756598 - RNA, 13 nt, Human
cccucuccugggc

SEQ ID NO: 2756599 - RNA, 14 nt, Human
cccucuccugggca

SEQ ID NO: 2756600 - RNA, 15 nt, Human
cccucuccugggcag

SEQ ID NO: 2756601 - RNA, 19 nt, Human
cccuccaccucccugcaau

SEQ ID NO: 2756602 - RNA, 15 nt, Human
cccuccaccucccug

SEQ ID NO: 2756603 - RNA, 17 nt, Human
cccuccaccucccugca

SEQ ID NO: 2756604 - RNA, 14 nt, Human
cccuccaccucccu

SEQ ID NO: 2756605 - RNA, 12 nt, Human
cccuccaccucc

SEQ ID NO: 2756606 - RNA, 14 nt, Human
cccugcuuucagau

SEQ ID NO: 2756607 - RNA, 17 nt, Human
cccugcuuucagauacu

SEQ ID NO: 2756608 - RNA, 20 nt, Human
cccacaagaaaugaaagcag

SEQ ID NO: 2756609 - RNA, 13 nt, Human
cccacaagaaaug

SEQ ID NO: 2756610 - RNA, 16 nt, Human
ccgggcguggugguga

SEQ ID NO: 2756611 - RNA, 15 nt, Human
ccgugcuaaggacuu

SEQ ID NO: 2756612 - RNA, 16 nt, Human
ccgugcuaaggacuug

SEQ ID NO: 2756613 - RNA, 14 nt, Human
ccgugcuaaggacu

SEQ ID NO: 2756614 - RNA, 12 nt, Human
ccuaaauccauu

SEQ ID NO: 2756615 - RNA, 17 nt, Human
ccuaaauccauuuggaa

SEQ ID NO: 2756616 - RNA, 13 nt, Human
ccuccaccucccu

SEQ ID NO: 2756617 - RNA, 14 nt, Human
ccuccaccucccug

SEQ ID NO: 2756618 - RNA, 15 nt, Human
ccuccaccucccugc

SEQ ID NO: 2756619 - RNA, 17 nt, Human
ccuccaccucccugcaa

SEQ ID NO: 2756620 - RNA, 22 nt, Human
ccuccaccucccugcaauaaaa

SEQ ID NO: 2756621 - RNA, 14 nt, Human
ccuccauccugagg

SEQ ID NO: 2756622 - RNA, 16 nt, Human
ccuccucugcuugcca

SEQ ID NO: 2756623 - RNA, 13 nt, Human
ccuccucugcuug

SEQ ID NO: 2756624 - RNA, 18 nt, Human
ccuccucugcuugccauc

SEQ ID NO: 2756625 - RNA, 20 nt, Human
ccucccuccaccucccugca

SEQ ID NO: 2756626 - RNA, 17 nt, Human
ccucccuccaccucccu

SEQ ID NO: 2756627 - RNA, 19 nt, Human
cuucggccuccauccugag

SEQ ID NO: 2756628 - RNA, 20 nt, Human
cuucggccuccauccugagg

SEQ ID NO: 2756629 - RNA, 20 nt, Human
cuuccuuggacucauuuuaa

SEQ ID NO: 2756630 - RNA, 15 nt, Human
cuucagccugaaaga

SEQ ID NO: 2756631 - RNA, 20 nt, Human
cuucagcaaaaauauuuuau

SEQ ID NO: 2756632 - RNA, 23 nt, Human
cuucagcaaaaauauuuuaugau

SEQ ID NO: 2756633 - RNA, 17 nt, Human
cuucaaauccuugaaga

SEQ ID NO: 2756634 - RNA, 14 nt, Human
cuucacaacagauu

SEQ ID NO: 2756635 - RNA, 12 nt, Human
cuucacaacaga

SEQ ID NO: 2756636 - RNA, 17 nt, Human
cuucagcaaaaauauuu

SEQ ID NO: 2756637 - RNA, 15 nt, Human
cuguuuuauaauuuu

SEQ ID NO: 2756638 - RNA, 14 nt, Human
cuguuuuauaauuu

SEQ ID NO: 2756639 - RNA, 17 nt, Human
cuuaauuaaaagaauau

SEQ ID NO: 2756640 - RNA, 16 nt, Human
cuuaauuaaaagaaua

SEQ ID NO: 2756641 - RNA, 20 nt, Human
cuuaauuaaaagaauauuuu

SEQ ID NO: 2756642 - RNA, 19 nt, Human
cuuaauuaaaagaauauuu

SEQ ID NO: 2756643 - RNA, 21 nt, Human
cuuaagaagacugcauuauau

SEQ ID NO: 2756644 - RNA, 23 nt, Human
cuuaagaagacugcauuauauuu

SEQ ID NO: 2756645 - RNA, 16 nt, Human
cuguuaaaagaugaaa

SEQ ID NO: 2756646 - RNA, 15 nt, Human
cuguuaaaagaugaa

SEQ ID NO: 2756647 - RNA, 19 nt, Human
cuguuaaaagaugaaaaua

SEQ ID NO: 2756648 - RNA, 15 nt, Human
cuguggugacuuugg

SEQ ID NO: 2756649 - RNA, 17 nt, Human
cuguggugacuuuggau

SEQ ID NO: 2756650 - RNA, 18 nt, Human
cuguggugacuuuggaua

SEQ ID NO: 2756651 - RNA, 20 nt, Human
cuguggugacuuuggauaau

SEQ ID NO: 2756652 - RNA, 23 nt, Human
cuguggugacuuuggauaauaag

SEQ ID NO: 2756653 - RNA, 13 nt, Human
cuguggugacuuu

SEQ ID NO: 2756654 - RNA, 14 nt, Human
cuguggugacuuug

SEQ ID NO: 2756655 - RNA, 12 nt, Human
cuguggugacuu

SEQ ID NO: 2756656 - RNA, 18 nt, Human
cugucuucacaacagauu

SEQ ID NO: 2756657 - RNA, 21 nt, Human
cugucuugccuuuuucauuau

SEQ ID NO: 2756658 - RNA, 23 nt, Human
cugucuugccuuuuucauuauuu

SEQ ID NO: 2756659 - RNA, 14 nt, Human
cugggguuaucuga

SEQ ID NO: 2756660 - RNA, 15 nt, Human
cugguguauguguga

SEQ ID NO: 2756661 - RNA, 21 nt, Human
gaacuagaguuuagcuggaaa

SEQ ID NO: 2756662 - RNA, 22 nt, Human
gaacuagaguuuagcuggaaaa

SEQ ID NO: 2756663 - RNA, 16 nt, Human
gaacgcguugaaauug

SEQ ID NO: 2756664 - RNA, 15 nt, Human
gaacgcguugaaauu

SEQ ID NO: 2756665 - RNA, 14 nt, Human
gaacucccuuucaa

SEQ ID NO: 2756666 - RNA, 22 nt, Human
gaacuuccagauccuggaaauc

SEQ ID NO: 2756667 - RNA, 21 nt, Human
gaacuuguaaaggaauuuaaa

SEQ ID NO: 2756668 - RNA, 21 nt, Human
gaagaagcaccaaucaugaau

SEQ ID NO: 2756669 - RNA, 13 nt, Human
gaaauauuauguu

SEQ ID NO: 2756670 - RNA, 16 nt, Human
gaaauauuauguuaaa

SEQ ID NO: 2756671 - RNA, 18 nt, Human
gaaauuguauuacaaauc

SEQ ID NO: 2756672 - RNA, 21 nt, Human
gaagccuuggggcugaugcag

SEQ ID NO: 2756673 - RNA, 14 nt, Human
gaauacuuuauaaa

SEQ ID NO: 2756674 - RNA, 20 nt, Human
gaauaauccuaaacauauga

SEQ ID NO: 2756675 - RNA, 20 nt, Human
gaaaaucuuauaauuuaaaa

SEQ ID NO: 2756676 - RNA, 19 nt, Human
gaaaauaacgauaaaagac

SEQ ID NO: 2756677 - RNA, 19 nt, Human
gaaaaucuuauaauuuaaa

SEQ ID NO: 2756678 - RNA, 12 nt, Human
gaaaauaucacu

SEQ ID NO: 2756679 - RNA, 22 nt, Human
gaaaacaauaacgauaaaagac

SEQ ID NO: 2756680 - RNA, 11 nt, Human
cuuuucugaua

SEQ ID NO: 2756681 - RNA, 14 nt, Human
cuuuucugauagag

SEQ ID NO: 2756682 - RNA, 18 nt, Human
cuuuaaagggauggcaag

SEQ ID NO: 2756683 - RNA, 21 nt, Human
cuuuauuuucuauaauuuaaa

SEQ ID NO: 2756684 - RNA, 13 nt, Human
cuuuccacagaag

SEQ ID NO: 2756685 - RNA, 19 nt, Human
cuuguaaaggaauuuaaaa

SEQ ID NO: 2756686 - RNA, 22 nt, Human
cuugccaucccucccuccaccu

SEQ ID NO: 2756687 - RNA, 21 nt, Human
cuugccaucccucccuccacc

SEQ ID NO: 2756688 - RNA, 20 nt, Human
cuccccuccucugcuugcca

SEQ ID NO: 2756689 - RNA, 13 nt, Human
cuccauccugagg

SEQ ID NO: 2756690 - RNA, 11 nt, Human
cuccccuccuc

SEQ ID NO: 2756691 - RNA, 13 nt, Human
cuccccuccucug

SEQ ID NO: 2756692 - RNA, 12 nt, Human
cuccauccugag

SEQ ID NO: 2756693 - RNA, 11 nt, Human
cuccauccuga

SEQ ID NO: 2756694 - RNA, 23 nt, Human
cuccaccucccugcaauaaaaug

SEQ ID NO: 2756695 - RNA, 21 nt, Human
cuccaaacugacucuuaagaa

SEQ ID NO: 2756696 - RNA, 12 nt, Human
cuccaaagaaau

SEQ ID NO: 2756697 - RNA, 13 nt, Human
cuccaaagaaaug

SEQ ID NO: 2756698 - RNA, 21 nt, Human
cucauuuccaagcaaguauua

SEQ ID NO: 2756699 - RNA, 15 nt, Human
cuauaggugcuacaa

SEQ ID NO: 2756700 - RNA, 20 nt, Human
cuauaggugcuacaaaaaca

SEQ ID NO: 2756701 - RNA, 22 nt, Human
cuauaggugcuacaaaaacaca

SEQ ID NO: 2756702 - RNA, 21 nt, Human
cuauaggugcuacaaaaacac

SEQ ID NO: 2756703 - RNA, 19 nt, Human
cuauauuuucauucuccua

SEQ ID NO: 2756704 - RNA, 15 nt, Human
cuauauuuucauucu

SEQ ID NO: 2756705 - RNA, 16 nt, Human
cuauucaaacagucuc

SEQ ID NO: 2756706 - RNA, 18 nt, Human
cuauucaaacagucucag

SEQ ID NO: 2756707 - RNA, 23 nt, Human
cuauucaaacagucucaggaaau

SEQ ID NO: 2756708 - RNA, 18 nt, Human
cuaugcugaguuugugcu

SEQ ID NO: 2756709 - RNA, 21 nt, Human
cuagugagcagucaggaaaga

SEQ ID NO: 2756710 - RNA, 19 nt, Human
cuagugaaagaggcagcuu

SEQ ID NO: 2756711 - RNA, 18 nt, Human
cuagugaaagaggcagcu

SEQ ID NO: 2756712 - RNA, 20 nt, Human
cuagugaaacucguuaauuu

SEQ ID NO: 2756713 - RNA, 16 nt, Human
cuaguaauuggaaagg

SEQ ID NO: 2756714 - RNA, 15 nt, Human
cucagauuuuauuau

SEQ ID NO: 2756715 - RNA, 17 nt, Human
cucagauuuuauuaugu

SEQ ID NO: 2756716 - RNA, 18 nt, Human
cucagauuuuauuaugua

SEQ ID NO: 2756717 - RNA, 13 nt, Human
cucagauuuuauu

SEQ ID NO: 2756718 - RNA, 16 nt, Human
cuauuucuauauuuuc

SEQ ID NO: 2756719 - RNA, 18 nt, Human
cuauuucuauauuuucau

SEQ ID NO: 2756720 - RNA, 14 nt, Human
cuauuucuauauuu

SEQ ID NO: 2756721 - RNA, 15 nt, Human
cugcaauaaaauggg

SEQ ID NO: 2756722 - RNA, 22 nt, Human
cugcaauaaaauggguuuuacu

SEQ ID NO: 2756723 - RNA, 21 nt, Human
cugauuugacauagucuggcu

SEQ ID NO: 2756724 - RNA, 22 nt, Human
cugauuugacauagucuggcug

SEQ ID NO: 2756725 - RNA, 23 nt, Human
cugauuugacauagucuggcugu

SEQ ID NO: 2756726 - RNA, 21 nt, Human
cugaggcuccacuuggucugu

SEQ ID NO: 2756727 - RNA, 15 nt, Human
cugaggcuccacuug

SEQ ID NO: 2756728 - RNA, 13 nt, Human
cugaguuugugcu

SEQ ID NO: 2756729 - RNA, 18 nt, Human
cugaguuugugcuggugu

SEQ ID NO: 2756730 - RNA, 20 nt, Human
cugcaucagcugcugaaaca

SEQ ID NO: 2756731 - RNA, 23 nt, Human
cucuuugucuacaccauuaugug

SEQ ID NO: 2756732 - RNA, 18 nt, Human
cugagaaagacuauucaa

SEQ ID NO: 2756733 - RNA, 15 nt, Human
cugagaaagacuauu

SEQ ID NO: 2756734 - RNA, 13 nt, Human
cugagaaagacua

SEQ ID NO: 2756735 - RNA, 12 nt, Human
cugagaaagacu

SEQ ID NO: 2756736 - RNA, 21 nt, Human
cugagaugugaacacaucagc

SEQ ID NO: 2756737 - RNA, 20 nt, Human
cugagaaagacuauucaaac

SEQ ID NO: 2756738 - RNA, 19 nt, Human
cugagaaagacuauucaaa

SEQ ID NO: 2756739 - RNA, 20 nt, Human
cugagaugugaacacaucag

SEQ ID NO: 2756740 - RNA, 16 nt, Human
cugagaugugaacaca

SEQ ID NO: 2756741 - RNA, 16 nt, Human
cugagcaggauuuuaa

SEQ ID NO: 2756742 - RNA, 22 nt, Human
cucuggccuucggccuccaucc

SEQ ID NO: 2756743 - RNA, 21 nt, Human
cucuggccuucggccuccauc

SEQ ID NO: 2756744 - RNA, 13 nt, Human
cucuuaagaagac

SEQ ID NO: 2756745 - RNA, 19 nt, Human
cucuuaagaagacugcauu

SEQ ID NO: 2756746 - RNA, 14 nt, Human
gagcugcccucucc

SEQ ID NO: 2756747 - RNA, 15 nt, Human
gagcugcccucuccu

SEQ ID NO: 2756748 - RNA, 16 nt, Human
gagcugcccucuccug

SEQ ID NO: 2756749 - RNA, 14 nt, Human
gagcuacaaaugca

SEQ ID NO: 2756750 - RNA, 13 nt, Human
gagcuacaaaugc

SEQ ID NO: 2756751 - RNA, 12 nt, Human
gagcuacaaaug

SEQ ID NO: 2756752 - RNA, 17 nt, Human
gagccugcacggugaau

SEQ ID NO: 2756753 - RNA, 22 nt, Human
gagccugcacggugaauggcuu

SEQ ID NO: 2756754 - RNA, 23 nt, Human
gagccugcacggugaauggcuuu

SEQ ID NO: 2756755 - RNA, 21 nt, Human
gagcaggcuacugucagcucc

SEQ ID NO: 2756756 - RNA, 19 nt, Human
gaggcagagguugcaguga

SEQ ID NO: 2756757 - RNA, 16 nt, Human
gaggaauucuguauag

SEQ ID NO: 2756758 - RNA, 17 nt, Human
gaggaauucuguauaga

SEQ ID NO: 2756759 - RNA, 14 nt, Human
gaggaauucuguau

SEQ ID NO: 2756760 - RNA, 14 nt, Human
gaucuuuaaaauac

SEQ ID NO: 2756761 - RNA, 13 nt, Human
gaucuuuaaaaua

SEQ ID NO: 2756762 - RNA, 16 nt, Human
gaugggaaagcauugu

SEQ ID NO: 2756763 - RNA, 18 nt, Human
gaugcaguucugaagaag

SEQ ID NO: 2756764 - RNA, 13 nt, Human
gauugugccccug

SEQ ID NO: 2756765 - RNA, 21 nt, Human
gaguugaaaaucuuauaauuu

SEQ ID NO: 2756766 - RNA, 19 nt, Human
gagugaacaaauuuacaga

SEQ ID NO: 2756767 - RNA, 22 nt, Human
gagugaacaaauuuacagagac

SEQ ID NO: 2756768 - RNA, 19 nt, Human
gagugucuuaauuaaaaga

SEQ ID NO: 2756769 - RNA, 13 nt, Human
gauagcagggcau

SEQ ID NO: 2756770 - RNA, 15 nt, Human
gauagaggaagccug

SEQ ID NO: 2756771 - RNA, 21 nt, Human
gauagaggaagccugauuaaa

SEQ ID NO: 2756772 - RNA, 22 nt, Human
gauagaggaagccugauuaaag

SEQ ID NO: 2756773 - RNA, 14 nt, Human
gauagaggaagccu

SEQ ID NO: 2756774 - RNA, 22 nt, Human
gccaugggacagggaggacgcu

SEQ ID NO: 2756775 - RNA, 23 nt, Human
gccaugggacagggaggacgcuc

SEQ ID NO: 2756776 - RNA, 18 nt, Human
gccagacuggcacaguuu

SEQ ID NO: 2756777 - RNA, 15 nt, Human
gccagacuggcacag

SEQ ID NO: 2756778 - RNA, 19 nt, Human
gccagacuggcacaguuuu

SEQ ID NO: 2756779 - RNA, 18 nt, Human
gcagagguugcagugagc

SEQ ID NO: 2756780 - RNA, 23 nt, Human
gcagagguugcagugagccgaga

SEQ ID NO: 2756781 - RNA, 13 nt, Human
gcagauuauucac

SEQ ID NO: 2756782 - RNA, 15 nt, Human
gcacagccucuuaga

SEQ ID NO: 2756783 - RNA, 18 nt, Human
gcacagccucuuagaugc

SEQ ID NO: 2756784 - RNA, 19 nt, Human
gcacuguggguagacacac

SEQ ID NO: 2756785 - RNA, 23 nt, Human
gcaucagcugcugaaacaacaaa

SEQ ID NO: 2756786 - RNA, 22 nt, Human
gcaucagcugcugaaacaacaa

SEQ ID NO: 2756787 - RNA, 20 nt, Human
gcaucuagcaugucgucaaa

SEQ ID NO: 2756788 - RNA, 15 nt, Human
gcaguugaaaagacu

SEQ ID NO: 2756789 - RNA, 19 nt, Human
gcaguugaaaagacuccaa

SEQ ID NO: 2756790 - RNA, 16 nt, Human
gcaguugaaaagacuc

SEQ ID NO: 2756791 - RNA, 21 nt, Human
gcaguugaaaagacuccaaag

SEQ ID NO: 2756792 - RNA, 19 nt, Human
gcaguucagagcugcccuc

SEQ ID NO: 2756793 - RNA, 20 nt, Human
gcaguucagagcugcccucu

SEQ ID NO: 2756794 - RNA, 22 nt, Human
gcaguucagagcugcccucucc

SEQ ID NO: 2756795 - RNA, 23 nt, Human
gcaguucagagcugcccucuccu

SEQ ID NO: 2756796 - RNA, 18 nt, Human
gcuugcccuguuaaaaga

SEQ ID NO: 2756797 - RNA, 12 nt, Human
gcuuuguauaga

SEQ ID NO: 2756798 - RNA, 13 nt, Human
gcuuuguauagaa

SEQ ID NO: 2756799 - RNA, 14 nt, Human
gcuuuguauagaac

SEQ ID NO: 2756800 - RNA, 19 nt, Human
gcuucuguuuuauaauuuu

SEQ ID NO: 2756801 - RNA, 23 nt, Human
gcuggucccagccagcaguucag

SEQ ID NO: 2756802 - RNA, 21 nt, Human
gcugguguaugugugaaguga

SEQ ID NO: 2756803 - RNA, 12 nt, Human
gcugcccucucc

SEQ ID NO: 2756804 - RNA, 21 nt, Human
gcugauuaaaccaaggcuaga

SEQ ID NO: 2756805 - RNA, 13 nt, Human
gcugcccucuccu

SEQ ID NO: 2756806 - RNA, 14 nt, Human
gcugcccucuccug

SEQ ID NO: 2756807 - RNA, 15 nt, Human
gcugcccucuccugg

SEQ ID NO: 2756808 - RNA, 16 nt, Human
gcugcccucuccuggg

SEQ ID NO: 2756809 - RNA, 17 nt, Human
gcugcccucuccugggc

SEQ ID NO: 2756810 - RNA, 18 nt, Human
gcugcccucuccugggca

SEQ ID NO: 2756811 - RNA, 20 nt, Human
gcugcccucuccugggcagc

SEQ ID NO: 2756812 - RNA, 22 nt, Human
gcugcccucuccugggcagcug

SEQ ID NO: 2756813 - RNA, 23 nt, Human
gcugcccucuccugggcagcugc

SEQ ID NO: 2756814 - RNA, 23 nt, Human
gcuggaaaaguauguuagugcaa

SEQ ID NO: 2756815 - RNA, 21 nt, Human
gcuggaaaaguauguuagugc

SEQ ID NO: 2756816 - RNA, 20 nt, Human
gcuccauuuuuagugaaaua

SEQ ID NO: 2756817 - RNA, 19 nt, Human
gcuauaggugcuacaaaaa

SEQ ID NO: 2756818 - RNA, 21 nt, Human
gcuauaggugcuacaaaaaca

SEQ ID NO: 2756819 - RNA, 13 nt, Human
gcuagauguaugu

SEQ ID NO: 2756820 - RNA, 14 nt, Human
gcuagauguaugua

SEQ ID NO: 2756821 - RNA, 17 nt, Human
gccugagcgacagugag

SEQ ID NO: 2756822 - RNA, 20 nt, Human
gccugagcgacagugagacu

SEQ ID NO: 2756823 - RNA, 18 nt, Human
gccuuggggcugaugcag

SEQ ID NO: 2756824 - RNA, 16 nt, Human
ggcuccacuuggucug

SEQ ID NO: 2756825 - RNA, 20 nt, Human
ggcuaguaucaaaagaaaga

SEQ ID NO: 2756826 - RNA, 23 nt, Human
ggcuauaggugcuacaaaaacac

SEQ ID NO: 2756827 - RNA, 21 nt, Human
gggacugaggggaggggagca

SEQ ID NO: 2756828 - RNA, 15 nt, Human
ggcuuuguauagaac

SEQ ID NO: 2756829 - RNA, 17 nt, Human
gggaggacgcucucugg

SEQ ID NO: 2756830 - RNA, 20 nt, Human
gggaggacgcucucuggccu

SEQ ID NO: 2756831 - RNA, 13 nt, Human
ggauucuuaaagu

SEQ ID NO: 2756832 - RNA, 21 nt, Human
ggcagagguugcagugagccg

SEQ ID NO: 2756833 - RNA, 17 nt, Human
ggauuagggagagaaga

SEQ ID NO: 2756834 - RNA, 11 nt, Human
ggcagcugccu

SEQ ID NO: 2756835 - RNA, 12 nt, Human
ggcagcugccuc

SEQ ID NO: 2756836 - RNA, 13 nt, Human
ggcagcugccucc

SEQ ID NO: 2756837 - RNA, 16 nt, Human
ggcagcugccuccccu

SEQ ID NO: 2756838 - RNA, 16 nt, Human
ggacauuugcucaugg

SEQ ID NO: 2756839 - RNA, 17 nt, Human
ggacauuugcucaugga

SEQ ID NO: 2756840 - RNA, 20 nt, Human
ggacauuugcucauggaauu

SEQ ID NO: 2756841 - RNA, 15 nt, Human
ggagaagagcuguuc

SEQ ID NO: 2756842 - RNA, 11 nt, Human
ggagaagaacu

SEQ ID NO: 2756843 - RNA, 14 nt, Human
ggagaagaacugaa

SEQ ID NO: 2756844 - RNA, 23 nt, Human
ggagaagagcuguucacagccag

SEQ ID NO: 2756845 - RNA, 15 nt, Human
ggacgcucucuggcc

SEQ ID NO: 2756846 - RNA, 16 nt, Human
ggacgcucucuggccu

SEQ ID NO: 2756847 - RNA, 19 nt, Human
ggacgcucucuggccuucg

SEQ ID NO: 2756848 - RNA, 19 nt, Human
ggaggggagcaugggaagu

SEQ ID NO: 2756849 - RNA, 16 nt, Human
ggaggacgcucucugg

SEQ ID NO: 2756850 - RNA, 18 nt, Human
ucagagcugcccucuccu

SEQ ID NO: 2756851 - RNA, 19 nt, Human
ucagagcugcccucuccug

SEQ ID NO: 2756852 - RNA, 20 nt, Human
ucagagcugcccucuccugg

SEQ ID NO: 2756853 - RNA, 21 nt, Human
ucagagcugcccucuccuggg

SEQ ID NO: 2756854 - RNA, 22 nt, Human
ucagagcugcccucuccugggc

SEQ ID NO: 2756855 - RNA, 17 nt, Human
ucagcuccccucggaga

SEQ ID NO: 2756856 - RNA, 18 nt, Human
ucagcuccccucggagaa

SEQ ID NO: 2756857 - RNA, 13 nt, Human
ucaggcuagaugu

SEQ ID NO: 2756858 - RNA, 17 nt, Human
ucaggcuagauguaugu

SEQ ID NO: 2756859 - RNA, 19 nt, Human
uccacagaagcuccaggua

SEQ ID NO: 2756860 - RNA, 12 nt, Human
uccaccucccug

SEQ ID NO: 2756861 - RNA, 13 nt, Human
uccaccucccugc

SEQ ID NO: 2756862 - RNA, 14 nt, Human
uccaccucccugca

SEQ ID NO: 2756863 - RNA, 15 nt, Human
uccaccucccugcaa

SEQ ID NO: 2756864 - RNA, 16 nt, Human
uccaccucccugcaau

SEQ ID NO: 2756865 - RNA, 17 nt, Human
uccaccucccugcaaua

SEQ ID NO: 2756866 - RNA, 15 nt, Human
uccacuuggucugug

SEQ ID NO: 2756867 - RNA, 16 nt, Human
uccacuuggucuguga

SEQ ID NO: 2756868 - RNA, 14 nt, Human
uccacuuggucugu

SEQ ID NO: 2756869 - RNA, 18 nt, Human
ucauaccuaucaucuuaa

SEQ ID NO: 2756870 - RNA, 13 nt, Human
ucauuaucucaaa

SEQ ID NO: 2756871 - RNA, 20 nt, Human
ucauuaucucaaaacugcac

SEQ ID NO: 2756872 - RNA, 19 nt, Human
ucauuaucucaaaacugca

SEQ ID NO: 2756873 - RNA, 23 nt, Human
ucauuauuuuauuaugaaacuug

SEQ ID NO: 2756874 - RNA, 22 nt, Human
ucauuauuuuauuaugaaacuu

SEQ ID NO: 2756875 - RNA, 13 nt, Human
ucauuuccaagca

SEQ ID NO: 2756876 - RNA, 16 nt, Human
ucauuuccaagcaagu

SEQ ID NO: 2756877 - RNA, 13 nt, Human
uauguacuucaug

SEQ ID NO: 2756878 - RNA, 17 nt, Human
uauguacuucaugcugu

SEQ ID NO: 2756879 - RNA, 15 nt, Human
uauguaaaucccauu

SEQ ID NO: 2756880 - RNA, 19 nt, Human
uauguaaaucccauuauuc

SEQ ID NO: 2756881 - RNA, 20 nt, Human
uauguaaaucccauuauuca

SEQ ID NO: 2756882 - RNA, 21 nt, Human
uauguaaaucccauuauucaa

SEQ ID NO: 2756883 - RNA, 23 nt, Human
uauguaaaucccauuauucaaag

SEQ ID NO: 2756884 - RNA, 12 nt, Human
uauguaaauccc

SEQ ID NO: 2756885 - RNA, 16 nt, Human
uauuauucccauucua

SEQ ID NO: 2756886 - RNA, 12 nt, Human
uauuacaguaua

SEQ ID NO: 2756887 - RNA, 13 nt, Human
uauuacaguauaa

SEQ ID NO: 2756888 - RNA, 14 nt, Human
ucaaauugugugaa

SEQ ID NO: 2756889 - RNA, 20 nt, Human
ucaaaucaagaaacuuaagg

SEQ ID NO: 2756890 - RNA, 14 nt, Human
ucaaauaugcaaag

SEQ ID NO: 2756891 - RNA, 18 nt, Human
uauuuuauuaugaaacuu

SEQ ID NO: 2756892 - RNA, 23 nt, Human
uauuuuauuaugaaacuugugua

SEQ ID NO: 2756893 - RNA, 13 nt, Human
uauuuuauuauga

SEQ ID NO: 2756894 - RNA, 15 nt, Human
uauuuucauucuccu

SEQ ID NO: 2756895 - RNA, 21 nt, Human
ucaauaaaauccauacauuug

SEQ ID NO: 2756896 - RNA, 13 nt, Human
ucaaugcagcccc

SEQ ID NO: 2756897 - RNA, 17 nt, Human
ucacaagacccaaaagg

SEQ ID NO: 2756898 - RNA, 18 nt, Human
ucacaagacccaaaaggc

SEQ ID NO: 2756899 - RNA, 13 nt, Human
ucacaagacccaa

SEQ ID NO: 2756900 - RNA, 16 nt, Human
ucacagucacauucca

SEQ ID NO: 2756901 - RNA, 14 nt, Human
ucaccaaggcugau

SEQ ID NO: 2756902 - RNA, 16 nt, Human
uccuuggacucauuuu

SEQ ID NO: 2756903 - RNA, 20 nt, Human
uccugccuaagugcagcccc

SEQ ID NO: 2756904 - RNA, 17 nt, Human
uccuggcaauagucaaa

SEQ ID NO: 2756905 - RNA, 13 nt, Human
ucguuaauuugua

SEQ ID NO: 2756906 - RNA, 18 nt, Human
ucggccuccauccugagg

SEQ ID NO: 2756907 - RNA, 17 nt, Human
ucggccuccauccugag

SEQ ID NO: 2756908 - RNA, 21 nt, Human
ucguggaacaguuaccucugc

SEQ ID NO: 2756909 - RNA, 22 nt, Human
ucgugggacagucaccucaugg

SEQ ID NO: 2756910 - RNA, 13 nt, Human
ucuaugaaauauu

SEQ ID NO: 2756911 - RNA, 14 nt, Human
ucuaugaaauauua

SEQ ID NO: 2756912 - RNA, 17 nt, Human
ucuaugaaauauuaugu

SEQ ID NO: 2756913 - RNA, 19 nt, Human
ucuauauuuucauucuccu

SEQ ID NO: 2756914 - RNA, 15 nt, Human
ucucaacuccaaacu

SEQ ID NO: 2756915 - RNA, 16 nt, Human
ucuaugcugaguuugu

SEQ ID NO: 2756916 - RNA, 20 nt, Human
ucuaugcugaguuugugcug

SEQ ID NO: 2756917 - RNA, 19 nt, Human
ucuagugagcagucaggaa

SEQ ID NO: 2756918 - RNA, 22 nt, Human
ucuagugagcagucaggaaaga

SEQ ID NO: 2756919 - RNA, 20 nt, Human
uccucugcuugccaucccuc

SEQ ID NO: 2756920 - RNA, 19 nt, Human
uccucugcuugccaucccu

SEQ ID NO: 2756921 - RNA, 21 nt, Human
uccucugcuugccaucccucc

SEQ ID NO: 2756922 - RNA, 22 nt, Human
uccucugcuugccaucccuccc

SEQ ID NO: 2756923 - RNA, 15 nt, Human
ucccuugaugaagaa

SEQ ID NO: 2756924 - RNA, 16 nt, Human
ucccuugaugaagaag

SEQ ID NO: 2756925 - RNA, 16 nt, Human
ucccugcaauaaaaug

SEQ ID NO: 2756926 - RNA, 23 nt, Human
ucucuggccuucggccuccaucc

SEQ ID NO: 2756927 - RNA, 19 nt, Human
ucucuaggaaauauuuauu

SEQ ID NO: 2756928 - RNA, 14 nt, Human
ucugcaucagcugc

SEQ ID NO: 2756929 - RNA, 21 nt, Human
ucugcaucagcugcugaaaca

SEQ ID NO: 2756930 - RNA, 19 nt, Human
ucugcaucagcugcugaaa

SEQ ID NO: 2756931 - RNA, 15 nt, Human
ucugaggaauucugu

SEQ ID NO: 2756932 - RNA, 16 nt, Human
ucugaggaauucugua

SEQ ID NO: 2756933 - RNA, 17 nt, Human
ucugaggaauucuguau

SEQ ID NO: 2756934 - RNA, 18 nt, Human
ucugaggaauucuguaua

SEQ ID NO: 2756935 - RNA, 14 nt, Human
ucugaggaauucug

SEQ ID NO: 2756936 - RNA, 15 nt, Human
ucugucuucacaaca

SEQ ID NO: 2756937 - RNA, 13 nt, Human
ucuuaaaguugaa

SEQ ID NO: 2756938 - RNA, 14 nt, Human
ucuuaaaguugaau

SEQ ID NO: 2756939 - RNA, 12 nt, Human
ucuuaaaguuga

SEQ ID NO: 2756940 - RNA, 18 nt, Human
ucuuaagaagacugcauu

SEQ ID NO: 2756941 - RNA, 12 nt, Human
ucuuaagaagac

SEQ ID NO: 2756942 - RNA, 16 nt, Human
ucuuaaaguugaauuu

SEQ ID NO: 2756943 - RNA, 19 nt, Human
ucuuaaaguugaauuuauu

SEQ ID NO: 2756944 - RNA, 20 nt, Human
ucuuaaaguugaauuuauug

SEQ ID NO: 2756945 - RNA, 21 nt, Human
ucuuaaaguugaauuuauugg

SEQ ID NO: 2756946 - RNA, 22 nt, Human
ucuuaaaguugaauuuauuggc

SEQ ID NO: 2756947 - RNA, 23 nt, Human
ucuucagcaaaaauauuuuauga

SEQ ID NO: 2756948 - RNA, 21 nt, Human
ucuucagcaaaaauauuuuau

SEQ ID NO: 2756949 - RNA, 22 nt, Human
ucuucagcaaaaauauuuuaug

SEQ ID NO: 2756950 - RNA, 17 nt, Human
ucuggccuucggccucc

SEQ ID NO: 2756951 - RNA, 18 nt, Human
ucuggccuucggccucca

SEQ ID NO: 2756952 - RNA, 10 nt, Human
ucuggccuuc

SEQ ID NO: 2756953 - RNA, 11 nt, Human
uguaaaauggu

SEQ ID NO: 2756954 - RNA, 12 nt, Human
uguaaaauggug

SEQ ID NO: 2756955 - RNA, 21 nt, Human
uguacaaaguauuaagcauau

SEQ ID NO: 2756956 - RNA, 17 nt, Human
uguacaaaguauuaagc

SEQ ID NO: 2756957 - RNA, 18 nt, Human
uguacaaaguauuaagca

SEQ ID NO: 2756958 - RNA, 19 nt, Human
uguacaaaguauuaagcau

SEQ ID NO: 2756959 - RNA, 20 nt, Human
uguacaaaguauuaagcaua

SEQ ID NO: 2756960 - RNA, 15 nt, Human
uguacaaaguauuaa

SEQ ID NO: 2756961 - RNA, 16 nt, Human
ugguucccuugaugaa

SEQ ID NO: 2756962 - RNA, 17 nt, Human
ugguucccuugaugaag

SEQ ID NO: 2756963 - RNA, 20 nt, Human
ugguucccuugaugaagaag

SEQ ID NO: 2756964 - RNA, 14 nt, Human
uggguagacacaca

SEQ ID NO: 2756965 - RNA, 15 nt, Human
uggugacuuuggaua

SEQ ID NO: 2756966 - RNA, 16 nt, Human
uggugacuuuggauaa

SEQ ID NO: 2756967 - RNA, 18 nt, Human
uggugacuuuggauaaua

SEQ ID NO: 2756968 - RNA, 19 nt, Human
uggugacuuuggauaauaa

SEQ ID NO: 2756969 - RNA, 23 nt, Human
uggugacuuuggauaauaaggaa

SEQ ID NO: 2756970 - RNA, 22 nt, Human
ugucuacacuaagagagaauga

SEQ ID NO: 2756971 - RNA, 18 nt, Human
ugucuacaccauuaugug

SEQ ID NO: 2756972 - RNA, 17 nt, Human
ugucuacacuaagagag

SEQ ID NO: 2756973 - RNA, 17 nt, Human
ugucuacaccauuaugu

SEQ ID NO: 2756974 - RNA, 16 nt, Human
ugucucagauuuuauu

SEQ ID NO: 2756975 - RNA, 20 nt, Human
ugucucagauuuuauuaugu

SEQ ID NO: 2756976 - RNA, 22 nt, Human
ugucucagauuuuauuauguaa

SEQ ID NO: 2756977 - RNA, 19 nt, Human
uguaguguuggagaagaac

SEQ ID NO: 2756978 - RNA, 20 nt, Human
uguaguguuggagaagaacu

SEQ ID NO: 2756979 - RNA, 21 nt, Human
uguaguguuggagaagaacug

SEQ ID NO: 2756980 - RNA, 13 nt, Human
uguauaaaauaau

SEQ ID NO: 2756981 - RNA, 14 nt, Human
uguauaaaauaauu

SEQ ID NO: 2756982 - RNA, 15 nt, Human
uguauagauuagaau

SEQ ID NO: 2756983 - RNA, 21 nt, Human
uguauagauuagaauucugua

SEQ ID NO: 2756984 - RNA, 23 nt, Human
uguauagaaccucuuugucuaca

SEQ ID NO: 2756985 - RNA, 23 nt, Human
uguauagauuagagaguguugaa

SEQ ID NO: 2756986 - RNA, 18 nt, Human
uguauuuuaaaagaauga

SEQ ID NO: 2756987 - RNA, 19 nt, Human
uguauuuuaaaagaaugau

SEQ ID NO: 2756988 - RNA, 17 nt, Human
ugcuucuguuuuauaau

SEQ ID NO: 2756989 - RNA, 22 nt, Human
ugcuucuguuuuauaauuuugu

SEQ ID NO: 2756990 - RNA, 14 nt, Human
uggaacgcguugaa

SEQ ID NO: 2756991 - RNA, 15 nt, Human
uggaacgcguugaaa

SEQ ID NO: 2756992 - RNA, 16 nt, Human
uggaacgcguugaaau

SEQ ID NO: 2756993 - RNA, 15 nt, Human
uggaccaaaaaccag

SEQ ID NO: 2756994 - RNA, 22 nt, Human
uggccuucggccuccauccuga

SEQ ID NO: 2756995 - RNA, 20 nt, Human
uggccuucggccuccauccu

SEQ ID NO: 2756996 - RNA, 23 nt, Human
uggccuucggccuccauccugag

SEQ ID NO: 2756997 - RNA, 14 nt, Human
ugggacagggagga

SEQ ID NO: 2756998 - RNA, 13 nt, Human
ugggauaaaugcc

SEQ ID NO: 2756999 - RNA, 14 nt, Human
ugggauaaaugcca

SEQ ID NO: 2757000 - RNA, 12 nt, Human
ugggauaaaugc

SEQ ID NO: 2757001 - RNA, 20 nt, Human
ugggcagcugccuccccucc

SEQ ID NO: 2757002 - RNA, 22 nt, Human
ugggcagcugccuccccuccuc

SEQ ID NO: 2757003 - RNA, 23 nt, Human
ugggcagcugccuccccuccucu

SEQ ID NO: 2757004 - RNA, 23 nt, Human
ugggguuaucugaagucagaucu

SEQ ID NO: 2757005 - RNA, 12 nt, Human
ugacucuuaaga

SEQ ID NO: 2757006 - RNA, 13 nt, Human
ugacugauucuuc

SEQ ID NO: 2757007 - RNA, 14 nt, Human
ugacugauucuuca

SEQ ID NO: 2757008 - RNA, 15 nt, Human
ugacugauucuucag

SEQ ID NO: 2757009 - RNA, 16 nt, Human
ugacugauucuucagc

SEQ ID NO: 2757010 - RNA, 17 nt, Human
ugacugauucuucagca

SEQ ID NO: 2757011 - RNA, 17 nt, Human
ugagaaagacuauucaa

SEQ ID NO: 2757012 - RNA, 16 nt, Human
ugagaaagacuauuca

SEQ ID NO: 2757013 - RNA, 18 nt, Human
ugagaaagacuauucaaa

SEQ ID NO: 2757014 - RNA, 14 nt, Human
ugagacagcucugc

SEQ ID NO: 2757015 - RNA, 16 nt, Human
ugagacagcucugcau

SEQ ID NO: 2757016 - RNA, 14 nt, Human
ugagaugcuagaac

SEQ ID NO: 2757017 - RNA, 16 nt, Human
ugagaugcuagaacuc

SEQ ID NO: 2757018 - RNA, 20 nt, Human
ugagaugcuagaacucccuu

SEQ ID NO: 2757019 - RNA, 20 nt, Human
ugagcagucaggaaagagaa

SEQ ID NO: 2757020 - RNA, 17 nt, Human
ugagcagucaggaaaga

SEQ ID NO: 2757021 - RNA, 15 nt, Human
ugagcagucaggaaa

SEQ ID NO: 2757022 - RNA, 24 nt, Human
ugauaguuguaccgcaaugugacu

SEQ ID NO: 2757023 - RNA, 21 nt, Human
ugcauuauauuuauuacugua

SEQ ID NO: 2757024 - RNA, 17 nt, Human
ugcagauaaacaguagu

SEQ ID NO: 2757025 - RNA, 19 nt, Human
ugcagauaaacaguaguga

SEQ ID NO: 2757026 - RNA, 17 nt, Human
ugcaugguuuagaaagc

SEQ ID NO: 2757027 - RNA, 12 nt, Human
ugcccugcuuuc

SEQ ID NO: 2757028 - RNA, 16 nt, Human
ugcccugcuuucagau

SEQ ID NO: 2757029 - RNA, 17 nt, Human
ugcccugcuuucagaua

SEQ ID NO: 2757030 - RNA, 14 nt, Human
ugccuaaggacuuc

SEQ ID NO: 2757031 - RNA, 15 nt, Human
ugccuaaggacuucu

SEQ ID NO: 2757032 - RNA, 16 nt, Human
ugccuaaggacuucuu

SEQ ID NO: 2757033 - RNA, 20 nt, Human
ugccuaaggacuucuuuaau

SEQ ID NO: 2757034 - RNA, 12 nt, Human
ugccuaaggacu

SEQ ID NO: 2757035 - RNA, 13 nt, Human
ugccuaaggacuu

SEQ ID NO: 2757036 - RNA, 21 nt, Human
ugccuaaggacuucuuuaauu

SEQ ID NO: 2757037 - RNA, 16 nt, Human
ugcacugucaagauga

SEQ ID NO: 2757038 - RNA, 13 nt, Human
uuuucuuauuuca

SEQ ID NO: 2757039 - RNA, 13 nt, Human
uuuuauauuugaa

SEQ ID NO: 2757040 - RNA, 18 nt, Human
uuuuauauuugaaauauu

SEQ ID NO: 2757041 - RNA, 13 nt, Human
uuuuauauuuacu

SEQ ID NO: 2757042 - RNA, 21 nt, Human
uuuuaaaguaacccuacaaaa

SEQ ID NO: 2757043 - RNA, 21 nt, Human
uuuuauaauuuugugaagcaa

SEQ ID NO: 2757044 - RNA, 23 nt, Human
uuuuauaauuuugugaagcaaaa

SEQ ID NO: 2757045 - RNA, 15 nt, Human
uuuccacagaagcuc

SEQ ID NO: 2757046 - RNA, 18 nt, Human
uuuggaccaaaaaccagu

SEQ ID NO: 2757047 - RNA, 21 nt, Human
uuuggaccaaaaaccaguauu

SEQ ID NO: 2757048 - RNA, 22 nt, Human
uuuggaccaaaaaccaguauug

SEQ ID NO: 2757049 - RNA, 17 nt, Human
uuuguauaaaauaauuu

SEQ ID NO: 2757050 - RNA, 18 nt, Human
uuuguauaaaauaauuuu

SEQ ID NO: 2757051 - RNA, 19 nt, Human
uuuguauaaaauaauuuuu

SEQ ID NO: 2757052 - RNA, 24 nt, Human
uuuggaccaaaaaccaguauugua

SEQ ID NO: 2757053 - RNA, 13 nt, Human
uuuuucauuauuu

SEQ ID NO: 2757054 - RNA, 22 nt, Human
uuuuucauuauuuuauuaugaa

SEQ ID NO: 2757055 - RNA, 19 nt, Human
uuuaacucuauaauguguu

SEQ ID NO: 2757056 - RNA, 16 nt, Human
uuuaacaacagcuggu

SEQ ID NO: 2757057 - RNA, 21 nt, Human
uuguuuggaccaaaaaccagu

SEQ ID NO: 2757058 - RNA, 13 nt, Human
uuuaauaauguuu

SEQ ID NO: 2757059 - RNA, 13 nt, Human
uuuaccacuugug

SEQ ID NO: 2757060 - RNA, 18 nt, Human
uuuaauaauuauaugcua

SEQ ID NO: 2757061 - RNA, 21 nt, Human
uuuaauaauuauaugcuauuu

SEQ ID NO: 2757062 - RNA, 17 nt, Human
uuuauggcacuaguauu

SEQ ID NO: 2757063 - RNA, 16 nt, Human
uuuauuauguaaaucc

SEQ ID NO: 2757064 - RNA, 17 nt, Human
uuuauuauguaaauccc

SEQ ID NO: 2757065 - RNA, 14 nt, Human
uuuauuauguaaau

SEQ ID NO: 2757066 - RNA, 22 nt, Human
uuuauaauuuugugaagcaaaa

SEQ ID NO: 2757067 - RNA, 22 nt, Human
uuuauuguuuaaaaucauuucu

SEQ ID NO: 2757068 - RNA, 13 nt, Human
uuucagauacugg

SEQ ID NO: 2757069 - RNA, 21 nt, Human
uuucagauacuggauuguacu

SEQ ID NO: 2757070 - RNA, 21 nt, Human
uuucagauaaucacaauacau

SEQ ID NO: 2757071 - RNA, 14 nt, Human
uuguuuaaaaucau

SEQ ID NO: 2757072 - RNA, 17 nt, Human
uuguuguuuguuuaguc

SEQ ID NO: 2757073 - RNA, 18 nt, Human
uuguguuuugcaagccag

SEQ ID NO: 2757074 - RNA, 17 nt, Human
uuguuagaucuaguuca

SEQ ID NO: 2757075 - RNA, 12 nt, Human
uugugccccugc

SEQ ID NO: 2757076 - RNA, 19 nt, Human
uugugcugggguuaucuga

SEQ ID NO: 2757077 - RNA, 22 nt, Human
uugugcgcuaaacuuuucugau

SEQ ID NO: 2757078 - RNA, 23 nt, Human
uugugcgcuaaacuuuucugaua

SEQ ID NO: 2757079 - RNA, 15 nt, Human
uugucuagugaaacu

SEQ ID NO: 2757080 - RNA, 20 nt, Human
uugucuacaccauuaugugc

SEQ ID NO: 2757081 - RNA, 16 nt, Human
uugucucagauuuuau

SEQ ID NO: 2757082 - RNA, 20 nt, Human
uugucucagauuuuauuaug

SEQ ID NO: 2757083 - RNA, 13 nt, Human
uugucucagauuu

SEQ ID NO: 2757084 - RNA, 22 nt, Human
uugucucagauuuuauuaugua

SEQ ID NO: 2757085 - RNA, 19 nt, Human
uugucuacaccauuaugug

SEQ ID NO: 2757086 - RNA, 14 nt, Human
uuguacucaauuuu

SEQ ID NO: 2757087 - RNA, 15 nt, Human
uuguacucaauuuua

SEQ ID NO: 2757088 - RNA, 15 nt, Human
uuggucugugagaug

SEQ ID NO: 2757089 - RNA, 16 nt, Human
uuggucugugagaugc

SEQ ID NO: 2757090 - RNA, 13 nt, Human
uuggguguauugu

SEQ ID NO: 2757091 - RNA, 15 nt, Human
uuggguguauugugc

SEQ ID NO: 2757092 - RNA, 16 nt, Human
uuggguguauugugcg

SEQ ID NO: 2757093 - RNA, 18 nt, Human
uuauggcuauaggugcua

SEQ ID NO: 2757094 - RNA, 16 nt, Human
uuauuacaguauaauu

SEQ ID NO: 2757095 - RNA, 22 nt, Human
uuaugauuaaguaaugauaacu

SEQ ID NO: 2757096 - RNA, 11 nt, Human
uuaucucaaaa

SEQ ID NO: 2757097 - RNA, 16 nt, Human
uuauauuuacaaaugg

SEQ ID NO: 2757098 - RNA, 20 nt, Human
uuauauuuauuacuguaaga

SEQ ID NO: 2757099 - RNA, 12 nt, Human
uuauauuugaaa

SEQ ID NO: 2757100 - RNA, 13 nt, Human
uuauauuugaaau

SEQ ID NO: 2757101 - RNA, 11 nt, Human
uuauaaucuuu

SEQ ID NO: 2757102 - RNA, 14 nt, Human
uuauaauuuuguga

SEQ ID NO: 2757103 - RNA, 15 nt, Human
uuauaauuuugugaa

SEQ ID NO: 2757104 - RNA, 12 nt, Human
uuauaauuuaaa

SEQ ID NO: 2757105 - RNA, 16 nt, Human
uuauaauuuugugaag

SEQ ID NO: 2757106 - RNA, 17 nt, Human
uuauaauuuugugaagc

SEQ ID NO: 2757107 - RNA, 18 nt, Human
uuauaauuuugugaagca

SEQ ID NO: 2757108 - RNA, 20 nt, Human
uuauaucugaggaauucugu

SEQ ID NO: 2757109 - RNA, 21 nt, Human
uuauaucugaggaauucugua

SEQ ID NO: 2757110 - RNA, 14 nt, Human
uuauaucugaggaa

SEQ ID NO: 2757111 - RNA, 22 nt, Human
uuauaucugaggaauucuguau

SEQ ID NO: 2757112 - RNA, 23 nt, Human
uuauaucugaggaauucuguaua

SEQ ID NO: 2757113 - RNA, 16 nt, Human
uuauaugcuauuucua

SEQ ID NO: 2757114 - RNA, 18 nt, Human
uuauaugcuauuucuaua

SEQ ID NO: 2757115 - RNA, 15 nt, Human
uucagagcugcccuc

SEQ ID NO: 2757116 - RNA, 17 nt, Human
uucagagcugcccucuc

SEQ ID NO: 2757117 - RNA, 18 nt, Human
uucagagcugcccucucc

SEQ ID NO: 2757118 - RNA, 19 nt, Human
uucagagcugcccucuccu

SEQ ID NO: 2757119 - RNA, 20 nt, Human
uucagagcugcccucuccug

SEQ ID NO: 2757120 - RNA, 20 nt, Human
uucagauaaucacaauacau

SEQ ID NO: 2757121 - RNA, 16 nt, Human
uucagauacuggauug

SEQ ID NO: 2757122 - RNA, 20 nt, Human
uucagauacuggauuguacu

SEQ ID NO: 2757123 - RNA, 20 nt, Human
uuauuuuaauaauguuucaa

SEQ ID NO: 2757124 - RNA, 14 nt, Human
uuauuuuauuauga

SEQ ID NO: 2757125 - RNA, 15 nt, Human
uuauuuuauuaugaa

SEQ ID NO: 2757126 - RNA, 16 nt, Human
uuauuuuauuaugaaa

SEQ ID NO: 2757127 - RNA, 17 nt, Human
uuauuuuaauaauguuu

SEQ ID NO: 2757128 - RNA, 19 nt, Human
uuauuuuaauaauguuuca

SEQ ID NO: 2757129 - RNA, 20 nt, Human
uuauuuuauuaugaaacuug

SEQ ID NO: 2757130 - RNA, 18 nt, Human
uuccagauccuggaaauc

SEQ ID NO: 2757131 - RNA, 23 nt, Human
uucaguuauuauauuuacaaaug

SEQ ID NO: 2757132 - RNA, 18 nt, Human
uucggugagcuacaaaug

SEQ ID NO: 2757133 - RNA, 15 nt, Human
uucuacauacuaugg

SEQ ID NO: 2757134 - RNA, 21 nt, Human
uucugagaaagacuauucaaa

SEQ ID NO: 2757135 - RNA, 16 nt, Human
uucugagaaagacuau

SEQ ID NO: 2757136 - RNA, 13 nt, Human
uucugauagagga

SEQ ID NO: 2757137 - RNA, 21 nt, Human
uucugauagaggaagccugau

SEQ ID NO: 2757138 - RNA, 21 nt, Human
uucuaugaaauauuauguuaa

SEQ ID NO: 2757139 - RNA, 14 nt, Human
uucuaugaaauauu

SEQ ID NO: 2757140 - RNA, 14 nt, Human
uugacccacaagaa

SEQ ID NO: 2757141 - RNA, 17 nt, Human
uugacccacaagaaaug

SEQ ID NO: 2757142 - RNA, 15 nt, Human
uugaauuuauuggcu

SEQ ID NO: 2757143 - RNA, 18 nt, Human
uugaauuuauuggcuuuu

SEQ ID NO: 2757144 - RNA, 22 nt, Human
uugaauuuauuggcuuuucuga

SEQ ID NO: 2757145 - RNA, 17 nt, Human
uugaauuuuguguuaga

SEQ ID NO: 2757146 - RNA, 21 nt, Human
uugaauuuuguguuagagauu

SEQ ID NO: 2757147 - RNA, 23 nt, Human
uugaugaagaaguugauaugccu

SEQ ID NO: 2757148 - RNA, 13 nt, Human
uugaugaagaagu

SEQ ID NO: 2757149 - RNA, 14 nt, Human
uugaugaagaaguu

SEQ ID NO: 2757150 - RNA, 17 nt, Human
uucugucuucacaacag

SEQ ID NO: 2757151 - RNA, 17 nt, Human
aaaagaaagaaaaucag

SEQ ID NO: 2757152 - RNA, 12 nt, Human
aaaagaauauuu

SEQ ID NO: 2757153 - RNA, 20 nt, Human
aaaagacaaggaaaaaauaa

SEQ ID NO: 2757154 - RNA, 13 nt, Human
aaaagaauauuuu

SEQ ID NO: 2757155 - RNA, 11 nt, Human
aaaagaaugau

SEQ ID NO: 2757156 - RNA, 13 nt, Human
aaaagacuccaaa

SEQ ID NO: 2757157 - RNA, 10 nt, Human
aaaaucauuu

SEQ ID NO: 2757158 - RNA, 12 nt, Human
aaaaucauuucu

SEQ ID NO: 2757159 - RNA, 11 nt, Human
aaaaucauuuc

SEQ ID NO: 2757160 - RNA, 14 nt, Human
aaaaguuuaauauu

SEQ ID NO: 2757161 - RNA, 16 nt, Human
aaaaguuuaauauuaa

SEQ ID NO: 2757162 - RNA, 18 nt, Human
aaaaguuuaauauuaaag

SEQ ID NO: 2757163 - RNA, 17 nt, Human
aaagcauuguaaaugug

SEQ ID NO: 2757164 - RNA, 15 nt, Human
aaagcauuguaaaug

SEQ ID NO: 2757165 - RNA, 14 nt, Human
aaagccauguuuau

SEQ ID NO: 2757166 - RNA, 16 nt, Human
aaagccauguuuauua

SEQ ID NO: 2757167 - RNA, 17 nt, Human
aaagccauguuuauuac

SEQ ID NO: 2757168 - RNA, 18 nt, Human
aaagccauguuuauuaca

SEQ ID NO: 2757169 - RNA, 23 nt, Human
aaagccauguuuauuacaguaua

SEQ ID NO: 2757170 - RNA, 21 nt, Human
aaaaucauuucugcaucagcu

SEQ ID NO: 2757171 - RNA, 15 nt, Human
aaacugcacugucaa

SEQ ID NO: 2757172 - RNA, 19 nt, Human
aaacccuugccaugugcua

SEQ ID NO: 2757173 - RNA, 14 nt, Human
aaaccaguauugua

SEQ ID NO: 2757174 - RNA, 16 nt, Human
aaaccaguauuguaca

SEQ ID NO: 2757175 - RNA, 17 nt, Human
aaaccaguauuguacaa

SEQ ID NO: 2757176 - RNA, 18 nt, Human
aaaccaguauuguacaaa

SEQ ID NO: 2757177 - RNA, 22 nt, Human
aaaccaguauuguacaaaguau

SEQ ID NO: 2757178 - RNA, 21 nt, Human
aaauauuuauuuuaauaaugu

SEQ ID NO: 2757179 - RNA, 18 nt, Human
aaaucucaauauuucaga

SEQ ID NO: 2757180 - RNA, 21 nt, Human
aaauggacuguggugacuuug

SEQ ID NO: 2757181 - RNA, 20 nt, Human
aaauggacuguggugacuuu

SEQ ID NO: 2757182 - RNA, 23 nt, Human
aaauggacuguggugacuuugga

SEQ ID NO: 2757183 - RNA, 13 nt, Human
aaauguucaucaa

SEQ ID NO: 2757184 - RNA, 22 nt, Human
aaauguugacaugggacauuug

SEQ ID NO: 2757185 - RNA, 23 nt, Human
aaauguugacaugggacauuugc

SEQ ID NO: 2757186 - RNA, 20 nt, Human
aaugaauacuuuauaaagga

SEQ ID NO: 2757187 - RNA, 16 nt, Human
aaucucaauauuucag

SEQ ID NO: 2757188 - RNA, 22 nt, Human
aauauuaaagccauguuuauua

SEQ ID NO: 2757189 - RNA, 15 nt, Human
aaguugaauuuauug

SEQ ID NO: 2757190 - RNA, 17 nt, Human
aaguugaauuuauuggc

SEQ ID NO: 2757191 - RNA, 14 nt, Human
aaguugaauuuauu

SEQ ID NO: 2757192 - RNA, 23 nt, Human
aaguugaauuuauuggcuuuucu

SEQ ID NO: 2757193 - RNA, 24 nt, Human
aaguugaauuuauuggcuuuucug

SEQ ID NO: 2757194 - RNA, 15 nt, Human
aaguuuaauauuaaa

SEQ ID NO: 2757195 - RNA, 17 nt, Human
aaguuuaauauuaaagc

SEQ ID NO: 2757196 - RNA, 21 nt, Human
aagacaaggaaaaaauaacaa

SEQ ID NO: 2757197 - RNA, 20 nt, Human
aagaagacugcauuauauuu

SEQ ID NO: 2757198 - RNA, 15 nt, Human
aagaagacugcauua

SEQ ID NO: 2757199 - RNA, 20 nt, Human
aacgcaggcccccaggugcc

SEQ ID NO: 2757200 - RNA, 12 nt, Human
aagaacugaaau

SEQ ID NO: 2757201 - RNA, 13 nt, Human
aagaacugaaauc

SEQ ID NO: 2757202 - RNA, 11 nt, Human
aagaacugaaa

SEQ ID NO: 2757203 - RNA, 15 nt, Human
aagaacugaaaucau

SEQ ID NO: 2757204 - RNA, 15 nt, Human
aaggacuuguuagau

SEQ ID NO: 2757205 - RNA, 21 nt, Human
aaggacuuguuagaucuaguu

SEQ ID NO: 2757206 - RNA, 23 nt, Human
aaggacuucuuuaauuuuggaau

SEQ ID NO: 2757207 - RNA, 23 nt, Human
aaggacuuguuagaucuaguuca

SEQ ID NO: 2757208 - RNA, 15 nt, Human
aauuggagcucgugg

SEQ ID NO: 2757209 - RNA, 12 nt, Human
aauucuguauag

SEQ ID NO: 2757210 - RNA, 13 nt, Human
aauucuguauaga

SEQ ID NO: 2757211 - RNA, 14 nt, Human
aauucuguauagau

SEQ ID NO: 2757212 - RNA, 20 nt, Human
aauucuguauagauuagaga

SEQ ID NO: 2757213 - RNA, 20 nt, Human
aauuauaucugaggaauucu

SEQ ID NO: 2757214 - RNA, 22 nt, Human
aauuauaucugaggaauucugu

SEQ ID NO: 2757215 - RNA, 23 nt, Human
aauuauaucugaggaauucugua

SEQ ID NO: 2757216 - RNA, 19 nt, Human
aauuauaugcuauuucuau

SEQ ID NO: 2757217 - RNA, 20 nt, Human
aauuauaugcuauuucuaua

SEQ ID NO: 2757218 - RNA, 21 nt, Human
aauuauaugcuauuucuauau

SEQ ID NO: 2757219 - RNA, 11 nt, Human
aauuguaauag

SEQ ID NO: 2757220 - RNA, 15 nt, Human
aauuguaauuauauc

SEQ ID NO: 2757221 - RNA, 16 nt, Human
aauuguaauuauaucu

SEQ ID NO: 2757222 - RNA, 14 nt, Human
aauuguaauuauau

SEQ ID NO: 2757223 - RNA, 22 nt, Human
aauuucauaccuaucaucuuaa

SEQ ID NO: 2757224 - RNA, 17 nt, Human
aauuguaauuauaucug

SEQ ID NO: 2757225 - RNA, 15 nt, Human
acaccaauauucaua

SEQ ID NO: 2757226 - RNA, 24 nt, Human
acaggaugguucccuugaugaaga

SEQ ID NO: 2757227 - RNA, 22 nt, Human
acaggaugguucccuugaugaa

SEQ ID NO: 2757228 - RNA, 19 nt, Human
acagugauuaccagggacu

SEQ ID NO: 2757229 - RNA, 15 nt, Human
acauuugcucaugga

SEQ ID NO: 2757230 - RNA, 16 nt, Human
acauuuguauaaaaua

SEQ ID NO: 2757231 - RNA, 19 nt, Human
acauuuguauaaaauaauu

SEQ ID NO: 2757232 - RNA, 21 nt, Human
acauuuguauaaaauaauuuu

SEQ ID NO: 2757233 - RNA, 16 nt, Human
acauguuaaaccaugg

SEQ ID NO: 2757234 - RNA, 21 nt, Human
acauguuaaaccaugggauaa

SEQ ID NO: 2757235 - RNA, 23 nt, Human
acauguuaaaccaugggauaaau

SEQ ID NO: 2757236 - RNA, 14 nt, Human
acauguuaaaccau

SEQ ID NO: 2757237 - RNA, 20 nt, Human
accucugccucagaaaacaa

SEQ ID NO: 2757238 - RNA, 21 nt, Human
acccugucucuacuaaaaaua

SEQ ID NO: 2757239 - RNA, 17 nt, Human
acuguaaaauaauaacu

SEQ ID NO: 2757240 - RNA, 20 nt, Human
acuggugacugauucuucag

SEQ ID NO: 2757241 - RNA, 18 nt, Human
acuggugacugauucuuc

SEQ ID NO: 2757242 - RNA, 19 nt, Human
acuggugacugauucuuca

SEQ ID NO: 2757243 - RNA, 16 nt, Human
acuggugacugauucu

SEQ ID NO: 2757244 - RNA, 21 nt, Human
acuuaaaaaugguuuaaaugg

SEQ ID NO: 2757245 - RNA, 22 nt, Human
acuuaaaaaugguuuaaauggu

SEQ ID NO: 2757246 - RNA, 18 nt, Human
acuucaaauccuugaaga

SEQ ID NO: 2757247 - RNA, 17 nt, Human
acuucaaauccuugaag

SEQ ID NO: 2757248 - RNA, 21 nt, Human
acuucagacauagaauuaaca

SEQ ID NO: 2757249 - RNA, 18 nt, Human
acuucuuuaauuuuggaa

SEQ ID NO: 2757250 - RNA, 19 nt, Human
acuucuuuaauuuuggaau

SEQ ID NO: 2757251 - RNA, 20 nt, Human
acuucuuuaauuuuggaauu

SEQ ID NO: 2757252 - RNA, 14 nt, Human
acucccuuucaaca

SEQ ID NO: 2757253 - RNA, 14 nt, Human
acucguuaauuugu

SEQ ID NO: 2757254 - RNA, 19 nt, Human
acucguuaauuuguagugu

SEQ ID NO: 2757255 - RNA, 19 nt, Human
acugauaugggucuugaua

SEQ ID NO: 2757256 - RNA, 22 nt, Human
acugauuugacauagucuggcu

SEQ ID NO: 2757257 - RNA, 15 nt, Human
auaaaagacagugaa

SEQ ID NO: 2757258 - RNA, 16 nt, Human
auaaaagacagugaaa

SEQ ID NO: 2757259 - RNA, 16 nt, Human
auaaaaaauuaugaca

SEQ ID NO: 2757260 - RNA, 20 nt, Human
auacacacucaaaucaagaa

SEQ ID NO: 2757261 - RNA, 14 nt, Human
auacaauuuuguuu

SEQ ID NO: 2757262 - RNA, 16 nt, Human
auacaauuuuguuucu

SEQ ID NO: 2757263 - RNA, 17 nt, Human
auacaauuuuguuucug

SEQ ID NO: 2757264 - RNA, 18 nt, Human
auacaauuuuguuucugu

SEQ ID NO: 2757265 - RNA, 13 nt, Human
aguacucauacau

SEQ ID NO: 2757266 - RNA, 13 nt, Human
agugauuaccagg

SEQ ID NO: 2757267 - RNA, 19 nt, Human
agugaugucacuagggcag

SEQ ID NO: 2757268 - RNA, 13 nt, Human
agucauuuaauaa

SEQ ID NO: 2757269 - RNA, 19 nt, Human
agucuggcuguacccagga

SEQ ID NO: 2757270 - RNA, 21 nt, Human
agucuggcuguacccaggaau

SEQ ID NO: 2757271 - RNA, 21 nt, Human
aucaugaauuaguuuuauaug

SEQ ID NO: 2757272 - RNA, 18 nt, Human
auccagcagauuauucac

SEQ ID NO: 2757273 - RNA, 12 nt, Human
auccuugaagau

SEQ ID NO: 2757274 - RNA, 14 nt, Human
aucaaaagaaagaa

SEQ ID NO: 2757275 - RNA, 23 nt, Human
auggcuuccuggcaauagucaaa

SEQ ID NO: 2757276 - RNA, 15 nt, Human
auggcuuuguauaga

SEQ ID NO: 2757277 - RNA, 16 nt, Human
auggcuuuguauagaa

SEQ ID NO: 2757278 - RNA, 20 nt, Human
augggaaagcauuguaaaug

SEQ ID NO: 2757279 - RNA, 14 nt, Human
augggaaagcauug

SEQ ID NO: 2757280 - RNA, 15 nt, Human
augggacagggagga

SEQ ID NO: 2757281 - RNA, 20 nt, Human
augggacauuugcucaugga

SEQ ID NO: 2757282 - RNA, 18 nt, Human
augaaacuuguguaaaua

SEQ ID NO: 2757283 - RNA, 20 nt, Human
agggauuagggagagaagau

SEQ ID NO: 2757284 - RNA, 17 nt, Human
agggacaggauaagagg

SEQ ID NO: 2757285 - RNA, 23 nt, Human
aggccaugggcacuguggguaga

SEQ ID NO: 2757286 - RNA, 20 nt, Human
aggcagagguugcagugagc

SEQ ID NO: 2757287 - RNA, 13 nt, Human
agcuacaaaugca

SEQ ID NO: 2757288 - RNA, 12 nt, Human
agcuacaaaugc

SEQ ID NO: 2757289 - RNA, 13 nt, Human
agcgacagugaga

SEQ ID NO: 2757290 - RNA, 15 nt, Human
agcgacagugagacu

SEQ ID NO: 2757291 - RNA, 20 nt, Human
agcugcugaaacaacaaaua

SEQ ID NO: 2757292 - RNA, 16 nt, Human
agcugcugaaacaaca

SEQ ID NO: 2757293 - RNA, 15 nt, Human
agcugcugaaacaac

SEQ ID NO: 2757294 - RNA, 14 nt, Human
agcugcugaaacaa

SEQ ID NO: 2757295 - RNA, 14 nt, Human
agcuguaugauucc

SEQ ID NO: 2757296 - RNA, 14 nt, Human
agcuggugcccugc

SEQ ID NO: 2757297 - RNA, 17 nt, Human
agcuguaugauucccag

SEQ ID NO: 2757298 - RNA, 18 nt, Human
agcuguaugauucccagc

SEQ ID NO: 2757299 - RNA, 18 nt, Human
aggaaaaaauaacaauga

SEQ ID NO: 2757300 - RNA, 19 nt, Human
agacaaggaaaaaauaaca

SEQ ID NO: 2757301 - RNA, 22 nt, Human
agaacagugauuaccagggacu

SEQ ID NO: 2757302 - RNA, 13 nt, Human
agaagagcuguuc

SEQ ID NO: 2757303 - RNA, 13 nt, Human
agaagauagcagg

SEQ ID NO: 2757304 - RNA, 20 nt, Human
agaagagcuguucacagcca

SEQ ID NO: 2757305 - RNA, 21 nt, Human
agaagacugcauuauauuuau

SEQ ID NO: 2757306 - RNA, 18 nt, Human
agaagacugcauuauauu

SEQ ID NO: 2757307 - RNA, 23 nt, Human
agcaaaauuuuuucucuaggaaa

SEQ ID NO: 2757308 - RNA, 13 nt, Human
agaucugccuaag

SEQ ID NO: 2757309 - RNA, 18 nt, Human
agaucugccuaaggacuu

SEQ ID NO: 2757310 - RNA, 20 nt, Human
agauagauaggucagugcaa

SEQ ID NO: 2757311 - RNA, 19 nt, Human
agcacugacuucuaaguaa

SEQ ID NO: 2757312 - RNA, 17 nt, Human
agcacugacuucuaagu

SEQ ID NO: 2757313 - RNA, 14 nt, Human
agccagcaguucag

SEQ ID NO: 2757314 - RNA, 21 nt, Human
aaaacuuuaugcuaagugaaa

SEQ ID NO: 2757315 - RNA, 22 nt, Human
aaaagcuccauuuuuagugaaa

SEQ ID NO: 2757316 - RNA, 11 nt, Human
gggaggcagag

SEQ ID NO: 2757317 - RNA, 20 nt, Human
gggaggcagagguugcagug

SEQ ID NO: 2757318 - RNA, 12 nt, Human
gggcagcugccu

SEQ ID NO: 2757319 - RNA, 13 nt, Human
gggcagcugccuc

SEQ ID NO: 2757320 - RNA, 14 nt, Human
gggcagcugccucc

SEQ ID NO: 2757321 - RNA, 19 nt, Human
gggcagcugccuccccucc

SEQ ID NO: 2757322 - RNA, 20 nt, Human
gggcagcugccuccccuccu

SEQ ID NO: 2757323 - RNA, 23 nt, Human
gggcagcugccuccccuccucug

SEQ ID NO: 2757324 - RNA, 20 nt, Human
gggauucuuaaaguugaauu

SEQ ID NO: 2757325 - RNA, 15 nt, Human
gggauucuuaaaguu

SEQ ID NO: 2757326 - RNA, 20 nt, Human
aaaauaauuuuuauauuuga

SEQ ID NO: 2757327 - RNA, 21 nt, Human
aaaauaauuuuuauauuugaa

SEQ ID NO: 2757328 - RNA, 23 nt, Human
aaaauaauuuuuauauuugaaau

SEQ ID NO: 2757329 - RNA, 21 nt, Human
aaacauauauaacaaugcugu

SEQ ID NO: 2757330 - RNA, 16 nt, Human
aaacauauauaacaau

SEQ ID NO: 2757331 - RNA, 19 nt, Human
aaacauauauaacaaugcu

SEQ ID NO: 2757332 - RNA, 13 nt, Human
aaacauauauaac

SEQ ID NO: 2757333 - RNA, 14 nt, Human
aaacacaacuauau

SEQ ID NO: 2757334 - RNA, 17 nt, Human
aaacaaggaugaauuaa

SEQ ID NO: 2757335 - RNA, 19 nt, Human
aaaauuuuuucucuaggaa

SEQ ID NO: 2757336 - RNA, 22 nt, Human
aaaauggacuguggugacuuug

SEQ ID NO: 2757337 - RNA, 21 nt, Human
aaaauuggggauucuuaaagu

SEQ ID NO: 2757338 - RNA, 23 nt, Human
aaaauuggggauucuuaaaguug

SEQ ID NO: 2757339 - RNA, 15 nt, Human
aaaccacagcaguug

SEQ ID NO: 2757340 - RNA, 16 nt, Human
aaaccacagcaguuga

SEQ ID NO: 2757341 - RNA, 16 nt, Human
aaacggaugauuucua

SEQ ID NO: 2757342 - RNA, 18 nt, Human
aaacggaugauuucuaug

SEQ ID NO: 2757343 - RNA, 14 nt, Human
ggucugugagaugc

SEQ ID NO: 2757344 - RNA, 24 nt, Human
ggucugugagaugcuagaacuccc

SEQ ID NO: 2757345 - RNA, 15 nt, Human
ggugccaguuauggc

SEQ ID NO: 2757346 - RNA, 13 nt, Human
aaaggaauuuaaa

SEQ ID NO: 2757347 - RNA, 13 nt, Human
aaagcuuauuaaa

SEQ ID NO: 2757348 - RNA, 16 nt, Human
aaagaaugauuaugaa

SEQ ID NO: 2757349 - RNA, 16 nt, Human
aaacuuuucugauaga

SEQ ID NO: 2757350 - RNA, 17 nt, Human
aaacuuuucugauagag

SEQ ID NO: 2757351 - RNA, 13 nt, Human
aaacuuuucugau

SEQ ID NO: 2757352 - RNA, 14 nt, Human
aaacuuuucugaua

SEQ ID NO: 2757353 - RNA, 12 nt, Human
aaacuuuucuga

SEQ ID NO: 2757354 - RNA, 17 nt, Human
aaacuuguguaaauaca

SEQ ID NO: 2757355 - RNA, 15 nt, Human
aaacuuguguaaaua

SEQ ID NO: 2757356 - RNA, 23 nt, Human
aaagacuauucaaacagucucag

SEQ ID NO: 2757357 - RNA, 13 nt, Human
aaagacuccaaag

SEQ ID NO: 2757358 - RNA, 22 nt, Human
aaagacuauucaaacagucuca

SEQ ID NO: 2757359 - RNA, 18 nt, Human
aaagagaacuuccagauc

SEQ ID NO: 2757360 - RNA, 20 nt, Human
aaagaggcagcuugaaacug

SEQ ID NO: 2757361 - RNA, 16 nt, Human
ggccuccauccugagg

SEQ ID NO: 2757362 - RNA, 22 nt, Human
ggauguugaaaaaguucugcag

SEQ ID NO: 2757363 - RNA, 22 nt, Human
ggaugguucccuugaugaagaa

SEQ ID NO: 2757364 - RNA, 23 nt, Human
ggaugguucccuugaugaagaag

SEQ ID NO: 2757365 - RNA, 15 nt, Human
ggaggcugagauggg

SEQ ID NO: 2757366 - RNA, 19 nt, Human
ggaggcugagaugggagaa

SEQ ID NO: 2757367 - RNA, 21 nt, Human
gcugccuccccuccucugcuu

SEQ ID NO: 2757368 - RNA, 22 nt, Human
gcugccuccccuccucugcuug

SEQ ID NO: 2757369 - RNA, 16 nt, Human
gcugccuccccuccuc

SEQ ID NO: 2757370 - RNA, 17 nt, Human
gcugccuccccuccucu

SEQ ID NO: 2757371 - RNA, 20 nt, Human
gcugccuccccuccucugcu

SEQ ID NO: 2757372 - RNA, 14 nt, Human
gcuggagcucugcc

SEQ ID NO: 2757373 - RNA, 17 nt, Human
gcuggagcucugcccau

SEQ ID NO: 2757374 - RNA, 16 nt, Human
gcuaguaucaaaagaa

SEQ ID NO: 2757375 - RNA, 21 nt, Human
gcuaguaauuggaaaggcagc

SEQ ID NO: 2757376 - RNA, 18 nt, Human
gcuccccucggagaagag

SEQ ID NO: 2757377 - RNA, 15 nt, Human
gcuccccucggagaa

SEQ ID NO: 2757378 - RNA, 22 nt, Human
gccagacaucaacagauaaaua

SEQ ID NO: 2757379 - RNA, 19 nt, Human
gccagauuuuccugaaaac

SEQ ID NO: 2757380 - RNA, 22 nt, Human
gccagcaguucagagcugcccu

SEQ ID NO: 2757381 - RNA, 23 nt, Human
gccagcaguucagagcugcccuc

SEQ ID NO: 2757382 - RNA, 16 nt, Human
gccauaugaaaaggcu

SEQ ID NO: 2757383 - RNA, 16 nt, Human
gcccccaggugccagu

SEQ ID NO: 2757384 - RNA, 13 nt, Human
gcccuguuaaaag

SEQ ID NO: 2757385 - RNA, 17 nt, Human
gcccuguuaaaagauga

SEQ ID NO: 2757386 - RNA, 14 nt, Human
gcccuguuaaaaga

SEQ ID NO: 2757387 - RNA, 21 nt, Human
gagugaguuggguguauugug

SEQ ID NO: 2757388 - RNA, 16 nt, Human
gaguuuaaauuguaau

SEQ ID NO: 2757389 - RNA, 23 nt, Human
gaggcuccacuuggucugugaga

SEQ ID NO: 2757390 - RNA, 19 nt, Human
gaggcuccacuuggucugu

SEQ ID NO: 2757391 - RNA, 18 nt, Human
gaggcuccacuuggucug

SEQ ID NO: 2757392 - RNA, 15 nt, Human
gaggacgcucucugg

SEQ ID NO: 2757393 - RNA, 21 nt, Human
gauuauucacugauuugacau

SEQ ID NO: 2757394 - RNA, 22 nt, Human
gauuauucacugauuugacaua

SEQ ID NO: 2757395 - RNA, 15 nt, Human
gauuuaccacuugug

SEQ ID NO: 2757396 - RNA, 23 nt, Human
gauucuucagcaaaaauauuuua

SEQ ID NO: 2757397 - RNA, 16 nt, Human
gauuuaccacuugugu

SEQ ID NO: 2757398 - RNA, 18 nt, Human
gaucugccuaaggacuuc

SEQ ID NO: 2757399 - RNA, 20 nt, Human
gaucugccuaaggacuucuu

SEQ ID NO: 2757400 - RNA, 21 nt, Human
gaucugccuaaggacuucuuu

SEQ ID NO: 2757401 - RNA, 23 nt, Human
gaucugccuaaggacuucuuuaa

SEQ ID NO: 2757402 - RNA, 17 nt, Human
gaucugccuaaggacuu

SEQ ID NO: 2757403 - RNA, 16 nt, Human
gaugaucuuuaaaaua

SEQ ID NO: 2757404 - RNA, 17 nt, Human
gauguagaggagaaacu

SEQ ID NO: 2757405 - RNA, 18 nt, Human
gauguagaggagaaacug

SEQ ID NO: 2757406 - RNA, 22 nt, Human
gaugguucccuugaugaagaag

SEQ ID NO: 2757407 - RNA, 18 nt, Human
gauuuuuuuguuguuugu

SEQ ID NO: 2757408 - RNA, 21 nt, Human
gauuuuuuuguuguuuguuua

SEQ ID NO: 2757409 - RNA, 20 nt, Human
gcaaguauuagaauaccaca

SEQ ID NO: 2757410 - RNA, 22 nt, Human
gcaauagucaaauugugugaaa

SEQ ID NO: 2757411 - RNA, 22 nt, Human
gcacaguuuucugagaaagacu

SEQ ID NO: 2757412 - RNA, 20 nt, Human
gcacaguuuucugagaaaga

SEQ ID NO: 2757413 - RNA, 23 nt, Human
gcacaguuuucugagaaagacua

SEQ ID NO: 2757414 - RNA, 14 nt, Human
gaagcaaaauuuuu

SEQ ID NO: 2757415 - RNA, 23 nt, Human
gaagcaacccaaauguucaucaa

SEQ ID NO: 2757416 - RNA, 19 nt, Human
gaacccgggaggcagaggu

SEQ ID NO: 2757417 - RNA, 14 nt, Human
gaacugaaaucaua

SEQ ID NO: 2757418 - RNA, 13 nt, Human
gaacugaaaucau

SEQ ID NO: 2757419 - RNA, 16 nt, Human
gacgcucucuggccuu

SEQ ID NO: 2757420 - RNA, 17 nt, Human
gacgcucucuggccuuc

SEQ ID NO: 2757421 - RNA, 15 nt, Human
gacgcucucuggccu

SEQ ID NO: 2757422 - RNA, 14 nt, Human
gacucuuaagaaga

SEQ ID NO: 2757423 - RNA, 18 nt, Human
gacucuuaagaagacugc

SEQ ID NO: 2757424 - RNA, 21 nt, Human
gacucuuaagaagacugcauu

SEQ ID NO: 2757425 - RNA, 13 nt, Human
gacuguggugacu

SEQ ID NO: 2757426 - RNA, 14 nt, Human
gacuguggugacuu

SEQ ID NO: 2757427 - RNA, 16 nt, Human
gacauuugcucaugga

SEQ ID NO: 2757428 - RNA, 17 nt, Human
gacauuugcucauggaa

SEQ ID NO: 2757429 - RNA, 21 nt, Human
gacagugagacucugucucag

SEQ ID NO: 2757430 - RNA, 15 nt, Human
gacacacugaagaag

SEQ ID NO: 2757431 - RNA, 16 nt, Human
gacacacugaagaagc

SEQ ID NO: 2757432 - RNA, 14 nt, Human
gacacacugaagaa

SEQ ID NO: 2757433 - RNA, 21 nt, Human
gacagaaagcagaacagugau

SEQ ID NO: 2757434 - RNA, 21 nt, Human
cuuugagugucuuaauuaaaa

SEQ ID NO: 2757435 - RNA, 13 nt, Human
cuuucagauacug

SEQ ID NO: 2757436 - RNA, 20 nt, Human
cuuuaaagggauggcaagau

SEQ ID NO: 2757437 - RNA, 14 nt, Human
cuuuaauuuuggaa

SEQ ID NO: 2757438 - RNA, 15 nt, Human
cuuuaauuuuggaau

SEQ ID NO: 2757439 - RNA, 13 nt, Human
cuuuaauuuugga

SEQ ID NO: 2757440 - RNA, 16 nt, Human
cuuuaauuuuggaauu

SEQ ID NO: 2757441 - RNA, 15 nt, Human
cuucuguuuuauaau

SEQ ID NO: 2757442 - RNA, 20 nt, Human
cuucuguuuuauaauuuugu

SEQ ID NO: 2757443 - RNA, 23 nt, Human
cuucaugcugucuacacuaagag

SEQ ID NO: 2757444 - RNA, 11 nt, Human
cuucagacaua

SEQ ID NO: 2757445 - RNA, 11 nt, Human
cuuaaaguuga

SEQ ID NO: 2757446 - RNA, 13 nt, Human
cuuaaaguugaau

SEQ ID NO: 2757447 - RNA, 21 nt, Human
cuggugccucaccccuugcca

SEQ ID NO: 2757448 - RNA, 12 nt, Human
cuggugccucac

SEQ ID NO: 2757449 - RNA, 13 nt, Human
cugggcagcugcc

SEQ ID NO: 2757450 - RNA, 14 nt, Human
cugggcagcugccu

SEQ ID NO: 2757451 - RNA, 15 nt, Human
cugggcagcugccuc

SEQ ID NO: 2757452 - RNA, 17 nt, Human
cugcacuccagccugag

SEQ ID NO: 2757453 - RNA, 20 nt, Human
cugcacuccagccugagcga

SEQ ID NO: 2757454 - RNA, 16 nt, Human
cugcacuccagccuga

SEQ ID NO: 2757455 - RNA, 14 nt, Human
cugcacggugaaug

SEQ ID NO: 2757456 - RNA, 15 nt, Human
cugcacggugaaugg

SEQ ID NO: 2757457 - RNA, 17 nt, Human
cugcacggugaauggcu

SEQ ID NO: 2757458 - RNA, 20 nt, Human
cugcacggugaauggcuuug

SEQ ID NO: 2757459 - RNA, 14 nt, Human
ccaaaaggcagaag

SEQ ID NO: 2757460 - RNA, 14 nt, Human
cauuuguauaaaau

SEQ ID NO: 2757461 - RNA, 16 nt, Human
cauuuguauaaaauaa

SEQ ID NO: 2757462 - RNA, 17 nt, Human
cauugguguuguacuca

SEQ ID NO: 2757463 - RNA, 21 nt, Human
ccaacuccagaaagugacaag

SEQ ID NO: 2757464 - RNA, 19 nt, Human
cauuauauuuauuacugua

SEQ ID NO: 2757465 - RNA, 14 nt, Human
cauuauucaaaguu

SEQ ID NO: 2757466 - RNA, 15 nt, Human
cauuauucaaaguug

SEQ ID NO: 2757467 - RNA, 18 nt, Human
cauccugaggcuccacuu

SEQ ID NO: 2757468 - RNA, 19 nt, Human
cauccugaggcuccacuug

SEQ ID NO: 2757469 - RNA, 19 nt, Human
cauagcagcuuauucacaa

SEQ ID NO: 2757470 - RNA, 16 nt, Human
cauagguuuaauaauu

SEQ ID NO: 2757471 - RNA, 21 nt, Human
caguuauuauauuuacaaaug

SEQ ID NO: 2757472 - RNA, 17 nt, Human
caguuauuauauuuaca

SEQ ID NO: 2757473 - RNA, 20 nt, Human
caguuauggcuauaggugcu

SEQ ID NO: 2757474 - RNA, 19 nt, Human
caguuauggcuauaggugc

SEQ ID NO: 2757475 - RNA, 13 nt, Human
caguuauggcuau

SEQ ID NO: 2757476 - RNA, 22 nt, Human
cagugauuaccagggacugagg

SEQ ID NO: 2757477 - RNA, 15 nt, Human
caguucagagcugcc

SEQ ID NO: 2757478 - RNA, 16 nt, Human
caguucagagcugccc

SEQ ID NO: 2757479 - RNA, 17 nt, Human
caguucagagcugcccu

SEQ ID NO: 2757480 - RNA, 22 nt, Human
caguuauuauauuuacaaaugg

SEQ ID NO: 2757481 - RNA, 23 nt, Human
caguucagagcugcccucuccug

SEQ ID NO: 2757482 - RNA, 24 nt, Human
caguucagagcugcccucuccugg

SEQ ID NO: 2757483 - RNA, 18 nt, Human
caguucagagcugcccuc

SEQ ID NO: 2757484 - RNA, 19 nt, Human
caguucagagcugcccucu

SEQ ID NO: 2757485 - RNA, 21 nt, Human
caguucagagcugcccucucc

SEQ ID NO: 2757486 - RNA, 22 nt, Human
caguucagagcugcccucuccu

SEQ ID NO: 2757487 - RNA, 18 nt, Human
cagacuggcacaguuuuc

SEQ ID NO: 2757488 - RNA, 17 nt, Human
cagacuggcacaguuuu

SEQ ID NO: 2757489 - RNA, 23 nt, Human
cagacuggcacaguuuucugaga

SEQ ID NO: 2757490 - RNA, 22 nt, Human
cagacuggcacaguuuucugag

SEQ ID NO: 2757491 - RNA, 23 nt, Human
cagccagcaguucagagcugccc

SEQ ID NO: 2757492 - RNA, 18 nt, Human
cagccagacuggcacagu

SEQ ID NO: 2757493 - RNA, 15 nt, Human
cagccagacuggcac

SEQ ID NO: 2757494 - RNA, 14 nt, Human
cagccagacuggca

SEQ ID NO: 2757495 - RNA, 18 nt, Human
cagagcugcccucuccug

SEQ ID NO: 2757496 - RNA, 19 nt, Human
cagagcugcccucuccugg

SEQ ID NO: 2757497 - RNA, 20 nt, Human
cagagcugcccucuccuggg

SEQ ID NO: 2757498 - RNA, 21 nt, Human
cagagcugcccucuccugggc

SEQ ID NO: 2757499 - RNA, 23 nt, Human
cagagcugcccucuccugggcag

SEQ ID NO: 2757500 - RNA, 17 nt, Human
cagagcugcccucuccu

SEQ ID NO: 2757501 - RNA, 18 nt, Human
cagauacuggauuguacu

SEQ ID NO: 2757502 - RNA, 14 nt, Human
cagauacuggauug

SEQ ID NO: 2757503 - RNA, 11 nt, Human
caggcuacugu

SEQ ID NO: 2757504 - RNA, 16 nt, Human
caggaaagagaacuuc

SEQ ID NO: 2757505 - RNA, 14 nt, Human
cagcuuauugucua

SEQ ID NO: 2757506 - RNA, 20 nt, Human
cagcuguaugauucccagcc

SEQ ID NO: 2757507 - RNA, 17 nt, Human
cagcuuauucacaagac

SEQ ID NO: 2757508 - RNA, 20 nt, Human
cagcuuauugucuagugaaa

SEQ ID NO: 2757509 - RNA, 11 nt, Human
cagcugccucc

SEQ ID NO: 2757510 - RNA, 10 nt, Human
cagcugccuc

SEQ ID NO: 2757511 - RNA, 9 nt, Human
cagcugccu

SEQ ID NO: 2757512 - RNA, 14 nt, Human
cagcugccuccccu

SEQ ID NO: 2757513 - RNA, 15 nt, Human
cagcugccuccccuc

SEQ ID NO: 2757514 - RNA, 16 nt, Human
cagcugccuccccucc

SEQ ID NO: 2757515 - RNA, 17 nt, Human
cagcugccuccccuccu

SEQ ID NO: 2757516 - RNA, 18 nt, Human
cagcugccuccccuccuc

SEQ ID NO: 2757517 - RNA, 19 nt, Human
cagcugccuccccuccucu

SEQ ID NO: 2757518 - RNA, 20 nt, Human
cagcugccuccccuccucug

SEQ ID NO: 2757519 - RNA, 19 nt, Human
cagcuguaugauucccagc

SEQ ID NO: 2757520 - RNA, 21 nt, Human
caauauuucagauaaucacaa

SEQ ID NO: 2757521 - RNA, 17 nt, Human
caaucagccuaguugau

SEQ ID NO: 2757522 - RNA, 19 nt, Human
caacuauauuguuugcuaa

SEQ ID NO: 2757523 - RNA, 19 nt, Human
caacuaucucauuuccaag

SEQ ID NO: 2757524 - RNA, 12 nt, Human
caacuccagaaa

SEQ ID NO: 2757525 - RNA, 14 nt, Human
caagcaaguauuag

SEQ ID NO: 2757526 - RNA, 16 nt, Human
cacuccagugagacag

SEQ ID NO: 2757527 - RNA, 21 nt, Human
cacuccagugagacagcucug

SEQ ID NO: 2757528 - RNA, 11 nt, Human
cacugaagaag

SEQ ID NO: 2757529 - RNA, 23 nt, Human
cacugaagaagcaccaaucauga

SEQ ID NO: 2757530 - RNA, 23 nt, Human
cacaucagcuugcccuguuaaaa

SEQ ID NO: 2757531 - RNA, 13 nt, Human
cacaucagcuugc

SEQ ID NO: 2757532 - RNA, 18 nt, Human
auuuucuauaauuuaaau

SEQ ID NO: 2757533 - RNA, 17 nt, Human
auuuucuauaauuuaaa

SEQ ID NO: 2757534 - RNA, 19 nt, Human
auuuucuauaauuuaaaua

SEQ ID NO: 2757535 - RNA, 21 nt, Human
caaaagguauuuuaaucacca

SEQ ID NO: 2757536 - RNA, 17 nt, Human
caaacauauauaacaau

SEQ ID NO: 2757537 - RNA, 19 nt, Human
auuuuuauauuugaaauau

SEQ ID NO: 2757538 - RNA, 16 nt, Human
auuuuuauauuugaaa

SEQ ID NO: 2757539 - RNA, 18 nt, Human
auuuuuuuguuguuuguu

SEQ ID NO: 2757540 - RNA, 16 nt, Human
auuucagcagcugcag

SEQ ID NO: 2757541 - RNA, 13 nt, Human
auuuaauaauuau

SEQ ID NO: 2757542 - RNA, 15 nt, Human
auuuaauaauuauau

SEQ ID NO: 2757543 - RNA, 18 nt, Human
auuuaauaauuauaugcu

SEQ ID NO: 2757544 - RNA, 22 nt, Human
auugaggacacugauauggguc

SEQ ID NO: 2757545 - RNA, 15 nt, Human
auuauguaaauccca

SEQ ID NO: 2757546 - RNA, 17 nt, Human
auuauguaaaucccauu

SEQ ID NO: 2757547 - RNA, 22 nt, Human
auuauguaaaucccauuauuca

SEQ ID NO: 2757548 - RNA, 23 nt, Human
auuauguaaaucccauuauucaa

SEQ ID NO: 2757549 - RNA, 13 nt, Human
auuauguaaaucc

SEQ ID NO: 2757550 - RNA, 14 nt, Human
auuauguaaauccc

SEQ ID NO: 2757551 - RNA, 12 nt, Human
auuauguaaauc

SEQ ID NO: 2757552 - RNA, 12 nt, Human
ccuuuucccaac

SEQ ID NO: 2757553 - RNA, 20 nt, Human
cuacaaaaacacagcaaggg

SEQ ID NO: 2757554 - RNA, 20 nt, Human
cuaacgaaguauccuucagc

SEQ ID NO: 2757555 - RNA, 17 nt, Human
ccuucucuucacaguca

SEQ ID NO: 2757556 - RNA, 18 nt, Human
cuauguucuaagaaguga

SEQ ID NO: 2757557 - RNA, 18 nt, Human
cuaucucauuuccaagca

SEQ ID NO: 2757558 - RNA, 23 nt, Human
cuaugucauuugcuggagcucug

SEQ ID NO: 2757559 - RNA, 16 nt, Human
cucaguccaugaagau

SEQ ID NO: 2757560 - RNA, 19 nt, Human
cucccuccaccucccugca

SEQ ID NO: 2757561 - RNA, 20 nt, Human
cucccuccaccucccugcaa

SEQ ID NO: 2757562 - RNA, 21 nt, Human
cucccuccaccucccugcaau

SEQ ID NO: 2757563 - RNA, 22 nt, Human
cucccuccaccucccugcaaua

SEQ ID NO: 2757564 - RNA, 22 nt, Human
cuccucugcuugccaucccucc

SEQ ID NO: 2757565 - RNA, 14 nt, Human
cucucuggccuucg

SEQ ID NO: 2757566 - RNA, 16 nt, Human
cucucuggccuucggc

SEQ ID NO: 2757567 - RNA, 13 nt, Human
cucucuggccuuc

SEQ ID NO: 2757568 - RNA, 19 nt, Human
cucuauguucuaagaagug

SEQ ID NO: 2757569 - RNA, 16 nt, Human
cucuccccaugauguu

SEQ ID NO: 2757570 - RNA, 15 nt, Human
cucuccccaugaugu

SEQ ID NO: 2757571 - RNA, 20 nt, Human
ccuaacgaaguauccuucag

SEQ ID NO: 2757572 - RNA, 16 nt, Human
ccuaaggacuucuuua

SEQ ID NO: 2757573 - RNA, 17 nt, Human
ccuaaggacuucuuuaa

SEQ ID NO: 2757574 - RNA, 18 nt, Human
ccuaaggacuucuuuaau

SEQ ID NO: 2757575 - RNA, 23 nt, Human
ccuaaggacuucuuuaauuuugg

SEQ ID NO: 2757576 - RNA, 11 nt, Human
ccuaaggacuu

SEQ ID NO: 2757577 - RNA, 12 nt, Human
ccuaaggacuuc

SEQ ID NO: 2757578 - RNA, 14 nt, Human
cccugagcaggauu

SEQ ID NO: 2757579 - RNA, 13 nt, Human
cccucggagaaga

SEQ ID NO: 2757580 - RNA, 17 nt, Human
ccucuccugggcagcug

SEQ ID NO: 2757581 - RNA, 18 nt, Human
ccucuccugggcagcugc

SEQ ID NO: 2757582 - RNA, 19 nt, Human
ccucuccugggcagcugcc

SEQ ID NO: 2757583 - RNA, 20 nt, Human
ccucuccugggcagcugccu

SEQ ID NO: 2757584 - RNA, 14 nt, Human
ccucuccugggcag

SEQ ID NO: 2757585 - RNA, 15 nt, Human
ccucuccugggcagc

SEQ ID NO: 2757586 - RNA, 16 nt, Human
ccucuccugggcagcu

SEQ ID NO: 2757587 - RNA, 21 nt, Human
ccucuccugggcagcugccuc

SEQ ID NO: 2757588 - RNA, 22 nt, Human
ccucuccugggcagcugccucc

SEQ ID NO: 2757589 - RNA, 15 nt, Human
ccccauuguggucac

SEQ ID NO: 2757590 - RNA, 18 nt, Human
ccaugggcacugugggua

SEQ ID NO: 2757591 - RNA, 17 nt, Human
ccaugggauaaaugcca

SEQ ID NO: 2757592 - RNA, 19 nt, Human
ccaugggauaaaugccauc

SEQ ID NO: 2757593 - RNA, 22 nt, Human
ccauuguggucacaggaaguag

SEQ ID NO: 2757594 - RNA, 13 nt, Human
ccauuuaaagcuu

SEQ ID NO: 2757595 - RNA, 12 nt, Human
ccacuuggucug

SEQ ID NO: 2757596 - RNA, 20 nt, Human
ccacuuggucugugagaugc

SEQ ID NO: 2757597 - RNA, 22 nt, Human
ccacuuggucugugagaugcua

SEQ ID NO: 2757598 - RNA, 15 nt, Human
ccacuuggucuguga

SEQ ID NO: 2757599 - RNA, 16 nt, Human
ccacuuggucugugag

SEQ ID NO: 2757600 - RNA, 17 nt, Human
ccacuuggucugugaga

SEQ ID NO: 2757601 - RNA, 19 nt, Human
ccacuuggucugugagaug

SEQ ID NO: 2757602 - RNA, 15 nt, Human
ccaggggccaugaau

SEQ ID NO: 2757603 - RNA, 14 nt, Human
ccaguauuguacaa

SEQ ID NO: 2757604 - RNA, 18 nt, Human
aaauuucagcagcugcag

SEQ ID NO: 2757605 - RNA, 17 nt, Human
aaauuucagcagcugca

SEQ ID NO: 2757606 - RNA, 22 nt, Human
aaauguaagggaaacugccagc

SEQ ID NO: 2757607 - RNA, 14 nt, Human
guaugauucccagc

SEQ ID NO: 2757608 - RNA, 17 nt, Human
guaugugugaagugagu

SEQ ID NO: 2757609 - RNA, 13 nt, Human
guaugugugaagu

SEQ ID NO: 2757610 - RNA, 19 nt, Human
aaaucuacacuccagugag

SEQ ID NO: 2757611 - RNA, 14 nt, Human
aaauccuugaagau

SEQ ID NO: 2757612 - RNA, 18 nt, Human
aaauccauuuggaaaucu

SEQ ID NO: 2757613 - RNA, 21 nt, Human
aaauccauuuggaaaucuuua

SEQ ID NO: 2757614 - RNA, 22 nt, Human
aaauccauuuggaaaucuuuaa

SEQ ID NO: 2757615 - RNA, 23 nt, Human
aaauccauuuggaaaucuuuaaa

SEQ ID NO: 2757616 - RNA, 13 nt, Human
aaaucccauuauu

SEQ ID NO: 2757617 - RNA, 15 nt, Human
aaaucccauuauuca

SEQ ID NO: 2757618 - RNA, 16 nt, Human
aaaucccauuauucaa

SEQ ID NO: 2757619 - RNA, 17 nt, Human
aaaucccauuauucaaa

SEQ ID NO: 2757620 - RNA, 19 nt, Human
aaaucccauuauucaaagu

SEQ ID NO: 2757621 - RNA, 20 nt, Human
aaaucccauuauucaaaguu

SEQ ID NO: 2757622 - RNA, 21 nt, Human
aaaucccauuauucaaaguug

SEQ ID NO: 2757623 - RNA, 22 nt, Human
aaaucccauuauucaaaguugc

SEQ ID NO: 2757624 - RNA, 15 nt, Human
aaauccauuuggaaa

SEQ ID NO: 2757625 - RNA, 16 nt, Human
aaauccauuuggaaau

SEQ ID NO: 2757626 - RNA, 14 nt, Human
aaauccauuuggaa

SEQ ID NO: 2757627 - RNA, 18 nt, Human
aaauccauacauuugugu

SEQ ID NO: 2757628 - RNA, 21 nt, Human
aaaugaaagcagggacuugaa

SEQ ID NO: 2757629 - RNA, 22 nt, Human
aaaugaaagcagggacuugaac

SEQ ID NO: 2757630 - RNA, 14 nt, Human
aaaugcauuucuaa

SEQ ID NO: 2757631 - RNA, 19 nt, Human
aaauggcuuccuggcaaua

SEQ ID NO: 2757632 - RNA, 18 nt, Human
aaauggcuuccuggcaau

SEQ ID NO: 2757633 - RNA, 18 nt, Human
aacauuugguaaggggaa

SEQ ID NO: 2757634 - RNA, 22 nt, Human
aacaguagugauaguuguaccg

SEQ ID NO: 2757635 - RNA, 21 nt, Human
aacaagccuccuuuuaaagua

SEQ ID NO: 2757636 - RNA, 15 nt, Human
aacaaggaugaauua

SEQ ID NO: 2757637 - RNA, 21 nt, Human
guccaagcauuuagauguaua

SEQ ID NO: 2757638 - RNA, 24 nt, Human
guccaagcauaccaacacgagcag

SEQ ID NO: 2757639 - RNA, 14 nt, Human
aacuccagaaagug

SEQ ID NO: 2757640 - RNA, 21 nt, Human
aacuccagaaagugacaagcu

SEQ ID NO: 2757641 - RNA, 13 nt, Human
aacucccuuucaa

SEQ ID NO: 2757642 - RNA, 14 nt, Human
aacucccuuucaac

SEQ ID NO: 2757643 - RNA, 18 nt, Human
aacucguuaauuuguagu

SEQ ID NO: 2757644 - RNA, 15 nt, Human
gugaacacaucagcu

SEQ ID NO: 2757645 - RNA, 21 nt, Human
gucuuaauuaaaagaauauuu

SEQ ID NO: 2757646 - RNA, 19 nt, Human
gucuuaauuaaaagaauau

SEQ ID NO: 2757647 - RNA, 22 nt, Human
gucuuaauuaaaagaauauuuu

SEQ ID NO: 2757648 - RNA, 12 nt, Human
aaccacagcagu

SEQ ID NO: 2757649 - RNA, 15 nt, Human
aaccaugggauaaau

SEQ ID NO: 2757650 - RNA, 17 nt, Human
aaccaugggauaaaugc

SEQ ID NO: 2757651 - RNA, 18 nt, Human
aaccaugggauaaaugcc

SEQ ID NO: 2757652 - RNA, 20 nt, Human
aaccaugggauaaaugccau

SEQ ID NO: 2757653 - RNA, 20 nt, Human
aaccuagggugauauuaacc

SEQ ID NO: 2757654 - RNA, 18 nt, Human
aacccaaauguucaucaa

SEQ ID NO: 2757655 - RNA, 13 nt, Human
aacccaaauguuc

SEQ ID NO: 2757656 - RNA, 21 nt, Human
aaccaugggauaaaugccauc

SEQ ID NO: 2757657 - RNA, 20 nt, Human
aacccauauuuguacaccaa

SEQ ID NO: 2757658 - RNA, 18 nt, Human
guuguaccgcaaugugac

SEQ ID NO: 2757659 - RNA, 16 nt, Human
guuuaaaaucauuucu

SEQ ID NO: 2757660 - RNA, 10 nt, Human
guuuaaaauc

SEQ ID NO: 2757661 - RNA, 15 nt, Human
guugccuaaauccau

SEQ ID NO: 2757662 - RNA, 16 nt, Human
guugccuaaauccauu

SEQ ID NO: 2757663 - RNA, 14 nt, Human
guugccuaaaucca

SEQ ID NO: 2757664 - RNA, 21 nt, Human
guuucaaacauauauaacaau

SEQ ID NO: 2757665 - RNA, 23 nt, Human
guuuucugagaaagacuauucaa

SEQ ID NO: 2757666 - RNA, 20 nt, Human
guuucuguacuuuuuggcau

SEQ ID NO: 2757667 - RNA, 23 nt, Human
aagcuuguauuccuuuuucucuc

SEQ ID NO: 2757668 - RNA, 14 nt, Human
guugacaugggaca

SEQ ID NO: 2757669 - RNA, 18 nt, Human
guugacaugggacauuug

SEQ ID NO: 2757670 - RNA, 13 nt, Human
guugacaugggac

SEQ ID NO: 2757671 - RNA, 12 nt, Human
guuagaucuagu

SEQ ID NO: 2757672 - RNA, 21 nt, Human
gugugaccacugcagaagaca

SEQ ID NO: 2757673 - RNA, 19 nt, Human
guguuguacucaauuuuaa

SEQ ID NO: 2757674 - RNA, 19 nt, Human
aagagcuguucacagccag

SEQ ID NO: 2757675 - RNA, 21 nt, Human
gugggacagucaccucaugga

SEQ ID NO: 2757676 - RNA, 16 nt, Human
aagaagugaaaaucua

SEQ ID NO: 2757677 - RNA, 22 nt, Human
aagaagugaaaaucuacacucc

SEQ ID NO: 2757678 - RNA, 18 nt, Human
gugcuaguaauuggaaag

SEQ ID NO: 2757679 - RNA, 16 nt, Human
aagaaugauuaugaau

SEQ ID NO: 2757680 - RNA, 18 nt, Human
aagaaugauuaugaauua

SEQ ID NO: 2757681 - RNA, 19 nt, Human
aagaaugguccgugcuaag

SEQ ID NO: 2757682 - RNA, 22 nt, Human
aagaaugguccgugcuaaggac

SEQ ID NO: 2757683 - RNA, 21 nt, Human
aaugagagacacacugaagaa

SEQ ID NO: 2757684 - RNA, 16 nt, Human
uaaugauaacuggaaa

SEQ ID NO: 2757685 - RNA, 19 nt, Human
aaucuuuaaaaaaaaaauu

SEQ ID NO: 2757686 - RNA, 20 nt, Human
aaucuuuaaaaaaaaaauug

SEQ ID NO: 2757687 - RNA, 23 nt, Human
aaucaugaauuaguuuuauaugc

SEQ ID NO: 2757688 - RNA, 19 nt, Human
aaucaugaauuaguuuuau

SEQ ID NO: 2757689 - RNA, 17 nt, Human
aaucaugaauuaguuuu

SEQ ID NO: 2757690 - RNA, 15 nt, Human
aaucaucaagucuuu

SEQ ID NO: 2757691 - RNA, 13 nt, Human
aauccuugaagau

SEQ ID NO: 2757692 - RNA, 16 nt, Human
aaucuuauaauuuaaa

SEQ ID NO: 2757693 - RNA, 14 nt, Human
aaucuuauaauuua

SEQ ID NO: 2757694 - RNA, 19 nt, Human
aaucugugaacuugaaauu

SEQ ID NO: 2757695 - RNA, 17 nt, Human
aaucugugaacuugaaa

SEQ ID NO: 2757696 - RNA, 18 nt, Human
aaucugugaacuugaaau

SEQ ID NO: 2757697 - RNA, 13 nt, Human
aaucugugaacuu

SEQ ID NO: 2757698 - RNA, 15 nt, Human
aaucugugaacuuga

SEQ ID NO: 2757699 - RNA, 15 nt, Human
uacaaaaacacagca

SEQ ID NO: 2757700 - RNA, 14 nt, Human
uacaaaaacacagc

SEQ ID NO: 2757701 - RNA, 13 nt, Human
uacaaaaacacag

SEQ ID NO: 2757702 - RNA, 18 nt, Human
uacacuaagagagaauga

SEQ ID NO: 2757703 - RNA, 19 nt, Human
uacacuaagagagaaugag

SEQ ID NO: 2757704 - RNA, 16 nt, Human
uacaguauaauuaaca

SEQ ID NO: 2757705 - RNA, 17 nt, Human
uacaguauaauuaacau

SEQ ID NO: 2757706 - RNA, 14 nt, Human
uacaguauaauuaa

SEQ ID NO: 2757707 - RNA, 19 nt, Human
aauggacuuuuguacauag

SEQ ID NO: 2757708 - RNA, 20 nt, Human
aauggacuguggugacuuug

SEQ ID NO: 2757709 - RNA, 11 nt, Human
aaugugauaug

SEQ ID NO: 2757710 - RNA, 18 nt, Human
uacaguauaauuaacaug

SEQ ID NO: 2757711 - RNA, 19 nt, Human
uacaguauaauuaacaugu

SEQ ID NO: 2757712 - RNA, 23 nt, Human
uacaguauaauuaacauguuaaa

SEQ ID NO: 2757713 - RNA, 20 nt, Human
aauaauuuuuauauuugaaa

SEQ ID NO: 2757714 - RNA, 17 nt, Human
uaaauaaauaaauagcu

SEQ ID NO: 2757715 - RNA, 14 nt, Human
uaaauaaauagcua

SEQ ID NO: 2757716 - RNA, 17 nt, Human
aauaauuuuuauauuug

SEQ ID NO: 2757717 - RNA, 19 nt, Human
aauaauuuuuauauuugaa

SEQ ID NO: 2757718 - RNA, 16 nt, Human
aauaauuuuuauauuu

SEQ ID NO: 2757719 - RNA, 18 nt, Human
uaaauagcuagacuggug

SEQ ID NO: 2757720 - RNA, 15 nt, Human
uaaaucugugaacuu

SEQ ID NO: 2757721 - RNA, 16 nt, Human
uaaaucugugaacuug

SEQ ID NO: 2757722 - RNA, 17 nt, Human
uaaaucugugaacuuga

SEQ ID NO: 2757723 - RNA, 18 nt, Human
uaaaucugugaacuugaa

SEQ ID NO: 2757724 - RNA, 19 nt, Human
uaaaucugugaacuugaaa

SEQ ID NO: 2757725 - RNA, 21 nt, Human
uaaaucugugaacuugaaauu

SEQ ID NO: 2757726 - RNA, 22 nt, Human
uaaaucugugaacuugaaauuu

SEQ ID NO: 2757727 - RNA, 21 nt, Human
aauaacaaugaaaguugauaa

SEQ ID NO: 2757728 - RNA, 19 nt, Human
aauaucuuuuuuuuaauaa

SEQ ID NO: 2757729 - RNA, 15 nt, Human
aauauuucagauaau

SEQ ID NO: 2757730 - RNA, 14 nt, Human
aauauuucagauaa

SEQ ID NO: 2757731 - RNA, 17 nt, Human
aauauuuuaugauccag

SEQ ID NO: 2757732 - RNA, 18 nt, Human
aauauuuuaugauccagc

SEQ ID NO: 2757733 - RNA, 24 nt, Human
aauaugcaaagcacugacuucuaa

SEQ ID NO: 2757734 - RNA, 17 nt, Human
aauaugcaaagcacuga

SEQ ID NO: 2757735 - RNA, 15 nt, Human
aauaugcaaagcacu

SEQ ID NO: 2757736 - RNA, 15 nt, Human
aauaucacuugucaa

SEQ ID NO: 2757737 - RNA, 12 nt, Human
aauaucacuugu

SEQ ID NO: 2757738 - RNA, 15 nt, Human
uaacauaaaucugug

SEQ ID NO: 2757739 - RNA, 16 nt, Human
uaacauaaaucuguga

SEQ ID NO: 2757740 - RNA, 17 nt, Human
uaacauaaaucugugaa

SEQ ID NO: 2757741 - RNA, 18 nt, Human
uaacauaaaucugugaac

SEQ ID NO: 2757742 - RNA, 20 nt, Human
uaacauaaaucugugaacuu

SEQ ID NO: 2757743 - RNA, 14 nt, Human
uaacauaaaucugu

SEQ ID NO: 2757744 - RNA, 18 nt, Human
aauaggcguaacuaauuu

SEQ ID NO: 2757745 - RNA, 16 nt, Human
uagcuacuaauuuuaa

SEQ ID NO: 2757746 - RNA, 15 nt, Human
uagcuagacugguga

SEQ ID NO: 2757747 - RNA, 18 nt, Human
uagcuagacuggugacug

SEQ ID NO: 2757748 - RNA, 17 nt, Human
acaaauuuacagagaca

SEQ ID NO: 2757749 - RNA, 15 nt, Human
acaacagcuggugcc

SEQ ID NO: 2757750 - RNA, 22 nt, Human
acaagcucacagaccuuugaac

SEQ ID NO: 2757751 - RNA, 22 nt, Human
aauuuuuucucuaggaaauauu

SEQ ID NO: 2757752 - RNA, 21 nt, Human
aauuuuucuuauuucauuucu

SEQ ID NO: 2757753 - RNA, 16 nt, Human
aauuuuguuucuguac

SEQ ID NO: 2757754 - RNA, 15 nt, Human
aauuuuguuucugua

SEQ ID NO: 2757755 - RNA, 14 nt, Human
uacuuuuuggcaua

SEQ ID NO: 2757756 - RNA, 16 nt, Human
uacuuugugcuggggu

SEQ ID NO: 2757757 - RNA, 22 nt, Human
uacuuugugcugggguuaucug

SEQ ID NO: 2757758 - RNA, 19 nt, Human
uacuuuuuggcauaacaua

SEQ ID NO: 2757759 - RNA, 20 nt, Human
uacuuuuuggcauaacauaa

SEQ ID NO: 2757760 - RNA, 21 nt, Human
uagaugcaguucugaagaaga

SEQ ID NO: 2757761 - RNA, 20 nt, Human
uagaugcaguucugaagaag

SEQ ID NO: 2757762 - RNA, 14 nt, Human
uagaucuaguucac

SEQ ID NO: 2757763 - RNA, 22 nt, Human
uagauaggucagugcaaauacu

SEQ ID NO: 2757764 - RNA, 17 nt, Human
uagauaggccaugggca

SEQ ID NO: 2757765 - RNA, 20 nt, Human
acaaaguauuaagcauauau

SEQ ID NO: 2757766 - RNA, 16 nt, Human
uacuucaugcugucua

SEQ ID NO: 2757767 - RNA, 19 nt, Human
uacuucuuaggguuaugau

SEQ ID NO: 2757768 - RNA, 17 nt, Human
aauuuacagagacagaa

SEQ ID NO: 2757769 - RNA, 18 nt, Human
aauuuacagagacagaaa

SEQ ID NO: 2757770 - RNA, 19 nt, Human
aauuucucccagucauuua

SEQ ID NO: 2757771 - RNA, 18 nt, Human
aauugaggacacugauau

SEQ ID NO: 2757772 - RNA, 17 nt, Human
uacugagagugaacaaa

SEQ ID NO: 2757773 - RNA, 18 nt, Human
uacuaaaaauacaaaaaa

SEQ ID NO: 2757774 - RNA, 14 nt, Human
uacuaaaaauacaa

SEQ ID NO: 2757775 - RNA, 13 nt, Human
acacacugaagaa

SEQ ID NO: 2757776 - RNA, 20 nt, Human
acacacucaaaucaagaaac

SEQ ID NO: 2757777 - RNA, 14 nt, Human
acacaacuauauug

SEQ ID NO: 2757778 - RNA, 17 nt, Human
acacaacuauauuguuu

SEQ ID NO: 2757779 - RNA, 14 nt, Human
acaaugcuguauuu

SEQ ID NO: 2757780 - RNA, 17 nt, Human
acaaugcuguauuuuaa

SEQ ID NO: 2757781 - RNA, 14 nt, Human
acacacugaagaag

SEQ ID NO: 2757782 - RNA, 16 nt, Human
uaguguuggagaagaa

SEQ ID NO: 2757783 - RNA, 17 nt, Human
uaguguuggagaagaac

SEQ ID NO: 2757784 - RNA, 12 nt, Human
uaguguuggaga

SEQ ID NO: 2757785 - RNA, 17 nt, Human
uagucuugucucagauu

SEQ ID NO: 2757786 - RNA, 22 nt, Human
uagucuugucucagauuuuauu

SEQ ID NO: 2757787 - RNA, 17 nt, Human
acacuaagagagaauga

SEQ ID NO: 2757788 - RNA, 18 nt, Human
acacuaagagagaaugag

SEQ ID NO: 2757789 - RNA, 14 nt, Human
acacuaagagagaa

SEQ ID NO: 2757790 - RNA, 23 nt, Human
uauaaaauaauuuuuauauuuga

SEQ ID NO: 2757791 - RNA, 14 nt, Human
acacuccagugaga

SEQ ID NO: 2757792 - RNA, 12 nt, Human
acacugaagaag

SEQ ID NO: 2757793 - RNA, 14 nt, Human
acacugaagaagca

SEQ ID NO: 2757794 - RNA, 12 nt, Human
uauauuuacaaa

SEQ ID NO: 2757795 - RNA, 13 nt, Human
acacuuaaaaaug

SEQ ID NO: 2757796 - RNA, 15 nt, Human
acacuuaaaaauggu

SEQ ID NO: 2757797 - RNA, 20 nt, Human
acagcccuucuuuccacaga

SEQ ID NO: 2757798 - RNA, 21 nt, Human
acagcccuucuuuccacagaa

SEQ ID NO: 2757799 - RNA, 19 nt, Human
acagcccuucuuuccacag

SEQ ID NO: 2757800 - RNA, 19 nt, Human
uauauuuauuacuguaaga

SEQ ID NO: 2757801 - RNA, 15 nt, Human
uauauuuauuacugu

SEQ ID NO: 2757802 - RNA, 17 nt, Human
uaucucaaaacugcacu

SEQ ID NO: 2757803 - RNA, 19 nt, Human
acaugauccugcaauucca

SEQ ID NO: 2757804 - RNA, 14 nt, Human
ucaaagcugaaaug

SEQ ID NO: 2757805 - RNA, 18 nt, Human
ucaaaguugccuaaaucc

SEQ ID NO: 2757806 - RNA, 19 nt, Human
ucaaaguugccuaaaucca

SEQ ID NO: 2757807 - RNA, 21 nt, Human
ucaaaguugccuaaauccauu

SEQ ID NO: 2757808 - RNA, 22 nt, Human
ucaaaguugccuaaauccauuu

SEQ ID NO: 2757809 - RNA, 18 nt, Human
ucaaaagaaagaaaauca

SEQ ID NO: 2757810 - RNA, 16 nt, Human
uauuuuuauauuuacu

SEQ ID NO: 2757811 - RNA, 21 nt, Human
ucaaaauaccaugccauuuaa

SEQ ID NO: 2757812 - RNA, 23 nt, Human
ucaaaauaccaugccauuuaaag

SEQ ID NO: 2757813 - RNA, 21 nt, Human
ucaaaauaugccccauucaac

SEQ ID NO: 2757814 - RNA, 22 nt, Human
ucaagaugaugaugaucuuuaa

SEQ ID NO: 2757815 - RNA, 15 nt, Human
acaguuuucugagaa

SEQ ID NO: 2757816 - RNA, 17 nt, Human
acaguuuucugagaaag

SEQ ID NO: 2757817 - RNA, 16 nt, Human
acaguuuucugagaaa

SEQ ID NO: 2757818 - RNA, 21 nt, Human
acaguuuucugagaaagacua

SEQ ID NO: 2757819 - RNA, 20 nt, Human
acaguuuucugagaaagacu

SEQ ID NO: 2757820 - RNA, 19 nt, Human
acaguuuucugagaaagac

SEQ ID NO: 2757821 - RNA, 18 nt, Human
acaguuuucugagaaaga

SEQ ID NO: 2757822 - RNA, 13 nt, Human
uauuucauuucuu

SEQ ID NO: 2757823 - RNA, 16 nt, Human
uauuucuauauuuuca

SEQ ID NO: 2757824 - RNA, 17 nt, Human
uauuucuauauuuucau

SEQ ID NO: 2757825 - RNA, 18 nt, Human
uauuucuauauuuucauu

SEQ ID NO: 2757826 - RNA, 13 nt, Human
acaucaacagaua

SEQ ID NO: 2757827 - RNA, 14 nt, Human
acauagaauuaaca

SEQ ID NO: 2757828 - RNA, 18 nt, Human
acauagaauuaacacaug

SEQ ID NO: 2757829 - RNA, 19 nt, Human
acauauauaacaaugcugu

SEQ ID NO: 2757830 - RNA, 14 nt, Human
acauagucuggcug

SEQ ID NO: 2757831 - RNA, 15 nt, Human
acauagucuggcugu

SEQ ID NO: 2757832 - RNA, 20 nt, Human
acauagucuggcuguaccca

SEQ ID NO: 2757833 - RNA, 14 nt, Human
accagggacugagg

SEQ ID NO: 2757834 - RNA, 18 nt, Human
accacuuguguuuugcaa

SEQ ID NO: 2757835 - RNA, 15 nt, Human
ucaauucuugccaaa

SEQ ID NO: 2757836 - RNA, 13 nt, Human
ucaauuuuaacaa

SEQ ID NO: 2757837 - RNA, 23 nt, Human
ucaauuuuucuuauuucauuucu

SEQ ID NO: 2757838 - RNA, 20 nt, Human
ucaauuuuucuuauuucauu

SEQ ID NO: 2757839 - RNA, 13 nt, Human
accaaucaugaau

SEQ ID NO: 2757840 - RNA, 15 nt, Human
accaaucaugaauua

SEQ ID NO: 2757841 - RNA, 23 nt, Human
accauuucuugagguaaaagcau

SEQ ID NO: 2757842 - RNA, 19 nt, Human
accaugggauaaaugccau

SEQ ID NO: 2757843 - RNA, 12 nt, Human
ucagagcugccc

SEQ ID NO: 2757844 - RNA, 13 nt, Human
ucaggaaagagaa

SEQ ID NO: 2757845 - RNA, 19 nt, Human
ucaggaaagagaacuucca

SEQ ID NO: 2757846 - RNA, 21 nt, Human
ucaggaaaucaaauaugcaaa

SEQ ID NO: 2757847 - RNA, 20 nt, Human
ucaggaaaucaaauaugcaa

SEQ ID NO: 2757848 - RNA, 19 nt, Human
uccauccugaggcuccacu

SEQ ID NO: 2757849 - RNA, 20 nt, Human
uccauccugaggcuccacuu

SEQ ID NO: 2757850 - RNA, 21 nt, Human
uccauccugaggcuccacuug

SEQ ID NO: 2757851 - RNA, 21 nt, Human
uccaugaagauguagaggaga

SEQ ID NO: 2757852 - RNA, 13 nt, Human
uccaugaagaugu

SEQ ID NO: 2757853 - RNA, 18 nt, Human
uccauuuaauaauuauau

SEQ ID NO: 2757854 - RNA, 22 nt, Human
ucccagucauuuaauaaaugug

SEQ ID NO: 2757855 - RNA, 14 nt, Human
ucccagucauuuaa

SEQ ID NO: 2757856 - RNA, 17 nt, Human
ucccagccagcaguuca

SEQ ID NO: 2757857 - RNA, 18 nt, Human
ucccagccagcaguucag

SEQ ID NO: 2757858 - RNA, 16 nt, Human
uccccucggagaagag

SEQ ID NO: 2757859 - RNA, 17 nt, Human
uccccucggagaagagc

SEQ ID NO: 2757860 - RNA, 13 nt, Human
ucccucccuccac

SEQ ID NO: 2757861 - RNA, 14 nt, Human
ucccucccuccacc

SEQ ID NO: 2757862 - RNA, 21 nt, Human
ucccuccaccucccugcaaua

SEQ ID NO: 2757863 - RNA, 23 nt, Human
ucccuccaccucccugcaauaaa

SEQ ID NO: 2757864 - RNA, 15 nt, Human
ucccucccuccaccu

SEQ ID NO: 2757865 - RNA, 16 nt, Human
ucccucccuccaccuc

SEQ ID NO: 2757866 - RNA, 11 nt, Human
ucccugagcag

SEQ ID NO: 2757867 - RNA, 14 nt, Human
acuccaaagaaaug

SEQ ID NO: 2757868 - RNA, 18 nt, Human
acuccaaagaaauguaag

SEQ ID NO: 2757869 - RNA, 15 nt, Human
acuccaaagaaaugu

SEQ ID NO: 2757870 - RNA, 21 nt, Human
acuccaaagaaauguaaggga

SEQ ID NO: 2757871 - RNA, 18 nt, Human
acuccagaaagugacaag

SEQ ID NO: 2757872 - RNA, 21 nt, Human
accuagggugauauuaaccag

SEQ ID NO: 2757873 - RNA, 16 nt, Human
accuagggugauauua

SEQ ID NO: 2757874 - RNA, 23 nt, Human
ucaggaaaucaaauaugcaaagc

SEQ ID NO: 2757875 - RNA, 22 nt, Human
ucaggaaaucaaauaugcaaag

SEQ ID NO: 2757876 - RNA, 16 nt, Human
ucaugaauuaguuuua

SEQ ID NO: 2757877 - RNA, 12 nt, Human
accucccugcaa

SEQ ID NO: 2757878 - RNA, 13 nt, Human
accucccugcaau

SEQ ID NO: 2757879 - RNA, 14 nt, Human
acgagaaaacaaua

SEQ ID NO: 2757880 - RNA, 20 nt, Human
acgagcaggcuacugucagc

SEQ ID NO: 2757881 - RNA, 19 nt, Human
acgagcaggcuacugucag

SEQ ID NO: 2757882 - RNA, 21 nt, Human
uccaacuaucucauuuccaag

SEQ ID NO: 2757883 - RNA, 14 nt, Human
acugcauuauauuu

SEQ ID NO: 2757884 - RNA, 15 nt, Human
acugcauuauauuua

SEQ ID NO: 2757885 - RNA, 13 nt, Human
acugccuucucaa

SEQ ID NO: 2757886 - RNA, 19 nt, Human
acugccuucucaacuccaa

SEQ ID NO: 2757887 - RNA, 20 nt, Human
acuggcacaguuuucugaga

SEQ ID NO: 2757888 - RNA, 19 nt, Human
acuggcacaguuuucugag

SEQ ID NO: 2757889 - RNA, 13 nt, Human
acuggcacaguuu

SEQ ID NO: 2757890 - RNA, 20 nt, Human
ucuaaagccauuguaguccu

SEQ ID NO: 2757891 - RNA, 22 nt, Human
ucuaaguaaaaccacagcaguu

SEQ ID NO: 2757892 - RNA, 21 nt, Human
ucuaaguaaaaccacagcagu

SEQ ID NO: 2757893 - RNA, 20 nt, Human
ucuaaguaaaaccacagcag

SEQ ID NO: 2757894 - RNA, 16 nt, Human
ucuacauacuauggaa

SEQ ID NO: 2757895 - RNA, 23 nt, Human
ucuaaguaaaaccacagcaguug

SEQ ID NO: 2757896 - RNA, 18 nt, Human
acugggacaggggagaac

SEQ ID NO: 2757897 - RNA, 21 nt, Human
acugucagcuccccucggaga

SEQ ID NO: 2757898 - RNA, 18 nt, Human
acuguggguagacacaca

SEQ ID NO: 2757899 - RNA, 14 nt, Human
acuguggugacuuu

SEQ ID NO: 2757900 - RNA, 15 nt, Human
acuguggugacuuug

SEQ ID NO: 2757901 - RNA, 12 nt, Human
acuguggugacu

SEQ ID NO: 2757902 - RNA, 18 nt, Human
acuguggugacuuuggau

SEQ ID NO: 2757903 - RNA, 20 nt, Human
acuguggugacuuuggauaa

SEQ ID NO: 2757904 - RNA, 21 nt, Human
acuguggugacuuuggauaau

SEQ ID NO: 2757905 - RNA, 22 nt, Human
ucggguuuuauuguuuaaaauc

SEQ ID NO: 2757906 - RNA, 12 nt, Human
ucugaagaagau

SEQ ID NO: 2757907 - RNA, 15 nt, Human
ucugaagucagaucu

SEQ ID NO: 2757908 - RNA, 19 nt, Human
ucugaagucagaucugccu

SEQ ID NO: 2757909 - RNA, 21 nt, Human
ucucuggccuucggccuccau

SEQ ID NO: 2757910 - RNA, 22 nt, Human
ucucuggccuucggccuccauc

SEQ ID NO: 2757911 - RNA, 12 nt, Human
ucucuggccuuc

SEQ ID NO: 2757912 - RNA, 21 nt, Human
acuugaacccauauuuguaca

SEQ ID NO: 2757913 - RNA, 19 nt, Human
acuugaacccgggaggcag

SEQ ID NO: 2757914 - RNA, 20 nt, Human
acuugaacccgggaggcaga

SEQ ID NO: 2757915 - RNA, 20 nt, Human
acuugaaauuugaauuuugu

SEQ ID NO: 2757916 - RNA, 19 nt, Human
acuugaaauuugaauuuug

SEQ ID NO: 2757917 - RNA, 16 nt, Human
acuugaaauuugaauu

SEQ ID NO: 2757918 - RNA, 16 nt, Human
acuugucaauaaaauc

SEQ ID NO: 2757919 - RNA, 23 nt, Human
acuucuaaguaaaaccacagcag

SEQ ID NO: 2757920 - RNA, 16 nt, Human
acuuguguuuugcaag

SEQ ID NO: 2757921 - RNA, 14 nt, Human
acuuguuagaucua

SEQ ID NO: 2757922 - RNA, 15 nt, Human
acuuguuagaucuag

SEQ ID NO: 2757923 - RNA, 23 nt, Human
acuuguuagaucuaguucacucu

SEQ ID NO: 2757924 - RNA, 16 nt, Human
agacacacugaagaag

SEQ ID NO: 2757925 - RNA, 17 nt, Human
agacacacugaagaagc

SEQ ID NO: 2757926 - RNA, 15 nt, Human
agacacacaugaagu

SEQ ID NO: 2757927 - RNA, 23 nt, Human
ucuuagaugcaguucugaagaag

SEQ ID NO: 2757928 - RNA, 22 nt, Human
ucuuagaugcaguucugaagaa

SEQ ID NO: 2757929 - RNA, 19 nt, Human
ucugugaacuugaaauuug

SEQ ID NO: 2757930 - RNA, 22 nt, Human
ucugugaacuugaaauuugaau

SEQ ID NO: 2757931 - RNA, 14 nt, Human
ucuguacuuuuugg

SEQ ID NO: 2757932 - RNA, 17 nt, Human
ucuguacuuuuuggcau

SEQ ID NO: 2757933 - RNA, 13 nt, Human
ucuguacuuuuug

SEQ ID NO: 2757934 - RNA, 23 nt, Human
agaauuaacacaugauccugcaa

SEQ ID NO: 2757935 - RNA, 24 nt, Human
agagacagaaagcagaacagugau

SEQ ID NO: 2757936 - RNA, 15 nt, Human
agagacagaaagcag

SEQ ID NO: 2757937 - RNA, 16 nt, Human
agacuggugacugauu

SEQ ID NO: 2757938 - RNA, 17 nt, Human
agacuggugacugauuc

SEQ ID NO: 2757939 - RNA, 13 nt, Human
agacuggugacug

SEQ ID NO: 2757940 - RNA, 14 nt, Human
agacuggugacuga

SEQ ID NO: 2757941 - RNA, 12 nt, Human
agacuggugacu

SEQ ID NO: 2757942 - RNA, 15 nt, Human
ucuuauuucauuucu

SEQ ID NO: 2757943 - RNA, 16 nt, Human
ucuuauuucauuucuu

SEQ ID NO: 2757944 - RNA, 23 nt, Human
agacuauucaaacagucucagga

SEQ ID NO: 2757945 - RNA, 16 nt, Human
agaguuuagcuggaaa

SEQ ID NO: 2757946 - RNA, 17 nt, Human
agaguuuagcuggaaaa

SEQ ID NO: 2757947 - RNA, 17 nt, Human
ugaauuuauuggcuuuu

SEQ ID NO: 2757948 - RNA, 21 nt, Human
ugaauuuauuggcuuuucuga

SEQ ID NO: 2757949 - RNA, 22 nt, Human
ugaauuuauuggcuuuucugau

SEQ ID NO: 2757950 - RNA, 23 nt, Human
ugaauuuauuggcuuuucugauc

SEQ ID NO: 2757951 - RNA, 14 nt, Human
agaugcuagaacuc

SEQ ID NO: 2757952 - RNA, 18 nt, Human
agaugcaguucugaagaa

SEQ ID NO: 2757953 - RNA, 19 nt, Human
agaugcaguucugaagaag

SEQ ID NO: 2757954 - RNA, 17 nt, Human
agaugcaguucugaaga

SEQ ID NO: 2757955 - RNA, 17 nt, Human
ugacccacaagaaauga

SEQ ID NO: 2757956 - RNA, 15 nt, Human
agagguugcagugag

SEQ ID NO: 2757957 - RNA, 21 nt, Human
agagcuguucacagccagacu

SEQ ID NO: 2757958 - RNA, 19 nt, Human
agagcuguucacagccaga

SEQ ID NO: 2757959 - RNA, 22 nt, Human
agagcugcccucuccugggcag

SEQ ID NO: 2757960 - RNA, 23 nt, Human
ugaacuagaguuuagcuggaaaa

SEQ ID NO: 2757961 - RNA, 19 nt, Human
ugaacaaauuuacagagac

SEQ ID NO: 2757962 - RNA, 20 nt, Human
ugaacaaauuuacagagaca

SEQ ID NO: 2757963 - RNA, 18 nt, Human
ugaacaaauuuacagaga

SEQ ID NO: 2757964 - RNA, 18 nt, Human
ugaaauauuauguuaaaa

SEQ ID NO: 2757965 - RNA, 15 nt, Human
ugaaauuguauuaca

SEQ ID NO: 2757966 - RNA, 21 nt, Human
ugaaauuguaauuauaucuga

SEQ ID NO: 2757967 - RNA, 20 nt, Human
ugaaauuguaauuauaucug

SEQ ID NO: 2757968 - RNA, 15 nt, Human
ugaaauuugaauuuu

SEQ ID NO: 2757969 - RNA, 16 nt, Human
ugaaauuugaauuuug

SEQ ID NO: 2757970 - RNA, 14 nt, Human
ugaaauuugaauuu

SEQ ID NO: 2757971 - RNA, 17 nt, Human
ugaaauuugaauuuugu

SEQ ID NO: 2757972 - RNA, 17 nt, Human
ugaaauaagccagacau

SEQ ID NO: 2757973 - RNA, 18 nt, Human
ugaaauaagccagacauc

SEQ ID NO: 2757974 - RNA, 20 nt, Human
ugaaauaagccagacaucaa

SEQ ID NO: 2757975 - RNA, 23 nt, Human
ugaaauaagccagacaucaacag

SEQ ID NO: 2757976 - RNA, 15 nt, Human
agagcugcccucucc

SEQ ID NO: 2757977 - RNA, 13 nt, Human
agagcugcccucu

SEQ ID NO: 2757978 - RNA, 14 nt, Human
agagcugcccucuc

SEQ ID NO: 2757979 - RNA, 23 nt, Human
agagauuuuuuuguuguuuguuu

SEQ ID NO: 2757980 - RNA, 22 nt, Human
agagauuuuuuuguuguuuguu

SEQ ID NO: 2757981 - RNA, 20 nt, Human
agcaucacaugaacuuguaa

SEQ ID NO: 2757982 - RNA, 22 nt, Human
agcauuuagauguauagguuga

SEQ ID NO: 2757983 - RNA, 16 nt, Human
ugauuaaguaaugaua

SEQ ID NO: 2757984 - RNA, 15 nt, Human
ugauuaaguaaugau

SEQ ID NO: 2757985 - RNA, 19 nt, Human
ugauccagcagauuauuca

SEQ ID NO: 2757986 - RNA, 14 nt, Human
agcaggcuacuguc

SEQ ID NO: 2757987 - RNA, 20 nt, Human
agcaggcuacugucagcucc

SEQ ID NO: 2757988 - RNA, 19 nt, Human
agcaggcuacugucagcuc

SEQ ID NO: 2757989 - RNA, 17 nt, Human
agcaggcuacugucagc

SEQ ID NO: 2757990 - RNA, 16 nt, Human
agcaggcuacugucag

SEQ ID NO: 2757991 - RNA, 19 nt, Human
agcagggcauggcugggaa

SEQ ID NO: 2757992 - RNA, 22 nt, Human
agcauaccaacacgagcaggcu

SEQ ID NO: 2757993 - RNA, 19 nt, Human
agcauaccaacacgagcag

SEQ ID NO: 2757994 - RNA, 15 nt, Human
agcauauauuuuuau

SEQ ID NO: 2757995 - RNA, 13 nt, Human
agcauaccaacac

SEQ ID NO: 2757996 - RNA, 18 nt, Human
agcauauauuuuuauauu

SEQ ID NO: 2757997 - RNA, 20 nt, Human
agcauauauuuuuauauuua

SEQ ID NO: 2757998 - RNA, 22 nt, Human
agcauauauuuuuauauuuacu

SEQ ID NO: 2757999 - RNA, 19 nt, Human
agcagucaggaaagagaac

SEQ ID NO: 2758000 - RNA, 17 nt, Human
agcagucaggaaagaga

SEQ ID NO: 2758001 - RNA, 18 nt, Human
agcagucaggaaagagaa

SEQ ID NO: 2758002 - RNA, 18 nt, Human
ugagugucuuaauuaaaa

SEQ ID NO: 2758003 - RNA, 13 nt, Human
ugccauaauuacu

SEQ ID NO: 2758004 - RNA, 17 nt, Human
ugccaguuauggcuaua

SEQ ID NO: 2758005 - RNA, 19 nt, Human
agccugagcgacagugaga

SEQ ID NO: 2758006 - RNA, 19 nt, Human
ugcauacucauuaggaugg

SEQ ID NO: 2758007 - RNA, 13 nt, Human
ugcauacucauua

SEQ ID NO: 2758008 - RNA, 20 nt, Human
ugcauagauucccugagcag

SEQ ID NO: 2758009 - RNA, 17 nt, Human
ugcaauaaaauggguuu

SEQ ID NO: 2758010 - RNA, 21 nt, Human
ugcaauaaaauggguuuuacu

SEQ ID NO: 2758011 - RNA, 15 nt, Human
ugcaagccagauuuu

SEQ ID NO: 2758012 - RNA, 21 nt, Human
ugcaagccagauuuuccugaa

SEQ ID NO: 2758013 - RNA, 18 nt, Human
ugcaaagcacugacuucu

SEQ ID NO: 2758014 - RNA, 22 nt, Human
ugcaaagcacugacuucuaagu

SEQ ID NO: 2758015 - RNA, 20 nt, Human
ugcaaagcacugacuucuaa

SEQ ID NO: 2758016 - RNA, 13 nt, Human
ugauuucauucaa

SEQ ID NO: 2758017 - RNA, 23 nt, Human
ugauuugacauagucuggcugua

SEQ ID NO: 2758018 - RNA, 22 nt, Human
ugcagaagacaguauggcagcu

SEQ ID NO: 2758019 - RNA, 17 nt, Human
ugcacuccagccugagc

SEQ ID NO: 2758020 - RNA, 15 nt, Human
ugcacuccagccuga

SEQ ID NO: 2758021 - RNA, 13 nt, Human
aggacgcucucug

SEQ ID NO: 2758022 - RNA, 14 nt, Human
aggacgcucucugg

SEQ ID NO: 2758023 - RNA, 16 nt, Human
aggacgcucucuggcc

SEQ ID NO: 2758024 - RNA, 17 nt, Human
aggacgcucucuggccu

SEQ ID NO: 2758025 - RNA, 19 nt, Human
aggacgcucucuggccuuc

SEQ ID NO: 2758026 - RNA, 20 nt, Human
aggacgcucucuggccuucg

SEQ ID NO: 2758027 - RNA, 13 nt, Human
aggaauucuguau

SEQ ID NO: 2758028 - RNA, 14 nt, Human
aggaauucuguaua

SEQ ID NO: 2758029 - RNA, 18 nt, Human
aggagaaacuggaacucu

SEQ ID NO: 2758030 - RNA, 19 nt, Human
aggagaaacuggaacucuc

SEQ ID NO: 2758031 - RNA, 17 nt, Human
aggagaaacuggaacuc

SEQ ID NO: 2758032 - RNA, 16 nt, Human
aggacuucuuuaauuu

SEQ ID NO: 2758033 - RNA, 21 nt, Human
aggacuucuuuaauuuuggaa

SEQ ID NO: 2758034 - RNA, 22 nt, Human
aggacuucuuuaauuuuggaau

SEQ ID NO: 2758035 - RNA, 23 nt, Human
aggacuucuuuaauuuuggaauu

SEQ ID NO: 2758036 - RNA, 14 nt, Human
aggacuucuuuaau

SEQ ID NO: 2758037 - RNA, 17 nt, Human
ugcuuuuaaaaaaaaau

SEQ ID NO: 2758038 - RNA, 17 nt, Human
uggagcucguggaacag

SEQ ID NO: 2758039 - RNA, 21 nt, Human
uggagcucguggaacaguuac

SEQ ID NO: 2758040 - RNA, 14 nt, Human
uggagcucguggaa

SEQ ID NO: 2758041 - RNA, 20 nt, Human
aggcauuuaggccaugggac

SEQ ID NO: 2758042 - RNA, 20 nt, Human
aggcagcucuaaaugucaau

SEQ ID NO: 2758043 - RNA, 15 nt, Human
aggcagcuugaaacu

SEQ ID NO: 2758044 - RNA, 14 nt, Human
uggaguugaaaauc

SEQ ID NO: 2758045 - RNA, 15 nt, Human
aggcccccaggugcc

SEQ ID NO: 2758046 - RNA, 22 nt, Human
aggaaaucaaauaugcaaagca

SEQ ID NO: 2758047 - RNA, 21 nt, Human
aggaaaucaaauaugcaaagc

SEQ ID NO: 2758048 - RNA, 20 nt, Human
aggaaaucaaauaugcaaag

SEQ ID NO: 2758049 - RNA, 19 nt, Human
aggaaaucaaauaugcaaa

SEQ ID NO: 2758050 - RNA, 21 nt, Human
ugcuauuucuauauuuucauu

SEQ ID NO: 2758051 - RNA, 22 nt, Human
ugcuauuucuauauuuucauuc

SEQ ID NO: 2758052 - RNA, 17 nt, Human
ugccuuuucccaacucc

SEQ ID NO: 2758053 - RNA, 19 nt, Human
ugccuuuucccaacuccag

SEQ ID NO: 2758054 - RNA, 14 nt, Human
ugcuacaaaaacac

SEQ ID NO: 2758055 - RNA, 19 nt, Human
agcuugcccuguuaaaaga

SEQ ID NO: 2758056 - RNA, 18 nt, Human
agcuugcccuguuaaaag

SEQ ID NO: 2758057 - RNA, 16 nt, Human
agcuugcccuguuaaa

SEQ ID NO: 2758058 - RNA, 20 nt, Human
agcuugcccuggugccucac

SEQ ID NO: 2758059 - RNA, 20 nt, Human
ugcccuguuaaaagaugaaa

SEQ ID NO: 2758060 - RNA, 19 nt, Human
ugcccuguuaaaagaugaa

SEQ ID NO: 2758061 - RNA, 13 nt, Human
agcugcccucucc

SEQ ID NO: 2758062 - RNA, 14 nt, Human
agcugcccucuccu

SEQ ID NO: 2758063 - RNA, 15 nt, Human
agcugcccucuccug

SEQ ID NO: 2758064 - RNA, 14 nt, Human
ugccaucaauaaaa

SEQ ID NO: 2758065 - RNA, 22 nt, Human
ugccaucaauaaaaaauuauga

SEQ ID NO: 2758066 - RNA, 14 nt, Human
agcuguucacagcc

SEQ ID NO: 2758067 - RNA, 16 nt, Human
uguaaaggaauuuaaa

SEQ ID NO: 2758068 - RNA, 15 nt, Human
uguaaauacaauuuu

SEQ ID NO: 2758069 - RNA, 16 nt, Human
uggugcccugcuuuca

SEQ ID NO: 2758070 - RNA, 19 nt, Human
uggugcccugcuuucagau

SEQ ID NO: 2758071 - RNA, 20 nt, Human
uggugcccugcuuucagaua

SEQ ID NO: 2758072 - RNA, 14 nt, Human
uggugcccugcuuu

SEQ ID NO: 2758073 - RNA, 14 nt, Human
uguaguguuggaga

SEQ ID NO: 2758074 - RNA, 15 nt, Human
uguaguguuggagaa

SEQ ID NO: 2758075 - RNA, 18 nt, Human
uguaucacaaaucuuaac

SEQ ID NO: 2758076 - RNA, 15 nt, Human
uguaucacaaaucuu

SEQ ID NO: 2758077 - RNA, 13 nt, Human
uguaugugugaag

SEQ ID NO: 2758078 - RNA, 22 nt, Human
uguauuacaaauccaaugaaau

SEQ ID NO: 2758079 - RNA, 13 nt, Human
uguauuacaaauc

SEQ ID NO: 2758080 - RNA, 18 nt, Human
aguauuagaauaccacag

SEQ ID NO: 2758081 - RNA, 14 nt, Human
agucaccucaugga

SEQ ID NO: 2758082 - RNA, 15 nt, Human
agucaccucauggaa

SEQ ID NO: 2758083 - RNA, 17 nt, Human
agucaccucauggaauu

SEQ ID NO: 2758084 - RNA, 18 nt, Human
aguauuucuaugaaauau

SEQ ID NO: 2758085 - RNA, 17 nt, Human
aguauuucuaugaaaua

SEQ ID NO: 2758086 - RNA, 16 nt, Human
aguauuucuaugaaau

SEQ ID NO: 2758087 - RNA, 13 nt, Human
aguaaugauaacu

SEQ ID NO: 2758088 - RNA, 17 nt, Human
aguaaugauaacuggaa

SEQ ID NO: 2758089 - RNA, 18 nt, Human
aguaaugauaacuggaaa

SEQ ID NO: 2758090 - RNA, 20 nt, Human
aguaaugauaacuggaaacu

SEQ ID NO: 2758091 - RNA, 13 nt, Human
aguaaaauccaca

SEQ ID NO: 2758092 - RNA, 13 nt, Human
agggaaauuucag

SEQ ID NO: 2758093 - RNA, 21 nt, Human
agggaggacgcucucuggccu

SEQ ID NO: 2758094 - RNA, 22 nt, Human
agggaggacgcucucuggccuu

SEQ ID NO: 2758095 - RNA, 23 nt, Human
agggaggacgcucucuggccuuc

SEQ ID NO: 2758096 - RNA, 18 nt, Human
aggggagcaugggaagug

SEQ ID NO: 2758097 - RNA, 16 nt, Human
aguucugcagauaaac

SEQ ID NO: 2758098 - RNA, 21 nt, Human
aguucugcagauaaacaguag

SEQ ID NO: 2758099 - RNA, 16 nt, Human
aguucugaagaagaug

SEQ ID NO: 2758100 - RNA, 14 nt, Human
uguuuugcaagcca

SEQ ID NO: 2758101 - RNA, 19 nt, Human
uguuuucauuaucucaaaa

SEQ ID NO: 2758102 - RNA, 19 nt, Human
uguuuggaccaaaaaccag

SEQ ID NO: 2758103 - RNA, 14 nt, Human
uguuuauuacagua

SEQ ID NO: 2758104 - RNA, 22 nt, Human
uguuuagucuugucucagauuu

SEQ ID NO: 2758105 - RNA, 20 nt, Human
uguuuagucuugucucagau

SEQ ID NO: 2758106 - RNA, 23 nt, Human
uguuuagucuugucucagauuuu

SEQ ID NO: 2758107 - RNA, 16 nt, Human
aguuuagcuggaaaag

SEQ ID NO: 2758108 - RNA, 20 nt, Human
aguuuaauauuaaagccaug

SEQ ID NO: 2758109 - RNA, 15 nt, Human
aguuuaauauuaaag

SEQ ID NO: 2758110 - RNA, 16 nt, Human
aguuuaauauuaaagc

SEQ ID NO: 2758111 - RNA, 18 nt, Human
aguuuaauauuaaagcca

SEQ ID NO: 2758112 - RNA, 19 nt, Human
aguuuaauauuaaagccau

SEQ ID NO: 2758113 - RNA, 17 nt, Human
aguuggguguauugugc

SEQ ID NO: 2758114 - RNA, 20 nt, Human
aguuggguguauugugcgcu

SEQ ID NO: 2758115 - RNA, 22 nt, Human
aguugccuaaauccauuuggaa

SEQ ID NO: 2758116 - RNA, 23 nt, Human
aguugccuaaauccauuuggaaa

SEQ ID NO: 2758117 - RNA, 19 nt, Human
aguugccuaaauccauuug

SEQ ID NO: 2758118 - RNA, 16 nt, Human
aguuggguguauugug

SEQ ID NO: 2758119 - RNA, 14 nt, Human
uuaacaacagcugg

SEQ ID NO: 2758120 - RNA, 14 nt, Human
uuaccuuacagaag

SEQ ID NO: 2758121 - RNA, 12 nt, Human
uuaccugggaaa

SEQ ID NO: 2758122 - RNA, 15 nt, Human
uuacuguaagaaaau

SEQ ID NO: 2758123 - RNA, 16 nt, Human
auaaauagcuagacug

SEQ ID NO: 2758124 - RNA, 18 nt, Human
auaaauagcuagacuggu

SEQ ID NO: 2758125 - RNA, 21 nt, Human
auaaaucugugaacuugaaau

SEQ ID NO: 2758126 - RNA, 22 nt, Human
auaaaucugugaacuugaaauu

SEQ ID NO: 2758127 - RNA, 20 nt, Human
auaaaucugugaacuugaaa

SEQ ID NO: 2758128 - RNA, 16 nt, Human
uuacaguauaauuaac

SEQ ID NO: 2758129 - RNA, 17 nt, Human
uuacaguauaauuaaca

SEQ ID NO: 2758130 - RNA, 13 nt, Human
uuacaguauaauu

SEQ ID NO: 2758131 - RNA, 18 nt, Human
uuacaguauaauuaacau

SEQ ID NO: 2758132 - RNA, 19 nt, Human
uuacaguauaauuaacaug

SEQ ID NO: 2758133 - RNA, 20 nt, Human
uuacaguauaauuaacaugu

SEQ ID NO: 2758134 - RNA, 20 nt, Human
uuaagaagacugcauuauau

SEQ ID NO: 2758135 - RNA, 22 nt, Human
uuaagaagacugcauuauauuu

SEQ ID NO: 2758136 - RNA, 18 nt, Human
uuaaguaaugauaacugg

SEQ ID NO: 2758137 - RNA, 15 nt, Human
auaaaauaauuuuua

SEQ ID NO: 2758138 - RNA, 16 nt, Human
auaaaauaauuuuuau

SEQ ID NO: 2758139 - RNA, 21 nt, Human
auaaaauaauuuuuauauuug

SEQ ID NO: 2758140 - RNA, 18 nt, Human
auaaaauccauacauuug

SEQ ID NO: 2758141 - RNA, 19 nt, Human
auaaaauccauacauuugu

SEQ ID NO: 2758142 - RNA, 18 nt, Human
agucuuucacauuuaaau

SEQ ID NO: 2758143 - RNA, 20 nt, Human
agugaaacucguuaauuugu

SEQ ID NO: 2758144 - RNA, 15 nt, Human
ugugagaugcuagaa

SEQ ID NO: 2758145 - RNA, 19 nt, Human
ugugagaugcuagaacucc

SEQ ID NO: 2758146 - RNA, 22 nt, Human
agucucaggaaaucaaauaugc

SEQ ID NO: 2758147 - RNA, 16 nt, Human
agucucaggaaaucaa

SEQ ID NO: 2758148 - RNA, 14 nt, Human
ugugaacuugaaau

SEQ ID NO: 2758149 - RNA, 15 nt, Human
ugugaacuugaaauu

SEQ ID NO: 2758150 - RNA, 16 nt, Human
ugugaacuugaaauuu

SEQ ID NO: 2758151 - RNA, 12 nt, Human
ugugaacuugaa

SEQ ID NO: 2758152 - RNA, 16 nt, Human
agugaacaaauuuaca

SEQ ID NO: 2758153 - RNA, 20 nt, Human
agugaacaaauuuacagaga

SEQ ID NO: 2758154 - RNA, 15 nt, Human
agugaaagaaaauaa

SEQ ID NO: 2758155 - RNA, 18 nt, Human
ugugcugggguuaucuga

SEQ ID NO: 2758156 - RNA, 20 nt, Human
uguggucacaggaaguagag

SEQ ID NO: 2758157 - RNA, 19 nt, Human
agugaguuggguguauugu

SEQ ID NO: 2758158 - RNA, 13 nt, Human
uguguaaguagau

SEQ ID NO: 2758159 - RNA, 15 nt, Human
uguuauaaucuuuca

SEQ ID NO: 2758160 - RNA, 18 nt, Human
uguuccuagugaaagagg

SEQ ID NO: 2758161 - RNA, 14 nt, Human
uguuccuagugaaa

SEQ ID NO: 2758162 - RNA, 19 nt, Human
aucaauuuuucuuauuuca

SEQ ID NO: 2758163 - RNA, 17 nt, Human
auauuuuaugauccagc

SEQ ID NO: 2758164 - RNA, 22 nt, Human
auauuuuaugauccagcagauu

SEQ ID NO: 2758165 - RNA, 12 nt, Human
auauuuuaugau

SEQ ID NO: 2758166 - RNA, 13 nt, Human
auauuuuaugauc

SEQ ID NO: 2758167 - RNA, 13 nt, Human
auauuugaaauau

SEQ ID NO: 2758168 - RNA, 22 nt, Human
auauuuguaucacaaaucuuaa

SEQ ID NO: 2758169 - RNA, 12 nt, Human
auauuuuaacuu

SEQ ID NO: 2758170 - RNA, 23 nt, Human
auauuugaaauauugacuuuuua

SEQ ID NO: 2758171 - RNA, 14 nt, Human
auauuugaaauauu

SEQ ID NO: 2758172 - RNA, 19 nt, Human
auauuugaaauauugacuu

SEQ ID NO: 2758173 - RNA, 14 nt, Human
auauuaaagccaug

SEQ ID NO: 2758174 - RNA, 15 nt, Human
auauuaaagccaugu

SEQ ID NO: 2758175 - RNA, 18 nt, Human
auauuaaagccauguuua

SEQ ID NO: 2758176 - RNA, 23 nt, Human
auauuaaagccauguuuauuaca

SEQ ID NO: 2758177 - RNA, 12 nt, Human
uucugaagaaga

SEQ ID NO: 2758178 - RNA, 13 nt, Human
uucugaagaagau

SEQ ID NO: 2758179 - RNA, 14 nt, Human
uucugaagaagaug

SEQ ID NO: 2758180 - RNA, 23 nt, Human
uucugcaucagcugcugaaacaa

SEQ ID NO: 2758181 - RNA, 16 nt, Human
uucugcaucagcugcu

SEQ ID NO: 2758182 - RNA, 11 nt, Human
aucccucccuc

SEQ ID NO: 2758183 - RNA, 13 nt, Human
aucccucccucca

SEQ ID NO: 2758184 - RNA, 23 nt, Human
aucccucccuccaccucccugca

SEQ ID NO: 2758185 - RNA, 20 nt, Human
aucauuucugcaucagcugc

SEQ ID NO: 2758186 - RNA, 14 nt, Human
uucucaacuccaaa

SEQ ID NO: 2758187 - RNA, 18 nt, Human
uucucaacuccaaacuga

SEQ ID NO: 2758188 - RNA, 17 nt, Human
uuauuguuuaaaaucau

SEQ ID NO: 2758189 - RNA, 18 nt, Human
auagcuacuaauuuuaaa

SEQ ID NO: 2758190 - RNA, 15 nt, Human
auagcuagacuggug

SEQ ID NO: 2758191 - RNA, 16 nt, Human
auagcuagacugguga

SEQ ID NO: 2758192 - RNA, 14 nt, Human
auagcuagacuggu

SEQ ID NO: 2758193 - RNA, 18 nt, Human
auagcuagacuggugacu

SEQ ID NO: 2758194 - RNA, 19 nt, Human
auagcuagacuggugacug

SEQ ID NO: 2758195 - RNA, 23 nt, Human
auagcuagacuggugacugauuc

SEQ ID NO: 2758196 - RNA, 17 nt, Human
auagcuacuaauuuuaa

SEQ ID NO: 2758197 - RNA, 14 nt, Human
auagcuacuaauuu

SEQ ID NO: 2758198 - RNA, 21 nt, Human
auaggaauugacccacaagaa

SEQ ID NO: 2758199 - RNA, 15 nt, Human
uucaaacauauauaa

SEQ ID NO: 2758200 - RNA, 17 nt, Human
auagucaaauuguguga

SEQ ID NO: 2758201 - RNA, 18 nt, Human
auagucaaauugugugaa

SEQ ID NO: 2758202 - RNA, 14 nt, Human
auauauaacaaugc

SEQ ID NO: 2758203 - RNA, 17 nt, Human
auauauaacaaugcugu

SEQ ID NO: 2758204 - RNA, 18 nt, Human
auauauaacaaugcugua

SEQ ID NO: 2758205 - RNA, 19 nt, Human
auauaagcuuguauuccuu

SEQ ID NO: 2758206 - RNA, 12 nt, Human
auauaacaaugc

SEQ ID NO: 2758207 - RNA, 15 nt, Human
auauaacaaugcugu

SEQ ID NO: 2758208 - RNA, 21 nt, Human
uucagcaaaaauauuuuauga

SEQ ID NO: 2758209 - RNA, 15 nt, Human
auaugcaaagcacug

SEQ ID NO: 2758210 - RNA, 16 nt, Human
auaugcaaagcacuga

SEQ ID NO: 2758211 - RNA, 23 nt, Human
auaugcaaagcacugacuucuaa

SEQ ID NO: 2758212 - RNA, 15 nt, Human
auaucugaggaauuc

SEQ ID NO: 2758213 - RNA, 16 nt, Human
auaucugaggaauucu

SEQ ID NO: 2758214 - RNA, 17 nt, Human
auaucugaggaauucug

SEQ ID NO: 2758215 - RNA, 18 nt, Human
auaucugaggaauucugu

SEQ ID NO: 2758216 - RNA, 19 nt, Human
auaucugaggaauucugua

SEQ ID NO: 2758217 - RNA, 20 nt, Human
auaucugaggaauucuguau

SEQ ID NO: 2758218 - RNA, 21 nt, Human
auaucugaggaauucuguaua

SEQ ID NO: 2758219 - RNA, 22 nt, Human
auaucugaggaauucuguauag

SEQ ID NO: 2758220 - RNA, 23 nt, Human
auaucugaggaauucuguauaga

SEQ ID NO: 2758221 - RNA, 18 nt, Human
augaacuuguaaaggaau

SEQ ID NO: 2758222 - RNA, 15 nt, Human
aucuuauaauuuaaa

SEQ ID NO: 2758223 - RNA, 16 nt, Human
aucuuauaauuuaaaa

SEQ ID NO: 2758224 - RNA, 14 nt, Human
aucuuauaauuuaa

SEQ ID NO: 2758225 - RNA, 15 nt, Human
aucuuuaaaauacac

SEQ ID NO: 2758226 - RNA, 12 nt, Human
aucuuuaaaaua

SEQ ID NO: 2758227 - RNA, 17 nt, Human
uuggagaagaacugaaa

SEQ ID NO: 2758228 - RNA, 22 nt, Human
uuggagaagaacugaaaucaua

SEQ ID NO: 2758229 - RNA, 15 nt, Human
uuggagaagaacuga

SEQ ID NO: 2758230 - RNA, 15 nt, Human
aucucaaaacugcac

SEQ ID NO: 2758231 - RNA, 20 nt, Human
aucucaaaacugcacuguca

SEQ ID NO: 2758232 - RNA, 19 nt, Human
aucucaaaacugcacuguc

SEQ ID NO: 2758233 - RNA, 13 nt, Human
uugacaugggaca

SEQ ID NO: 2758234 - RNA, 12 nt, Human
uugacuuuuuau

SEQ ID NO: 2758235 - RNA, 16 nt, Human
aucugaagucagaucu

SEQ ID NO: 2758236 - RNA, 17 nt, Human
aucugaagucagaucug

SEQ ID NO: 2758237 - RNA, 18 nt, Human
aucugaagucagaucugc

SEQ ID NO: 2758238 - RNA, 23 nt, Human
aucugaagucagaucugccuaag

SEQ ID NO: 2758239 - RNA, 21 nt, Human
uuuauaugcuucuguuuuaua

SEQ ID NO: 2758240 - RNA, 19 nt, Human
uuuauaugcuucuguuuua

SEQ ID NO: 2758241 - RNA, 17 nt, Human
uuuagucuugucucaga

SEQ ID NO: 2758242 - RNA, 23 nt, Human
uuuagucuugucucagauuuuau

SEQ ID NO: 2758243 - RNA, 15 nt, Human
uuuagucuugucuca

SEQ ID NO: 2758244 - RNA, 14 nt, Human
augccuuuucccaa

SEQ ID NO: 2758245 - RNA, 20 nt, Human
augccuuuucccaacuccag

SEQ ID NO: 2758246 - RNA, 22 nt, Human
augccuuuucccaacuccagaa

SEQ ID NO: 2758247 - RNA, 18 nt, Human
augcuacaggauuugaaa

SEQ ID NO: 2758248 - RNA, 14 nt, Human
augccaucaauaaa

SEQ ID NO: 2758249 - RNA, 23 nt, Human
augcuguauuuuaaaagaaugau

SEQ ID NO: 2758250 - RNA, 19 nt, Human
augcuguauuuuaaaagaa

SEQ ID NO: 2758251 - RNA, 22 nt, Human
augcuguauuuuaaaagaauga

SEQ ID NO: 2758252 - RNA, 21 nt, Human
augcuucuguuuuauaauuuu

SEQ ID NO: 2758253 - RNA, 19 nt, Human
uuucaaacauauauaacaa

SEQ ID NO: 2758254 - RNA, 17 nt, Human
uuucaaacauauauaac

SEQ ID NO: 2758255 - RNA, 21 nt, Human
uuuaaauauaugcuaagucuu

SEQ ID NO: 2758256 - RNA, 14 nt, Human
augcaaagcacuga

SEQ ID NO: 2758257 - RNA, 13 nt, Human
augcaaagcacug

SEQ ID NO: 2758258 - RNA, 12 nt, Human
augcaaagcacu

SEQ ID NO: 2758259 - RNA, 18 nt, Human
uuuaaaaaaauuccaagu

SEQ ID NO: 2758260 - RNA, 13 nt, Human
augauuucauuca

SEQ ID NO: 2758261 - RNA, 17 nt, Human
augagguacugagagug

SEQ ID NO: 2758262 - RNA, 18 nt, Human
augagguacugagaguga

SEQ ID NO: 2758263 - RNA, 15 nt, Human
augagguacugagag

SEQ ID NO: 2758264 - RNA, 20 nt, Human
uugucaauaaaauccauaca

SEQ ID NO: 2758265 - RNA, 15 nt, Human
auuacuguaagaaaa

SEQ ID NO: 2758266 - RNA, 16 nt, Human
auuacuguaagaaaau

SEQ ID NO: 2758267 - RNA, 21 nt, Human
auuagaauucuguauagauua

SEQ ID NO: 2758268 - RNA, 14 nt, Human
uuuugugaagcaaa

SEQ ID NO: 2758269 - RNA, 15 nt, Human
uuuuggaauuuuccu

SEQ ID NO: 2758270 - RNA, 15 nt, Human
uuuuguuuucauuau

SEQ ID NO: 2758271 - RNA, 20 nt, Human
uuuuuauauuuacuaaaaug

SEQ ID NO: 2758272 - RNA, 15 nt, Human
uuuuugaagcuguau

SEQ ID NO: 2758273 - RNA, 23 nt, Human
uuuuuggcauaacauaaaucugu

SEQ ID NO: 2758274 - RNA, 24 nt, Human
uuuuuggcauaacauaaaucugug

SEQ ID NO: 2758275 - RNA, 17 nt, Human
auuccaagugauugaaa

SEQ ID NO: 2758276 - RNA, 12 nt, Human
auucacugauuu

SEQ ID NO: 2758277 - RNA, 17 nt, Human
auucacugauuugacau

SEQ ID NO: 2758278 - RNA, 20 nt, Human
auuauauggcuugaguuuaa

SEQ ID NO: 2758279 - RNA, 18 nt, Human
auuauaugcuauuucuau

SEQ ID NO: 2758280 - RNA, 17 nt, Human
auuauaugcuauuucua

SEQ ID NO: 2758281 - RNA, 19 nt, Human
auuauaugcuauuucuaua

SEQ ID NO: 2758282 - RNA, 19 nt, Human
auuauucaaaguugccuaa

SEQ ID NO: 2758283 - RNA, 22 nt, Human
auuauucaaaguugccuaaauc

SEQ ID NO: 2758284 - RNA, 18 nt, Human
auuauucaaaguugccua

SEQ ID NO: 2758285 - RNA, 24 nt, Human
auuauucaaaguugccuaaaucca

SEQ ID NO: 2758286 - RNA, 19 nt, Human
auuauucacugauuugaca

SEQ ID NO: 2758287 - RNA, 20 nt, Human
auuauaucugaggaauucug

SEQ ID NO: 2758288 - RNA, 21 nt, Human
auuauaucugaggaauucugu

SEQ ID NO: 2758289 - RNA, 22 nt, Human
auuauaucugaggaauucugua

SEQ ID NO: 2758290 - RNA, 16 nt, Human
auuauaugcuauuucu

SEQ ID NO: 2758291 - RNA, 18 nt, Human
auuauaucugaggaauuc

SEQ ID NO: 2758292 - RNA, 19 nt, Human
auuauaucugaggaauucu

SEQ ID NO: 2758293 - RNA, 22 nt, Human
auucaaacagucucaggaaauc

SEQ ID NO: 2758294 - RNA, 20 nt, Human
uuugcuggagcucugcccau

SEQ ID NO: 2758295 - RNA, 19 nt, Human
uuugcuaagcauuccaacu

SEQ ID NO: 2758296 - RNA, 12 nt, Human
uuugaauuuugu

SEQ ID NO: 2758297 - RNA, 14 nt, Human
uuugaauuuugugu

SEQ ID NO: 2758298 - RNA, 17 nt, Human
uuuguaguguuggagaa

SEQ ID NO: 2758299 - RNA, 23 nt, Human
augucgucaaagcugaaauggac

SEQ ID NO: 2758300 - RNA, 19 nt, Human
auguauauuuuauaucaau

SEQ ID NO: 2758301 - RNA, 21 nt, Human
augugcuaguaauuggaaagg

SEQ ID NO: 2758302 - RNA, 20 nt, Human
augugcuaguaauuggaaag

SEQ ID NO: 2758303 - RNA, 22 nt, Human
uuuuauggcacuaguauuucua

SEQ ID NO: 2758304 - RNA, 20 nt, Human
uuuucaggcuagauguaugu

SEQ ID NO: 2758305 - RNA, 16 nt, Human
uuuucucuaggaaaua

SEQ ID NO: 2758306 - RNA, 19 nt, Human
uuuucugauccaguuuugu

SEQ ID NO: 2758307 - RNA, 12 nt, Human
auguuuauuaca

SEQ ID NO: 2758308 - RNA, 15 nt, Human
auguuuauuacagua

SEQ ID NO: 2758309 - RNA, 16 nt, Human
auguuuauuacaguau

SEQ ID NO: 2758310 - RNA, 18 nt, Human
auguuuauuacaguauaa

SEQ ID NO: 2758311 - RNA, 19 nt, Human
auguuuauuacaguauaau

SEQ ID NO: 2758312 - RNA, 22 nt, Human
auguuuauuacaguauaauuaa

SEQ ID NO: 2758313 - RNA, 23 nt, Human
auguuuauuacaguauaauuaac

SEQ ID NO: 2758314 - RNA, 16 nt, Human
auuggagcucguggaa

SEQ ID NO: 2758315 - RNA, 17 nt, Human
auuggagcucgugggac

SEQ ID NO: 2758316 - RNA, 14 nt, Human
auuggggauucuua

SEQ ID NO: 2758317 - RNA, 15 nt, Human
auuggggauucuuaa

SEQ ID NO: 2758318 - RNA, 16 nt, Human
auuggggauucuuaaa

SEQ ID NO: 2758319 - RNA, 20 nt, Human
auuggggauucuuaaaguug

SEQ ID NO: 2758320 - RNA, 21 nt, Human
auuggggauucuuaaaguuga

SEQ ID NO: 2758321 - RNA, 22 nt, Human
auuggggauucuuaaaguugaa

SEQ ID NO: 2758322 - RNA, 20 nt, Human
auuucuugagguaaaagcau

SEQ ID NO: 2758323 - RNA, 13 nt, Human
auuugaauuuugu

SEQ ID NO: 2758324 - RNA, 21 nt, Human
auuuauuuuaauaauguuuca

SEQ ID NO: 2758325 - RNA, 20 nt, Human
auuuauuggcuuuucugauc

SEQ ID NO: 2758326 - RNA, 23 nt, Human
auuuauuggcuuuucugauccag

SEQ ID NO: 2758327 - RNA, 19 nt, Human
auuuauuacuguaagaaaa

SEQ ID NO: 2758328 - RNA, 20 nt, Human
auuuauuacuguaagaaaau

SEQ ID NO: 2758329 - RNA, 14 nt, Human
auuuauuggcuuuu

SEQ ID NO: 2758330 - RNA, 18 nt, Human
auuuauuggcuuuucuga

SEQ ID NO: 2758331 - RNA, 17 nt, Human
auuuaaaaaaaaaccug

SEQ ID NO: 2758332 - RNA, 16 nt, Human
auuguaguccuguaau

SEQ ID NO: 2758333 - RNA, 15 nt, Human
auuguacuuugugcu

SEQ ID NO: 2758334 - RNA, 15 nt, Human
auuuaccacuugugu

SEQ ID NO: 2758335 - RNA, 22 nt, Human
auuuaccacuuguguuuugcaa

SEQ ID NO: 2758336 - RNA, 15 nt, Human
auuuacuaaaaugga

SEQ ID NO: 2758337 - RNA, 16 nt, Human
auuuacuaaaauggac

SEQ ID NO: 2758338 - RNA, 19 nt, Human
auuuacuaaaauggacugu

SEQ ID NO: 2758339 - RNA, 20 nt, Human
auuuacuaaaauggacugug

SEQ ID NO: 2758340 - RNA, 18 nt, Human
auuuuaauaauguuucaa

SEQ ID NO: 2758341 - RNA, 19 nt, Human
auuuuaauaauguuucaaa

SEQ ID NO: 2758342 - RNA, 17 nt, Human
auuuuaacaacagcugg

SEQ ID NO: 2758343 - RNA, 14 nt, Human
caaagaaauguaag

SEQ ID NO: 2758344 - RNA, 15 nt, Human
caaaguugccuaaau

SEQ ID NO: 2758345 - RNA, 17 nt, Human
caaaguugccuaaaucc

SEQ ID NO: 2758346 - RNA, 14 nt, Human
caaaguugccuaaa

SEQ ID NO: 2758347 - RNA, 18 nt, Human
caaaguugccuaaaucca

SEQ ID NO: 2758348 - RNA, 19 nt, Human
caagacugcacaucaaaau

SEQ ID NO: 2758349 - RNA, 13 nt, Human
caagaaaugaaag

SEQ ID NO: 2758350 - RNA, 16 nt, Human
caagcauaccaacacg

SEQ ID NO: 2758351 - RNA, 21 nt, Human
caagcauaccaacacgagcag

SEQ ID NO: 2758352 - RNA, 16 nt, Human
caagcauuuagaugua

SEQ ID NO: 2758353 - RNA, 19 nt, Human
caagcauuuagauguauag

SEQ ID NO: 2758354 - RNA, 16 nt, Human
caaauuuacagagaca

SEQ ID NO: 2758355 - RNA, 17 nt, Human
caaauuuacagagacag

SEQ ID NO: 2758356 - RNA, 23 nt, Human
caaauuuacagagacagaaagca

SEQ ID NO: 2758357 - RNA, 23 nt, Human
cacaagaaaugaaagcagggacu

SEQ ID NO: 2758358 - RNA, 23 nt, Human
cacaagacccaaaaggcagaagc

SEQ ID NO: 2758359 - RNA, 13 nt, Human
cacaagaaaugaa

SEQ ID NO: 2758360 - RNA, 15 nt, Human
cacaagaaaugaaag

SEQ ID NO: 2758361 - RNA, 13 nt, Human
caauuuuguuucu

SEQ ID NO: 2758362 - RNA, 14 nt, Human
caauuuuguuucug

SEQ ID NO: 2758363 - RNA, 16 nt, Human
caauuuuguuucugua

SEQ ID NO: 2758364 - RNA, 17 nt, Human
caauuuuguuucuguac

SEQ ID NO: 2758365 - RNA, 17 nt, Human
cacaugaaguccaagca

SEQ ID NO: 2758366 - RNA, 20 nt, Human
cacaugaaguccaagcauuu

SEQ ID NO: 2758367 - RNA, 16 nt, Human
cacaugaaguccaagc

SEQ ID NO: 2758368 - RNA, 20 nt, Human
cacaguuuucugagaaagac

SEQ ID NO: 2758369 - RNA, 22 nt, Human
cacaguuuucugagaaagacua

SEQ ID NO: 2758370 - RNA, 21 nt, Human
cacaguuuucugagaaagacu

SEQ ID NO: 2758371 - RNA, 13 nt, Human
cccaggugccagu

SEQ ID NO: 2758372 - RNA, 18 nt, Human
ccaucaaggguacacugc

SEQ ID NO: 2758373 - RNA, 19 nt, Human
ccaucaauaaaaaauuaug

SEQ ID NO: 2758374 - RNA, 20 nt, Human
ccaucaauaaaaaauuauga

SEQ ID NO: 2758375 - RNA, 14 nt, Human
ccaugaagauguag

SEQ ID NO: 2758376 - RNA, 16 nt, Human
ccaugauguuuagaaa

SEQ ID NO: 2758377 - RNA, 18 nt, Human
cccaaaaggcagaagcaa

SEQ ID NO: 2758378 - RNA, 13 nt, Human
cccaaaaggcaga

SEQ ID NO: 2758379 - RNA, 17 nt, Human
ccaggugccaguuaugg

SEQ ID NO: 2758380 - RNA, 20 nt, Human
ccaggaauggagccugcacg

SEQ ID NO: 2758381 - RNA, 13 nt, Human
ccacugcagaaga

SEQ ID NO: 2758382 - RNA, 18 nt, Human
ccacugcagaagacagua

SEQ ID NO: 2758383 - RNA, 16 nt, Human
ccaauauucauagcag

SEQ ID NO: 2758384 - RNA, 20 nt, Human
ccacaggaaccacaagacug

SEQ ID NO: 2758385 - RNA, 22 nt, Human
ccaaacugacucuuaagaagac

SEQ ID NO: 2758386 - RNA, 23 nt, Human
ccaaauuucauaccuaucaucuu

SEQ ID NO: 2758387 - RNA, 14 nt, Human
ccaagcaaguauua

SEQ ID NO: 2758388 - RNA, 17 nt, Human
ccaagcauuuagaugua

SEQ ID NO: 2758389 - RNA, 22 nt, Human
ccaagcauaccaacacgagcag

SEQ ID NO: 2758390 - RNA, 17 nt, Human
cauuuaggccaugggac

SEQ ID NO: 2758391 - RNA, 23 nt, Human
cauuuaauaauuauaugcuauuu

SEQ ID NO: 2758392 - RNA, 15 nt, Human
cauuuaauaauuaua

SEQ ID NO: 2758393 - RNA, 16 nt, Human
cauuuaauaauuauau

SEQ ID NO: 2758394 - RNA, 17 nt, Human
cauuuaauaauuauaug

SEQ ID NO: 2758395 - RNA, 19 nt, Human
cauuuaauaauuauaugcu

SEQ ID NO: 2758396 - RNA, 12 nt, Human
cauuuaauaauu

SEQ ID NO: 2758397 - RNA, 14 nt, Human
cauuuaauaauuau

SEQ ID NO: 2758398 - RNA, 13 nt, Human
cauuugcucaugg

SEQ ID NO: 2758399 - RNA, 18 nt, Human
cauuugcucauggaauug

SEQ ID NO: 2758400 - RNA, 14 nt, Human
cggccuccauccug

SEQ ID NO: 2758401 - RNA, 16 nt, Human
cggccuccauccugag

SEQ ID NO: 2758402 - RNA, 17 nt, Human
cggccuccauccugagg

SEQ ID NO: 2758403 - RNA, 14 nt, Human
cggaugauuucuau

SEQ ID NO: 2758404 - RNA, 13 nt, Human
cggaugauuucua

SEQ ID NO: 2758405 - RNA, 11 nt, Human
cgcaaugugac

SEQ ID NO: 2758406 - RNA, 16 nt, Human
ccuuucucuuucguua

SEQ ID NO: 2758407 - RNA, 13 nt, Human
cgcguugaaauug

SEQ ID NO: 2758408 - RNA, 17 nt, Human
cgcguugaaauuguaau

SEQ ID NO: 2758409 - RNA, 21 nt, Human
cgcguugaaauuguaauuaua

SEQ ID NO: 2758410 - RNA, 13 nt, Human
cguugaaauugua

SEQ ID NO: 2758411 - RNA, 23 nt, Human
cguucauggaacgcguugaaauu

SEQ ID NO: 2758412 - RNA, 21 nt, Human
cguucauggaacgcguugaaa

SEQ ID NO: 2758413 - RNA, 22 nt, Human
cguucauggaacgcguugaaau

SEQ ID NO: 2758414 - RNA, 20 nt, Human
ccugggcagcugccuccccu

SEQ ID NO: 2758415 - RNA, 15 nt, Human
ccugggcagcugccu

SEQ ID NO: 2758416 - RNA, 16 nt, Human
ccugggcagcugccuc

SEQ ID NO: 2758417 - RNA, 17 nt, Human
ccugggcagcugccucc

SEQ ID NO: 2758418 - RNA, 18 nt, Human
ccugggcagcugccuccc

SEQ ID NO: 2758419 - RNA, 21 nt, Human
ccugcuuucagauacuggauu

SEQ ID NO: 2758420 - RNA, 15 nt, Human
ccugcuuucagauac

SEQ ID NO: 2758421 - RNA, 16 nt, Human
ccugcuuucagauacu

SEQ ID NO: 2758422 - RNA, 12 nt, Human
ccuucagccuga

SEQ ID NO: 2758423 - RNA, 17 nt, Human
ccuccccuccucugcuu

SEQ ID NO: 2758424 - RNA, 18 nt, Human
ccuccccuccucugcuug

SEQ ID NO: 2758425 - RNA, 12 nt, Human
ccucccugcaau

SEQ ID NO: 2758426 - RNA, 16 nt, Human
ccucccugcaauaaaa

SEQ ID NO: 2758427 - RNA, 11 nt, Human
ccuccucugcu

SEQ ID NO: 2758428 - RNA, 15 nt, Human
ccuccccuccucugc

SEQ ID NO: 2758429 - RNA, 14 nt, Human
ccuccccuccucug

SEQ ID NO: 2758430 - RNA, 20 nt, Human
ccucagaaaacaaggaugaa

SEQ ID NO: 2758431 - RNA, 17 nt, Human
ccucugcuugccauccc

SEQ ID NO: 2758432 - RNA, 20 nt, Human
ccucugcuugccaucccucc

SEQ ID NO: 2758433 - RNA, 21 nt, Human
ccucugcuugccaucccuccc

SEQ ID NO: 2758434 - RNA, 11 nt, Human
ccucuccuggg

SEQ ID NO: 2758435 - RNA, 12 nt, Human
ccucuccugggc

SEQ ID NO: 2758436 - RNA, 13 nt, Human
ccucuccugggca

SEQ ID NO: 2758437 - RNA, 17 nt, Human
ccugaggcuccacuugg

SEQ ID NO: 2758438 - RNA, 18 nt, Human
ccugaggcuccacuuggu

SEQ ID NO: 2758439 - RNA, 20 nt, Human
ccugaggcuccacuuggucu

SEQ ID NO: 2758440 - RNA, 12 nt, Human
ccugauuaaaga

SEQ ID NO: 2758441 - RNA, 13 nt, Human
ccugauuaaagaa

SEQ ID NO: 2758442 - RNA, 23 nt, Human
ccugaaagaggaaugaaguacuc

SEQ ID NO: 2758443 - RNA, 18 nt, Human
ccugaaagaggaaugaag

SEQ ID NO: 2758444 - RNA, 13 nt, Human
ccugaaagaggaa

SEQ ID NO: 2758445 - RNA, 23 nt, Human
ccucuuagaugcaguucugaaga

SEQ ID NO: 2758446 - RNA, 15 nt, Human
cccuugaugaagaag

SEQ ID NO: 2758447 - RNA, 16 nt, Human
cccuugaugaagaagu

SEQ ID NO: 2758448 - RNA, 22 nt, Human
ccgggaggcagagguugcagug

SEQ ID NO: 2758449 - RNA, 13 nt, Human
ccgugcuaaggac

SEQ ID NO: 2758450 - RNA, 21 nt, Human
ccucacccacccuuuuuuaaa

SEQ ID NO: 2758451 - RNA, 21 nt, Human
cuggucccagccagcaguuca

SEQ ID NO: 2758452 - RNA, 22 nt, Human
cugggaacccaaguccaagcau

SEQ ID NO: 2758453 - RNA, 19 nt, Human
cuggcacaguuuucugaga

SEQ ID NO: 2758454 - RNA, 18 nt, Human
cuggcacaguuuucugag

SEQ ID NO: 2758455 - RNA, 19 nt, Human
cuggauuguacuuugugcu

SEQ ID NO: 2758456 - RNA, 20 nt, Human
cuggauuguacuuugugcug

SEQ ID NO: 2758457 - RNA, 16 nt, Human
cuggccaacgggguga

SEQ ID NO: 2758458 - RNA, 23 nt, Human
cuggaauaauccuaaacauauga

SEQ ID NO: 2758459 - RNA, 13 nt, Human
cugcugaaacaac

SEQ ID NO: 2758460 - RNA, 18 nt, Human
cugcuuucagauacugga

SEQ ID NO: 2758461 - RNA, 21 nt, Human
cugcuuucagauacuggauug

SEQ ID NO: 2758462 - RNA, 16 nt, Human
cugcuuucagauacug

SEQ ID NO: 2758463 - RNA, 15 nt, Human
cugccuaagugcagc

SEQ ID NO: 2758464 - RNA, 20 nt, Human
cugccuaaggacuucuuuaa

SEQ ID NO: 2758465 - RNA, 21 nt, Human
cugccuaaggacuucuuuaau

SEQ ID NO: 2758466 - RNA, 22 nt, Human
cugccuaaggacuucuuuaauu

SEQ ID NO: 2758467 - RNA, 19 nt, Human
cugccuaaggacuucuuua

SEQ ID NO: 2758468 - RNA, 23 nt, Human
cugcagaagacaguauggcagcu

SEQ ID NO: 2758469 - RNA, 13 nt, Human
cugcagaagacag

SEQ ID NO: 2758470 - RNA, 15 nt, Human
cugauucuucagcaa

SEQ ID NO: 2758471 - RNA, 21 nt, Human
cugauguuccuagugaaagag

SEQ ID NO: 2758472 - RNA, 20 nt, Human
cugauguuccuagugaaaga

SEQ ID NO: 2758473 - RNA, 18 nt, Human
cugauguuccuagugaaa

SEQ ID NO: 2758474 - RNA, 13 nt, Human
cugauguuccuag

SEQ ID NO: 2758475 - RNA, 20 nt, Human
cugauagaggaagccugauu

SEQ ID NO: 2758476 - RNA, 20 nt, Human
cugauccaguuuuguuugga

SEQ ID NO: 2758477 - RNA, 15 nt, Human
cugaagucagaucug

SEQ ID NO: 2758478 - RNA, 16 nt, Human
cugaagucagaucugc

SEQ ID NO: 2758479 - RNA, 14 nt, Human
cugaagucagaucu

SEQ ID NO: 2758480 - RNA, 21 nt, Human
cugaagucagaucugccuaag

SEQ ID NO: 2758481 - RNA, 21 nt, Human
cucuccugggcagcugccucc

SEQ ID NO: 2758482 - RNA, 13 nt, Human
cucuccauuuaau

SEQ ID NO: 2758483 - RNA, 23 nt, Human
cucugcauacucauuaggauggc

SEQ ID NO: 2758484 - RNA, 14 nt, Human
cuccaccucccugc

SEQ ID NO: 2758485 - RNA, 15 nt, Human
cuccaccucccugca

SEQ ID NO: 2758486 - RNA, 16 nt, Human
cuccaccucccugcaa

SEQ ID NO: 2758487 - RNA, 17 nt, Human
cuccaccucccugcaau

SEQ ID NO: 2758488 - RNA, 17 nt, Human
cucccagucauuuaaua

SEQ ID NO: 2758489 - RNA, 23 nt, Human
cuccauccugaggcuccacuugg

SEQ ID NO: 2758490 - RNA, 21 nt, Human
cuccauccugaggcuccacuu

SEQ ID NO: 2758491 - RNA, 20 nt, Human
cuccauccugaggcuccacu

SEQ ID NO: 2758492 - RNA, 17 nt, Human
cucauuaggauggcuag

SEQ ID NO: 2758493 - RNA, 18 nt, Human
cucauuaggauggcuagu

SEQ ID NO: 2758494 - RNA, 12 nt, Human
cucggagaagag

SEQ ID NO: 2758495 - RNA, 20 nt, Human
cucggagaagagcuguucac

SEQ ID NO: 2758496 - RNA, 13 nt, Human
cucggagaagagc

SEQ ID NO: 2758497 - RNA, 13 nt, Human
cucccuuucaaca

SEQ ID NO: 2758498 - RNA, 12 nt, Human
cucccuuucaac

SEQ ID NO: 2758499 - RNA, 16 nt, Human
cucccuucucuucaca

SEQ ID NO: 2758500 - RNA, 18 nt, Human
cuccuaucaccugucuug

SEQ ID NO: 2758501 - RNA, 18 nt, Human
cuucggccuccauccuga

SEQ ID NO: 2758502 - RNA, 17 nt, Human
cuucggccuccauccug

SEQ ID NO: 2758503 - RNA, 19 nt, Human
cuuccuuggacucauuuua

SEQ ID NO: 2758504 - RNA, 18 nt, Human
cuucagcgguuuauauaa

SEQ ID NO: 2758505 - RNA, 16 nt, Human
cuucagcgguuuauau

SEQ ID NO: 2758506 - RNA, 19 nt, Human
cuuccagauccuggaaauc

SEQ ID NO: 2758507 - RNA, 13 nt, Human
cuuauaauuuaaa

SEQ ID NO: 2758508 - RNA, 21 nt, Human
cuuaggguuaugauuaaguaa

SEQ ID NO: 2758509 - RNA, 19 nt, Human
cuuauaggaauugacccac

SEQ ID NO: 2758510 - RNA, 14 nt, Human
cuuauaauuuaaaa

SEQ ID NO: 2758511 - RNA, 19 nt, Human
cuuagaugcaguucugaag

SEQ ID NO: 2758512 - RNA, 19 nt, Human
cuuacuaguuucccuugca

SEQ ID NO: 2758513 - RNA, 19 nt, Human
cuguuuuauaauuuuguga

SEQ ID NO: 2758514 - RNA, 18 nt, Human
cuuaaugccacuaaauug

SEQ ID NO: 2758515 - RNA, 19 nt, Human
gaaaauaacaauaaaagac

SEQ ID NO: 2758516 - RNA, 20 nt, Human
gaaaaguauguuagugcaaa

SEQ ID NO: 2758517 - RNA, 14 nt, Human
gaaaaguauguuag

SEQ ID NO: 2758518 - RNA, 14 nt, Human
gaaaacaaggauga

SEQ ID NO: 2758519 - RNA, 14 nt, Human
cuuuucugauccag

SEQ ID NO: 2758520 - RNA, 15 nt, Human
cuuuucugauccagu

SEQ ID NO: 2758521 - RNA, 11 nt, Human
cuuuucugauc

SEQ ID NO: 2758522 - RNA, 16 nt, Human
cuuuucugauccaguu

SEQ ID NO: 2758523 - RNA, 18 nt, Human
cuuuucugauccaguuuu

SEQ ID NO: 2758524 - RNA, 15 nt, Human
cuuuuuuaaauaaau

SEQ ID NO: 2758525 - RNA, 12 nt, Human
cuuuuucauuau

SEQ ID NO: 2758526 - RNA, 13 nt, Human
cuuuuucauuauu

SEQ ID NO: 2758527 - RNA, 14 nt, Human
cuuuuucauuauuu

SEQ ID NO: 2758528 - RNA, 19 nt, Human
cuuuccucaaaacuucaga

SEQ ID NO: 2758529 - RNA, 16 nt, Human
cuuuggauaauaagga

SEQ ID NO: 2758530 - RNA, 14 nt, Human
cuuuggauaauaag

SEQ ID NO: 2758531 - RNA, 17 nt, Human
cuuguacuuuauuuucu

SEQ ID NO: 2758532 - RNA, 18 nt, Human
cuuggggcugaugcaguu

SEQ ID NO: 2758533 - RNA, 16 nt, Human
cuuggggcugaugcag

SEQ ID NO: 2758534 - RNA, 16 nt, Human
cuuggacucauuuuaa

SEQ ID NO: 2758535 - RNA, 13 nt, Human
cuuguuagaucua

SEQ ID NO: 2758536 - RNA, 16 nt, Human
cuuguuagaucuaguu

SEQ ID NO: 2758537 - RNA, 17 nt, Human
cuuuaaaaaaaaaauug

SEQ ID NO: 2758538 - RNA, 22 nt, Human
cuugcccuguuaaaagaugaaa

SEQ ID NO: 2758539 - RNA, 20 nt, Human
cuugcuugauuguauggugg

SEQ ID NO: 2758540 - RNA, 14 nt, Human
cuugccaucccucc

SEQ ID NO: 2758541 - RNA, 17 nt, Human
cuugccaucccucccuc

SEQ ID NO: 2758542 - RNA, 15 nt, Human
cuugccaucccuccc

SEQ ID NO: 2758543 - RNA, 16 nt, Human
cuugccaucccucccu

SEQ ID NO: 2758544 - RNA, 19 nt, Human
cuugccaucccucccucca

SEQ ID NO: 2758545 - RNA, 18 nt, Human
cuugcccuggugccucac

SEQ ID NO: 2758546 - RNA, 14 nt, Human
cuugcccuguuaaa

SEQ ID NO: 2758547 - RNA, 24 nt, Human
gacugcauuauauuuauuacugua

SEQ ID NO: 2758548 - RNA, 16 nt, Human
gacugauucuucagca

SEQ ID NO: 2758549 - RNA, 13 nt, Human
gacugauucuuca

SEQ ID NO: 2758550 - RNA, 16 nt, Human
gacugaggggagggga

SEQ ID NO: 2758551 - RNA, 14 nt, Human
gacuggcacaguuu

SEQ ID NO: 2758552 - RNA, 22 nt, Human
gacuggcacaguuuucugagaa

SEQ ID NO: 2758553 - RNA, 18 nt, Human
gacuggcacaguuuucug

SEQ ID NO: 2758554 - RNA, 16 nt, Human
gaccacugcagaagac

SEQ ID NO: 2758555 - RNA, 18 nt, Human
gaccacugcagaagacag

SEQ ID NO: 2758556 - RNA, 18 nt, Human
gacccaaaaggcagaagc

SEQ ID NO: 2758557 - RNA, 19 nt, Human
gacccaaaaggcagaagca

SEQ ID NO: 2758558 - RNA, 20 nt, Human
gacccaaaaggcagaagcaa

SEQ ID NO: 2758559 - RNA, 23 nt, Human
gacaggaugguucccuugaugaa

SEQ ID NO: 2758560 - RNA, 14 nt, Human
gacaucaacagaua

SEQ ID NO: 2758561 - RNA, 16 nt, Human
gaaguauccuucagcc

SEQ ID NO: 2758562 - RNA, 14 nt, Human
gaaguauccuucag

SEQ ID NO: 2758563 - RNA, 12 nt, Human
gaaguccaagca

SEQ ID NO: 2758564 - RNA, 22 nt, Human
gaaguccaagcauuuagaugua

SEQ ID NO: 2758565 - RNA, 16 nt, Human
gaauauuuuaacuucc

SEQ ID NO: 2758566 - RNA, 14 nt, Human
gaauuuauuggcuu

SEQ ID NO: 2758567 - RNA, 16 nt, Human
gaauuuauuggcuuuu

SEQ ID NO: 2758568 - RNA, 20 nt, Human
gaauuuauuggcuuuucuga

SEQ ID NO: 2758569 - RNA, 21 nt, Human
gaauuuauuggcuuuucugau

SEQ ID NO: 2758570 - RNA, 22 nt, Human
gaauuuauuggcuuuucugauc

SEQ ID NO: 2758571 - RNA, 21 nt, Human
gaauggcuuuguauagaaccu

SEQ ID NO: 2758572 - RNA, 20 nt, Human
gaaugguccgugcuaaggac

SEQ ID NO: 2758573 - RNA, 22 nt, Human
gaaugguccgugcuaaggacuu

SEQ ID NO: 2758574 - RNA, 23 nt, Human
gaaugguccgugcuaaggacuug

SEQ ID NO: 2758575 - RNA, 17 nt, Human
gaagauguagaggagaa

SEQ ID NO: 2758576 - RNA, 18 nt, Human
gaagauguagaggagaaa

SEQ ID NO: 2758577 - RNA, 12 nt, Human
gaagaacugaaa

SEQ ID NO: 2758578 - RNA, 19 nt, Human
gaagacugcauuauauuua

SEQ ID NO: 2758579 - RNA, 17 nt, Human
gaagacugcauuauauu

SEQ ID NO: 2758580 - RNA, 16 nt, Human
gaaauuguauuacaaa

SEQ ID NO: 2758581 - RNA, 17 nt, Human
gaaauuguaauuauauc

SEQ ID NO: 2758582 - RNA, 16 nt, Human
gaacagugauuaccag

SEQ ID NO: 2758583 - RNA, 20 nt, Human
gaacagugauuaccagggac

SEQ ID NO: 2758584 - RNA, 15 nt, Human
gaacauaaaauacaa

SEQ ID NO: 2758585 - RNA, 14 nt, Human
gauccuggaaauca

SEQ ID NO: 2758586 - RNA, 17 nt, Human
gaucuaguucacucucc

SEQ ID NO: 2758587 - RNA, 13 nt, Human
gauaaacaguagu

SEQ ID NO: 2758588 - RNA, 22 nt, Human
gauaauaaggaaaaguuuaaua

SEQ ID NO: 2758589 - RNA, 20 nt, Human
gauaauaaggaaaaguuuaa

SEQ ID NO: 2758590 - RNA, 21 nt, Human
gauaauaaggaaaaguuuaau

SEQ ID NO: 2758591 - RNA, 23 nt, Human
gaucagcuuauugucuagugaaa

SEQ ID NO: 2758592 - RNA, 16 nt, Human
gcaagaugugggcagu

SEQ ID NO: 2758593 - RNA, 12 nt, Human
gcaagauguggg

SEQ ID NO: 2758594 - RNA, 16 nt, Human
gaugcuagaacucccu

SEQ ID NO: 2758595 - RNA, 22 nt, Human
gauuaaguaaugauaacuggaa

SEQ ID NO: 2758596 - RNA, 14 nt, Human
gauuaaguaaugau

SEQ ID NO: 2758597 - RNA, 14 nt, Human
gcagaagacaguau

SEQ ID NO: 2758598 - RNA, 15 nt, Human
gcacugucaagauga

SEQ ID NO: 2758599 - RNA, 20 nt, Human
gcacagccucuuagaugcag

SEQ ID NO: 2758600 - RNA, 15 nt, Human
gcaggcuacugucag

SEQ ID NO: 2758601 - RNA, 13 nt, Human
gcaguucugaaga

SEQ ID NO: 2758602 - RNA, 18 nt, Human
gcauagauucccugagca

SEQ ID NO: 2758603 - RNA, 14 nt, Human
gcauauauuuuuau

SEQ ID NO: 2758604 - RNA, 15 nt, Human
gcauauauuuuuaua

SEQ ID NO: 2758605 - RNA, 11 nt, Human
gcauauauuuu

SEQ ID NO: 2758606 - RNA, 16 nt, Human
gcauauauuuuuauau

SEQ ID NO: 2758607 - RNA, 18 nt, Human
gcccucuccugggcagcu

SEQ ID NO: 2758608 - RNA, 19 nt, Human
gcccucuccugggcagcug

SEQ ID NO: 2758609 - RNA, 21 nt, Human
gcccucuccugggcagcugcc

SEQ ID NO: 2758610 - RNA, 14 nt, Human
gcccucuccugggc

SEQ ID NO: 2758611 - RNA, 15 nt, Human
gcccucuccugggca

SEQ ID NO: 2758612 - RNA, 16 nt, Human
gcccucuccugggcag

SEQ ID NO: 2758613 - RNA, 19 nt, Human
gccccugcacuccagccug

SEQ ID NO: 2758614 - RNA, 17 nt, Human
gccccgugggguuccuc

SEQ ID NO: 2758615 - RNA, 16 nt, Human
gcccacagcuguauga

SEQ ID NO: 2758616 - RNA, 22 nt, Human
gccauuuaaagcuuauuaaaac

SEQ ID NO: 2758617 - RNA, 14 nt, Human
gccaugggacaggg

SEQ ID NO: 2758618 - RNA, 19 nt, Human
gccaugggacagggaggac

SEQ ID NO: 2758619 - RNA, 15 nt, Human
gccaucccucccucc

SEQ ID NO: 2758620 - RNA, 16 nt, Human
gccaucccucccucca

SEQ ID NO: 2758621 - RNA, 11 nt, Human
gccaucccucc

SEQ ID NO: 2758622 - RNA, 13 nt, Human
gccaucccucccu

SEQ ID NO: 2758623 - RNA, 14 nt, Human
gccaucccucccuc

SEQ ID NO: 2758624 - RNA, 22 nt, Human
gccacguucuuacuaguuuccc

SEQ ID NO: 2758625 - RNA, 19 nt, Human
gccuucggccuccauccug

SEQ ID NO: 2758626 - RNA, 18 nt, Human
gccuucggccuccauccu

SEQ ID NO: 2758627 - RNA, 22 nt, Human
gcgacagugagacucugucuca

SEQ ID NO: 2758628 - RNA, 20 nt, Human
gccuuuuucauuauuuuauu

SEQ ID NO: 2758629 - RNA, 22 nt, Human
gccuuuuucauuauuuuauuau

SEQ ID NO: 2758630 - RNA, 12 nt, Human
gccuuuuucauu

SEQ ID NO: 2758631 - RNA, 16 nt, Human
gccuuuuucauuauuu

SEQ ID NO: 2758632 - RNA, 18 nt, Human
gccuguaaucacagcuac

SEQ ID NO: 2758633 - RNA, 13 nt, Human
gcuagacugguga

SEQ ID NO: 2758634 - RNA, 15 nt, Human
gcuagacuggugacu

SEQ ID NO: 2758635 - RNA, 16 nt, Human
gcuagacuggugacug

SEQ ID NO: 2758636 - RNA, 19 nt, Human
gcuagacuggugacugauu

SEQ ID NO: 2758637 - RNA, 20 nt, Human
gcuagacuggugacugauuc

SEQ ID NO: 2758638 - RNA, 22 nt, Human
gcuagacuggugacugauucuu

SEQ ID NO: 2758639 - RNA, 11 nt, Human
gccuccccucc

SEQ ID NO: 2758640 - RNA, 12 nt, Human
gccuccccuccu

SEQ ID NO: 2758641 - RNA, 13 nt, Human
gccuccccuccuc

SEQ ID NO: 2758642 - RNA, 14 nt, Human
gccuccccuccucu

SEQ ID NO: 2758643 - RNA, 19 nt, Human
gcccuucuuuccacagaag

SEQ ID NO: 2758644 - RNA, 11 nt, Human
gccuaaaucca

SEQ ID NO: 2758645 - RNA, 14 nt, Human
gccuaaggacuucu

SEQ ID NO: 2758646 - RNA, 15 nt, Human
gccuaaggacuucuu

SEQ ID NO: 2758647 - RNA, 18 nt, Human
gccuaaggacuucuuuaa

SEQ ID NO: 2758648 - RNA, 12 nt, Human
gccuaaggacuu

SEQ ID NO: 2758649 - RNA, 13 nt, Human
gccuaaggacuuc

SEQ ID NO: 2758650 - RNA, 22 nt, Human
ggcagcugccuccccuccucug

SEQ ID NO: 2758651 - RNA, 18 nt, Human
ggcagcugccuccccucc

SEQ ID NO: 2758652 - RNA, 21 nt, Human
ggcagcugccuccccuccucu

SEQ ID NO: 2758653 - RNA, 22 nt, Human
ggccaugggacagggaggacgc

SEQ ID NO: 2758654 - RNA, 19 nt, Human
ggaggacgcucucuggccu

SEQ ID NO: 2758655 - RNA, 20 nt, Human
ggaggacgcucucuggccuu

SEQ ID NO: 2758656 - RNA, 21 nt, Human
ggaggacgcucucuggccuuc

SEQ ID NO: 2758657 - RNA, 22 nt, Human
gcuguauuuuaaaagaaugauu

SEQ ID NO: 2758658 - RNA, 22 nt, Human
gcuggugcccugcuuucagaua

SEQ ID NO: 2758659 - RNA, 24 nt, Human
gcuggugcccugcuuucagauacu

SEQ ID NO: 2758660 - RNA, 18 nt, Human
gcuagauguauguacuuc

SEQ ID NO: 2758661 - RNA, 16 nt, Human
gcuagauguauguacu

SEQ ID NO: 2758662 - RNA, 13 nt, Human
ggaaauauuuauu

SEQ ID NO: 2758663 - RNA, 15 nt, Human
ggaaauauuuauuuu

SEQ ID NO: 2758664 - RNA, 12 nt, Human
ggaaauauuuau

SEQ ID NO: 2758665 - RNA, 17 nt, Human
ggaaauauuuauuuuaa

SEQ ID NO: 2758666 - RNA, 18 nt, Human
ggaaauauuuauuuuaau

SEQ ID NO: 2758667 - RNA, 19 nt, Human
ggaaaaguuuaauauuaaa

SEQ ID NO: 2758668 - RNA, 18 nt, Human
ggaaaaguuuaauauuaa

SEQ ID NO: 2758669 - RNA, 17 nt, Human
ggaacgcguugaaauug

SEQ ID NO: 2758670 - RNA, 16 nt, Human
ggaacgcguugaaauu

SEQ ID NO: 2758671 - RNA, 21 nt, Human
ggaacgcguugaaauuguaau

SEQ ID NO: 2758672 - RNA, 23 nt, Human
gcuguucacagccagacuggcac

SEQ ID NO: 2758673 - RNA, 16 nt, Human
gcuguucacagccaga

SEQ ID NO: 2758674 - RNA, 15 nt, Human
gcuguucacagccag

SEQ ID NO: 2758675 - RNA, 17 nt, Human
gcuugcccuggugccuc

SEQ ID NO: 2758676 - RNA, 19 nt, Human
gcuugcccuggugccucac

SEQ ID NO: 2758677 - RNA, 18 nt, Human
gcuugccaucccucccuc

SEQ ID NO: 2758678 - RNA, 21 nt, Human
gcuugccaucccucccuccac

SEQ ID NO: 2758679 - RNA, 16 nt, Human
gcuugccaucccuccc

SEQ ID NO: 2758680 - RNA, 17 nt, Human
gcuuuuaaaaaaaaaua

SEQ ID NO: 2758681 - RNA, 20 nt, Human
ggaaaaaauaacaaugaaag

SEQ ID NO: 2758682 - RNA, 22 nt, Human
ggcuugaguuuaaauuguaaua

SEQ ID NO: 2758683 - RNA, 13 nt, Human
ggcuuuucugauc

SEQ ID NO: 2758684 - RNA, 16 nt, Human
ggcuuuucugauccag

SEQ ID NO: 2758685 - RNA, 12 nt, Human
ggcuuuucugau

SEQ ID NO: 2758686 - RNA, 14 nt, Human
gggaauugaggaca

SEQ ID NO: 2758687 - RNA, 17 nt, Human
ggcuuuucugauccagu

SEQ ID NO: 2758688 - RNA, 23 nt, Human
ggugcuacaaaaacacagcaagg

SEQ ID NO: 2758689 - RNA, 21 nt, Human
ggugcuacaaaaacacagcaa

SEQ ID NO: 2758690 - RNA, 19 nt, Human
ggugacuuuggauaauaag

SEQ ID NO: 2758691 - RNA, 20 nt, Human
ggugacuuuggauaauaagg

SEQ ID NO: 2758692 - RNA, 21 nt, Human
ggugacuuuggauaauaagga

SEQ ID NO: 2758693 - RNA, 14 nt, Human
ggugacuuuggaua

SEQ ID NO: 2758694 - RNA, 18 nt, Human
ggugacuuuggauaauaa

SEQ ID NO: 2758695 - RNA, 20 nt, Human
gguuaucugaagucagaucu

SEQ ID NO: 2758696 - RNA, 16 nt, Human
gguguaugugugaagu

SEQ ID NO: 2758697 - RNA, 11 nt, Human
ggggauucuua

SEQ ID NO: 2758698 - RNA, 15 nt, Human
ggggauucuuaaagu

SEQ ID NO: 2758699 - RNA, 19 nt, Human
uauauuuuuuguuaaauga

SEQ ID NO: 2758700 - RNA, 19 nt, Human
uauauuuuuauauuuacua

SEQ ID NO: 2758701 - RNA, 20 nt, Human
uauauuuauuacuguaagaa

SEQ ID NO: 2758702 - RNA, 23 nt, Human
uauauuuauuacuguaagaaaau

SEQ ID NO: 2758703 - RNA, 14 nt, Human
uauauuugaaauau

SEQ ID NO: 2758704 - RNA, 13 nt, Human
uauauuugaaaua

SEQ ID NO: 2758705 - RNA, 18 nt, Human
uauauuuuuauauuuacu

SEQ ID NO: 2758706 - RNA, 18 nt, Human
uauaugcuauuucuauau

SEQ ID NO: 2758707 - RNA, 16 nt, Human
uauaugcuauuucuau

SEQ ID NO: 2758708 - RNA, 18 nt, Human
uagucaaauugugugaaa

SEQ ID NO: 2758709 - RNA, 14 nt, Human
uagucaaauugugu

SEQ ID NO: 2758710 - RNA, 21 nt, Human
uaguuguaccgcaaugugacu

SEQ ID NO: 2758711 - RNA, 23 nt, Human
uaggaauugacccacaagaaaug

SEQ ID NO: 2758712 - RNA, 20 nt, Human
uaggaauugacccacaagaa

SEQ ID NO: 2758713 - RNA, 13 nt, Human
uaggccaugggac

SEQ ID NO: 2758714 - RNA, 17 nt, Human
uagaguuuagcuggaaa

SEQ ID NO: 2758715 - RNA, 18 nt, Human
uagaguuuagcuggaaaa

SEQ ID NO: 2758716 - RNA, 14 nt, Human
uagagaguguugaa

SEQ ID NO: 2758717 - RNA, 15 nt, Human
uagagaguguugaaa

SEQ ID NO: 2758718 - RNA, 13 nt, Human
uagacuggugacu

SEQ ID NO: 2758719 - RNA, 14 nt, Human
uagacuggugacug

SEQ ID NO: 2758720 - RNA, 17 nt, Human
uagacuggugacugauu

SEQ ID NO: 2758721 - RNA, 20 nt, Human
uagauguauguacuucaugc

SEQ ID NO: 2758722 - RNA, 16 nt, Human
uagauguauguacuuc

SEQ ID NO: 2758723 - RNA, 20 nt, Human
uagcagggcauggcugggaa

SEQ ID NO: 2758724 - RNA, 19 nt, Human
uacugagagugaacaaauu

SEQ ID NO: 2758725 - RNA, 23 nt, Human
uacugauguuccuagugaaagag

SEQ ID NO: 2758726 - RNA, 23 nt, Human
uaccacaggaaccacaagacugc

SEQ ID NO: 2758727 - RNA, 21 nt, Human
uacaugagguacugagaguga

SEQ ID NO: 2758728 - RNA, 22 nt, Human
uacaugagguacugagagugaa

SEQ ID NO: 2758729 - RNA, 17 nt, Human
uacauuuguauaaaaua

SEQ ID NO: 2758730 - RNA, 11 nt, Human
uacauuugugu

SEQ ID NO: 2758731 - RNA, 16 nt, Human
uacauuuguauaaaau

SEQ ID NO: 2758732 - RNA, 16 nt, Human
uaccaacacgagcagg

SEQ ID NO: 2758733 - RNA, 14 nt, Human
uacaggauuugaaa

SEQ ID NO: 2758734 - RNA, 12 nt, Human
uaauuuuggaau

SEQ ID NO: 2758735 - RNA, 13 nt, Human
uaauuuuggaauu

SEQ ID NO: 2758736 - RNA, 19 nt, Human
uacaauuuuguuucuguac

SEQ ID NO: 2758737 - RNA, 21 nt, Human
uacaauuuuguuucuguacuu

SEQ ID NO: 2758738 - RNA, 18 nt, Human
uacaauuuuguuucugua

SEQ ID NO: 2758739 - RNA, 19 nt, Human
uaaugccacuaaauugaca

SEQ ID NO: 2758740 - RNA, 13 nt, Human
uaauauuaaagcc

SEQ ID NO: 2758741 - RNA, 14 nt, Human
uaauauuaaagcca

SEQ ID NO: 2758742 - RNA, 12 nt, Human
uaauauuaaagc

SEQ ID NO: 2758743 - RNA, 15 nt, Human
uaauaauguuucaaa

SEQ ID NO: 2758744 - RNA, 14 nt, Human
uaauaauguuucaa

SEQ ID NO: 2758745 - RNA, 15 nt, Human
uaauaauuauaugcu

SEQ ID NO: 2758746 - RNA, 16 nt, Human
uaauaauuauaugcua

SEQ ID NO: 2758747 - RNA, 19 nt, Human
uaauaauuauaugcuauuu

SEQ ID NO: 2758748 - RNA, 20 nt, Human
uaauaauuauaugcuauuuc

SEQ ID NO: 2758749 - RNA, 22 nt, Human
uaauaauuauaugcuauuucua

SEQ ID NO: 2758750 - RNA, 23 nt, Human
uaauaauuauaugcuauuucuau

SEQ ID NO: 2758751 - RNA, 20 nt, Human
uaauaaggaaaaguuuaaua

SEQ ID NO: 2758752 - RNA, 18 nt, Human
uaauaaggaaaaguuuaa

SEQ ID NO: 2758753 - RNA, 20 nt, Human
uaauuuguaguguuggagaa

SEQ ID NO: 2758754 - RNA, 23 nt, Human
uaauuuguaguguuggagaagaa

SEQ ID NO: 2758755 - RNA, 22 nt, Human
uaauuggaaaggcagcucuaaa

SEQ ID NO: 2758756 - RNA, 20 nt, Human
uaauuaaaagaauauuuuaa

SEQ ID NO: 2758757 - RNA, 12 nt, Human
uaauuaacaugu

SEQ ID NO: 2758758 - RNA, 14 nt, Human
uaauuaacauguua

SEQ ID NO: 2758759 - RNA, 15 nt, Human
uaauuaacauguuaa

SEQ ID NO: 2758760 - RNA, 17 nt, Human
uaauuaacauguuaaac

SEQ ID NO: 2758761 - RNA, 18 nt, Human
uaauuaacauguuaaacc

SEQ ID NO: 2758762 - RNA, 19 nt, Human
uaauuaacauguuaaacca

SEQ ID NO: 2758763 - RNA, 15 nt, Human
uaauguuucaaacau

SEQ ID NO: 2758764 - RNA, 14 nt, Human
uaauguuucaaaca

SEQ ID NO: 2758765 - RNA, 19 nt, Human
uaacaaugcuguauuuuaa

SEQ ID NO: 2758766 - RNA, 23 nt, Human
uaaauugacacuuaaaaaugguu

SEQ ID NO: 2758767 - RNA, 16 nt, Human
uaaaucccauuauuca

SEQ ID NO: 2758768 - RNA, 17 nt, Human
uaaaucccauuauucaa

SEQ ID NO: 2758769 - RNA, 18 nt, Human
uaaauccauuuggaaauc

SEQ ID NO: 2758770 - RNA, 19 nt, Human
uaaauccauuuggaaaucu

SEQ ID NO: 2758771 - RNA, 22 nt, Human
uaaauccauuuggaaaucuuua

SEQ ID NO: 2758772 - RNA, 23 nt, Human
uaaauccauuuggaaaucuuuaa

SEQ ID NO: 2758773 - RNA, 16 nt, Human
uaacauguuaaaccau

SEQ ID NO: 2758774 - RNA, 17 nt, Human
uaacauguuaaaccaug

SEQ ID NO: 2758775 - RNA, 18 nt, Human
uaacauguuaaaccaugg

SEQ ID NO: 2758776 - RNA, 23 nt, Human
uaagagggauuagggagagaaga

SEQ ID NO: 2758777 - RNA, 23 nt, Human
uaagagagaaugagagacacacu

SEQ ID NO: 2758778 - RNA, 13 nt, Human
uaagccagacauc

SEQ ID NO: 2758779 - RNA, 20 nt, Human
uaagcauuccaacuaucuca

SEQ ID NO: 2758780 - RNA, 16 nt, Human
uaagcauuccaacuau

SEQ ID NO: 2758781 - RNA, 18 nt, Human
uaagcauuccaacuaucu

SEQ ID NO: 2758782 - RNA, 23 nt, Human
uaagcauauauuuuuauauuuac

SEQ ID NO: 2758783 - RNA, 21 nt, Human
uaagcauauauuuuuauauuu

SEQ ID NO: 2758784 - RNA, 22 nt, Human
uaagcauauauuuuuauauuua

SEQ ID NO: 2758785 - RNA, 19 nt, Human
uaagcauauauuuuuauau

SEQ ID NO: 2758786 - RNA, 16 nt, Human
uaagcauauauuuuua

SEQ ID NO: 2758787 - RNA, 20 nt, Human
uaagccagacaucaacagau

SEQ ID NO: 2758788 - RNA, 21 nt, Human
uaagccagacaucaacagaua

SEQ ID NO: 2758789 - RNA, 20 nt, Human
guuuaggauguugaaaaagu

SEQ ID NO: 2758790 - RNA, 14 nt, Human
guuuagucuugucu

SEQ ID NO: 2758791 - RNA, 18 nt, Human
guuuagucuugucucaga

SEQ ID NO: 2758792 - RNA, 13 nt, Human
guuuagaaagcuu

SEQ ID NO: 2758793 - RNA, 23 nt, Human
guuugugcugguguaugugugaa

SEQ ID NO: 2758794 - RNA, 16 nt, Human
uaaaaaagaaacauuu

SEQ ID NO: 2758795 - RNA, 18 nt, Human
guuuucaggcuagaugua

SEQ ID NO: 2758796 - RNA, 12 nt, Human
guuuguuuaguc

SEQ ID NO: 2758797 - RNA, 16 nt, Human
guuuucauuaucucaa

SEQ ID NO: 2758798 - RNA, 14 nt, Human
uaaaagaugaaaau

SEQ ID NO: 2758799 - RNA, 19 nt, Human
uaaaauccauacauuugug

SEQ ID NO: 2758800 - RNA, 18 nt, Human
uaaaauccauacauuugu

SEQ ID NO: 2758801 - RNA, 17 nt, Human
uaaaauggguuuuacug

SEQ ID NO: 2758802 - RNA, 14 nt, Human
uaaaggaauuuaaa

SEQ ID NO: 2758803 - RNA, 13 nt, Human
uaaacuuuucuga

SEQ ID NO: 2758804 - RNA, 14 nt, Human
uaaacuuuucugau

SEQ ID NO: 2758805 - RNA, 15 nt, Human
uaaacuuuucugaua

SEQ ID NO: 2758806 - RNA, 17 nt, Human
uaaauaaaaauaauccu

SEQ ID NO: 2758807 - RNA, 17 nt, Human
uaaaguugaauuuauug

SEQ ID NO: 2758808 - RNA, 19 nt, Human
uaaaguugaauuuauuggc

SEQ ID NO: 2758809 - RNA, 21 nt, Human
uaaaguugaauuuauuggcuu

SEQ ID NO: 2758810 - RNA, 23 nt, Human
uaaaguugaauuuauuggcuuuu

SEQ ID NO: 2758811 - RNA, 14 nt, Human
uaaaguugaauuua

SEQ ID NO: 2758812 - RNA, 15 nt, Human
uaaaguugaauuuau

SEQ ID NO: 2758813 - RNA, 13 nt, Human
uaaaguugaauuu

SEQ ID NO: 2758814 - RNA, 18 nt, Human
uaaauauaugcuaagucu

SEQ ID NO: 2758815 - RNA, 15 nt, Human
uaaauccauuuggaa

SEQ ID NO: 2758816 - RNA, 16 nt, Human
uaaauccauuuggaaa

SEQ ID NO: 2758817 - RNA, 14 nt, Human
uaaauccauuugga

SEQ ID NO: 2758818 - RNA, 21 nt, Human
uauuucuaugaaauauuaugu

SEQ ID NO: 2758819 - RNA, 22 nt, Human
uauuucuaugaaauauuauguu

SEQ ID NO: 2758820 - RNA, 17 nt, Human
uaucugaagucagaucu

SEQ ID NO: 2758821 - RNA, 18 nt, Human
uaucugaagucagaucug

SEQ ID NO: 2758822 - RNA, 15 nt, Human
uaucugaggaauucu

SEQ ID NO: 2758823 - RNA, 13 nt, Human
ucaaaacugcacu

SEQ ID NO: 2758824 - RNA, 12 nt, Human
uauuuuaugauc

SEQ ID NO: 2758825 - RNA, 19 nt, Human
ucaacuccaaacugacucu

SEQ ID NO: 2758826 - RNA, 14 nt, Human
ucacaggaaguaga

SEQ ID NO: 2758827 - RNA, 19 nt, Human
ucacaggaaguagaggagg

SEQ ID NO: 2758828 - RNA, 23 nt, Human
ucacaggacagcccuucuuucca

SEQ ID NO: 2758829 - RNA, 23 nt, Human
ucagagcugcccucuccugggca

SEQ ID NO: 2758830 - RNA, 22 nt, Human
ucagacauagaauuaacacaug

SEQ ID NO: 2758831 - RNA, 19 nt, Human
ucagacauagaauuaacac

SEQ ID NO: 2758832 - RNA, 17 nt, Human
ucacuugucaauaaaau

SEQ ID NO: 2758833 - RNA, 18 nt, Human
ucacucuccauuuaauaa

SEQ ID NO: 2758834 - RNA, 16 nt, Human
ucccaaauuucauacc

SEQ ID NO: 2758835 - RNA, 17 nt, Human
ucccucccuccaccucc

SEQ ID NO: 2758836 - RNA, 17 nt, Human
uccaagcauuuagaugu

SEQ ID NO: 2758837 - RNA, 23 nt, Human
uccaagcauaccaacacgagcag

SEQ ID NO: 2758838 - RNA, 14 nt, Human
ucauuucuuugagu

SEQ ID NO: 2758839 - RNA, 22 nt, Human
ucauuucugcaucagcugcuga

SEQ ID NO: 2758840 - RNA, 16 nt, Human
ucauuucugcaucagc

SEQ ID NO: 2758841 - RNA, 12 nt, Human
uccaaagaaaug

SEQ ID NO: 2758842 - RNA, 23 nt, Human
uccaaacugacucuuaagaagac

SEQ ID NO: 2758843 - RNA, 14 nt, Human
uccaccuacaugag

SEQ ID NO: 2758844 - RNA, 23 nt, Human
uccaccucccugcaauaaaaugg

SEQ ID NO: 2758845 - RNA, 20 nt, Human
uccaagcauuuagauguaua

SEQ ID NO: 2758846 - RNA, 14 nt, Human
uccagauccuggaa

SEQ ID NO: 2758847 - RNA, 16 nt, Human
uccagauccuggaaau

SEQ ID NO: 2758848 - RNA, 17 nt, Human
uccagauccuggaaauc

SEQ ID NO: 2758849 - RNA, 22 nt, Human
uccagcagauuauucacugauu

SEQ ID NO: 2758850 - RNA, 17 nt, Human
uccagcagauuauucac

SEQ ID NO: 2758851 - RNA, 20 nt, Human
uccagcagauuauucacuga

SEQ ID NO: 2758852 - RNA, 12 nt, Human
uccacuuggucu

SEQ ID NO: 2758853 - RNA, 13 nt, Human
uccacuuggucug

SEQ ID NO: 2758854 - RNA, 16 nt, Human
ucauuauuuuauuaug

SEQ ID NO: 2758855 - RNA, 18 nt, Human
ucauuauuuuauuaugaa

SEQ ID NO: 2758856 - RNA, 19 nt, Human
ucauuauuuuauuaugaaa

SEQ ID NO: 2758857 - RNA, 14 nt, Human
ucauuauuuuauua

SEQ ID NO: 2758858 - RNA, 15 nt, Human
ucauuauuuuauuau

SEQ ID NO: 2758859 - RNA, 13 nt, Human
ucauuauuuuauu

SEQ ID NO: 2758860 - RNA, 18 nt, Human
ucucuucacagucacauu

SEQ ID NO: 2758861 - RNA, 20 nt, Human
ucugaggaauucuguauaga

SEQ ID NO: 2758862 - RNA, 19 nt, Human
ucugaggaauucuguauag

SEQ ID NO: 2758863 - RNA, 13 nt, Human
ucucuaggaaaua

SEQ ID NO: 2758864 - RNA, 21 nt, Human
ucuccugggcagcugccuccc

SEQ ID NO: 2758865 - RNA, 19 nt, Human
ucuccugggcagcugccuc

SEQ ID NO: 2758866 - RNA, 20 nt, Human
ucuccugggcagcugccucc

SEQ ID NO: 2758867 - RNA, 21 nt, Human
ucucagugucaaugcagcccc

SEQ ID NO: 2758868 - RNA, 14 nt, Human
ucuccugggcagcu

SEQ ID NO: 2758869 - RNA, 13 nt, Human
ucuccugggcagc

SEQ ID NO: 2758870 - RNA, 15 nt, Human
ucuccugggcagcug

SEQ ID NO: 2758871 - RNA, 16 nt, Human
ucuccugggcagcugc

SEQ ID NO: 2758872 - RNA, 17 nt, Human
ucuccugggcagcugcc

SEQ ID NO: 2758873 - RNA, 18 nt, Human
ucuccugggcagcugccu

SEQ ID NO: 2758874 - RNA, 15 nt, Human
uccuugcaucaauuu

SEQ ID NO: 2758875 - RNA, 21 nt, Human
ucuacacuaagagagaaugag

SEQ ID NO: 2758876 - RNA, 17 nt, Human
ucuacacuccagugaga

SEQ ID NO: 2758877 - RNA, 17 nt, Human
ucuacacuaagagagaa

SEQ ID NO: 2758878 - RNA, 14 nt, Human
ugaacacaucagcu

SEQ ID NO: 2758879 - RNA, 22 nt, Human
ugaacuuguaaaggaauuuaaa

SEQ ID NO: 2758880 - RNA, 21 nt, Human
ugaaguccaagcauuuagaug

SEQ ID NO: 2758881 - RNA, 22 nt, Human
ugaaguccaagcauuuagaugu

SEQ ID NO: 2758882 - RNA, 18 nt, Human
ugaaagcagggacuugaa

SEQ ID NO: 2758883 - RNA, 19 nt, Human
ugaaagcagggacuugaac

SEQ ID NO: 2758884 - RNA, 23 nt, Human
ugaaagcagggacuugaacccau

SEQ ID NO: 2758885 - RNA, 18 nt, Human
ugaaacccugucucuacu

SEQ ID NO: 2758886 - RNA, 22 nt, Human
ugaaaagacuccaaagaaaugu

SEQ ID NO: 2758887 - RNA, 19 nt, Human
ugaaaacuuuaugcuaagu

SEQ ID NO: 2758888 - RNA, 19 nt, Human
ugaaaagacuccaaagaaa

SEQ ID NO: 2758889 - RNA, 17 nt, Human
ugaaaagacuccaaaga

SEQ ID NO: 2758890 - RNA, 16 nt, Human
ugaaaagacuccaaag

SEQ ID NO: 2758891 - RNA, 15 nt, Human
ugaaaagacuccaaa

SEQ ID NO: 2758892 - RNA, 20 nt, Human
ucuguuuuauaauuuuguga

SEQ ID NO: 2758893 - RNA, 22 nt, Human
ucuguuuuauaauuuugugaag

SEQ ID NO: 2758894 - RNA, 23 nt, Human
ucuggccuucggccuccauccug

SEQ ID NO: 2758895 - RNA, 18 nt, Human
ucuuuaaaaaaaaaauug

SEQ ID NO: 2758896 - RNA, 19 nt, Human
ucuuuaaaaaaaaaauugg

SEQ ID NO: 2758897 - RNA, 19 nt, Human
ucuugucucagauuuuauu

SEQ ID NO: 2758898 - RNA, 17 nt, Human
ucuugucucagauuuua

SEQ ID NO: 2758899 - RNA, 18 nt, Human
ugccuccccuccucugcu

SEQ ID NO: 2758900 - RNA, 19 nt, Human
ugccuccccuccucugcuu

SEQ ID NO: 2758901 - RNA, 22 nt, Human
ugccuccccuccucugcuugcc

SEQ ID NO: 2758902 - RNA, 23 nt, Human
ugccuccccuccucugcuugcca

SEQ ID NO: 2758903 - RNA, 23 nt, Human
ugccuaaggacuucuuuaauuuu

SEQ ID NO: 2758904 - RNA, 22 nt, Human
ugccuucucaacuccaaacuga

SEQ ID NO: 2758905 - RNA, 17 nt, Human
ugccuucucaacuccaa

SEQ ID NO: 2758906 - RNA, 19 nt, Human
ugcuagaacucccuuucaa

SEQ ID NO: 2758907 - RNA, 18 nt, Human
ugcuagaacucccuuuca

SEQ ID NO: 2758908 - RNA, 20 nt, Human
ugcuagaacucccuuucaac

SEQ ID NO: 2758909 - RNA, 21 nt, Human
ugcuagaacucccuuucaaca

SEQ ID NO: 2758910 - RNA, 15 nt, Human
ugcugaguuugugcu

SEQ ID NO: 2758911 - RNA, 17 nt, Human
ugcugaguuugugcugg

SEQ ID NO: 2758912 - RNA, 16 nt, Human
ugcagauaaacaguag

SEQ ID NO: 2758913 - RNA, 22 nt, Human
ugcacggugaauggcuuuguau

SEQ ID NO: 2758914 - RNA, 23 nt, Human
ugcacggugaauggcuuuguaua

SEQ ID NO: 2758915 - RNA, 19 nt, Human
ugcacggugaauggcuuug

SEQ ID NO: 2758916 - RNA, 15 nt, Human
ugcacaucaaaauau

SEQ ID NO: 2758917 - RNA, 21 nt, Human
ugccaucccucccuccaccuc

SEQ ID NO: 2758918 - RNA, 22 nt, Human
ugccaucccucccuccaccucc

SEQ ID NO: 2758919 - RNA, 15 nt, Human
ugccaucccucccuc

SEQ ID NO: 2758920 - RNA, 14 nt, Human
ugccaucccucccu

SEQ ID NO: 2758921 - RNA, 19 nt, Human
ugccaucccucccuccacc

SEQ ID NO: 2758922 - RNA, 20 nt, Human
ugccaucccucccuccaccu

SEQ ID NO: 2758923 - RNA, 22 nt, Human
ugcaucagcugcugaaacaaca

SEQ ID NO: 2758924 - RNA, 19 nt, Human
ugcaucagcugcugaaaca

SEQ ID NO: 2758925 - RNA, 14 nt, Human
ugcauuauauuuau

SEQ ID NO: 2758926 - RNA, 20 nt, Human
ugcauuauauuuauuacugu

SEQ ID NO: 2758927 - RNA, 15 nt, Human
ugcauuauauuuauu

SEQ ID NO: 2758928 - RNA, 14 nt, Human
uggaacucucgagc

SEQ ID NO: 2758929 - RNA, 22 nt, Human
uggaaaaguauguuagugcaaa

SEQ ID NO: 2758930 - RNA, 14 nt, Human
ugcuucuguuuuau

SEQ ID NO: 2758931 - RNA, 16 nt, Human
ugcuuucagauacugg

SEQ ID NO: 2758932 - RNA, 17 nt, Human
ugcuuucagauacugga

SEQ ID NO: 2758933 - RNA, 20 nt, Human
ugcuuucagauacuggauug

SEQ ID NO: 2758934 - RNA, 21 nt, Human
ugcuuucagauacuggauugu

SEQ ID NO: 2758935 - RNA, 12 nt, Human
ugcuuucagaua

SEQ ID NO: 2758936 - RNA, 15 nt, Human
uggcauaacauaaau

SEQ ID NO: 2758937 - RNA, 17 nt, Human
uggguagacacacauga

SEQ ID NO: 2758938 - RNA, 16 nt, Human
uggguagacacacaug

SEQ ID NO: 2758939 - RNA, 18 nt, Human
ugggacagucaccucaug

SEQ ID NO: 2758940 - RNA, 20 nt, Human
ugggacagucaccucaugga

SEQ ID NO: 2758941 - RNA, 21 nt, Human
ugggacagucaccucauggaa

SEQ ID NO: 2758942 - RNA, 15 nt, Human
uggcuguacccagga

SEQ ID NO: 2758943 - RNA, 14 nt, Human
uggcuuuguauaga

SEQ ID NO: 2758944 - RNA, 22 nt, Human
uggcuuuguauagaaccucuuu

SEQ ID NO: 2758945 - RNA, 19 nt, Human
ugggacauuugcucaugga

SEQ ID NO: 2758946 - RNA, 20 nt, Human
ugggacauuugcucauggaa

SEQ ID NO: 2758947 - RNA, 14 nt, Human
uggccuucggccuc

SEQ ID NO: 2758948 - RNA, 17 nt, Human
uggccuucggccuccau

SEQ ID NO: 2758949 - RNA, 18 nt, Human
uggccuucggccuccauc

SEQ ID NO: 2758950 - RNA, 19 nt, Human
uuaaaagaaugauuaugaa

SEQ ID NO: 2758951 - RNA, 13 nt, Human
uuaaaagaaugau

SEQ ID NO: 2758952 - RNA, 20 nt, Human
uuaaagcuuauuaaaacuca

SEQ ID NO: 2758953 - RNA, 18 nt, Human
uuaacauguuaaaccaug

SEQ ID NO: 2758954 - RNA, 19 nt, Human
uuaacauguuaaaccaugg

SEQ ID NO: 2758955 - RNA, 12 nt, Human
uuaacauguuaa

SEQ ID NO: 2758956 - RNA, 21 nt, Human
uguuuguuuagucuugucuca

SEQ ID NO: 2758957 - RNA, 12 nt, Human
uguuuguuuagu

SEQ ID NO: 2758958 - RNA, 18 nt, Human
uuaauaauguuucaaaca

SEQ ID NO: 2758959 - RNA, 18 nt, Human
uuaauaauuauaugcuau

SEQ ID NO: 2758960 - RNA, 20 nt, Human
uuaauaauuauaugcuauuu

SEQ ID NO: 2758961 - RNA, 23 nt, Human
uuaauaauuauaugcuauuucua

SEQ ID NO: 2758962 - RNA, 16 nt, Human
uuaauaauguuucaaa

SEQ ID NO: 2758963 - RNA, 22 nt, Human
uuaaugucaauucuugccaaau

SEQ ID NO: 2758964 - RNA, 20 nt, Human
uuacagagacagaaagcaga

SEQ ID NO: 2758965 - RNA, 14 nt, Human
uuacauuuguauaa

SEQ ID NO: 2758966 - RNA, 15 nt, Human
uuacauuuguauaaa

SEQ ID NO: 2758967 - RNA, 21 nt, Human
uuaccacuuguguuuugcaag

SEQ ID NO: 2758968 - RNA, 17 nt, Human
ugugugaagugagugag

SEQ ID NO: 2758969 - RNA, 16 nt, Human
uguucacagccagacu

SEQ ID NO: 2758970 - RNA, 14 nt, Human
uguuagugcaaauu

SEQ ID NO: 2758971 - RNA, 16 nt, Human
uguuagaucuaguuca

SEQ ID NO: 2758972 - RNA, 12 nt, Human
uguuauaaucuu

SEQ ID NO: 2758973 - RNA, 20 nt, Human
uguuaaaccaugggauaaau

SEQ ID NO: 2758974 - RNA, 21 nt, Human
uguuaaaccaugggauaaaug

SEQ ID NO: 2758975 - RNA, 18 nt, Human
uguuaaaccaugggauaa

SEQ ID NO: 2758976 - RNA, 16 nt, Human
uguuaaaccaugggau

SEQ ID NO: 2758977 - RNA, 23 nt, Human
uguuaaaccaugggauaaaugcc

SEQ ID NO: 2758978 - RNA, 13 nt, Human
uguuuaaaaucau

SEQ ID NO: 2758979 - RNA, 14 nt, Human
uguuguuuguuuag

SEQ ID NO: 2758980 - RNA, 21 nt, Human
uguuggagaagaacugaaauc

SEQ ID NO: 2758981 - RNA, 21 nt, Human
uguugaaacggaugauuucua

SEQ ID NO: 2758982 - RNA, 22 nt, Human
uguugaaacggaugauuucuau

SEQ ID NO: 2758983 - RNA, 23 nt, Human
uguugaaacggaugauuucuaug

SEQ ID NO: 2758984 - RNA, 20 nt, Human
uguugaaacggaugauuucu

SEQ ID NO: 2758985 - RNA, 16 nt, Human
uguaugauucccagcc

SEQ ID NO: 2758986 - RNA, 16 nt, Human
uguauagaaccucuuu

SEQ ID NO: 2758987 - RNA, 15 nt, Human
uguaaucacagcuac

SEQ ID NO: 2758988 - RNA, 14 nt, Human
uguaaucacagcua

SEQ ID NO: 2758989 - RNA, 17 nt, Human
uguagauaauacaguuc

SEQ ID NO: 2758990 - RNA, 13 nt, Human
uguacucaauuuu

SEQ ID NO: 2758991 - RNA, 19 nt, Human
ugugcgcuaaacuuuucug

SEQ ID NO: 2758992 - RNA, 22 nt, Human
ugugcgcuaaacuuuucugaua

SEQ ID NO: 2758993 - RNA, 23 nt, Human
ugugcgcuaaacuuuucugauag

SEQ ID NO: 2758994 - RNA, 14 nt, Human
ugugcgcuaaacuu

SEQ ID NO: 2758995 - RNA, 21 nt, Human
ugucucaguccaugaagaugu

SEQ ID NO: 2758996 - RNA, 22 nt, Human
ugucucaguccaugaagaugua

SEQ ID NO: 2758997 - RNA, 22 nt, Human
ugugaccacugcagaagacagu

SEQ ID NO: 2758998 - RNA, 12 nt, Human
uugggaggcuga

SEQ ID NO: 2758999 - RNA, 19 nt, Human
uuggcuuuucugauccagu

SEQ ID NO: 2759000 - RNA, 22 nt, Human
uuggcuuuucugauccaguuuu

SEQ ID NO: 2759001 - RNA, 15 nt, Human
uuggcuuuucugauc

SEQ ID NO: 2759002 - RNA, 14 nt, Human
uuguauuacaaauc

SEQ ID NO: 2759003 - RNA, 19 nt, Human
uuguaucacaaaucuuaac

SEQ ID NO: 2759004 - RNA, 18 nt, Human
uuguaaaugugcuuuuaa

SEQ ID NO: 2759005 - RNA, 14 nt, Human
uuguaaaugugcuu

SEQ ID NO: 2759006 - RNA, 11 nt, Human
uuguaaaugug

SEQ ID NO: 2759007 - RNA, 22 nt, Human
uuguacaaaguauuaagcauau

SEQ ID NO: 2759008 - RNA, 16 nt, Human
uuguaaaggaauuuaa

SEQ ID NO: 2759009 - RNA, 15 nt, Human
uuggaaaucuuuaaa

SEQ ID NO: 2759010 - RNA, 12 nt, Human
uuggaaaucuuu

SEQ ID NO: 2759011 - RNA, 21 nt, Human
uuggaccaaaaaccaguauug

SEQ ID NO: 2759012 - RNA, 14 nt, Human
uucugagcauuuaa

SEQ ID NO: 2759013 - RNA, 15 nt, Human
uucugagaaagacua

SEQ ID NO: 2759014 - RNA, 15 nt, Human
uucuuauuucauuuc

SEQ ID NO: 2759015 - RNA, 23 nt, Human
uugaaaagacuccaaagaaaugu

SEQ ID NO: 2759016 - RNA, 22 nt, Human
uugaaaagacuccaaagaaaug

SEQ ID NO: 2759017 - RNA, 18 nt, Human
uugaaaagacuccaaaga

SEQ ID NO: 2759018 - RNA, 16 nt, Human
uugaaaagacuccaaa

SEQ ID NO: 2759019 - RNA, 23 nt, Human
uugaaacugagaugugaacacau

SEQ ID NO: 2759020 - RNA, 22 nt, Human
uugaaacggaugauuucuaugc

SEQ ID NO: 2759021 - RNA, 20 nt, Human
uugaaacggaugauuucuau

SEQ ID NO: 2759022 - RNA, 21 nt, Human
uugaaacggaugauuucuaug

SEQ ID NO: 2759023 - RNA, 15 nt, Human
uugaggacacugaua

SEQ ID NO: 2759024 - RNA, 14 nt, Human
uugaggacacugau

SEQ ID NO: 2759025 - RNA, 18 nt, Human
uugcauagauucccugag

SEQ ID NO: 2759026 - RNA, 12 nt, Human
uugaugaagaag

SEQ ID NO: 2759027 - RNA, 21 nt, Human
uucagagcugcccucuccugg

SEQ ID NO: 2759028 - RNA, 22 nt, Human
uucagagcugcccucuccuggg

SEQ ID NO: 2759029 - RNA, 23 nt, Human
uucagagcugcccucuccugggc

SEQ ID NO: 2759030 - RNA, 11 nt, Human
uucacugauuu

SEQ ID NO: 2759031 - RNA, 15 nt, Human
uuacuaaaauggacu

SEQ ID NO: 2759032 - RNA, 16 nt, Human
uuacuaaaauggacug

SEQ ID NO: 2759033 - RNA, 17 nt, Human
uuacuaaaauggacugu

SEQ ID NO: 2759034 - RNA, 18 nt, Human
uuacuaaaauggacugug

SEQ ID NO: 2759035 - RNA, 19 nt, Human
uuccacuuauaggaauuga

SEQ ID NO: 2759036 - RNA, 18 nt, Human
uucggccuccauccugag

SEQ ID NO: 2759037 - RNA, 19 nt, Human
uucggccuccauccugagg

SEQ ID NO: 2759038 - RNA, 12 nt, Human
uuccuagugaaa

SEQ ID NO: 2759039 - RNA, 18 nt, Human
uucccuugaugaagaagu

SEQ ID NO: 2759040 - RNA, 23 nt, Human
uucucuccucuccccaugauguu

SEQ ID NO: 2759041 - RNA, 15 nt, Human
uucuauauuuucauu

SEQ ID NO: 2759042 - RNA, 16 nt, Human
uucuauauuuucauuc

SEQ ID NO: 2759043 - RNA, 18 nt, Human
uucuauauuuucauucuc

SEQ ID NO: 2759044 - RNA, 21 nt, Human
uucuauauuuucauucuccua

SEQ ID NO: 2759045 - RNA, 11 nt, Human
uucuauauuuu

SEQ ID NO: 2759046 - RNA, 14 nt, Human
uucuauauuuucau

SEQ ID NO: 2759047 - RNA, 17 nt, Human
uucuaugcugaguuugu

SEQ ID NO: 2759048 - RNA, 15 nt, Human
uuucagcagcugcag

SEQ ID NO: 2759049 - RNA, 15 nt, Human
uuucagauaaucaca

SEQ ID NO: 2759050 - RNA, 15 nt, Human
uuucugagaaagacu

SEQ ID NO: 2759051 - RNA, 14 nt, Human
uuucucuuucguua

SEQ ID NO: 2759052 - RNA, 22 nt, Human
uuucugagaaagacuauucaaa

SEQ ID NO: 2759053 - RNA, 12 nt, Human
uuuagaaacaca

SEQ ID NO: 2759054 - RNA, 20 nt, Human
uuuagaaacacaacuauauu

SEQ ID NO: 2759055 - RNA, 13 nt, Human
uuuaugauccagc

SEQ ID NO: 2759056 - RNA, 17 nt, Human
uuuauuggcuuuucuga

SEQ ID NO: 2759057 - RNA, 21 nt, Human
uuuauuggcuuuucugaucca

SEQ ID NO: 2759058 - RNA, 21 nt, Human
uuuguauaaaauaauuuuuau

SEQ ID NO: 2759059 - RNA, 11 nt, Human
uuuguauagaa

SEQ ID NO: 2759060 - RNA, 12 nt, Human
uuuguuguuugu

SEQ ID NO: 2759061 - RNA, 14 nt, Human
uuuguuguuuguuu

SEQ ID NO: 2759062 - RNA, 12 nt, Human
uuuguguuagag

SEQ ID NO: 2759063 - RNA, 21 nt, Human
uuugcauagauucccugagca

SEQ ID NO: 2759064 - RNA, 16 nt, Human
uuuggaaaucuuuaaa

SEQ ID NO: 2759065 - RNA, 15 nt, Human
uuuggaaaucuuuaa

SEQ ID NO: 2759066 - RNA, 10 nt, Human
uuuuauauuu

SEQ ID NO: 2759067 - RNA, 20 nt, Human
uuuuauaucaauuuaaaaaa

SEQ ID NO: 2759068 - RNA, 15 nt, Human
uuuuauaugcuucug

SEQ ID NO: 2759069 - RNA, 20 nt, Human
uuuuauaugcuucuguuuua

SEQ ID NO: 2759070 - RNA, 19 nt, Human
uuuguuguuuguuuagucu

SEQ ID NO: 2759071 - RNA, 13 nt, Human
uuuuaugauccag

SEQ ID NO: 2759072 - RNA, 15 nt, Human
uuuuaugauccagca

SEQ ID NO: 2759073 - RNA, 20 nt, Human
cucuuagaugcaguucugaa

SEQ ID NO: 2759074 - RNA, 12 nt, Human
cucucuggccuu

SEQ ID NO: 2759075 - RNA, 11 nt, Human
cucucuggccu

SEQ ID NO: 2759076 - RNA, 15 nt, Human
cucuuagaugcaguu

SEQ ID NO: 2759077 - RNA, 14 nt, Human
cucccugcaauaaa

SEQ ID NO: 2759078 - RNA, 16 nt, Human
cucccugcaauaaaau

SEQ ID NO: 2759079 - RNA, 15 nt, Human
cgacagugagacucu

SEQ ID NO: 2759080 - RNA, 16 nt, Human
cgacagugagacucug

SEQ ID NO: 2759081 - RNA, 15 nt, Human
ccuuuuucauuauuu

SEQ ID NO: 2759082 - RNA, 17 nt, Human
ccuuuuucauuauuuua

SEQ ID NO: 2759083 - RNA, 20 nt, Human
cuaagugaaauaagccagac

SEQ ID NO: 2759084 - RNA, 23 nt, Human
cuaagugaaauaagccagacauc

SEQ ID NO: 2759085 - RNA, 15 nt, Human
cuacaugagguacug

SEQ ID NO: 2759086 - RNA, 13 nt, Human
cuaaacuuuucug

SEQ ID NO: 2759087 - RNA, 16 nt, Human
cuagaacucccuuuca

SEQ ID NO: 2759088 - RNA, 17 nt, Human
cuagaacucccuuucaa

SEQ ID NO: 2759089 - RNA, 18 nt, Human
cuagaacucccuuucaac

SEQ ID NO: 2759090 - RNA, 19 nt, Human
cuagaacucccuuucaaca

SEQ ID NO: 2759091 - RNA, 23 nt, Human
cuaguugaucagcuuauugucua

SEQ ID NO: 2759092 - RNA, 16 nt, Human
cccagccagcaguuca

SEQ ID NO: 2759093 - RNA, 17 nt, Human
cccagccagcaguucag

SEQ ID NO: 2759094 - RNA, 20 nt, Human
cccagccagcaguucagagc

SEQ ID NO: 2759095 - RNA, 22 nt, Human
cccauuguggucacaggaagua

SEQ ID NO: 2759096 - RNA, 23 nt, Human
cccauuguggucacaggaaguag

SEQ ID NO: 2759097 - RNA, 23 nt, Human
cccgggaggcagagguugcagug

SEQ ID NO: 2759098 - RNA, 15 nt, Human
ccagauccuggaaau

SEQ ID NO: 2759099 - RNA, 21 nt, Human
ccagcagauuauucacugauu

SEQ ID NO: 2759100 - RNA, 22 nt, Human
ccagcagauuauucacugauuu

SEQ ID NO: 2759101 - RNA, 16 nt, Human
ccagcagauuauucac

SEQ ID NO: 2759102 - RNA, 13 nt, Human
ccucugcuugcca

SEQ ID NO: 2759103 - RNA, 15 nt, Human
ccucauguccacugg

SEQ ID NO: 2759104 - RNA, 20 nt, Human
ccucauguccacugguucuu

SEQ ID NO: 2759105 - RNA, 16 nt, Human
ccguagguuauuuuca

SEQ ID NO: 2759106 - RNA, 23 nt, Human
caacacgagcaggcuacugucag

SEQ ID NO: 2759107 - RNA, 15 nt, Human
caacacgagcaggcu

SEQ ID NO: 2759108 - RNA, 22 nt, Human
caaagcacugacuucuaaguaa

SEQ ID NO: 2759109 - RNA, 20 nt, Human
caaagcacugacuucuaagu

SEQ ID NO: 2759110 - RNA, 20 nt, Human
caaaaaaaaaaaaaaauuag

SEQ ID NO: 2759111 - RNA, 15 nt, Human
caaaaggcagaagca

SEQ ID NO: 2759112 - RNA, 14 nt, Human
auuugcucauggaa

SEQ ID NO: 2759113 - RNA, 17 nt, Human
auuugcucauggaauug

SEQ ID NO: 2759114 - RNA, 11 nt, Human
auuuggaaauc

SEQ ID NO: 2759115 - RNA, 12 nt, Human
auuuggaaaucu

SEQ ID NO: 2759116 - RNA, 13 nt, Human
auuuggaaaucuu

SEQ ID NO: 2759117 - RNA, 19 nt, Human
auuuuauagcuacuaauuu

SEQ ID NO: 2759118 - RNA, 17 nt, Human
auuuuauagcuacuaau

SEQ ID NO: 2759119 - RNA, 15 nt, Human
auuuuaugauccagc

SEQ ID NO: 2759120 - RNA, 16 nt, Human
auuuuaugauccagca

SEQ ID NO: 2759121 - RNA, 14 nt, Human
auuuuaugauccag

SEQ ID NO: 2759122 - RNA, 14 nt, Human
auuaugaauuacau

SEQ ID NO: 2759123 - RNA, 17 nt, Human
auuaugaauuacauuug

SEQ ID NO: 2759124 - RNA, 18 nt, Human
auuaugaaacuuguguaa

SEQ ID NO: 2759125 - RNA, 20 nt, Human
auuaugaaacuuguguaaau

SEQ ID NO: 2759126 - RNA, 21 nt, Human
auuaugaaacuuguguaaaua

SEQ ID NO: 2759127 - RNA, 14 nt, Human
auuaugaaacuugu

SEQ ID NO: 2759128 - RNA, 15 nt, Human
auuaugaaacuugug

SEQ ID NO: 2759129 - RNA, 16 nt, Human
auuagggagagaagau

SEQ ID NO: 2759130 - RNA, 19 nt, Human
auucacaagacccaaaagg

SEQ ID NO: 2759131 - RNA, 18 nt, Human
auuaugaauuacauuugu

SEQ ID NO: 2759132 - RNA, 18 nt, Human
auucaaaguugccuaaau

SEQ ID NO: 2759133 - RNA, 20 nt, Human
auucaaaguugccuaaaucc

SEQ ID NO: 2759134 - RNA, 21 nt, Human
auucaaaguugccuaaaucca

SEQ ID NO: 2759135 - RNA, 22 nt, Human
auucaaaguugccuaaauccau

SEQ ID NO: 2759136 - RNA, 17 nt, Human
auucaaaguugccuaaa

SEQ ID NO: 2759137 - RNA, 19 nt, Human
auucauagcagcuuauuca

SEQ ID NO: 2759138 - RNA, 22 nt, Human
auucauagcagcuuauucacaa

SEQ ID NO: 2759139 - RNA, 12 nt, Human
auuacaguauaa

SEQ ID NO: 2759140 - RNA, 14 nt, Human
auuacaguauaauu

SEQ ID NO: 2759141 - RNA, 15 nt, Human
auuacaguauaauua

SEQ ID NO: 2759142 - RNA, 16 nt, Human
auuacaguauaauuaa

SEQ ID NO: 2759143 - RNA, 23 nt, Human
auuguaauaggcguaacuaauuu

SEQ ID NO: 2759144 - RNA, 13 nt, Human
auuguaauuauau

SEQ ID NO: 2759145 - RNA, 13 nt, Human
auuguaaaauggu

SEQ ID NO: 2759146 - RNA, 14 nt, Human
auuguaaaauggug

SEQ ID NO: 2759147 - RNA, 14 nt, Human
auuguaauuauauc

SEQ ID NO: 2759148 - RNA, 17 nt, Human
cacagccucuuagaugc

SEQ ID NO: 2759149 - RNA, 21 nt, Human
cacagccucuuagaugcaguu

SEQ ID NO: 2759150 - RNA, 17 nt, Human
cacacaugaaguccaag

SEQ ID NO: 2759151 - RNA, 22 nt, Human
cacacaugaaguccaagcauuu

SEQ ID NO: 2759152 - RNA, 18 nt, Human
cacaagacugcacaucaa

SEQ ID NO: 2759153 - RNA, 15 nt, Human
caaugcuguauuuua

SEQ ID NO: 2759154 - RNA, 16 nt, Human
caaugcuguauuuuaa

SEQ ID NO: 2759155 - RNA, 17 nt, Human
caaugcuguauuuuaaa

SEQ ID NO: 2759156 - RNA, 15 nt, Human
caauucuugccaaau

SEQ ID NO: 2759157 - RNA, 14 nt, Human
caaguccaagcaua

SEQ ID NO: 2759158 - RNA, 21 nt, Human
cacuagggcagggacaggaua

SEQ ID NO: 2759159 - RNA, 20 nt, Human
cacuagggcagggacaggau

SEQ ID NO: 2759160 - RNA, 21 nt, Human
cacugcagaagacaguauggc

SEQ ID NO: 2759161 - RNA, 22 nt, Human
cacuuguguuuugcaagccaga

SEQ ID NO: 2759162 - RNA, 19 nt, Human
cacuuguguuuugcaagcc

SEQ ID NO: 2759163 - RNA, 16 nt, Human
cacuugucaauaaaau

SEQ ID NO: 2759164 - RNA, 22 nt, Human
cacugguucuucuuggucucag

SEQ ID NO: 2759165 - RNA, 16 nt, Human
caugaauuaguuuuau

SEQ ID NO: 2759166 - RNA, 20 nt, Human
caucagcuugcccuguuaaa

SEQ ID NO: 2759167 - RNA, 13 nt, Human
caucagcugcuga

SEQ ID NO: 2759168 - RNA, 15 nt, Human
caucagcugcugaaa

SEQ ID NO: 2759169 - RNA, 18 nt, Human
caucagcugcugaaacaa

SEQ ID NO: 2759170 - RNA, 17 nt, Human
caucagcugcugaaaca

SEQ ID NO: 2759171 - RNA, 20 nt, Human
cauagcagcuuauucacaag

SEQ ID NO: 2759172 - RNA, 18 nt, Human
cauagauucccugagcag

SEQ ID NO: 2759173 - RNA, 17 nt, Human
cauagauucccugagca

SEQ ID NO: 2759174 - RNA, 15 nt, Human
cauuaggauggcuag

SEQ ID NO: 2759175 - RNA, 21 nt, Human
cauucuccuaucaccugucuu

SEQ ID NO: 2759176 - RNA, 16 nt, Human
ccaaaaaccaguauug

SEQ ID NO: 2759177 - RNA, 19 nt, Human
ccaaaaaccaguauuguac

SEQ ID NO: 2759178 - RNA, 20 nt, Human
ccaaaaaccaguauuguaca

SEQ ID NO: 2759179 - RNA, 18 nt, Human
ccaaauguucaucaauga

SEQ ID NO: 2759180 - RNA, 23 nt, Human
caggacagcccuucuuuccacag

SEQ ID NO: 2759181 - RNA, 24 nt, Human
caggacagcccuucuuuccacaga

SEQ ID NO: 2759182 - RNA, 21 nt, Human
caggaaaucaaauaugcaaag

SEQ ID NO: 2759183 - RNA, 19 nt, Human
caggaaaucaaauaugcaa

SEQ ID NO: 2759184 - RNA, 16 nt, Human
cagcuuauucacaaga

SEQ ID NO: 2759185 - RNA, 22 nt, Human
cagggaggacgcucucuggccu

SEQ ID NO: 2759186 - RNA, 19 nt, Human
cagggaggacgcucucugg

SEQ ID NO: 2759187 - RNA, 22 nt, Human
caguauuguacaaaguauuaag

SEQ ID NO: 2759188 - RNA, 22 nt, Human
cagccugagcgacagugagacu

SEQ ID NO: 2759189 - RNA, 23 nt, Human
cagccugagcgacagugagacuc

SEQ ID NO: 2759190 - RNA, 19 nt, Human
cagccccgugggguuccuc

SEQ ID NO: 2759191 - RNA, 18 nt, Human
cagcaguucagagcugcc

SEQ ID NO: 2759192 - RNA, 19 nt, Human
cagcaguucagagcugccc

SEQ ID NO: 2759193 - RNA, 20 nt, Human
cagcaguucagagcugcccu

SEQ ID NO: 2759194 - RNA, 21 nt, Human
cagcaguucagagcugcccuc

SEQ ID NO: 2759195 - RNA, 22 nt, Human
cagcaguucagagcugcccucu

SEQ ID NO: 2759196 - RNA, 20 nt, Human
cagccagacuggcacaguuu

SEQ ID NO: 2759197 - RNA, 13 nt, Human
cagauacuggauu

SEQ ID NO: 2759198 - RNA, 20 nt, Human
gggacauuugcucauggaau

SEQ ID NO: 2759199 - RNA, 21 nt, Human
gggacauuugcucauggaauu

SEQ ID NO: 2759200 - RNA, 19 nt, Human
gggacauuugcucauggaa

SEQ ID NO: 2759201 - RNA, 14 nt, Human
aaaaauauuuuaug

SEQ ID NO: 2759202 - RNA, 12 nt, Human
aaaaccacagca

SEQ ID NO: 2759203 - RNA, 22 nt, Human
aaaaauggaacauaaaauacaa

SEQ ID NO: 2759204 - RNA, 13 nt, Human
aaaacucauuuuu

SEQ ID NO: 2759205 - RNA, 17 nt, Human
aaaagaugaaaauauuu

SEQ ID NO: 2759206 - RNA, 14 nt, Human
aaaaccacagcagu

SEQ ID NO: 2759207 - RNA, 13 nt, Human
aaaaccacagcag

SEQ ID NO: 2759208 - RNA, 16 nt, Human
gggauuguaaaauggu

SEQ ID NO: 2759209 - RNA, 17 nt, Human
gggauuguaaaauggug

SEQ ID NO: 2759210 - RNA, 19 nt, Human
aaaaguauguuagugcaaa

SEQ ID NO: 2759211 - RNA, 15 nt, Human
gggcgugguggugag

SEQ ID NO: 2759212 - RNA, 20 nt, Human
aaacagucucaggaaaucaa

SEQ ID NO: 2759213 - RNA, 20 nt, Human
aaacaagcacuaaacaaaga

SEQ ID NO: 2759214 - RNA, 22 nt, Human
aaaauuuuuucucuaggaaaua

SEQ ID NO: 2759215 - RNA, 15 nt, Human
aaaaugugauaugua

SEQ ID NO: 2759216 - RNA, 15 nt, Human
aaauaauuuuuauau

SEQ ID NO: 2759217 - RNA, 18 nt, Human
aaauaauuuuuauauuug

SEQ ID NO: 2759218 - RNA, 20 nt, Human
aaauaauuuuuauauuugaa

SEQ ID NO: 2759219 - RNA, 20 nt, Human
aaaguuuaauauuaaagcca

SEQ ID NO: 2759220 - RNA, 21 nt, Human
aaaguuuaauauuaaagccau

SEQ ID NO: 2759221 - RNA, 22 nt, Human
aaaguuuaauauuaaagccaug

SEQ ID NO: 2759222 - RNA, 16 nt, Human
aaaguuuaauauuaaa

SEQ ID NO: 2759223 - RNA, 19 nt, Human
aaaguuuaauauuaaagcc

SEQ ID NO: 2759224 - RNA, 16 nt, Human
aaaguugaauuuauug

SEQ ID NO: 2759225 - RNA, 22 nt, Human
aaaguugaauuuauuggcuuuu

SEQ ID NO: 2759226 - RNA, 12 nt, Human
aaaguugaauuu

SEQ ID NO: 2759227 - RNA, 13 nt, Human
aaaguugaauuua

SEQ ID NO: 2759228 - RNA, 16 nt, Human
gguuuagaaagcuugc

SEQ ID NO: 2759229 - RNA, 16 nt, Human
ggugugaccacugcag

SEQ ID NO: 2759230 - RNA, 17 nt, Human
aaagcagggacuugaac

SEQ ID NO: 2759231 - RNA, 15 nt, Human
aaagacuauucaaac

SEQ ID NO: 2759232 - RNA, 14 nt, Human
aaagacuauucaaa

SEQ ID NO: 2759233 - RNA, 22 nt, Human
ggccuucggccuccauccugag

SEQ ID NO: 2759234 - RNA, 23 nt, Human
ggccuucggccuccauccugagg

SEQ ID NO: 2759235 - RNA, 12 nt, Human
ggauggcaagau

SEQ ID NO: 2759236 - RNA, 22 nt, Human
ggauaauaaggaaaaguuuaau

SEQ ID NO: 2759237 - RNA, 12 nt, Human
ggauaaaugcca

SEQ ID NO: 2759238 - RNA, 13 nt, Human
gccagcaguucag

SEQ ID NO: 2759239 - RNA, 14 nt, Human
gccagcaguucaga

SEQ ID NO: 2759240 - RNA, 19 nt, Human
gccagcaguucagagcugc

SEQ ID NO: 2759241 - RNA, 20 nt, Human
gccagcaguucagagcugcc

SEQ ID NO: 2759242 - RNA, 21 nt, Human
gccagcaguucagagcugccc

SEQ ID NO: 2759243 - RNA, 22 nt, Human
gccaguuauggcuauaggugcu

SEQ ID NO: 2759244 - RNA, 22 nt, Human
gccaugugcuaguaauuggaaa

SEQ ID NO: 2759245 - RNA, 24 nt, Human
gccaucaauaaaaaauuaugacau

SEQ ID NO: 2759246 - RNA, 17 nt, Human
gcuacaaaaacacagca

SEQ ID NO: 2759247 - RNA, 19 nt, Human
gcuacaaaaacacagcaag

SEQ ID NO: 2759248 - RNA, 18 nt, Human
gcuacaaaaacacagcaa

SEQ ID NO: 2759249 - RNA, 23 nt, Human
gcguugaaauuguaauuauaucu

SEQ ID NO: 2759250 - RNA, 24 nt, Human
gcguugaaauuguaauuauaucug

SEQ ID NO: 2759251 - RNA, 17 nt, Human
gcuacuugggaggcuga

SEQ ID NO: 2759252 - RNA, 15 nt, Human
gcuacugucagcucc

SEQ ID NO: 2759253 - RNA, 18 nt, Human
gcguugaaauuguaauua

SEQ ID NO: 2759254 - RNA, 15 nt, Human
gccuccauccugagg

SEQ ID NO: 2759255 - RNA, 16 nt, Human
gccuccauccugaggc

SEQ ID NO: 2759256 - RNA, 20 nt, Human
gccuccauccugaggcucca

SEQ ID NO: 2759257 - RNA, 13 nt, Human
ggaaaucuuuaaa

SEQ ID NO: 2759258 - RNA, 12 nt, Human
gcuuuucugauc

SEQ ID NO: 2759259 - RNA, 15 nt, Human
gcuuuucugauccag

SEQ ID NO: 2759260 - RNA, 16 nt, Human
gcuuuucugauccagu

SEQ ID NO: 2759261 - RNA, 11 nt, Human
gcuuuucugau

SEQ ID NO: 2759262 - RNA, 19 nt, Human
gcuuccuggcaauagucaa

SEQ ID NO: 2759263 - RNA, 13 nt, Human
gcuguauuuuaaa

SEQ ID NO: 2759264 - RNA, 12 nt, Human
gcuguauuuuaa

SEQ ID NO: 2759265 - RNA, 21 nt, Human
gcucugcccauccugccccug

SEQ ID NO: 2759266 - RNA, 15 nt, Human
gcucugcccauccug

SEQ ID NO: 2759267 - RNA, 16 nt, Human
gcugaaacaacaaaua

SEQ ID NO: 2759268 - RNA, 20 nt, Human
gcuccacuuggucugugaga

SEQ ID NO: 2759269 - RNA, 16 nt, Human
gaguuuagcuggaaaa

SEQ ID NO: 2759270 - RNA, 20 nt, Human
gauauguaccuaacgaagua

SEQ ID NO: 2759271 - RNA, 11 nt, Human
gauccaguuuu

SEQ ID NO: 2759272 - RNA, 17 nt, Human
gauccaguuuuguuugg

SEQ ID NO: 2759273 - RNA, 22 nt, Human
gauccaguuuuguuuggaccaa

SEQ ID NO: 2759274 - RNA, 13 nt, Human
gauuauucacuga

SEQ ID NO: 2759275 - RNA, 15 nt, Human
gauuauucacugauu

SEQ ID NO: 2759276 - RNA, 16 nt, Human
gauuauucacugauuu

SEQ ID NO: 2759277 - RNA, 17 nt, Human
gauuagggagagaagau

SEQ ID NO: 2759278 - RNA, 14 nt, Human
gauuagagaguguu

SEQ ID NO: 2759279 - RNA, 18 nt, Human
gauuagagaguguugaaa

SEQ ID NO: 2759280 - RNA, 14 nt, Human
gauuaccagggacu

SEQ ID NO: 2759281 - RNA, 14 nt, Human
gauuagaauucugu

SEQ ID NO: 2759282 - RNA, 15 nt, Human
gauuagaauucugua

SEQ ID NO: 2759283 - RNA, 23 nt, Human
gauuagaauucuguauagauuag

SEQ ID NO: 2759284 - RNA, 16 nt, Human
gaugugaacacaucag

SEQ ID NO: 2759285 - RNA, 14 nt, Human
gaugugaacacauc

SEQ ID NO: 2759286 - RNA, 15 nt, Human
gcauaacauaaaucu

SEQ ID NO: 2759287 - RNA, 21 nt, Human
gcauaacauaaaucugugaac

SEQ ID NO: 2759288 - RNA, 23 nt, Human
gcauaacauaaaucugugaacuu

SEQ ID NO: 2759289 - RNA, 11 nt, Human
gcagcugccuc

SEQ ID NO: 2759290 - RNA, 12 nt, Human
gcagcugccucc

SEQ ID NO: 2759291 - RNA, 13 nt, Human
gcagcugccuccc

SEQ ID NO: 2759292 - RNA, 15 nt, Human
gcagcugccuccccu

SEQ ID NO: 2759293 - RNA, 16 nt, Human
gcagcugccuccccuc

SEQ ID NO: 2759294 - RNA, 17 nt, Human
gcagcugccuccccucc

SEQ ID NO: 2759295 - RNA, 18 nt, Human
gcagcugccuccccuccu

SEQ ID NO: 2759296 - RNA, 22 nt, Human
gcagcugccuccccuccucugc

SEQ ID NO: 2759297 - RNA, 19 nt, Human
gcagggacuugaacccaua

SEQ ID NO: 2759298 - RNA, 18 nt, Human
gcacaguuuucugagaaa

SEQ ID NO: 2759299 - RNA, 17 nt, Human
gcacaguuuucugagaa

SEQ ID NO: 2759300 - RNA, 14 nt, Human
gcacaguuuucuga

SEQ ID NO: 2759301 - RNA, 12 nt, Human
gacuggugacug

SEQ ID NO: 2759302 - RNA, 15 nt, Human
gacuggugacugauu

SEQ ID NO: 2759303 - RNA, 18 nt, Human
gacuggugacugauucuu

SEQ ID NO: 2759304 - RNA, 14 nt, Human
gagaaucacuugaa

SEQ ID NO: 2759305 - RNA, 15 nt, Human
gagaaucacuugaac

SEQ ID NO: 2759306 - RNA, 22 nt, Human
gacuauucaaacagucucagga

SEQ ID NO: 2759307 - RNA, 17 nt, Human
gacucuuaagaagacug

SEQ ID NO: 2759308 - RNA, 15 nt, Human
gacucuuaagaagac

SEQ ID NO: 2759309 - RNA, 16 nt, Human
gacucuuaagaagacu

SEQ ID NO: 2759310 - RNA, 16 nt, Human
gacacuuaaaaauggu

SEQ ID NO: 2759311 - RNA, 20 nt, Human
gacaguauggcagcuuuccu

SEQ ID NO: 2759312 - RNA, 17 nt, Human
gacagucaccucaugga

SEQ ID NO: 2759313 - RNA, 14 nt, Human
gacagugaaagaaa

SEQ ID NO: 2759314 - RNA, 13 nt, Human
gacacacugaaga

SEQ ID NO: 2759315 - RNA, 12 nt, Human
gacacacaugaa

SEQ ID NO: 2759316 - RNA, 11 nt, Human
gaauuaguuuu

SEQ ID NO: 2759317 - RNA, 16 nt, Human
gaauuuuguguuagag

SEQ ID NO: 2759318 - RNA, 22 nt, Human
gaauuuuguguuagagauuuuu

SEQ ID NO: 2759319 - RNA, 13 nt, Human
gaauuuuguguua

SEQ ID NO: 2759320 - RNA, 22 nt, Human
gaaugagagacacacugaagaa

SEQ ID NO: 2759321 - RNA, 23 nt, Human
gaaugagagacacacugaagaag

SEQ ID NO: 2759322 - RNA, 20 nt, Human
gaaugagagacacacugaag

SEQ ID NO: 2759323 - RNA, 13 nt, Human
cuugaugaagaag

SEQ ID NO: 2759324 - RNA, 14 nt, Human
cuugccuuuuucau

SEQ ID NO: 2759325 - RNA, 15 nt, Human
cuugccuuuuucauu

SEQ ID NO: 2759326 - RNA, 20 nt, Human
cuugccuuuuucauuauuuu

SEQ ID NO: 2759327 - RNA, 22 nt, Human
cuugccuuuuucauuauuuuau

SEQ ID NO: 2759328 - RNA, 23 nt, Human
cuugccuuuuucauuauuuuauu

SEQ ID NO: 2759329 - RNA, 12 nt, Human
cuugaugaagaa

SEQ ID NO: 2759330 - RNA, 23 nt, Human
cuucuaaguaaaaccacagcagu

SEQ ID NO: 2759331 - RNA, 22 nt, Human
cuucuaaguaaaaccacagcag

SEQ ID NO: 2759332 - RNA, 15 nt, Human
cuucacuguaaaaua

SEQ ID NO: 2759333 - RNA, 17 nt, Human
gaaagacuauucaaaca

SEQ ID NO: 2759334 - RNA, 15 nt, Human
gaaagacuauucaaa

SEQ ID NO: 2759335 - RNA, 14 nt, Human
gaaagacuauucaa

SEQ ID NO: 2759336 - RNA, 17 nt, Human
gaaauauuuauuuuaau

SEQ ID NO: 2759337 - RNA, 17 nt, Human
gaaaucaaauaugcaaa

SEQ ID NO: 2759338 - RNA, 18 nt, Human
gaaaucaaauaugcaaag

SEQ ID NO: 2759339 - RNA, 18 nt, Human
gaaauauuuauuuuaaua

SEQ ID NO: 2759340 - RNA, 22 nt, Human
gaaauauuuauuuuaauaaugu

SEQ ID NO: 2759341 - RNA, 20 nt, Human
gaaaucaaauaugcaaagca

SEQ ID NO: 2759342 - RNA, 19 nt, Human
gaaaucaaauaugcaaagc

SEQ ID NO: 2759343 - RNA, 11 nt, Human
cuuuguauaga

SEQ ID NO: 2759344 - RNA, 20 nt, Human
cuuuguauagaaccucuuug

SEQ ID NO: 2759345 - RNA, 16 nt, Human
cugugagaugcuagaa

SEQ ID NO: 2759346 - RNA, 18 nt, Human
cugugaacuugaaauuug

SEQ ID NO: 2759347 - RNA, 23 nt, Human
cugucagcuccccucggagaaga

SEQ ID NO: 2759348 - RNA, 21 nt, Human
cugucagcuccccucggagaa

SEQ ID NO: 2759349 - RNA, 14 nt, Human
cuguacuuuuuggc

SEQ ID NO: 2759350 - RNA, 16 nt, Human
cugggcagcugccucc

SEQ ID NO: 2759351 - RNA, 19 nt, Human
cugggcagcugccuccccu

SEQ ID NO: 2759352 - RNA, 20 nt, Human
cugggcagcugccuccccuc

SEQ ID NO: 2759353 - RNA, 21 nt, Human
cugggcagcugccuccccucc

SEQ ID NO: 2759354 - RNA, 22 nt, Human
cugggcagcugccuccccuccu

SEQ ID NO: 2759355 - RNA, 18 nt, Human
cuggugacugauucuuca

SEQ ID NO: 2759356 - RNA, 10 nt, Human
cugggacagg

SEQ ID NO: 2759357 - RNA, 21 nt, Human
cuggaaaucaggguuaguauu

SEQ ID NO: 2759358 - RNA, 21 nt, Human
aacuagaguuuagcuggaaaa

SEQ ID NO: 2759359 - RNA, 23 nt, Human
aacuaucucauuuccaagcaagu

SEQ ID NO: 2759360 - RNA, 18 nt, Human
aaccuugaaaacuuuaug

SEQ ID NO: 2759361 - RNA, 16 nt, Human
gucuuucacauuuaaa

SEQ ID NO: 2759362 - RNA, 20 nt, Human
aaccugagccccaaaaggua

SEQ ID NO: 2759363 - RNA, 18 nt, Human
aaccugagccccaaaagg

SEQ ID NO: 2759364 - RNA, 16 nt, Human
aaccucuuugucuaca

SEQ ID NO: 2759365 - RNA, 23 nt, Human
aacccaaauguucaucaaugaau

SEQ ID NO: 2759366 - RNA, 18 nt, Human
aacccaaguccaagcaua

SEQ ID NO: 2759367 - RNA, 21 nt, Human
aacuucagcgguuuauauaag

SEQ ID NO: 2759368 - RNA, 18 nt, Human
aacuuccagauccuggaa

SEQ ID NO: 2759369 - RNA, 17 nt, Human
gugaugggaaagcauug

SEQ ID NO: 2759370 - RNA, 17 nt, Human
aacugggacaggggaga

SEQ ID NO: 2759371 - RNA, 19 nt, Human
aacuggacugguucaaaug

SEQ ID NO: 2759372 - RNA, 19 nt, Human
aacugcacugucaagauga

SEQ ID NO: 2759373 - RNA, 12 nt, Human
aacugaaaucau

SEQ ID NO: 2759374 - RNA, 21 nt, Human
gugagaugcuagaacucccuu

SEQ ID NO: 2759375 - RNA, 14 nt, Human
gugaacuugaaauu

SEQ ID NO: 2759376 - RNA, 15 nt, Human
gugaacuugaaauuu

SEQ ID NO: 2759377 - RNA, 20 nt, Human
aaauuuuuucucuaggaaau

SEQ ID NO: 2759378 - RNA, 12 nt, Human
aacaauaaaaga

SEQ ID NO: 2759379 - RNA, 14 nt, Human
aacaaugcuguauu

SEQ ID NO: 2759380 - RNA, 15 nt, Human
aacaaugcuguauuu

SEQ ID NO: 2759381 - RNA, 15 nt, Human
aacacaacuauauug

SEQ ID NO: 2759382 - RNA, 16 nt, Human
aacacaacuauauugu

SEQ ID NO: 2759383 - RNA, 17 nt, Human
aacaaugcuguauuuua

SEQ ID NO: 2759384 - RNA, 22 nt, Human
aacaaugcuguauuuuaaaaga

SEQ ID NO: 2759385 - RNA, 15 nt, Human
aacacagcaagggug

SEQ ID NO: 2759386 - RNA, 15 nt, Human
aacagugauuaccag

SEQ ID NO: 2759387 - RNA, 22 nt, Human
aacagugauuaccagggacuga

SEQ ID NO: 2759388 - RNA, 16 nt, Human
aacagauaaauaguuu

SEQ ID NO: 2759389 - RNA, 18 nt, Human
guauguacuucaugcugu

SEQ ID NO: 2759390 - RNA, 16 nt, Human
gucaaauugugugaaa

SEQ ID NO: 2759391 - RNA, 15 nt, Human
aaauuguaauuauau

SEQ ID NO: 2759392 - RNA, 14 nt, Human
aaauuguaauuaua

SEQ ID NO: 2759393 - RNA, 14 nt, Human
aaauggguuuuacu

SEQ ID NO: 2759394 - RNA, 15 nt, Human
aaauggguuuuacug

SEQ ID NO: 2759395 - RNA, 20 nt, Human
guaguguuggagaagaacug

SEQ ID NO: 2759396 - RNA, 17 nt, Human
guaguguuggagaagaa

SEQ ID NO: 2759397 - RNA, 16 nt, Human
aaauguaagggaaacu

SEQ ID NO: 2759398 - RNA, 16 nt, Human
guauauuuuauaucaa

SEQ ID NO: 2759399 - RNA, 15 nt, Human
guauaaaauaauuuu

SEQ ID NO: 2759400 - RNA, 21 nt, Human
guauaaaauaauuuuuauauu

SEQ ID NO: 2759401 - RNA, 13 nt, Human
aagguacuucaaa

SEQ ID NO: 2759402 - RNA, 19 nt, Human
aagggugaugggaaagcau

SEQ ID NO: 2759403 - RNA, 14 nt, Human
aagguacuucaaau

SEQ ID NO: 2759404 - RNA, 20 nt, Human
guuuaauauuaaagccaugu

SEQ ID NO: 2759405 - RNA, 19 nt, Human
guuuaauauuaaagccaug

SEQ ID NO: 2759406 - RNA, 17 nt, Human
guugccuaaauccauuu

SEQ ID NO: 2759407 - RNA, 22 nt, Human
guugccuaaauccauuuggaaa

SEQ ID NO: 2759408 - RNA, 22 nt, Human
aagucuuauauauuguagauaa

SEQ ID NO: 2759409 - RNA, 16 nt, Human
aagucuuucacauuua

SEQ ID NO: 2759410 - RNA, 13 nt, Human
aaguauuagaaua

SEQ ID NO: 2759411 - RNA, 16 nt, Human
aaguauuaagcauaua

SEQ ID NO: 2759412 - RNA, 17 nt, Human
aaguauuaagcauauau

SEQ ID NO: 2759413 - RNA, 18 nt, Human
aaguauuaagcauauauu

SEQ ID NO: 2759414 - RNA, 14 nt, Human
aaguauuaagcaua

SEQ ID NO: 2759415 - RNA, 15 nt, Human
aaguauuaagcauau

SEQ ID NO: 2759416 - RNA, 14 nt, Human
aaguaaugauaacu

SEQ ID NO: 2759417 - RNA, 12 nt, Human
uaaaagaaugau

SEQ ID NO: 2759418 - RNA, 23 nt, Human
uaaaagaauauuuuaacuuccuu

SEQ ID NO: 2759419 - RNA, 16 nt, Human
uaaaagaauauuuuaa

SEQ ID NO: 2759420 - RNA, 20 nt, Human
uaaaagacagugaaagaaaa

SEQ ID NO: 2759421 - RNA, 13 nt, Human
aagauguagagga

SEQ ID NO: 2759422 - RNA, 14 nt, Human
aagaugaaaauauu

SEQ ID NO: 2759423 - RNA, 13 nt, Human
aagaugaaaauau

SEQ ID NO: 2759424 - RNA, 16 nt, Human
aagacugcacaucaaa

SEQ ID NO: 2759425 - RNA, 17 nt, Human
aagacugcauuauauuu

SEQ ID NO: 2759426 - RNA, 23 nt, Human
aagaggaaugaaguacucauaca

SEQ ID NO: 2759427 - RNA, 20 nt, Human
guuauuauauuuacaaaugg

SEQ ID NO: 2759428 - RNA, 13 nt, Human
aagcuccagguag

SEQ ID NO: 2759429 - RNA, 14 nt, Human
aagcuccagguaga

SEQ ID NO: 2759430 - RNA, 20 nt, Human
aagcucacagaccuuugaac

SEQ ID NO: 2759431 - RNA, 16 nt, Human
aagcauuuagauguau

SEQ ID NO: 2759432 - RNA, 13 nt, Human
aagcauuguaaau

SEQ ID NO: 2759433 - RNA, 16 nt, Human
uaaaugugcuuuuaaa

SEQ ID NO: 2759434 - RNA, 23 nt, Human
aauacaucccuuaccugggaaag

SEQ ID NO: 2759435 - RNA, 23 nt, Human
aauaccacaggaaccacaagacu

SEQ ID NO: 2759436 - RNA, 18 nt, Human
aauaccaugccauuuaaa

SEQ ID NO: 2759437 - RNA, 19 nt, Human
aauagucaaauugugugaa

SEQ ID NO: 2759438 - RNA, 21 nt, Human
aauagcuagacuggugacuga

SEQ ID NO: 2759439 - RNA, 14 nt, Human
aauagcuagacugg

SEQ ID NO: 2759440 - RNA, 20 nt, Human
aauagcuagacuggugacug

SEQ ID NO: 2759441 - RNA, 12 nt, Human
uaacauguuaaa

SEQ ID NO: 2759442 - RNA, 15 nt, Human
uaacauguuaaacca

SEQ ID NO: 2759443 - RNA, 21 nt, Human
uaacuuccuuggacucauuuu

SEQ ID NO: 2759444 - RNA, 13 nt, Human
uaagaagugaaaa

SEQ ID NO: 2759445 - RNA, 20 nt, Human
aauccucaguuuuugugaaa

SEQ ID NO: 2759446 - RNA, 21 nt, Human
aaucccauuauucaaaguugc

SEQ ID NO: 2759447 - RNA, 14 nt, Human
aaucccauuauuca

SEQ ID NO: 2759448 - RNA, 16 nt, Human
aaucccauuauucaaa

SEQ ID NO: 2759449 - RNA, 20 nt, Human
uaaguaaugauaacuggaaa

SEQ ID NO: 2759450 - RNA, 19 nt, Human
uaaguaaaaccacagcagu

SEQ ID NO: 2759451 - RNA, 18 nt, Human
uaaguaaaaccacagcag

SEQ ID NO: 2759452 - RNA, 17 nt, Human
uaaguaaaaccacagca

SEQ ID NO: 2759453 - RNA, 16 nt, Human
uaaguaaaaccacagc

SEQ ID NO: 2759454 - RNA, 15 nt, Human
uaaguaaaaccacag

SEQ ID NO: 2759455 - RNA, 13 nt, Human
uaaguaaaaccac

SEQ ID NO: 2759456 - RNA, 18 nt, Human
uaagguuaccuuuguucc

SEQ ID NO: 2759457 - RNA, 13 nt, Human
uaaggacuuguua

SEQ ID NO: 2759458 - RNA, 15 nt, Human
uaaggacuuguuaga

SEQ ID NO: 2759459 - RNA, 16 nt, Human
uaaggacuuguuagau

SEQ ID NO: 2759460 - RNA, 19 nt, Human
uaaggacuuguuagaucua

SEQ ID NO: 2759461 - RNA, 18 nt, Human
uaaguuuuuuuuuaaaaa

SEQ ID NO: 2759462 - RNA, 15 nt, Human
uaagcaaaaugugau

SEQ ID NO: 2759463 - RNA, 21 nt, Human
uaagcaaaaugugauauguac

SEQ ID NO: 2759464 - RNA, 14 nt, Human
uaagcaaaauguga

SEQ ID NO: 2759465 - RNA, 13 nt, Human
uaagcauauauuu

SEQ ID NO: 2759466 - RNA, 21 nt, Human
uaaggaaaaguuuaauauuaa

SEQ ID NO: 2759467 - RNA, 17 nt, Human
uaaggaaaaguuuaaua

SEQ ID NO: 2759468 - RNA, 19 nt, Human
uaaggaaaaguuuaauauu

SEQ ID NO: 2759469 - RNA, 14 nt, Human
uaaggacuucuuua

SEQ ID NO: 2759470 - RNA, 15 nt, Human
uaaggacuucuuuaa

SEQ ID NO: 2759471 - RNA, 16 nt, Human
uaaggacuucuuuaau

SEQ ID NO: 2759472 - RNA, 22 nt, Human
uaaggacuucuuuaauuuugga

SEQ ID NO: 2759473 - RNA, 16 nt, Human
aaucagccuaguugau

SEQ ID NO: 2759474 - RNA, 21 nt, Human
uacaaaaaaaaaaaaaaauua

SEQ ID NO: 2759475 - RNA, 22 nt, Human
aaugcuguauuuuaaaagaaug

SEQ ID NO: 2759476 - RNA, 20 nt, Human
aaugcuguauuuuaaaagaa

SEQ ID NO: 2759477 - RNA, 21 nt, Human
aaugcuguauuuuaaaagaau

SEQ ID NO: 2759478 - RNA, 20 nt, Human
aauguaagggaaacugccag

SEQ ID NO: 2759479 - RNA, 17 nt, Human
uacagagacagaaagca

SEQ ID NO: 2759480 - RNA, 13 nt, Human
uacagaauuuuau

SEQ ID NO: 2759481 - RNA, 14 nt, Human
uacaccauuaugug

SEQ ID NO: 2759482 - RNA, 22 nt, Human
uaauuccguagguuauuuucag

SEQ ID NO: 2759483 - RNA, 18 nt, Human
uaauuuuuauauuugaaa

SEQ ID NO: 2759484 - RNA, 19 nt, Human
uaauuuuuauauuugaaau

SEQ ID NO: 2759485 - RNA, 21 nt, Human
uaauuuuuauauuugaaauau

SEQ ID NO: 2759486 - RNA, 16 nt, Human
aaugauuucauucaau

SEQ ID NO: 2759487 - RNA, 14 nt, Human
uaauuauaugcuau

SEQ ID NO: 2759488 - RNA, 18 nt, Human
uaauuauaugcuauuucu

SEQ ID NO: 2759489 - RNA, 19 nt, Human
uaauuauaugcuauuucua

SEQ ID NO: 2759490 - RNA, 19 nt, Human
uaauuauaucugaggaauu

SEQ ID NO: 2759491 - RNA, 21 nt, Human
uaauuauaucugaggaauucu

SEQ ID NO: 2759492 - RNA, 22 nt, Human
uaauuauaucugaggaauucug

SEQ ID NO: 2759493 - RNA, 23 nt, Human
uaauuauaucugaggaauucugu

SEQ ID NO: 2759494 - RNA, 22 nt, Human
aaugagagacacacugaagaag

SEQ ID NO: 2759495 - RNA, 23 nt, Human
aaugauuaugaauuacauuugua

SEQ ID NO: 2759496 - RNA, 16 nt, Human
aauguucaucaaugaa

SEQ ID NO: 2759497 - RNA, 20 nt, Human
aauguucaucaaugaaugaa

SEQ ID NO: 2759498 - RNA, 13 nt, Human
aauguucaucaau

SEQ ID NO: 2759499 - RNA, 19 nt, Human
uaccagggacugaggggag

SEQ ID NO: 2759500 - RNA, 16 nt, Human
uaccaugccauuuaaa

SEQ ID NO: 2759501 - RNA, 14 nt, Human
aauuacauuuguau

SEQ ID NO: 2759502 - RNA, 13 nt, Human
aauuacauuugua

SEQ ID NO: 2759503 - RNA, 17 nt, Human
acacucaaaucaagaaa

SEQ ID NO: 2759504 - RNA, 13 nt, Human
acacucaaaucaa

SEQ ID NO: 2759505 - RNA, 19 nt, Human
acacuaagagagaaugaga

SEQ ID NO: 2759506 - RNA, 16 nt, Human
uauaggugcuacaaaa

SEQ ID NO: 2759507 - RNA, 19 nt, Human
uauaggaauugacccacaa

SEQ ID NO: 2759508 - RNA, 12 nt, Human
uauaggaauuga

SEQ ID NO: 2759509 - RNA, 18 nt, Human
uauagauuagaauucugu

SEQ ID NO: 2759510 - RNA, 19 nt, Human
acagaaagcagaacaguga

SEQ ID NO: 2759511 - RNA, 14 nt, Human
acagaccuuugaac

SEQ ID NO: 2759512 - RNA, 20 nt, Human
uaucacaaaucuuaacuuga

SEQ ID NO: 2759513 - RNA, 16 nt, Human
uaucacaaaucuuaac

SEQ ID NO: 2759514 - RNA, 14 nt, Human
uaucacaaaucuua

SEQ ID NO: 2759515 - RNA, 14 nt, Human
acagcuguaugauu

SEQ ID NO: 2759516 - RNA, 19 nt, Human
acagcuguaugauucccag

SEQ ID NO: 2759517 - RNA, 20 nt, Human
acagcuguaugauucccagc

SEQ ID NO: 2759518 - RNA, 23 nt, Human
acagcuguaugauucccagccag

SEQ ID NO: 2759519 - RNA, 14 nt, Human
uaugaaacuugugu

SEQ ID NO: 2759520 - RNA, 19 nt, Human
uaugaaacuuguguaaaua

SEQ ID NO: 2759521 - RNA, 21 nt, Human
uaugaaacuuguguaaauaca

SEQ ID NO: 2759522 - RNA, 18 nt, Human
acagcaagggugauggga

SEQ ID NO: 2759523 - RNA, 14 nt, Human
uaugcuauuucuau

SEQ ID NO: 2759524 - RNA, 15 nt, Human
uaugcuauuucuaua

SEQ ID NO: 2759525 - RNA, 16 nt, Human
uaugcuauuucuauau

SEQ ID NO: 2759526 - RNA, 18 nt, Human
uaugcuauuucuauauuu

SEQ ID NO: 2759527 - RNA, 22 nt, Human
uaugcuauuucuauauuuucau

SEQ ID NO: 2759528 - RNA, 23 nt, Human
uaugcuauuucuauauuuucauu

SEQ ID NO: 2759529 - RNA, 17 nt, Human
uagaacucccuuucaac

SEQ ID NO: 2759530 - RNA, 16 nt, Human
uagaacucccuuucaa

SEQ ID NO: 2759531 - RNA, 15 nt, Human
uagaaacacaacuau

SEQ ID NO: 2759532 - RNA, 13 nt, Human
uagacacacauga

SEQ ID NO: 2759533 - RNA, 13 nt, Human
acaaaaacacagc

SEQ ID NO: 2759534 - RNA, 15 nt, Human
acaaaaacacagcaa

SEQ ID NO: 2759535 - RNA, 14 nt, Human
acaaaaacacagca

SEQ ID NO: 2759536 - RNA, 15 nt, Human
acaaaguauuaagca

SEQ ID NO: 2759537 - RNA, 16 nt, Human
acaaaguauuaagcau

SEQ ID NO: 2759538 - RNA, 13 nt, Human
acaaaguauuaag

SEQ ID NO: 2759539 - RNA, 18 nt, Human
acaaaguauuaagcauau

SEQ ID NO: 2759540 - RNA, 14 nt, Human
uagaggguguguaa

SEQ ID NO: 2759541 - RNA, 13 nt, Human
uaggauguugaaa

SEQ ID NO: 2759542 - RNA, 13 nt, Human
acacaacuauauu

SEQ ID NO: 2759543 - RNA, 18 nt, Human
acuauucaaacagucuca

SEQ ID NO: 2759544 - RNA, 16 nt, Human
acuauucaaacagucu

SEQ ID NO: 2759545 - RNA, 14 nt, Human
acuauucaaacagu

SEQ ID NO: 2759546 - RNA, 13 nt, Human
acuauucaaacag

SEQ ID NO: 2759547 - RNA, 14 nt, Human
uccccuccucugcu

SEQ ID NO: 2759548 - RNA, 15 nt, Human
uccccuccucugcuu

SEQ ID NO: 2759549 - RNA, 18 nt, Human
uccccuccucugcuugcc

SEQ ID NO: 2759550 - RNA, 24 nt, Human
uccccuccucugcuugccaucccu

SEQ ID NO: 2759551 - RNA, 20 nt, Human
acuagaguuuagcuggaaaa

SEQ ID NO: 2759552 - RNA, 21 nt, Human
acuccaaacugacucuuaaga

SEQ ID NO: 2759553 - RNA, 20 nt, Human
acucauuuuaaaaaauggaa

SEQ ID NO: 2759554 - RNA, 19 nt, Human
ucccuccaccucccugcaa

SEQ ID NO: 2759555 - RNA, 15 nt, Human
ucccuccaccucccu

SEQ ID NO: 2759556 - RNA, 17 nt, Human
ucccuccaccucccugc

SEQ ID NO: 2759557 - RNA, 14 nt, Human
ucccuccaccuccc

SEQ ID NO: 2759558 - RNA, 14 nt, Human
acuccagaaaguga

SEQ ID NO: 2759559 - RNA, 17 nt, Human
uccgugcuaaggacuug

SEQ ID NO: 2759560 - RNA, 18 nt, Human
uccgugcuaaggacuugu

SEQ ID NO: 2759561 - RNA, 16 nt, Human
uccgugcuaaggacuu

SEQ ID NO: 2759562 - RNA, 23 nt, Human
uccgugcuaaggacuuguuagau

SEQ ID NO: 2759563 - RNA, 21 nt, Human
uccugaaaacccuugccaugu

SEQ ID NO: 2759564 - RNA, 17 nt, Human
uccucuccccaugaugu

SEQ ID NO: 2759565 - RNA, 16 nt, Human
ucauaauaaguugcau

SEQ ID NO: 2759566 - RNA, 12 nt, Human
accugagcccca

SEQ ID NO: 2759567 - RNA, 17 nt, Human
accugagccccaaaagg

SEQ ID NO: 2759568 - RNA, 17 nt, Human
acgcucucuggccuucg

SEQ ID NO: 2759569 - RNA, 15 nt, Human
acggaugauuucuau

SEQ ID NO: 2759570 - RNA, 14 nt, Human
acggaugauuucua

SEQ ID NO: 2759571 - RNA, 15 nt, Human
acgcucucuggccuu

SEQ ID NO: 2759572 - RNA, 16 nt, Human
acgcucucuggccuuc

SEQ ID NO: 2759573 - RNA, 14 nt, Human
acgcucucuggccu

SEQ ID NO: 2759574 - RNA, 13 nt, Human
acgcguugaaauu

SEQ ID NO: 2759575 - RNA, 14 nt, Human
acgcguugaaauug

SEQ ID NO: 2759576 - RNA, 18 nt, Human
acgcguugaaauuguaau

SEQ ID NO: 2759577 - RNA, 20 nt, Human
acgcguugaaauuguaauua

SEQ ID NO: 2759578 - RNA, 14 nt, Human
uccagugagacagc

SEQ ID NO: 2759579 - RNA, 22 nt, Human
uccaugaagauguagaggagaa

SEQ ID NO: 2759580 - RNA, 12 nt, Human
uccauuuaauaa

SEQ ID NO: 2759581 - RNA, 17 nt, Human
uccauuuaauaauuaua

SEQ ID NO: 2759582 - RNA, 12 nt, Human
uccauuuggaaa

SEQ ID NO: 2759583 - RNA, 19 nt, Human
uccauuuggaaaucuuuaa

SEQ ID NO: 2759584 - RNA, 20 nt, Human
uccauuuggaaaucuuuaaa

SEQ ID NO: 2759585 - RNA, 23 nt, Human
ucaauauuucagauaaucacaau

SEQ ID NO: 2759586 - RNA, 14 nt, Human
acauugguguugua

SEQ ID NO: 2759587 - RNA, 16 nt, Human
acauugguguuguacu

SEQ ID NO: 2759588 - RNA, 22 nt, Human
acauugguguuguacucaauuu

SEQ ID NO: 2759589 - RNA, 23 nt, Human
acauugguguuguacucaauuuu

SEQ ID NO: 2759590 - RNA, 12 nt, Human
ucaauuuaaaaa

SEQ ID NO: 2759591 - RNA, 13 nt, Human
ucaauuuaaaaaa

SEQ ID NO: 2759592 - RNA, 16 nt, Human
ucacagaccuuugaac

SEQ ID NO: 2759593 - RNA, 23 nt, Human
ucacagccagacuggcacaguuu

SEQ ID NO: 2759594 - RNA, 17 nt, Human
ucacagccagacuggca

SEQ ID NO: 2759595 - RNA, 16 nt, Human
accacaagacugcaca

SEQ ID NO: 2759596 - RNA, 19 nt, Human
accaacacgagcaggcuac

SEQ ID NO: 2759597 - RNA, 14 nt, Human
accaacacgagcag

SEQ ID NO: 2759598 - RNA, 12 nt, Human
accaaaaaccag

SEQ ID NO: 2759599 - RNA, 13 nt, Human
accaaaaaccagu

SEQ ID NO: 2759600 - RNA, 18 nt, Human
uauuuuaaaagaaugauu

SEQ ID NO: 2759601 - RNA, 14 nt, Human
uauuuuaaaagaau

SEQ ID NO: 2759602 - RNA, 19 nt, Human
uauuuuaauaauguuucaa

SEQ ID NO: 2759603 - RNA, 22 nt, Human
uauuuuaauaauguuucaaaca

SEQ ID NO: 2759604 - RNA, 21 nt, Human
ucaaacagucucaggaaauca

SEQ ID NO: 2759605 - RNA, 20 nt, Human
ucaaacagucucaggaaauc

SEQ ID NO: 2759606 - RNA, 13 nt, Human
ucaaacagucuca

SEQ ID NO: 2759607 - RNA, 15 nt, Human
ucaaaguugccuaaa

SEQ ID NO: 2759608 - RNA, 17 nt, Human
ucagagcugcccucucc

SEQ ID NO: 2759609 - RNA, 15 nt, Human
ucagagcugcccucu

SEQ ID NO: 2759610 - RNA, 16 nt, Human
ucagagcugcccucuc

SEQ ID NO: 2759611 - RNA, 13 nt, Human
ucagaucugccua

SEQ ID NO: 2759612 - RNA, 15 nt, Human
ucagaucugccuaag

SEQ ID NO: 2759613 - RNA, 18 nt, Human
ucagaucugccuaaggac

SEQ ID NO: 2759614 - RNA, 20 nt, Human
ucagaucugccuaaggacuu

SEQ ID NO: 2759615 - RNA, 13 nt, Human
ucagagcugcccu

SEQ ID NO: 2759616 - RNA, 14 nt, Human
ucagagcugcccuc

SEQ ID NO: 2759617 - RNA, 16 nt, Human
acccaaauguucauca

SEQ ID NO: 2759618 - RNA, 20 nt, Human
acccaaauguucaucaauga

SEQ ID NO: 2759619 - RNA, 17 nt, Human
accaugggauaaaugcc

SEQ ID NO: 2759620 - RNA, 18 nt, Human
accaugggauaaaugcca

SEQ ID NO: 2759621 - RNA, 13 nt, Human
acuguggguagac

SEQ ID NO: 2759622 - RNA, 17 nt, Human
ucuaccaaaaaucucaa

SEQ ID NO: 2759623 - RNA, 23 nt, Human
acugucagcuccccucggagaag

SEQ ID NO: 2759624 - RNA, 22 nt, Human
acugucagcuccccucggagaa

SEQ ID NO: 2759625 - RNA, 22 nt, Human
acugaagaagcaccaaucauga

SEQ ID NO: 2759626 - RNA, 23 nt, Human
acuugaacccgggaggcagaggu

SEQ ID NO: 2759627 - RNA, 21 nt, Human
acuugaacccgggaggcagag

SEQ ID NO: 2759628 - RNA, 17 nt, Human
ucucaaaacugcacugu

SEQ ID NO: 2759629 - RNA, 21 nt, Human
acuucuaaguaaaaccacagc

SEQ ID NO: 2759630 - RNA, 13 nt, Human
acuucuaaguaaa

SEQ ID NO: 2759631 - RNA, 19 nt, Human
acuucuaaguaaaaccaca

SEQ ID NO: 2759632 - RNA, 18 nt, Human
acuucuaaguaaaaccac

SEQ ID NO: 2759633 - RNA, 13 nt, Human
ucuauaauuuaaa

SEQ ID NO: 2759634 - RNA, 16 nt, Human
ucuaguucacucucca

SEQ ID NO: 2759635 - RNA, 19 nt, Human
ucuaguucacucuccauuu

SEQ ID NO: 2759636 - RNA, 12 nt, Human
ucuaguucacuc

SEQ ID NO: 2759637 - RNA, 20 nt, Human
acuuccagauccuggaaauc

SEQ ID NO: 2759638 - RNA, 20 nt, Human
agaaagcagaacagugauua

SEQ ID NO: 2759639 - RNA, 17 nt, Human
agaaagcagaacaguga

SEQ ID NO: 2759640 - RNA, 18 nt, Human
agaaagcagaacagugau

SEQ ID NO: 2759641 - RNA, 16 nt, Human
agaaagacuauucaaa

SEQ ID NO: 2759642 - RNA, 16 nt, Human
agaaacacaacuauau

SEQ ID NO: 2759643 - RNA, 23 nt, Human
agaaacuuaagguuaccuuuguu

SEQ ID NO: 2759644 - RNA, 22 nt, Human
acuuugugcugggguuaucuga

SEQ ID NO: 2759645 - RNA, 19 nt, Human
agaagcaacccaaauguuc

SEQ ID NO: 2759646 - RNA, 19 nt, Human
agaagcaccaaucaugaau

SEQ ID NO: 2759647 - RNA, 20 nt, Human
ucugcccauccugccccuga

SEQ ID NO: 2759648 - RNA, 21 nt, Human
agaagccccacccugccucac

SEQ ID NO: 2759649 - RNA, 17 nt, Human
agaacucccuuucaaca

SEQ ID NO: 2759650 - RNA, 15 nt, Human
agaacucccuuucaa

SEQ ID NO: 2759651 - RNA, 16 nt, Human
agaacucccuuucaac

SEQ ID NO: 2759652 - RNA, 13 nt, Human
agaaguugauaug

SEQ ID NO: 2759653 - RNA, 14 nt, Human
agaagcuccaggua

SEQ ID NO: 2759654 - RNA, 15 nt, Human
ugaauacuuuauaaa

SEQ ID NO: 2759655 - RNA, 12 nt, Human
ugaauggcuuug

SEQ ID NO: 2759656 - RNA, 15 nt, Human
ugaauggcuuuguau

SEQ ID NO: 2759657 - RNA, 11 nt, Human
ugaauggcuuu

SEQ ID NO: 2759658 - RNA, 17 nt, Human
ugaauggcuuuguauag

SEQ ID NO: 2759659 - RNA, 18 nt, Human
ugaauggcuuuguauaga

SEQ ID NO: 2759660 - RNA, 19 nt, Human
ugaauggcuuuguauagaa

SEQ ID NO: 2759661 - RNA, 22 nt, Human
ugaauggcuuuguauagaaccu

SEQ ID NO: 2759662 - RNA, 21 nt, Human
ugaauuuuguguuagagauuu

SEQ ID NO: 2759663 - RNA, 17 nt, Human
ugaauuuuguguuagag

SEQ ID NO: 2759664 - RNA, 17 nt, Human
agauacuggauuguacu

SEQ ID NO: 2759665 - RNA, 14 nt, Human
agauacuggauugu

SEQ ID NO: 2759666 - RNA, 23 nt, Human
agcaacgcaggcccccaggugcc

SEQ ID NO: 2759667 - RNA, 15 nt, Human
agauuuuuuuguugu

SEQ ID NO: 2759668 - RNA, 16 nt, Human
agauuuuuuuguuguu

SEQ ID NO: 2759669 - RNA, 18 nt, Human
agauuuuuuuguuguuug

SEQ ID NO: 2759670 - RNA, 19 nt, Human
agauuuuuuuguuguuugu

SEQ ID NO: 2759671 - RNA, 23 nt, Human
agauuuuuuuguuguuuguuuag

SEQ ID NO: 2759672 - RNA, 15 nt, Human
agauucccugagcag

SEQ ID NO: 2759673 - RNA, 15 nt, Human
ugacuucuaaguaaa

SEQ ID NO: 2759674 - RNA, 23 nt, Human
ugacuucuaaguaaaaccacagc

SEQ ID NO: 2759675 - RNA, 22 nt, Human
ugacuucuaaguaaaaccacag

SEQ ID NO: 2759676 - RNA, 24 nt, Human
ugacuucuaaguaaaaccacagca

SEQ ID NO: 2759677 - RNA, 15 nt, Human
agauuuuauuaugua

SEQ ID NO: 2759678 - RNA, 16 nt, Human
agauuuuauuauguaa

SEQ ID NO: 2759679 - RNA, 17 nt, Human
agauuuuauuauguaaa

SEQ ID NO: 2759680 - RNA, 18 nt, Human
agauuuuauuauguaaau

SEQ ID NO: 2759681 - RNA, 14 nt, Human
agauuuuauuaugu

SEQ ID NO: 2759682 - RNA, 19 nt, Human
agauuuuauuauguaaauc

SEQ ID NO: 2759683 - RNA, 17 nt, Human
ugacacuuaaaaauggu

SEQ ID NO: 2759684 - RNA, 16 nt, Human
ugacacuuaaaaaugg

SEQ ID NO: 2759685 - RNA, 16 nt, Human
agaugcaguucugaag

SEQ ID NO: 2759686 - RNA, 14 nt, Human
agacuauucaaaca

SEQ ID NO: 2759687 - RNA, 12 nt, Human
agacuauucaaa

SEQ ID NO: 2759688 - RNA, 15 nt, Human
agacuauucaaacag

SEQ ID NO: 2759689 - RNA, 14 nt, Human
agaaucacuugaac

SEQ ID NO: 2759690 - RNA, 15 nt, Human
ucuucacaacagauu

SEQ ID NO: 2759691 - RNA, 17 nt, Human
agacaucaacagauaaa

SEQ ID NO: 2759692 - RNA, 18 nt, Human
agacaucaacagauaaau

SEQ ID NO: 2759693 - RNA, 14 nt, Human
agacauagaauuaa

SEQ ID NO: 2759694 - RNA, 21 nt, Human
agacauagaauuaacacauga

SEQ ID NO: 2759695 - RNA, 20 nt, Human
ugaaaagcuccauuuuuagu

SEQ ID NO: 2759696 - RNA, 22 nt, Human
ugaaaaaguucugcagauaaac

SEQ ID NO: 2759697 - RNA, 22 nt, Human
ugaaacugagaugugaacacau

SEQ ID NO: 2759698 - RNA, 19 nt, Human
ugaaacucguuaauuugua

SEQ ID NO: 2759699 - RNA, 17 nt, Human
ugaaacuuguguaaaua

SEQ ID NO: 2759700 - RNA, 23 nt, Human
ugaaacuuguguaaauacaauuu

SEQ ID NO: 2759701 - RNA, 17 nt, Human
ugaaacggaugauuucu

SEQ ID NO: 2759702 - RNA, 18 nt, Human
ugaaacggaugauuucua

SEQ ID NO: 2759703 - RNA, 19 nt, Human
ugaaacggaugauuucuau

SEQ ID NO: 2759704 - RNA, 20 nt, Human
ugaaacggaugauuucuaug

SEQ ID NO: 2759705 - RNA, 15 nt, Human
ugaaacggaugauuu

SEQ ID NO: 2759706 - RNA, 12 nt, Human
ugauaugggucu

SEQ ID NO: 2759707 - RNA, 20 nt, Human
agcaugucgucaaagcugaa

SEQ ID NO: 2759708 - RNA, 17 nt, Human
agcaugucgucaaagcu

SEQ ID NO: 2759709 - RNA, 18 nt, Human
agcauuguaaaugugcuu

SEQ ID NO: 2759710 - RNA, 17 nt, Human
agcauuguaaaugugcu

SEQ ID NO: 2759711 - RNA, 22 nt, Human
ugaguaacugauuuguaacaag

SEQ ID NO: 2759712 - RNA, 23 nt, Human
agcauaaauguugacaugggaca

SEQ ID NO: 2759713 - RNA, 17 nt, Human
ugaugaagaaguugaua

SEQ ID NO: 2759714 - RNA, 22 nt, Human
ugauccagcagauuauucacug

SEQ ID NO: 2759715 - RNA, 21 nt, Human
ugauccagcagauuauucacu

SEQ ID NO: 2759716 - RNA, 20 nt, Human
ugauccagcagauuauucac

SEQ ID NO: 2759717 - RNA, 22 nt, Human
ugauccaguuuuguuuggacca

SEQ ID NO: 2759718 - RNA, 14 nt, Human
ugauuaccagggac

SEQ ID NO: 2759719 - RNA, 12 nt, Human
ugauuaaaccaa

SEQ ID NO: 2759720 - RNA, 17 nt, Human
ugaugaucuuuaaaaua

SEQ ID NO: 2759721 - RNA, 14 nt, Human
ugaugaucuuuaaa

SEQ ID NO: 2759722 - RNA, 14 nt, Human
agccagacuggcac

SEQ ID NO: 2759723 - RNA, 19 nt, Human
agccagacuggcacaguuu

SEQ ID NO: 2759724 - RNA, 13 nt, Human
agccauguuuauu

SEQ ID NO: 2759725 - RNA, 14 nt, Human
agccauguuuauua

SEQ ID NO: 2759726 - RNA, 16 nt, Human
agccauguuuauuaca

SEQ ID NO: 2759727 - RNA, 22 nt, Human
agccugaaagaggaaugaagua

SEQ ID NO: 2759728 - RNA, 15 nt, Human
agccucauguccacu

SEQ ID NO: 2759729 - RNA, 20 nt, Human
agccucauguccacugguuc

SEQ ID NO: 2759730 - RNA, 18 nt, Human
agcccauggcacucuaug

SEQ ID NO: 2759731 - RNA, 18 nt, Human
agccccgugggguuccuc

SEQ ID NO: 2759732 - RNA, 17 nt, Human
agcuacuugggaggcug

SEQ ID NO: 2759733 - RNA, 18 nt, Human
agcuacuugggaggcuga

SEQ ID NO: 2759734 - RNA, 14 nt, Human
agcuagacugguga

SEQ ID NO: 2759735 - RNA, 16 nt, Human
agcuagacuggugacu

SEQ ID NO: 2759736 - RNA, 17 nt, Human
agcuagacuggugacug

SEQ ID NO: 2759737 - RNA, 21 nt, Human
agcuagacuggugacugauuc

SEQ ID NO: 2759738 - RNA, 13 nt, Human
agcuagacuggug

SEQ ID NO: 2759739 - RNA, 20 nt, Human
agccuuggggcugaugcagu

SEQ ID NO: 2759740 - RNA, 13 nt, Human
uggagaagaacug

SEQ ID NO: 2759741 - RNA, 17 nt, Human
uggacuguggugacuuu

SEQ ID NO: 2759742 - RNA, 19 nt, Human
uggacuguggugacuuugg

SEQ ID NO: 2759743 - RNA, 21 nt, Human
uggacuguggugacuuuggau

SEQ ID NO: 2759744 - RNA, 22 nt, Human
uggacuguggugacuuuggaua

SEQ ID NO: 2759745 - RNA, 15 nt, Human
uggacuguggugacu

SEQ ID NO: 2759746 - RNA, 16 nt, Human
uggacuguggugacuu

SEQ ID NO: 2759747 - RNA, 13 nt, Human
uggaaaggcagcu

SEQ ID NO: 2759748 - RNA, 14 nt, Human
uggaaaucuuuaaa

SEQ ID NO: 2759749 - RNA, 15 nt, Human
uggaaaucuuuaaaa

SEQ ID NO: 2759750 - RNA, 19 nt, Human
uggcacaguuuucugagaa

SEQ ID NO: 2759751 - RNA, 18 nt, Human
uggcacaguuuucugaga

SEQ ID NO: 2759752 - RNA, 17 nt, Human
uggcauaacauaaaucu

SEQ ID NO: 2759753 - RNA, 21 nt, Human
uggcauaacauaaaucuguga

SEQ ID NO: 2759754 - RNA, 22 nt, Human
uggcauaacauaaaucugugaa

SEQ ID NO: 2759755 - RNA, 19 nt, Human
agcuguucacagccagacu

SEQ ID NO: 2759756 - RNA, 16 nt, Human
agcuguucacagccag

SEQ ID NO: 2759757 - RNA, 22 nt, Human
agcugcccucuccugggcagcu

SEQ ID NO: 2759758 - RNA, 15 nt, Human
agcugccuccccucc

SEQ ID NO: 2759759 - RNA, 16 nt, Human
agcugccuccccuccu

SEQ ID NO: 2759760 - RNA, 19 nt, Human
ugcuacaaaaacacagcaa

SEQ ID NO: 2759761 - RNA, 18 nt, Human
ugcuacaaaaacacagca

SEQ ID NO: 2759762 - RNA, 17 nt, Human
ugcuacaaaaacacagc

SEQ ID NO: 2759763 - RNA, 16 nt, Human
ugcuacaaaaacacag

SEQ ID NO: 2759764 - RNA, 15 nt, Human
ugcuacaaaaacaca

SEQ ID NO: 2759765 - RNA, 13 nt, Human
ugcuaaggacuug

SEQ ID NO: 2759766 - RNA, 18 nt, Human
ugcuaaggacuuguuaga

SEQ ID NO: 2759767 - RNA, 22 nt, Human
ugcuaaggacuuguuagaucua

SEQ ID NO: 2759768 - RNA, 20 nt, Human
ugcuacaaaaacacagcaag

SEQ ID NO: 2759769 - RNA, 17 nt, Human
agcuugaaacugagaug

SEQ ID NO: 2759770 - RNA, 12 nt, Human
ugcuaaggacuu

SEQ ID NO: 2759771 - RNA, 13 nt, Human
ugcuguauuuuaa

SEQ ID NO: 2759772 - RNA, 21 nt, Human
ugcuguauuuuaaaagaauga

SEQ ID NO: 2759773 - RNA, 22 nt, Human
ugcuguauuuuaaaagaaugau

SEQ ID NO: 2759774 - RNA, 23 nt, Human
aggaauggagccugcacggugaa

SEQ ID NO: 2759775 - RNA, 17 nt, Human
aggacacugauaugggu

SEQ ID NO: 2759776 - RNA, 23 nt, Human
aggaaaucaaauaugcaaagcac

SEQ ID NO: 2759777 - RNA, 12 nt, Human
aggaaauauuua

SEQ ID NO: 2759778 - RNA, 21 nt, Human
aggaagccugauuaaagaaug

SEQ ID NO: 2759779 - RNA, 17 nt, Human
aggaagccugauuaaag

SEQ ID NO: 2759780 - RNA, 18 nt, Human
aggaagccugauuaaaga

SEQ ID NO: 2759781 - RNA, 14 nt, Human
ugcucauggaauug

SEQ ID NO: 2759782 - RNA, 11 nt, Human
ugcucauggaa

SEQ ID NO: 2759783 - RNA, 19 nt, Human
aguagauaggccaugggca

SEQ ID NO: 2759784 - RNA, 15 nt, Human
aguaaaaccacagca

SEQ ID NO: 2759785 - RNA, 18 nt, Human
uguagaggagaaacugga

SEQ ID NO: 2759786 - RNA, 16 nt, Human
uguagaggagaaacug

SEQ ID NO: 2759787 - RNA, 17 nt, Human
uguacuuuuuggcauaa

SEQ ID NO: 2759788 - RNA, 15 nt, Human
uguacuuuuuggcau

SEQ ID NO: 2759789 - RNA, 16 nt, Human
uguacuuuuuggcaua

SEQ ID NO: 2759790 - RNA, 12 nt, Human
uguacuuuuugg

SEQ ID NO: 2759791 - RNA, 13 nt, Human
uguaauuauaucu

SEQ ID NO: 2759792 - RNA, 14 nt, Human
uguaauuauaucug

SEQ ID NO: 2759793 - RNA, 15 nt, Human
uguaauuauaucuga

SEQ ID NO: 2759794 - RNA, 16 nt, Human
uguaaaucccauuauu

SEQ ID NO: 2759795 - RNA, 18 nt, Human
uguaaaucccauuauuca

SEQ ID NO: 2759796 - RNA, 13 nt, Human
uguaaaucccauu

SEQ ID NO: 2759797 - RNA, 19 nt, Human
uguaaaucccauuauucaa

SEQ ID NO: 2759798 - RNA, 20 nt, Human
uguaaaucccauuauucaaa

SEQ ID NO: 2759799 - RNA, 22 nt, Human
uguaaaucccauuauucaaagu

SEQ ID NO: 2759800 - RNA, 21 nt, Human
ugucaauaaaauccauacauu

SEQ ID NO: 2759801 - RNA, 20 nt, Human
ugucaaucagccuaguugau

SEQ ID NO: 2759802 - RNA, 22 nt, Human
aguauuucuaugaaauauuaug

SEQ ID NO: 2759803 - RNA, 13 nt, Human
aguauuucuauga

SEQ ID NO: 2759804 - RNA, 15 nt, Human
aguauuucuaugaaa

SEQ ID NO: 2759805 - RNA, 23 nt, Human
ugucauuugcuggagcucugccc

SEQ ID NO: 2759806 - RNA, 16 nt, Human
agucaggaaagagaac

SEQ ID NO: 2759807 - RNA, 15 nt, Human
agucaggaaagagaa

SEQ ID NO: 2759808 - RNA, 17 nt, Human
agggcagggacaggaua

SEQ ID NO: 2759809 - RNA, 20 nt, Human
ugguaaggggaauugaggac

SEQ ID NO: 2759810 - RNA, 23 nt, Human
agguacuucaaauccuugaagau

SEQ ID NO: 2759811 - RNA, 21 nt, Human
agugccuguaaucacagcuac

SEQ ID NO: 2759812 - RNA, 16 nt, Human
uguggugacuuuggau

SEQ ID NO: 2759813 - RNA, 17 nt, Human
uguggugacuuuggaua

SEQ ID NO: 2759814 - RNA, 18 nt, Human
agugcaaauugucacagg

SEQ ID NO: 2759815 - RNA, 21 nt, Human
agugcaaauugucacaggaca

SEQ ID NO: 2759816 - RNA, 14 nt, Human
agugcaaauuguca

SEQ ID NO: 2759817 - RNA, 17 nt, Human
aguguuggagaagaacu

SEQ ID NO: 2759818 - RNA, 18 nt, Human
aguguuggagaagaacug

SEQ ID NO: 2759819 - RNA, 14 nt, Human
aguguuggagaaga

SEQ ID NO: 2759820 - RNA, 16 nt, Human
aguguuggagaagaac

SEQ ID NO: 2759821 - RNA, 21 nt, Human
aguguugaaacggaugauuuc

SEQ ID NO: 2759822 - RNA, 19 nt, Human
aguucggugagcuacaaau

SEQ ID NO: 2759823 - RNA, 22 nt, Human
aguucacucuccauuuaauaau

SEQ ID NO: 2759824 - RNA, 24 nt, Human
aguucacucuccauuuaauaauua

SEQ ID NO: 2759825 - RNA, 13 nt, Human
uguuuagucuugu

SEQ ID NO: 2759826 - RNA, 17 nt, Human
uguuuagucuugucuca

SEQ ID NO: 2759827 - RNA, 18 nt, Human
uguuuagucuugucucag

SEQ ID NO: 2759828 - RNA, 19 nt, Human
uguuuagucuugucucaga

SEQ ID NO: 2759829 - RNA, 18 nt, Human
uguuuauuacaguauaau

SEQ ID NO: 2759830 - RNA, 23 nt, Human
aguuuucugagaaagacuauuca

SEQ ID NO: 2759831 - RNA, 18 nt, Human
aguuuucugagaaagacu

SEQ ID NO: 2759832 - RNA, 19 nt, Human
aguuuucugagaaagacua

SEQ ID NO: 2759833 - RNA, 22 nt, Human
auaaaauaauuuuuauauuuga

SEQ ID NO: 2759834 - RNA, 12 nt, Human
auaaaauaauuu

SEQ ID NO: 2759835 - RNA, 13 nt, Human
uguuucaaacaua

SEQ ID NO: 2759836 - RNA, 15 nt, Human
aguugccuaaaucca

SEQ ID NO: 2759837 - RNA, 16 nt, Human
aguugccuaaauccau

SEQ ID NO: 2759838 - RNA, 11 nt, Human
aguugccuaaa

SEQ ID NO: 2759839 - RNA, 17 nt, Human
aguugccuaaauccauu

SEQ ID NO: 2759840 - RNA, 14 nt, Human
aguuuaaauuguaa

SEQ ID NO: 2759841 - RNA, 18 nt, Human
auaauccuaaacauauga

SEQ ID NO: 2759842 - RNA, 22 nt, Human
auaacgauaaaagacagugaaa

SEQ ID NO: 2759843 - RNA, 13 nt, Human
auaaauaaaaaua

SEQ ID NO: 2759844 - RNA, 14 nt, Human
auaaauaaaaauaa

SEQ ID NO: 2759845 - RNA, 21 nt, Human
auaaauagcuagacuggugac

SEQ ID NO: 2759846 - RNA, 22 nt, Human
auaaauagcuagacuggugacu

SEQ ID NO: 2759847 - RNA, 15 nt, Human
auaaauaguuuauga

SEQ ID NO: 2759848 - RNA, 13 nt, Human
uuugcucauggaa

SEQ ID NO: 2759849 - RNA, 15 nt, Human
auggcuauaggugcu

SEQ ID NO: 2759850 - RNA, 11 nt, Human
uuugcucaugg

SEQ ID NO: 2759851 - RNA, 12 nt, Human
uuugcucaugga

SEQ ID NO: 2759852 - RNA, 14 nt, Human
uuuuaaaagaauga

SEQ ID NO: 2759853 - RNA, 13 nt, Human
uuuuaaaaaagaa

SEQ ID NO: 2759854 - RNA, 15 nt, Human
uuugucuacaccauu

SEQ ID NO: 2759855 - RNA, 18 nt, Human
uuuguuucuguacuuuuu

SEQ ID NO: 2759856 - RNA, 12 nt, Human
uuuguuucugua

SEQ ID NO: 2759857 - RNA, 13 nt, Human
uuuguuucuguac

SEQ ID NO: 2759858 - RNA, 21 nt, Human
auguuucaaacauauauaaca

SEQ ID NO: 2759859 - RNA, 18 nt, Human
auguuucaaacauauaua

SEQ ID NO: 2759860 - RNA, 16 nt, Human
auuaaaagaauauuuu

SEQ ID NO: 2759861 - RNA, 15 nt, Human
auuaaaagaauauuu

SEQ ID NO: 2759862 - RNA, 12 nt, Human
auuaaagccaug

SEQ ID NO: 2759863 - RNA, 16 nt, Human
auuaaagccauguuua

SEQ ID NO: 2759864 - RNA, 17 nt, Human
auuaaagccauguuuau

SEQ ID NO: 2759865 - RNA, 21 nt, Human
auuaaagccauguuuauuaca

SEQ ID NO: 2759866 - RNA, 11 nt, Human
auuaaagccau

SEQ ID NO: 2759867 - RNA, 13 nt, Human
auuaacauguuaa

SEQ ID NO: 2759868 - RNA, 14 nt, Human
auuaacauguuaaa

SEQ ID NO: 2759869 - RNA, 15 nt, Human
auuaacauguuaaac

SEQ ID NO: 2759870 - RNA, 17 nt, Human
auuaacauguuaaacca

SEQ ID NO: 2759871 - RNA, 19 nt, Human
auuaacauguuaaaccaug

SEQ ID NO: 2759872 - RNA, 15 nt, Human
auguugacaugggac

SEQ ID NO: 2759873 - RNA, 19 nt, Human
auguucaucaaugaaugaa

SEQ ID NO: 2759874 - RNA, 19 nt, Human
uuuuauggcacuaguauuu

SEQ ID NO: 2759875 - RNA, 23 nt, Human
uuuuauggaggcuuugcauagau

SEQ ID NO: 2759876 - RNA, 12 nt, Human
uuuuauuaugua

SEQ ID NO: 2759877 - RNA, 14 nt, Human
uuuuauaauuuugu

SEQ ID NO: 2759878 - RNA, 13 nt, Human
uuuuauuauguaa

SEQ ID NO: 2759879 - RNA, 14 nt, Human
uuuuauuauguaaa

SEQ ID NO: 2759880 - RNA, 16 nt, Human
uuuucuauaauuuaaa

SEQ ID NO: 2759881 - RNA, 15 nt, Human
uuuucauuauuuuau

SEQ ID NO: 2759882 - RNA, 22 nt, Human
uuuucauucuccuaucaccugu

SEQ ID NO: 2759883 - RNA, 21 nt, Human
uuuucauuauuuuauuaugaa

SEQ ID NO: 2759884 - RNA, 15 nt, Human
auuauauuuacaaau

SEQ ID NO: 2759885 - RNA, 17 nt, Human
auuauauuuacaaaugg

SEQ ID NO: 2759886 - RNA, 23 nt, Human
auuaucucaaaacugcacuguca

SEQ ID NO: 2759887 - RNA, 18 nt, Human
auuaucucaaaacugcac

SEQ ID NO: 2759888 - RNA, 20 nt, Human
auuauuaccuuacagaaguu

SEQ ID NO: 2759889 - RNA, 15 nt, Human
auuauuuuauuauga

SEQ ID NO: 2759890 - RNA, 16 nt, Human
auuauauuuacaaaug

SEQ ID NO: 2759891 - RNA, 15 nt, Human
auuagagaguguuga

SEQ ID NO: 2759892 - RNA, 16 nt, Human
auuagagaguguugaa

SEQ ID NO: 2759893 - RNA, 17 nt, Human
auuagagaguguugaaa

SEQ ID NO: 2759894 - RNA, 18 nt, Human
auuagagaguguugaaac

SEQ ID NO: 2759895 - RNA, 19 nt, Human
auuagagaguguugaaacg

SEQ ID NO: 2759896 - RNA, 13 nt, Human
auuaaguaaugau

SEQ ID NO: 2759897 - RNA, 15 nt, Human
auuaaguaaugauaa

SEQ ID NO: 2759898 - RNA, 23 nt, Human
uuuuuuaaaaaagaaacauuugg

SEQ ID NO: 2759899 - RNA, 15 nt, Human
auuacauuuguauaa

SEQ ID NO: 2759900 - RNA, 20 nt, Human
auuacauuuguauaaaauaa

SEQ ID NO: 2759901 - RNA, 13 nt, Human
auuacauuuguau

SEQ ID NO: 2759902 - RNA, 15 nt, Human
auucaaacagucuca

SEQ ID NO: 2759903 - RNA, 14 nt, Human
auucaaacagucuc

SEQ ID NO: 2759904 - RNA, 21 nt, Human
auuauuuuauuaugaaacuug

SEQ ID NO: 2759905 - RNA, 22 nt, Human
auuauuuuauuaugaaacuugu

SEQ ID NO: 2759906 - RNA, 20 nt, Human
auuccacuuauaggaauuga

SEQ ID NO: 2759907 - RNA, 16 nt, Human
auuuacaaaugggaaa

SEQ ID NO: 2759908 - RNA, 19 nt, Human
auuuaaagcuuauuaaaac

SEQ ID NO: 2759909 - RNA, 13 nt, Human
auugugccccugc

SEQ ID NO: 2759910 - RNA, 14 nt, Human
auuguauuacaaau

SEQ ID NO: 2759911 - RNA, 23 nt, Human
auugugcgcuaaacuuuucugau

SEQ ID NO: 2759912 - RNA, 20 nt, Human
auugacacuuaaaaaugguu

SEQ ID NO: 2759913 - RNA, 21 nt, Human
auugacccacaagaaaugaaa

SEQ ID NO: 2759914 - RNA, 12 nt, Human
auuuuaauaaug

SEQ ID NO: 2759915 - RNA, 14 nt, Human
auuuuaauaauguu

SEQ ID NO: 2759916 - RNA, 15 nt, Human
auuuuaauaauguuu

SEQ ID NO: 2759917 - RNA, 16 nt, Human
auuuuaauaauguuuc

SEQ ID NO: 2759918 - RNA, 21 nt, Human
auuuguauaaaauaauuuuua

SEQ ID NO: 2759919 - RNA, 15 nt, Human
auuuguaucacaaau

SEQ ID NO: 2759920 - RNA, 13 nt, Human
auuuuauuaugaa

SEQ ID NO: 2759921 - RNA, 14 nt, Human
auuuuauuaugaaa

SEQ ID NO: 2759922 - RNA, 11 nt, Human
auuuuauuaug

SEQ ID NO: 2759923 - RNA, 12 nt, Human
auuuuauuauga

SEQ ID NO: 2759924 - RNA, 18 nt, Human
auuuuauuaugaaacuug

SEQ ID NO: 2759925 - RNA, 21 nt, Human
auuuuauuaugaaacuugugu

SEQ ID NO: 2759926 - RNA, 14 nt, Human
auuuuauuauguaa

SEQ ID NO: 2759927 - RNA, 13 nt, Human
auuuuauuaugua

SEQ ID NO: 2759928 - RNA, 22 nt, Human
auuuauuacuguaagaaaauau

SEQ ID NO: 2759929 - RNA, 23 nt, Human
auuugguaaggggaauugaggac

SEQ ID NO: 2759930 - RNA, 18 nt, Human
auuuguaguguuggagaa

SEQ ID NO: 2759931 - RNA, 17 nt, Human
auuuggaaaucuuuaaa

SEQ ID NO: 2759932 - RNA, 20 nt, Human
auuuggaaaucuuuaaaaaa

SEQ ID NO: 2759933 - RNA, 19 nt, Human
auauauaacaaugcuguau

SEQ ID NO: 2759934 - RNA, 17 nt, Human
auauaacaaugcuguau

SEQ ID NO: 2759935 - RNA, 20 nt, Human
auaguuguaccgcaauguga

SEQ ID NO: 2759936 - RNA, 13 nt, Human
auagucuggcugu

SEQ ID NO: 2759937 - RNA, 22 nt, Human
uucacaagacccaaaaggcaga

SEQ ID NO: 2759938 - RNA, 23 nt, Human
uucacaagacccaaaaggcagaa

SEQ ID NO: 2759939 - RNA, 22 nt, Human
auaggaauugacccacaagaaa

SEQ ID NO: 2759940 - RNA, 17 nt, Human
auaggcguaacuaauuu

SEQ ID NO: 2759941 - RNA, 14 nt, Human
uucaaacauauaua

SEQ ID NO: 2759942 - RNA, 18 nt, Human
uucaaacagucucaggaa

SEQ ID NO: 2759943 - RNA, 18 nt, Human
uucccaacuccagaaagu

SEQ ID NO: 2759944 - RNA, 12 nt, Human
uucccaaauuuc

SEQ ID NO: 2759945 - RNA, 20 nt, Human
aucaaauaugcaaagcacug

SEQ ID NO: 2759946 - RNA, 16 nt, Human
auauuuuuauauuuac

SEQ ID NO: 2759947 - RNA, 17 nt, Human
auauuuucauucuccua

SEQ ID NO: 2759948 - RNA, 13 nt, Human
auauuuucauucu

SEQ ID NO: 2759949 - RNA, 17 nt, Human
uucuaaguaaaaccaca

SEQ ID NO: 2759950 - RNA, 20 nt, Human
uucuaaguaaaaccacagca

SEQ ID NO: 2759951 - RNA, 19 nt, Human
uucuaaguaaaaccacagc

SEQ ID NO: 2759952 - RNA, 15 nt, Human
aucaauaaaaaauua

SEQ ID NO: 2759953 - RNA, 17 nt, Human
aucaauaaaaaauuaug

SEQ ID NO: 2759954 - RNA, 18 nt, Human
aucaauaaaaaauuauga

SEQ ID NO: 2759955 - RNA, 21 nt, Human
uucuaaguaaaaccacagcag

SEQ ID NO: 2759956 - RNA, 14 nt, Human
uucuauaauuuaaa

SEQ ID NO: 2759957 - RNA, 13 nt, Human
uucuauaauuuaa

SEQ ID NO: 2759958 - RNA, 14 nt, Human
auccauacauuugu

SEQ ID NO: 2759959 - RNA, 17 nt, Human
auccauuuggaaaucuu

SEQ ID NO: 2759960 - RNA, 19 nt, Human
auccauuuggaaaucuuua

SEQ ID NO: 2759961 - RNA, 13 nt, Human
auccauuuggaaa

SEQ ID NO: 2759962 - RNA, 20 nt, Human
auccaguuuuguuuggacca

SEQ ID NO: 2759963 - RNA, 21 nt, Human
auccaguuuuguuuggaccaa

SEQ ID NO: 2759964 - RNA, 18 nt, Human
auccaguuuuguuuggac

SEQ ID NO: 2759965 - RNA, 17 nt, Human
auccaguuuuguuugga

SEQ ID NO: 2759966 - RNA, 18 nt, Human
uucuguacuuuuuggcau

SEQ ID NO: 2759967 - RNA, 19 nt, Human
uucuguacuuuuuggcaua

SEQ ID NO: 2759968 - RNA, 13 nt, Human
uucuguacuuuuu

SEQ ID NO: 2759969 - RNA, 19 nt, Human
uugaaauauugacuuuuua

SEQ ID NO: 2759970 - RNA, 23 nt, Human
uugugugaaagguacuucaaauc

SEQ ID NO: 2759971 - RNA, 19 nt, Human
uuguguaaauacaauuuug

SEQ ID NO: 2759972 - RNA, 23 nt, Human
augagagacacacugaagaagca

SEQ ID NO: 2759973 - RNA, 20 nt, Human
augagagacacacugaagaa

SEQ ID NO: 2759974 - RNA, 21 nt, Human
augagagacacacugaagaag

SEQ ID NO: 2759975 - RNA, 22 nt, Human
augauuaugaauuacauuugua

SEQ ID NO: 2759976 - RNA, 12 nt, Human
augauucccagc

SEQ ID NO: 2759977 - RNA, 15 nt, Human
augcaaagcacugac

SEQ ID NO: 2759978 - RNA, 12 nt, Human
augauuucuaug

SEQ ID NO: 2759979 - RNA, 13 nt, Human
augauuucuaugc

SEQ ID NO: 2759980 - RNA, 16 nt, Human
augauuucuaugcuga

SEQ ID NO: 2759981 - RNA, 14 nt, Human
uuguuuucauuauc

SEQ ID NO: 2759982 - RNA, 15 nt, Human
augccacuaaauuga

SEQ ID NO: 2759983 - RNA, 17 nt, Human
augccacuaaauugaca

SEQ ID NO: 2759984 - RNA, 18 nt, Human
augcaguucugaagaaga

SEQ ID NO: 2759985 - RNA, 19 nt, Human
augcaguucugaagaagau

SEQ ID NO: 2759986 - RNA, 15 nt, Human
augcaguucugaaga

SEQ ID NO: 2759987 - RNA, 17 nt, Human
augcaguucugaagaag

SEQ ID NO: 2759988 - RNA, 14 nt, Human
uuuaauuuuggaau

SEQ ID NO: 2759989 - RNA, 15 nt, Human
uuuaauuuuggaauu

SEQ ID NO: 2759990 - RNA, 17 nt, Human
uuuaauuuuggaauuuu

SEQ ID NO: 2759991 - RNA, 20 nt, Human
auggcuaguaucaaaagaaa

SEQ ID NO: 2759992 - RNA, 22 nt, Human
augcugucuacacuaagagaga

SEQ ID NO: 2759993 - RNA, 23 nt, Human
auggaacgcguugaaauuguaau

SEQ ID NO: 2759994 - RNA, 16 nt, Human
augcuagaacucccuu

SEQ ID NO: 2759995 - RNA, 15 nt, Human
augcuagaacucccu

SEQ ID NO: 2759996 - RNA, 23 nt, Human
uuuauuacaguauaauuaacaug

SEQ ID NO: 2759997 - RNA, 13 nt, Human
uuuauauaagcuu

SEQ ID NO: 2759998 - RNA, 22 nt, Human
uuuauuacaguauaauuaacau

SEQ ID NO: 2759999 - RNA, 20 nt, Human
uuuagcuggaaaaguauguu

SEQ ID NO: 2760000 - RNA, 22 nt, Human
uuuagcuggaaaaguauguuag

SEQ ID NO: 2760001 - RNA, 14 nt, Human
uuuagucuugucuc

SEQ ID NO: 2760002 - RNA, 13 nt, Human
uugcccuguuaaa

SEQ ID NO: 2760003 - RNA, 14 nt, Human
uugccuaaauccau

SEQ ID NO: 2760004 - RNA, 15 nt, Human
uugccuaaauccauu

SEQ ID NO: 2760005 - RNA, 13 nt, Human
uugccuaaaucca

SEQ ID NO: 2760006 - RNA, 22 nt, Human
uugccuaaauccauuuggaaau

SEQ ID NO: 2760007 - RNA, 15 nt, Human
aucugaggaauucug

SEQ ID NO: 2760008 - RNA, 16 nt, Human
aucugaggaauucugu

SEQ ID NO: 2760009 - RNA, 17 nt, Human
aucugaggaauucugua

SEQ ID NO: 2760010 - RNA, 18 nt, Human
aucugaggaauucuguau

SEQ ID NO: 2760011 - RNA, 20 nt, Human
aucugaggaauucuguauag

SEQ ID NO: 2760012 - RNA, 21 nt, Human
aucugaggaauucuguauaga

SEQ ID NO: 2760013 - RNA, 14 nt, Human
aucugccuaaggac

SEQ ID NO: 2760014 - RNA, 15 nt, Human
aucugccuaaggacu

SEQ ID NO: 2760015 - RNA, 16 nt, Human
aucugccuaaggacuu

SEQ ID NO: 2760016 - RNA, 17 nt, Human
aucugccuaaggacuuc

SEQ ID NO: 2760017 - RNA, 13 nt, Human
aucugccuaagga

SEQ ID NO: 2760018 - RNA, 18 nt, Human
aucugccuaaggacuucu

SEQ ID NO: 2760019 - RNA, 19 nt, Human
aucugccuaaggacuucuu

SEQ ID NO: 2760020 - RNA, 20 nt, Human
aucugccuaaggacuucuuu

SEQ ID NO: 2760021 - RNA, 13 nt, Human
aucugugaacuug

SEQ ID NO: 2760022 - RNA, 17 nt, Human
aucugugaacuugaaau

SEQ ID NO: 2760023 - RNA, 18 nt, Human
aucugugaacuugaaauu

SEQ ID NO: 2760024 - RNA, 19 nt, Human
aucugugaacuugaaauuu

SEQ ID NO: 2760025 - RNA, 13 nt, Human
aucucaauauuuc

SEQ ID NO: 2760026 - RNA, 21 nt, Human
aucucauuuccaagcaaguau

SEQ ID NO: 2760027 - RNA, 23 nt, Human
aucucauuuccaagcaaguauua

SEQ ID NO: 2760028 - RNA, 14 nt, Human
aucucauuuccaag

SEQ ID NO: 2760029 - RNA, 19 nt, Human
uugauggugguauguuuuc

SEQ ID NO: 2760030 - RNA, 18 nt, Human
uugauggugguauguuuu

SEQ ID NO: 2760031 - RNA, 13 nt, Human
aucuuuuucuaac

SEQ ID NO: 2760032 - RNA, 15 nt, Human
augaaagcagggacu

SEQ ID NO: 2760033 - RNA, 19 nt, Human
uuggauaauaaggaaaagu

SEQ ID NO: 2760034 - RNA, 21 nt, Human
uuggauaauaaggaaaaguuu

SEQ ID NO: 2760035 - RNA, 15 nt, Human
uuggauaauaaggaa

SEQ ID NO: 2760036 - RNA, 18 nt, Human
augaaauauuauguuaaa

SEQ ID NO: 2760037 - RNA, 13 nt, Human
augaaauauuaug

SEQ ID NO: 2760038 - RNA, 17 nt, Human
augaaauauuauguuaa

SEQ ID NO: 2760039 - RNA, 18 nt, Human
augaagauguagaggaga

SEQ ID NO: 2760040 - RNA, 13 nt, Human
augaaugaauggc

SEQ ID NO: 2760041 - RNA, 13 nt, Human
uuggggauucuua

SEQ ID NO: 2760042 - RNA, 15 nt, Human
uuggggauucuuaaa

SEQ ID NO: 2760043 - RNA, 16 nt, Human
uuguauaaaauaauuu

SEQ ID NO: 2760044 - RNA, 15 nt, Human
uuguauaaaauaauu

SEQ ID NO: 2760045 - RNA, 15 nt, Human
uuguacaaaguauua

SEQ ID NO: 2760046 - RNA, 17 nt, Human
uuguacaaaguauuaag

SEQ ID NO: 2760047 - RNA, 20 nt, Human
uuguacaaaguauuaagcau

SEQ ID NO: 2760048 - RNA, 21 nt, Human
uuguacaaaguauuaagcaua

SEQ ID NO: 2760049 - RNA, 13 nt, Human
uuguacaaaguau

SEQ ID NO: 2760050 - RNA, 14 nt, Human
uuguacaaaguauu

SEQ ID NO: 2760051 - RNA, 16 nt, Human
uuguaucacaaaucuu

SEQ ID NO: 2760052 - RNA, 17 nt, Human
uuguauaaaauaauuuu

SEQ ID NO: 2760053 - RNA, 13 nt, Human
augagagacacac

SEQ ID NO: 2760054 - RNA, 14 nt, Human
augagagacacacu

SEQ ID NO: 2760055 - RNA, 17 nt, Human
augagagacacacugaa

SEQ ID NO: 2760056 - RNA, 19 nt, Human
augagagacacacugaaga

SEQ ID NO: 2760057 - RNA, 14 nt, Human
auaagccagacauc

SEQ ID NO: 2760058 - RNA, 21 nt, Human
auaagccagacaucaacagau

SEQ ID NO: 2760059 - RNA, 22 nt, Human
auaagccagacaucaacagaua

SEQ ID NO: 2760060 - RNA, 13 nt, Human
auaauguuucaaa

SEQ ID NO: 2760061 - RNA, 18 nt, Human
auaauguuucaaacauau

SEQ ID NO: 2760062 - RNA, 14 nt, Human
auaacaaugaaagu

SEQ ID NO: 2760063 - RNA, 15 nt, Human
auaacaaugcuguau

SEQ ID NO: 2760064 - RNA, 17 nt, Human
auaacaaugcuguauuu

SEQ ID NO: 2760065 - RNA, 19 nt, Human
auaacaaugcuguauuuua

SEQ ID NO: 2760066 - RNA, 20 nt, Human
auaacaaugcuguauuuuaa

SEQ ID NO: 2760067 - RNA, 21 nt, Human
auaacaaugcuguauuuuaaa

SEQ ID NO: 2760068 - RNA, 13 nt, Human
auauuauguuaaa

SEQ ID NO: 2760069 - RNA, 14 nt, Human
auauuauguuaaaa

SEQ ID NO: 2760070 - RNA, 23 nt, Human
auauuucagauaaucacaauaca

SEQ ID NO: 2760071 - RNA, 18 nt, Human
auauauuuuuauauuuac

SEQ ID NO: 2760072 - RNA, 19 nt, Human
auauauuuuuauauuuacu

SEQ ID NO: 2760073 - RNA, 20 nt, Human
auauauuuuuauauuuacua

SEQ ID NO: 2760074 - RNA, 15 nt, Human
auagcagcuuauuca

SEQ ID NO: 2760075 - RNA, 11 nt, Human
aguccaagcau

SEQ ID NO: 2760076 - RNA, 19 nt, Human
agugucaaugcagccccca

SEQ ID NO: 2760077 - RNA, 23 nt, Human
aguucagagcugcccucuccugg

SEQ ID NO: 2760078 - RNA, 21 nt, Human
aguucagagcugcccucuccu

SEQ ID NO: 2760079 - RNA, 22 nt, Human
aguucagagcugcccucuccug

SEQ ID NO: 2760080 - RNA, 20 nt, Human
aguucagagcugcccucucc

SEQ ID NO: 2760081 - RNA, 19 nt, Human
aguucagagcugcccucuc

SEQ ID NO: 2760082 - RNA, 18 nt, Human
aguugaaaagacuccaaa

SEQ ID NO: 2760083 - RNA, 14 nt, Human
aguugaaaagacuc

SEQ ID NO: 2760084 - RNA, 20 nt, Human
aguugaaaagacuccaaaga

SEQ ID NO: 2760085 - RNA, 19 nt, Human
aguugaaaagacuccaaag

SEQ ID NO: 2760086 - RNA, 13 nt, Human
augaaguacucau

SEQ ID NO: 2760087 - RNA, 21 nt, Human
augaaguacucauacauguua

SEQ ID NO: 2760088 - RNA, 20 nt, Human
augaaguccaagcauuuaga

SEQ ID NO: 2760089 - RNA, 23 nt, Human
augaaguccaagcauuuagaugu

SEQ ID NO: 2760090 - RNA, 19 nt, Human
auccucaguuuuugugaaa

SEQ ID NO: 2760091 - RNA, 14 nt, Human
aucccauuauucaa

SEQ ID NO: 2760092 - RNA, 15 nt, Human
aucccauuauucaaa

SEQ ID NO: 2760093 - RNA, 20 nt, Human
aucccauuauucaaaguugc

SEQ ID NO: 2760094 - RNA, 14 nt, Human
aucaaauaugcaaa

SEQ ID NO: 2760095 - RNA, 17 nt, Human
aucaugaauuaguuuua

SEQ ID NO: 2760096 - RNA, 13 nt, Human
aucagcuuauugu

SEQ ID NO: 2760097 - RNA, 22 nt, Human
aucagcuugcccuguuaaaaga

SEQ ID NO: 2760098 - RNA, 17 nt, Human
auguuccuagugaaaga

SEQ ID NO: 2760099 - RNA, 16 nt, Human
auguuccuagugaaag

SEQ ID NO: 2760100 - RNA, 15 nt, Human
auguuccuagugaaa

SEQ ID NO: 2760101 - RNA, 15 nt, Human
augugaacacaucag

SEQ ID NO: 2760102 - RNA, 16 nt, Human
augucaaucagccuag

SEQ ID NO: 2760103 - RNA, 21 nt, Human
augucaaucagccuaguugau

SEQ ID NO: 2760104 - RNA, 15 nt, Human
augguccgugcuaag

SEQ ID NO: 2760105 - RNA, 18 nt, Human
augguccgugcuaaggac

SEQ ID NO: 2760106 - RNA, 16 nt, Human
augaucuuuaaaauac

SEQ ID NO: 2760107 - RNA, 21 nt, Human
augaugaucuuuaaaauacac

SEQ ID NO: 2760108 - RNA, 18 nt, Human
augaugaucuuuaaaaua

SEQ ID NO: 2760109 - RNA, 19 nt, Human
auggcuuuguauagaaccu

SEQ ID NO: 2760110 - RNA, 18 nt, Human
auggcuuuguauagaacc

SEQ ID NO: 2760111 - RNA, 20 nt, Human
augcugaguuugugcuggug

SEQ ID NO: 2760112 - RNA, 17 nt, Human
agcgacagugagacucu

SEQ ID NO: 2760113 - RNA, 19 nt, Human
agcuccccucggagaagag

SEQ ID NO: 2760114 - RNA, 17 nt, Human
agcuccccucggagaag

SEQ ID NO: 2760115 - RNA, 20 nt, Human
agcuccccucggagaagagc

SEQ ID NO: 2760116 - RNA, 13 nt, Human
aggaaguagagga

SEQ ID NO: 2760117 - RNA, 15 nt, Human
agggauuagggagag

SEQ ID NO: 2760118 - RNA, 15 nt, Human
agggacugaggggag

SEQ ID NO: 2760119 - RNA, 21 nt, Human
aggccaugggcacugugggua

SEQ ID NO: 2760120 - RNA, 13 nt, Human
agaggaaugaagu

SEQ ID NO: 2760121 - RNA, 18 nt, Human
agacucugucucagucca

SEQ ID NO: 2760122 - RNA, 17 nt, Human
agacccaaaaggcagaa

SEQ ID NO: 2760123 - RNA, 19 nt, Human
agacccaaaaggcagaagc

SEQ ID NO: 2760124 - RNA, 17 nt, Human
agaaugagagacacacu

SEQ ID NO: 2760125 - RNA, 22 nt, Human
agaaugagagacacacugaaga

SEQ ID NO: 2760126 - RNA, 17 nt, Human
agaaugauuaugaauua

SEQ ID NO: 2760127 - RNA, 21 nt, Human
agaagugaaaaucuacacucc

SEQ ID NO: 2760128 - RNA, 21 nt, Human
agaagagcuguucacagccag

SEQ ID NO: 2760129 - RNA, 22 nt, Human
agaagagcuguucacagccaga

SEQ ID NO: 2760130 - RNA, 16 nt, Human
agauguagaggagaaa

SEQ ID NO: 2760131 - RNA, 19 nt, Human
agauguagaggagaaacug

SEQ ID NO: 2760132 - RNA, 19 nt, Human
agaucugccuaaggacuuc

SEQ ID NO: 2760133 - RNA, 24 nt, Human
agcaaaauuuuuucucuaggaaau

SEQ ID NO: 2760134 - RNA, 12 nt, Human
aaguagaggagg

SEQ ID NO: 2760135 - RNA, 17 nt, Human
aagggauggcaagaugu

SEQ ID NO: 2760136 - RNA, 14 nt, Human
aagggauggcaaga

SEQ ID NO: 2760137 - RNA, 19 nt, Human
aagccagauuuuccugaaa

SEQ ID NO: 2760138 - RNA, 23 nt, Human
aagacagugaaagaaaauaacaa

SEQ ID NO: 2760139 - RNA, 15 nt, Human
aagagaacuuccaga

SEQ ID NO: 2760140 - RNA, 15 nt, Human
aagcagggacuugaa

SEQ ID NO: 2760141 - RNA, 17 nt, Human
aaguucugcagauaaac

SEQ ID NO: 2760142 - RNA, 22 nt, Human
aaguugauaugccuuuucccaa

SEQ ID NO: 2760143 - RNA, 10 nt, Human
aauaaaccau

SEQ ID NO: 2760144 - RNA, 14 nt, Human
aauaauguuucaaa

SEQ ID NO: 2760145 - RNA, 19 nt, Human
aauaauguuucaaacauau

SEQ ID NO: 2760146 - RNA, 12 nt, Human
aauaauguuuca

SEQ ID NO: 2760147 - RNA, 16 nt, Human
aauauuaaagccaugu

SEQ ID NO: 2760148 - RNA, 18 nt, Human
aauauuaaagccauguuu

SEQ ID NO: 2760149 - RNA, 19 nt, Human
aauauuaaagccauguuua

SEQ ID NO: 2760150 - RNA, 20 nt, Human
aauauuaaagccauguuuau

SEQ ID NO: 2760151 - RNA, 14 nt, Human
aauauuaaagccau

SEQ ID NO: 2760152 - RNA, 15 nt, Human
aauauuaaagccaug

SEQ ID NO: 2760153 - RNA, 13 nt, Human
aauauuaaagcca

SEQ ID NO: 2760154 - RNA, 12 nt, Human
aauauuaaagcc

SEQ ID NO: 2760155 - RNA, 22 nt, Human
aaucaaauaugcaaagcacuga

SEQ ID NO: 2760156 - RNA, 16 nt, Human
aaucaaauaugcaaag

SEQ ID NO: 2760157 - RNA, 15 nt, Human
aaucaaauaugcaaa

SEQ ID NO: 2760158 - RNA, 22 nt, Human
aaucauuucugcaucagcugcu

SEQ ID NO: 2760159 - RNA, 14 nt, Human
aaugauaacuggaa

SEQ ID NO: 2760160 - RNA, 15 nt, Human
aaugauaacuggaaa

SEQ ID NO: 2760161 - RNA, 16 nt, Human
aaugauaacuggaaac

SEQ ID NO: 2760162 - RNA, 14 nt, Human
aauccauacauuug

SEQ ID NO: 2760163 - RNA, 17 nt, Human
aauccauacauuugugu

SEQ ID NO: 2760164 - RNA, 16 nt, Human
aauccauacauuugug

SEQ ID NO: 2760165 - RNA, 15 nt, Human
aauccaaugaaauga

SEQ ID NO: 2760166 - RNA, 20 nt, Human
aaugguccgugcuaaggacu

SEQ ID NO: 2760167 - RNA, 23 nt, Human
aacugagaugugaacacaucagc

SEQ ID NO: 2760168 - RNA, 13 nt, Human
aacgcguugaaau

SEQ ID NO: 2760169 - RNA, 14 nt, Human
aacgcguugaaauu

SEQ ID NO: 2760170 - RNA, 15 nt, Human
aacgcguugaaauug

SEQ ID NO: 2760171 - RNA, 17 nt, Human
aacgcguugaaauugua

SEQ ID NO: 2760172 - RNA, 11 nt, Human
aaccaguauug

SEQ ID NO: 2760173 - RNA, 13 nt, Human
aaccaguauugua

SEQ ID NO: 2760174 - RNA, 14 nt, Human
aaccaguauuguac

SEQ ID NO: 2760175 - RNA, 14 nt, Human
aaaucuuaacuuga

SEQ ID NO: 2760176 - RNA, 20 nt, Human
aaaucugugaacuugaaauu

SEQ ID NO: 2760177 - RNA, 19 nt, Human
aaaucugugaacuugaaau

SEQ ID NO: 2760178 - RNA, 21 nt, Human
aaaucugugaacuugaaauuu

SEQ ID NO: 2760179 - RNA, 17 nt, Human
aaauguucaucaaugaa

SEQ ID NO: 2760180 - RNA, 20 nt, Human
aaauguucaucaaugaauga

SEQ ID NO: 2760181 - RNA, 22 nt, Human
aaauugacacuuaaaaaugguu

SEQ ID NO: 2760182 - RNA, 18 nt, Human
aaauuggggauucuuaaa

SEQ ID NO: 2760183 - RNA, 19 nt, Human
aaauuggggauucuuaaag

SEQ ID NO: 2760184 - RNA, 20 nt, Human
aaauuggggauucuuaaagu

SEQ ID NO: 2760185 - RNA, 22 nt, Human
aaauuggggauucuuaaaguug

SEQ ID NO: 2760186 - RNA, 17 nt, Human
aaauuggggauucuuaa

SEQ ID NO: 2760187 - RNA, 23 nt, Human
aaauuggggauucuuaaaguuga

SEQ ID NO: 2760188 - RNA, 12 nt, Human
aacacaucagcu

SEQ ID NO: 2760189 - RNA, 19 nt, Human
aaaauccauacauuugugu

SEQ ID NO: 2760190 - RNA, 20 nt, Human
aaaaguuuaauauuaaagcc

SEQ ID NO: 2760191 - RNA, 21 nt, Human
aaaaguuuaauauuaaagcca

SEQ ID NO: 2760192 - RNA, 22 nt, Human
aaaaguuuaauauuaaagccau

SEQ ID NO: 2760193 - RNA, 23 nt, Human
aaaaguuuaauauuaaagccaug

SEQ ID NO: 2760194 - RNA, 13 nt, Human
aaagaaacauuug

SEQ ID NO: 2760195 - RNA, 21 nt, Human
aaacccugucucuacuaaaaa

SEQ ID NO: 2760196 - RNA, 20 nt, Human
aaagcauuguaaaugugcuu

SEQ ID NO: 2760197 - RNA, 19 nt, Human
aaagcauuguaaaugugcu

SEQ ID NO: 2760198 - RNA, 19 nt, Human
aaaggcagaagcaacccaa

SEQ ID NO: 2760199 - RNA, 16 nt, Human
acagaagcuccaggua

SEQ ID NO: 2760200 - RNA, 20 nt, Human
acaauuuuguuucuguacuu

SEQ ID NO: 2760201 - RNA, 18 nt, Human
acaauuuuguuucuguac

SEQ ID NO: 2760202 - RNA, 13 nt, Human
acaagaaaugaaa

SEQ ID NO: 2760203 - RNA, 15 nt, Human
acaagaaaugaaagc

SEQ ID NO: 2760204 - RNA, 16 nt, Human
acaagaaaugaaagca

SEQ ID NO: 2760205 - RNA, 21 nt, Human
acaaggaugaauuaaguuuuu

SEQ ID NO: 2760206 - RNA, 13 nt, Human
aauuuugugaagc

SEQ ID NO: 2760207 - RNA, 17 nt, Human
aauuuugugaagcaaaa

SEQ ID NO: 2760208 - RNA, 18 nt, Human
aauuuugugaagcaaaau

SEQ ID NO: 2760209 - RNA, 11 nt, Human
aauuuuggaau

SEQ ID NO: 2760210 - RNA, 12 nt, Human
aauuuuggaauu

SEQ ID NO: 2760211 - RNA, 16 nt, Human
aauuggggauucuuaa

SEQ ID NO: 2760212 - RNA, 15 nt, Human
aauuggggauucuua

SEQ ID NO: 2760213 - RNA, 21 nt, Human
aaugguccgugcuaaggacuu

SEQ ID NO: 2760214 - RNA, 17 nt, Human
aauuggggauucuuaaa

SEQ ID NO: 2760215 - RNA, 20 nt, Human
aauuggggauucuuaaaguu

SEQ ID NO: 2760216 - RNA, 17 nt, Human
aauuuauuggcuuuucu

SEQ ID NO: 2760217 - RNA, 19 nt, Human
aauuuauuggcuuuucuga

SEQ ID NO: 2760218 - RNA, 20 nt, Human
aauuuauuggcuuuucugau

SEQ ID NO: 2760219 - RNA, 21 nt, Human
aauuuauuggcuuuucugauc

SEQ ID NO: 2760220 - RNA, 23 nt, Human
aauuuauuggcuuuucugaucca

SEQ ID NO: 2760221 - RNA, 21 nt, Human
acagugauuaccagggacuga

SEQ ID NO: 2760222 - RNA, 20 nt, Human
acagugauuaccagggacug

SEQ ID NO: 2760223 - RNA, 20 nt, Human
acaucccuuaccugggaaag

SEQ ID NO: 2760224 - RNA, 19 nt, Human
accaaggcugauuaaacca

SEQ ID NO: 2760225 - RNA, 20 nt, Human
accaaggcugauuaaaccaa

SEQ ID NO: 2760226 - RNA, 19 nt, Human
acggacgaaccuugaaaac

SEQ ID NO: 2760227 - RNA, 19 nt, Human
acuaguauuucuaugaaau

SEQ ID NO: 2760228 - RNA, 18 nt, Human
acuaguauuucuaugaaa

SEQ ID NO: 2760229 - RNA, 17 nt, Human
accucugccucagaaaa

SEQ ID NO: 2760230 - RNA, 18 nt, Human
accucugccucagaaaac

SEQ ID NO: 2760231 - RNA, 19 nt, Human
accugucuugccuuuuuca

SEQ ID NO: 2760232 - RNA, 21 nt, Human
accugucuugccuuuuucauu

SEQ ID NO: 2760233 - RNA, 22 nt, Human
accugucuugccuuuuucauua

SEQ ID NO: 2760234 - RNA, 14 nt, Human
acucuuaagaagac

SEQ ID NO: 2760235 - RNA, 15 nt, Human
acucuuaagaagacu

SEQ ID NO: 2760236 - RNA, 20 nt, Human
acucuuaagaagacugcauu

SEQ ID NO: 2760237 - RNA, 15 nt, Human
acucugucucagucc

SEQ ID NO: 2760238 - RNA, 17 nt, Human
acucugucucaguccau

SEQ ID NO: 2760239 - RNA, 12 nt, Human
acugauucuuca

SEQ ID NO: 2760240 - RNA, 13 nt, Human
acugauucuucag

SEQ ID NO: 2760241 - RNA, 15 nt, Human
acugauucuucagca

SEQ ID NO: 2760242 - RNA, 22 nt, Human
acugauucuucagcaaaaauau

SEQ ID NO: 2760243 - RNA, 22 nt, Human
acuugggaggcugagaugggag

SEQ ID NO: 2760244 - RNA, 12 nt, Human
acuuuaugcuaa

SEQ ID NO: 2760245 - RNA, 17 nt, Human
acuuuaugcuaagugaa

SEQ ID NO: 2760246 - RNA, 13 nt, Human
acuuaaaaauggu

SEQ ID NO: 2760247 - RNA, 14 nt, Human
acuuaaaaaugguu

SEQ ID NO: 2760248 - RNA, 19 nt, Human
acuucaaauccuugaagau

SEQ ID NO: 2760249 - RNA, 20 nt, Human
acuucaaauccuugaagauu

SEQ ID NO: 2760250 - RNA, 17 nt, Human
acuucagcgguuuauau

SEQ ID NO: 2760251 - RNA, 18 nt, Human
acuucagcgguuuauaua

SEQ ID NO: 2760252 - RNA, 19 nt, Human
acuucagcgguuuauauaa

SEQ ID NO: 2760253 - RNA, 22 nt, Human
caauuuuucuuauuucauuucu

SEQ ID NO: 2760254 - RNA, 20 nt, Human
cacaagaaaugaaagcaggg

SEQ ID NO: 2760255 - RNA, 21 nt, Human
cacaagaaaugaaagcaggga

SEQ ID NO: 2760256 - RNA, 18 nt, Human
cacaagaaaugaaagcag

SEQ ID NO: 2760257 - RNA, 18 nt, Human
cacagccagacuggcaca

SEQ ID NO: 2760258 - RNA, 17 nt, Human
cacagccagacuggcac

SEQ ID NO: 2760259 - RNA, 19 nt, Human
cacagcaguugaaaagacu

SEQ ID NO: 2760260 - RNA, 21 nt, Human
cacagcaguugaaaagacucc

SEQ ID NO: 2760261 - RNA, 13 nt, Human
cacacugaagaag

SEQ ID NO: 2760262 - RNA, 23 nt, Human
caagggugaugggaaagcauugu

SEQ ID NO: 2760263 - RNA, 21 nt, Human
caagggugaugggaaagcauu

SEQ ID NO: 2760264 - RNA, 17 nt, Human
caauagucaaauugugu

SEQ ID NO: 2760265 - RNA, 19 nt, Human
caauagucaaauuguguga

SEQ ID NO: 2760266 - RNA, 18 nt, Human
caaggaaaaaauaacaau

SEQ ID NO: 2760267 - RNA, 20 nt, Human
caaggaaaaaauaacaauga

SEQ ID NO: 2760268 - RNA, 13 nt, Human
caaauaugcaaag

SEQ ID NO: 2760269 - RNA, 12 nt, Human
caaauaugcaaa

SEQ ID NO: 2760270 - RNA, 14 nt, Human
caaauguucaucaa

SEQ ID NO: 2760271 - RNA, 18 nt, Human
caaauguucaucaaugaa

SEQ ID NO: 2760272 - RNA, 23 nt, Human
caacagcuggugcccugcuuuca

SEQ ID NO: 2760273 - RNA, 15 nt, Human
caagaaaugaaagca

SEQ ID NO: 2760274 - RNA, 17 nt, Human
caagaaaugaaagcagg

SEQ ID NO: 2760275 - RNA, 19 nt, Human
caagaaaugaaagcaggga

SEQ ID NO: 2760276 - RNA, 17 nt, Human
caaacugacucuuaaga

SEQ ID NO: 2760277 - RNA, 21 nt, Human
caaacugacucuuaagaagac

SEQ ID NO: 2760278 - RNA, 16 nt, Human
caaacugacucuuaag

SEQ ID NO: 2760279 - RNA, 18 nt, Human
caaaacugcacugucaag

SEQ ID NO: 2760280 - RNA, 17 nt, Human
caaaacugcacugucaa

SEQ ID NO: 2760281 - RNA, 14 nt, Human
caaaacugcacugu

SEQ ID NO: 2760282 - RNA, 14 nt, Human
cagugucaaugcag

SEQ ID NO: 2760283 - RNA, 21 nt, Human
caguuaccucugccucagaaa

SEQ ID NO: 2760284 - RNA, 12 nt, Human
caguucugaaga

SEQ ID NO: 2760285 - RNA, 13 nt, Human
caguucugaagaa

SEQ ID NO: 2760286 - RNA, 14 nt, Human
caguucugaagaag

SEQ ID NO: 2760287 - RNA, 22 nt, Human
caguucugaagaagaugguacc

SEQ ID NO: 2760288 - RNA, 15 nt, Human
caguucugaagaaga

SEQ ID NO: 2760289 - RNA, 16 nt, Human
caguucugaagaagau

SEQ ID NO: 2760290 - RNA, 22 nt, Human
caguucggugagcuacaaaugc

SEQ ID NO: 2760291 - RNA, 17 nt, Human
cauaccaacacgagcag

SEQ ID NO: 2760292 - RNA, 21 nt, Human
cauaacauaaaucugugaacu

SEQ ID NO: 2760293 - RNA, 12 nt, Human
cauaacauaaau

SEQ ID NO: 2760294 - RNA, 19 nt, Human
cauaacauaaaucugugaa

SEQ ID NO: 2760295 - RNA, 14 nt, Human
cauaaaucugugaa

SEQ ID NO: 2760296 - RNA, 16 nt, Human
cauaaaucugugaacu

SEQ ID NO: 2760297 - RNA, 18 nt, Human
cauaaaucugugaacuug

SEQ ID NO: 2760298 - RNA, 22 nt, Human
cauaaaucugugaacuugaaau

SEQ ID NO: 2760299 - RNA, 23 nt, Human
cauaaaucugugaacuugaaauu

SEQ ID NO: 2760300 - RNA, 18 nt, Human
caguugaaaagacuccaa

SEQ ID NO: 2760301 - RNA, 14 nt, Human
caguugaaaagacu

SEQ ID NO: 2760302 - RNA, 23 nt, Human
caguugaaaagacuccaaagaaa

SEQ ID NO: 2760303 - RNA, 22 nt, Human
caguugaaaagacuccaaagaa

SEQ ID NO: 2760304 - RNA, 21 nt, Human
caguugaaaagacuccaaaga

SEQ ID NO: 2760305 - RNA, 20 nt, Human
caguuuucugagaaagacua

SEQ ID NO: 2760306 - RNA, 19 nt, Human
caguuuucugagaaagacu

SEQ ID NO: 2760307 - RNA, 21 nt, Human
caguuuuguuuggaccaaaaa

SEQ ID NO: 2760308 - RNA, 15 nt, Human
caguuuucugagaaa

SEQ ID NO: 2760309 - RNA, 14 nt, Human
caguuuucugagaa

SEQ ID NO: 2760310 - RNA, 22 nt, Human
caucuagugagcagucaggaaa

SEQ ID NO: 2760311 - RNA, 14 nt, Human
caucuagugagcag

SEQ ID NO: 2760312 - RNA, 14 nt, Human
caucccucccucca

SEQ ID NO: 2760313 - RNA, 12 nt, Human
caucccucccuc

SEQ ID NO: 2760314 - RNA, 13 nt, Human
caucccucccucc

SEQ ID NO: 2760315 - RNA, 18 nt, Human
caucaaugaaugaaugaa

SEQ ID NO: 2760316 - RNA, 22 nt, Human
caucaagucuuucacauuuaaa

SEQ ID NO: 2760317 - RNA, 20 nt, Human
cauauauaacaaugcuguau

SEQ ID NO: 2760318 - RNA, 22 nt, Human
cauauauuuuuauauuuacuaa

SEQ ID NO: 2760319 - RNA, 23 nt, Human
caugcugucuacacuaagagaga

SEQ ID NO: 2760320 - RNA, 19 nt, Human
cauggaacgcguugaaauu

SEQ ID NO: 2760321 - RNA, 20 nt, Human
cauggaacgcguugaaauug

SEQ ID NO: 2760322 - RNA, 23 nt, Human
cauggaacgcguugaaauuguaa

SEQ ID NO: 2760323 - RNA, 18 nt, Human
cauggaacgcguugaaau

SEQ ID NO: 2760324 - RNA, 17 nt, Human
caugggacagggaggac

SEQ ID NO: 2760325 - RNA, 13 nt, Human
cauguuuauuaca

SEQ ID NO: 2760326 - RNA, 18 nt, Human
cauguuuauuacaguaua

SEQ ID NO: 2760327 - RNA, 19 nt, Human
cauguuuauuacaguauaa

SEQ ID NO: 2760328 - RNA, 20 nt, Human
cauguuuauuacaguauaau

SEQ ID NO: 2760329 - RNA, 22 nt, Human
cauguuuauuacaguauaauua

SEQ ID NO: 2760330 - RNA, 12 nt, Human
cauguuuauuac

SEQ ID NO: 2760331 - RNA, 11 nt, Human
cauuauuuuau

SEQ ID NO: 2760332 - RNA, 21 nt, Human
ccaacacgagcaggcuacugu

SEQ ID NO: 2760333 - RNA, 14 nt, Human
ccaacacgagcagg

SEQ ID NO: 2760334 - RNA, 16 nt, Human
ccacaagaaaugaaag

SEQ ID NO: 2760335 - RNA, 22 nt, Human
ccacaagaaaugaaagcaggga

SEQ ID NO: 2760336 - RNA, 20 nt, Human
ccaauauucauagcagcuua

SEQ ID NO: 2760337 - RNA, 19 nt, Human
ccaaggcugauuaaaccaa

SEQ ID NO: 2760338 - RNA, 18 nt, Human
ccaaggcuagaaccaccu

SEQ ID NO: 2760339 - RNA, 19 nt, Human
cauuuaaagcuuauuaaaa

SEQ ID NO: 2760340 - RNA, 12 nt, Human
cauuuccaagca

SEQ ID NO: 2760341 - RNA, 23 nt, Human
cauuucugcaucagcugcugaaa

SEQ ID NO: 2760342 - RNA, 12 nt, Human
cauuauuuuauu

SEQ ID NO: 2760343 - RNA, 14 nt, Human
cauuauuuuauuau

SEQ ID NO: 2760344 - RNA, 16 nt, Human
cauuauuuuauuauga

SEQ ID NO: 2760345 - RNA, 17 nt, Human
ccaaagaaauguaaggg

SEQ ID NO: 2760346 - RNA, 16 nt, Human
cauuugcucauggaau

SEQ ID NO: 2760347 - RNA, 15 nt, Human
cauuugcucauggaa

SEQ ID NO: 2760348 - RNA, 14 nt, Human
cauuugcucaugga

SEQ ID NO: 2760349 - RNA, 23 nt, Human
ccauggcacucuauguucuaaga

SEQ ID NO: 2760350 - RNA, 16 nt, Human
ccauccugaggcucca

SEQ ID NO: 2760351 - RNA, 15 nt, Human
ccauccugaggcucc

SEQ ID NO: 2760352 - RNA, 13 nt, Human
ccuaaacauauga

SEQ ID NO: 2760353 - RNA, 19 nt, Human
ccuaaauccauuuggaaau

SEQ ID NO: 2760354 - RNA, 18 nt, Human
ccuaaauccauuuggaaa

SEQ ID NO: 2760355 - RNA, 20 nt, Human
ccuaaauccauuuggaaauc

SEQ ID NO: 2760356 - RNA, 21 nt, Human
ccuaaauccauuuggaaaucu

SEQ ID NO: 2760357 - RNA, 17 nt, Human
cccuucuuuccacagaa

SEQ ID NO: 2760358 - RNA, 12 nt, Human
ccuccccuccuc

SEQ ID NO: 2760359 - RNA, 13 nt, Human
ccuccccuccucu

SEQ ID NO: 2760360 - RNA, 12 nt, Human
ccuccauccuga

SEQ ID NO: 2760361 - RNA, 13 nt, Human
ccuccauccugag

SEQ ID NO: 2760362 - RNA, 20 nt, Human
cccucccuccaccucccugc

SEQ ID NO: 2760363 - RNA, 13 nt, Human
cccucccuccacc

SEQ ID NO: 2760364 - RNA, 12 nt, Human
cccucccuccac

SEQ ID NO: 2760365 - RNA, 14 nt, Human
ccccaggugccagu

SEQ ID NO: 2760366 - RNA, 14 nt, Human
cccugcaauaaaau

SEQ ID NO: 2760367 - RNA, 15 nt, Human
cccugcaauaaaaug

SEQ ID NO: 2760368 - RNA, 15 nt, Human
cuaguaucaaaagaa

SEQ ID NO: 2760369 - RNA, 17 nt, Human
cuaguaucaaaagaaag

SEQ ID NO: 2760370 - RNA, 23 nt, Human
cuaguaucaaaagaaagaaaauc

SEQ ID NO: 2760371 - RNA, 22 nt, Human
cuaguauuucuaugaaauauua

SEQ ID NO: 2760372 - RNA, 19 nt, Human
cuaguauuucuaugaaaua

SEQ ID NO: 2760373 - RNA, 20 nt, Human
cuaguauuucuaugaaauau

SEQ ID NO: 2760374 - RNA, 22 nt, Human
cuaggaaauauuuauuuuaaua

SEQ ID NO: 2760375 - RNA, 19 nt, Human
cuauauuguuugcuaagca

SEQ ID NO: 2760376 - RNA, 20 nt, Human
cuauauuuuuuguuaaauga

SEQ ID NO: 2760377 - RNA, 18 nt, Human
cuauauuguuugcuaagc

SEQ ID NO: 2760378 - RNA, 12 nt, Human
cuaguucacucu

SEQ ID NO: 2760379 - RNA, 13 nt, Human
cuaugaaauauua

SEQ ID NO: 2760380 - RNA, 22 nt, Human
cuauauuuuuuguuaaaugauu

SEQ ID NO: 2760381 - RNA, 13 nt, Human
cucacauuuauau

SEQ ID NO: 2760382 - RNA, 17 nt, Human
cucaccccuugccauaa

SEQ ID NO: 2760383 - RNA, 19 nt, Human
cuacuugggaggcugagau

SEQ ID NO: 2760384 - RNA, 15 nt, Human
cuacuugggaggcug

SEQ ID NO: 2760385 - RNA, 18 nt, Human
cuacuugggaggcugaga

SEQ ID NO: 2760386 - RNA, 15 nt, Human
cuaagcaaaauguga

SEQ ID NO: 2760387 - RNA, 18 nt, Human
cuaagcaaaaugugauau

SEQ ID NO: 2760388 - RNA, 14 nt, Human
cuaagcaaaaugug

SEQ ID NO: 2760389 - RNA, 16 nt, Human
cuaaggacuuguuaga

SEQ ID NO: 2760390 - RNA, 17 nt, Human
cuaaggacuuguuagau

SEQ ID NO: 2760391 - RNA, 11 nt, Human
cuaaggacuug

SEQ ID NO: 2760392 - RNA, 22 nt, Human
cuaaggacuucuuuaauuuugg

SEQ ID NO: 2760393 - RNA, 16 nt, Human
cuacacuccagugaga

SEQ ID NO: 2760394 - RNA, 17 nt, Human
cuacacuccagugagac

SEQ ID NO: 2760395 - RNA, 23 nt, Human
cuaaauugacacuuaaaaauggu

SEQ ID NO: 2760396 - RNA, 17 nt, Human
cuaaauccauuuggaaa

SEQ ID NO: 2760397 - RNA, 19 nt, Human
cuaaauccauuuggaaauc

SEQ ID NO: 2760398 - RNA, 20 nt, Human
cuaaauccauuuggaaaucu

SEQ ID NO: 2760399 - RNA, 16 nt, Human
cuaaauccauuuggaa

SEQ ID NO: 2760400 - RNA, 23 nt, Human
cguugaaauuguaauuauaucug

SEQ ID NO: 2760401 - RNA, 18 nt, Human
cguugaaauuguaauuau

SEQ ID NO: 2760402 - RNA, 12 nt, Human
cgugcuaaggac

SEQ ID NO: 2760403 - RNA, 13 nt, Human
cgugcuaaggacu

SEQ ID NO: 2760404 - RNA, 14 nt, Human
cgugcuaaggacuu

SEQ ID NO: 2760405 - RNA, 15 nt, Human
cgugcuaaggacuug

SEQ ID NO: 2760406 - RNA, 16 nt, Human
cgugcuaaggacuugu

SEQ ID NO: 2760407 - RNA, 18 nt, Human
cgcucucuggccuucggc

SEQ ID NO: 2760408 - RNA, 14 nt, Human
cgcucucuggccuu

SEQ ID NO: 2760409 - RNA, 15 nt, Human
cgcucucuggccuuc

SEQ ID NO: 2760410 - RNA, 12 nt, Human
cggccuccaucc

SEQ ID NO: 2760411 - RNA, 21 nt, Human
cggguuuuauuguuuaaaauc

SEQ ID NO: 2760412 - RNA, 22 nt, Human
cggucggguuuuauuguuuaaa

SEQ ID NO: 2760413 - RNA, 13 nt, Human
cggugaauggcuu

SEQ ID NO: 2760414 - RNA, 14 nt, Human
cggugaauggcuuu

SEQ ID NO: 2760415 - RNA, 15 nt, Human
cggugaauggcuuug

SEQ ID NO: 2760416 - RNA, 16 nt, Human
cggugaauggcuuugu

SEQ ID NO: 2760417 - RNA, 17 nt, Human
cggugagcuacaaaugc

SEQ ID NO: 2760418 - RNA, 18 nt, Human
cggugaauggcuuuguau

SEQ ID NO: 2760419 - RNA, 20 nt, Human
cggugaauggcuuuguauag

SEQ ID NO: 2760420 - RNA, 22 nt, Human
cggugaauggcuuuguauagaa

SEQ ID NO: 2760421 - RNA, 20 nt, Human
cucuccugggcagcugccuc

SEQ ID NO: 2760422 - RNA, 15 nt, Human
cucuccugggcagcu

SEQ ID NO: 2760423 - RNA, 16 nt, Human
cucuccugggcagcug

SEQ ID NO: 2760424 - RNA, 18 nt, Human
cucuccugggcagcugcc

SEQ ID NO: 2760425 - RNA, 19 nt, Human
cucuccugggcagcugccu

SEQ ID NO: 2760426 - RNA, 12 nt, Human
cucuccugggca

SEQ ID NO: 2760427 - RNA, 15 nt, Human
cucuaggaaauauuu

SEQ ID NO: 2760428 - RNA, 17 nt, Human
cucuaggaaauauuuau

SEQ ID NO: 2760429 - RNA, 15 nt, Human
cucccuccaccuccc

SEQ ID NO: 2760430 - RNA, 17 nt, Human
cucccuccaccucccug

SEQ ID NO: 2760431 - RNA, 14 nt, Human
cuccauccugaggc

SEQ ID NO: 2760432 - RNA, 16 nt, Human
cuccauccugaggcuc

SEQ ID NO: 2760433 - RNA, 18 nt, Human
cuccauccugaggcucca

SEQ ID NO: 2760434 - RNA, 16 nt, Human
cugagcgacagugaga

SEQ ID NO: 2760435 - RNA, 20 nt, Human
cugagcgacagugagacucu

SEQ ID NO: 2760436 - RNA, 23 nt, Human
cugagaaagacuauucaaacagu

SEQ ID NO: 2760437 - RNA, 22 nt, Human
cugagaaagacuauucaaacag

SEQ ID NO: 2760438 - RNA, 15 nt, Human
cugacuucuaaguaa

SEQ ID NO: 2760439 - RNA, 13 nt, Human
cugacuucuaagu

SEQ ID NO: 2760440 - RNA, 16 nt, Human
cugacuucuaaguaaa

SEQ ID NO: 2760441 - RNA, 17 nt, Human
cugacucuuaagaagac

SEQ ID NO: 2760442 - RNA, 19 nt, Human
cucuggccuucggccucca

SEQ ID NO: 2760443 - RNA, 12 nt, Human
cucuggccuucg

SEQ ID NO: 2760444 - RNA, 12 nt, Human
cucugcuugcca

SEQ ID NO: 2760445 - RNA, 14 nt, Human
cucugcuugccauc

SEQ ID NO: 2760446 - RNA, 17 nt, Human
cucugcuugccaucccu

SEQ ID NO: 2760447 - RNA, 20 nt, Human
cucugcuugccaucccuccc

SEQ ID NO: 2760448 - RNA, 22 nt, Human
cucuucuuuaaagggauggcaa

SEQ ID NO: 2760449 - RNA, 23 nt, Human
cugaagaagcaccaaucaugaau

SEQ ID NO: 2760450 - RNA, 14 nt, Human
cugaagaagauggu

SEQ ID NO: 2760451 - RNA, 12 nt, Human
cugcccucuccu

SEQ ID NO: 2760452 - RNA, 13 nt, Human
cugcccucuccug

SEQ ID NO: 2760453 - RNA, 14 nt, Human
cugcccucuccugg

SEQ ID NO: 2760454 - RNA, 15 nt, Human
cugcccucuccuggg

SEQ ID NO: 2760455 - RNA, 18 nt, Human
cugcuugccaucccuccc

SEQ ID NO: 2760456 - RNA, 19 nt, Human
cugcuugccaucccucccu

SEQ ID NO: 2760457 - RNA, 20 nt, Human
cugcuugccaucccucccuc

SEQ ID NO: 2760458 - RNA, 22 nt, Human
cugcuugccaucccucccucca

SEQ ID NO: 2760459 - RNA, 16 nt, Human
cugcuugccaucccuc

SEQ ID NO: 2760460 - RNA, 15 nt, Human
cugcuugccaucccu

SEQ ID NO: 2760461 - RNA, 12 nt, Human
cugcuuucagau

SEQ ID NO: 2760462 - RNA, 15 nt, Human
cugcuuucagauacu

SEQ ID NO: 2760463 - RNA, 12 nt, Human
cugcacugucaa

SEQ ID NO: 2760464 - RNA, 15 nt, Human
cugccagcaacgcag

SEQ ID NO: 2760465 - RNA, 16 nt, Human
cuggccuucggccucc

SEQ ID NO: 2760466 - RNA, 17 nt, Human
cuggccuucggccucca

SEQ ID NO: 2760467 - RNA, 18 nt, Human
cuggccuucggccuccau

SEQ ID NO: 2760468 - RNA, 21 nt, Human
cuggccuucggccuccauccu

SEQ ID NO: 2760469 - RNA, 15 nt, Human
cuggccuucggccuc

SEQ ID NO: 2760470 - RNA, 18 nt, Human
cugucucuacuaaaaaua

SEQ ID NO: 2760471 - RNA, 13 nt, Human
cuguauuuuaaaa

SEQ ID NO: 2760472 - RNA, 16 nt, Human
cuguauuuuaaaagaa

SEQ ID NO: 2760473 - RNA, 15 nt, Human
cuguaugauucccag

SEQ ID NO: 2760474 - RNA, 15 nt, Human
cuguauagauuagag

SEQ ID NO: 2760475 - RNA, 20 nt, Human
cuguauagauuagaauucug

SEQ ID NO: 2760476 - RNA, 16 nt, Human
cuguauagauuagaga

SEQ ID NO: 2760477 - RNA, 16 nt, Human
gaacucccuuucaaca

SEQ ID NO: 2760478 - RNA, 15 nt, Human
gaacucccuuucaac

SEQ ID NO: 2760479 - RNA, 14 nt, Human
gaaccacaagacug

SEQ ID NO: 2760480 - RNA, 15 nt, Human
gaaccacaagacugc

SEQ ID NO: 2760481 - RNA, 12 nt, Human
gaacuugaaauu

SEQ ID NO: 2760482 - RNA, 13 nt, Human
gaacuugaaauuu

SEQ ID NO: 2760483 - RNA, 15 nt, Human
gaacuugaaauuuga

SEQ ID NO: 2760484 - RNA, 22 nt, Human
gaacuugaaauuugaauuuugu

SEQ ID NO: 2760485 - RNA, 22 nt, Human
gaacuuguaaaggaauuuaaaa

SEQ ID NO: 2760486 - RNA, 20 nt, Human
gaagagcuguucacagccag

SEQ ID NO: 2760487 - RNA, 15 nt, Human
gaagagcuguucaca

SEQ ID NO: 2760488 - RNA, 13 nt, Human
gaagagcuguuca

SEQ ID NO: 2760489 - RNA, 23 nt, Human
gaagagcuguucacagccagacu

SEQ ID NO: 2760490 - RNA, 23 nt, Human
gaaguccaagcauuuagauguau

SEQ ID NO: 2760491 - RNA, 22 nt, Human
gaagucagaucugccuaaggac

SEQ ID NO: 2760492 - RNA, 23 nt, Human
gaagucagaucugccuaaggacu

SEQ ID NO: 2760493 - RNA, 14 nt, Human
gaagucagaucugc

SEQ ID NO: 2760494 - RNA, 15 nt, Human
gaaauauuuauuuua

SEQ ID NO: 2760495 - RNA, 16 nt, Human
gaaauauuuauuuuaa

SEQ ID NO: 2760496 - RNA, 13 nt, Human
gaaauauuuauuu

SEQ ID NO: 2760497 - RNA, 22 nt, Human
gaaauguaagggaaacugccag

SEQ ID NO: 2760498 - RNA, 24 nt, Human
gaacaguuaccucugccucagaaa

SEQ ID NO: 2760499 - RNA, 16 nt, Human
gaaauuugaauuuugu

SEQ ID NO: 2760500 - RNA, 24 nt, Human
gaaauuugaauuuuguguuagaga

SEQ ID NO: 2760501 - RNA, 13 nt, Human
gaaauuugaauuu

SEQ ID NO: 2760502 - RNA, 19 nt, Human
gaaagacuauucaaacagu

SEQ ID NO: 2760503 - RNA, 23 nt, Human
gaaagacuauucaaacagucuca

SEQ ID NO: 2760504 - RNA, 22 nt, Human
gaaagacuauucaaacagucuc

SEQ ID NO: 2760505 - RNA, 13 nt, Human
gaaagcagaacag

SEQ ID NO: 2760506 - RNA, 14 nt, Human
gaaagcagaacagu

SEQ ID NO: 2760507 - RNA, 15 nt, Human
gaaacugccagcaac

SEQ ID NO: 2760508 - RNA, 13 nt, Human
gaaacugccagca

SEQ ID NO: 2760509 - RNA, 16 nt, Human
gaaacggaugauuucu

SEQ ID NO: 2760510 - RNA, 21 nt, Human
gaaagcuugcccuggugccuc

SEQ ID NO: 2760511 - RNA, 17 nt, Human
cuugccaaauauaaaua

SEQ ID NO: 2760512 - RNA, 18 nt, Human
cuuguaaaggaauuuaaa

SEQ ID NO: 2760513 - RNA, 21 nt, Human
cuugcaugguuuagaaagcuu

SEQ ID NO: 2760514 - RNA, 23 nt, Human
cuugcaucaauuuuucuuauuuc

SEQ ID NO: 2760515 - RNA, 19 nt, Human
cuugaacccgggaggcaga

SEQ ID NO: 2760516 - RNA, 20 nt, Human
cuugaacccgggaggcagag

SEQ ID NO: 2760517 - RNA, 14 nt, Human
cuugaacccgggag

SEQ ID NO: 2760518 - RNA, 19 nt, Human
cuugaaauuugaauuuugu

SEQ ID NO: 2760519 - RNA, 20 nt, Human
cuugaaauuugaauuuugug

SEQ ID NO: 2760520 - RNA, 19 nt, Human
cuucuuuccacagaagcuc

SEQ ID NO: 2760521 - RNA, 13 nt, Human
cuucuuuccacag

SEQ ID NO: 2760522 - RNA, 21 nt, Human
cuuuuucauuauuuuauuaug

SEQ ID NO: 2760523 - RNA, 23 nt, Human
gaccugauuucugagcauuuaau

SEQ ID NO: 2760524 - RNA, 22 nt, Human
gacccacaagaaaugaaagcag

SEQ ID NO: 2760525 - RNA, 18 nt, Human
gacuccaaagaaauguaa

SEQ ID NO: 2760526 - RNA, 17 nt, Human
gacaugggacauuugcu

SEQ ID NO: 2760527 - RNA, 22 nt, Human
gacaugggacauuugcucaugg

SEQ ID NO: 2760528 - RNA, 13 nt, Human
gaccaaaaaccag

SEQ ID NO: 2760529 - RNA, 19 nt, Human
gaccaaaaaccaguauugu

SEQ ID NO: 2760530 - RNA, 20 nt, Human
gaccaaaaaccaguauugua

SEQ ID NO: 2760531 - RNA, 16 nt, Human
gacauagucuggcugu

SEQ ID NO: 2760532 - RNA, 18 nt, Human
gagcugcccucuccuggg

SEQ ID NO: 2760533 - RNA, 19 nt, Human
gagcugcccucuccugggc

SEQ ID NO: 2760534 - RNA, 21 nt, Human
gagcugcccucuccugggcag

SEQ ID NO: 2760535 - RNA, 23 nt, Human
gagcugcccucuccugggcagcu

SEQ ID NO: 2760536 - RNA, 18 nt, Human
gaggaagccugauuaaag

SEQ ID NO: 2760537 - RNA, 19 nt, Human
gaggaagccugauuaaaga

SEQ ID NO: 2760538 - RNA, 16 nt, Human
gagcucgugggacagu

SEQ ID NO: 2760539 - RNA, 17 nt, Human
gagcugcccucuccugg

SEQ ID NO: 2760540 - RNA, 19 nt, Human
gagagacacacugaagaag

SEQ ID NO: 2760541 - RNA, 15 nt, Human
gagagugaacaaauu

SEQ ID NO: 2760542 - RNA, 19 nt, Human
gagagugaacaaauuuaca

SEQ ID NO: 2760543 - RNA, 17 nt, Human
gagauacagaauuuuau

SEQ ID NO: 2760544 - RNA, 15 nt, Human
gagacagcucugcau

SEQ ID NO: 2760545 - RNA, 18 nt, Human
gagacagcucugcauacu

SEQ ID NO: 2760546 - RNA, 13 nt, Human
gagacagcucugc

SEQ ID NO: 2760547 - RNA, 18 nt, Human
gagacacacugaagaagc

SEQ ID NO: 2760548 - RNA, 13 nt, Human
gagaagagcuguu

SEQ ID NO: 2760549 - RNA, 22 nt, Human
gagaagagcuguucacagccag

SEQ ID NO: 2760550 - RNA, 15 nt, Human
gagaagagcuguuca

SEQ ID NO: 2760551 - RNA, 13 nt, Human
gagaagaacugaa

SEQ ID NO: 2760552 - RNA, 14 nt, Human
gagaagaacugaaa

SEQ ID NO: 2760553 - RNA, 16 nt, Human
gagaagaacugaaauc

SEQ ID NO: 2760554 - RNA, 18 nt, Human
gagaaagacuauucaaac

SEQ ID NO: 2760555 - RNA, 17 nt, Human
gagaaagacuauucaaa

SEQ ID NO: 2760556 - RNA, 15 nt, Human
gagaaagacuauuca

SEQ ID NO: 2760557 - RNA, 13 nt, Human
gagaaagacuauu

SEQ ID NO: 2760558 - RNA, 12 nt, Human
gacuuguuagau

SEQ ID NO: 2760559 - RNA, 13 nt, Human
gauccuggaaauc

SEQ ID NO: 2760560 - RNA, 14 nt, Human
gaugaaaauauuug

SEQ ID NO: 2760561 - RNA, 21 nt, Human
gauggcuaguaucaaaagaaa

SEQ ID NO: 2760562 - RNA, 23 nt, Human
gauagauaggucagugcaaauac

SEQ ID NO: 2760563 - RNA, 17 nt, Human
gauaggucagugcaaau

SEQ ID NO: 2760564 - RNA, 22 nt, Human
gauaaauaguuuaugauuccac

SEQ ID NO: 2760565 - RNA, 14 nt, Human
gcaagggugauggg

SEQ ID NO: 2760566 - RNA, 10 nt, Human
gcaagccaga

SEQ ID NO: 2760567 - RNA, 23 nt, Human
gcaaagcacugacuucuaaguaa

SEQ ID NO: 2760568 - RNA, 15 nt, Human
gauuuuccugaaaac

SEQ ID NO: 2760569 - RNA, 13 nt, Human
gauuuuauuaugu

SEQ ID NO: 2760570 - RNA, 15 nt, Human
gauuuuauuauguaa

SEQ ID NO: 2760571 - RNA, 18 nt, Human
gauuuuauuauguaaauc

SEQ ID NO: 2760572 - RNA, 19 nt, Human
gauuuuauuauguaaaucc

SEQ ID NO: 2760573 - RNA, 20 nt, Human
gauuuuauuauguaaauccc

SEQ ID NO: 2760574 - RNA, 23 nt, Human
gauuuuauuauguaaaucccauu

SEQ ID NO: 2760575 - RNA, 16 nt, Human
gcaguucagagcugcc

SEQ ID NO: 2760576 - RNA, 15 nt, Human
gcaguucugaagaag

SEQ ID NO: 2760577 - RNA, 17 nt, Human
gcaguucagagcugccc

SEQ ID NO: 2760578 - RNA, 18 nt, Human
gcaguucagagcugcccu

SEQ ID NO: 2760579 - RNA, 14 nt, Human
gcaguucugaagaa

SEQ ID NO: 2760580 - RNA, 17 nt, Human
gcaguucugaagaagau

SEQ ID NO: 2760581 - RNA, 13 nt, Human
gcauagaaguaaa

SEQ ID NO: 2760582 - RNA, 17 nt, Human
gcauagguuuaauaauu

SEQ ID NO: 2760583 - RNA, 20 nt, Human
gcauauauuuuuauauuuac

SEQ ID NO: 2760584 - RNA, 13 nt, Human
gcauuauauuuau

SEQ ID NO: 2760585 - RNA, 12 nt, Human
gcaucagcugcu

SEQ ID NO: 2760586 - RNA, 20 nt, Human
gcagccccgugggguuccuc

SEQ ID NO: 2760587 - RNA, 18 nt, Human
gcagauaaacaguaguga

SEQ ID NO: 2760588 - RNA, 18 nt, Human
gcagauuauucacugauu

SEQ ID NO: 2760589 - RNA, 16 nt, Human
gcagauuauucacuga

SEQ ID NO: 2760590 - RNA, 18 nt, Human
gcacggugaauggcuuug

SEQ ID NO: 2760591 - RNA, 12 nt, Human
gcgacagugaga

SEQ ID NO: 2760592 - RNA, 19 nt, Human
gcuagaacucccuuucaac

SEQ ID NO: 2760593 - RNA, 13 nt, Human
gcuauaggugcua

SEQ ID NO: 2760594 - RNA, 15 nt, Human
gcuaaacuuuucuga

SEQ ID NO: 2760595 - RNA, 17 nt, Human
gcuaaacuuuucugaua

SEQ ID NO: 2760596 - RNA, 13 nt, Human
gcuaaacuuuucu

SEQ ID NO: 2760597 - RNA, 23 nt, Human
gccuuuuucauuauuuuauuaug

SEQ ID NO: 2760598 - RNA, 12 nt, Human
gccuaaauccau

SEQ ID NO: 2760599 - RNA, 13 nt, Human
gccuaaauccauu

SEQ ID NO: 2760600 - RNA, 19 nt, Human
gccuaaauccauuuggaaa

SEQ ID NO: 2760601 - RNA, 21 nt, Human
gccuaaauccauuuggaaauc

SEQ ID NO: 2760602 - RNA, 22 nt, Human
gccuaaauccauuuggaaaucu

SEQ ID NO: 2760603 - RNA, 23 nt, Human
gccuaaauccauuuggaaaucuu

SEQ ID NO: 2760604 - RNA, 20 nt, Human
gccgggcgugguggugagug

SEQ ID NO: 2760605 - RNA, 14 nt, Human
gcccugcuuucaga

SEQ ID NO: 2760606 - RNA, 16 nt, Human
gcccugcuuucagaua

SEQ ID NO: 2760607 - RNA, 17 nt, Human
gccuccccuccucugcu

SEQ ID NO: 2760608 - RNA, 19 nt, Human
gccuccccuccucugcuug

SEQ ID NO: 2760609 - RNA, 16 nt, Human
gccuccccuccucugc

SEQ ID NO: 2760610 - RNA, 23 nt, Human
gccuccccuccucugcuugccau

SEQ ID NO: 2760611 - RNA, 20 nt, Human
gccuccccuccucugcuugc

SEQ ID NO: 2760612 - RNA, 22 nt, Human
gccuccccuccucugcuugcca

SEQ ID NO: 2760613 - RNA, 19 nt, Human
gccaugggcacugugggua

SEQ ID NO: 2760614 - RNA, 18 nt, Human
gccaucccucccuccacc

SEQ ID NO: 2760615 - RNA, 23 nt, Human
gccaucccucccuccaccucccu

SEQ ID NO: 2760616 - RNA, 20 nt, Human
uuuuaauaauguuucaaaca

SEQ ID NO: 2760617 - RNA, 21 nt, Human
uuuuaaaagaaugauuaugaa

SEQ ID NO: 2760618 - RNA, 15 nt, Human
uuuuaaaagaaugau

SEQ ID NO: 2760619 - RNA, 13 nt, Human
uuuguauaaaaua

SEQ ID NO: 2760620 - RNA, 14 nt, Human
uuuguauaaaauaa

SEQ ID NO: 2760621 - RNA, 16 nt, Human
uuuguauaaaauaauu

SEQ ID NO: 2760622 - RNA, 16 nt, Human
uuuggauaauaaggaa

SEQ ID NO: 2760623 - RNA, 22 nt, Human
uuuggaauuuuccuccuuucuc

SEQ ID NO: 2760624 - RNA, 13 nt, Human
uuucugagaaaga

SEQ ID NO: 2760625 - RNA, 22 nt, Human
uuuccucaaaacuucagacaua

SEQ ID NO: 2760626 - RNA, 18 nt, Human
uuugaaucaucaagucuu

SEQ ID NO: 2760627 - RNA, 17 nt, Human
uuucuuauuucauuucu

SEQ ID NO: 2760628 - RNA, 19 nt, Human
uuuuucucuaggaaauauu

SEQ ID NO: 2760629 - RNA, 14 nt, Human
uuuuccugaaaacc

SEQ ID NO: 2760630 - RNA, 13 nt, Human
uuuuccugaaaac

SEQ ID NO: 2760631 - RNA, 18 nt, Human
uuuuggucuggagggaag

SEQ ID NO: 2760632 - RNA, 21 nt, Human
uuuuggcauaacauaaaucug

SEQ ID NO: 2760633 - RNA, 18 nt, Human
uuuuuaaaaaagaaacau

SEQ ID NO: 2760634 - RNA, 22 nt, Human
gucagcuccccucggagaagag

SEQ ID NO: 2760635 - RNA, 21 nt, Human
gucagcuccccucggagaaga

SEQ ID NO: 2760636 - RNA, 23 nt, Human
gucagcuccccucggagaagagc

SEQ ID NO: 2760637 - RNA, 23 nt, Human
gucaauaaaauccauacauuugu

SEQ ID NO: 2760638 - RNA, 22 nt, Human
gucaauaaaauccauacauuug

SEQ ID NO: 2760639 - RNA, 15 nt, Human
gucaaugcagccccc

SEQ ID NO: 2760640 - RNA, 18 nt, Human
guauuuuaaaagaaugau

SEQ ID NO: 2760641 - RNA, 13 nt, Human
guauuuuaaucac

SEQ ID NO: 2760642 - RNA, 20 nt, Human
guauuuuaaaagaaugauua

SEQ ID NO: 2760643 - RNA, 16 nt, Human
guauuaagcauauauu

SEQ ID NO: 2760644 - RNA, 17 nt, Human
guauuaagcauauauuu

SEQ ID NO: 2760645 - RNA, 15 nt, Human
guauuaagcauauau

SEQ ID NO: 2760646 - RNA, 18 nt, Human
guauuaagcauauauuuu

SEQ ID NO: 2760647 - RNA, 21 nt, Human
guauuaagcauauauuuuuau

SEQ ID NO: 2760648 - RNA, 19 nt, Human
gucagcuccccucggagaa

SEQ ID NO: 2760649 - RNA, 19 nt, Human
gucagaucugccuaaggac

SEQ ID NO: 2760650 - RNA, 20 nt, Human
gucagaucugccuaaggacu

SEQ ID NO: 2760651 - RNA, 21 nt, Human
gucagaucugccuaaggacuu

SEQ ID NO: 2760652 - RNA, 16 nt, Human
gucagaucugccuaag

SEQ ID NO: 2760653 - RNA, 18 nt, Human
gucagaucugccuaagga

SEQ ID NO: 2760654 - RNA, 14 nt, Human
guaguguuggagaa

SEQ ID NO: 2760655 - RNA, 15 nt, Human
guaguguuggagaag

SEQ ID NO: 2760656 - RNA, 13 nt, Human
guauaauuaacau

SEQ ID NO: 2760657 - RNA, 14 nt, Human
guauaauuaacaug

SEQ ID NO: 2760658 - RNA, 10 nt, Human
guauaauuaa

SEQ ID NO: 2760659 - RNA, 15 nt, Human
guauaauuaacaugu

SEQ ID NO: 2760660 - RNA, 17 nt, Human
guauaauuaacauguua

SEQ ID NO: 2760661 - RNA, 19 nt, Human
guauaauuaacauguuaaa

SEQ ID NO: 2760662 - RNA, 22 nt, Human
guauaauuaacauguuaaacca

SEQ ID NO: 2760663 - RNA, 23 nt, Human
guauaauuaacauguuaaaccau

SEQ ID NO: 2760664 - RNA, 18 nt, Human
gcuauaggugcuacaaaa

SEQ ID NO: 2760665 - RNA, 17 nt, Human
guauguuagugcaaauu

SEQ ID NO: 2760666 - RNA, 21 nt, Human
guaugugugaagugagugagu

SEQ ID NO: 2760667 - RNA, 19 nt, Human
guauagaaccucuuugucu

SEQ ID NO: 2760668 - RNA, 14 nt, Human
guauagauuagaau

SEQ ID NO: 2760669 - RNA, 15 nt, Human
gucugugagaugcua

SEQ ID NO: 2760670 - RNA, 16 nt, Human
gucugugagaugcuag

SEQ ID NO: 2760671 - RNA, 17 nt, Human
gucugugagaugcuaga

SEQ ID NO: 2760672 - RNA, 21 nt, Human
gucugugagaugcuagaacuc

SEQ ID NO: 2760673 - RNA, 22 nt, Human
gucugugagaugcuagaacucc

SEQ ID NO: 2760674 - RNA, 23 nt, Human
gucugugagaugcuagaacuccc

SEQ ID NO: 2760675 - RNA, 15 nt, Human
gucuugccuuuuuca

SEQ ID NO: 2760676 - RNA, 16 nt, Human
gucuugccuuuuucau

SEQ ID NO: 2760677 - RNA, 17 nt, Human
gucuugccuuuuucauu

SEQ ID NO: 2760678 - RNA, 18 nt, Human
gucuugccuuuuucauua

SEQ ID NO: 2760679 - RNA, 20 nt, Human
gucuugccuuuuucauuauu

SEQ ID NO: 2760680 - RNA, 20 nt, Human
gucuugucucagauuuuauu

SEQ ID NO: 2760681 - RNA, 22 nt, Human
gucuugucucagauuuuauuau

SEQ ID NO: 2760682 - RNA, 15 nt, Human
gucuugucucagauu

SEQ ID NO: 2760683 - RNA, 18 nt, Human
gucgucaaagcugaaaug

SEQ ID NO: 2760684 - RNA, 23 nt, Human
gucggguuuuauuguuuaaaauc

SEQ ID NO: 2760685 - RNA, 13 nt, Human
gucugacuguuuc

SEQ ID NO: 2760686 - RNA, 15 nt, Human
gucucagauuuuauu

SEQ ID NO: 2760687 - RNA, 16 nt, Human
gucucagauuuuauua

SEQ ID NO: 2760688 - RNA, 14 nt, Human
gucucagauuuuau

SEQ ID NO: 2760689 - RNA, 17 nt, Human
gucucagauuuuauuau

SEQ ID NO: 2760690 - RNA, 21 nt, Human
gucucagauuuuauuauguaa

SEQ ID NO: 2760691 - RNA, 17 nt, Human
gugcgcuaaacuuuucu

SEQ ID NO: 2760692 - RNA, 21 nt, Human
gugcgcuaaacuuuucugaua

SEQ ID NO: 2760693 - RNA, 12 nt, Human
gugcuaaggacu

SEQ ID NO: 2760694 - RNA, 13 nt, Human
gugcuaaggacuu

SEQ ID NO: 2760695 - RNA, 14 nt, Human
gugcuaaggacuug

SEQ ID NO: 2760696 - RNA, 20 nt, Human
gugcuaaggacuuguuagau

SEQ ID NO: 2760697 - RNA, 21 nt, Human
gugaacaaauuuacagagaca

SEQ ID NO: 2760698 - RNA, 13 nt, Human
gugaacacaucag

SEQ ID NO: 2760699 - RNA, 16 nt, Human
gugacaagcucacaga

SEQ ID NO: 2760700 - RNA, 14 nt, Human
guucugaagaagau

SEQ ID NO: 2760701 - RNA, 15 nt, Human
guucugaagaagaug

SEQ ID NO: 2760702 - RNA, 12 nt, Human
guucugaagaag

SEQ ID NO: 2760703 - RNA, 13 nt, Human
guucugaagaaga

SEQ ID NO: 2760704 - RNA, 23 nt, Human
guugaaaagacuccaaagaaaug

SEQ ID NO: 2760705 - RNA, 22 nt, Human
guugaaaagacuccaaagaaau

SEQ ID NO: 2760706 - RNA, 17 nt, Human
guugaaaagacuccaaa

SEQ ID NO: 2760707 - RNA, 21 nt, Human
guugauggugguauguuuuca

SEQ ID NO: 2760708 - RNA, 20 nt, Human
guugauggugguauguuuuc

SEQ ID NO: 2760709 - RNA, 21 nt, Human
guugaauuuauuggcuuuucu

SEQ ID NO: 2760710 - RNA, 22 nt, Human
guugaauuuauuggcuuuucug

SEQ ID NO: 2760711 - RNA, 14 nt, Human
guugaauuuauugg

SEQ ID NO: 2760712 - RNA, 16 nt, Human
guugaaauuguaauua

SEQ ID NO: 2760713 - RNA, 20 nt, Human
guugaaauuguaauuauauc

SEQ ID NO: 2760714 - RNA, 15 nt, Human
guugaaauuguaauu

SEQ ID NO: 2760715 - RNA, 21 nt, Human
guugaaacggaugauuucuau

SEQ ID NO: 2760716 - RNA, 22 nt, Human
guugaaacggaugauuucuaug

SEQ ID NO: 2760717 - RNA, 23 nt, Human
guuaccucugccucagaaaacaa

SEQ ID NO: 2760718 - RNA, 19 nt, Human
guuaucugaagucagaucu

SEQ ID NO: 2760719 - RNA, 13 nt, Human
guucagagcugcc

SEQ ID NO: 2760720 - RNA, 14 nt, Human
guucagagcugccc

SEQ ID NO: 2760721 - RNA, 23 nt, Human
guucagagcugcccucuccuggg

SEQ ID NO: 2760722 - RNA, 20 nt, Human
guucagagcugcccucuccu

SEQ ID NO: 2760723 - RNA, 22 nt, Human
guucagagcugcccucuccugg

SEQ ID NO: 2760724 - RNA, 15 nt, Human
guucagagcugcccu

SEQ ID NO: 2760725 - RNA, 16 nt, Human
guucagagcugcccuc

SEQ ID NO: 2760726 - RNA, 17 nt, Human
guucagagcugcccucu

SEQ ID NO: 2760727 - RNA, 19 nt, Human
guucagagcugcccucucc

SEQ ID NO: 2760728 - RNA, 19 nt, Human
guucacucuccauuuaaua

SEQ ID NO: 2760729 - RNA, 16 nt, Human
guucaucaaugaauga

SEQ ID NO: 2760730 - RNA, 22 nt, Human
guucauggaacgcguugaaauu

SEQ ID NO: 2760731 - RNA, 23 nt, Human
guucauggaacgcguugaaauug

SEQ ID NO: 2760732 - RNA, 16 nt, Human
guuaaaagaugaaaau

SEQ ID NO: 2760733 - RNA, 14 nt, Human
guuaaaagaugaaa

SEQ ID NO: 2760734 - RNA, 20 nt, Human
guuaaaagaugaaaauauuu

SEQ ID NO: 2760735 - RNA, 18 nt, Human
guuaaaccaugggauaaa

SEQ ID NO: 2760736 - RNA, 21 nt, Human
guuaaaccaugggauaaaugc

SEQ ID NO: 2760737 - RNA, 13 nt, Human
guuacagaagccc

SEQ ID NO: 2760738 - RNA, 21 nt, Human
guguaaguagauaggccaugg

SEQ ID NO: 2760739 - RNA, 16 nt, Human
guggugacuuuggaua

SEQ ID NO: 2760740 - RNA, 13 nt, Human
guggugacuuugg

SEQ ID NO: 2760741 - RNA, 15 nt, Human
guggugacuuuggau

SEQ ID NO: 2760742 - RNA, 20 nt, Human
gugcuacaaaaacacagcaa

SEQ ID NO: 2760743 - RNA, 15 nt, Human
gugcuacaaaaacac

SEQ ID NO: 2760744 - RNA, 20 nt, Human
guuuagcuggaaaaguaugu

SEQ ID NO: 2760745 - RNA, 21 nt, Human
guuuagcuggaaaaguauguu

SEQ ID NO: 2760746 - RNA, 20 nt, Human
guuuauauaagcuuguauuc

SEQ ID NO: 2760747 - RNA, 17 nt, Human
guuuagaaagcuugccc

SEQ ID NO: 2760748 - RNA, 13 nt, Human
uaaaaucauuucu

SEQ ID NO: 2760749 - RNA, 10 nt, Human
uaaaaucauu

SEQ ID NO: 2760750 - RNA, 15 nt, Human
uaaaauccauacauu

SEQ ID NO: 2760751 - RNA, 17 nt, Human
uaaaauccauacauuug

SEQ ID NO: 2760752 - RNA, 22 nt, Human
uaaaaucauuucugcaucagcu

SEQ ID NO: 2760753 - RNA, 18 nt, Human
uaaaaucauuucugcauc

SEQ ID NO: 2760754 - RNA, 22 nt, Human
uaaaacaagcacuaaacaaaga

SEQ ID NO: 2760755 - RNA, 19 nt, Human
uaaaaaugguuuaaauggu

SEQ ID NO: 2760756 - RNA, 15 nt, Human
uaaaaaugguuuaaa

SEQ ID NO: 2760757 - RNA, 18 nt, Human
uaaaaaugguuuaaaugg

SEQ ID NO: 2760758 - RNA, 14 nt, Human
uaaaguguuugaaa

SEQ ID NO: 2760759 - RNA, 15 nt, Human
uaaagccauguuuau

SEQ ID NO: 2760760 - RNA, 20 nt, Human
uaaagccauguuuauuacag

SEQ ID NO: 2760761 - RNA, 11 nt, Human
uaaagccaugu

SEQ ID NO: 2760762 - RNA, 13 nt, Human
uaaagccauguuu

SEQ ID NO: 2760763 - RNA, 23 nt, Human
uaaugauaacuggaaacuucagc

SEQ ID NO: 2760764 - RNA, 17 nt, Human
uaaugauaacuggaaac

SEQ ID NO: 2760765 - RNA, 22 nt, Human
uaaugauaacuggaaacuucag

SEQ ID NO: 2760766 - RNA, 22 nt, Human
uaauguuucaaacauauauaac

SEQ ID NO: 2760767 - RNA, 20 nt, Human
uaauuaacauguuaaaccau

SEQ ID NO: 2760768 - RNA, 21 nt, Human
uaauuaacauguuaaaccaug

SEQ ID NO: 2760769 - RNA, 15 nt, Human
uaauauuaaagccau

SEQ ID NO: 2760770 - RNA, 16 nt, Human
uaauauuaaagccaug

SEQ ID NO: 2760771 - RNA, 17 nt, Human
uaauauuaaagccaugu

SEQ ID NO: 2760772 - RNA, 20 nt, Human
uaauauuaaagccauguuua

SEQ ID NO: 2760773 - RNA, 21 nt, Human
uaauauuaaagccauguuuau

SEQ ID NO: 2760774 - RNA, 13 nt, Human
uaagugaaauaag

SEQ ID NO: 2760775 - RNA, 16 nt, Human
uaauaaggaaaaguuu

SEQ ID NO: 2760776 - RNA, 16 nt, Human
uaaaugugccuucauu

SEQ ID NO: 2760777 - RNA, 20 nt, Human
uaaauugacacuuaaaaaug

SEQ ID NO: 2760778 - RNA, 20 nt, Human
uaaauggcuuccuggcaaua

SEQ ID NO: 2760779 - RNA, 16 nt, Human
uaaaugccaucaauaa

SEQ ID NO: 2760780 - RNA, 23 nt, Human
uaaaugccaucaauaaaaaauua

SEQ ID NO: 2760781 - RNA, 15 nt, Human
uaacuggaaacuuca

SEQ ID NO: 2760782 - RNA, 13 nt, Human
uaagagagaauga

SEQ ID NO: 2760783 - RNA, 14 nt, Human
uaagagagaaugag

SEQ ID NO: 2760784 - RNA, 21 nt, Human
uaagaaaauaucacuugucaa

SEQ ID NO: 2760785 - RNA, 17 nt, Human
uaaccaggggccaugaa

SEQ ID NO: 2760786 - RNA, 14 nt, Human
uauaugcuucuguu

SEQ ID NO: 2760787 - RNA, 16 nt, Human
uauaugcuucuguuuu

SEQ ID NO: 2760788 - RNA, 20 nt, Human
uauauuugaaauauugacuu

SEQ ID NO: 2760789 - RNA, 21 nt, Human
uauauuuuuuguuaaaugauu

SEQ ID NO: 2760790 - RNA, 16 nt, Human
uauauuuucauucucc

SEQ ID NO: 2760791 - RNA, 14 nt, Human
uaucaaaagaaaga

SEQ ID NO: 2760792 - RNA, 17 nt, Human
uauauaacaaugcugua

SEQ ID NO: 2760793 - RNA, 19 nt, Human
uauauaacaaugcuguauu

SEQ ID NO: 2760794 - RNA, 23 nt, Human
uauaucugaggaauucuguauag

SEQ ID NO: 2760795 - RNA, 21 nt, Human
uauagaaccucuuugucuaca

SEQ ID NO: 2760796 - RNA, 20 nt, Human
uauagaaccucuuugucuac

SEQ ID NO: 2760797 - RNA, 17 nt, Human
uaguauuguccaggucu

SEQ ID NO: 2760798 - RNA, 18 nt, Human
uaggugcuacaaaaacac

SEQ ID NO: 2760799 - RNA, 23 nt, Human
uaggugcuacaaaaacacagcaa

SEQ ID NO: 2760800 - RNA, 22 nt, Human
uaggugcuacaaaaacacagca

SEQ ID NO: 2760801 - RNA, 20 nt, Human
uaggugcuacaaaaacacag

SEQ ID NO: 2760802 - RNA, 14 nt, Human
uagauaggccaugg

SEQ ID NO: 2760803 - RNA, 16 nt, Human
uagauuagaauucugu

SEQ ID NO: 2760804 - RNA, 17 nt, Human
uagauuagaauucugua

SEQ ID NO: 2760805 - RNA, 19 nt, Human
uagauuagaauucuguaua

SEQ ID NO: 2760806 - RNA, 20 nt, Human
uagauuagaauucuguauag

SEQ ID NO: 2760807 - RNA, 14 nt, Human
uagauuagaauucu

SEQ ID NO: 2760808 - RNA, 15 nt, Human
uagauuagaauucug

SEQ ID NO: 2760809 - RNA, 20 nt, Human
uagauuagagaguguugaaa

SEQ ID NO: 2760810 - RNA, 15 nt, Human
uagaauuaacacaug

SEQ ID NO: 2760811 - RNA, 16 nt, Human
uagaauuaacacauga

SEQ ID NO: 2760812 - RNA, 18 nt, Human
uagaauuaacacaugauc

SEQ ID NO: 2760813 - RNA, 23 nt, Human
uagaauaccacaggaaccacaag

SEQ ID NO: 2760814 - RNA, 14 nt, Human
uagaauucuguaua

SEQ ID NO: 2760815 - RNA, 15 nt, Human
uagaauucuguauag

SEQ ID NO: 2760816 - RNA, 16 nt, Human
uagaauucuguauaga

SEQ ID NO: 2760817 - RNA, 21 nt, Human
uagaauucuguauagauuaga

SEQ ID NO: 2760818 - RNA, 11 nt, Human
uagaauucugu

SEQ ID NO: 2760819 - RNA, 13 nt, Human
uagaauucuguau

SEQ ID NO: 2760820 - RNA, 21 nt, Human
uagacuggugacugauucuuc

SEQ ID NO: 2760821 - RNA, 23 nt, Human
uagacuggugacugauucuucag

SEQ ID NO: 2760822 - RNA, 20 nt, Human
uagacuggugacugauucuu

SEQ ID NO: 2760823 - RNA, 18 nt, Human
uagacuggugacugauuc

SEQ ID NO: 2760824 - RNA, 13 nt, Human
uaauuuugugaag

SEQ ID NO: 2760825 - RNA, 16 nt, Human
uaauuuuuauauuuga

SEQ ID NO: 2760826 - RNA, 17 nt, Human
uaauuuuuauauuugaa

SEQ ID NO: 2760827 - RNA, 18 nt, Human
uaauuuugugaagcaaaa

SEQ ID NO: 2760828 - RNA, 12 nt, Human
uaauuuuuauau

SEQ ID NO: 2760829 - RNA, 15 nt, Human
uacaaaguauuaagc

SEQ ID NO: 2760830 - RNA, 16 nt, Human
uacaaaguauuaagca

SEQ ID NO: 2760831 - RNA, 18 nt, Human
uacaaaguauuaagcaua

SEQ ID NO: 2760832 - RNA, 19 nt, Human
uacaaaguauuaagcauau

SEQ ID NO: 2760833 - RNA, 13 nt, Human
uacaaaguauuaa

SEQ ID NO: 2760834 - RNA, 14 nt, Human
uacaaaguauuaag

SEQ ID NO: 2760835 - RNA, 12 nt, Human
uacaaaguauua

SEQ ID NO: 2760836 - RNA, 16 nt, Human
uacacacucaaaucaa

SEQ ID NO: 2760837 - RNA, 17 nt, Human
uacacacucaaaucaag

SEQ ID NO: 2760838 - RNA, 14 nt, Human
uacacuccagugag

SEQ ID NO: 2760839 - RNA, 17 nt, Human
uacaauuuuguuucugu

SEQ ID NO: 2760840 - RNA, 15 nt, Human
uacaauuuuguuucu

SEQ ID NO: 2760841 - RNA, 16 nt, Human
uacaauuuuguuucug

SEQ ID NO: 2760842 - RNA, 12 nt, Human
uacaauuuuguu

SEQ ID NO: 2760843 - RNA, 23 nt, Human
uacaguucggugagcuacaaaug

SEQ ID NO: 2760844 - RNA, 23 nt, Human
uacugucagcuccccucggagaa

SEQ ID NO: 2760845 - RNA, 23 nt, Human
uaccuuuguucccaaauuucaua

SEQ ID NO: 2760846 - RNA, 23 nt, Human
uacuaaaauggacuguggugacu

SEQ ID NO: 2760847 - RNA, 17 nt, Human
uacuaaaauggacugug

SEQ ID NO: 2760848 - RNA, 15 nt, Human
uacuaaaauggacug

SEQ ID NO: 2760849 - RNA, 22 nt, Human
uaccuaacgaaguauccuucag

SEQ ID NO: 2760850 - RNA, 22 nt, Human
uaccaaaaaucucaauauuuca

SEQ ID NO: 2760851 - RNA, 16 nt, Human
uaccuaucaucuuaag

SEQ ID NO: 2760852 - RNA, 13 nt, Human
ugaauuacauuug

SEQ ID NO: 2760853 - RNA, 14 nt, Human
ugaauuaaguuuuu

SEQ ID NO: 2760854 - RNA, 16 nt, Human
ugaccacugcagaaga

SEQ ID NO: 2760855 - RNA, 17 nt, Human
ugaccacugcagaagac

SEQ ID NO: 2760856 - RNA, 18 nt, Human
ugaccacugcagaagaca

SEQ ID NO: 2760857 - RNA, 15 nt, Human
ugaaugaauggcuaa

SEQ ID NO: 2760858 - RNA, 13 nt, Human
ugaacuugaaauu

SEQ ID NO: 2760859 - RNA, 14 nt, Human
ugaacuugaaauuu

SEQ ID NO: 2760860 - RNA, 18 nt, Human
ugaacuugaaauuugaau

SEQ ID NO: 2760861 - RNA, 14 nt, Human
ugacucuuaagaag

SEQ ID NO: 2760862 - RNA, 15 nt, Human
ugacucuuaagaaga

SEQ ID NO: 2760863 - RNA, 16 nt, Human
ugacucuuaagaagac

SEQ ID NO: 2760864 - RNA, 13 nt, Human
ugacucuuaagaa

SEQ ID NO: 2760865 - RNA, 12 nt, Human
ugacuuuggaua

SEQ ID NO: 2760866 - RNA, 13 nt, Human
ugacuuuggauaa

SEQ ID NO: 2760867 - RNA, 14 nt, Human
ugacuuuggauaau

SEQ ID NO: 2760868 - RNA, 15 nt, Human
ugacuuuggauaaua

SEQ ID NO: 2760869 - RNA, 16 nt, Human
ugacuuuggauaauaa

SEQ ID NO: 2760870 - RNA, 20 nt, Human
ugacuuuggauaauaaggaa

SEQ ID NO: 2760871 - RNA, 22 nt, Human
ugacuuuggauaauaaggaaaa

SEQ ID NO: 2760872 - RNA, 15 nt, Human
ugagaaagacuauuc

SEQ ID NO: 2760873 - RNA, 20 nt, Human
ugagaaagacuauucaaaca

SEQ ID NO: 2760874 - RNA, 20 nt, Human
ugagcaggauuuuaaucuuu

SEQ ID NO: 2760875 - RNA, 15 nt, Human
ugagcaggauuuuaa

SEQ ID NO: 2760876 - RNA, 14 nt, Human
ucugucucagucca

SEQ ID NO: 2760877 - RNA, 23 nt, Human
ucugccuaaggacuucuuuaauu

SEQ ID NO: 2760878 - RNA, 20 nt, Human
ucugccuaaggacuucuuua

SEQ ID NO: 2760879 - RNA, 21 nt, Human
ucugccuaaggacuucuuuaa

SEQ ID NO: 2760880 - RNA, 17 nt, Human
ucuuuccacagaagcuc

SEQ ID NO: 2760881 - RNA, 14 nt, Human
ucuugucucagauu

SEQ ID NO: 2760882 - RNA, 15 nt, Human
ucuugucucagauuu

SEQ ID NO: 2760883 - RNA, 12 nt, Human
ucuugucucaga

SEQ ID NO: 2760884 - RNA, 14 nt, Human
ucuuauaauuuaaa

SEQ ID NO: 2760885 - RNA, 13 nt, Human
ucuuauaauuuaa

SEQ ID NO: 2760886 - RNA, 22 nt, Human
ucuuaggguuaugauuaaguaa

SEQ ID NO: 2760887 - RNA, 19 nt, Human
ucuugccaaauauaaauaa

SEQ ID NO: 2760888 - RNA, 16 nt, Human
ucuucuuggucucagu

SEQ ID NO: 2760889 - RNA, 16 nt, Human
ucagcugcugaaacaa

SEQ ID NO: 2760890 - RNA, 21 nt, Human
ucagcuccccucggagaagag

SEQ ID NO: 2760891 - RNA, 22 nt, Human
ucagcuccccucggagaagagc

SEQ ID NO: 2760892 - RNA, 16 nt, Human
ucagauacuggauugu

SEQ ID NO: 2760893 - RNA, 19 nt, Human
ucagauacuggauuguacu

SEQ ID NO: 2760894 - RNA, 20 nt, Human
ucagauacuggauuguacuu

SEQ ID NO: 2760895 - RNA, 14 nt, Human
ucagauacuggauu

SEQ ID NO: 2760896 - RNA, 15 nt, Human
ucagauacuggauug

SEQ ID NO: 2760897 - RNA, 18 nt, Human
ucaguccaugaagaugua

SEQ ID NO: 2760898 - RNA, 21 nt, Human
ucauggaauuggagcucgugg

SEQ ID NO: 2760899 - RNA, 19 nt, Human
ucauggaauuggagcucgu

SEQ ID NO: 2760900 - RNA, 12 nt, Human
ucuacuaaaaau

SEQ ID NO: 2760901 - RNA, 19 nt, Human
ucuacuaaaaauacaaaaa

SEQ ID NO: 2760902 - RNA, 15 nt, Human
ucuacuaaaaauaca

SEQ ID NO: 2760903 - RNA, 13 nt, Human
ucuauauuuucau

SEQ ID NO: 2760904 - RNA, 14 nt, Human
ucuauauuuucauu

SEQ ID NO: 2760905 - RNA, 15 nt, Human
ucuauauuuucauuc

SEQ ID NO: 2760906 - RNA, 16 nt, Human
ucuauauuuucauucu

SEQ ID NO: 2760907 - RNA, 16 nt, Human
ucucagauuuuauuau

SEQ ID NO: 2760908 - RNA, 17 nt, Human
ucucagauuuuauuaug

SEQ ID NO: 2760909 - RNA, 18 nt, Human
ucucagauuuuauuaugu

SEQ ID NO: 2760910 - RNA, 19 nt, Human
ucucagauuuuauuaugua

SEQ ID NO: 2760911 - RNA, 14 nt, Human
ucucagauuuuauu

SEQ ID NO: 2760912 - RNA, 15 nt, Human
ucucagauuuuauua

SEQ ID NO: 2760913 - RNA, 13 nt, Human
ucucagauuuuau

SEQ ID NO: 2760914 - RNA, 15 nt, Human
ucggccuccauccug

SEQ ID NO: 2760915 - RNA, 16 nt, Human
ucggccuccauccuga

SEQ ID NO: 2760916 - RNA, 17 nt, Human
uccuugcaucaauuuuu

SEQ ID NO: 2760917 - RNA, 15 nt, Human
uccugaggcuccacu

SEQ ID NO: 2760918 - RNA, 16 nt, Human
uccugaggcuccacuu

SEQ ID NO: 2760919 - RNA, 17 nt, Human
uccugaggcuccacuug

SEQ ID NO: 2760920 - RNA, 21 nt, Human
uccugaggcuccacuuggucu

SEQ ID NO: 2760921 - RNA, 14 nt, Human
uccucugcuugcca

SEQ ID NO: 2760922 - RNA, 15 nt, Human
uccucugcuugccau

SEQ ID NO: 2760923 - RNA, 16 nt, Human
uccucugcuugccauc

SEQ ID NO: 2760924 - RNA, 17 nt, Human
uccucugcuugccaucc

SEQ ID NO: 2760925 - RNA, 18 nt, Human
ugccuguaaucacagcua

SEQ ID NO: 2760926 - RNA, 15 nt, Human
ugccuucucaacucc

SEQ ID NO: 2760927 - RNA, 15 nt, Human
ugcuaagcauuccaa

SEQ ID NO: 2760928 - RNA, 19 nt, Human
ugcuaagcauuccaacuau

SEQ ID NO: 2760929 - RNA, 17 nt, Human
ugcugaaacaacaaaua

SEQ ID NO: 2760930 - RNA, 14 nt, Human
ugcacggugaaugg

SEQ ID NO: 2760931 - RNA, 18 nt, Human
ugcacggugaauggcuuu

SEQ ID NO: 2760932 - RNA, 19 nt, Human
ugcagugagccgagauugu

SEQ ID NO: 2760933 - RNA, 15 nt, Human
ugcaguucugaagaa

SEQ ID NO: 2760934 - RNA, 16 nt, Human
ugcaguucugaagaag

SEQ ID NO: 2760935 - RNA, 17 nt, Human
ugcaguucugaagaaga

SEQ ID NO: 2760936 - RNA, 18 nt, Human
ugcaguucugaagaagau

SEQ ID NO: 2760937 - RNA, 14 nt, Human
ugcaguucugaaga

SEQ ID NO: 2760938 - RNA, 19 nt, Human
ugcaguucugaagaagaug

SEQ ID NO: 2760939 - RNA, 22 nt, Human
ugcaguucugaagaagauggua

SEQ ID NO: 2760940 - RNA, 11 nt, Human
ugccaucccuc

SEQ ID NO: 2760941 - RNA, 12 nt, Human
ugccaucccucc

SEQ ID NO: 2760942 - RNA, 20 nt, Human
ugccacuaaauugacacuua

SEQ ID NO: 2760943 - RNA, 18 nt, Human
ugccaaauauaaauaaaa

SEQ ID NO: 2760944 - RNA, 17 nt, Human
ugccaaauauaaauaaa

SEQ ID NO: 2760945 - RNA, 22 nt, Human
ugccaaauauaaauaaaaauaa

SEQ ID NO: 2760946 - RNA, 19 nt, Human
ugccaaauauaaauaaaaa

SEQ ID NO: 2760947 - RNA, 14 nt, Human
ugggaguacaaaag

SEQ ID NO: 2760948 - RNA, 21 nt, Human
uggcuugaguuuaaauuguaa

SEQ ID NO: 2760949 - RNA, 18 nt, Human
uggcuuuucugauccagu

SEQ ID NO: 2760950 - RNA, 19 nt, Human
uggcuuuucugauccaguu

SEQ ID NO: 2760951 - RNA, 14 nt, Human
uggcuuuucugauc

SEQ ID NO: 2760952 - RNA, 17 nt, Human
uggcuuuucugauccag

SEQ ID NO: 2760953 - RNA, 13 nt, Human
uggcuuuucugau

SEQ ID NO: 2760954 - RNA, 16 nt, Human
uggcuuccuggcaaua

SEQ ID NO: 2760955 - RNA, 21 nt, Human
ugguauguuuucaggcuagau

SEQ ID NO: 2760956 - RNA, 18 nt, Human
uggggauucuuaaaguug

SEQ ID NO: 2760957 - RNA, 20 nt, Human
uggggauucuuaaaguugaa

SEQ ID NO: 2760958 - RNA, 13 nt, Human
uggggauucuuaa

SEQ ID NO: 2760959 - RNA, 16 nt, Human
uggggauucuuaaagu

SEQ ID NO: 2760960 - RNA, 12 nt, Human
uggggauucuua

SEQ ID NO: 2760961 - RNA, 11 nt, Human
uggagggaagc

SEQ ID NO: 2760962 - RNA, 21 nt, Human
uggaacauaaaauacaauguu

SEQ ID NO: 2760963 - RNA, 20 nt, Human
uggaacauaaaauacaaugu

SEQ ID NO: 2760964 - RNA, 23 nt, Human
uggaaacuucagcgguuuauaua

SEQ ID NO: 2760965 - RNA, 22 nt, Human
uggaauaauccuaaacauauga

SEQ ID NO: 2760966 - RNA, 18 nt, Human
uggaacgcguugaaauug

SEQ ID NO: 2760967 - RNA, 17 nt, Human
uggaacgcguugaaauu

SEQ ID NO: 2760968 - RNA, 19 nt, Human
uggaacgcguugaaauugu

SEQ ID NO: 2760969 - RNA, 19 nt, Human
ugugcuaguaauuggaaag

SEQ ID NO: 2760970 - RNA, 15 nt, Human
uguaugauucccagc

SEQ ID NO: 2760971 - RNA, 21 nt, Human
uguauugugcgcuaaacuuuu

SEQ ID NO: 2760972 - RNA, 22 nt, Human
uguaguguuggagaagaacuga

SEQ ID NO: 2760973 - RNA, 16 nt, Human
uguaccgcaaugugac

SEQ ID NO: 2760974 - RNA, 15 nt, Human
uguaccgcaauguga

SEQ ID NO: 2760975 - RNA, 18 nt, Human
uuaaaauacacacucaaa

SEQ ID NO: 2760976 - RNA, 18 nt, Human
uuaaagccauguuuauua

SEQ ID NO: 2760977 - RNA, 20 nt, Human
uuaaagccauguuuauuaca

SEQ ID NO: 2760978 - RNA, 12 nt, Human
uuaaagccaugu

SEQ ID NO: 2760979 - RNA, 14 nt, Human
uuaaagccauguuu

SEQ ID NO: 2760980 - RNA, 22 nt, Human
uuaaaaaaaaaccugagcccca

SEQ ID NO: 2760981 - RNA, 15 nt, Human
uuaaaaaaaaaauug

SEQ ID NO: 2760982 - RNA, 11 nt, Human
uguuucuguac

SEQ ID NO: 2760983 - RNA, 22 nt, Human
uguuucuguacuuuuuggcaua

SEQ ID NO: 2760984 - RNA, 23 nt, Human
uguuucuguacuuuuuggcauaa

SEQ ID NO: 2760985 - RNA, 20 nt, Human
uuacauuuguauaaaauaau

SEQ ID NO: 2760986 - RNA, 12 nt, Human
uuacagaagccc

SEQ ID NO: 2760987 - RNA, 18 nt, Human
uuaauauuaaagccaugu

SEQ ID NO: 2760988 - RNA, 19 nt, Human
uuaauauuaaagccauguu

SEQ ID NO: 2760989 - RNA, 23 nt, Human
uuaagcauauauuuuuauauuua

SEQ ID NO: 2760990 - RNA, 13 nt, Human
uuaauauuaaagc

SEQ ID NO: 2760991 - RNA, 14 nt, Human
uuaauauuaaagcc

SEQ ID NO: 2760992 - RNA, 16 nt, Human
uuaauauuaaagccau

SEQ ID NO: 2760993 - RNA, 17 nt, Human
uuaauauuaaagccaug

SEQ ID NO: 2760994 - RNA, 11 nt, Human
uuaauauuaaa

SEQ ID NO: 2760995 - RNA, 20 nt, Human
uguugacaugggacauuugc

SEQ ID NO: 2760996 - RNA, 16 nt, Human
uguuggagaagaacug

SEQ ID NO: 2760997 - RNA, 17 nt, Human
uguuggagaagaacuga

SEQ ID NO: 2760998 - RNA, 14 nt, Human
uguuggagaagaac

SEQ ID NO: 2760999 - RNA, 19 nt, Human
uguuggagaagaacugaaa

SEQ ID NO: 2761000 - RNA, 20 nt, Human
uguuggagaagaacugaaau

SEQ ID NO: 2761001 - RNA, 14 nt, Human
uguuuaaaaucauu

SEQ ID NO: 2761002 - RNA, 18 nt, Human
uguuuaaaaucauuucug

SEQ ID NO: 2761003 - RNA, 17 nt, Human
uguuuaaaaucauuucu

SEQ ID NO: 2761004 - RNA, 13 nt, Human
uguguuuugcaag

SEQ ID NO: 2761005 - RNA, 19 nt, Human
uguguuuugcaagccagau

SEQ ID NO: 2761006 - RNA, 20 nt, Human
ugugugaaagguacuucaaa

SEQ ID NO: 2761007 - RNA, 21 nt, Human
ugugugaaagguacuucaaau

SEQ ID NO: 2761008 - RNA, 22 nt, Human
ugugugaaagguacuucaaauc

SEQ ID NO: 2761009 - RNA, 21 nt, Human
uguuaaaagaugaaaauauuu

SEQ ID NO: 2761010 - RNA, 16 nt, Human
auagaauuaacacaug

SEQ ID NO: 2761011 - RNA, 22 nt, Human
agguacugagagugaacaaauu

SEQ ID NO: 2761012 - RNA, 22 nt, Human
aggaauugacccacaagaaaug

SEQ ID NO: 2761013 - RNA, 16 nt, Human
cugaggaauucuguau

SEQ ID NO: 2761014 - RNA, 15 nt, Human
cugaggaauucugua

SEQ ID NO: 2761015 - RNA, 19 nt, Human
cugaggaauucuguauaga

SEQ ID NO: 2761016 - RNA, 18 nt, Human
cugaggaauucuguauag

SEQ ID NO: 2761017 - RNA, 17 nt, Human
cugaaagaggaaugaag

SEQ ID NO: 2761018 - RNA, 13 nt, Human
cugaaagaggaau

SEQ ID NO: 2761019 - RNA, 17 nt, Human
cucucuggccuucggcc

SEQ ID NO: 2761020 - RNA, 22 nt, Human
cucucuggccuucggccuccau

SEQ ID NO: 2761021 - RNA, 19 nt, Human
cucucuggccuucggccuc

SEQ ID NO: 2761022 - RNA, 13 nt, Human
cuccuuucucuuu

SEQ ID NO: 2761023 - RNA, 21 nt, Human
cuccagugagacagcucugca

SEQ ID NO: 2761024 - RNA, 13 nt, Human
cucaaaacugcac

SEQ ID NO: 2761025 - RNA, 23 nt, Human
cucagaaaacaaggaugaauuaa

SEQ ID NO: 2761026 - RNA, 19 nt, Human
cucagaaaacaaggaugaa

SEQ ID NO: 2761027 - RNA, 16 nt, Human
cuaaacuuuucugaua

SEQ ID NO: 2761028 - RNA, 15 nt, Human
cuaaacuuuucugau

SEQ ID NO: 2761029 - RNA, 14 nt, Human
cuaacuggacuggu

SEQ ID NO: 2761030 - RNA, 15 nt, Human
cgguuuauauaagcu

SEQ ID NO: 2761031 - RNA, 23 nt, Human
cggagaagagcuguucacagcca

SEQ ID NO: 2761032 - RNA, 24 nt, Human
cggagaagagcuguucacagccag

SEQ ID NO: 2761033 - RNA, 20 nt, Human
cccauauuuguacaccaaua

SEQ ID NO: 2761034 - RNA, 24 nt, Human
cccagccagcaguucagagcugcc

SEQ ID NO: 2761035 - RNA, 13 nt, Human
ccccugcacucca

SEQ ID NO: 2761036 - RNA, 22 nt, Human
cccuccucugcuugccaucccu

SEQ ID NO: 2761037 - RNA, 13 nt, Human
cccuccucugcuu

SEQ ID NO: 2761038 - RNA, 15 nt, Human
ccaucccucccucca

SEQ ID NO: 2761039 - RNA, 14 nt, Human
ccaucccucccucc

SEQ ID NO: 2761040 - RNA, 13 nt, Human
ccaucccucccuc

SEQ ID NO: 2761041 - RNA, 13 nt, Human
cccaacuccagaa

SEQ ID NO: 2761042 - RNA, 17 nt, Human
ccugucucuacuaaaaa

SEQ ID NO: 2761043 - RNA, 16 nt, Human
ccucccuucucuucac

SEQ ID NO: 2761044 - RNA, 12 nt, Human
ccucggagaaga

SEQ ID NO: 2761045 - RNA, 14 nt, Human
ccucggagaagagc

SEQ ID NO: 2761046 - RNA, 23 nt, Human
cacuccagccugagcgacaguga

SEQ ID NO: 2761047 - RNA, 13 nt, Human
cacuccagccuga

SEQ ID NO: 2761048 - RNA, 12 nt, Human
cacuccagccug

SEQ ID NO: 2761049 - RNA, 11 nt, Human
cagaacaguga

SEQ ID NO: 2761050 - RNA, 17 nt, Human
cagaacagugauuacca

SEQ ID NO: 2761051 - RNA, 12 nt, Human
cagaacagugau

SEQ ID NO: 2761052 - RNA, 15 nt, Human
cacuuaaaaaugguu

SEQ ID NO: 2761053 - RNA, 23 nt, Human
caauaaaauccauacauuugugu

SEQ ID NO: 2761054 - RNA, 20 nt, Human
caauaaaauccauacauuug

SEQ ID NO: 2761055 - RNA, 15 nt, Human
caauaaaauggguuu

SEQ ID NO: 2761056 - RNA, 16 nt, Human
caaacagucucaggaa

SEQ ID NO: 2761057 - RNA, 17 nt, Human
caaacagucucaggaaa

SEQ ID NO: 2761058 - RNA, 15 nt, Human
caaacagucucagga

SEQ ID NO: 2761059 - RNA, 21 nt, Human
caaaaggauaaugaauacuuu

SEQ ID NO: 2761060 - RNA, 13 nt, Human
auuuuuuuguugu

SEQ ID NO: 2761061 - RNA, 16 nt, Human
auuuuuauauuuacua

SEQ ID NO: 2761062 - RNA, 15 nt, Human
auuuuuauauuuacu

SEQ ID NO: 2761063 - RNA, 15 nt, Human
auuuuuauauuugaa

SEQ ID NO: 2761064 - RNA, 21 nt, Human
auuuuauaucaauuuaaaaaa

SEQ ID NO: 2761065 - RNA, 19 nt, Human
caagacccaaaaggcagaa

SEQ ID NO: 2761066 - RNA, 21 nt, Human
caaaucuuaacuugaaggagu

SEQ ID NO: 2761067 - RNA, 22 nt, Human
auuaugaauuacauuuguauaa

SEQ ID NO: 2761068 - RNA, 20 nt, Human
auuaugaauuacauuuguau

SEQ ID NO: 2761069 - RNA, 19 nt, Human
auuaugaauuacauuugua

SEQ ID NO: 2761070 - RNA, 15 nt, Human
auuguaauuauaucu

SEQ ID NO: 2761071 - RNA, 17 nt, Human
auuguaauuauaucuga

SEQ ID NO: 2761072 - RNA, 16 nt, Human
auuguaauuauaucug

SEQ ID NO: 2761073 - RNA, 19 nt, Human
auuguacaaaguauuaagc

SEQ ID NO: 2761074 - RNA, 17 nt, Human
auuguacaaaguauuaa

SEQ ID NO: 2761075 - RNA, 16 nt, Human
auuguacaaaguauua

SEQ ID NO: 2761076 - RNA, 21 nt, Human
auuguaauuauaucugaggaa

SEQ ID NO: 2761077 - RNA, 15 nt, Human
auuguuuaaaaucau

SEQ ID NO: 2761078 - RNA, 22 nt, Human
auuucuaugcugaguuugugcu

SEQ ID NO: 2761079 - RNA, 21 nt, Human
auuucuaugcugaguuugugc

SEQ ID NO: 2761080 - RNA, 19 nt, Human
auuucuaugcugaguuugu

SEQ ID NO: 2761081 - RNA, 19 nt, Human
auuucuauauuuucauucu

SEQ ID NO: 2761082 - RNA, 20 nt, Human
auuucauaccuaucaucuua

SEQ ID NO: 2761083 - RNA, 16 nt, Human
auuucuauauuuucau

SEQ ID NO: 2761084 - RNA, 15 nt, Human
auuucuauauuuuca

SEQ ID NO: 2761085 - RNA, 18 nt, Human
auuucuauauuuucauuc

SEQ ID NO: 2761086 - RNA, 17 nt, Human
auuucuauauuuucauu

SEQ ID NO: 2761087 - RNA, 14 nt, Human
auuucuaugaaaua

SEQ ID NO: 2761088 - RNA, 16 nt, Human
auuuaauaaaugugcc

SEQ ID NO: 2761089 - RNA, 22 nt, Human
cauuuggaaaucuuuaaaaaaa

SEQ ID NO: 2761090 - RNA, 18 nt, Human
ccacagaagcuccaggua

SEQ ID NO: 2761091 - RNA, 18 nt, Human
ccaccagucugacuguuu

SEQ ID NO: 2761092 - RNA, 16 nt, Human
ccacagaagcuccagg

SEQ ID NO: 2761093 - RNA, 13 nt, Human
cauuaucucaaaa

SEQ ID NO: 2761094 - RNA, 12 nt, Human
cauuaucucaaa

SEQ ID NO: 2761095 - RNA, 18 nt, Human
cagggaggacgcucucug

SEQ ID NO: 2761096 - RNA, 17 nt, Human
cagggaggacgcucucu

SEQ ID NO: 2761097 - RNA, 21 nt, Human
caguauuguacaaaguauuaa

SEQ ID NO: 2761098 - RNA, 13 nt, Human
caguauuguacaa

SEQ ID NO: 2761099 - RNA, 12 nt, Human
caguauuguaca

SEQ ID NO: 2761100 - RNA, 19 nt, Human
caguauuguacaaaguauu

SEQ ID NO: 2761101 - RNA, 18 nt, Human
caguauuguacaaaguau

SEQ ID NO: 2761102 - RNA, 17 nt, Human
caguauuguacaaagua

SEQ ID NO: 2761103 - RNA, 16 nt, Human
caguauuguacaaagu

SEQ ID NO: 2761104 - RNA, 15 nt, Human
cagucucaggaaauc

SEQ ID NO: 2761105 - RNA, 15 nt, Human
cagagcugcccucuc

SEQ ID NO: 2761106 - RNA, 13 nt, Human
cagagcugcccuc

SEQ ID NO: 2761107 - RNA, 22 nt, Human
cagcacagccucuuagaugcag

SEQ ID NO: 2761108 - RNA, 14 nt, Human
cagccagcaguuca

SEQ ID NO: 2761109 - RNA, 21 nt, Human
cagccagcaguucagagcugc

SEQ ID NO: 2761110 - RNA, 15 nt, Human
cagccagcaguucag

SEQ ID NO: 2761111 - RNA, 20 nt, Human
cagcaguugaaaagacucca

SEQ ID NO: 2761112 - RNA, 21 nt, Human
cagcaguugaaaagacuccaa

SEQ ID NO: 2761113 - RNA, 17 nt, Human
cagcaguugaaaagacu

SEQ ID NO: 2761114 - RNA, 18 nt, Human
cagccugagcgacaguga

SEQ ID NO: 2761115 - RNA, 19 nt, Human
cagccugagcgacagugag

SEQ ID NO: 2761116 - RNA, 20 nt, Human
cagcccuucuuuccacagaa

SEQ ID NO: 2761117 - RNA, 19 nt, Human
cagcccuucuuuccacaga

SEQ ID NO: 2761118 - RNA, 15 nt, Human
cagcccuucuuucca

SEQ ID NO: 2761119 - RNA, 22 nt, Human
cagcugccuccccuccucugcu

SEQ ID NO: 2761120 - RNA, 21 nt, Human
cagcugccuccccuccucugc

SEQ ID NO: 2761121 - RNA, 24 nt, Human
cagcugccuccccuccucugcuug

SEQ ID NO: 2761122 - RNA, 23 nt, Human
cagcugccuccccuccucugcuu

SEQ ID NO: 2761123 - RNA, 17 nt, Human
cagcuccccucggagaa

SEQ ID NO: 2761124 - RNA, 18 nt, Human
cagcuccccucggagaag

SEQ ID NO: 2761125 - RNA, 16 nt, Human
cagcuccccucggaga

SEQ ID NO: 2761126 - RNA, 20 nt, Human
caggaaagagaacuuccaga

SEQ ID NO: 2761127 - RNA, 22 nt, Human
caggaaaucaaauaugcaaagc

SEQ ID NO: 2761128 - RNA, 23 nt, Human
caggaaaucaaauaugcaaagca

SEQ ID NO: 2761129 - RNA, 15 nt, Human
gccucuuagaugcag

SEQ ID NO: 2761130 - RNA, 20 nt, Human
gccuucggccuccauccuga

SEQ ID NO: 2761131 - RNA, 21 nt, Human
gccuucggccuccauccugag

SEQ ID NO: 2761132 - RNA, 19 nt, Human
gcuccacuuggucugugag

SEQ ID NO: 2761133 - RNA, 18 nt, Human
gcuccacuuggucuguga

SEQ ID NO: 2761134 - RNA, 21 nt, Human
gcuccccucggagaagagcug

SEQ ID NO: 2761135 - RNA, 18 nt, Human
gcuccccucggagaagag

SEQ ID NO: 2761136 - RNA, 15 nt, Human
gcuccacuuggucug

SEQ ID NO: 2761137 - RNA, 15 nt, Human
gcuagaacucccuuu

SEQ ID NO: 2761138 - RNA, 14 nt, Human
gcuagaacucccuu

SEQ ID NO: 2761139 - RNA, 13 nt, Human
gcuagaacucccu

SEQ ID NO: 2761140 - RNA, 12 nt, Human
gcuagaacuccc

SEQ ID NO: 2761141 - RNA, 18 nt, Human
gcuagaacucccuuucaa

SEQ ID NO: 2761142 - RNA, 16 nt, Human
gcuagaacucccuuuc

SEQ ID NO: 2761143 - RNA, 22 nt, Human
gcuauuucuauauuuucauucu

SEQ ID NO: 2761144 - RNA, 14 nt, Human
gcugggguuaucug

SEQ ID NO: 2761145 - RNA, 23 nt, Human
gcugggguuaucugaagucagau

SEQ ID NO: 2761146 - RNA, 22 nt, Human
gcugggguuaucugaagucaga

SEQ ID NO: 2761147 - RNA, 22 nt, Human
ggacuucuuuaauuuuggaauu

SEQ ID NO: 2761148 - RNA, 18 nt, Human
ggacuucuuuaauuuugg

SEQ ID NO: 2761149 - RNA, 21 nt, Human
ggacuucuuuaauuuuggaau

SEQ ID NO: 2761150 - RNA, 15 nt, Human
ggacuuguuagaucu

SEQ ID NO: 2761151 - RNA, 12 nt, Human
ggacuuguuaga

SEQ ID NO: 2761152 - RNA, 13 nt, Human
ggagaaacuggaa

SEQ ID NO: 2761153 - RNA, 22 nt, Human
ggacucauuuuaaaaaauggaa

SEQ ID NO: 2761154 - RNA, 11 nt, Human
aaacacagcaa

SEQ ID NO: 2761155 - RNA, 12 nt, Human
aaacacagcaag

SEQ ID NO: 2761156 - RNA, 14 nt, Human
aaacacagcaaggg

SEQ ID NO: 2761157 - RNA, 19 nt, Human
ggggaauugaggacacuga

SEQ ID NO: 2761158 - RNA, 15 nt, Human
aaacagucucaggaa

SEQ ID NO: 2761159 - RNA, 14 nt, Human
aaacaguagugaua

SEQ ID NO: 2761160 - RNA, 12 nt, Human
aaaccacagcag

SEQ ID NO: 2761161 - RNA, 15 nt, Human
aaacucguuaauuug

SEQ ID NO: 2761162 - RNA, 17 nt, Human
aaagcacugacuucuaa

SEQ ID NO: 2761163 - RNA, 21 nt, Human
aaagcacugacuucuaaguaa

SEQ ID NO: 2761164 - RNA, 14 nt, Human
aaagguacuucaaa

SEQ ID NO: 2761165 - RNA, 23 nt, Human
aaacuucagcgguuuauauaagc

SEQ ID NO: 2761166 - RNA, 19 nt, Human
aaacuucagacauagaauu

SEQ ID NO: 2761167 - RNA, 11 nt, Human
aaacuuuucug

SEQ ID NO: 2761168 - RNA, 13 nt, Human
aaagacagugaaa

SEQ ID NO: 2761169 - RNA, 18 nt, Human
aaagacuauucaaacagu

SEQ ID NO: 2761170 - RNA, 19 nt, Human
aaagacuauucaaacaguc

SEQ ID NO: 2761171 - RNA, 17 nt, Human
aaagacuauucaaacag

SEQ ID NO: 2761172 - RNA, 21 nt, Human
aaagacuauucaaacagucuc

SEQ ID NO: 2761173 - RNA, 15 nt, Human
aaagacuccaaagaa

SEQ ID NO: 2761174 - RNA, 21 nt, Human
aaagacuccaaagaaauguaa

SEQ ID NO: 2761175 - RNA, 14 nt, Human
aaagacuccaaaga

SEQ ID NO: 2761176 - RNA, 15 nt, Human
aaagaggcagcuuga

SEQ ID NO: 2761177 - RNA, 15 nt, Human
aaagaggaaugaagu

SEQ ID NO: 2761178 - RNA, 12 nt, Human
aaaguuuaauau

SEQ ID NO: 2761179 - RNA, 17 nt, Human
aaaguugccuaaaucca

SEQ ID NO: 2761180 - RNA, 16 nt, Human
aaaguugccuaaaucc

SEQ ID NO: 2761181 - RNA, 23 nt, Human
aaaguugccuaaauccauuugga

SEQ ID NO: 2761182 - RNA, 20 nt, Human
aaaguauuaagcauauauuu

SEQ ID NO: 2761183 - RNA, 19 nt, Human
aaaguauuaagcauauauu

SEQ ID NO: 2761184 - RNA, 18 nt, Human
aaaguauuaagcauauau

SEQ ID NO: 2761185 - RNA, 13 nt, Human
aaaguauuaagca

SEQ ID NO: 2761186 - RNA, 17 nt, Human
aaaguauguuagugcaa

SEQ ID NO: 2761187 - RNA, 14 nt, Human
aaaguugccuaaau

SEQ ID NO: 2761188 - RNA, 13 nt, Human
aaaguugccuaaa

SEQ ID NO: 2761189 - RNA, 23 nt, Human
aaaguucugcagauaaacaguag

SEQ ID NO: 2761190 - RNA, 20 nt, Human
aaagguauuuuaaucaccaa

SEQ ID NO: 2761191 - RNA, 18 nt, Human
aaaguauguuagugcaaa

SEQ ID NO: 2761192 - RNA, 19 nt, Human
aaauacacacucaaaucaa

SEQ ID NO: 2761193 - RNA, 13 nt, Human
aaauacaauuuug

SEQ ID NO: 2761194 - RNA, 23 nt, Human
aaauaauuuuuauauuugaaaua

SEQ ID NO: 2761195 - RNA, 22 nt, Human
aaauaauuuuuauauuugaaau

SEQ ID NO: 2761196 - RNA, 20 nt, Human
aaauacaauuuuguuucugu

SEQ ID NO: 2761197 - RNA, 18 nt, Human
aaauacaauuuuguuucu

SEQ ID NO: 2761198 - RNA, 17 nt, Human
aaauacaauuuuguuuc

SEQ ID NO: 2761199 - RNA, 14 nt, Human
aaauacaauuuugu

SEQ ID NO: 2761200 - RNA, 22 nt, Human
aaauacaauuuuguuucuguac

SEQ ID NO: 2761201 - RNA, 21 nt, Human
aaauacaauuuuguuucugua

SEQ ID NO: 2761202 - RNA, 15 nt, Human
aaauacacacucaaa

SEQ ID NO: 2761203 - RNA, 21 nt, Human
aaauaauuuuuauauuugaaa

SEQ ID NO: 2761204 - RNA, 23 nt, Human
guacacugccuucucaacuccaa

SEQ ID NO: 2761205 - RNA, 20 nt, Human
guaauaggcguaacuaauuu

SEQ ID NO: 2761206 - RNA, 15 nt, Human
aaauccauacauuug

SEQ ID NO: 2761207 - RNA, 17 nt, Human
aaauauuauguuaaaac

SEQ ID NO: 2761208 - RNA, 12 nt, Human
aaaucauuucug

SEQ ID NO: 2761209 - RNA, 11 nt, Human
aaaucauuucu

SEQ ID NO: 2761210 - RNA, 19 nt, Human
aaaucauuucugcaucagc

SEQ ID NO: 2761211 - RNA, 21 nt, Human
aaaucauuucugcaucagcug

SEQ ID NO: 2761212 - RNA, 22 nt, Human
aaaucauuucugcaucagcugc

SEQ ID NO: 2761213 - RNA, 23 nt, Human
aaaucauuucugcaucagcugcu

SEQ ID NO: 2761214 - RNA, 22 nt, Human
guacuucaaauccuugaagauu

SEQ ID NO: 2761215 - RNA, 21 nt, Human
guacuucaaauccuugaagau

SEQ ID NO: 2761216 - RNA, 15 nt, Human
guacuucaugcuguc

SEQ ID NO: 2761217 - RNA, 21 nt, Human
ggcacaguuuucugagaaaga

SEQ ID NO: 2761218 - RNA, 13 nt, Human
ggccuccauccug

SEQ ID NO: 2761219 - RNA, 15 nt, Human
ggccuccauccugag

SEQ ID NO: 2761220 - RNA, 14 nt, Human
ggccuccauccuga

SEQ ID NO: 2761221 - RNA, 17 nt, Human
ggcauaacauaaaucug

SEQ ID NO: 2761222 - RNA, 16 nt, Human
ggcauaacauaaaucu

SEQ ID NO: 2761223 - RNA, 17 nt, Human
aaaaccaguauuguaca

SEQ ID NO: 2761224 - RNA, 14 nt, Human
aaaaccacagcagu

SEQ ID NO: 2761225 - RNA, 17 nt, Human
aaaaaugguuuaaaugg

SEQ ID NO: 2761226 - RNA, 15 nt, Human
aaaacuucagacaua

SEQ ID NO: 2761227 - RNA, 15 nt, Human
ggcuguacccaggaa

SEQ ID NO: 2761228 - RNA, 14 nt, Human
aaaaauaacaauga

SEQ ID NO: 2761229 - RNA, 20 nt, Human
gggaacccaaguccaagcau

SEQ ID NO: 2761230 - RNA, 22 nt, Human
gggacagucaccucauggaauu

SEQ ID NO: 2761231 - RNA, 21 nt, Human
gggacagucaccucauggaau

SEQ ID NO: 2761232 - RNA, 20 nt, Human
gggacagucaccucauggaa

SEQ ID NO: 2761233 - RNA, 14 nt, Human
ggcuccacuugguc

SEQ ID NO: 2761234 - RNA, 21 nt, Human
gacagcccuucuuuccacaga

SEQ ID NO: 2761235 - RNA, 20 nt, Human
gacagaaagcagaacaguga

SEQ ID NO: 2761236 - RNA, 14 nt, Human
gacagaaagcagaa

SEQ ID NO: 2761237 - RNA, 15 nt, Human
gacuauucaaacagu

SEQ ID NO: 2761238 - RNA, 16 nt, Human
gacuauucaaacaguc

SEQ ID NO: 2761239 - RNA, 19 nt, Human
gacuuuggauaauaaggaa

SEQ ID NO: 2761240 - RNA, 17 nt, Human
gacuguggugacuuugg

SEQ ID NO: 2761241 - RNA, 15 nt, Human
gagcgacagugagac

SEQ ID NO: 2761242 - RNA, 13 nt, Human
gagcgacagugag

SEQ ID NO: 2761243 - RNA, 13 nt, Human
gcauaacauaaau

SEQ ID NO: 2761244 - RNA, 22 nt, Human
gcaguugaaaagacuccaaaga

SEQ ID NO: 2761245 - RNA, 15 nt, Human
gcagcuuauucacaa

SEQ ID NO: 2761246 - RNA, 16 nt, Human
gcauuguaaaugugcu

SEQ ID NO: 2761247 - RNA, 16 nt, Human
gcaauaaaauggguuu

SEQ ID NO: 2761248 - RNA, 18 nt, Human
gcaauagucaaauugugu

SEQ ID NO: 2761249 - RNA, 15 nt, Human
gauucuuaaaguuga

SEQ ID NO: 2761250 - RNA, 21 nt, Human
gauucuuaaaguugaauuuau

SEQ ID NO: 2761251 - RNA, 17 nt, Human
gauucuuaaaguugaau

SEQ ID NO: 2761252 - RNA, 16 nt, Human
gauucuuaaaguugaa

SEQ ID NO: 2761253 - RNA, 16 nt, Human
gcaaaaauauuuuaug

SEQ ID NO: 2761254 - RNA, 23 nt, Human
gcaaaaauauuuuaugauccagc

SEQ ID NO: 2761255 - RNA, 22 nt, Human
gcaaaaauauuuuaugauccag

SEQ ID NO: 2761256 - RNA, 17 nt, Human
gcaaaaauauuuuauga

SEQ ID NO: 2761257 - RNA, 15 nt, Human
gaaaucuuuaaaaaa

SEQ ID NO: 2761258 - RNA, 12 nt, Human
gaaaucuuuaaa

SEQ ID NO: 2761259 - RNA, 18 nt, Human
gaaagaaaaucaggcugg

SEQ ID NO: 2761260 - RNA, 16 nt, Human
gaaaagacuccaaaga

SEQ ID NO: 2761261 - RNA, 17 nt, Human
gaaaagacuccaaagaa

SEQ ID NO: 2761262 - RNA, 14 nt, Human
gaaaagacuccaaa

SEQ ID NO: 2761263 - RNA, 21 nt, Human
gaaaacuuuaugcuaagugaa

SEQ ID NO: 2761264 - RNA, 16 nt, Human
gaacccaaguccaagc

SEQ ID NO: 2761265 - RNA, 17 nt, Human
gaacccaaguccaagca

SEQ ID NO: 2761266 - RNA, 17 nt, Human
gaacccgggaggcagag

SEQ ID NO: 2761267 - RNA, 18 nt, Human
cuugucucagauuuuauu

SEQ ID NO: 2761268 - RNA, 13 nt, Human
cuugucucagauu

SEQ ID NO: 2761269 - RNA, 17 nt, Human
cuugucucagauuuuau

SEQ ID NO: 2761270 - RNA, 14 nt, Human
cuugucucagauuu

SEQ ID NO: 2761271 - RNA, 16 nt, Human
cuuggucugugagaug

SEQ ID NO: 2761272 - RNA, 19 nt, Human
cuuggucugugagaugcua

SEQ ID NO: 2761273 - RNA, 14 nt, Human
cuuucagauacugg

SEQ ID NO: 2761274 - RNA, 22 nt, Human
cuuucagauacuggauuguacu

SEQ ID NO: 2761275 - RNA, 13 nt, Human
cuuucagauacug

SEQ ID NO: 2761276 - RNA, 17 nt, Human
cuuucagauacuggauu

SEQ ID NO: 2761277 - RNA, 15 nt, Human
cuuucagauacugga

SEQ ID NO: 2761278 - RNA, 13 nt, Human
cuucucacauuua

SEQ ID NO: 2761279 - RNA, 20 nt, Human
cuucucacauuuauauuuuu

SEQ ID NO: 2761280 - RNA, 21 nt, Human
cuucuaaguaaaaccacagca

SEQ ID NO: 2761281 - RNA, 13 nt, Human
cuucuaaguaaaa

SEQ ID NO: 2761282 - RNA, 17 nt, Human
cuucuaaguaaaaccac

SEQ ID NO: 2761283 - RNA, 21 nt, Human
cugccuccccuccucugcuug

SEQ ID NO: 2761284 - RNA, 15 nt, Human
cuguacuuuuuggca

SEQ ID NO: 2761285 - RNA, 13 nt, Human
cuguuauaaucuu

SEQ ID NO: 2761286 - RNA, 22 nt, Human
cuuaaaguugaauuuauuggcu

SEQ ID NO: 2761287 - RNA, 14 nt, Human
cuuaaaguugaauu

SEQ ID NO: 2761288 - RNA, 18 nt, Human
cuuaaaguugaauuuauu

SEQ ID NO: 2761289 - RNA, 15 nt, Human
cuuaaaguugaauuu

SEQ ID NO: 2761290 - RNA, 21 nt, Human
cuuaaaaaugguuuaaauggu

SEQ ID NO: 2761291 - RNA, 18 nt, Human
auuauauuuauuacugua

SEQ ID NO: 2761292 - RNA, 15 nt, Human
auuauauuuauuacu

SEQ ID NO: 2761293 - RNA, 21 nt, Human
auuauguuaaaacugggacag

SEQ ID NO: 2761294 - RNA, 20 nt, Human
auuauuaccuuacagaaguu

SEQ ID NO: 2761295 - RNA, 17 nt, Human
auuauucaaaguugccu

SEQ ID NO: 2761296 - RNA, 13 nt, Human
auuauucaaaguu

SEQ ID NO: 2761297 - RNA, 15 nt, Human
auuauucaaaguugc

SEQ ID NO: 2761298 - RNA, 14 nt, Human
auuauucaaaguug

SEQ ID NO: 2761299 - RNA, 16 nt, Human
auucaaacagucucag

SEQ ID NO: 2761300 - RNA, 18 nt, Human
auucaaacagucucagga

SEQ ID NO: 2761301 - RNA, 19 nt, Human
auucaaacagucucaggaa

SEQ ID NO: 2761302 - RNA, 20 nt, Human
auucaaacagucucaggaaa

SEQ ID NO: 2761303 - RNA, 13 nt, Human
auucuguauagau

SEQ ID NO: 2761304 - RNA, 12 nt, Human
auucuguauaga

SEQ ID NO: 2761305 - RNA, 11 nt, Human
auucuguauag

SEQ ID NO: 2761306 - RNA, 21 nt, Human
auucuuaaaguugaauuuauu

SEQ ID NO: 2761307 - RNA, 20 nt, Human
auucuuaaaguugaauuuau

SEQ ID NO: 2761308 - RNA, 19 nt, Human
auucuuaaaguugaauuua

SEQ ID NO: 2761309 - RNA, 19 nt, Human
auugacacuuaaaaauggu

SEQ ID NO: 2761310 - RNA, 17 nt, Human
auugacacuuaaaaaug

SEQ ID NO: 2761311 - RNA, 15 nt, Human
auugacacuuaaaaa

SEQ ID NO: 2761312 - RNA, 23 nt, Human
auuuuuucucuaggaaauauuua

SEQ ID NO: 2761313 - RNA, 20 nt, Human
auuuuuucucuaggaaauau

SEQ ID NO: 2761314 - RNA, 18 nt, Human
auuuuuuguuaaaugauu

SEQ ID NO: 2761315 - RNA, 21 nt, Human
auuuuuguuuucauuaucuca

SEQ ID NO: 2761316 - RNA, 22 nt, Human
auuuuugugauuuugugauuga

SEQ ID NO: 2761317 - RNA, 15 nt, Human
auuuuguuucuguac

SEQ ID NO: 2761318 - RNA, 14 nt, Human
auuuuguuucugua

SEQ ID NO: 2761319 - RNA, 19 nt, Human
auuuuucuuauuucauuuc

SEQ ID NO: 2761320 - RNA, 20 nt, Human
auuuuucuuauuucauuucu

SEQ ID NO: 2761321 - RNA, 15 nt, Human
auuuuucuuauuuca

SEQ ID NO: 2761322 - RNA, 12 nt, Human
auuuuggaauuu

SEQ ID NO: 2761323 - RNA, 11 nt, Human
auuuuguuucu

SEQ ID NO: 2761324 - RNA, 14 nt, Human
auuuuccugaaaac

SEQ ID NO: 2761325 - RNA, 14 nt, Human
auuuucuauaauuu

SEQ ID NO: 2761326 - RNA, 15 nt, Human
auuuucuauaauuua

SEQ ID NO: 2761327 - RNA, 16 nt, Human
auuuuaaaagaaugau

SEQ ID NO: 2761328 - RNA, 23 nt, Human
auuuuaaaagaaugauuaugaau

SEQ ID NO: 2761329 - RNA, 17 nt, Human
auuuuaacaacagcugg

SEQ ID NO: 2761330 - RNA, 14 nt, Human
auuuguauaaaaua

SEQ ID NO: 2761331 - RNA, 22 nt, Human
auuuguaguguuggagaagaac

SEQ ID NO: 2761332 - RNA, 19 nt, Human
auuuguaguguuggagaag

SEQ ID NO: 2761333 - RNA, 15 nt, Human
auuugaauuuugugu

SEQ ID NO: 2761334 - RNA, 21 nt, Human
auuugacauagucuggcugua

SEQ ID NO: 2761335 - RNA, 17 nt, Human
auuugacauagucuggc

SEQ ID NO: 2761336 - RNA, 16 nt, Human
auuugacauagucugg

SEQ ID NO: 2761337 - RNA, 14 nt, Human
auuuauuuuaauaa

SEQ ID NO: 2761338 - RNA, 13 nt, Human
auugucuagugaa

SEQ ID NO: 2761339 - RNA, 15 nt, Human
auuggcuuuucugau

SEQ ID NO: 2761340 - RNA, 13 nt, Human
auuggcuuuucug

SEQ ID NO: 2761341 - RNA, 20 nt, Human
auuggcuuuucugauccagu

SEQ ID NO: 2761342 - RNA, 19 nt, Human
auuggcuuuucugauccag

SEQ ID NO: 2761343 - RNA, 16 nt, Human
auuggcuuuucugauc

SEQ ID NO: 2761344 - RNA, 13 nt, Human
auugacuuuuuau

SEQ ID NO: 2761345 - RNA, 19 nt, Human
auuggagcucgugggacag

SEQ ID NO: 2761346 - RNA, 19 nt, Human
auuggacaguaaaauccac

SEQ ID NO: 2761347 - RNA, 16 nt, Human
uuuauauuuacuaaaa

SEQ ID NO: 2761348 - RNA, 13 nt, Human
uuuauauuuacua

SEQ ID NO: 2761349 - RNA, 23 nt, Human
augcuauuucuauauuuucauuc

SEQ ID NO: 2761350 - RNA, 22 nt, Human
augcuauuucuauauuuucauu

SEQ ID NO: 2761351 - RNA, 21 nt, Human
augcuauuucuauauuuucau

SEQ ID NO: 2761352 - RNA, 11 nt, Human
augcuauuucu

SEQ ID NO: 2761353 - RNA, 20 nt, Human
augcuauuucuauauuuuca

SEQ ID NO: 2761354 - RNA, 15 nt, Human
augcuauuucuauau

SEQ ID NO: 2761355 - RNA, 14 nt, Human
augcuauuucuaua

SEQ ID NO: 2761356 - RNA, 13 nt, Human
augcuauuucuau

SEQ ID NO: 2761357 - RNA, 18 nt, Human
uuuauuacaguauaauua

SEQ ID NO: 2761358 - RNA, 14 nt, Human
uuuauuacaguaua

SEQ ID NO: 2761359 - RNA, 22 nt, Human
augcuagaacucccuuucaaca

SEQ ID NO: 2761360 - RNA, 19 nt, Human
augcuagaacucccuuuca

SEQ ID NO: 2761361 - RNA, 21 nt, Human
augcuagaacucccuuucaac

SEQ ID NO: 2761362 - RNA, 20 nt, Human
augcuagaacucccuuucaa

SEQ ID NO: 2761363 - RNA, 15 nt, Human
auggaacgcguugaa

SEQ ID NO: 2761364 - RNA, 17 nt, Human
auggaacgcguugaaau

SEQ ID NO: 2761365 - RNA, 16 nt, Human
auggaacgcguugaaa

SEQ ID NO: 2761366 - RNA, 19 nt, Human
auggaacgcguugaaauug

SEQ ID NO: 2761367 - RNA, 18 nt, Human
auggaacgcguugaaauu

SEQ ID NO: 2761368 - RNA, 16 nt, Human
uuucaaacauauauaa

SEQ ID NO: 2761369 - RNA, 16 nt, Human
auggacuguggugacu

SEQ ID NO: 2761370 - RNA, 22 nt, Human
auggacuguggugacuuuggau

SEQ ID NO: 2761371 - RNA, 17 nt, Human
auggacuguggugacuu

SEQ ID NO: 2761372 - RNA, 15 nt, Human
uuucauuauuuuauu

SEQ ID NO: 2761373 - RNA, 13 nt, Human
uuucauuauuuua

SEQ ID NO: 2761374 - RNA, 20 nt, Human
uuucauuauuuuauuaugaa

SEQ ID NO: 2761375 - RNA, 19 nt, Human
uuucauuauuuuauuauga

SEQ ID NO: 2761376 - RNA, 14 nt, Human
augggauaaaugcc

SEQ ID NO: 2761377 - RNA, 23 nt, Human
auggcuauaggugcuacaaaaac

SEQ ID NO: 2761378 - RNA, 19 nt, Human
auggcuaagcaaaauguga

SEQ ID NO: 2761379 - RNA, 16 nt, Human
auggcacuaguauuuc

SEQ ID NO: 2761380 - RNA, 14 nt, Human
auggcacuaguauu

SEQ ID NO: 2761381 - RNA, 15 nt, Human
augauaacuggaaac

SEQ ID NO: 2761382 - RNA, 10 nt, Human
augauccagc

SEQ ID NO: 2761383 - RNA, 20 nt, Human
augauccagcagauuauuca

SEQ ID NO: 2761384 - RNA, 19 nt, Human
augauccagcagauuauuc

SEQ ID NO: 2761385 - RNA, 22 nt, Human
augauccagcagauuauucacu

SEQ ID NO: 2761386 - RNA, 14 nt, Human
augauuaaguaaug

SEQ ID NO: 2761387 - RNA, 18 nt, Human
augauuaaguaaugauaa

SEQ ID NO: 2761388 - RNA, 17 nt, Human
augccauuuaaagcuua

SEQ ID NO: 2761389 - RNA, 21 nt, Human
augccauuuaaagcuuauuaa

SEQ ID NO: 2761390 - RNA, 13 nt, Human
augcaguucugaa

SEQ ID NO: 2761391 - RNA, 21 nt, Human
uuuaaauaaauaaauagcuag

SEQ ID NO: 2761392 - RNA, 18 nt, Human
uuuaaauauaugcuaagu

SEQ ID NO: 2761393 - RNA, 15 nt, Human
uuugaaauauugacu

SEQ ID NO: 2761394 - RNA, 20 nt, Human
uuucuguacuuuuuggcaua

SEQ ID NO: 2761395 - RNA, 19 nt, Human
uuucuguacuuuuuggcau

SEQ ID NO: 2761396 - RNA, 20 nt, Human
augggauaaaugccaucaau

SEQ ID NO: 2761397 - RNA, 16 nt, Human
augggauaaaugccau

SEQ ID NO: 2761398 - RNA, 15 nt, Human
augggauaaaugcca

SEQ ID NO: 2761399 - RNA, 18 nt, Human
uuucucccagucauuuaa

SEQ ID NO: 2761400 - RNA, 17 nt, Human
uuucucccagucauuua

SEQ ID NO: 2761401 - RNA, 23 nt, Human
auguaaaucccauuauucaaagu

SEQ ID NO: 2761402 - RNA, 22 nt, Human
auguaaaucccauuauucaaag

SEQ ID NO: 2761403 - RNA, 20 nt, Human
auguaaaucccauuauucaa

SEQ ID NO: 2761404 - RNA, 14 nt, Human
auguaaaucccauu

SEQ ID NO: 2761405 - RNA, 21 nt, Human
augguucccuugaugaagaag

SEQ ID NO: 2761406 - RNA, 14 nt, Human
uuugcaagccagau

SEQ ID NO: 2761407 - RNA, 13 nt, Human
uuugcucauggaa

SEQ ID NO: 2761408 - RNA, 16 nt, Human
auguacuucaugcugu

SEQ ID NO: 2761409 - RNA, 19 nt, Human
auguagaggagaaacugga

SEQ ID NO: 2761410 - RNA, 17 nt, Human
auguagaggagaaacug

SEQ ID NO: 2761411 - RNA, 13 nt, Human
auguagaggagaa

SEQ ID NO: 2761412 - RNA, 12 nt, Human
auguagaggaga

SEQ ID NO: 2761413 - RNA, 20 nt, Human
uuuggcauaacauaaaucug

SEQ ID NO: 2761414 - RNA, 21 nt, Human
uuuggcauaacauaaaucugu

SEQ ID NO: 2761415 - RNA, 17 nt, Human
auguccacugguucuuc

SEQ ID NO: 2761416 - RNA, 16 nt, Human
auguccacugguucuu

SEQ ID NO: 2761417 - RNA, 19 nt, Human
uuugugcugguguaugugu

SEQ ID NO: 2761418 - RNA, 17 nt, Human
uuugugaagcaaaauuu

SEQ ID NO: 2761419 - RNA, 21 nt, Human
uuuguaguguuggagaagaac

SEQ ID NO: 2761420 - RNA, 19 nt, Human
uuuguaguguuggagaaga

SEQ ID NO: 2761421 - RNA, 17 nt, Human
uuuguaguguuggagaa

SEQ ID NO: 2761422 - RNA, 14 nt, Human
uucggccuccaucc

SEQ ID NO: 2761423 - RNA, 15 nt, Human
uucggccuccauccu

SEQ ID NO: 2761424 - RNA, 13 nt, Human
uucuaagaaguga

SEQ ID NO: 2761425 - RNA, 23 nt, Human
uucuaagaagugaaaaucuacac

SEQ ID NO: 2761426 - RNA, 15 nt, Human
uucuaaguaaaacca

SEQ ID NO: 2761427 - RNA, 16 nt, Human
uucuaaguaaaaccac

SEQ ID NO: 2761428 - RNA, 17 nt, Human
aucaggguuaguauugu

SEQ ID NO: 2761429 - RNA, 22 nt, Human
aucacuugucaauaaaauccau

SEQ ID NO: 2761430 - RNA, 22 nt, Human
aucaccugucuugccuuuuuca

SEQ ID NO: 2761431 - RNA, 23 nt, Human
aucaccugucuugccuuuuucau

SEQ ID NO: 2761432 - RNA, 14 nt, Human
aucaacagauaaau

SEQ ID NO: 2761433 - RNA, 18 nt, Human
auauuuuuuguuaaauga

SEQ ID NO: 2761434 - RNA, 20 nt, Human
auauuuuuuguuaaaugauu

SEQ ID NO: 2761435 - RNA, 19 nt, Human
uuccguagguuauuuucag

SEQ ID NO: 2761436 - RNA, 21 nt, Human
auccauuuggaaaucuuuaaa

SEQ ID NO: 2761437 - RNA, 20 nt, Human
auccauuuggaaaucuuuaa

SEQ ID NO: 2761438 - RNA, 12 nt, Human
uucucuaggaaa

SEQ ID NO: 2761439 - RNA, 14 nt, Human
uugaaauuguaauu

SEQ ID NO: 2761440 - RNA, 13 nt, Human
uugaaauuguaau

SEQ ID NO: 2761441 - RNA, 17 nt, Human
uugaaauuguauuacaa

SEQ ID NO: 2761442 - RNA, 17 nt, Human
uugaaauuguaauuaua

SEQ ID NO: 2761443 - RNA, 15 nt, Human
uugaaauuguaauua

SEQ ID NO: 2761444 - RNA, 18 nt, Human
uugaacccgggaggcaga

SEQ ID NO: 2761445 - RNA, 19 nt, Human
uugaacccgggaggcagag

SEQ ID NO: 2761446 - RNA, 13 nt, Human
uugcaucaauuuu

SEQ ID NO: 2761447 - RNA, 22 nt, Human
uugcaagccagauuuuccugaa

SEQ ID NO: 2761448 - RNA, 17 nt, Human
uugaagggaaauuucag

SEQ ID NO: 2761449 - RNA, 18 nt, Human
aucuacacuccagugaga

SEQ ID NO: 2761450 - RNA, 19 nt, Human
aucuacacuccagugagac

SEQ ID NO: 2761451 - RNA, 23 nt, Human
aucugccuaaggacuucuuuaau

SEQ ID NO: 2761452 - RNA, 22 nt, Human
aucugccuaaggacuucuuuaa

SEQ ID NO: 2761453 - RNA, 21 nt, Human
aucugccuaaggacuucuuua

SEQ ID NO: 2761454 - RNA, 11 nt, Human
aucugccuaag

SEQ ID NO: 2761455 - RNA, 16 nt, Human
augaauuacauuugua

SEQ ID NO: 2761456 - RNA, 15 nt, Human
augaauuacauuugu

SEQ ID NO: 2761457 - RNA, 15 nt, Human
augaauuaaguuuuu

SEQ ID NO: 2761458 - RNA, 23 nt, Human
augaauggcuaagcaaaauguga

SEQ ID NO: 2761459 - RNA, 15 nt, Human
uuagaauucuguaua

SEQ ID NO: 2761460 - RNA, 14 nt, Human
uuagaauucuguau

SEQ ID NO: 2761461 - RNA, 18 nt, Human
auaaaugccaucaauaaa

SEQ ID NO: 2761462 - RNA, 17 nt, Human
auaaaugccaucaauaa

SEQ ID NO: 2761463 - RNA, 19 nt, Human
auaaaucugugaacuugaa

SEQ ID NO: 2761464 - RNA, 16 nt, Human
auaaaucugugaacuu

SEQ ID NO: 2761465 - RNA, 15 nt, Human
auaaaucugugaacu

SEQ ID NO: 2761466 - RNA, 14 nt, Human
auaaucuuucacag

SEQ ID NO: 2761467 - RNA, 15 nt, Human
uuagggagagaagau

SEQ ID NO: 2761468 - RNA, 14 nt, Human
uuagggagagaaga

SEQ ID NO: 2761469 - RNA, 16 nt, Human
uuaggguuaugauuaa

SEQ ID NO: 2761470 - RNA, 14 nt, Human
uuaggguuaugauu

SEQ ID NO: 2761471 - RNA, 22 nt, Human
uuaaaccaugggauaaaugcca

SEQ ID NO: 2761472 - RNA, 21 nt, Human
uuaaaccaugggauaaaugcc

SEQ ID NO: 2761473 - RNA, 22 nt, Human
uuaaaguugaauuuauuggcuu

SEQ ID NO: 2761474 - RNA, 17 nt, Human
uuaaaguugaauuuauu

SEQ ID NO: 2761475 - RNA, 16 nt, Human
uuaaaguugaauuuau

SEQ ID NO: 2761476 - RNA, 13 nt, Human
uuaaaguugaauu

SEQ ID NO: 2761477 - RNA, 19 nt, Human
aguuugugcugguguaugu

SEQ ID NO: 2761478 - RNA, 17 nt, Human
uuaaaccaugggauaaa

SEQ ID NO: 2761479 - RNA, 22 nt, Human
uuaaaaucauuucugcaucagc

SEQ ID NO: 2761480 - RNA, 14 nt, Human
uuaaaaucauuucu

SEQ ID NO: 2761481 - RNA, 16 nt, Human
uuaaaaaauggaacau

SEQ ID NO: 2761482 - RNA, 19 nt, Human
uuaaaaaagaaacauuugg

SEQ ID NO: 2761483 - RNA, 15 nt, Human
aguuuagcuggaaaa

SEQ ID NO: 2761484 - RNA, 17 nt, Human
aguuuaaauuguaauag

SEQ ID NO: 2761485 - RNA, 20 nt, Human
aguuuaaauuguaauaggcg

SEQ ID NO: 2761486 - RNA, 13 nt, Human
uuaauuuuggaau

SEQ ID NO: 2761487 - RNA, 15 nt, Human
uuaauuuuggaauuu

SEQ ID NO: 2761488 - RNA, 14 nt, Human
uuaauuuuggaauu

SEQ ID NO: 2761489 - RNA, 18 nt, Human
aguuuuguuuggaccaaa

SEQ ID NO: 2761490 - RNA, 12 nt, Human
aguuuuguuugg

SEQ ID NO: 2761491 - RNA, 16 nt, Human
aguuuuguuuggacca

SEQ ID NO: 2761492 - RNA, 14 nt, Human
aguuuuguuuggac

SEQ ID NO: 2761493 - RNA, 16 nt, Human
aguuuuauaugcuucu

SEQ ID NO: 2761494 - RNA, 19 nt, Human
uuauucaaaguugccuaaa

SEQ ID NO: 2761495 - RNA, 15 nt, Human
uuauucaaaguugcc

SEQ ID NO: 2761496 - RNA, 13 nt, Human
uuauucaaaguug

SEQ ID NO: 2761497 - RNA, 14 nt, Human
uuauuauguaaauc

SEQ ID NO: 2761498 - RNA, 13 nt, Human
uuauuauguaaau

SEQ ID NO: 2761499 - RNA, 22 nt, Human
uuauuauguaaaucccauuauu

SEQ ID NO: 2761500 - RNA, 16 nt, Human
uuauuauguaaauccc

SEQ ID NO: 2761501 - RNA, 14 nt, Human
uuauucacugauuu

SEQ ID NO: 2761502 - RNA, 23 nt, Human
uuauuaugaaacuuguguaaaua

SEQ ID NO: 2761503 - RNA, 22 nt, Human
uuauuaugaaacuuguguaaau

SEQ ID NO: 2761504 - RNA, 21 nt, Human
uuauuaugaaacuuguguaaa

SEQ ID NO: 2761505 - RNA, 20 nt, Human
uuauuaugaaacuuguguaa

SEQ ID NO: 2761506 - RNA, 17 nt, Human
uuauuaugaaacuugug

SEQ ID NO: 2761507 - RNA, 11 nt, Human
uuauuaugaaa

SEQ ID NO: 2761508 - RNA, 15 nt, Human
uuauuauauuuacaa

SEQ ID NO: 2761509 - RNA, 14 nt, Human
uuauuauauuuaca

SEQ ID NO: 2761510 - RNA, 19 nt, Human
uuauguuaaaacugggaca

SEQ ID NO: 2761511 - RNA, 15 nt, Human
auacuggauuguacu

SEQ ID NO: 2761512 - RNA, 16 nt, Human
auacucauuaggaugg

SEQ ID NO: 2761513 - RNA, 21 nt, Human
auagauuagagaguguugaaa

SEQ ID NO: 2761514 - RNA, 16 nt, Human
auagauuagaauucug

SEQ ID NO: 2761515 - RNA, 15 nt, Human
auagauuagaauucu

SEQ ID NO: 2761516 - RNA, 13 nt, Human
auagauuagaauu

SEQ ID NO: 2761517 - RNA, 22 nt, Human
auagauuagagaguguugaaac

SEQ ID NO: 2761518 - RNA, 22 nt, Human
auagaggaagccugauuaaaga

SEQ ID NO: 2761519 - RNA, 21 nt, Human
auagaggaagccugauuaaag

SEQ ID NO: 2761520 - RNA, 18 nt, Human
auagauaggucagugcaa

SEQ ID NO: 2761521 - RNA, 17 nt, Human
auagaauuaacacauga

SEQ ID NO: 2761522 - RNA, 14 nt, Human
auagaaccucuuug

SEQ ID NO: 2761523 - RNA, 20 nt, Human
auagaaccucuuugucuaca

SEQ ID NO: 2761524 - RNA, 13 nt, Human
auagaaguaaaaa

SEQ ID NO: 2761525 - RNA, 16 nt, Human
uuaugugcgcugauaa

SEQ ID NO: 2761526 - RNA, 11 nt, Human
uuauguaaauc

SEQ ID NO: 2761527 - RNA, 13 nt, Human
uuauguaaauccc

SEQ ID NO: 2761528 - RNA, 12 nt, Human
uuauguaaaucc

SEQ ID NO: 2761529 - RNA, 23 nt, Human
uuauguaaaucccauuauucaaa

SEQ ID NO: 2761530 - RNA, 22 nt, Human
uuauguaaaucccauuauucaa

SEQ ID NO: 2761531 - RNA, 21 nt, Human
uuauguaaaucccauuauuca

SEQ ID NO: 2761532 - RNA, 19 nt, Human
uuauguaaaucccauuauu

SEQ ID NO: 2761533 - RNA, 23 nt, Human
uuaugauccagcagauuauucac

SEQ ID NO: 2761534 - RNA, 22 nt, Human
uuaugauccagcagauuauuca

SEQ ID NO: 2761535 - RNA, 19 nt, Human
uuaugauuaaguaaugaua

SEQ ID NO: 2761536 - RNA, 19 nt, Human
uuaugaaacuuguguaaau

SEQ ID NO: 2761537 - RNA, 13 nt, Human
uuaugaaacuugu

SEQ ID NO: 2761538 - RNA, 18 nt, Human
uuaugaaacuuguguaaa

SEQ ID NO: 2761539 - RNA, 16 nt, Human
uuaugaaacuugugua

SEQ ID NO: 2761540 - RNA, 18 nt, Human
uuaugauccagcagauua

SEQ ID NO: 2761541 - RNA, 13 nt, Human
uuaugauccagca

SEQ ID NO: 2761542 - RNA, 21 nt, Human
uuaugaauuacauuuguauaa

SEQ ID NO: 2761543 - RNA, 17 nt, Human
uuaugaauuacauuugu

SEQ ID NO: 2761544 - RNA, 16 nt, Human
uuaugaauuacauuug

SEQ ID NO: 2761545 - RNA, 14 nt, Human
uuaugaauuacauu

SEQ ID NO: 2761546 - RNA, 22 nt, Human
auaccacaggaaccacaagacu

SEQ ID NO: 2761547 - RNA, 19 nt, Human
uuauauuugaaauauugac

SEQ ID NO: 2761548 - RNA, 15 nt, Human
uuauauuugaaauau

SEQ ID NO: 2761549 - RNA, 17 nt, Human
auacuauggaauuucuc

SEQ ID NO: 2761550 - RNA, 20 nt, Human
ugugcugguguaugugugaa

SEQ ID NO: 2761551 - RNA, 19 nt, Human
ugugcugggguuaucugaa

SEQ ID NO: 2761552 - RNA, 20 nt, Human
agugaguuggguguauugug

SEQ ID NO: 2761553 - RNA, 21 nt, Human
agugaguuggguguauugugc

SEQ ID NO: 2761554 - RNA, 22 nt, Human
agugcaaauugucacaggacag

SEQ ID NO: 2761555 - RNA, 16 nt, Human
agucuugucucagauu

SEQ ID NO: 2761556 - RNA, 19 nt, Human
agucuugucucagauuuua

SEQ ID NO: 2761557 - RNA, 17 nt, Human
agucuugucucagauuu

SEQ ID NO: 2761558 - RNA, 23 nt, Human
agugaacaaauuuacagagacag

SEQ ID NO: 2761559 - RNA, 22 nt, Human
agugaacaaauuuacagagaca

SEQ ID NO: 2761560 - RNA, 21 nt, Human
agucuugucucagauuuuauu

SEQ ID NO: 2761561 - RNA, 20 nt, Human
agucuugucucagauuuuau

SEQ ID NO: 2761562 - RNA, 16 nt, Human
agucuuucacauuuaa

SEQ ID NO: 2761563 - RNA, 21 nt, Human
agugaacaaauuuacagagac

SEQ ID NO: 2761564 - RNA, 16 nt, Human
uguguuagagauuuuu

SEQ ID NO: 2761565 - RNA, 22 nt, Human
uguugcccacagcuguaugauu

SEQ ID NO: 2761566 - RNA, 15 nt, Human
uguucuaagaaguga

SEQ ID NO: 2761567 - RNA, 23 nt, Human
aguguuggagaagaacugaaauc

SEQ ID NO: 2761568 - RNA, 13 nt, Human
aguaauuggaaag

SEQ ID NO: 2761569 - RNA, 12 nt, Human
aguaauuggaaa

SEQ ID NO: 2761570 - RNA, 16 nt, Human
aguaaaaccacagcag

SEQ ID NO: 2761571 - RNA, 17 nt, Human
aguaaaaccacagcagu

SEQ ID NO: 2761572 - RNA, 19 nt, Human
aguaaaaccacagcaguug

SEQ ID NO: 2761573 - RNA, 20 nt, Human
aguaaaaccacagcaguuga

SEQ ID NO: 2761574 - RNA, 16 nt, Human
uguaguguuggagaag

SEQ ID NO: 2761575 - RNA, 18 nt, Human
uguaguguuggagaagaa

SEQ ID NO: 2761576 - RNA, 17 nt, Human
uguaguguuggagaaga

SEQ ID NO: 2761577 - RNA, 13 nt, Human
uguaagggaaacu

SEQ ID NO: 2761578 - RNA, 18 nt, Human
uguaagggaaacugccag

SEQ ID NO: 2761579 - RNA, 19 nt, Human
uguaagggaaacugccagc

SEQ ID NO: 2761580 - RNA, 14 nt, Human
agguugcagugagc

SEQ ID NO: 2761581 - RNA, 16 nt, Human
aggugcuacaaaaaca

SEQ ID NO: 2761582 - RNA, 13 nt, Human
agucucaggaaau

SEQ ID NO: 2761583 - RNA, 14 nt, Human
agucaggaaagaga

SEQ ID NO: 2761584 - RNA, 23 nt, Human
aguauaauuaacauguuaaacca

SEQ ID NO: 2761585 - RNA, 16 nt, Human
aguauaauuaacaugu

SEQ ID NO: 2761586 - RNA, 14 nt, Human
aguauaauuaacau

SEQ ID NO: 2761587 - RNA, 13 nt, Human
aguauaauuaaca

SEQ ID NO: 2761588 - RNA, 14 nt, Human
aguauuaagcauau

SEQ ID NO: 2761589 - RNA, 12 nt, Human
aguauuaagcau

SEQ ID NO: 2761590 - RNA, 19 nt, Human
ugggaggcugagaugggag

SEQ ID NO: 2761591 - RNA, 13 nt, Human
agggagagaagau

SEQ ID NO: 2761592 - RNA, 14 nt, Human
agggagagaagaua

SEQ ID NO: 2761593 - RNA, 23 nt, Human
agggacuucugucuucacaacag

SEQ ID NO: 2761594 - RNA, 22 nt, Human
agggcuguuauaaucuuucaca

SEQ ID NO: 2761595 - RNA, 20 nt, Human
ugggaacccaaguccaagca

SEQ ID NO: 2761596 - RNA, 16 nt, Human
agggaaacugccagca

SEQ ID NO: 2761597 - RNA, 19 nt, Human
agggaaacugccagcaacg

SEQ ID NO: 2761598 - RNA, 21 nt, Human
agggaaacugccagcaacgca

SEQ ID NO: 2761599 - RNA, 23 nt, Human
agggaaacugccagcaacgcagg

SEQ ID NO: 2761600 - RNA, 14 nt, Human
agggaaacugccag

SEQ ID NO: 2761601 - RNA, 15 nt, Human
agggaaacugccagc

SEQ ID NO: 2761602 - RNA, 14 nt, Human
ugggaaagcauugu

SEQ ID NO: 2761603 - RNA, 16 nt, Human
ugggaaagcauuguaa

SEQ ID NO: 2761604 - RNA, 17 nt, Human
ugggaaagcauuguaaa

SEQ ID NO: 2761605 - RNA, 18 nt, Human
ugggaaagcauuguaaau

SEQ ID NO: 2761606 - RNA, 18 nt, Human
ugggaaacaaaaggauaa

SEQ ID NO: 2761607 - RNA, 23 nt, Human
uggcuauaggugcuacaaaaaca

SEQ ID NO: 2761608 - RNA, 18 nt, Human
uggcuaagcaaaauguga

SEQ ID NO: 2761609 - RNA, 15 nt, Human
uggcuauaggugcua

SEQ ID NO: 2761610 - RNA, 19 nt, Human
uggcuauaggugcuacaaa

SEQ ID NO: 2761611 - RNA, 22 nt, Human
aggcuccacuuggucugugaga

SEQ ID NO: 2761612 - RNA, 21 nt, Human
aggcuccacuuggucugugag

SEQ ID NO: 2761613 - RNA, 17 nt, Human
aggcuccacuuggucug

SEQ ID NO: 2761614 - RNA, 11 nt, Human
aggcuccacuu

SEQ ID NO: 2761615 - RNA, 21 nt, Human
uggaauuuuccuccuuucucu

SEQ ID NO: 2761616 - RNA, 17 nt, Human
uggaauuuuccuccuuu

SEQ ID NO: 2761617 - RNA, 23 nt, Human
uggagccugcacggugaauggcu

SEQ ID NO: 2761618 - RNA, 21 nt, Human
uggagcucgugggacagucac

SEQ ID NO: 2761619 - RNA, 14 nt, Human
uggagaagaacuga

SEQ ID NO: 2761620 - RNA, 16 nt, Human
uggagaagaacugaaa

SEQ ID NO: 2761621 - RNA, 13 nt, Human
aggaaauauuuau

SEQ ID NO: 2761622 - RNA, 18 nt, Human
aggaaauauuuauuuuaa

SEQ ID NO: 2761623 - RNA, 14 nt, Human
aggaaauauuuauu

SEQ ID NO: 2761624 - RNA, 15 nt, Human
aggaauucuguauag

SEQ ID NO: 2761625 - RNA, 16 nt, Human
aggaauucuguauaga

SEQ ID NO: 2761626 - RNA, 22 nt, Human
aggaauucuguauagauuagaa

SEQ ID NO: 2761627 - RNA, 17 nt, Human
aggaauucuguauagau

SEQ ID NO: 2761628 - RNA, 23 nt, Human
aggaauucuguauagauuagaau

SEQ ID NO: 2761629 - RNA, 19 nt, Human
aggaauugacccacaagaa

SEQ ID NO: 2761630 - RNA, 21 nt, Human
agcuuauugucuagugaaacu

SEQ ID NO: 2761631 - RNA, 20 nt, Human
agcuuauuaaaacucauuuu

SEQ ID NO: 2761632 - RNA, 15 nt, Human
agcuuauuaaaacuc

SEQ ID NO: 2761633 - RNA, 21 nt, Human
aggaaaaguuuaauauuaaag

SEQ ID NO: 2761634 - RNA, 24 nt, Human
aggaaaaguuuaauauuaaagcca

SEQ ID NO: 2761635 - RNA, 23 nt, Human
aggaaaaguuuaauauuaaagcc

SEQ ID NO: 2761636 - RNA, 19 nt, Human
aggaaagagaacuuccaga

SEQ ID NO: 2761637 - RNA, 13 nt, Human
aggaaagagaacu

SEQ ID NO: 2761638 - RNA, 14 nt, Human
ugcuaguaauugga

SEQ ID NO: 2761639 - RNA, 16 nt, Human
ugcuaguaauuggaaa

SEQ ID NO: 2761640 - RNA, 21 nt, Human
ugccuuuuucauuauuuuauu

SEQ ID NO: 2761641 - RNA, 17 nt, Human
ugccuuuuucauuauuu

SEQ ID NO: 2761642 - RNA, 16 nt, Human
ugccuuuuucauuauu

SEQ ID NO: 2761643 - RNA, 15 nt, Human
ugccuuuuucauuau

SEQ ID NO: 2761644 - RNA, 14 nt, Human
ugccuuuuucauua

SEQ ID NO: 2761645 - RNA, 13 nt, Human
ugccuuuuucauu

SEQ ID NO: 2761646 - RNA, 23 nt, Human
agcugccuccccuccucugcuug

SEQ ID NO: 2761647 - RNA, 22 nt, Human
agcugccuccccuccucugcuu

SEQ ID NO: 2761648 - RNA, 21 nt, Human
agcugccuccccuccucugcu

SEQ ID NO: 2761649 - RNA, 20 nt, Human
agcugccuccccuccucugc

SEQ ID NO: 2761650 - RNA, 19 nt, Human
agcugccuccccuccucug

SEQ ID NO: 2761651 - RNA, 18 nt, Human
agcugccuccccuccucu

SEQ ID NO: 2761652 - RNA, 17 nt, Human
agcugccuccccuccuc

SEQ ID NO: 2761653 - RNA, 13 nt, Human
agcuggaaaagua

SEQ ID NO: 2761654 - RNA, 14 nt, Human
agccugauuaaaga

SEQ ID NO: 2761655 - RNA, 18 nt, Human
agccugcacggugaaugg

SEQ ID NO: 2761656 - RNA, 16 nt, Human
agccugcacggugaau

SEQ ID NO: 2761657 - RNA, 14 nt, Human
ugcagugagccgag

SEQ ID NO: 2761658 - RNA, 18 nt, Human
agccugagcgacagugag

SEQ ID NO: 2761659 - RNA, 17 nt, Human
agcccuucuuuccacag

SEQ ID NO: 2761660 - RNA, 19 nt, Human
agcccuucuuuccacagaa

SEQ ID NO: 2761661 - RNA, 18 nt, Human
agcccuucuuuccacaga

SEQ ID NO: 2761662 - RNA, 19 nt, Human
agcuacuaauuuuaaaaug

SEQ ID NO: 2761663 - RNA, 17 nt, Human
ucuguauagauuagaau

SEQ ID NO: 2761664 - RNA, 16 nt, Human
ucuguauagauuagag

SEQ ID NO: 2761665 - RNA, 18 nt, Human
ucuguuuuauaauuuugu

SEQ ID NO: 2761666 - RNA, 18 nt, Human
ucuuaauuaaaagaauau

SEQ ID NO: 2761667 - RNA, 21 nt, Human
ucuuaauuaaaagaauauuuu

SEQ ID NO: 2761668 - RNA, 14 nt, Human
ucuuaauuaaaaga

SEQ ID NO: 2761669 - RNA, 14 nt, Human
agacuggcacaguu

SEQ ID NO: 2761670 - RNA, 15 nt, Human
agacuggcacaguuu

SEQ ID NO: 2761671 - RNA, 17 nt, Human
agagacacacugaagaa

SEQ ID NO: 2761672 - RNA, 15 nt, Human
agagaaugagagaca

SEQ ID NO: 2761673 - RNA, 20 nt, Human
agagacacacugaagaagca

SEQ ID NO: 2761674 - RNA, 18 nt, Human
agagacacacugaagaag

SEQ ID NO: 2761675 - RNA, 18 nt, Human
ucuuuaauuuuggaauuu

SEQ ID NO: 2761676 - RNA, 17 nt, Human
ucuuuaauuuuggaauu

SEQ ID NO: 2761677 - RNA, 16 nt, Human
ucuuuaauuuuggaau

SEQ ID NO: 2761678 - RNA, 15 nt, Human
ucuuuaauuuuggaa

SEQ ID NO: 2761679 - RNA, 14 nt, Human
ucuuuaauuuugga

SEQ ID NO: 2761680 - RNA, 17 nt, Human
ucuuuaaaauacacacu

SEQ ID NO: 2761681 - RNA, 13 nt, Human
ucuuuaauuuugg

SEQ ID NO: 2761682 - RNA, 21 nt, Human
ucuuuaaagggauggcaagau

SEQ ID NO: 2761683 - RNA, 16 nt, Human
agacuccaaagaaaug

SEQ ID NO: 2761684 - RNA, 19 nt, Human
agacuccaaagaaauguaa

SEQ ID NO: 2761685 - RNA, 16 nt, Human
agacuauucaaacagu

SEQ ID NO: 2761686 - RNA, 13 nt, Human
agacuccaaagaa

SEQ ID NO: 2761687 - RNA, 14 nt, Human
agacuccaaagaaa

SEQ ID NO: 2761688 - RNA, 12 nt, Human
agacuccaaaga

SEQ ID NO: 2761689 - RNA, 18 nt, Human
agacuauucaaacagucu

SEQ ID NO: 2761690 - RNA, 20 nt, Human
agacuauucaaacagucuca

SEQ ID NO: 2761691 - RNA, 21 nt, Human
agacuauucaaacagucucag

SEQ ID NO: 2761692 - RNA, 19 nt, Human
agaaagacuauucaaacag

SEQ ID NO: 2761693 - RNA, 18 nt, Human
agaaagacuauucaaaca

SEQ ID NO: 2761694 - RNA, 20 nt, Human
agaaagacuauucaaacagu

SEQ ID NO: 2761695 - RNA, 23 nt, Human
agaaagacuauucaaacagucuc

SEQ ID NO: 2761696 - RNA, 21 nt, Human
ucugacuguuuccaucaaggg

SEQ ID NO: 2761697 - RNA, 14 nt, Human
ucugagaaagacua

SEQ ID NO: 2761698 - RNA, 15 nt, Human
ucugagaaagacuau

SEQ ID NO: 2761699 - RNA, 19 nt, Human
ucugagaaagacuauucaa

SEQ ID NO: 2761700 - RNA, 20 nt, Human
ucugagaaagacuauucaaa

SEQ ID NO: 2761701 - RNA, 23 nt, Human
ucugagaaagacuauucaaacag

SEQ ID NO: 2761702 - RNA, 21 nt, Human
ucugagaaagacuauucaaac

SEQ ID NO: 2761703 - RNA, 22 nt, Human
ucugagaaagacuauucaaaca

SEQ ID NO: 2761704 - RNA, 14 nt, Human
agaacucccuuuca

SEQ ID NO: 2761705 - RNA, 13 nt, Human
ucugccuaaggac

SEQ ID NO: 2761706 - RNA, 16 nt, Human
ucugccuaaggacuuc

SEQ ID NO: 2761707 - RNA, 15 nt, Human
ucugccuaaggacuu

SEQ ID NO: 2761708 - RNA, 14 nt, Human
ucugccuaaggacu

SEQ ID NO: 2761709 - RNA, 21 nt, Human
agaagaacugaaaucauacuu

SEQ ID NO: 2761710 - RNA, 11 nt, Human
ucugcuugcca

SEQ ID NO: 2761711 - RNA, 12 nt, Human
ucugcuugccau

SEQ ID NO: 2761712 - RNA, 19 nt, Human
ucuccauuuaauaauuaua

SEQ ID NO: 2761713 - RNA, 16 nt, Human
ucuccauuuaauaauu

SEQ ID NO: 2761714 - RNA, 12 nt, Human
ucuccauuuaau

SEQ ID NO: 2761715 - RNA, 15 nt, Human
ucucccagucauuua

SEQ ID NO: 2761716 - RNA, 23 nt, Human
acuuguguaaauacaauuuuguu

SEQ ID NO: 2761717 - RNA, 13 nt, Human
acuuguguaaaua

SEQ ID NO: 2761718 - RNA, 22 nt, Human
acuuguguaaauacaauuuugu

SEQ ID NO: 2761719 - RNA, 21 nt, Human
acuuguguaaauacaauuuug

SEQ ID NO: 2761720 - RNA, 22 nt, Human
acuuuuuauggcacuaguauuu

SEQ ID NO: 2761721 - RNA, 16 nt, Human
agaaaacaaggaugaa

SEQ ID NO: 2761722 - RNA, 19 nt, Human
agaaaacaaggaugaauua

SEQ ID NO: 2761723 - RNA, 15 nt, Human
agaaacauuugguaa

SEQ ID NO: 2761724 - RNA, 14 nt, Human
agaaagaaaaucag

SEQ ID NO: 2761725 - RNA, 13 nt, Human
agaaacuggaacu

SEQ ID NO: 2761726 - RNA, 13 nt, Human
ucucuucuuuaaa

SEQ ID NO: 2761727 - RNA, 12 nt, Human
ucucuucuuuaa

SEQ ID NO: 2761728 - RNA, 13 nt, Human
ucucuggccuucg

SEQ ID NO: 2761729 - RNA, 17 nt, Human
ucucuggccuucggccu

SEQ ID NO: 2761730 - RNA, 16 nt, Human
ucucuggccuucggcc

SEQ ID NO: 2761731 - RNA, 23 nt, Human
agcaaaaauauuuuaugauccag

SEQ ID NO: 2761732 - RNA, 19 nt, Human
agcaaaaauauuuuaugau

SEQ ID NO: 2761733 - RNA, 18 nt, Human
agcaaaaauauuuuauga

SEQ ID NO: 2761734 - RNA, 17 nt, Human
agcaaaaauauuuuaug

SEQ ID NO: 2761735 - RNA, 15 nt, Human
agcaaaaauauuuua

SEQ ID NO: 2761736 - RNA, 22 nt, Human
agauuuuauuauguaaauccca

SEQ ID NO: 2761737 - RNA, 20 nt, Human
agauuuuauuauguaaaucc

SEQ ID NO: 2761738 - RNA, 21 nt, Human
agauuuuauuauguaaauccc

SEQ ID NO: 2761739 - RNA, 16 nt, Human
agauuuaccacuugug

SEQ ID NO: 2761740 - RNA, 16 nt, Human
agauugugccccugca

SEQ ID NO: 2761741 - RNA, 16 nt, Human
agauuauucacugauu

SEQ ID NO: 2761742 - RNA, 15 nt, Human
ugacuguuuccauca

SEQ ID NO: 2761743 - RNA, 12 nt, Human
ugaauuuauugg

SEQ ID NO: 2761744 - RNA, 16 nt, Human
ugaauuuauuggcuuu

SEQ ID NO: 2761745 - RNA, 15 nt, Human
ugaauuuauuggcuu

SEQ ID NO: 2761746 - RNA, 14 nt, Human
agauccuggaaauc

SEQ ID NO: 2761747 - RNA, 19 nt, Human
agaugaugaugaucuuuaa

SEQ ID NO: 2761748 - RNA, 22 nt, Human
agaugcuagaacucccuuucaa

SEQ ID NO: 2761749 - RNA, 23 nt, Human
agaugcuagaacucccuuucaac

SEQ ID NO: 2761750 - RNA, 20 nt, Human
ugaagaagcaccaaucauga

SEQ ID NO: 2761751 - RNA, 14 nt, Human
ugaagaagauggua

SEQ ID NO: 2761752 - RNA, 17 nt, Human
ugaagauguagaggaga

SEQ ID NO: 2761753 - RNA, 18 nt, Human
ugaagauguagaggagaa

SEQ ID NO: 2761754 - RNA, 14 nt, Human
agagugaacaaauu

SEQ ID NO: 2761755 - RNA, 22 nt, Human
agagugaacaaauuuacagaga

SEQ ID NO: 2761756 - RNA, 16 nt, Human
ugagcuacaaaugcau

SEQ ID NO: 2761757 - RNA, 13 nt, Human
ugagcuacaaaug

SEQ ID NO: 2761758 - RNA, 14 nt, Human
ugagcuacaaaugc

SEQ ID NO: 2761759 - RNA, 14 nt, Human
ugaggaauucugua

SEQ ID NO: 2761760 - RNA, 16 nt, Human
ugaggaauucuguaua

SEQ ID NO: 2761761 - RNA, 15 nt, Human
ugaggaauucuguau

SEQ ID NO: 2761762 - RNA, 19 nt, Human
ugaggaauucuguauagau

SEQ ID NO: 2761763 - RNA, 18 nt, Human
ugaggaauucuguauaga

SEQ ID NO: 2761764 - RNA, 15 nt, Human
ugaggacacugauau

SEQ ID NO: 2761765 - RNA, 20 nt, Human
agcagauuauucacugauuu

SEQ ID NO: 2761766 - RNA, 19 nt, Human
agcagauuauucacugauu

SEQ ID NO: 2761767 - RNA, 14 nt, Human
agcagauuauucac

SEQ ID NO: 2761768 - RNA, 16 nt, Human
agcagauuauucacug

SEQ ID NO: 2761769 - RNA, 15 nt, Human
agcagauuauucacu

SEQ ID NO: 2761770 - RNA, 17 nt, Human
ugagguacugagaguga

SEQ ID NO: 2761771 - RNA, 22 nt, Human
ugagguacugagagugaacaaa

SEQ ID NO: 2761772 - RNA, 20 nt, Human
ugagcgacagugagacucug

SEQ ID NO: 2761773 - RNA, 16 nt, Human
ugagcgacagugagac

SEQ ID NO: 2761774 - RNA, 14 nt, Human
ugagcgacagugag

SEQ ID NO: 2761775 - RNA, 13 nt, Human
ugagcgacaguga

SEQ ID NO: 2761776 - RNA, 14 nt, Human
agcagaacagugau

SEQ ID NO: 2761777 - RNA, 14 nt, Human
agcaacgcaggccc

SEQ ID NO: 2761778 - RNA, 22 nt, Human
agcacagccucuuagaugcagu

SEQ ID NO: 2761779 - RNA, 16 nt, Human
agcaccaaucaugaau

SEQ ID NO: 2761780 - RNA, 23 nt, Human
accacuuguguuuugcaagccag

SEQ ID NO: 2761781 - RNA, 19 nt, Human
accacuuguguuuugcaag

SEQ ID NO: 2761782 - RNA, 13 nt, Human
accacugcagaag

SEQ ID NO: 2761783 - RNA, 19 nt, Human
accacugcagaagacagua

SEQ ID NO: 2761784 - RNA, 14 nt, Human
accacugcagaaga

SEQ ID NO: 2761785 - RNA, 11 nt, Human
accacagcagu

SEQ ID NO: 2761786 - RNA, 12 nt, Human
uauuucauuucu

SEQ ID NO: 2761787 - RNA, 18 nt, Human
acccaaaaggcagaagca

SEQ ID NO: 2761788 - RNA, 21 nt, Human
acccaaauguucaucaaugaa

SEQ ID NO: 2761789 - RNA, 15 nt, Human
acccaaaaggcagaa

SEQ ID NO: 2761790 - RNA, 13 nt, Human
acccaaaaggcag

SEQ ID NO: 2761791 - RNA, 20 nt, Human
ucagauuuuauuauguaaau

SEQ ID NO: 2761792 - RNA, 19 nt, Human
ucagauuuuauuauguaaa

SEQ ID NO: 2761793 - RNA, 16 nt, Human
ucagauuuuauuaugu

SEQ ID NO: 2761794 - RNA, 21 nt, Human
ucagaucugccuaaggacuuc

SEQ ID NO: 2761795 - RNA, 13 nt, Human
ucagauuuuauua

SEQ ID NO: 2761796 - RNA, 15 nt, Human
ucagauuuuauuaug

SEQ ID NO: 2761797 - RNA, 14 nt, Human
ucagauuuuauuau

SEQ ID NO: 2761798 - RNA, 21 nt, Human
ucaugaauuaguuuuauaugc

SEQ ID NO: 2761799 - RNA, 22 nt, Human
ucaugaauuaguuuuauaugcu

SEQ ID NO: 2761800 - RNA, 21 nt, Human
uccagccugagcgacagugag

SEQ ID NO: 2761801 - RNA, 20 nt, Human
uccagccugagcgacaguga

SEQ ID NO: 2761802 - RNA, 22 nt, Human
acugaggggaggggagcauggg

SEQ ID NO: 2761803 - RNA, 17 nt, Human
acugaggggaggggagc

SEQ ID NO: 2761804 - RNA, 17 nt, Human
uccugggcagcugccuc

SEQ ID NO: 2761805 - RNA, 16 nt, Human
uccugggcagcugccu

SEQ ID NO: 2761806 - RNA, 15 nt, Human
uccugggcagcugcc

SEQ ID NO: 2761807 - RNA, 14 nt, Human
uccugggcagcugc

SEQ ID NO: 2761808 - RNA, 23 nt, Human
uccugggcagcugccuccccucc

SEQ ID NO: 2761809 - RNA, 22 nt, Human
uccugggcagcugccuccccuc

SEQ ID NO: 2761810 - RNA, 19 nt, Human
uccugggcagcugccuccc

SEQ ID NO: 2761811 - RNA, 18 nt, Human
uccugggcagcugccucc

SEQ ID NO: 2761812 - RNA, 16 nt, Human
acuggauuguacuuug

SEQ ID NO: 2761813 - RNA, 13 nt, Human
acuggauuguacu

SEQ ID NO: 2761814 - RNA, 22 nt, Human
acugccuucucaacuccaaacu

SEQ ID NO: 2761815 - RNA, 20 nt, Human
acugccuucucaacuccaaa

SEQ ID NO: 2761816 - RNA, 21 nt, Human
acuggcacaguuuucugagaa

SEQ ID NO: 2761817 - RNA, 22 nt, Human
acuggcacaguuuucugagaaa

SEQ ID NO: 2761818 - RNA, 13 nt, Human
uccuucagccuga

SEQ ID NO: 2761819 - RNA, 13 nt, Human
acuaaaaauacaa

SEQ ID NO: 2761820 - RNA, 12 nt, Human
uccccuccucug

SEQ ID NO: 2761821 - RNA, 15 nt, Human
uccgugcuaaggacu

SEQ ID NO: 2761822 - RNA, 14 nt, Human
uccgugcuaaggac

SEQ ID NO: 2761823 - RNA, 22 nt, Human
acucuccauuuaauaauuauau

SEQ ID NO: 2761824 - RNA, 20 nt, Human
uccucaaaacuucagacaua

SEQ ID NO: 2761825 - RNA, 22 nt, Human
uauaaaauaauuuuuauauuug

SEQ ID NO: 2761826 - RNA, 21 nt, Human
uauaaaauaauuuuuauauuu

SEQ ID NO: 2761827 - RNA, 22 nt, Human
acacaucagcuugcccuguuaa

SEQ ID NO: 2761828 - RNA, 22 nt, Human
uagugagcagucaggaaagaga

SEQ ID NO: 2761829 - RNA, 16 nt, Human
uaguuuuauaugcuuc

SEQ ID NO: 2761830 - RNA, 15 nt, Human
uaguuuuauaugcuu

SEQ ID NO: 2761831 - RNA, 19 nt, Human
uauagauuagaauucugua

SEQ ID NO: 2761832 - RNA, 20 nt, Human
uauagauuagaauucuguau

SEQ ID NO: 2761833 - RNA, 22 nt, Human
uauagauuagagaguguugaaa

SEQ ID NO: 2761834 - RNA, 19 nt, Human
uauagauuagagaguguug

SEQ ID NO: 2761835 - RNA, 14 nt, Human
uauaauuuugugaa

SEQ ID NO: 2761836 - RNA, 18 nt, Human
uauaacaaugcuguauuu

SEQ ID NO: 2761837 - RNA, 21 nt, Human
uauaggugcuacaaaaacaca

SEQ ID NO: 2761838 - RNA, 20 nt, Human
uauaggugcuacaaaaacac

SEQ ID NO: 2761839 - RNA, 23 nt, Human
uauaggugcuacaaaaacacagc

SEQ ID NO: 2761840 - RNA, 13 nt, Human
uauaggaauugac

SEQ ID NO: 2761841 - RNA, 14 nt, Human
uauaggaauugacc

SEQ ID NO: 2761842 - RNA, 10 nt, Human
uaugauccag

SEQ ID NO: 2761843 - RNA, 19 nt, Human
uaugauccagcagauuauu

SEQ ID NO: 2761844 - RNA, 11 nt, Human
uaugauccagc

SEQ ID NO: 2761845 - RNA, 22 nt, Human
uaugauccagcagauuauucac

SEQ ID NO: 2761846 - RNA, 21 nt, Human
uaugauccagcagauuauuca

SEQ ID NO: 2761847 - RNA, 20 nt, Human
uaugauccagcagauuauuc

SEQ ID NO: 2761848 - RNA, 16 nt, Human
uauggcuauaggugcu

SEQ ID NO: 2761849 - RNA, 17 nt, Human
uauggcuauaggugcua

SEQ ID NO: 2761850 - RNA, 20 nt, Human
uaucaccugucuugccuuuu

SEQ ID NO: 2761851 - RNA, 14 nt, Human
uauauuuacaaaug

SEQ ID NO: 2761852 - RNA, 15 nt, Human
uauauuuacaaaugg

SEQ ID NO: 2761853 - RNA, 21 nt, Human
acaguauaauuaacauguuaa

SEQ ID NO: 2761854 - RNA, 23 nt, Human
acaguauaauuaacauguuaaac

SEQ ID NO: 2761855 - RNA, 21 nt, Human
acaguauggcagcuuuccuca

SEQ ID NO: 2761856 - RNA, 21 nt, Human
acaguuaccucugccucagaa

SEQ ID NO: 2761857 - RNA, 18 nt, Human
acagugagacucugucuc

SEQ ID NO: 2761858 - RNA, 14 nt, Human
acagugagacucug

SEQ ID NO: 2761859 - RNA, 17 nt, Human
acagucucaggaaauca

SEQ ID NO: 2761860 - RNA, 20 nt, Human
acagugaaagaaaauaacaa

SEQ ID NO: 2761861 - RNA, 13 nt, Human
acagucucaggaa

SEQ ID NO: 2761862 - RNA, 14 nt, Human
acagucucaggaaa

SEQ ID NO: 2761863 - RNA, 15 nt, Human
acagucucaggaaau

SEQ ID NO: 2761864 - RNA, 16 nt, Human
acagucucaggaaauc

SEQ ID NO: 2761865 - RNA, 20 nt, Human
acagcuggugcccugcuuuc

SEQ ID NO: 2761866 - RNA, 17 nt, Human
acagcuggugcccugcu

SEQ ID NO: 2761867 - RNA, 20 nt, Human
uauuaaagccauguuuauua

SEQ ID NO: 2761868 - RNA, 18 nt, Human
uauuaaagccauguuuau

SEQ ID NO: 2761869 - RNA, 17 nt, Human
uauuaaagccauguuua

SEQ ID NO: 2761870 - RNA, 14 nt, Human
uauuacaguauaau

SEQ ID NO: 2761871 - RNA, 21 nt, Human
uauuacaguauaauuaacaug

SEQ ID NO: 2761872 - RNA, 20 nt, Human
uauuacaguauaauuaacau

SEQ ID NO: 2761873 - RNA, 18 nt, Human
uauuacaguauaauuaac

SEQ ID NO: 2761874 - RNA, 16 nt, Human
uauuacaguauaauua

SEQ ID NO: 2761875 - RNA, 12 nt, Human
uauuaaagccau

SEQ ID NO: 2761876 - RNA, 14 nt, Human
uauuaaagccaugu

SEQ ID NO: 2761877 - RNA, 13 nt, Human
uauuaaagccaug

SEQ ID NO: 2761878 - RNA, 12 nt, Human
uauuaaaacuca

SEQ ID NO: 2761879 - RNA, 15 nt, Human
uauuagaauaccaca

SEQ ID NO: 2761880 - RNA, 13 nt, Human
uauucacugauuu

SEQ ID NO: 2761881 - RNA, 22 nt, Human
uauucacugauuugacauaguc

SEQ ID NO: 2761882 - RNA, 19 nt, Human
uauucacugauuugacaua

SEQ ID NO: 2761883 - RNA, 23 nt, Human
uauucaaaguugccuaaauccau

SEQ ID NO: 2761884 - RNA, 18 nt, Human
uauucaaaguugccuaaa

SEQ ID NO: 2761885 - RNA, 22 nt, Human
uauucaaaguugccuaaaucca

SEQ ID NO: 2761886 - RNA, 21 nt, Human
uauucaaaguugccuaaaucc

SEQ ID NO: 2761887 - RNA, 23 nt, Human
uauucauagcagcuuauucacaa

SEQ ID NO: 2761888 - RNA, 14 nt, Human
uauuggcuuuucug

SEQ ID NO: 2761889 - RNA, 18 nt, Human
uauuggcuuuucugaucc

SEQ ID NO: 2761890 - RNA, 17 nt, Human
uauuggcuuuucugauc

SEQ ID NO: 2761891 - RNA, 16 nt, Human
uauuggcuuuucugau

SEQ ID NO: 2761892 - RNA, 15 nt, Human
uauuggcuuuucuga

SEQ ID NO: 2761893 - RNA, 22 nt, Human
uauuggcuuuucugauccaguu

SEQ ID NO: 2761894 - RNA, 21 nt, Human
uauuggcuuuucugauccagu

SEQ ID NO: 2761895 - RNA, 19 nt, Human
acaguucggugagcuacaa

SEQ ID NO: 2761896 - RNA, 22 nt, Human
acaguucggugagcuacaaaug

SEQ ID NO: 2761897 - RNA, 23 nt, Human
acaguucggugagcuacaaaugc

SEQ ID NO: 2761898 - RNA, 23 nt, Human
uauuguacaaaguauuaagcaua

SEQ ID NO: 2761899 - RNA, 22 nt, Human
uauuguacaaaguauuaagcau

SEQ ID NO: 2761900 - RNA, 21 nt, Human
uauuguacaaaguauuaagca

SEQ ID NO: 2761901 - RNA, 16 nt, Human
uauuguacaaaguauu

SEQ ID NO: 2761902 - RNA, 15 nt, Human
uauuguacaaaguau

SEQ ID NO: 2761903 - RNA, 17 nt, Human
uauugucuagugaaacu

SEQ ID NO: 2761904 - RNA, 18 nt, Human
uauuuacuaaaauggacu

SEQ ID NO: 2761905 - RNA, 18 nt, Human
uauuuauuuuaauaaugu

SEQ ID NO: 2761906 - RNA, 16 nt, Human
uauuuauuuuaauaau

SEQ ID NO: 2761907 - RNA, 14 nt, Human
uauuuauuuuaaua

SEQ ID NO: 2761908 - RNA, 21 nt, Human
uagaggaagccugauuaaaga

SEQ ID NO: 2761909 - RNA, 16 nt, Human
uagaugcaguucugaa

SEQ ID NO: 2761910 - RNA, 19 nt, Human
uagaugcaguucugaagaa

SEQ ID NO: 2761911 - RNA, 17 nt, Human
uagaugcaguucugaag

SEQ ID NO: 2761912 - RNA, 21 nt, Human
uagcaugucgucaaagcugaa

SEQ ID NO: 2761913 - RNA, 18 nt, Human
uagcaugucgucaaagcu

SEQ ID NO: 2761914 - RNA, 18 nt, Human
acaagcacuaaacaaaga

SEQ ID NO: 2761915 - RNA, 22 nt, Human
acaagaaaugaaagcagggacu

SEQ ID NO: 2761916 - RNA, 14 nt, Human
uagaaccucuuugu

SEQ ID NO: 2761917 - RNA, 15 nt, Human
uagaacucccuuuca

SEQ ID NO: 2761918 - RNA, 21 nt, Human
uacuucaaauccuugaagauu

SEQ ID NO: 2761919 - RNA, 18 nt, Human
uagaacucccuuucaaca

SEQ ID NO: 2761920 - RNA, 19 nt, Human
aauuuuuauauuugaaaua

SEQ ID NO: 2761921 - RNA, 16 nt, Human
acaaaaacacagcaag

SEQ ID NO: 2761922 - RNA, 19 nt, Human
aauuuuuucucuaggaaau

SEQ ID NO: 2761923 - RNA, 18 nt, Human
aauuugaauuuuguguua

SEQ ID NO: 2761924 - RNA, 16 nt, Human
aauuugaauuuugugu

SEQ ID NO: 2761925 - RNA, 13 nt, Human
aauuugaauuuug

SEQ ID NO: 2761926 - RNA, 19 nt, Human
uacuucaaauccuugaaga

SEQ ID NO: 2761927 - RNA, 14 nt, Human
uacuucaaauccuu

SEQ ID NO: 2761928 - RNA, 20 nt, Human
aauuucucccagucauuuaa

SEQ ID NO: 2761929 - RNA, 19 nt, Human
aauuucucccagucauuua

SEQ ID NO: 2761930 - RNA, 23 nt, Human
aauugugugaaagguacuucaaa

SEQ ID NO: 2761931 - RNA, 12 nt, Human
uacucaauuuua

SEQ ID NO: 2761932 - RNA, 14 nt, Human
uacucaauuuuaac

SEQ ID NO: 2761933 - RNA, 13 nt, Human
uacucaauuuuaa

SEQ ID NO: 2761934 - RNA, 21 nt, Human
aauucuugccaaauauaaaua

SEQ ID NO: 2761935 - RNA, 19 nt, Human
aauugacccacaagaaaug

SEQ ID NO: 2761936 - RNA, 16 nt, Human
aauugacccacaagaa

SEQ ID NO: 2761937 - RNA, 13 nt, Human
aauugacccacaa

SEQ ID NO: 2761938 - RNA, 18 nt, Human
aauuaacauguuaaacca

SEQ ID NO: 2761939 - RNA, 14 nt, Human
aauuaacauguuaa

SEQ ID NO: 2761940 - RNA, 13 nt, Human
aauuaacauguua

SEQ ID NO: 2761941 - RNA, 18 nt, Human
aauguugacaugggacau

SEQ ID NO: 2761942 - RNA, 16 nt, Human
aaugguuuaaaugguc

SEQ ID NO: 2761943 - RNA, 17 nt, Human
uaauuauaucugaggaa

SEQ ID NO: 2761944 - RNA, 13 nt, Human
uaauuauaucuga

SEQ ID NO: 2761945 - RNA, 20 nt, Human
uaauuauaugcuauuucuau

SEQ ID NO: 2761946 - RNA, 21 nt, Human
uaauuauaugcuauuucuaua

SEQ ID NO: 2761947 - RNA, 16 nt, Human
uacaaaaacacagcaa

SEQ ID NO: 2761948 - RNA, 17 nt, Human
uacaaaaacacagcaag

SEQ ID NO: 2761949 - RNA, 18 nt, Human
uacaaaaacacagcaagg

SEQ ID NO: 2761950 - RNA, 15 nt, Human
aaugaaugaaugaau

SEQ ID NO: 2761951 - RNA, 20 nt, Human
aacuaucucauuuccaagca

SEQ ID NO: 2761952 - RNA, 13 nt, Human
aacuauauuguuu

SEQ ID NO: 2761953 - RNA, 20 nt, Human
aacugaaaucauacuucuua

SEQ ID NO: 2761954 - RNA, 13 nt, Human
aacugaaaucaua

SEQ ID NO: 2761955 - RNA, 13 nt, Human
gucuucacaacag

SEQ ID NO: 2761956 - RNA, 23 nt, Human
gucucaguccaugaagauguaga

SEQ ID NO: 2761957 - RNA, 23 nt, Human
guccaugaagauguagaggagaa

SEQ ID NO: 2761958 - RNA, 14 nt, Human
aacauaaaucugug

SEQ ID NO: 2761959 - RNA, 12 nt, Human
aacauaaaucug

SEQ ID NO: 2761960 - RNA, 15 nt, Human
aacauaaaucuguga

SEQ ID NO: 2761961 - RNA, 23 nt, Human
aacauguuaaaccaugggauaaa

SEQ ID NO: 2761962 - RNA, 16 nt, Human
aacauguuaaaccaug

SEQ ID NO: 2761963 - RNA, 16 nt, Human
aacauauauaacaaug

SEQ ID NO: 2761964 - RNA, 19 nt, Human
aacagauuauuaccuuaca

SEQ ID NO: 2761965 - RNA, 17 nt, Human
aacagucucaggaaauc

SEQ ID NO: 2761966 - RNA, 19 nt, Human
aacagucucaggaaaucaa

SEQ ID NO: 2761967 - RNA, 14 nt, Human
guggguagacacac

SEQ ID NO: 2761968 - RNA, 18 nt, Human
aagagcuguucacagcca

SEQ ID NO: 2761969 - RNA, 16 nt, Human
aagacuccaaagaaau

SEQ ID NO: 2761970 - RNA, 17 nt, Human
aagacuccaaagaaaug

SEQ ID NO: 2761971 - RNA, 14 nt, Human
aagacuccaaagaa

SEQ ID NO: 2761972 - RNA, 14 nt, Human
aagacuauucaaac

SEQ ID NO: 2761973 - RNA, 13 nt, Human
aagacuauucaaa

SEQ ID NO: 2761974 - RNA, 23 nt, Human
guguugaaacggaugauuucuau

SEQ ID NO: 2761975 - RNA, 21 nt, Human
guguugaaacggaugauuucu

SEQ ID NO: 2761976 - RNA, 16 nt, Human
aagcaaguauuagaau

SEQ ID NO: 2761977 - RNA, 19 nt, Human
aagcaaaauuuuuucucua

SEQ ID NO: 2761978 - RNA, 22 nt, Human
aagauguagaggagaaacugga

SEQ ID NO: 2761979 - RNA, 13 nt, Human
aagcaaaauguga

SEQ ID NO: 2761980 - RNA, 19 nt, Human
aagauguagaggagaaacu

SEQ ID NO: 2761981 - RNA, 14 nt, Human
aacuuguguaaaua

SEQ ID NO: 2761982 - RNA, 20 nt, Human
aacuuguguaaauacaauuu

SEQ ID NO: 2761983 - RNA, 15 nt, Human
aacuuguguaaauac

SEQ ID NO: 2761984 - RNA, 22 nt, Human
aagaagcaccaaucaugaauua

SEQ ID NO: 2761985 - RNA, 13 nt, Human
aagaaaauaucac

SEQ ID NO: 2761986 - RNA, 22 nt, Human
gugcugggguuaucugaaguca

SEQ ID NO: 2761987 - RNA, 19 nt, Human
gugcugguguaugugugaa

SEQ ID NO: 2761988 - RNA, 13 nt, Human
aagacccaaaagg

SEQ ID NO: 2761989 - RNA, 13 nt, Human
aagaauauuuuaa

SEQ ID NO: 2761990 - RNA, 10 nt, Human
guuucuguac

SEQ ID NO: 2761991 - RNA, 15 nt, Human
guuuucugagaaaga

SEQ ID NO: 2761992 - RNA, 22 nt, Human
guuuuauaauuuugugaagcaa

SEQ ID NO: 2761993 - RNA, 15 nt, Human
guuuuauaauuuugu

SEQ ID NO: 2761994 - RNA, 17 nt, Human
aaguaaaaccacagcag

SEQ ID NO: 2761995 - RNA, 18 nt, Human
aaguaaaaccacagcagu

SEQ ID NO: 2761996 - RNA, 14 nt, Human
aaguaaaaccacag

SEQ ID NO: 2761997 - RNA, 15 nt, Human
aaguaaaaccacagc

SEQ ID NO: 2761998 - RNA, 16 nt, Human
aaguaaaaccacagca

SEQ ID NO: 2761999 - RNA, 21 nt, Human
aagggugaugggaaagcauug

SEQ ID NO: 2762000 - RNA, 16 nt, Human
guuuucugagaaagac

SEQ ID NO: 2762001 - RNA, 17 nt, Human
guuuucugagaaagacu

SEQ ID NO: 2762002 - RNA, 22 nt, Human
guuuucugagaaagacuauuca

SEQ ID NO: 2762003 - RNA, 13 nt, Human
aaguauuaagcau

SEQ ID NO: 2762004 - RNA, 21 nt, Human
aaguauguuagugcaaauugu

SEQ ID NO: 2762005 - RNA, 23 nt, Human
aaguauguuagugcaaauuguca

SEQ ID NO: 2762006 - RNA, 23 nt, Human
guuuuuuuuuaaaaaagaaacau

SEQ ID NO: 2762007 - RNA, 13 nt, Human
aaggauaaugaau

SEQ ID NO: 2762008 - RNA, 16 nt, Human
aaggaaaaaauaacaa

SEQ ID NO: 2762009 - RNA, 19 nt, Human
aaggaaaaaauaacaauga

SEQ ID NO: 2762010 - RNA, 22 nt, Human
uaaaccaugggauaaaugccau

SEQ ID NO: 2762011 - RNA, 21 nt, Human
uaaaccaugggauaaaugcca

SEQ ID NO: 2762012 - RNA, 20 nt, Human
uaaaccaugggauaaaugcc

SEQ ID NO: 2762013 - RNA, 18 nt, Human
uaaaccaugggauaaaug

SEQ ID NO: 2762014 - RNA, 18 nt, Human
aaguuuaauauuaaagcc

SEQ ID NO: 2762015 - RNA, 21 nt, Human
aaguuuaauauuaaagccaug

SEQ ID NO: 2762016 - RNA, 20 nt, Human
aaguuuaauauuaaagccau

SEQ ID NO: 2762017 - RNA, 19 nt, Human
aaguuuaauauuaaagcca

SEQ ID NO: 2762018 - RNA, 19 nt, Human
uaaaccaaggcuagaacca

SEQ ID NO: 2762019 - RNA, 15 nt, Human
aauaaggaaaaguuu

SEQ ID NO: 2762020 - RNA, 13 nt, Human
aauaaggaaaagu

SEQ ID NO: 2762021 - RNA, 22 nt, Human
aauaaggaaaaguuuaauauua

SEQ ID NO: 2762022 - RNA, 19 nt, Human
aauaaggaaaaguuuaaua

SEQ ID NO: 2762023 - RNA, 16 nt, Human
aauaaggaaaaguuua

SEQ ID NO: 2762024 - RNA, 15 nt, Human
aauaauuauaugcua

SEQ ID NO: 2762025 - RNA, 14 nt, Human
aauaauuauaugcu

SEQ ID NO: 2762026 - RNA, 23 nt, Human
aauaauuauaugcuauuucuaua

SEQ ID NO: 2762027 - RNA, 22 nt, Human
aauaauuauaugcuauuucuau

SEQ ID NO: 2762028 - RNA, 21 nt, Human
aauaauuauaugcuauuucua

SEQ ID NO: 2762029 - RNA, 20 nt, Human
aauaauuauaugcuauuucu

SEQ ID NO: 2762030 - RNA, 21 nt, Human
aauaaauagcuagacugguga

SEQ ID NO: 2762031 - RNA, 12 nt, Human
aauaaaugugcc

SEQ ID NO: 2762032 - RNA, 21 nt, Human
aauaaaugugccuucauuuuu

SEQ ID NO: 2762033 - RNA, 15 nt, Human
aauaacaauaaaaga

SEQ ID NO: 2762034 - RNA, 15 nt, Human
aauaacgauaaaaga

SEQ ID NO: 2762035 - RNA, 14 nt, Human
aauaaaaaauuaug

SEQ ID NO: 2762036 - RNA, 16 nt, Human
aauaaaaaauuaugac

SEQ ID NO: 2762037 - RNA, 15 nt, Human
aauaaaaaauuauga

SEQ ID NO: 2762038 - RNA, 22 nt, Human
aauaaaauccauacauuugugu

SEQ ID NO: 2762039 - RNA, 12 nt, Human
aauaaaaauaau

SEQ ID NO: 2762040 - RNA, 15 nt, Human
uaaauguugacaugg

SEQ ID NO: 2762041 - RNA, 17 nt, Human
uaaaugauuucauucaa

SEQ ID NO: 2762042 - RNA, 16 nt, Human
uaacaacagcuggugc

SEQ ID NO: 2762043 - RNA, 13 nt, Human
uaacaaugcugua

SEQ ID NO: 2762044 - RNA, 17 nt, Human
uaacaaugcuguauuuu

SEQ ID NO: 2762045 - RNA, 15 nt, Human
uaacaaugcuguauu

SEQ ID NO: 2762046 - RNA, 13 nt, Human
uaaauacaauuuu

SEQ ID NO: 2762047 - RNA, 22 nt, Human
uaaauacaauuuuguuucugua

SEQ ID NO: 2762048 - RNA, 15 nt, Human
uaaauacaauuuugu

SEQ ID NO: 2762049 - RNA, 19 nt, Human
uaaauagcuagacugguga

SEQ ID NO: 2762050 - RNA, 23 nt, Human
uaaauacaauuuuguuucuguac

SEQ ID NO: 2762051 - RNA, 23 nt, Human
uaaauagcuagacuggugacuga

SEQ ID NO: 2762052 - RNA, 19 nt, Human
uaaaucccauuauucaaag

SEQ ID NO: 2762053 - RNA, 23 nt, Human
uaaaucccauuauucaaaguugc

SEQ ID NO: 2762054 - RNA, 13 nt, Human
aauacaauuuugu

SEQ ID NO: 2762055 - RNA, 12 nt, Human
aauacaauuuug

SEQ ID NO: 2762056 - RNA, 20 nt, Human
aauacaauuuuguuucugua

SEQ ID NO: 2762057 - RNA, 18 nt, Human
aauacaauuuuguuucug

SEQ ID NO: 2762058 - RNA, 17 nt, Human
aauacaauuuuguuucu

SEQ ID NO: 2762059 - RNA, 15 nt, Human
aauacaauuuuguuu

SEQ ID NO: 2762060 - RNA, 23 nt, Human
aauacaauuuuguuucuguacuu

SEQ ID NO: 2762061 - RNA, 22 nt, Human
aauacaauuuuguuucuguacu

SEQ ID NO: 2762062 - RNA, 14 nt, Human
aauacacacucaaa

SEQ ID NO: 2762063 - RNA, 21 nt, Human
aucagcugcugaaacaacaaa

SEQ ID NO: 2762064 - RNA, 15 nt, Human
auauuuauuuuaaua

SEQ ID NO: 2762065 - RNA, 14 nt, Human
auauuuauuuuaau

SEQ ID NO: 2762066 - RNA, 17 nt, Human
auauuuauuuuaauaau

SEQ ID NO: 2762067 - RNA, 22 nt, Human
aucagcugcugaaacaacaaau

SEQ ID NO: 2762068 - RNA, 23 nt, Human
aucagcugcugaaacaacaaaua

SEQ ID NO: 2762069 - RNA, 13 nt, Human
augugugaaguga

SEQ ID NO: 2762070 - RNA, 18 nt, Human
augugggcagugauguca

SEQ ID NO: 2762071 - RNA, 17 nt, Human
auguucuaagaagugaa

SEQ ID NO: 2762072 - RNA, 19 nt, Human
augguccgugcuaaggacu

SEQ ID NO: 2762073 - RNA, 21 nt, Human
augguccgugcuaaggacuug

SEQ ID NO: 2762074 - RNA, 20 nt, Human
augguccgugcuaaggacuu

SEQ ID NO: 2762075 - RNA, 14 nt, Human
auguaagggaaacu

SEQ ID NO: 2762076 - RNA, 16 nt, Human
auguaagggaaacugc

SEQ ID NO: 2762077 - RNA, 19 nt, Human
auguaagggaaacugccag

SEQ ID NO: 2762078 - RNA, 12 nt, Human
aguccuguaaug

SEQ ID NO: 2762079 - RNA, 19 nt, Human
agucaaauugugugaaagg

SEQ ID NO: 2762080 - RNA, 23 nt, Human
agucaaauugugugaaagguacu

SEQ ID NO: 2762081 - RNA, 22 nt, Human
aguugaaaaucuuauaauuuaa

SEQ ID NO: 2762082 - RNA, 21 nt, Human
aguugaaaagacuccaaagaa

SEQ ID NO: 2762083 - RNA, 22 nt, Human
aguugaaaagacuccaaagaaa

SEQ ID NO: 2762084 - RNA, 23 nt, Human
aguugaaaaucuuauaauuuaaa

SEQ ID NO: 2762085 - RNA, 17 nt, Human
agugucuuaauuaaaag

SEQ ID NO: 2762086 - RNA, 18 nt, Human
agugucuuaauuaaaaga

SEQ ID NO: 2762087 - RNA, 15 nt, Human
agugucuuaauuaaa

SEQ ID NO: 2762088 - RNA, 15 nt, Human
auaaggaaaaguuua

SEQ ID NO: 2762089 - RNA, 16 nt, Human
auaaggaaaaguuuaa

SEQ ID NO: 2762090 - RNA, 15 nt, Human
auaauuaacauguua

SEQ ID NO: 2762091 - RNA, 23 nt, Human
auaauguuucaaacauauauaac

SEQ ID NO: 2762092 - RNA, 17 nt, Human
auacacacucaaaucaa

SEQ ID NO: 2762093 - RNA, 18 nt, Human
auacacacucaaaucaag

SEQ ID NO: 2762094 - RNA, 19 nt, Human
auaacauaaaucugugaac

SEQ ID NO: 2762095 - RNA, 18 nt, Human
auaacauaaaucugugaa

SEQ ID NO: 2762096 - RNA, 17 nt, Human
auaacauaaaucuguga

SEQ ID NO: 2762097 - RNA, 15 nt, Human
auaacauaaaucugu

SEQ ID NO: 2762098 - RNA, 14 nt, Human
auaacauaaaucug

SEQ ID NO: 2762099 - RNA, 18 nt, Human
auaaaggauuaaugucaa

SEQ ID NO: 2762100 - RNA, 20 nt, Human
auauuuacuaaaauggacug

SEQ ID NO: 2762101 - RNA, 18 nt, Human
auauuuacuaaaauggac

SEQ ID NO: 2762102 - RNA, 13 nt, Human
auauuuauuuuaa

SEQ ID NO: 2762103 - RNA, 22 nt, Human
auauuuauuacuguaagaaaau

SEQ ID NO: 2762104 - RNA, 16 nt, Human
auauuauguuaaaacu

SEQ ID NO: 2762105 - RNA, 21 nt, Human
auaugcuauuucuauauuuuc

SEQ ID NO: 2762106 - RNA, 19 nt, Human
auaugcuauuucuauauuu

SEQ ID NO: 2762107 - RNA, 18 nt, Human
auaugcuauuucuauauu

SEQ ID NO: 2762108 - RNA, 16 nt, Human
auaugcuauuucuaua

SEQ ID NO: 2762109 - RNA, 15 nt, Human
auaugcuauuucuau

SEQ ID NO: 2762110 - RNA, 23 nt, Human
auaugcuauuucuauauuuucau

SEQ ID NO: 2762111 - RNA, 22 nt, Human
auaugcuauuucuauauuuuca

SEQ ID NO: 2762112 - RNA, 22 nt, Human
auaugcuucuguuuuauaauuu

SEQ ID NO: 2762113 - RNA, 20 nt, Human
auaugcuucuguuuuauaau

SEQ ID NO: 2762114 - RNA, 18 nt, Human
auagcagcuuauucacaa

SEQ ID NO: 2762115 - RNA, 15 nt, Human
auaggugcuacaaaa

SEQ ID NO: 2762116 - RNA, 21 nt, Human
auaggugcuacaaaaacacag

SEQ ID NO: 2762117 - RNA, 23 nt, Human
auaggugcuacaaaaacacagca

SEQ ID NO: 2762118 - RNA, 14 nt, Human
auaggugcuacaaa

SEQ ID NO: 2762119 - RNA, 15 nt, Human
auagguuuaauaauu

SEQ ID NO: 2762120 - RNA, 14 nt, Human
auagucaaauugug

SEQ ID NO: 2762121 - RNA, 16 nt, Human
aggcuagauguaugua

SEQ ID NO: 2762122 - RNA, 15 nt, Human
aggcuagauguaugu

SEQ ID NO: 2762123 - RNA, 17 nt, Human
aggcuagauguauguac

SEQ ID NO: 2762124 - RNA, 17 nt, Human
aggcuacugucagcucc

SEQ ID NO: 2762125 - RNA, 21 nt, Human
aggcuagaaccaccugccuau

SEQ ID NO: 2762126 - RNA, 23 nt, Human
aggugcuacaaaaacacagcaag

SEQ ID NO: 2762127 - RNA, 24 nt, Human
aggugcuacaaaaacacagcaagg

SEQ ID NO: 2762128 - RNA, 20 nt, Human
agguaaaagcaucacaugaa

SEQ ID NO: 2762129 - RNA, 19 nt, Human
aggugcuacaaaaacacag

SEQ ID NO: 2762130 - RNA, 20 nt, Human
aggugcuacaaaaacacagc

SEQ ID NO: 2762131 - RNA, 21 nt, Human
aggugcuacaaaaacacagca

SEQ ID NO: 2762132 - RNA, 22 nt, Human
aggugcuacaaaaacacagcaa

SEQ ID NO: 2762133 - RNA, 18 nt, Human
aggugcuacaaaaacaca

SEQ ID NO: 2762134 - RNA, 22 nt, Human
agcuccccucggagaagagcug

SEQ ID NO: 2762135 - RNA, 17 nt, Human
aggauguugaaaaaguu

SEQ ID NO: 2762136 - RNA, 23 nt, Human
aggaugguucccuugaugaagaa

SEQ ID NO: 2762137 - RNA, 17 nt, Human
agagaacuuccagaucc

SEQ ID NO: 2762138 - RNA, 21 nt, Human
agacugcauuauauuuauuac

SEQ ID NO: 2762139 - RNA, 16 nt, Human
agcacugacuucuaag

SEQ ID NO: 2762140 - RNA, 20 nt, Human
agcaguucagagcugcccuc

SEQ ID NO: 2762141 - RNA, 23 nt, Human
agcaguucagagcugcccucucc

SEQ ID NO: 2762142 - RNA, 13 nt, Human
agcaguugaaaag

SEQ ID NO: 2762143 - RNA, 16 nt, Human
agcaguugaaaagacu

SEQ ID NO: 2762144 - RNA, 23 nt, Human
aauguuucaaacauauauaacaa

SEQ ID NO: 2762145 - RNA, 19 nt, Human
aaguugccuaaauccauuu

SEQ ID NO: 2762146 - RNA, 18 nt, Human
aaguugccuaaauccauu

SEQ ID NO: 2762147 - RNA, 17 nt, Human
aaguugccuaaauccau

SEQ ID NO: 2762148 - RNA, 16 nt, Human
aaguugccuaaaucca

SEQ ID NO: 2762149 - RNA, 15 nt, Human
aaguugccuaaaucc

SEQ ID NO: 2762150 - RNA, 21 nt, Human
aaugauuaugaauuacauuug

SEQ ID NO: 2762151 - RNA, 15 nt, Human
aaugauuaugaauua

SEQ ID NO: 2762152 - RNA, 21 nt, Human
aaggacuucuuuaauuuugga

SEQ ID NO: 2762153 - RNA, 20 nt, Human
aaggacuucuuuaauuuugg

SEQ ID NO: 2762154 - RNA, 15 nt, Human
aaggacuucuuuaau

SEQ ID NO: 2762155 - RNA, 14 nt, Human
aaggacuucuuuaa

SEQ ID NO: 2762156 - RNA, 20 nt, Human
aaggcagcucuaaaugucaa

SEQ ID NO: 2762157 - RNA, 12 nt, Human
aaguugccuaaa

SEQ ID NO: 2762158 - RNA, 18 nt, Human
aaguccaagcauuuagau

SEQ ID NO: 2762159 - RNA, 17 nt, Human
aaguccaagcauaccaa

SEQ ID NO: 2762160 - RNA, 21 nt, Human
aaguagggacuucugucuuca

SEQ ID NO: 2762161 - RNA, 23 nt, Human
aagggaaacugccagcaacgcag

SEQ ID NO: 2762162 - RNA, 16 nt, Human
aagggaaacugccagc

SEQ ID NO: 2762163 - RNA, 17 nt, Human
aagggaaacugccagca

SEQ ID NO: 2762164 - RNA, 19 nt, Human
aaauugacacuuaaaaaug

SEQ ID NO: 2762165 - RNA, 17 nt, Human
aaaucuuauaauuuaaa

SEQ ID NO: 2762166 - RNA, 22 nt, Human
aaauguuguucucuucuuuaaa

SEQ ID NO: 2762167 - RNA, 16 nt, Human
aacacaucagcuugcc

SEQ ID NO: 2762168 - RNA, 18 nt, Human
aacaaauuuacagagaca

SEQ ID NO: 2762169 - RNA, 21 nt, Human
aacagcuggugcccugcuuuc

SEQ ID NO: 2762170 - RNA, 20 nt, Human
aacagcuggugcccugcuuu

SEQ ID NO: 2762171 - RNA, 17 nt, Human
aacagcuggugcccugc

SEQ ID NO: 2762172 - RNA, 19 nt, Human
aacagcuggugcccugcuu

SEQ ID NO: 2762173 - RNA, 22 nt, Human
aaccacuggaaaguuuaugguu

SEQ ID NO: 2762174 - RNA, 16 nt, Human
aacccgggaggcagag

SEQ ID NO: 2762175 - RNA, 17 nt, Human
aaccuagggugauauua

SEQ ID NO: 2762176 - RNA, 17 nt, Human
aacggaugauuucuaug

SEQ ID NO: 2762177 - RNA, 16 nt, Human
aacggaugauuucuau

SEQ ID NO: 2762178 - RNA, 15 nt, Human
aacggaugauuucua

SEQ ID NO: 2762179 - RNA, 14 nt, Human
aacggaugauuucu

SEQ ID NO: 2762180 - RNA, 18 nt, Human
aacugacucuuaagaaga

SEQ ID NO: 2762181 - RNA, 15 nt, Human
aacugacucuuaaga

SEQ ID NO: 2762182 - RNA, 20 nt, Human
aacugacucuuaagaagacu

SEQ ID NO: 2762183 - RNA, 19 nt, Human
aacugacucuuaagaagac

SEQ ID NO: 2762184 - RNA, 20 nt, Human
aacugagaugugaacacauc

SEQ ID NO: 2762185 - RNA, 20 nt, Human
aacuuuaugcuaagugaaau

SEQ ID NO: 2762186 - RNA, 21 nt, Human
aacuuuaugcuaagugaaaua

SEQ ID NO: 2762187 - RNA, 16 nt, Human
aaaaagaaacauuugg

SEQ ID NO: 2762188 - RNA, 18 nt, Human
aaaaguucugcagauaaa

SEQ ID NO: 2762189 - RNA, 21 nt, Human
aaaaucuacacuccagugaga

SEQ ID NO: 2762190 - RNA, 16 nt, Human
aaaaucucaauauuuc

SEQ ID NO: 2762191 - RNA, 20 nt, Human
aaaccaugggauaaaugcca

SEQ ID NO: 2762192 - RNA, 15 nt, Human
aaaccaugggauaaa

SEQ ID NO: 2762193 - RNA, 21 nt, Human
aaacugagaugugaacacauc

SEQ ID NO: 2762194 - RNA, 23 nt, Human
aaacugagaugugaacacaucag

SEQ ID NO: 2762195 - RNA, 15 nt, Human
aaagaaauguaaggg

SEQ ID NO: 2762196 - RNA, 18 nt, Human
aaauagcuagacugguga

SEQ ID NO: 2762197 - RNA, 18 nt, Human
aaaucugugaacuugaaa

SEQ ID NO: 2762198 - RNA, 16 nt, Human
aaaucugugaacuuga

SEQ ID NO: 2762199 - RNA, 15 nt, Human
aaaucugugaacuug

SEQ ID NO: 2762200 - RNA, 15 nt, Human
aaaucaaauaugcaa

SEQ ID NO: 2762201 - RNA, 12 nt, Human
aaaucaaauaug

SEQ ID NO: 2762202 - RNA, 14 nt, Human
aaaucaaauaugca

SEQ ID NO: 2762203 - RNA, 20 nt, Human
aaauauuuauuuuaauaaug

SEQ ID NO: 2762204 - RNA, 13 nt, Human
aaauauuuauuuu

SEQ ID NO: 2762205 - RNA, 15 nt, Human
aaauauuuauuuuaa

SEQ ID NO: 2762206 - RNA, 10 nt, Human
aaauaaauaa

SEQ ID NO: 2762207 - RNA, 14 nt, Human
aaaggcagaagcaa

SEQ ID NO: 2762208 - RNA, 13 nt, Human
aauuuuguuucug

SEQ ID NO: 2762209 - RNA, 14 nt, Human
aauuuuguuucugu

SEQ ID NO: 2762210 - RNA, 14 nt, Human
acacgagcaggcua

SEQ ID NO: 2762211 - RNA, 19 nt, Human
acacgagcaggcuacuguc

SEQ ID NO: 2762212 - RNA, 21 nt, Human
acacgagcaggcuacugucag

SEQ ID NO: 2762213 - RNA, 22 nt, Human
acagcaguugaaaagacuccaa

SEQ ID NO: 2762214 - RNA, 23 nt, Human
acagcaguugaaaagacuccaaa

SEQ ID NO: 2762215 - RNA, 21 nt, Human
acagcaguugaaaagacucca

SEQ ID NO: 2762216 - RNA, 17 nt, Human
acccacaagaaaugaaa

SEQ ID NO: 2762217 - RNA, 21 nt, Human
acccacaagaaaugaaagcag

SEQ ID NO: 2762218 - RNA, 21 nt, Human
acuuggucugugagaugcuag

SEQ ID NO: 2762219 - RNA, 22 nt, Human
acuucugucuucacaacagauu

SEQ ID NO: 2762220 - RNA, 21 nt, Human
acuucugucuucacaacagau

SEQ ID NO: 2762221 - RNA, 12 nt, Human
acuucagacaua

SEQ ID NO: 2762222 - RNA, 13 nt, Human
acugccagcaacg

SEQ ID NO: 2762223 - RNA, 18 nt, Human
acucugucucaguccaug

SEQ ID NO: 2762224 - RNA, 20 nt, Human
acucugucucaguccaugaa

SEQ ID NO: 2762225 - RNA, 14 nt, Human
acuggugacugauu

SEQ ID NO: 2762226 - RNA, 13 nt, Human
acuguaagaaaau

SEQ ID NO: 2762227 - RNA, 19 nt, Human
acuguaagaaaauaucacu

SEQ ID NO: 2762228 - RNA, 22 nt, Human
acuguaagaaaauaucacuugu

SEQ ID NO: 2762229 - RNA, 22 nt, Human
acuuuauuuucuauaauuuaaa

SEQ ID NO: 2762230 - RNA, 16 nt, Human
agaaaaucaggcuggc

SEQ ID NO: 2762231 - RNA, 14 nt, Human
agaaaauaacaaua

SEQ ID NO: 2762232 - RNA, 13 nt, Human
acuaagagagaau

SEQ ID NO: 2762233 - RNA, 19 nt, Human
acgcaggcccccaggugcc

SEQ ID NO: 2762234 - RNA, 22 nt, Human
acgcaggcccccaggugccagu

SEQ ID NO: 2762235 - RNA, 14 nt, Human
acucaaaucaagaa

SEQ ID NO: 2762236 - RNA, 21 nt, Human
acuauucaaacagucucagga

SEQ ID NO: 2762237 - RNA, 20 nt, Human
acuaguauuucuaugaaaua

SEQ ID NO: 2762238 - RNA, 17 nt, Human
acucuauguucuaagaa

SEQ ID NO: 2762239 - RNA, 20 nt, Human
aaaaaccaguauuguacaaa

SEQ ID NO: 2762240 - RNA, 12 nt, Human
aaaaacacagca

SEQ ID NO: 2762241 - RNA, 18 nt, Human
aaaaacacagcaagggug

SEQ ID NO: 2762242 - RNA, 18 nt, Human
aaaaaauuggggauucuu

SEQ ID NO: 2762243 - RNA, 13 nt, Human
aaaaacacagcaa

SEQ ID NO: 2762244 - RNA, 15 nt, Human
cacccacccuuuuuu

SEQ ID NO: 2762245 - RNA, 17 nt, Human
caagcacuaaacaaaga

SEQ ID NO: 2762246 - RNA, 15 nt, Human
caaauuuacagagac

SEQ ID NO: 2762247 - RNA, 15 nt, Human
caaauugugugaaag

SEQ ID NO: 2762248 - RNA, 14 nt, Human
caaauuuacagaga

SEQ ID NO: 2762249 - RNA, 19 nt, Human
caaaguugccuaaauccau

SEQ ID NO: 2762250 - RNA, 14 nt, Human
caaauaugcaaagc

SEQ ID NO: 2762251 - RNA, 20 nt, Human
caaauguucaucaaugaaug

SEQ ID NO: 2762252 - RNA, 21 nt, Human
caaauguucaucaaugaauga

SEQ ID NO: 2762253 - RNA, 18 nt, Human
caaauaugcaaagcacug

SEQ ID NO: 2762254 - RNA, 16 nt, Human
caaauaugcaaagcac

SEQ ID NO: 2762255 - RNA, 17 nt, Human
caaauaugcaaagcacu

SEQ ID NO: 2762256 - RNA, 20 nt, Human
cacauugguguuguacucaa

SEQ ID NO: 2762257 - RNA, 14 nt, Human
cacaguuuucugag

SEQ ID NO: 2762258 - RNA, 19 nt, Human
cacaggaaccacaagacug

SEQ ID NO: 2762259 - RNA, 20 nt, Human
cacaggaaccacaagacugc

SEQ ID NO: 2762260 - RNA, 15 nt, Human
cacaggaaguagagg

SEQ ID NO: 2762261 - RNA, 22 nt, Human
cacagcaguugaaaagacucca

SEQ ID NO: 2762262 - RNA, 13 nt, Human
cacaacuauauug

SEQ ID NO: 2762263 - RNA, 14 nt, Human
cacacugaagaagc

SEQ ID NO: 2762264 - RNA, 19 nt, Human
cacacucaaaucaagaaac

SEQ ID NO: 2762265 - RNA, 11 nt, Human
cacaacagauu

SEQ ID NO: 2762266 - RNA, 21 nt, Human
caauaucuuuuuuuuaauaaa

SEQ ID NO: 2762267 - RNA, 22 nt, Human
caaugaaugaaugaauggcuaa

SEQ ID NO: 2762268 - RNA, 13 nt, Human
uugccuuuuucau

SEQ ID NO: 2762269 - RNA, 12 nt, Human
uugccuuuuuca

SEQ ID NO: 2762270 - RNA, 17 nt, Human
uugccuuuuucauuauu

SEQ ID NO: 2762271 - RNA, 16 nt, Human
uugccuuuuucauuau

SEQ ID NO: 2762272 - RNA, 15 nt, Human
uugccuuuuucauua

SEQ ID NO: 2762273 - RNA, 14 nt, Human
uugccuuuuucauu

SEQ ID NO: 2762274 - RNA, 16 nt, Human
uugcuaagcauuccaa

SEQ ID NO: 2762275 - RNA, 18 nt, Human
uugcuaagcauuccaacu

SEQ ID NO: 2762276 - RNA, 16 nt, Human
uuguaccgcaauguga

SEQ ID NO: 2762277 - RNA, 20 nt, Human
uuguaaaauggugugaccac

SEQ ID NO: 2762278 - RNA, 18 nt, Human
uuggcauaacauaaaucu

SEQ ID NO: 2762279 - RNA, 23 nt, Human
uuggcauaacauaaaucugugaa

SEQ ID NO: 2762280 - RNA, 22 nt, Human
uuggcauaacauaaaucuguga

SEQ ID NO: 2762281 - RNA, 20 nt, Human
uuggcauaacauaaaucugu

SEQ ID NO: 2762282 - RNA, 19 nt, Human
uuggcauaacauaaaucug

SEQ ID NO: 2762283 - RNA, 20 nt, Human
uugguaaggggaauugagga

SEQ ID NO: 2762284 - RNA, 13 nt, Human
uuguaaaauggug

SEQ ID NO: 2762285 - RNA, 12 nt, Human
uuguaaaauggu

SEQ ID NO: 2762286 - RNA, 20 nt, Human
uugauaugccuuuucccaac

SEQ ID NO: 2762287 - RNA, 13 nt, Human
uugccaucccucc

SEQ ID NO: 2762288 - RNA, 18 nt, Human
uugccaucccucccucca

SEQ ID NO: 2762289 - RNA, 17 nt, Human
uugccaucccucccucc

SEQ ID NO: 2762290 - RNA, 16 nt, Human
uugccaucccucccuc

SEQ ID NO: 2762291 - RNA, 14 nt, Human
uugccaucccuccc

SEQ ID NO: 2762292 - RNA, 23 nt, Human
uugccaucccucccuccaccucc

SEQ ID NO: 2762293 - RNA, 22 nt, Human
uugccaucccucccuccaccuc

SEQ ID NO: 2762294 - RNA, 14 nt, Human
uucuguauagauua

SEQ ID NO: 2762295 - RNA, 13 nt, Human
uucuguauagauu

SEQ ID NO: 2762296 - RNA, 11 nt, Human
uucuguauaga

SEQ ID NO: 2762297 - RNA, 24 nt, Human
uucuaaguaaaaccacagcaguug

SEQ ID NO: 2762298 - RNA, 19 nt, Human
uucuuaggguuaugauuaa

SEQ ID NO: 2762299 - RNA, 19 nt, Human
uugaaacggaugauuucua

SEQ ID NO: 2762300 - RNA, 16 nt, Human
uugaaacggaugauuu

SEQ ID NO: 2762301 - RNA, 12 nt, Human
uucuuuaauuuu

SEQ ID NO: 2762302 - RNA, 18 nt, Human
uucuuuaauuuuggaauu

SEQ ID NO: 2762303 - RNA, 17 nt, Human
uucuuuaauuuuggaau

SEQ ID NO: 2762304 - RNA, 18 nt, Human
uucuuuccacagaagcuc

SEQ ID NO: 2762305 - RNA, 21 nt, Human
uugaaaaucuuauaauuuaaa

SEQ ID NO: 2762306 - RNA, 13 nt, Human
uuucugauccagu

SEQ ID NO: 2762307 - RNA, 22 nt, Human
uuucugauccaguuuuguuugg

SEQ ID NO: 2762308 - RNA, 20 nt, Human
uuucugauccaguuuuguuu

SEQ ID NO: 2762309 - RNA, 16 nt, Human
uuucugauccaguuuu

SEQ ID NO: 2762310 - RNA, 15 nt, Human
uuucugauccaguuu

SEQ ID NO: 2762311 - RNA, 12 nt, Human
uuucucuaggaa

SEQ ID NO: 2762312 - RNA, 18 nt, Human
uuugguaaggggaauuga

SEQ ID NO: 2762313 - RNA, 21 nt, Human
uuugaaauuguauuacaaauc

SEQ ID NO: 2762314 - RNA, 12 nt, Human
uuguuucuguac

SEQ ID NO: 2762315 - RNA, 14 nt, Human
uuguuucuguacuu

SEQ ID NO: 2762316 - RNA, 14 nt, Human
uuguuuguuuaguc

SEQ ID NO: 2762317 - RNA, 13 nt, Human
uuguuuguuuagu

SEQ ID NO: 2762318 - RNA, 18 nt, Human
uuguuuaaaaucauuucu

SEQ ID NO: 2762319 - RNA, 17 nt, Human
uuguuuaaaaucauuuc

SEQ ID NO: 2762320 - RNA, 12 nt, Human
uuuaaaaugucu

SEQ ID NO: 2762321 - RNA, 17 nt, Human
uuuaaaagaaugauuau

SEQ ID NO: 2762322 - RNA, 14 nt, Human
uuuaaaagaaugau

SEQ ID NO: 2762323 - RNA, 16 nt, Human
uuuaaaaucauuucug

SEQ ID NO: 2762324 - RNA, 19 nt, Human
uuuaaaauacacacucaaa

SEQ ID NO: 2762325 - RNA, 14 nt, Human
uuuaauauuaaagc

SEQ ID NO: 2762326 - RNA, 21 nt, Human
uuuaauauuaaagccauguuu

SEQ ID NO: 2762327 - RNA, 20 nt, Human
uuuaauauuaaagccauguu

SEQ ID NO: 2762328 - RNA, 17 nt, Human
uuuaauauuaaagccau

SEQ ID NO: 2762329 - RNA, 15 nt, Human
uuuaauauuaaagcc

SEQ ID NO: 2762330 - RNA, 13 nt, Human
uuuacagagacag

SEQ ID NO: 2762331 - RNA, 19 nt, Human
uuuaauaauguuucaaaca

SEQ ID NO: 2762332 - RNA, 15 nt, Human
uuuaauaauguuuca

SEQ ID NO: 2762333 - RNA, 14 nt, Human
uuuaauaauguuuc

SEQ ID NO: 2762334 - RNA, 13 nt, Human
uuuaauaaaccau

SEQ ID NO: 2762335 - RNA, 17 nt, Human
uuaucugaagucagauc

SEQ ID NO: 2762336 - RNA, 21 nt, Human
uuauggcacuaguauuucuau

SEQ ID NO: 2762337 - RNA, 17 nt, Human
uuauggcuauaggugcu

SEQ ID NO: 2762338 - RNA, 16 nt, Human
uuauuacuguaagaaa

SEQ ID NO: 2762339 - RNA, 18 nt, Human
uuauuacuguaagaaaau

SEQ ID NO: 2762340 - RNA, 17 nt, Human
uuauuacuguaagaaaa

SEQ ID NO: 2762341 - RNA, 16 nt, Human
uucagacauagaauua

SEQ ID NO: 2762342 - RNA, 20 nt, Human
uucagacauagaauuaacac

SEQ ID NO: 2762343 - RNA, 21 nt, Human
uucacucuccauuuaauaauu

SEQ ID NO: 2762344 - RNA, 13 nt, Human
uucagagcugccc

SEQ ID NO: 2762345 - RNA, 22 nt, Human
uuauuggcuuuucugauccagu

SEQ ID NO: 2762346 - RNA, 18 nt, Human
uuauuggcuuuucugauc

SEQ ID NO: 2762347 - RNA, 16 nt, Human
uuauuggcuuuucuga

SEQ ID NO: 2762348 - RNA, 12 nt, Human
uuauuggcuuuu

SEQ ID NO: 2762349 - RNA, 16 nt, Human
uuauuuuaauaauguu

SEQ ID NO: 2762350 - RNA, 15 nt, Human
uuauuuuaauaaugu

SEQ ID NO: 2762351 - RNA, 15 nt, Human
uuauugucuagugaa

SEQ ID NO: 2762352 - RNA, 13 nt, Human
uuauuuuauuaug

SEQ ID NO: 2762353 - RNA, 23 nt, Human
uucaaaguugccuaaauccauuu

SEQ ID NO: 2762354 - RNA, 17 nt, Human
uucaaaguugccuaaau

SEQ ID NO: 2762355 - RNA, 16 nt, Human
uucaaaguugccuaaa

SEQ ID NO: 2762356 - RNA, 15 nt, Human
uucaaaguugccuaa

SEQ ID NO: 2762357 - RNA, 11 nt, Human
uucaaaguugc

SEQ ID NO: 2762358 - RNA, 19 nt, Human
uuccagauccuggaaauca

SEQ ID NO: 2762359 - RNA, 22 nt, Human
uucggccuccauccugaggcuc

SEQ ID NO: 2762360 - RNA, 17 nt, Human
uuccuuggacucauuuu

SEQ ID NO: 2762361 - RNA, 20 nt, Human
uuccuuggacucauuuuaaa

SEQ ID NO: 2762362 - RNA, 17 nt, Human
uucccuugaugaagaag

SEQ ID NO: 2762363 - RNA, 17 nt, Human
uuacuaguuucccuugc

SEQ ID NO: 2762364 - RNA, 14 nt, Human
uuagagaguguuga

SEQ ID NO: 2762365 - RNA, 17 nt, Human
uuagagaguguugaaac

SEQ ID NO: 2762366 - RNA, 16 nt, Human
uuagagaguguugaaa

SEQ ID NO: 2762367 - RNA, 19 nt, Human
uuagaaacacaacuauauu

SEQ ID NO: 2762368 - RNA, 13 nt, Human
uuagcuggaaaag

SEQ ID NO: 2762369 - RNA, 12 nt, Human
uuagcuggaaaa

SEQ ID NO: 2762370 - RNA, 12 nt, Human
uuagagauuuuu

SEQ ID NO: 2762371 - RNA, 18 nt, Human
uuagagaguguugaaacg

SEQ ID NO: 2762372 - RNA, 14 nt, Human
uuagaucuaguuca

SEQ ID NO: 2762373 - RNA, 13 nt, Human
uuagaucuaguuc

SEQ ID NO: 2762374 - RNA, 21 nt, Human
uuagaugcaguucugaagaag

SEQ ID NO: 2762375 - RNA, 20 nt, Human
uuagaugcaguucugaagaa

SEQ ID NO: 2762376 - RNA, 18 nt, Human
uuaggauguugaaaaagu

SEQ ID NO: 2762377 - RNA, 19 nt, Human
uuaagcauauauuuuuaua

SEQ ID NO: 2762378 - RNA, 13 nt, Human
uuaagcauauauu

SEQ ID NO: 2762379 - RNA, 18 nt, Human
uuaagcauauauuuuuau

SEQ ID NO: 2762380 - RNA, 15 nt, Human
uuaagcauauauuuu

SEQ ID NO: 2762381 - RNA, 20 nt, Human
uuaauauuaaagccauguuu

SEQ ID NO: 2762382 - RNA, 22 nt, Human
uuaauauuaaagccauguuuau

SEQ ID NO: 2762383 - RNA, 21 nt, Human
uuaauauuaaagccauguuua

SEQ ID NO: 2762384 - RNA, 22 nt, Human
uguuucaaacauauauaacaau

SEQ ID NO: 2762385 - RNA, 21 nt, Human
uguuucaaacauauauaacaa

SEQ ID NO: 2762386 - RNA, 19 nt, Human
uguuucaaacauauauaac

SEQ ID NO: 2762387 - RNA, 21 nt, Human
uuaaaagaauauuuuaacuuc

SEQ ID NO: 2762388 - RNA, 22 nt, Human
uuaaaagaauauuuuaacuucc

SEQ ID NO: 2762389 - RNA, 15 nt, Human
uuaaaagaugaaaau

SEQ ID NO: 2762390 - RNA, 18 nt, Human
uuaaaagaugaaaauauu

SEQ ID NO: 2762391 - RNA, 19 nt, Human
uuaaaauacacacucaaau

SEQ ID NO: 2762392 - RNA, 15 nt, Human
ugggcagcugccucc

SEQ ID NO: 2762393 - RNA, 14 nt, Human
ugggcagcugccuc

SEQ ID NO: 2762394 - RNA, 13 nt, Human
ugggcagcugccu

SEQ ID NO: 2762395 - RNA, 12 nt, Human
ugggcagcugcc

SEQ ID NO: 2762396 - RNA, 19 nt, Human
ugggcagcugccuccccuc

SEQ ID NO: 2762397 - RNA, 17 nt, Human
ugggcagcugccucccc

SEQ ID NO: 2762398 - RNA, 19 nt, Human
uggugacugauucuucagc

SEQ ID NO: 2762399 - RNA, 16 nt, Human
uggugacugauucuuc

SEQ ID NO: 2762400 - RNA, 15 nt, Human
uggugacugauucuu

SEQ ID NO: 2762401 - RNA, 20 nt, Human
ugguccgugcuaaggacuug

SEQ ID NO: 2762402 - RNA, 19 nt, Human
ugguccgugcuaaggacuu

SEQ ID NO: 2762403 - RNA, 18 nt, Human
ugguccgugcuaaggacu

SEQ ID NO: 2762404 - RNA, 17 nt, Human
ugguccgugcuaaggac

SEQ ID NO: 2762405 - RNA, 16 nt, Human
uggucccagccagcag

SEQ ID NO: 2762406 - RNA, 17 nt, Human
uggucacaggaaguaga

SEQ ID NO: 2762407 - RNA, 22 nt, Human
uggucacaggaaguagaggagg

SEQ ID NO: 2762408 - RNA, 13 nt, Human
ugguauguuuuca

SEQ ID NO: 2762409 - RNA, 22 nt, Human
uggaccaaaaaccaguauugua

SEQ ID NO: 2762410 - RNA, 17 nt, Human
uggaccaaaaaccagua

SEQ ID NO: 2762411 - RNA, 20 nt, Human
uggcaauagucaaauugugu

SEQ ID NO: 2762412 - RNA, 15 nt, Human
uggcacuaguauuuc

SEQ ID NO: 2762413 - RNA, 13 nt, Human
ugccuaaauccau

SEQ ID NO: 2762414 - RNA, 19 nt, Human
ugccuaaauccauuuggaa

SEQ ID NO: 2762415 - RNA, 15 nt, Human
ugccuaaauccauuu

SEQ ID NO: 2762416 - RNA, 20 nt, Human
ugccucacccacccuuuuuu

SEQ ID NO: 2762417 - RNA, 23 nt, Human
ugccuaaauccauuuggaaaucu

SEQ ID NO: 2762418 - RNA, 22 nt, Human
ugccuaaauccauuuggaaauc

SEQ ID NO: 2762419 - RNA, 20 nt, Human
ugccuaaauccauuuggaaa

SEQ ID NO: 2762420 - RNA, 16 nt, Human
ugccacuaaauugaca

SEQ ID NO: 2762421 - RNA, 13 nt, Human
ugcaucagcugcu

SEQ ID NO: 2762422 - RNA, 12 nt, Human
ugcaguucugaa

SEQ ID NO: 2762423 - RNA, 22 nt, Human
ugcaucaauuuuucuuauuuca

SEQ ID NO: 2762424 - RNA, 22 nt, Human
ugcugguguaugugugaaguga

SEQ ID NO: 2762425 - RNA, 13 nt, Human
ugcugguguaugu

SEQ ID NO: 2762426 - RNA, 20 nt, Human
ugcugggguuaucugaaguc

SEQ ID NO: 2762427 - RNA, 17 nt, Human
ugcugggguuaucugaa

SEQ ID NO: 2762428 - RNA, 20 nt, Human
ugcugggggggauuguaaaa

SEQ ID NO: 2762429 - RNA, 21 nt, Human
ugcgcuaaacuuuucugauag

SEQ ID NO: 2762430 - RNA, 20 nt, Human
ugcgcuaaacuuuucugaua

SEQ ID NO: 2762431 - RNA, 19 nt, Human
ugcgcuaaacuuuucugau

SEQ ID NO: 2762432 - RNA, 17 nt, Human
ugcuagaacucccuuuc

SEQ ID NO: 2762433 - RNA, 15 nt, Human
ugcuagaacucccuu

SEQ ID NO: 2762434 - RNA, 14 nt, Human
ugcuagaacucccu

SEQ ID NO: 2762435 - RNA, 13 nt, Human
ugcuagaacuccc

SEQ ID NO: 2762436 - RNA, 20 nt, Human
ugaggcuccacuuggucugu

SEQ ID NO: 2762437 - RNA, 18 nt, Human
ugaggcuccacuuggucu

SEQ ID NO: 2762438 - RNA, 16 nt, Human
ugauaacuggaaacuu

SEQ ID NO: 2762439 - RNA, 13 nt, Human
ugagccccaaaag

SEQ ID NO: 2762440 - RNA, 16 nt, Human
ugagagugaacaaauu

SEQ ID NO: 2762441 - RNA, 15 nt, Human
ugauagaggaagccu

SEQ ID NO: 2762442 - RNA, 17 nt, Human
ugaucagcuuauugucu

SEQ ID NO: 2762443 - RNA, 24 nt, Human
ugaucagcuuauugucuagugaaa

SEQ ID NO: 2762444 - RNA, 14 nt, Human
ugaucuuuaaaaua

SEQ ID NO: 2762445 - RNA, 17 nt, Human
ugaucuuuaaaauacac

SEQ ID NO: 2762446 - RNA, 23 nt, Human
ugaugcuacaggauuugaaauug

SEQ ID NO: 2762447 - RNA, 20 nt, Human
ugaugcuacaggauuugaaa

SEQ ID NO: 2762448 - RNA, 15 nt, Human
ugauggugguauguu

SEQ ID NO: 2762449 - RNA, 21 nt, Human
ugauucuucagcaaaaauauu

SEQ ID NO: 2762450 - RNA, 22 nt, Human
ugauuaugaauuacauuuguau

SEQ ID NO: 2762451 - RNA, 21 nt, Human
ugauuaugaauuacauuugua

SEQ ID NO: 2762452 - RNA, 19 nt, Human
ugauuaugaauuacauuug

SEQ ID NO: 2762453 - RNA, 17 nt, Human
ugauuaugaauuacauu

SEQ ID NO: 2762454 - RNA, 13 nt, Human
ugauuauauguca

SEQ ID NO: 2762455 - RNA, 22 nt, Human
ugauguuuagaaacacaacuau

SEQ ID NO: 2762456 - RNA, 16 nt, Human
ugauuaccagggacug

SEQ ID NO: 2762457 - RNA, 12 nt, Human
ucuuugccaagu

SEQ ID NO: 2762458 - RNA, 19 nt, Human
ucuuuccacagaagcucca

SEQ ID NO: 2762459 - RNA, 15 nt, Human
ucuugccuuuuucau

SEQ ID NO: 2762460 - RNA, 17 nt, Human
ucuugccuuuuucauua

SEQ ID NO: 2762461 - RNA, 16 nt, Human
ucuugccuuuuucauu

SEQ ID NO: 2762462 - RNA, 19 nt, Human
ucuugccuuuuucauuauu

SEQ ID NO: 2762463 - RNA, 17 nt, Human
ucuuucacauuuaaaua

SEQ ID NO: 2762464 - RNA, 16 nt, Human
ugaaauauugacuuuu

SEQ ID NO: 2762465 - RNA, 19 nt, Human
ugaaauggacuuuuguaca

SEQ ID NO: 2762466 - RNA, 22 nt, Human
ugaaacaacaaauaggaauugu

SEQ ID NO: 2762467 - RNA, 18 nt, Human
ugaaagaggcagcuugaa

SEQ ID NO: 2762468 - RNA, 16 nt, Human
ugaaagguacuucaaa

SEQ ID NO: 2762469 - RNA, 15 nt, Human
ugaaagguacuucaa

SEQ ID NO: 2762470 - RNA, 18 nt, Human
ugaauuacauuuguauaa

SEQ ID NO: 2762471 - RNA, 16 nt, Human
ugaauuacauuuguau

SEQ ID NO: 2762472 - RNA, 15 nt, Human
ugaauuacauuugua

SEQ ID NO: 2762473 - RNA, 14 nt, Human
ugaauuacauuugu

SEQ ID NO: 2762474 - RNA, 20 nt, Human
ugaaugaauggcuaagcaaa

SEQ ID NO: 2762475 - RNA, 13 nt, Human
ugaaguccaagca

SEQ ID NO: 2762476 - RNA, 20 nt, Human
ugaagucagaucugccuaag

SEQ ID NO: 2762477 - RNA, 23 nt, Human
ugaagucagaucugccuaaggac

SEQ ID NO: 2762478 - RNA, 11 nt, Human
ugaaguccaag

SEQ ID NO: 2762479 - RNA, 18 nt, Human
ugacaugggacauuugcu

SEQ ID NO: 2762480 - RNA, 17 nt, Human
ugacauagucuggcugu

SEQ ID NO: 2762481 - RNA, 16 nt, Human
ugacauagucuggcug

SEQ ID NO: 2762482 - RNA, 17 nt, Human
ugacaugggacauuugc

SEQ ID NO: 2762483 - RNA, 16 nt, Human
ugacaugggacauuug

SEQ ID NO: 2762484 - RNA, 20 nt, Human
ugaccacugcagaagacagu

SEQ ID NO: 2762485 - RNA, 18 nt, Human
ugaccacugcagaagaca

SEQ ID NO: 2762486 - RNA, 20 nt, Human
ugacaagcucacagaccuuu

SEQ ID NO: 2762487 - RNA, 15 nt, Human
ugacaagcucacaga

SEQ ID NO: 2762488 - RNA, 12 nt, Human
ugacaagcucac

SEQ ID NO: 2762489 - RNA, 23 nt, Human
ucucaguccaugaagauguagag

SEQ ID NO: 2762490 - RNA, 14 nt, Human
ucggagaagagcug

SEQ ID NO: 2762491 - RNA, 16 nt, Human
ucggagaagagcuguu

SEQ ID NO: 2762492 - RNA, 12 nt, Human
ucggagaagagc

SEQ ID NO: 2762493 - RNA, 18 nt, Human
ucuaugaaauauuauguu

SEQ ID NO: 2762494 - RNA, 20 nt, Human
uccugaggcuccacuugguc

SEQ ID NO: 2762495 - RNA, 19 nt, Human
uccugaggcuccacuuggu

SEQ ID NO: 2762496 - RNA, 17 nt, Human
uccugaggcuccacuug

SEQ ID NO: 2762497 - RNA, 18 nt, Human
uccugccccugagcccau

SEQ ID NO: 2762498 - RNA, 17 nt, Human
uccugccccugagccca

SEQ ID NO: 2762499 - RNA, 20 nt, Human
uccuaucaccugucuugccu

SEQ ID NO: 2762500 - RNA, 14 nt, Human
uccuagugaaagag

SEQ ID NO: 2762501 - RNA, 23 nt, Human
uccuagugaaagaggcagcuuga

SEQ ID NO: 2762502 - RNA, 14 nt, Human
ucccauuauucaaa

SEQ ID NO: 2762503 - RNA, 13 nt, Human
ucccauuauucaa

SEQ ID NO: 2762504 - RNA, 19 nt, Human
ucccauuauucaaaguugc

SEQ ID NO: 2762505 - RNA, 18 nt, Human
ucccauuauucaaaguug

SEQ ID NO: 2762506 - RNA, 16 nt, Human
ucccauuauucaaagu

SEQ ID NO: 2762507 - RNA, 17 nt, Human
uccaguuuuguuuggac

SEQ ID NO: 2762508 - RNA, 15 nt, Human
uccaguuuuguuugg

SEQ ID NO: 2762509 - RNA, 20 nt, Human
uccaguuuuguuuggaccaa

SEQ ID NO: 2762510 - RNA, 12 nt, Human
uccauacauuug

SEQ ID NO: 2762511 - RNA, 19 nt, Human
uccagguagagggugugua

SEQ ID NO: 2762512 - RNA, 15 nt, Human
uccauacauuugugu

SEQ ID NO: 2762513 - RNA, 20 nt, Human
uccaugggccauaugaaaag

SEQ ID NO: 2762514 - RNA, 14 nt, Human
uccagcagauuauu

SEQ ID NO: 2762515 - RNA, 16 nt, Human
uccagcagauuauuca

SEQ ID NO: 2762516 - RNA, 15 nt, Human
uccagcagauuauuc

SEQ ID NO: 2762517 - RNA, 23 nt, Human
uccacuuggucugugagaugcua

SEQ ID NO: 2762518 - RNA, 17 nt, Human
uccacuuggucugugag

SEQ ID NO: 2762519 - RNA, 21 nt, Human
uccacuuggucugugagaugc

SEQ ID NO: 2762520 - RNA, 20 nt, Human
ucauggaacgcguugaaauu

SEQ ID NO: 2762521 - RNA, 22 nt, Human
ucauggaacgcguugaaauugu

SEQ ID NO: 2762522 - RNA, 21 nt, Human
ucauggaacgcguugaaauug

SEQ ID NO: 2762523 - RNA, 17 nt, Human
ucaucaaugaaugaaug

SEQ ID NO: 2762524 - RNA, 12 nt, Human
ucauagcagcuu

SEQ ID NO: 2762525 - RNA, 11 nt, Human
ucauagcagcu

SEQ ID NO: 2762526 - RNA, 14 nt, Human
uccaaagaaaugua

SEQ ID NO: 2762527 - RNA, 17 nt, Human
uccaaagaaauguaagg

SEQ ID NO: 2762528 - RNA, 16 nt, Human
ucauuaggauggcuag

SEQ ID NO: 2762529 - RNA, 16 nt, Human
uaggucagugcaaaua

SEQ ID NO: 2762530 - RNA, 18 nt, Human
uaggccaugggacaggga

SEQ ID NO: 2762531 - RNA, 16 nt, Human
uaggccaugggacagg

SEQ ID NO: 2762532 - RNA, 12 nt, Human
uaggaauugacc

SEQ ID NO: 2762533 - RNA, 15 nt, Human
uagugcaaauuguca

SEQ ID NO: 2762534 - RNA, 14 nt, Human
uagugcaaauuguc

SEQ ID NO: 2762535 - RNA, 13 nt, Human
uagucaaauugug

SEQ ID NO: 2762536 - RNA, 16 nt, Human
uaguauuucuaugaaa

SEQ ID NO: 2762537 - RNA, 19 nt, Human
uaguauuucuaugaaauau

SEQ ID NO: 2762538 - RNA, 18 nt, Human
uaguauuucuaugaaaua

SEQ ID NO: 2762539 - RNA, 13 nt, Human
uaguaucaaaaga

SEQ ID NO: 2762540 - RNA, 12 nt, Human
uauaauuaacau

SEQ ID NO: 2762541 - RNA, 14 nt, Human
uauaauuaacaugu

SEQ ID NO: 2762542 - RNA, 13 nt, Human
uauaauuaacaug

SEQ ID NO: 2762543 - RNA, 19 nt, Human
uauaauuaacauguuaaac

SEQ ID NO: 2762544 - RNA, 18 nt, Human
uauaauuaacauguuaaa

SEQ ID NO: 2762545 - RNA, 16 nt, Human
uauaauuaacauguua

SEQ ID NO: 2762546 - RNA, 15 nt, Human
uauaauuaacauguu

SEQ ID NO: 2762547 - RNA, 22 nt, Human
uauaauuaacauguuaaaccau

SEQ ID NO: 2762548 - RNA, 18 nt, Human
uauaucugaggaauucug

SEQ ID NO: 2762549 - RNA, 22 nt, Human
uauaucugaggaauucuguaua

SEQ ID NO: 2762550 - RNA, 21 nt, Human
uauaucugaggaauucuguau

SEQ ID NO: 2762551 - RNA, 20 nt, Human
uauaucugaggaauucugua

SEQ ID NO: 2762552 - RNA, 19 nt, Human
uauaucugaggaauucugu

SEQ ID NO: 2762553 - RNA, 13 nt, Human
uauaugcuucugu

SEQ ID NO: 2762554 - RNA, 16 nt, Human
uaugcuucuguuuuau

SEQ ID NO: 2762555 - RNA, 15 nt, Human
uaugcuucuguuuua

SEQ ID NO: 2762556 - RNA, 16 nt, Human
uaugauucccagccag

SEQ ID NO: 2762557 - RNA, 15 nt, Human
uaugcaaagcacuga

SEQ ID NO: 2762558 - RNA, 13 nt, Human
uaugcaaagcacu

SEQ ID NO: 2762559 - RNA, 14 nt, Human
uaugcaaagcacug

SEQ ID NO: 2762560 - RNA, 12 nt, Human
uaugcaaagcac

SEQ ID NO: 2762561 - RNA, 17 nt, Human
uaugaauuacauuugua

SEQ ID NO: 2762562 - RNA, 23 nt, Human
uaugaauuacauuuguauaaaau

SEQ ID NO: 2762563 - RNA, 22 nt, Human
uaucugaggaauucuguauaga

SEQ ID NO: 2762564 - RNA, 21 nt, Human
uaucugaggaauucuguauag

SEQ ID NO: 2762565 - RNA, 19 nt, Human
uaucugaggaauucuguau

SEQ ID NO: 2762566 - RNA, 18 nt, Human
uaucugaggaauucugua

SEQ ID NO: 2762567 - RNA, 16 nt, Human
uaucugaggaauucug

SEQ ID NO: 2762568 - RNA, 17 nt, Human
uaucugaggaauucugu

SEQ ID NO: 2762569 - RNA, 14 nt, Human
uauccuucagccug

SEQ ID NO: 2762570 - RNA, 15 nt, Human
uauccuucagccuga

SEQ ID NO: 2762571 - RNA, 17 nt, Human
uauguucuaagaaguga

SEQ ID NO: 2762572 - RNA, 19 nt, Human
uauggaggcuuugcauaga

SEQ ID NO: 2762573 - RNA, 12 nt, Human
uauguuaaaacu

SEQ ID NO: 2762574 - RNA, 19 nt, Human
uauguuagugcaaauuguc

SEQ ID NO: 2762575 - RNA, 16 nt, Human
uauuaagcauauauuu

SEQ ID NO: 2762576 - RNA, 17 nt, Human
uauuauauuuacaaaug

SEQ ID NO: 2762577 - RNA, 22 nt, Human
uauuaugaaacuuguguaaaua

SEQ ID NO: 2762578 - RNA, 21 nt, Human
uauuaugaaacuuguguaaau

SEQ ID NO: 2762579 - RNA, 20 nt, Human
uauuaugaaacuuguguaaa

SEQ ID NO: 2762580 - RNA, 12 nt, Human
uauuaugaaacu

SEQ ID NO: 2762581 - RNA, 15 nt, Human
uauuauguaaauccc

SEQ ID NO: 2762582 - RNA, 12 nt, Human
uauuauguaaau

SEQ ID NO: 2762583 - RNA, 22 nt, Human
uauuauguaaaucccauuauuc

SEQ ID NO: 2762584 - RNA, 16 nt, Human
uauuauguuaaaacug

SEQ ID NO: 2762585 - RNA, 20 nt, Human
uauuguuuaaaaucauuucu

SEQ ID NO: 2762586 - RNA, 15 nt, Human
uauuucuaugaaaua

SEQ ID NO: 2762587 - RNA, 14 nt, Human
uauuucuaugaaau

SEQ ID NO: 2762588 - RNA, 13 nt, Human
uauuuauuacugu

SEQ ID NO: 2762589 - RNA, 13 nt, Human
uauuucuaugaaa

SEQ ID NO: 2762590 - RNA, 14 nt, Human
uauuuauuacugua

SEQ ID NO: 2762591 - RNA, 23 nt, Human
uauugugcgcuaaacuuuucuga

SEQ ID NO: 2762592 - RNA, 22 nt, Human
uauugugcgcuaaacuuuucug

SEQ ID NO: 2762593 - RNA, 19 nt, Human
uauugugcgcuaaacuuuu

SEQ ID NO: 2762594 - RNA, 15 nt, Human
uauuguuuaaaauca

SEQ ID NO: 2762595 - RNA, 16 nt, Human
uauuguuuaaaaucau

SEQ ID NO: 2762596 - RNA, 17 nt, Human
uauuguuuaaaaucauu

SEQ ID NO: 2762597 - RNA, 19 nt, Human
ucaauaaaaaauuaugaca

SEQ ID NO: 2762598 - RNA, 22 nt, Human
ucacaagacccaaaaggcagaa

SEQ ID NO: 2762599 - RNA, 18 nt, Human
ucacauugguguuguacu

SEQ ID NO: 2762600 - RNA, 12 nt, Human
ucacauuuaaau

SEQ ID NO: 2762601 - RNA, 13 nt, Human
ucaauaaaaaauu

SEQ ID NO: 2762602 - RNA, 16 nt, Human
ucaauaaaaaauuaug

SEQ ID NO: 2762603 - RNA, 14 nt, Human
ucaauaaaaaauua

SEQ ID NO: 2762604 - RNA, 22 nt, Human
ucaacuccaaacugacucuuaa

SEQ ID NO: 2762605 - RNA, 16 nt, Human
ucaaauaugcaaagca

SEQ ID NO: 2762606 - RNA, 17 nt, Human
ucaaauaugcaaagcac

SEQ ID NO: 2762607 - RNA, 18 nt, Human
ucaaauaugcaaagcacu

SEQ ID NO: 2762608 - RNA, 19 nt, Human
ucaaauaugcaaagcacug

SEQ ID NO: 2762609 - RNA, 15 nt, Human
ucaaauccuugaaga

SEQ ID NO: 2762610 - RNA, 16 nt, Human
ucaaauccuugaagau

SEQ ID NO: 2762611 - RNA, 22 nt, Human
ucaaacagucucaggaaaucaa

SEQ ID NO: 2762612 - RNA, 17 nt, Human
ucaaacauauauaacaa

SEQ ID NO: 2762613 - RNA, 14 nt, Human
gugagcuacaaaug

SEQ ID NO: 2762614 - RNA, 16 nt, Human
gugagcagucaggaaa

SEQ ID NO: 2762615 - RNA, 14 nt, Human
gugaauggcuuugu

SEQ ID NO: 2762616 - RNA, 13 nt, Human
gugaauggcuuug

SEQ ID NO: 2762617 - RNA, 19 nt, Human
gugaauggcuuuguauaga

SEQ ID NO: 2762618 - RNA, 18 nt, Human
gugaauggcuuuguauag

SEQ ID NO: 2762619 - RNA, 17 nt, Human
gugaauggcuuuguaua

SEQ ID NO: 2762620 - RNA, 19 nt, Human
gugaaagaaaauaacaaua

SEQ ID NO: 2762621 - RNA, 20 nt, Human
gugaaacucguuaauuugua

SEQ ID NO: 2762622 - RNA, 18 nt, Human
gugcaaauugucacagga

SEQ ID NO: 2762623 - RNA, 13 nt, Human
gucucagauuuua

SEQ ID NO: 2762624 - RNA, 17 nt, Human
gucuacacuaagagaga

SEQ ID NO: 2762625 - RNA, 23 nt, Human
gucuacacuaagagagaaugaga

SEQ ID NO: 2762626 - RNA, 20 nt, Human
gucccagccagcaguucaga

SEQ ID NO: 2762627 - RNA, 21 nt, Human
gucaauaaaauccauacauuu

SEQ ID NO: 2762628 - RNA, 15 nt, Human
gucaauaaaauccau

SEQ ID NO: 2762629 - RNA, 14 nt, Human
gucaccucauggaa

SEQ ID NO: 2762630 - RNA, 17 nt, Human
guauuuuaaaagaauga

SEQ ID NO: 2762631 - RNA, 16 nt, Human
guauuuuaaaagaaug

SEQ ID NO: 2762632 - RNA, 17 nt, Human
guauuucuaugaaauau

SEQ ID NO: 2762633 - RNA, 22 nt, Human
guauuucuaugaaauauuaugu

SEQ ID NO: 2762634 - RNA, 18 nt, Human
gguccgugcuaaggacuu

SEQ ID NO: 2762635 - RNA, 17 nt, Human
gguccgugcuaaggacu

SEQ ID NO: 2762636 - RNA, 16 nt, Human
gguccgugcuaaggac

SEQ ID NO: 2762637 - RNA, 14 nt, Human
ggugaauggcuuug

SEQ ID NO: 2762638 - RNA, 20 nt, Human
ggugaauggcuuuguauaga

SEQ ID NO: 2762639 - RNA, 17 nt, Human
ggugaauggcuuuguau

SEQ ID NO: 2762640 - RNA, 19 nt, Human
ggugcccugcuuucagaua

SEQ ID NO: 2762641 - RNA, 19 nt, Human
ggugcuacaaaaacacagc

SEQ ID NO: 2762642 - RNA, 22 nt, Human
gguacuucaaauccuugaagau

SEQ ID NO: 2762643 - RNA, 22 nt, Human
gguagacacacaugaaguccaa

SEQ ID NO: 2762644 - RNA, 15 nt, Human
gguagacacacauga

SEQ ID NO: 2762645 - RNA, 23 nt, Human
guaaaaccacagcaguugaaaag

SEQ ID NO: 2762646 - RNA, 14 nt, Human
guaaaaccacagca

SEQ ID NO: 2762647 - RNA, 15 nt, Human
guaaaaccacagcag

SEQ ID NO: 2762648 - RNA, 16 nt, Human
guaaaaccacagcagu

SEQ ID NO: 2762649 - RNA, 18 nt, Human
guaaaaccacagcaguug

SEQ ID NO: 2762650 - RNA, 21 nt, Human
guaaaucccauuauucaaagu

SEQ ID NO: 2762651 - RNA, 20 nt, Human
guaaaucccauuauucaaag

SEQ ID NO: 2762652 - RNA, 19 nt, Human
guaaaucccauuauucaaa

SEQ ID NO: 2762653 - RNA, 18 nt, Human
guaaaucccauuauucaa

SEQ ID NO: 2762654 - RNA, 17 nt, Human
guaaaucccauuauuca

SEQ ID NO: 2762655 - RNA, 16 nt, Human
guaaaucccauuauuc

SEQ ID NO: 2762656 - RNA, 21 nt, Human
guaaauacaauuuuguuucug

SEQ ID NO: 2762657 - RNA, 15 nt, Human
guaaaucccauuauu

SEQ ID NO: 2762658 - RNA, 23 nt, Human
guaaauacaauuuuguuucugua

SEQ ID NO: 2762659 - RNA, 22 nt, Human
guaaauacaauuuuguuucugu

SEQ ID NO: 2762660 - RNA, 17 nt, Human
guaagggaaacugccag

SEQ ID NO: 2762661 - RNA, 18 nt, Human
guaagggaaacugccagc

SEQ ID NO: 2762662 - RNA, 23 nt, Human
guacuuuauuuucuauaauuuaa

SEQ ID NO: 2762663 - RNA, 21 nt, Human
guacuuuuuggcauaacauaa

SEQ ID NO: 2762664 - RNA, 12 nt, Human
guacuuuuuggc

SEQ ID NO: 2762665 - RNA, 15 nt, Human
guagaggagaaacug

SEQ ID NO: 2762666 - RNA, 15 nt, Human
guaccgcaaugugac

SEQ ID NO: 2762667 - RNA, 13 nt, Human
guaauuauaucug

SEQ ID NO: 2762668 - RNA, 15 nt, Human
guaauuggaaaggca

SEQ ID NO: 2762669 - RNA, 19 nt, Human
guaaugauaacuggaaacu

SEQ ID NO: 2762670 - RNA, 20 nt, Human
gcucucuggccuucggccuc

SEQ ID NO: 2762671 - RNA, 19 nt, Human
gcucucuggccuucggccu

SEQ ID NO: 2762672 - RNA, 15 nt, Human
gcucucuggccuucg

SEQ ID NO: 2762673 - RNA, 14 nt, Human
gcucucuggccuuc

SEQ ID NO: 2762674 - RNA, 11 nt, Human
gcucucuggcc

SEQ ID NO: 2762675 - RNA, 13 nt, Human
gcucucuggccuu

SEQ ID NO: 2762676 - RNA, 12 nt, Human
gcucucuggccu

SEQ ID NO: 2762677 - RNA, 17 nt, Human
gcuaagcaaaaugugau

SEQ ID NO: 2762678 - RNA, 14 nt, Human
gcuaagcauuccaa

SEQ ID NO: 2762679 - RNA, 23 nt, Human
gcccucuccugggcagcugccuc

SEQ ID NO: 2762680 - RNA, 22 nt, Human
gcccucuccugggcagcugccu

SEQ ID NO: 2762681 - RNA, 13 nt, Human
gcccucuccuggg

SEQ ID NO: 2762682 - RNA, 12 nt, Human
gcccucuccugg

SEQ ID NO: 2762683 - RNA, 13 nt, Human
gccugauuaaaga

SEQ ID NO: 2762684 - RNA, 16 nt, Human
gccugauuaaagaaug

SEQ ID NO: 2762685 - RNA, 23 nt, Human
gccugcacggugaauggcuuugu

SEQ ID NO: 2762686 - RNA, 17 nt, Human
gccuaagugcagccccg

SEQ ID NO: 2762687 - RNA, 22 nt, Human
gccuauauuuuuuguuaaauga

SEQ ID NO: 2762688 - RNA, 23 nt, Human
gccuccccuccucugcuugccau

SEQ ID NO: 2762689 - RNA, 20 nt, Human
gcugucuacacuaagagaga

SEQ ID NO: 2762690 - RNA, 18 nt, Human
gcuuucagauacuggauu

SEQ ID NO: 2762691 - RNA, 14 nt, Human
gcuuucagauacug

SEQ ID NO: 2762692 - RNA, 20 nt, Human
gcuuuguauagaaccucuuu

SEQ ID NO: 2762693 - RNA, 23 nt, Human
gcuuucagauacuggauuguacu

SEQ ID NO: 2762694 - RNA, 16 nt, Human
ggaaaucaaauaugca

SEQ ID NO: 2762695 - RNA, 17 nt, Human
ggaaaucaaauaugcaa

SEQ ID NO: 2762696 - RNA, 14 nt, Human
ggaaaaguuuaaua

SEQ ID NO: 2762697 - RNA, 20 nt, Human
ggaagugacgguuuaauggg

SEQ ID NO: 2762698 - RNA, 17 nt, Human
ggaauucuguauagauu

SEQ ID NO: 2762699 - RNA, 15 nt, Human
ggaauucuguauaga

SEQ ID NO: 2762700 - RNA, 12 nt, Human
ggaauucuguau

SEQ ID NO: 2762701 - RNA, 22 nt, Human
ggaauuggagcucgugggacag

SEQ ID NO: 2762702 - RNA, 16 nt, Human
ggaauuggagcucgug

SEQ ID NO: 2762703 - RNA, 23 nt, Human
ggaauuucucccagucauuuaau

SEQ ID NO: 2762704 - RNA, 14 nt, Human
ggaccaaaaaccag

SEQ ID NO: 2762705 - RNA, 23 nt, Human
ggaccaaaaaccaguauuguaca

SEQ ID NO: 2762706 - RNA, 16 nt, Human
ggaccaaaaaccagua

SEQ ID NO: 2762707 - RNA, 22 nt, Human
ggacuguggugacuuuggauaa

SEQ ID NO: 2762708 - RNA, 21 nt, Human
ggacuguggugacuuuggaua

SEQ ID NO: 2762709 - RNA, 17 nt, Human
ggacuguggugacuuug

SEQ ID NO: 2762710 - RNA, 15 nt, Human
ggacuguggugacuu

SEQ ID NO: 2762711 - RNA, 19 nt, Human
ggagaaucacuugaacccg

SEQ ID NO: 2762712 - RNA, 15 nt, Human
ggagaaucacuugaa

SEQ ID NO: 2762713 - RNA, 14 nt, Human
ggacuguggugacu

SEQ ID NO: 2762714 - RNA, 14 nt, Human
ggacgcucucuggc

SEQ ID NO: 2762715 - RNA, 13 nt, Human
ggacgcucucugg

SEQ ID NO: 2762716 - RNA, 14 nt, Human
ggcauggcugggaa

SEQ ID NO: 2762717 - RNA, 16 nt, Human
ggauucuuaaaguuga

SEQ ID NO: 2762718 - RNA, 19 nt, Human
ggauucuuaaaguugaauu

SEQ ID NO: 2762719 - RNA, 18 nt, Human
ggauucuuaaaguugaau

SEQ ID NO: 2762720 - RNA, 20 nt, Human
ggauucuuaaaguugaauuu

SEQ ID NO: 2762721 - RNA, 15 nt, Human
ggauuguaaaauggu

SEQ ID NO: 2762722 - RNA, 16 nt, Human
gcaaauugucacagga

SEQ ID NO: 2762723 - RNA, 19 nt, Human
gauguugaaaaaguucugc

SEQ ID NO: 2762724 - RNA, 18 nt, Human
gaugcuagaacucccuuu

SEQ ID NO: 2762725 - RNA, 22 nt, Human
gaugcuagaacucccuuucaac

SEQ ID NO: 2762726 - RNA, 20 nt, Human
gaugcuagaacucccuuuca

SEQ ID NO: 2762727 - RNA, 18 nt, Human
gcacugacuucuaaguaa

SEQ ID NO: 2762728 - RNA, 15 nt, Human
gcacugacuucuaag

SEQ ID NO: 2762729 - RNA, 23 nt, Human
gagugaacaaauuuacagagaca

SEQ ID NO: 2762730 - RNA, 12 nt, Human
gaguguugaaac

SEQ ID NO: 2762731 - RNA, 16 nt, Human
gaguguugaaacggau

SEQ ID NO: 2762732 - RNA, 15 nt, Human
gauaaaugccaucaa

SEQ ID NO: 2762733 - RNA, 11 nt, Human
gauaaaugcca

SEQ ID NO: 2762734 - RNA, 20 nt, Human
gauaaaugccaucaauaaaa

SEQ ID NO: 2762735 - RNA, 22 nt, Human
gauaaauggcuuccuggcaaua

SEQ ID NO: 2762736 - RNA, 13 nt, Human
gagaguguugaaa

SEQ ID NO: 2762737 - RNA, 19 nt, Human
gagagacacacugaagaag

SEQ ID NO: 2762738 - RNA, 21 nt, Human
gagaaugagagacacacugaa

SEQ ID NO: 2762739 - RNA, 20 nt, Human
gagaaugagagacacacuga

SEQ ID NO: 2762740 - RNA, 20 nt, Human
gagacagcucugcauacuca

SEQ ID NO: 2762741 - RNA, 22 nt, Human
gagaaccuagggugauauuaac

SEQ ID NO: 2762742 - RNA, 21 nt, Human
gagaaccuagggugauauuaa

SEQ ID NO: 2762743 - RNA, 23 nt, Human
gagaacuuccagauccuggaaau

SEQ ID NO: 2762744 - RNA, 22 nt, Human
gagaacuuccagauccuggaaa

SEQ ID NO: 2762745 - RNA, 17 nt, Human
gagaaugagagacacac

SEQ ID NO: 2762746 - RNA, 21 nt, Human
gacuucuuuaauuuuggaauu

SEQ ID NO: 2762747 - RNA, 20 nt, Human
gacuucuuuaauuuuggaau

SEQ ID NO: 2762748 - RNA, 19 nt, Human
gacuucuuuaauuuuggaa

SEQ ID NO: 2762749 - RNA, 16 nt, Human
gacuucuuuaauuuug

SEQ ID NO: 2762750 - RNA, 18 nt, Human
gacuucuuuaauuuugga

SEQ ID NO: 2762751 - RNA, 17 nt, Human
gacuucuuuaauuuugg

SEQ ID NO: 2762752 - RNA, 16 nt, Human
gacuucuaaguaaaac

SEQ ID NO: 2762753 - RNA, 17 nt, Human
gacuucuaaguaaaacc

SEQ ID NO: 2762754 - RNA, 18 nt, Human
gacuucuaaguaaaacca

SEQ ID NO: 2762755 - RNA, 20 nt, Human
gacuucugucuucacaacag

SEQ ID NO: 2762756 - RNA, 23 nt, Human
gacuucugucuucacaacagauu

SEQ ID NO: 2762757 - RNA, 19 nt, Human
gacuucuaaguaaaaccac

SEQ ID NO: 2762758 - RNA, 23 nt, Human
gacuucuaaguaaaaccacagca

SEQ ID NO: 2762759 - RNA, 24 nt, Human
gacuucuaaguaaaaccacagcag

SEQ ID NO: 2762760 - RNA, 16 nt, Human
gacuccaaagaaaugu

SEQ ID NO: 2762761 - RNA, 21 nt, Human
gacucauuuuaaaaaauggaa

SEQ ID NO: 2762762 - RNA, 11 nt, Human
gacuccaaaga

SEQ ID NO: 2762763 - RNA, 12 nt, Human
gacuccaaagaa

SEQ ID NO: 2762764 - RNA, 15 nt, Human
gacuccaaagaaaug

SEQ ID NO: 2762765 - RNA, 16 nt, Human
gacugcauuauauuua

SEQ ID NO: 2762766 - RNA, 14 nt, Human
gacugcauuauauu

SEQ ID NO: 2762767 - RNA, 20 nt, Human
gacauagaauuaacacauga

SEQ ID NO: 2762768 - RNA, 17 nt, Human
gacagggaggacgcucu

SEQ ID NO: 2762769 - RNA, 18 nt, Human
gacagggaggacgcucuc

SEQ ID NO: 2762770 - RNA, 16 nt, Human
gacaugggacauuugc

SEQ ID NO: 2762771 - RNA, 21 nt, Human
gaccacugcagaagacaguau

SEQ ID NO: 2762772 - RNA, 15 nt, Human
gacccacaagaaaug

SEQ ID NO: 2762773 - RNA, 16 nt, Human
gacccaaaaggcagaa

SEQ ID NO: 2762774 - RNA, 16 nt, Human
gacaaggaaaaaauaa

SEQ ID NO: 2762775 - RNA, 15 nt, Human
gacaagcucacagac

SEQ ID NO: 2762776 - RNA, 16 nt, Human
gaauggcuuuguauag

SEQ ID NO: 2762777 - RNA, 14 nt, Human
gaauggcuuuguau

SEQ ID NO: 2762778 - RNA, 17 nt, Human
gaauggcuuuguauaga

SEQ ID NO: 2762779 - RNA, 11 nt, Human
gaauucuguau

SEQ ID NO: 2762780 - RNA, 13 nt, Human
gaauucuguauag

SEQ ID NO: 2762781 - RNA, 22 nt, Human
gaauucuguauagauuagaauu

SEQ ID NO: 2762782 - RNA, 21 nt, Human
gaauucuguauagauuagaau

SEQ ID NO: 2762783 - RNA, 14 nt, Human
gaauucuguauaga

SEQ ID NO: 2762784 - RNA, 16 nt, Human
gaauuggagcucgugg

SEQ ID NO: 2762785 - RNA, 21 nt, Human
gaauugacccacaagaaauga

SEQ ID NO: 2762786 - RNA, 16 nt, Human
gaauugacccacaaga

SEQ ID NO: 2762787 - RNA, 21 nt, Human
cuguuaaaagaugaaaauauu

SEQ ID NO: 2762788 - RNA, 23 nt, Human
cuguuaaaagaugaaaauauuug

SEQ ID NO: 2762789 - RNA, 20 nt, Human
cuguuaaaagaugaaaauau

SEQ ID NO: 2762790 - RNA, 22 nt, Human
cugggggggauuguaaaauggu

SEQ ID NO: 2762791 - RNA, 23 nt, Human
cuguaaucacagcuacuugggag

SEQ ID NO: 2762792 - RNA, 20 nt, Human
cugucuacacuaagagagaa

SEQ ID NO: 2762793 - RNA, 16 nt, Human
cuguauagauuagaau

SEQ ID NO: 2762794 - RNA, 22 nt, Human
cuguauuuuaaaagaaugauua

SEQ ID NO: 2762795 - RNA, 19 nt, Human
cuguauuuuaaaagaauga

SEQ ID NO: 2762796 - RNA, 20 nt, Human
cuguauuuuaaaagaaugau

SEQ ID NO: 2762797 - RNA, 16 nt, Human
cuggagcucugcccau

SEQ ID NO: 2762798 - RNA, 13 nt, Human
cuggagcucugcc

SEQ ID NO: 2762799 - RNA, 12 nt, Human
cuggagcucugc

SEQ ID NO: 2762800 - RNA, 23 nt, Human
cuggccuucggccuccauccuga

SEQ ID NO: 2762801 - RNA, 22 nt, Human
cuggccuucggccuccauccug

SEQ ID NO: 2762802 - RNA, 21 nt, Human
cuggcacaguuuucugagaaa

SEQ ID NO: 2762803 - RNA, 22 nt, Human
cuggcacaguuuucugagaaag

SEQ ID NO: 2762804 - RNA, 20 nt, Human
cuggcacaguuuucugagaa

SEQ ID NO: 2762805 - RNA, 18 nt, Human
cugcugaaacaacaaaua

SEQ ID NO: 2762806 - RNA, 12 nt, Human
cugccuaaggac

SEQ ID NO: 2762807 - RNA, 14 nt, Human
cugccuaaggacuu

SEQ ID NO: 2762808 - RNA, 13 nt, Human
cugccuaaggacu

SEQ ID NO: 2762809 - RNA, 15 nt, Human
cugccuaaggacuuc

SEQ ID NO: 2762810 - RNA, 13 nt, Human
cugccuccccucc

SEQ ID NO: 2762811 - RNA, 19 nt, Human
cugcccucuccugggcagc

SEQ ID NO: 2762812 - RNA, 18 nt, Human
cugcccucuccugggcag

SEQ ID NO: 2762813 - RNA, 16 nt, Human
cugcccucuccugggc

SEQ ID NO: 2762814 - RNA, 21 nt, Human
cugcccucuccugggcagcug

SEQ ID NO: 2762815 - RNA, 20 nt, Human
cugcccucuccugggcagcu

SEQ ID NO: 2762816 - RNA, 19 nt, Human
cuucuuuaauuuuggaauu

SEQ ID NO: 2762817 - RNA, 18 nt, Human
cuucuuuaauuuuggaau

SEQ ID NO: 2762818 - RNA, 17 nt, Human
cuucuuuaauuuuggaa

SEQ ID NO: 2762819 - RNA, 16 nt, Human
cuucuuuaauuuugga

SEQ ID NO: 2762820 - RNA, 15 nt, Human
cuucuuuaauuuugg

SEQ ID NO: 2762821 - RNA, 21 nt, Human
cuucugucuucacaacagauu

SEQ ID NO: 2762822 - RNA, 22 nt, Human
cuucugucuucacaacagauua

SEQ ID NO: 2762823 - RNA, 18 nt, Human
cuucugucuucacaacag

SEQ ID NO: 2762824 - RNA, 22 nt, Human
cuuagaugcaguucugaagaag

SEQ ID NO: 2762825 - RNA, 20 nt, Human
cuuagaugcaguucugaaga

SEQ ID NO: 2762826 - RNA, 15 nt, Human
cuuauuucauuucuu

SEQ ID NO: 2762827 - RNA, 14 nt, Human
cuuauuucauuucu

SEQ ID NO: 2762828 - RNA, 20 nt, Human
cuuugucuacaccauuaugu

SEQ ID NO: 2762829 - RNA, 23 nt, Human
cuuugucuacaccauuaugugcg

SEQ ID NO: 2762830 - RNA, 22 nt, Human
cuuugugcugggguuaucugaa

SEQ ID NO: 2762831 - RNA, 20 nt, Human
cuuugugcugggguuaucug

SEQ ID NO: 2762832 - RNA, 15 nt, Human
cuuugugcugggguu

SEQ ID NO: 2762833 - RNA, 16 nt, Human
cuuucucuuucguuac

SEQ ID NO: 2762834 - RNA, 22 nt, Human
cuuguuagaucuaguucacucu

SEQ ID NO: 2762835 - RNA, 12 nt, Human
cuuguguaaaua

SEQ ID NO: 2762836 - RNA, 21 nt, Human
cuuguguaaauacaauuuugu

SEQ ID NO: 2762837 - RNA, 16 nt, Human
cuuguguaaauacaau

SEQ ID NO: 2762838 - RNA, 14 nt, Human
cuuguguaaauaca

SEQ ID NO: 2762839 - RNA, 23 nt, Human
cuugucaauaaaauccauacauu

SEQ ID NO: 2762840 - RNA, 19 nt, Human
cuugaguuuaaauuguaau

SEQ ID NO: 2762841 - RNA, 20 nt, Human
cuuuuuggcauaacauaaau

SEQ ID NO: 2762842 - RNA, 16 nt, Human
cuuuuuggcauaacau

SEQ ID NO: 2762843 - RNA, 22 nt, Human
cuuuuuggcauaacauaaaucu

SEQ ID NO: 2762844 - RNA, 15 nt, Human
gaaaaguuuaauauu

SEQ ID NO: 2762845 - RNA, 22 nt, Human
gaaaaguuuaauauuaaagcca

SEQ ID NO: 2762846 - RNA, 21 nt, Human
gaaaaguuuaauauuaaagcc

SEQ ID NO: 2762847 - RNA, 20 nt, Human
gaaaaguuuaauauuaaagc

SEQ ID NO: 2762848 - RNA, 19 nt, Human
gaaaaguuuaauauuaaag

SEQ ID NO: 2762849 - RNA, 23 nt, Human
gaaaaguuuaauauuaaagccau

SEQ ID NO: 2762850 - RNA, 18 nt, Human
gaaaauauuuguaucaca

SEQ ID NO: 2762851 - RNA, 22 nt, Human
gaaaaucuacacuccagugaga

SEQ ID NO: 2762852 - RNA, 18 nt, Human
gaaaaucuuauaauuuaa

SEQ ID NO: 2762853 - RNA, 14 nt, Human
gaaagcagggacuu

SEQ ID NO: 2762854 - RNA, 17 nt, Human
gaaagcagaacagugau

SEQ ID NO: 2762855 - RNA, 14 nt, Human
gaaagcagaacagu

SEQ ID NO: 2762856 - RNA, 22 nt, Human
gaaagcagaacagugauuacca

SEQ ID NO: 2762857 - RNA, 20 nt, Human
gaaagaggcagcuugaaacu

SEQ ID NO: 2762858 - RNA, 21 nt, Human
gaaagaggaaugaaguacuca

SEQ ID NO: 2762859 - RNA, 17 nt, Human
gaaagagaacuuccaga

SEQ ID NO: 2762860 - RNA, 14 nt, Human
gaaacccugucucu

SEQ ID NO: 2762861 - RNA, 18 nt, Human
gaaacggaugauuucuau

SEQ ID NO: 2762862 - RNA, 17 nt, Human
gaaacggaugauuucua

SEQ ID NO: 2762863 - RNA, 23 nt, Human
gaaacucguuaauuuguaguguu

SEQ ID NO: 2762864 - RNA, 11 nt, Human
gaaacauuugg

SEQ ID NO: 2762865 - RNA, 16 nt, Human
gaaacacaacuauauu

SEQ ID NO: 2762866 - RNA, 14 nt, Human
ccugaggcuccacu

SEQ ID NO: 2762867 - RNA, 13 nt, Human
ccugaggcuccac

SEQ ID NO: 2762868 - RNA, 17 nt, Human
ccugccccugagcccau

SEQ ID NO: 2762869 - RNA, 14 nt, Human
ccugggcagcugcc

SEQ ID NO: 2762870 - RNA, 13 nt, Human
ccugggcagcugc

SEQ ID NO: 2762871 - RNA, 19 nt, Human
cgcuaaacuuuucugauag

SEQ ID NO: 2762872 - RNA, 18 nt, Human
cgcuaaacuuuucugaua

SEQ ID NO: 2762873 - RNA, 17 nt, Human
cgcuaaacuuuucugau

SEQ ID NO: 2762874 - RNA, 22 nt, Human
cgcguugaaauuguaauuauau

SEQ ID NO: 2762875 - RNA, 24 nt, Human
cgcguugaaauuguaauuauaucu

SEQ ID NO: 2762876 - RNA, 15 nt, Human
ccuuggacucauuuu

SEQ ID NO: 2762877 - RNA, 17 nt, Human
ccuucggccuccauccu

SEQ ID NO: 2762878 - RNA, 16 nt, Human
ccuucggccuccaucc

SEQ ID NO: 2762879 - RNA, 18 nt, Human
ccuucggccuccauccug

SEQ ID NO: 2762880 - RNA, 19 nt, Human
cuaaauugacacuuaaaaa

SEQ ID NO: 2762881 - RNA, 15 nt, Human
cuaagagagaaugag

SEQ ID NO: 2762882 - RNA, 14 nt, Human
cuaagagagaauga

SEQ ID NO: 2762883 - RNA, 21 nt, Human
cuaaaauggacuguggugacu

SEQ ID NO: 2762884 - RNA, 22 nt, Human
cuaaaauggacuguggugacuu

SEQ ID NO: 2762885 - RNA, 20 nt, Human
cgggaggcagagguugcagu

SEQ ID NO: 2762886 - RNA, 14 nt, Human
cuacacuaagagag

SEQ ID NO: 2762887 - RNA, 23 nt, Human
cuacacgagauacagaauuuuau

SEQ ID NO: 2762888 - RNA, 16 nt, Human
cuaaggacuucuuuaa

SEQ ID NO: 2762889 - RNA, 15 nt, Human
cuaaggacuucuuua

SEQ ID NO: 2762890 - RNA, 14 nt, Human
cuaaggacuucuuu

SEQ ID NO: 2762891 - RNA, 21 nt, Human
cuaagcuucacuguaaaauaa

SEQ ID NO: 2762892 - RNA, 14 nt, Human
cuaaguaaaaccac

SEQ ID NO: 2762893 - RNA, 18 nt, Human
cuaaguaaaaccacagca

SEQ ID NO: 2762894 - RNA, 19 nt, Human
cuaaguaaaaccacagcag

SEQ ID NO: 2762895 - RNA, 20 nt, Human
cuaggaaauauuuauuuuaa

SEQ ID NO: 2762896 - RNA, 19 nt, Human
cuaggaaauauuuauuuua

SEQ ID NO: 2762897 - RNA, 15 nt, Human
cuaggaaauauuuau

SEQ ID NO: 2762898 - RNA, 14 nt, Human
cuaggaaauauuua

SEQ ID NO: 2762899 - RNA, 18 nt, Human
cuagacuggugacugauu

SEQ ID NO: 2762900 - RNA, 17 nt, Human
cuagacuggugacugau

SEQ ID NO: 2762901 - RNA, 15 nt, Human
cuagacuggugacug

SEQ ID NO: 2762902 - RNA, 14 nt, Human
cuagacuggugacu

SEQ ID NO: 2762903 - RNA, 23 nt, Human
cuagacuggugacugauucuuca

SEQ ID NO: 2762904 - RNA, 22 nt, Human
cuagacuggugacugauucuuc

SEQ ID NO: 2762905 - RNA, 19 nt, Human
cuagacuggugacugauuc

SEQ ID NO: 2762906 - RNA, 19 nt, Human
cuagaguuuagcuggaaaa

SEQ ID NO: 2762907 - RNA, 18 nt, Human
cuagaguuuagcuggaaa

SEQ ID NO: 2762908 - RNA, 19 nt, Human
cuauuucuauauuuucauu

SEQ ID NO: 2762909 - RNA, 20 nt, Human
cuauuucuauauuuucauuc

SEQ ID NO: 2762910 - RNA, 13 nt, Human
cuaugcugaguuu

SEQ ID NO: 2762911 - RNA, 15 nt, Human
cuaugcugaguuugu

SEQ ID NO: 2762912 - RNA, 14 nt, Human
cuaugcugaguuug

SEQ ID NO: 2762913 - RNA, 19 nt, Human
cuaugaaauauuauguuaa

SEQ ID NO: 2762914 - RNA, 18 nt, Human
cuaugaaauauuauguua

SEQ ID NO: 2762915 - RNA, 12 nt, Human
cuauaauuuaaa

SEQ ID NO: 2762916 - RNA, 13 nt, Human
cuauaauuuaaau

SEQ ID NO: 2762917 - RNA, 23 nt, Human
cucagauuuuauuauguaaaucc

SEQ ID NO: 2762918 - RNA, 22 nt, Human
cucagauuuuauuauguaaauc

SEQ ID NO: 2762919 - RNA, 22 nt, Human
cucaggaaaucaaauaugcaaa

SEQ ID NO: 2762920 - RNA, 20 nt, Human
cuccauuuaauaauuauaug

SEQ ID NO: 2762921 - RNA, 13 nt, Human
cuccauuuaauaa

SEQ ID NO: 2762922 - RNA, 14 nt, Human
cuccccucggagaa

SEQ ID NO: 2762923 - RNA, 12 nt, Human
cucauuuccaag

SEQ ID NO: 2762924 - RNA, 14 nt, Human
cucauuuccaagca

SEQ ID NO: 2762925 - RNA, 13 nt, Human
cucauuuccaagc

SEQ ID NO: 2762926 - RNA, 17 nt, Human
cucauuuccaagcaagu

SEQ ID NO: 2762927 - RNA, 23 nt, Human
cccauuauucaaaguugccuaaa

SEQ ID NO: 2762928 - RNA, 18 nt, Human
cccauuauucaaaguugc

SEQ ID NO: 2762929 - RNA, 16 nt, Human
ccccacccugccucac

SEQ ID NO: 2762930 - RNA, 12 nt, Human
cccauuauucaa

SEQ ID NO: 2762931 - RNA, 17 nt, Human
ccccuccucugcuugcc

SEQ ID NO: 2762932 - RNA, 14 nt, Human
ccccuccucugcuu

SEQ ID NO: 2762933 - RNA, 13 nt, Human
ccccuccucugcu

SEQ ID NO: 2762934 - RNA, 15 nt, Human
ccccucggagaagag

SEQ ID NO: 2762935 - RNA, 15 nt, Human
ccuaacgaaguaucc

SEQ ID NO: 2762936 - RNA, 22 nt, Human
cccucuccugggcagcugccuc

SEQ ID NO: 2762937 - RNA, 21 nt, Human
cccucuccugggcagcugccu

SEQ ID NO: 2762938 - RNA, 20 nt, Human
cccucuccugggcagcugcc

SEQ ID NO: 2762939 - RNA, 23 nt, Human
cccucuccugggcagcugccucc

SEQ ID NO: 2762940 - RNA, 13 nt, Human
ccauuuggaaauc

SEQ ID NO: 2762941 - RNA, 11 nt, Human
ccauuauucaa

SEQ ID NO: 2762942 - RNA, 12 nt, Human
ccaggugccagu

SEQ ID NO: 2762943 - RNA, 13 nt, Human
ccaggugccaguu

SEQ ID NO: 2762944 - RNA, 18 nt, Human
ccauccugaggcuccacu

SEQ ID NO: 2762945 - RNA, 20 nt, Human
ccauccugaggcuccacuug

SEQ ID NO: 2762946 - RNA, 20 nt, Human
ccagguagaggguguguaag

SEQ ID NO: 2762947 - RNA, 19 nt, Human
ccagccugagcgacaguga

SEQ ID NO: 2762948 - RNA, 15 nt, Human
ccacugguucuucuu

SEQ ID NO: 2762949 - RNA, 14 nt, Human
ccagacaucaacag

SEQ ID NO: 2762950 - RNA, 15 nt, Human
ccaccucccugcaau

SEQ ID NO: 2762951 - RNA, 21 nt, Human
ccaccucccugcaauaaaaug

SEQ ID NO: 2762952 - RNA, 19 nt, Human
ccaccucccugcaauaaaa

SEQ ID NO: 2762953 - RNA, 18 nt, Human
aaaaaccaguauuguaca

SEQ ID NO: 2762954 - RNA, 16 nt, Human
aaaaaccaguauugua

SEQ ID NO: 2762955 - RNA, 20 nt, Human
aaaaauuggggauucuuaaa

SEQ ID NO: 2762956 - RNA, 19 nt, Human
aaaaauuggggauucuuaa

SEQ ID NO: 2762957 - RNA, 18 nt, Human
aaaaauuggggauucuua

SEQ ID NO: 2762958 - RNA, 17 nt, Human
aaaaauuggggauucuu

SEQ ID NO: 2762959 - RNA, 17 nt, Human
aaaacaaggaugaauua

SEQ ID NO: 2762960 - RNA, 12 nt, Human
aaaacacagcaa

SEQ ID NO: 2762961 - RNA, 13 nt, Human
aaaacacagcaag

SEQ ID NO: 2762962 - RNA, 18 nt, Human
aaaacacagcaaggguga

SEQ ID NO: 2762963 - RNA, 14 nt, Human
aaaacaaggaugaa

SEQ ID NO: 2762964 - RNA, 23 nt, Human
aaaaaauuggggauucuuaaagu

SEQ ID NO: 2762965 - RNA, 17 nt, Human
agccauguuuauuacag

SEQ ID NO: 2762966 - RNA, 22 nt, Human
agccauguuuauuacaguauaa

SEQ ID NO: 2762967 - RNA, 19 nt, Human
agccagauuuuccugaaaa

SEQ ID NO: 2762968 - RNA, 15 nt, Human
agccagauuuuccug

SEQ ID NO: 2762969 - RNA, 19 nt, Human
agcaguucagagcugcccu

SEQ ID NO: 2762970 - RNA, 18 nt, Human
agcaguucagagcugccc

SEQ ID NO: 2762971 - RNA, 17 nt, Human
agcaguucagagcugcc

SEQ ID NO: 2762972 - RNA, 15 nt, Human
agcaguucagagcug

SEQ ID NO: 2762973 - RNA, 16 nt, Human
agcaguucagagcugc

SEQ ID NO: 2762974 - RNA, 23 nt, Human
agcaguugaaaagacuccaaaga

SEQ ID NO: 2762975 - RNA, 21 nt, Human
agcaguugaaaagacuccaaa

SEQ ID NO: 2762976 - RNA, 21 nt, Human
agaugggagaaucacuugaac

SEQ ID NO: 2762977 - RNA, 14 nt, Human
agauguagaggaga

SEQ ID NO: 2762978 - RNA, 21 nt, Human
agccgggcgugguggugagug

SEQ ID NO: 2762979 - RNA, 14 nt, Human
agaguguugaaacg

SEQ ID NO: 2762980 - RNA, 13 nt, Human
agaguguugaaac

SEQ ID NO: 2762981 - RNA, 21 nt, Human
agauaggucagugcaaauacu

SEQ ID NO: 2762982 - RNA, 17 nt, Human
agacugcauuauauuua

SEQ ID NO: 2762983 - RNA, 14 nt, Human
aggauguugaaaaa

SEQ ID NO: 2762984 - RNA, 18 nt, Human
agcuucacuguaaaauaa

SEQ ID NO: 2762985 - RNA, 22 nt, Human
auggagccugcacggugaaugg

SEQ ID NO: 2762986 - RNA, 18 nt, Human
auggagccugcacgguga

SEQ ID NO: 2762987 - RNA, 21 nt, Human
auguaagggaaacugccagca

SEQ ID NO: 2762988 - RNA, 22 nt, Human
auguaagggaaacugccagcaa

SEQ ID NO: 2762989 - RNA, 20 nt, Human
auguaagggaaacugccagc

SEQ ID NO: 2762990 - RNA, 22 nt, Human
aucuuauaauuuaaaauaugcu

SEQ ID NO: 2762991 - RNA, 12 nt, Human
aucaccugucuu

SEQ ID NO: 2762992 - RNA, 21 nt, Human
aucaccugucuugccuuuuuc

SEQ ID NO: 2762993 - RNA, 17 nt, Human
aucagcugcugaaacaa

SEQ ID NO: 2762994 - RNA, 21 nt, Human
aguccaagcauuuagauguau

SEQ ID NO: 2762995 - RNA, 16 nt, Human
aguccaagcauuuaga

SEQ ID NO: 2762996 - RNA, 17 nt, Human
agucaaauugugugaaa

SEQ ID NO: 2762997 - RNA, 15 nt, Human
agucaaauuguguga

SEQ ID NO: 2762998 - RNA, 13 nt, Human
agucaaauugugu

SEQ ID NO: 2762999 - RNA, 21 nt, Human
agugucuuaauuaaaagaaua

SEQ ID NO: 2763000 - RNA, 15 nt, Human
agugauuaccaggga

SEQ ID NO: 2763001 - RNA, 18 nt, Human
agugauuaccagggacug

SEQ ID NO: 2763002 - RNA, 19 nt, Human
aguugaauuuauuggcuuu

SEQ ID NO: 2763003 - RNA, 17 nt, Human
aguugaauuuauuggcu

SEQ ID NO: 2763004 - RNA, 13 nt, Human
aguugaauuuauu

SEQ ID NO: 2763005 - RNA, 11 nt, Human
aguugaauuua

SEQ ID NO: 2763006 - RNA, 20 nt, Human
aguugaauuuauuggcuuuu

SEQ ID NO: 2763007 - RNA, 18 nt, Human
aguuguaccgcaauguga

SEQ ID NO: 2763008 - RNA, 19 nt, Human
aguuguaccgcaaugugac

SEQ ID NO: 2763009 - RNA, 19 nt, Human
auauuuauuacuguaagaa

SEQ ID NO: 2763010 - RNA, 14 nt, Human
auauuuauuacugu

SEQ ID NO: 2763011 - RNA, 18 nt, Human
auauuuauuuuaauaaug

SEQ ID NO: 2763012 - RNA, 14 nt, Human
auaugcuauuucua

SEQ ID NO: 2763013 - RNA, 23 nt, Human
auaugcuucuguuuuauaauuuu

SEQ ID NO: 2763014 - RNA, 18 nt, Human
auaucacuugucaauaaa

SEQ ID NO: 2763015 - RNA, 15 nt, Human
auaucaauuuaaaaa

SEQ ID NO: 2763016 - RNA, 17 nt, Human
auaauuaacauguuaaa

SEQ ID NO: 2763017 - RNA, 22 nt, Human
auaauuaacauguuaaaccaug

SEQ ID NO: 2763018 - RNA, 21 nt, Human
auaauuaacauguuaaaccau

SEQ ID NO: 2763019 - RNA, 20 nt, Human
auaauuaacauguuaaacca

SEQ ID NO: 2763020 - RNA, 20 nt, Human
auacaauuuuguuucuguac

SEQ ID NO: 2763021 - RNA, 19 nt, Human
auacaauuuuguuucugua

SEQ ID NO: 2763022 - RNA, 14 nt, Human
auaauuacuauguc

SEQ ID NO: 2763023 - RNA, 18 nt, Human
auacaauuuuguuucugu

SEQ ID NO: 2763024 - RNA, 16 nt, Human
acuaagagagaaugag

SEQ ID NO: 2763025 - RNA, 15 nt, Human
acuaagagagaauga

SEQ ID NO: 2763026 - RNA, 13 nt, Human
acucccuuucaac

SEQ ID NO: 2763027 - RNA, 12 nt, Human
acucccuuucaa

SEQ ID NO: 2763028 - RNA, 14 nt, Human
acuagcuauggugu

SEQ ID NO: 2763029 - RNA, 12 nt, Human
acuuuucugaua

SEQ ID NO: 2763030 - RNA, 12 nt, Human
acuggaacucuc

SEQ ID NO: 2763031 - RNA, 21 nt, Human
acuucuuuaauuuuggaauuu

SEQ ID NO: 2763032 - RNA, 19 nt, Human
acuuguaaaggaauuuaaa

SEQ ID NO: 2763033 - RNA, 20 nt, Human
acuuguaaaggaauuuaaaa

SEQ ID NO: 2763034 - RNA, 18 nt, Human
acuuguaaaggaauuuaa

SEQ ID NO: 2763035 - RNA, 15 nt, Human
acuuggucugugaga

SEQ ID NO: 2763036 - RNA, 13 nt, Human
acuuggucuguga

SEQ ID NO: 2763037 - RNA, 14 nt, Human
acuuggucugugag

SEQ ID NO: 2763038 - RNA, 16 nt, Human
acccaaguccaagcau

SEQ ID NO: 2763039 - RNA, 15 nt, Human
acccacaagaaauga

SEQ ID NO: 2763040 - RNA, 14 nt, Human
acauuuguauaaaa

SEQ ID NO: 2763041 - RNA, 16 nt, Human
acauuugcucauggaa

SEQ ID NO: 2763042 - RNA, 18 nt, Human
acauuugcucauggaauu

SEQ ID NO: 2763043 - RNA, 14 nt, Human
acauaaaucuguga

SEQ ID NO: 2763044 - RNA, 18 nt, Human
acauaaaucugugaacuu

SEQ ID NO: 2763045 - RNA, 15 nt, Human
acauaaaucugugaa

SEQ ID NO: 2763046 - RNA, 13 nt, Human
acauguuacaaca

SEQ ID NO: 2763047 - RNA, 15 nt, Human
acagcaguugaaaag

SEQ ID NO: 2763048 - RNA, 18 nt, Human
acagcaguugaaaagacu

SEQ ID NO: 2763049 - RNA, 16 nt, Human
acagccagacuggcac

SEQ ID NO: 2763050 - RNA, 13 nt, Human
acagccagacugg

SEQ ID NO: 2763051 - RNA, 15 nt, Human
acagccagacuggca

SEQ ID NO: 2763052 - RNA, 20 nt, Human
acagcucugcauacucauua

SEQ ID NO: 2763053 - RNA, 14 nt, Human
acaauuuuguuucu

SEQ ID NO: 2763054 - RNA, 17 nt, Human
acaauuuuguuucugua

SEQ ID NO: 2763055 - RNA, 15 nt, Human
acaauuuuguuucug

SEQ ID NO: 2763056 - RNA, 13 nt, Human
acaacuauauugu

SEQ ID NO: 2763057 - RNA, 15 nt, Human
aaccaguauuguaca

SEQ ID NO: 2763058 - RNA, 20 nt, Human
aaccaguauuguacaaagua

SEQ ID NO: 2763059 - RNA, 22 nt, Human
aaccaguauuguacaaaguauu

SEQ ID NO: 2763060 - RNA, 21 nt, Human
aaccaguauuguacaaaguau

SEQ ID NO: 2763061 - RNA, 16 nt, Human
aaauuggggauucuua

SEQ ID NO: 2763062 - RNA, 15 nt, Human
aacacgagcaggcua

SEQ ID NO: 2763063 - RNA, 12 nt, Human
aacuuuucugau

SEQ ID NO: 2763064 - RNA, 14 nt, Human
aacuuuucugauag

SEQ ID NO: 2763065 - RNA, 13 nt, Human
aacuuuucugaua

SEQ ID NO: 2763066 - RNA, 13 nt, Human
aagaaauguaagg

SEQ ID NO: 2763067 - RNA, 14 nt, Human
aagaaauguaaggg

SEQ ID NO: 2763068 - RNA, 17 nt, Human
aaaauuggggauucuua

SEQ ID NO: 2763069 - RNA, 19 nt, Human
aaaauuggggauucuuaaa

SEQ ID NO: 2763070 - RNA, 18 nt, Human
aaaauuggggauucuuaa

SEQ ID NO: 2763071 - RNA, 16 nt, Human
aaacugacucuuaaga

SEQ ID NO: 2763072 - RNA, 14 nt, Human
aaacugccagcaac

SEQ ID NO: 2763073 - RNA, 15 nt, Human
aaacugccagcaacg

SEQ ID NO: 2763074 - RNA, 17 nt, Human
aaacugacucuuaagaa

SEQ ID NO: 2763075 - RNA, 19 nt, Human
aaacugccagcaacgcagg

SEQ ID NO: 2763076 - RNA, 17 nt, Human
aaagaugaaaauauuug

SEQ ID NO: 2763077 - RNA, 13 nt, Human
aaagaugaaaaua

SEQ ID NO: 2763078 - RNA, 16 nt, Human
aaagaugaaaauauuu

SEQ ID NO: 2763079 - RNA, 12 nt, Human
aaauaacaauga

SEQ ID NO: 2763080 - RNA, 14 nt, Human
aaauauuuuaugau

SEQ ID NO: 2763081 - RNA, 19 nt, Human
aaauauuuuaugauccagc

SEQ ID NO: 2763082 - RNA, 18 nt, Human
aaauauuuuaugauccag

SEQ ID NO: 2763083 - RNA, 19 nt, Human
aaauggacuguggugacuu

SEQ ID NO: 2763084 - RNA, 16 nt, Human
aaaucaaauaugcaaa

SEQ ID NO: 2763085 - RNA, 18 nt, Human
aaaucaaauaugcaaagc

SEQ ID NO: 2763086 - RNA, 19 nt, Human
aaaucaaauaugcaaagca

SEQ ID NO: 2763087 - RNA, 22 nt, Human
aaugguccgugcuaaggacuug

SEQ ID NO: 2763088 - RNA, 13 nt, Human
aauggcuuuguau

SEQ ID NO: 2763089 - RNA, 18 nt, Human
aauggcuuuguauagaac

SEQ ID NO: 2763090 - RNA, 16 nt, Human
aauggcuuuguauaga

SEQ ID NO: 2763091 - RNA, 15 nt, Human
aauggcuuuguauag

SEQ ID NO: 2763092 - RNA, 20 nt, Human
aauuaguuuuauaugcuucu

SEQ ID NO: 2763093 - RNA, 17 nt, Human
aauuaguuuuauaugcu

SEQ ID NO: 2763094 - RNA, 14 nt, Human
aauuaguuuuauau

SEQ ID NO: 2763095 - RNA, 16 nt, Human
aauauuauguuaaaac

SEQ ID NO: 2763096 - RNA, 13 nt, Human
aaucacaauacau

SEQ ID NO: 2763097 - RNA, 15 nt, Human
aaucaagaaacuuaa

SEQ ID NO: 2763098 - RNA, 15 nt, Human
aauccauuuggaaau

SEQ ID NO: 2763099 - RNA, 14 nt, Human
aauccauuuggaaa

SEQ ID NO: 2763100 - RNA, 22 nt, Human
aauccauuuggaaaucuuuaaa

SEQ ID NO: 2763101 - RNA, 18 nt, Human
aauccauuuggaaaucuu

SEQ ID NO: 2763102 - RNA, 17 nt, Human
aauccauuuggaaaucu

SEQ ID NO: 2763103 - RNA, 13 nt, Human
aauccauacauuu

SEQ ID NO: 2763104 - RNA, 17 nt, Human
aaugauaacuggaaacu

SEQ ID NO: 2763105 - RNA, 20 nt, Human
aaugauaacuggaaacuuca

SEQ ID NO: 2763106 - RNA, 19 nt, Human
aauaaaauggguuuuacug

SEQ ID NO: 2763107 - RNA, 14 nt, Human
aauaaaauggguuu

SEQ ID NO: 2763108 - RNA, 21 nt, Human
aauaauccuaaacauaugaau

SEQ ID NO: 2763109 - RNA, 13 nt, Human
aagccauguuuau

SEQ ID NO: 2763110 - RNA, 13 nt, Human
aagccagauuuuc

SEQ ID NO: 2763111 - RNA, 16 nt, Human
aagauuuaccacuugu

SEQ ID NO: 2763112 - RNA, 21 nt, Human
auucuccuaucaccugucuug

SEQ ID NO: 2763113 - RNA, 12 nt, Human
auuagaauucug

SEQ ID NO: 2763114 - RNA, 14 nt, Human
auuagaauucugua

SEQ ID NO: 2763115 - RNA, 13 nt, Human
auuagaauucugu

SEQ ID NO: 2763116 - RNA, 18 nt, Human
auuagaauucuguauaga

SEQ ID NO: 2763117 - RNA, 17 nt, Human
auuagaauucuguauag

SEQ ID NO: 2763118 - RNA, 16 nt, Human
auuagaauucuguaua

SEQ ID NO: 2763119 - RNA, 15 nt, Human
auuagaauucuguau

SEQ ID NO: 2763120 - RNA, 23 nt, Human
auuaaguaaugauaacuggaaac

SEQ ID NO: 2763121 - RNA, 21 nt, Human
auuaaguaaugauaacuggaa

SEQ ID NO: 2763122 - RNA, 19 nt, Human
uuuuugugaaaagcuccau

SEQ ID NO: 2763123 - RNA, 17 nt, Human
auuacauuuguauaaaa

SEQ ID NO: 2763124 - RNA, 18 nt, Human
auuacauuuguauaaaau

SEQ ID NO: 2763125 - RNA, 16 nt, Human
auuacauuuguauaaa

SEQ ID NO: 2763126 - RNA, 12 nt, Human
auuaccagggac

SEQ ID NO: 2763127 - RNA, 14 nt, Human
auuaagcauauauu

SEQ ID NO: 2763128 - RNA, 21 nt, Human
auuaagcauauauuuuuauau

SEQ ID NO: 2763129 - RNA, 15 nt, Human
auuaagcauauauuu

SEQ ID NO: 2763130 - RNA, 12 nt, Human
uuuuguuucugu

SEQ ID NO: 2763131 - RNA, 13 nt, Human
uuuuguuucugua

SEQ ID NO: 2763132 - RNA, 22 nt, Human
uuuuguuuggaccaaaaaccag

SEQ ID NO: 2763133 - RNA, 12 nt, Human
uuuuguuuggac

SEQ ID NO: 2763134 - RNA, 18 nt, Human
uuuuguuguuuguuuagu

SEQ ID NO: 2763135 - RNA, 23 nt, Human
uuuuguuuggaccaaaaaccagu

SEQ ID NO: 2763136 - RNA, 17 nt, Human
uuuuuauauuugaaaua

SEQ ID NO: 2763137 - RNA, 19 nt, Human
uuuuuauauuugaaauauu

SEQ ID NO: 2763138 - RNA, 14 nt, Human
uuuuaauaauguuu

SEQ ID NO: 2763139 - RNA, 13 nt, Human
uuuuaauaauguu

SEQ ID NO: 2763140 - RNA, 12 nt, Human
uuuuaauaaugu

SEQ ID NO: 2763141 - RNA, 16 nt, Human
uuuuaauaauguuuca

SEQ ID NO: 2763142 - RNA, 19 nt, Human
augugcuaguaauuggaaa

SEQ ID NO: 2763143 - RNA, 20 nt, Human
auguuaaaccaugggauaaa

SEQ ID NO: 2763144 - RNA, 13 nt, Human
auguuaaaccaug

SEQ ID NO: 2763145 - RNA, 12 nt, Human
auguuaaaccau

SEQ ID NO: 2763146 - RNA, 18 nt, Human
auguucaucaaugaauga

SEQ ID NO: 2763147 - RNA, 15 nt, Human
auguuuucaggcuag

SEQ ID NO: 2763148 - RNA, 21 nt, Human
auguuuucaggcuagauguau

SEQ ID NO: 2763149 - RNA, 17 nt, Human
auguuuucaggcuagau

SEQ ID NO: 2763150 - RNA, 22 nt, Human
uuuuauuaugaaacuuguguaa

SEQ ID NO: 2763151 - RNA, 21 nt, Human
uuuuauuaugaaacuugugua

SEQ ID NO: 2763152 - RNA, 12 nt, Human
uuuuauuaugaa

SEQ ID NO: 2763153 - RNA, 15 nt, Human
uuuucugauccaguu

SEQ ID NO: 2763154 - RNA, 15 nt, Human
uuuucugagaaagac

SEQ ID NO: 2763155 - RNA, 18 nt, Human
uuuucugagaaagacuau

SEQ ID NO: 2763156 - RNA, 14 nt, Human
uuuucucuaggaaa

SEQ ID NO: 2763157 - RNA, 22 nt, Human
uuuucauucuccuaucaccugu

SEQ ID NO: 2763158 - RNA, 15 nt, Human
auuuuauuauguaaa

SEQ ID NO: 2763159 - RNA, 19 nt, Human
auuuuauuauguaaauccc

SEQ ID NO: 2763160 - RNA, 18 nt, Human
auuuuauuauguaaaucc

SEQ ID NO: 2763161 - RNA, 17 nt, Human
auuuuauuauguaaauc

SEQ ID NO: 2763162 - RNA, 16 nt, Human
auuuuauuauguaaau

SEQ ID NO: 2763163 - RNA, 21 nt, Human
auuuuauuauguaaaucccau

SEQ ID NO: 2763164 - RNA, 20 nt, Human
auuuuauuauguaaauccca

SEQ ID NO: 2763165 - RNA, 17 nt, Human
auuuuccuccuuucucu

SEQ ID NO: 2763166 - RNA, 13 nt, Human
auuuuccuccuuu

SEQ ID NO: 2763167 - RNA, 22 nt, Human
auuuucaguuauuauauuuaca

SEQ ID NO: 2763168 - RNA, 22 nt, Human
auuuuaaaagaaugauuaugaa

SEQ ID NO: 2763169 - RNA, 18 nt, Human
auuuuaaaagaaugauua

SEQ ID NO: 2763170 - RNA, 18 nt, Human
auuuguauaaaauaauuu

SEQ ID NO: 2763171 - RNA, 15 nt, Human
auuuguauaaaauaa

SEQ ID NO: 2763172 - RNA, 19 nt, Human
auuuguauaaaauaauuuu

SEQ ID NO: 2763173 - RNA, 17 nt, Human
auuuuaaaagaaugauu

SEQ ID NO: 2763174 - RNA, 22 nt, Human
auugguguuguacucaauuuua

SEQ ID NO: 2763175 - RNA, 14 nt, Human
auugguguuguacu

SEQ ID NO: 2763176 - RNA, 23 nt, Human
auugguguuguacucaauuuuaa

SEQ ID NO: 2763177 - RNA, 15 nt, Human
auuguauuacaaauc

SEQ ID NO: 2763178 - RNA, 23 nt, Human
auucuucagcaaaaauauuuuau

SEQ ID NO: 2763179 - RNA, 15 nt, Human
auucuucagcaaaaa

SEQ ID NO: 2763180 - RNA, 18 nt, Human
auucuuaaaguugaauuu

SEQ ID NO: 2763181 - RNA, 16 nt, Human
auucuuaaaguugaau

SEQ ID NO: 2763182 - RNA, 15 nt, Human
auucuuaaaguugaa

SEQ ID NO: 2763183 - RNA, 14 nt, Human
auucuuaaaguuga

SEQ ID NO: 2763184 - RNA, 13 nt, Human
auucuuaaaguug

SEQ ID NO: 2763185 - RNA, 15 nt, Human
auucuguauagauua

SEQ ID NO: 2763186 - RNA, 21 nt, Human
auucuguauagauuagaauuc

SEQ ID NO: 2763187 - RNA, 18 nt, Human
auugacccacaagaaaug

SEQ ID NO: 2763188 - RNA, 14 nt, Human
auuugaaauauuga

SEQ ID NO: 2763189 - RNA, 20 nt, Human
auuuauuuuaauaauguuuc

SEQ ID NO: 2763190 - RNA, 19 nt, Human
auuuauuuuaauaauguuu

SEQ ID NO: 2763191 - RNA, 12 nt, Human
auuucauuucuu

SEQ ID NO: 2763192 - RNA, 17 nt, Human
auuuauuuuaauaaugu

SEQ ID NO: 2763193 - RNA, 13 nt, Human
auuuagauguaua

SEQ ID NO: 2763194 - RNA, 20 nt, Human
augaaauauuauguuaaaac

SEQ ID NO: 2763195 - RNA, 21 nt, Human
augaaauauuauguuaaaacu

SEQ ID NO: 2763196 - RNA, 11 nt, Human
uugcucaugga

SEQ ID NO: 2763197 - RNA, 12 nt, Human
uugcucauggaa

SEQ ID NO: 2763198 - RNA, 23 nt, Human
augaauuaguuuuauaugcuucu

SEQ ID NO: 2763199 - RNA, 21 nt, Human
augaauuaguuuuauaugcuu

SEQ ID NO: 2763200 - RNA, 22 nt, Human
augaauuacauuuguauaaaau

SEQ ID NO: 2763201 - RNA, 15 nt, Human
uuguaauuauaucug

SEQ ID NO: 2763202 - RNA, 23 nt, Human
uuguaguguuggagaagaacuga

SEQ ID NO: 2763203 - RNA, 13 nt, Human
uuguauaaaauaa

SEQ ID NO: 2763204 - RNA, 19 nt, Human
uuguauaaaauaauuuuua

SEQ ID NO: 2763205 - RNA, 17 nt, Human
augaauuacauuuguau

SEQ ID NO: 2763206 - RNA, 19 nt, Human
augaauuacauuuguauaa

SEQ ID NO: 2763207 - RNA, 18 nt, Human
augaauuacauuuguaua

SEQ ID NO: 2763208 - RNA, 17 nt, Human
uuuaaaaaaaaaauugg

SEQ ID NO: 2763209 - RNA, 20 nt, Human
uuuaaaaaagaaacauuugg

SEQ ID NO: 2763210 - RNA, 18 nt, Human
uugugaagcaaaauuuuu

SEQ ID NO: 2763211 - RNA, 14 nt, Human
augauaacuggaaa

SEQ ID NO: 2763212 - RNA, 16 nt, Human
auggaacauaaaauac

SEQ ID NO: 2763213 - RNA, 16 nt, Human
uuuauuuuaauaaugu

SEQ ID NO: 2763214 - RNA, 21 nt, Human
uuuauuaugaaacuuguguaa

SEQ ID NO: 2763215 - RNA, 13 nt, Human
uuuauuaugaaac

SEQ ID NO: 2763216 - RNA, 19 nt, Human
uuuauuacuguaagaaaau

SEQ ID NO: 2763217 - RNA, 23 nt, Human
augcugucuacacuaagagagaa

SEQ ID NO: 2763218 - RNA, 14 nt, Human
augcuguauuuuaa

SEQ ID NO: 2763219 - RNA, 23 nt, Human
auggaauuggagcucgugggaca

SEQ ID NO: 2763220 - RNA, 17 nt, Human
uuuauaugcuucuguuu

SEQ ID NO: 2763221 - RNA, 16 nt, Human
uuuauuacuguaagaa

SEQ ID NO: 2763222 - RNA, 15 nt, Human
uuuacuaaaauggac

SEQ ID NO: 2763223 - RNA, 17 nt, Human
uuuacuaaaauggacug

SEQ ID NO: 2763224 - RNA, 24 nt, Human
uuuaaagcuuauuaaaacucauuu

SEQ ID NO: 2763225 - RNA, 13 nt, Human
augcuaagugaaa

SEQ ID NO: 2763226 - RNA, 13 nt, Human
uuucuauauuuuc

SEQ ID NO: 2763227 - RNA, 18 nt, Human
uuucuauauuuucauucu

SEQ ID NO: 2763228 - RNA, 15 nt, Human
uuucuauauuuucau

SEQ ID NO: 2763229 - RNA, 21 nt, Human
uuucuaugcugaguuugugcu

SEQ ID NO: 2763230 - RNA, 13 nt, Human
uuucuaugaaaua

SEQ ID NO: 2763231 - RNA, 20 nt, Human
uuucuaugaaauauuauguu

SEQ ID NO: 2763232 - RNA, 14 nt, Human
uuucuaugaaauau

SEQ ID NO: 2763233 - RNA, 14 nt, Human
uuucugcaucagcu

SEQ ID NO: 2763234 - RNA, 14 nt, Human
uuugaaauauugac

SEQ ID NO: 2763235 - RNA, 17 nt, Human
auggaauuucucccagu

SEQ ID NO: 2763236 - RNA, 16 nt, Human
auggcuauaggugcua

SEQ ID NO: 2763237 - RNA, 19 nt, Human
auggcuauaggugcuacaa

SEQ ID NO: 2763238 - RNA, 21 nt, Human
auggcuauaggugcuacaaaa

SEQ ID NO: 2763239 - RNA, 21 nt, Human
augggacauuugcucauggaa

SEQ ID NO: 2763240 - RNA, 22 nt, Human
augggacauuugcucauggaau

SEQ ID NO: 2763241 - RNA, 22 nt, Human
uucauuauuuuauuaugaaacu

SEQ ID NO: 2763242 - RNA, 14 nt, Human
uucauuaucucaaa

SEQ ID NO: 2763243 - RNA, 13 nt, Human
auauauuuuuaua

SEQ ID NO: 2763244 - RNA, 13 nt, Human
auaugcaaagcac

SEQ ID NO: 2763245 - RNA, 14 nt, Human
auaugcaaagcacu

SEQ ID NO: 2763246 - RNA, 20 nt, Human
uucauggaacgcguugaaau

SEQ ID NO: 2763247 - RNA, 19 nt, Human
uucauggaacgcguugaaa

SEQ ID NO: 2763248 - RNA, 22 nt, Human
uucauggaacgcguugaaauug

SEQ ID NO: 2763249 - RNA, 21 nt, Human
uucauggaacgcguugaaauu

SEQ ID NO: 2763250 - RNA, 23 nt, Human
auauguaccuaacgaaguauccu

SEQ ID NO: 2763251 - RNA, 13 nt, Human
auauaugcuaagu

SEQ ID NO: 2763252 - RNA, 15 nt, Human
uucaucaaugaauga

SEQ ID NO: 2763253 - RNA, 17 nt, Human
uucagcaaaaauauuuu

SEQ ID NO: 2763254 - RNA, 19 nt, Human
uucagcaaaaauauuuuau

SEQ ID NO: 2763255 - RNA, 17 nt, Human
uucagcgguuuauauaa

SEQ ID NO: 2763256 - RNA, 12 nt, Human
auauuaaagcca

SEQ ID NO: 2763257 - RNA, 14 nt, Human
auauuguuugcuaa

SEQ ID NO: 2763258 - RNA, 13 nt, Human
auauuuacaaaug

SEQ ID NO: 2763259 - RNA, 15 nt, Human
aucaaauaugcaaag

SEQ ID NO: 2763260 - RNA, 16 nt, Human
aucaaggguacacugc

SEQ ID NO: 2763261 - RNA, 16 nt, Human
aucaaauaugcaaagc

SEQ ID NO: 2763262 - RNA, 17 nt, Human
aucaaauaugcaaagca

SEQ ID NO: 2763263 - RNA, 18 nt, Human
aucaaauaugcaaagcac

SEQ ID NO: 2763264 - RNA, 21 nt, Human
aucaaggguacacugccuucu

SEQ ID NO: 2763265 - RNA, 13 nt, Human
aucaauuuaaaaa

SEQ ID NO: 2763266 - RNA, 14 nt, Human
aucaauuuuucuua

SEQ ID NO: 2763267 - RNA, 23 nt, Human
aucacuugaacccgggaggcaga

SEQ ID NO: 2763268 - RNA, 13 nt, Human
uucuuaaaguuga

SEQ ID NO: 2763269 - RNA, 17 nt, Human
uucuguuuuauaauuuu

SEQ ID NO: 2763270 - RNA, 16 nt, Human
uucuguuuuauaauuu

SEQ ID NO: 2763271 - RNA, 20 nt, Human
aucccucccuccaccucccu

SEQ ID NO: 2763272 - RNA, 18 nt, Human
aucccucccuccaccucc

SEQ ID NO: 2763273 - RNA, 17 nt, Human
aucccucccuccaccuc

SEQ ID NO: 2763274 - RNA, 16 nt, Human
aucccucccuccaccu

SEQ ID NO: 2763275 - RNA, 14 nt, Human
aucccucccuccac

SEQ ID NO: 2763276 - RNA, 17 nt, Human
uugacauagucuggcug

SEQ ID NO: 2763277 - RNA, 14 nt, Human
uugacauagucugg

SEQ ID NO: 2763278 - RNA, 19 nt, Human
uugacacuuaaaaaugguu

SEQ ID NO: 2763279 - RNA, 17 nt, Human
uugacacuuaaaaaugg

SEQ ID NO: 2763280 - RNA, 18 nt, Human
auccugaggcuccacuug

SEQ ID NO: 2763281 - RNA, 16 nt, Human
auccugaggcuccacu

SEQ ID NO: 2763282 - RNA, 13 nt, Human
auccugaggcucc

SEQ ID NO: 2763283 - RNA, 11 nt, Human
auccugaggcu

SEQ ID NO: 2763284 - RNA, 13 nt, Human
auccugccccuga

SEQ ID NO: 2763285 - RNA, 22 nt, Human
auccugaggcuccacuuggucu

SEQ ID NO: 2763286 - RNA, 16 nt, Human
auccugcaauuccacu

SEQ ID NO: 2763287 - RNA, 22 nt, Human
uggcacaguuuucugagaaaga

SEQ ID NO: 2763288 - RNA, 20 nt, Human
uggcacaguuuucugagaaa

SEQ ID NO: 2763289 - RNA, 18 nt, Human
uggacgagaaaacaauaa

SEQ ID NO: 2763290 - RNA, 21 nt, Human
ugggaaagcauuguaaaugug

SEQ ID NO: 2763291 - RNA, 13 nt, Human
ugcuauuucuaua

SEQ ID NO: 2763292 - RNA, 12 nt, Human
ugcuauuucuau

SEQ ID NO: 2763293 - RNA, 20 nt, Human
ugcuauuucuauauuuucau

SEQ ID NO: 2763294 - RNA, 14 nt, Human
ugcuauuucuauau

SEQ ID NO: 2763295 - RNA, 11 nt, Human
aggaauuuaaa

SEQ ID NO: 2763296 - RNA, 23 nt, Human
aggaauugacccacaagaaauga

SEQ ID NO: 2763297 - RNA, 23 nt, Human
ugcuguauuuuaaaagaaugauu

SEQ ID NO: 2763298 - RNA, 14 nt, Human
ugcuggagcucugc

SEQ ID NO: 2763299 - RNA, 13 nt, Human
ugcuggagcucug

SEQ ID NO: 2763300 - RNA, 23 nt, Human
aggacagcccuucuuuccacaga

SEQ ID NO: 2763301 - RNA, 14 nt, Human
aggacacugauaug

SEQ ID NO: 2763302 - RNA, 16 nt, Human
aggacuuguuagaucu

SEQ ID NO: 2763303 - RNA, 14 nt, Human
aggacuuguuagau

SEQ ID NO: 2763304 - RNA, 17 nt, Human
aggacuuguuagaucua

SEQ ID NO: 2763305 - RNA, 11 nt, Human
aggagaaacug

SEQ ID NO: 2763306 - RNA, 15 nt, Human
ugcuugccaucccuc

SEQ ID NO: 2763307 - RNA, 16 nt, Human
ugcuugccaucccucc

SEQ ID NO: 2763308 - RNA, 22 nt, Human
uggaauuucucccagucauuua

SEQ ID NO: 2763309 - RNA, 18 nt, Human
uggaauuggagcucgugg

SEQ ID NO: 2763310 - RNA, 21 nt, Human
agccagcaguucagagcugcc

SEQ ID NO: 2763311 - RNA, 20 nt, Human
agccagcaguucagagcugc

SEQ ID NO: 2763312 - RNA, 22 nt, Human
agccagcaguucagagcugccc

SEQ ID NO: 2763313 - RNA, 19 nt, Human
agccagcaguucagagcug

SEQ ID NO: 2763314 - RNA, 17 nt, Human
agccagcaguucagagc

SEQ ID NO: 2763315 - RNA, 15 nt, Human
agccagcaguucaga

SEQ ID NO: 2763316 - RNA, 18 nt, Human
ugauuaaguaaugauaac

SEQ ID NO: 2763317 - RNA, 23 nt, Human
ugauuaaguaaugauaacuggaa

SEQ ID NO: 2763318 - RNA, 12 nt, Human
ugaugaagaagu

SEQ ID NO: 2763319 - RNA, 11 nt, Human
ugaugaagaag

SEQ ID NO: 2763320 - RNA, 14 nt, Human
ugaugggaaagcau

SEQ ID NO: 2763321 - RNA, 19 nt, Human
ugaugggaaagcauuguaa

SEQ ID NO: 2763322 - RNA, 16 nt, Human
ugauuucuaugcugag

SEQ ID NO: 2763323 - RNA, 15 nt, Human
ugauuucuaugcuga

SEQ ID NO: 2763324 - RNA, 12 nt, Human
ugauuucuaugc

SEQ ID NO: 2763325 - RNA, 15 nt, Human
ugcagaagacaguau

SEQ ID NO: 2763326 - RNA, 14 nt, Human
ugcagaagacagua

SEQ ID NO: 2763327 - RNA, 16 nt, Human
ugccccauucaacauc

SEQ ID NO: 2763328 - RNA, 19 nt, Human
agcuauggugucauaggcu

SEQ ID NO: 2763329 - RNA, 22 nt, Human
ugccauuuaaagcuuauuaaaa

SEQ ID NO: 2763330 - RNA, 12 nt, Human
ugcccucuccug

SEQ ID NO: 2763331 - RNA, 15 nt, Human
ugcccucuccugggc

SEQ ID NO: 2763332 - RNA, 14 nt, Human
ugcccucuccuggg

SEQ ID NO: 2763333 - RNA, 13 nt, Human
ugcccucuccugg

SEQ ID NO: 2763334 - RNA, 20 nt, Human
ugcccucuccugggcagcug

SEQ ID NO: 2763335 - RNA, 18 nt, Human
ugcccucuccugggcagc

SEQ ID NO: 2763336 - RNA, 17 nt, Human
ugcccucuccugggcag

SEQ ID NO: 2763337 - RNA, 16 nt, Human
ugcccucuccugggca

SEQ ID NO: 2763338 - RNA, 23 nt, Human
ugcccucuccugggcagcugccu

SEQ ID NO: 2763339 - RNA, 22 nt, Human
ugcccucuccugggcagcugcc

SEQ ID NO: 2763340 - RNA, 23 nt, Human
agcucugcccauccugccccuga

SEQ ID NO: 2763341 - RNA, 16 nt, Human
agcugcccucuccugg

SEQ ID NO: 2763342 - RNA, 18 nt, Human
agcugcccucuccugggc

SEQ ID NO: 2763343 - RNA, 17 nt, Human
agcugcccucuccuggg

SEQ ID NO: 2763344 - RNA, 20 nt, Human
agcugcccucuccugggcag

SEQ ID NO: 2763345 - RNA, 19 nt, Human
agcugcccucuccugggca

SEQ ID NO: 2763346 - RNA, 21 nt, Human
agcugcccucuccugggcagc

SEQ ID NO: 2763347 - RNA, 15 nt, Human
ugccucaccccuugc

SEQ ID NO: 2763348 - RNA, 23 nt, Human
ugccucacccacccuuuuuuaaa

SEQ ID NO: 2763349 - RNA, 11 nt, Human
ugccuccccuc

SEQ ID NO: 2763350 - RNA, 15 nt, Human
ugccuccccuccucu

SEQ ID NO: 2763351 - RNA, 14 nt, Human
ugccuccccuccuc

SEQ ID NO: 2763352 - RNA, 13 nt, Human
ugccuccccuccu

SEQ ID NO: 2763353 - RNA, 12 nt, Human
ugccuccccucc

SEQ ID NO: 2763354 - RNA, 16 nt, Human
ugccuccccuccucug

SEQ ID NO: 2763355 - RNA, 18 nt, Human
ugccucagaaaacaagga

SEQ ID NO: 2763356 - RNA, 19 nt, Human
uguuugcuaagcauuccaa

SEQ ID NO: 2763357 - RNA, 15 nt, Human
uguuugcuaagcauu

SEQ ID NO: 2763358 - RNA, 20 nt, Human
uguuuuauaauuuugugaag

SEQ ID NO: 2763359 - RNA, 13 nt, Human
uguuuuauaauuu

SEQ ID NO: 2763360 - RNA, 21 nt, Human
aguugauaugccuuuucccaa

SEQ ID NO: 2763361 - RNA, 14 nt, Human
aguucugaagaaga

SEQ ID NO: 2763362 - RNA, 13 nt, Human
aguucugaagaag

SEQ ID NO: 2763363 - RNA, 15 nt, Human
aguucugaagaagau

SEQ ID NO: 2763364 - RNA, 20 nt, Human
uuaaaaaugguuuaaauggu

SEQ ID NO: 2763365 - RNA, 22 nt, Human
aguugcauagguuuaauaauuu

SEQ ID NO: 2763366 - RNA, 18 nt, Human
uuaaaaaagaaacauuug

SEQ ID NO: 2763367 - RNA, 15 nt, Human
uuaaaaaagaaacau

SEQ ID NO: 2763368 - RNA, 23 nt, Human
uuaaaccaugggauaaaugccau

SEQ ID NO: 2763369 - RNA, 20 nt, Human
aguuauuauauuuacaaaug

SEQ ID NO: 2763370 - RNA, 19 nt, Human
aguuauggcuauaggugcu

SEQ ID NO: 2763371 - RNA, 21 nt, Human
uguuguacucaauuuuaacaa

SEQ ID NO: 2763372 - RNA, 18 nt, Human
aguucagagcugcccucu

SEQ ID NO: 2763373 - RNA, 17 nt, Human
aguucagagcugcccuc

SEQ ID NO: 2763374 - RNA, 16 nt, Human
aguucagagcugcccu

SEQ ID NO: 2763375 - RNA, 15 nt, Human
aguucagagcugccc

SEQ ID NO: 2763376 - RNA, 14 nt, Human
aguucagagcugcc

SEQ ID NO: 2763377 - RNA, 20 nt, Human
aguucggugagcuacaaaug

SEQ ID NO: 2763378 - RNA, 21 nt, Human
auacaguucggugagcuacaa

SEQ ID NO: 2763379 - RNA, 20 nt, Human
auacaucccuuaccugggaa

SEQ ID NO: 2763380 - RNA, 22 nt, Human
auaauuuuuauauuugaaauau

SEQ ID NO: 2763381 - RNA, 21 nt, Human
auaauuuuuauauuugaaaua

SEQ ID NO: 2763382 - RNA, 22 nt, Human
auacaaaaaaaaaaaaaaauua

SEQ ID NO: 2763383 - RNA, 20 nt, Human
auaauuuugugaagcaaaau

SEQ ID NO: 2763384 - RNA, 15 nt, Human
auaauuuugugaagc

SEQ ID NO: 2763385 - RNA, 14 nt, Human
auaauuuugugaag

SEQ ID NO: 2763386 - RNA, 13 nt, Human
auaauuuugugaa

SEQ ID NO: 2763387 - RNA, 19 nt, Human
auaauuuuuauauuugaaa

SEQ ID NO: 2763388 - RNA, 16 nt, Human
auaauuuuuauauuug

SEQ ID NO: 2763389 - RNA, 14 nt, Human
auaauuuuuauauu

SEQ ID NO: 2763390 - RNA, 18 nt, Human
uuauauaagcuuguauuc

SEQ ID NO: 2763391 - RNA, 12 nt, Human
aguuuucugaga

SEQ ID NO: 2763392 - RNA, 13 nt, Human
aguuuucugagaa

SEQ ID NO: 2763393 - RNA, 14 nt, Human
aguuuucugagaaa

SEQ ID NO: 2763394 - RNA, 17 nt, Human
aguuuucugagaaagac

SEQ ID NO: 2763395 - RNA, 19 nt, Human
auaaaugugccuucauuuu

SEQ ID NO: 2763396 - RNA, 12 nt, Human
auaacuggaaac

SEQ ID NO: 2763397 - RNA, 16 nt, Human
auaauaaggaaaaguu

SEQ ID NO: 2763398 - RNA, 22 nt, Human
auaauaaggaaaaguuuaauau

SEQ ID NO: 2763399 - RNA, 19 nt, Human
auaauaaggaaaaguuuaa

SEQ ID NO: 2763400 - RNA, 18 nt, Human
auaauaaggaaaaguuua

SEQ ID NO: 2763401 - RNA, 17 nt, Human
auaauaaggaaaaguuu

SEQ ID NO: 2763402 - RNA, 21 nt, Human
auaaucuuucacaggggacag

SEQ ID NO: 2763403 - RNA, 23 nt, Human
auaauuauaugcuauuucuauau

SEQ ID NO: 2763404 - RNA, 21 nt, Human
auaauuauaugcuauuucuau

SEQ ID NO: 2763405 - RNA, 19 nt, Human
auaauuauaugcuauuucu

SEQ ID NO: 2763406 - RNA, 17 nt, Human
auaauuauaugcuauuu

SEQ ID NO: 2763407 - RNA, 14 nt, Human
auaaugaauacuuu

SEQ ID NO: 2763408 - RNA, 22 nt, Human
uuagaugcaguucugaagaaga

SEQ ID NO: 2763409 - RNA, 23 nt, Human
uuagaugcaguucugaagaagau

SEQ ID NO: 2763410 - RNA, 17 nt, Human
agucagaucugccuaag

SEQ ID NO: 2763411 - RNA, 20 nt, Human
agucagaucugccuaaggac

SEQ ID NO: 2763412 - RNA, 22 nt, Human
agucagaucugccuaaggacuu

SEQ ID NO: 2763413 - RNA, 21 nt, Human
agucagaucugccuaaggacu

SEQ ID NO: 2763414 - RNA, 23 nt, Human
agucagaucugccuaaggacuuc

SEQ ID NO: 2763415 - RNA, 20 nt, Human
ugucagcuccccucggagaa

SEQ ID NO: 2763416 - RNA, 21 nt, Human
ugucagcuccccucggagaag

SEQ ID NO: 2763417 - RNA, 23 nt, Human
ugucagcuccccucggagaagag

SEQ ID NO: 2763418 - RNA, 12 nt, Human
uguaugugugaa

SEQ ID NO: 2763419 - RNA, 16 nt, Human
aguauuguccaggucu

SEQ ID NO: 2763420 - RNA, 15 nt, Human
aguauuguccagguc

SEQ ID NO: 2763421 - RNA, 20 nt, Human
agucacauuccaagccucau

SEQ ID NO: 2763422 - RNA, 11 nt, Human
aguauuguaca

SEQ ID NO: 2763423 - RNA, 23 nt, Human
aguauuguacaaaguauuaagca

SEQ ID NO: 2763424 - RNA, 22 nt, Human
aguauuguacaaaguauuaagc

SEQ ID NO: 2763425 - RNA, 20 nt, Human
aguauuguacaaaguauuaa

SEQ ID NO: 2763426 - RNA, 15 nt, Human
aguauuguacaaagu

SEQ ID NO: 2763427 - RNA, 21 nt, Human
aguauguuagugcaaauuguc

SEQ ID NO: 2763428 - RNA, 18 nt, Human
aguauguuagugcaaauu

SEQ ID NO: 2763429 - RNA, 21 nt, Human
aguauuagaauaccacaggaa

SEQ ID NO: 2763430 - RNA, 12 nt, Human
ugucuuaauuaa

SEQ ID NO: 2763431 - RNA, 14 nt, Human
ugucuuaauuaaaa

SEQ ID NO: 2763432 - RNA, 17 nt, Human
ugucucuacuaaaaaua

SEQ ID NO: 2763433 - RNA, 21 nt, Human
ugucuugccuuuuucauuauu

SEQ ID NO: 2763434 - RNA, 17 nt, Human
ugucuugccuuuuucau

SEQ ID NO: 2763435 - RNA, 16 nt, Human
ugucuugccuuuuuca

SEQ ID NO: 2763436 - RNA, 15 nt, Human
ugucuugccuuuuuc

SEQ ID NO: 2763437 - RNA, 14 nt, Human
ugucuucacaacag

SEQ ID NO: 2763438 - RNA, 16 nt, Human
agugagccgagauugu

SEQ ID NO: 2763439 - RNA, 21 nt, Human
agugagcagucaggaaagaga

SEQ ID NO: 2763440 - RNA, 22 nt, Human
agugaaagaggcagcuugaaac

SEQ ID NO: 2763441 - RNA, 14 nt, Human
agugagacagcucu

SEQ ID NO: 2763442 - RNA, 16 nt, Human
agugaaagaggcagcu

SEQ ID NO: 2763443 - RNA, 17 nt, Human
agugaaagaaaauaaca

SEQ ID NO: 2763444 - RNA, 14 nt, Human
ugugaagcaaaauu

SEQ ID NO: 2763445 - RNA, 22 nt, Human
ugugagaugcuagaacucccuu

SEQ ID NO: 2763446 - RNA, 15 nt, Human
aggucagugcaaaua

SEQ ID NO: 2763447 - RNA, 20 nt, Human
aggguuuauguuuaggaugu

SEQ ID NO: 2763448 - RNA, 17 nt, Human
aggguuaugauuaagua

SEQ ID NO: 2763449 - RNA, 22 nt, Human
uggucugugagaugcuagaacu

SEQ ID NO: 2763450 - RNA, 22 nt, Human
ugguccaugggccauaugaaaa

SEQ ID NO: 2763451 - RNA, 16 nt, Human
aggggaauugaggaca

SEQ ID NO: 2763452 - RNA, 21 nt, Human
agggugaugggaaagcauugu

SEQ ID NO: 2763453 - RNA, 22 nt, Human
agggugaugggaaagcauugua

SEQ ID NO: 2763454 - RNA, 23 nt, Human
uggugugaccacugcagaagaca

SEQ ID NO: 2763455 - RNA, 10 nt, Human
uguaaauccc

SEQ ID NO: 2763456 - RNA, 21 nt, Human
uguaaauacaauuuuguuucu

SEQ ID NO: 2763457 - RNA, 19 nt, Human
uguaaauacaauuuuguuu

SEQ ID NO: 2763458 - RNA, 18 nt, Human
uguaaauacaauuuuguu

SEQ ID NO: 2763459 - RNA, 17 nt, Human
uguaaauacaauuuugu

SEQ ID NO: 2763460 - RNA, 16 nt, Human
uguaaauacaauuuug

SEQ ID NO: 2763461 - RNA, 13 nt, Human
uguacaaaguauu

SEQ ID NO: 2763462 - RNA, 14 nt, Human
uguacaaaguauua

SEQ ID NO: 2763463 - RNA, 18 nt, Human
uguaagaaaauaucacuu

SEQ ID NO: 2763464 - RNA, 17 nt, Human
uguaagaaaauaucacu

SEQ ID NO: 2763465 - RNA, 19 nt, Human
ugaaauuguaauuauaucu

SEQ ID NO: 2763466 - RNA, 16 nt, Human
ugaaauuguaauuaua

SEQ ID NO: 2763467 - RNA, 15 nt, Human
ugaaauuguaauuau

SEQ ID NO: 2763468 - RNA, 14 nt, Human
ugaaauuguaauua

SEQ ID NO: 2763469 - RNA, 13 nt, Human
ugaaauuguaauu

SEQ ID NO: 2763470 - RNA, 14 nt, Human
ugaaauaagccaga

SEQ ID NO: 2763471 - RNA, 20 nt, Human
agagcugcccucuccugggc

SEQ ID NO: 2763472 - RNA, 19 nt, Human
agagcugcccucuccuggg

SEQ ID NO: 2763473 - RNA, 18 nt, Human
agagcugcccucuccugg

SEQ ID NO: 2763474 - RNA, 17 nt, Human
agagcugcccucuccug

SEQ ID NO: 2763475 - RNA, 16 nt, Human
agagcugcccucuccu

SEQ ID NO: 2763476 - RNA, 13 nt, Human
ugaacaaauuuac

SEQ ID NO: 2763477 - RNA, 18 nt, Human
ugaacccgggaggcagag

SEQ ID NO: 2763478 - RNA, 22 nt, Human
ugaacccauauuuguacaccaa

SEQ ID NO: 2763479 - RNA, 22 nt, Human
ugaagaagcaccaaucaugaau

SEQ ID NO: 2763480 - RNA, 17 nt, Human
ugaaguacucauacaug

SEQ ID NO: 2763481 - RNA, 20 nt, Human
ugaagauuuaccacuugugu

SEQ ID NO: 2763482 - RNA, 17 nt, Human
ugaagauuuaccacuug

SEQ ID NO: 2763483 - RNA, 18 nt, Human
agagcuguucacagccag

SEQ ID NO: 2763484 - RNA, 23 nt, Human
agacuggcacaguuuucugagaa

SEQ ID NO: 2763485 - RNA, 20 nt, Human
agacuggcacaguuuucuga

SEQ ID NO: 2763486 - RNA, 21 nt, Human
agacuggcacaguuuucugag

SEQ ID NO: 2763487 - RNA, 18 nt, Human
agacuggcacaguuuucu

SEQ ID NO: 2763488 - RNA, 22 nt, Human
agacuccaaagaaauguaaggg

SEQ ID NO: 2763489 - RNA, 21 nt, Human
agacuggugacugauucuuca

SEQ ID NO: 2763490 - RNA, 20 nt, Human
agacuggugacugauucuuc

SEQ ID NO: 2763491 - RNA, 19 nt, Human
agacuggugacugauucuu

SEQ ID NO: 2763492 - RNA, 17 nt, Human
ucuuugucuacaccauu

SEQ ID NO: 2763493 - RNA, 16 nt, Human
agagacacacugaaga

SEQ ID NO: 2763494 - RNA, 14 nt, Human
agagacagaaagca

SEQ ID NO: 2763495 - RNA, 15 nt, Human
agagaguguugaaac

SEQ ID NO: 2763496 - RNA, 16 nt, Human
agagaguguugaaacg

SEQ ID NO: 2763497 - RNA, 17 nt, Human
ugaaagaggaaugaagu

SEQ ID NO: 2763498 - RNA, 18 nt, Human
ugaaagaggaaugaagua

SEQ ID NO: 2763499 - RNA, 17 nt, Human
ugaaaauauuuguauca

SEQ ID NO: 2763500 - RNA, 20 nt, Human
ugaaaaucuuauaauuuaaa

SEQ ID NO: 2763501 - RNA, 21 nt, Human
ugaaaauauuuguaucacaaa

SEQ ID NO: 2763502 - RNA, 22 nt, Human
ugaaaauauuuguaucacaaau

SEQ ID NO: 2763503 - RNA, 13 nt, Human
ugaaagaaaauaa

SEQ ID NO: 2763504 - RNA, 24 nt, Human
ugagaugugaacacaucagcuugc

SEQ ID NO: 2763505 - RNA, 18 nt, Human
ugagaugugaacacauca

SEQ ID NO: 2763506 - RNA, 19 nt, Human
ugagaugugaacacaucag

SEQ ID NO: 2763507 - RNA, 13 nt, Human
ugagaugugaaca

SEQ ID NO: 2763508 - RNA, 22 nt, Human
ugagagacacacugaagaagca

SEQ ID NO: 2763509 - RNA, 21 nt, Human
ugagagacacacugaagaagc

SEQ ID NO: 2763510 - RNA, 20 nt, Human
ugagagacacacugaagaag

SEQ ID NO: 2763511 - RNA, 19 nt, Human
ugagagacacacugaagaa

SEQ ID NO: 2763512 - RNA, 17 nt, Human
ugagagacacacugaag

SEQ ID NO: 2763513 - RNA, 16 nt, Human
ugagagacacacugaa

SEQ ID NO: 2763514 - RNA, 12 nt, Human
ugagacagcucu

SEQ ID NO: 2763515 - RNA, 20 nt, Human
ugagacucugucucagucca

SEQ ID NO: 2763516 - RNA, 14 nt, Human
agauuuuccugaaa

SEQ ID NO: 2763517 - RNA, 15 nt, Human
agauuuuccugaaaa

SEQ ID NO: 2763518 - RNA, 16 nt, Human
agauuuuccugaaaac

SEQ ID NO: 2763519 - RNA, 20 nt, Human
agcaagggugaugggaaagc

SEQ ID NO: 2763520 - RNA, 22 nt, Human
agcaagggugaugggaaagcau

SEQ ID NO: 2763521 - RNA, 16 nt, Human
agcaagggugauggga

SEQ ID NO: 2763522 - RNA, 21 nt, Human
agauuagagaguguugaaacg

SEQ ID NO: 2763523 - RNA, 23 nt, Human
agauuagaauucuguauagauua

SEQ ID NO: 2763524 - RNA, 22 nt, Human
agauuagaauucuguauagauu

SEQ ID NO: 2763525 - RNA, 16 nt, Human
agauuagaauucugua

SEQ ID NO: 2763526 - RNA, 15 nt, Human
agauuagaauucugu

SEQ ID NO: 2763527 - RNA, 21 nt, Human
agauugugccccugcacucca

SEQ ID NO: 2763528 - RNA, 22 nt, Human
agaugugaacacaucagcuugc

SEQ ID NO: 2763529 - RNA, 17 nt, Human
agaugugaacacaucag

SEQ ID NO: 2763530 - RNA, 22 nt, Human
agauguauguacuucaugcugu

SEQ ID NO: 2763531 - RNA, 15 nt, Human
ugacacuuaaaaaug

SEQ ID NO: 2763532 - RNA, 20 nt, Human
agaugcaguucugaagaaga

SEQ ID NO: 2763533 - RNA, 21 nt, Human
agaugcaguucugaagaagau

SEQ ID NO: 2763534 - RNA, 19 nt, Human
agaugcuagaacucccuuu

SEQ ID NO: 2763535 - RNA, 15 nt, Human
agaugcuagaacucc

SEQ ID NO: 2763536 - RNA, 21 nt, Human
agaugcuagaacucccuuuca

SEQ ID NO: 2763537 - RNA, 13 nt, Human
agauccuggaaau

SEQ ID NO: 2763538 - RNA, 14 nt, Human
ucugcuugccaucc

SEQ ID NO: 2763539 - RNA, 23 nt, Human
ucugcuugccaucccucccucca

SEQ ID NO: 2763540 - RNA, 20 nt, Human
ucugcuugccaucccucccu

SEQ ID NO: 2763541 - RNA, 17 nt, Human
ucugcuugccaucccuc

SEQ ID NO: 2763542 - RNA, 16 nt, Human
ucugcuugccaucccu

SEQ ID NO: 2763543 - RNA, 18 nt, Human
agaagaugguaccaccag

SEQ ID NO: 2763544 - RNA, 14 nt, Human
agaagaacugaaau

SEQ ID NO: 2763545 - RNA, 13 nt, Human
agaagaacugaaa

SEQ ID NO: 2763546 - RNA, 14 nt, Human
agaaaugaaagcag

SEQ ID NO: 2763547 - RNA, 11 nt, Human
ucugauccagu

SEQ ID NO: 2763548 - RNA, 21 nt, Human
ucugauccaguuuuguuugga

SEQ ID NO: 2763549 - RNA, 14 nt, Human
ucugauccaguuuu

SEQ ID NO: 2763550 - RNA, 15 nt, Human
ucugcagauaaacag

SEQ ID NO: 2763551 - RNA, 18 nt, Human
ucugcagauaaacaguag

SEQ ID NO: 2763552 - RNA, 12 nt, Human
agacacacauga

SEQ ID NO: 2763553 - RNA, 14 nt, Human
agaauucuguauag

SEQ ID NO: 2763554 - RNA, 12 nt, Human
agaauucuguau

SEQ ID NO: 2763555 - RNA, 17 nt, Human
ucugugaacuugaaauu

SEQ ID NO: 2763556 - RNA, 14 nt, Human
ucugugaacuugaa

SEQ ID NO: 2763557 - RNA, 18 nt, Human
ucugugaacuugaaauuu

SEQ ID NO: 2763558 - RNA, 14 nt, Human
ucugugagaugcua

SEQ ID NO: 2763559 - RNA, 22 nt, Human
ucugugagaugcuagaacuccc

SEQ ID NO: 2763560 - RNA, 17 nt, Human
ucugugagaugcuagaa

SEQ ID NO: 2763561 - RNA, 23 nt, Human
ucugugagaugcuagaacucccu

SEQ ID NO: 2763562 - RNA, 23 nt, Human
agaaugguccgugcuaaggacuu

SEQ ID NO: 2763563 - RNA, 21 nt, Human
agaaugguccgugcuaaggac

SEQ ID NO: 2763564 - RNA, 15 nt, Human
agaauuaacacauga

SEQ ID NO: 2763565 - RNA, 14 nt, Human
ucuaaguaaaacca

SEQ ID NO: 2763566 - RNA, 15 nt, Human
ucuaaguaaaaccac

SEQ ID NO: 2763567 - RNA, 19 nt, Human
ucuaaguaaaaccacagca

SEQ ID NO: 2763568 - RNA, 13 nt, Human
uccugggcagcug

SEQ ID NO: 2763569 - RNA, 12 nt, Human
uccugggcagcu

SEQ ID NO: 2763570 - RNA, 17 nt, Human
ucuaggaaauauuuauu

SEQ ID NO: 2763571 - RNA, 16 nt, Human
ucuaggaaauauuuau

SEQ ID NO: 2763572 - RNA, 12 nt, Human
acuuuggauaau

SEQ ID NO: 2763573 - RNA, 19 nt, Human
acuuuggauaauaaggaaa

SEQ ID NO: 2763574 - RNA, 17 nt, Human
acuuuggauaauaagga

SEQ ID NO: 2763575 - RNA, 15 nt, Human
acuugucaauaaaau

SEQ ID NO: 2763576 - RNA, 15 nt, Human
ucucauuuccaagca

SEQ ID NO: 2763577 - RNA, 23 nt, Human
ucucagauuuuauuauguaaauc

SEQ ID NO: 2763578 - RNA, 22 nt, Human
ucucagauuuuauuauguaaau

SEQ ID NO: 2763579 - RNA, 12 nt, Human
ucucaggaaauc

SEQ ID NO: 2763580 - RNA, 14 nt, Human
ucucaggaaaucaa

SEQ ID NO: 2763581 - RNA, 21 nt, Human
ucucaggaaaucaaauaugca

SEQ ID NO: 2763582 - RNA, 23 nt, Human
ucucaggaaaucaaauaugcaaa

SEQ ID NO: 2763583 - RNA, 15 nt, Human
acucaauuuuaacaa

SEQ ID NO: 2763584 - RNA, 12 nt, Human
acucaauuuuaa

SEQ ID NO: 2763585 - RNA, 17 nt, Human
acuauauuguuugcuaa

SEQ ID NO: 2763586 - RNA, 22 nt, Human
acuauauuguuugcuaagcauu

SEQ ID NO: 2763587 - RNA, 15 nt, Human
acuaucucauuucca

SEQ ID NO: 2763588 - RNA, 17 nt, Human
acuaucucauuuccaag

SEQ ID NO: 2763589 - RNA, 16 nt, Human
acuaucucauuuccaa

SEQ ID NO: 2763590 - RNA, 15 nt, Human
acuaauuuuaaaaug

SEQ ID NO: 2763591 - RNA, 20 nt, Human
acggugaauggcuuuguaua

SEQ ID NO: 2763592 - RNA, 19 nt, Human
acggugaauggcuuuguau

SEQ ID NO: 2763593 - RNA, 16 nt, Human
acggugaauggcuuug

SEQ ID NO: 2763594 - RNA, 15 nt, Human
uccauccugaggcuc

SEQ ID NO: 2763595 - RNA, 12 nt, Human
uccauccugagg

SEQ ID NO: 2763596 - RNA, 11 nt, Human
uccauccugag

SEQ ID NO: 2763597 - RNA, 13 nt, Human
acggaugauuucu

SEQ ID NO: 2763598 - RNA, 18 nt, Human
uccagugagacagcucug

SEQ ID NO: 2763599 - RNA, 11 nt, Human
acgcucucugg

SEQ ID NO: 2763600 - RNA, 20 nt, Human
accuuuuggucuggagggaa

SEQ ID NO: 2763601 - RNA, 22 nt, Human
uccacugguucuucuuggucuc

SEQ ID NO: 2763602 - RNA, 19 nt, Human
accuugaaaacuuuaugcu

SEQ ID NO: 2763603 - RNA, 22 nt, Human
uccugaaaacccuugccaugug

SEQ ID NO: 2763604 - RNA, 12 nt, Human
acugaagaagca

SEQ ID NO: 2763605 - RNA, 16 nt, Human
acugacucuuaagaag

SEQ ID NO: 2763606 - RNA, 15 nt, Human
acugacucuuaagaa

SEQ ID NO: 2763607 - RNA, 14 nt, Human
acugacucuuaaga

SEQ ID NO: 2763608 - RNA, 13 nt, Human
acugacucuuaag

SEQ ID NO: 2763609 - RNA, 20 nt, Human
acugacucuuaagaagacug

SEQ ID NO: 2763610 - RNA, 18 nt, Human
acugacucuuaagaagac

SEQ ID NO: 2763611 - RNA, 17 nt, Human
acugacucuuaagaaga

SEQ ID NO: 2763612 - RNA, 13 nt, Human
acugacuucuaag

SEQ ID NO: 2763613 - RNA, 15 nt, Human
acugacuucuaagua

SEQ ID NO: 2763614 - RNA, 16 nt, Human
acugacuucuaaguaa

SEQ ID NO: 2763615 - RNA, 22 nt, Human
acugacuucuaaguaaaaccac

SEQ ID NO: 2763616 - RNA, 18 nt, Human
acugagagugaacaaauu

SEQ ID NO: 2763617 - RNA, 22 nt, Human
acugagaugugaacacaucagc

SEQ ID NO: 2763618 - RNA, 17 nt, Human
acugagaugugaacaca

SEQ ID NO: 2763619 - RNA, 16 nt, Human
uccuggaaaucagggu

SEQ ID NO: 2763620 - RNA, 21 nt, Human
acucuuaagaagacugcauua

SEQ ID NO: 2763621 - RNA, 19 nt, Human
acuccagugagacagcucu

SEQ ID NO: 2763622 - RNA, 20 nt, Human
ucagcaaaaauauuuuauga

SEQ ID NO: 2763623 - RNA, 19 nt, Human
ucagcaaaaauauuuuaug

SEQ ID NO: 2763624 - RNA, 22 nt, Human
ucagauuuuauuauguaaaucc

SEQ ID NO: 2763625 - RNA, 23 nt, Human
ucagauuuuauuauguaaauccc

SEQ ID NO: 2763626 - RNA, 17 nt, Human
acccgggaggcagaggu

SEQ ID NO: 2763627 - RNA, 15 nt, Human
acccgggaggcagag

SEQ ID NO: 2763628 - RNA, 15 nt, Human
ucaguuuuugugaaa

SEQ ID NO: 2763629 - RNA, 17 nt, Human
ucaguuuuugugaaaag

SEQ ID NO: 2763630 - RNA, 14 nt, Human
acaugggacauuug

SEQ ID NO: 2763631 - RNA, 11 nt, Human
acaugggacau

SEQ ID NO: 2763632 - RNA, 20 nt, Human
acaugggacauuugcucaug

SEQ ID NO: 2763633 - RNA, 15 nt, Human
acaugggacauuugc

SEQ ID NO: 2763634 - RNA, 21 nt, Human
acaugggacauuugcucaugg

SEQ ID NO: 2763635 - RNA, 16 nt, Human
acaugaaguccaagca

SEQ ID NO: 2763636 - RNA, 20 nt, Human
acaugagguacugagaguga

SEQ ID NO: 2763637 - RNA, 16 nt, Human
acaugagguacugaga

SEQ ID NO: 2763638 - RNA, 23 nt, Human
acaugagguacugagagugaaca

SEQ ID NO: 2763639 - RNA, 15 nt, Human
ucaaauugugugaaa

SEQ ID NO: 2763640 - RNA, 18 nt, Human
ucaaauugugugaaaggu

SEQ ID NO: 2763641 - RNA, 23 nt, Human
accaaaaaucucaauauuucaga

SEQ ID NO: 2763642 - RNA, 19 nt, Human
ucaauauuucagauaauca

SEQ ID NO: 2763643 - RNA, 15 nt, Human
ucaauauuucagaua

SEQ ID NO: 2763644 - RNA, 23 nt, Human
ucaaugaaugaaugaauggcuaa

SEQ ID NO: 2763645 - RNA, 22 nt, Human
ucaauaucuuuuuuuuaauaaa

SEQ ID NO: 2763646 - RNA, 16 nt, Human
ucaauucuugccaaau

SEQ ID NO: 2763647 - RNA, 21 nt, Human
ucacaacagauuauuaccuua

SEQ ID NO: 2763648 - RNA, 20 nt, Human
ucaccugucuugccuuuuuc

SEQ ID NO: 2763649 - RNA, 19 nt, Human
ucaccugucuugccuuuuu

SEQ ID NO: 2763650 - RNA, 14 nt, Human
ucaccucauggaau

SEQ ID NO: 2763651 - RNA, 13 nt, Human
ucaccucauggaa

SEQ ID NO: 2763652 - RNA, 12 nt, Human
ucaccucaugga

SEQ ID NO: 2763653 - RNA, 22 nt, Human
accaguauuguacaaaguauua

SEQ ID NO: 2763654 - RNA, 20 nt, Human
accaguauuguacaaaguau

SEQ ID NO: 2763655 - RNA, 15 nt, Human
accaguauuguacaa

SEQ ID NO: 2763656 - RNA, 14 nt, Human
accaguauuguaca

SEQ ID NO: 2763657 - RNA, 23 nt, Human
ucacuugaacccgggaggcagag

SEQ ID NO: 2763658 - RNA, 23 nt, Human
accaguauuguacaaaguauuaa

SEQ ID NO: 2763659 - RNA, 14 nt, Human
accagucugacugu

SEQ ID NO: 2763660 - RNA, 20 nt, Human
uaacgauaaaagacagugaa

SEQ ID NO: 2763661 - RNA, 18 nt, Human
uaagaagugaaaaucuac

SEQ ID NO: 2763662 - RNA, 16 nt, Human
aauagucaaauugugu

SEQ ID NO: 2763663 - RNA, 12 nt, Human
uaacauaaaucu

SEQ ID NO: 2763664 - RNA, 22 nt, Human
aauaucacuugucaauaaaauc

SEQ ID NO: 2763665 - RNA, 20 nt, Human
aauaucacuugucaauaaaa

SEQ ID NO: 2763666 - RNA, 21 nt, Human
aaucaggguuaguauugucca

SEQ ID NO: 2763667 - RNA, 16 nt, Human
aaucaggguuaguauu

SEQ ID NO: 2763668 - RNA, 22 nt, Human
aaucaggguuaguauuguccag

SEQ ID NO: 2763669 - RNA, 24 nt, Human
aauaugccccauucaacaucuagu

SEQ ID NO: 2763670 - RNA, 21 nt, Human
aauaugccccauucaacaucu

SEQ ID NO: 2763671 - RNA, 15 nt, Human
aauauuuauuuuaau

SEQ ID NO: 2763672 - RNA, 19 nt, Human
aauauuuauuuuaauaaug

SEQ ID NO: 2763673 - RNA, 18 nt, Human
aauauuuauuuuaauaau

SEQ ID NO: 2763674 - RNA, 22 nt, Human
aaugaauggcuaagcaaaaugu

SEQ ID NO: 2763675 - RNA, 13 nt, Human
uaaucuuucacag

SEQ ID NO: 2763676 - RNA, 15 nt, Human
aaucaugaauuaguu

SEQ ID NO: 2763677 - RNA, 12 nt, Human
aaucaugaauua

SEQ ID NO: 2763678 - RNA, 16 nt, Human
uaagcuuguauuccuu

SEQ ID NO: 2763679 - RNA, 19 nt, Human
uaaguaaugauaacuggaa

SEQ ID NO: 2763680 - RNA, 22 nt, Human
aaucugugaacuugaaauuuga

SEQ ID NO: 2763681 - RNA, 21 nt, Human
aaucugugaacuugaaauuug

SEQ ID NO: 2763682 - RNA, 20 nt, Human
aaucugugaacuugaaauuu

SEQ ID NO: 2763683 - RNA, 19 nt, Human
aaucuacacuccagugaga

SEQ ID NO: 2763684 - RNA, 19 nt, Human
aaucuuauaauuuaaaaua

SEQ ID NO: 2763685 - RNA, 20 nt, Human
aauuaacauguuaaaccaug

SEQ ID NO: 2763686 - RNA, 19 nt, Human
aauuaacauguuaaaccau

SEQ ID NO: 2763687 - RNA, 18 nt, Human
uaccaccagucugacugu

SEQ ID NO: 2763688 - RNA, 20 nt, Human
uacaucccuuaccugggaaa

SEQ ID NO: 2763689 - RNA, 14 nt, Human
uacacuaagagaga

SEQ ID NO: 2763690 - RNA, 23 nt, Human
aaugccaucaauaaaaaauuaug

SEQ ID NO: 2763691 - RNA, 21 nt, Human
aaugccaucaauaaaaaauua

SEQ ID NO: 2763692 - RNA, 16 nt, Human
aaugccaucaauaaaa

SEQ ID NO: 2763693 - RNA, 16 nt, Human
aaugcuguauuuuaaa

SEQ ID NO: 2763694 - RNA, 18 nt, Human
aauuccaagugauugaaa

SEQ ID NO: 2763695 - RNA, 22 nt, Human
aauuccacuuauaggaauugac

SEQ ID NO: 2763696 - RNA, 14 nt, Human
uacuggauuguacu

SEQ ID NO: 2763697 - RNA, 14 nt, Human
uacuguaagaaaau

SEQ ID NO: 2763698 - RNA, 13 nt, Human
uacuguaagaaaa

SEQ ID NO: 2763699 - RNA, 22 nt, Human
aauugacccacaagaaaugaaa

SEQ ID NO: 2763700 - RNA, 21 nt, Human
aauugacccacaagaaaugaa

SEQ ID NO: 2763701 - RNA, 16 nt, Human
uauuaaaacucauuuu

SEQ ID NO: 2763702 - RNA, 14 nt, Human
uaugugugaaguga

SEQ ID NO: 2763703 - RNA, 12 nt, Human
uaugugugaagu

SEQ ID NO: 2763704 - RNA, 21 nt, Human
uauguuuucaggcuagaugua

SEQ ID NO: 2763705 - RNA, 22 nt, Human
acaggaaccacaagacugcaca

SEQ ID NO: 2763706 - RNA, 17 nt, Human
acaggaaguagaggagg

SEQ ID NO: 2763707 - RNA, 16 nt, Human
uauucaaaguugccua

SEQ ID NO: 2763708 - RNA, 13 nt, Human
uauucaaaguugc

SEQ ID NO: 2763709 - RNA, 12 nt, Human
uauucaaaguug

SEQ ID NO: 2763710 - RNA, 23 nt, Human
uauucaaacagucucaggaaauc

SEQ ID NO: 2763711 - RNA, 15 nt, Human
uauucaaacagucuc

SEQ ID NO: 2763712 - RNA, 14 nt, Human
uauuacuguaagaa

SEQ ID NO: 2763713 - RNA, 13 nt, Human
acaguauaauuaa

SEQ ID NO: 2763714 - RNA, 20 nt, Human
acaguauaauuaacauguua

SEQ ID NO: 2763715 - RNA, 15 nt, Human
acaguauaauuaaca

SEQ ID NO: 2763716 - RNA, 16 nt, Human
acagucaccucaugga

SEQ ID NO: 2763717 - RNA, 18 nt, Human
acagucaccucauggaau

SEQ ID NO: 2763718 - RNA, 17 nt, Human
acagucaccucauggaa

SEQ ID NO: 2763719 - RNA, 21 nt, Human
acagggaggacgcucucuggc

SEQ ID NO: 2763720 - RNA, 20 nt, Human
acagggaggacgcucucugg

SEQ ID NO: 2763721 - RNA, 21 nt, Human
uaugaaauauuauguuaaaac

SEQ ID NO: 2763722 - RNA, 20 nt, Human
uaugauuaaguaaugauaac

SEQ ID NO: 2763723 - RNA, 16 nt, Human
uaugauuaaguaauga

SEQ ID NO: 2763724 - RNA, 21 nt, Human
uaugauuaaguaaugauaacu

SEQ ID NO: 2763725 - RNA, 15 nt, Human
uaugccccauucaac

SEQ ID NO: 2763726 - RNA, 19 nt, Human
uaugccccauucaacaucu

SEQ ID NO: 2763727 - RNA, 15 nt, Human
uaugcugaguuugug

SEQ ID NO: 2763728 - RNA, 16 nt, Human
acagccucuuagaugc

SEQ ID NO: 2763729 - RNA, 19 nt, Human
uauaauuuugugaagcaaa

SEQ ID NO: 2763730 - RNA, 21 nt, Human
uauauuuacuaaaauggacug

SEQ ID NO: 2763731 - RNA, 20 nt, Human
uauauuuacuaaaauggacu

SEQ ID NO: 2763732 - RNA, 19 nt, Human
uauauuuacuaaaauggac

SEQ ID NO: 2763733 - RNA, 15 nt, Human
uauauuguuugcuaa

SEQ ID NO: 2763734 - RNA, 17 nt, Human
acaccauuaugugcgcu

SEQ ID NO: 2763735 - RNA, 21 nt, Human
acaccauuaugugcgcugaua

SEQ ID NO: 2763736 - RNA, 15 nt, Human
acacaucagcuugcc

SEQ ID NO: 2763737 - RNA, 15 nt, Human
acacaugaaguccaa

SEQ ID NO: 2763738 - RNA, 18 nt, Human
acacaugauccugcaauu

SEQ ID NO: 2763739 - RNA, 18 nt, Human
acacucaaaucaagaaac

SEQ ID NO: 2763740 - RNA, 13 nt, Human
acacuaagagaga

SEQ ID NO: 2763741 - RNA, 19 nt, Human
acacucaaaucaagaaacu

SEQ ID NO: 2763742 - RNA, 22 nt, Human
acaaugcuguauuuuaaaagaa

SEQ ID NO: 2763743 - RNA, 18 nt, Human
acaaugcuguauuuuaaa

SEQ ID NO: 2763744 - RNA, 15 nt, Human
acacacucaaaucaa

SEQ ID NO: 2763745 - RNA, 23 nt, Human
uaguguuggagaagaacugaaau

SEQ ID NO: 2763746 - RNA, 17 nt, Human
uaguguuggagaagaac

SEQ ID NO: 2763747 - RNA, 22 nt, Human
uagugaaacucguuaauuugua

SEQ ID NO: 2763748 - RNA, 19 nt, Human
acaaauuuacagagacaga

SEQ ID NO: 2763749 - RNA, 18 nt, Human
acaaauuuacagagacag

SEQ ID NO: 2763750 - RNA, 20 nt, Human
acaagacccaaaaggcagaa

SEQ ID NO: 2763751 - RNA, 15 nt, Human
uagaugcaguucuga

SEQ ID NO: 2763752 - RNA, 22 nt, Human
uagaggagaaacuggaacucuc

SEQ ID NO: 2763753 - RNA, 23 nt, Human
uagagauuuuuuuguuguuuguu

SEQ ID NO: 2763754 - RNA, 19 nt, Human
uagaggagaaacuggaacu

SEQ ID NO: 2763755 - RNA, 18 nt, Human
acaaaaggauaaugaaua

SEQ ID NO: 2763756 - RNA, 22 nt, Human
uagcuagacuggugacugauuc

SEQ ID NO: 2763757 - RNA, 21 nt, Human
uagcuagacuggugacugauu

SEQ ID NO: 2763758 - RNA, 14 nt, Human
acaagacugcacau

SEQ ID NO: 2763759 - RNA, 13 nt, Human
acaagacugcaca

SEQ ID NO: 2763760 - RNA, 23 nt, Human
acaauacaucccuuaccugggaa

SEQ ID NO: 2763761 - RNA, 19 nt, Human
uaggaaauauuuauuuuaa

SEQ ID NO: 2763762 - RNA, 18 nt, Human
uaggaaauauuuauuuua

SEQ ID NO: 2763763 - RNA, 14 nt, Human
uagggagagaagau

SEQ ID NO: 2763764 - RNA, 15 nt, Human
uagggagagaagaua

SEQ ID NO: 2763765 - RNA, 12 nt, Human
gugacuuuggau

SEQ ID NO: 2763766 - RNA, 15 nt, Human
gugacuuuggauaau

SEQ ID NO: 2763767 - RNA, 24 nt, Human
aacucauuuuuguuuucauuaucu

SEQ ID NO: 2763768 - RNA, 21 nt, Human
aacucauuuuuguuuucauua

SEQ ID NO: 2763769 - RNA, 23 nt, Human
gucuugucucagauuuuauuaug

SEQ ID NO: 2763770 - RNA, 14 nt, Human
gucuuaauuaaaag

SEQ ID NO: 2763771 - RNA, 19 nt, Human
gucuuauauauuguagaua

SEQ ID NO: 2763772 - RNA, 11 nt, Human
aagaaacauuu

SEQ ID NO: 2763773 - RNA, 16 nt, Human
aagaaagaaaaucagg

SEQ ID NO: 2763774 - RNA, 13 nt, Human
aagaaagaaaauc

SEQ ID NO: 2763775 - RNA, 14 nt, Human
aagaaagaaaauca

SEQ ID NO: 2763776 - RNA, 21 nt, Human
gugcuacaaaaacacagcaag

SEQ ID NO: 2763777 - RNA, 22 nt, Human
gugcuacaaaaacacagcaagg

SEQ ID NO: 2763778 - RNA, 18 nt, Human
gugcuaguaauuggaaag

SEQ ID NO: 2763779 - RNA, 16 nt, Human
gugauuaccagggacu

SEQ ID NO: 2763780 - RNA, 11 nt, Human
gugauuaccag

SEQ ID NO: 2763781 - RNA, 17 nt, Human
gugauuaccagggacug

SEQ ID NO: 2763782 - RNA, 19 nt, Human
aacuugaaauuugaauuuu

SEQ ID NO: 2763783 - RNA, 18 nt, Human
aacuugaaauuugaauuu

SEQ ID NO: 2763784 - RNA, 13 nt, Human
aacuugaaauuug

SEQ ID NO: 2763785 - RNA, 12 nt, Human
aacuugaaauuu

SEQ ID NO: 2763786 - RNA, 23 nt, Human
aacuuccuuggacucauuuuaaa

SEQ ID NO: 2763787 - RNA, 22 nt, Human
aacuuccuuggacucauuuuaa

SEQ ID NO: 2763788 - RNA, 18 nt, Human
aacuucagcgguuuauau

SEQ ID NO: 2763789 - RNA, 13 nt, Human
aacuucagacaua

SEQ ID NO: 2763790 - RNA, 22 nt, Human
guccaugaagauguagaggaga

SEQ ID NO: 2763791 - RNA, 22 nt, Human
aaauuugaauuuuguguuagag

SEQ ID NO: 2763792 - RNA, 15 nt, Human
aaauuugaauuuugu

SEQ ID NO: 2763793 - RNA, 12 nt, Human
aaauuugaauuu

SEQ ID NO: 2763794 - RNA, 17 nt, Human
aacacaacuauauuguu

SEQ ID NO: 2763795 - RNA, 20 nt, Human
aacacagcaagggugauggg

SEQ ID NO: 2763796 - RNA, 18 nt, Human
aacacagcaagggugaug

SEQ ID NO: 2763797 - RNA, 15 nt, Human
aacauguuaaaccau

SEQ ID NO: 2763798 - RNA, 14 nt, Human
aacauguuaaacca

SEQ ID NO: 2763799 - RNA, 12 nt, Human
aacauauauaac

SEQ ID NO: 2763800 - RNA, 14 nt, Human
aacagucucaggaa

SEQ ID NO: 2763801 - RNA, 14 nt, Human
aacauaaaauacaa

SEQ ID NO: 2763802 - RNA, 15 nt, Human
guccgugcuaaggac

SEQ ID NO: 2763803 - RNA, 17 nt, Human
guccgugcuaaggacuu

SEQ ID NO: 2763804 - RNA, 16 nt, Human
guccgugcuaaggacu

SEQ ID NO: 2763805 - RNA, 13 nt, Human
aacagucucagga

SEQ ID NO: 2763806 - RNA, 15 nt, Human
gucacaggaaguaga

SEQ ID NO: 2763807 - RNA, 13 nt, Human
gucacaggaagua

SEQ ID NO: 2763808 - RNA, 21 nt, Human
gucaauuuuguuauguauauu

SEQ ID NO: 2763809 - RNA, 20 nt, Human
gucacaggaaguagaggagg

SEQ ID NO: 2763810 - RNA, 13 nt, Human
gucaggaaagaga

SEQ ID NO: 2763811 - RNA, 14 nt, Human
gucaggaaagagaa

SEQ ID NO: 2763812 - RNA, 23 nt, Human
guauuguacaaaguauuaagcau

SEQ ID NO: 2763813 - RNA, 22 nt, Human
guauuguacaaaguauuaagca

SEQ ID NO: 2763814 - RNA, 21 nt, Human
guauuguacaaaguauuaagc

SEQ ID NO: 2763815 - RNA, 19 nt, Human
guauuguacaaaguauuaa

SEQ ID NO: 2763816 - RNA, 17 nt, Human
aaauuccaagugauuga

SEQ ID NO: 2763817 - RNA, 17 nt, Human
aaauuguauuacaaauc

SEQ ID NO: 2763818 - RNA, 18 nt, Human
aaaugugccuucauuuuu

SEQ ID NO: 2763819 - RNA, 15 nt, Human
aaaugugcuuuuaaa

SEQ ID NO: 2763820 - RNA, 18 nt, Human
aagcuuauuaaaacucau

SEQ ID NO: 2763821 - RNA, 18 nt, Human
guucccuugaugaagaag

SEQ ID NO: 2763822 - RNA, 21 nt, Human
aagccuuggggcugaugcagu

SEQ ID NO: 2763823 - RNA, 23 nt, Human
aagccauguuuauuacaguauaa

SEQ ID NO: 2763824 - RNA, 22 nt, Human
aagccauguuuauuacaguaua

SEQ ID NO: 2763825 - RNA, 21 nt, Human
aagccauguuuauuacaguau

SEQ ID NO: 2763826 - RNA, 20 nt, Human
aagccauguuuauuacagua

SEQ ID NO: 2763827 - RNA, 17 nt, Human
guuauuauauuuacaaa

SEQ ID NO: 2763828 - RNA, 18 nt, Human
guuagagauuuuuuuguu

SEQ ID NO: 2763829 - RNA, 19 nt, Human
guuauuauauuuacaaaug

SEQ ID NO: 2763830 - RNA, 22 nt, Human
guguaaauacaauuuuguuucu

SEQ ID NO: 2763831 - RNA, 21 nt, Human
guguaaauacaauuuuguuuc

SEQ ID NO: 2763832 - RNA, 18 nt, Human
guguaaauacaauuuugu

SEQ ID NO: 2763833 - RNA, 15 nt, Human
aagauagcagggcau

SEQ ID NO: 2763834 - RNA, 14 nt, Human
aagauagcagggca

SEQ ID NO: 2763835 - RNA, 22 nt, Human
gugucuuaauuaaaagaauauu

SEQ ID NO: 2763836 - RNA, 17 nt, Human
aagcaacccaaauguuc

SEQ ID NO: 2763837 - RNA, 18 nt, Human
aagcauuguaaaugugcu

SEQ ID NO: 2763838 - RNA, 23 nt, Human
aagcauauauuuuuauauuuacu

SEQ ID NO: 2763839 - RNA, 19 nt, Human
aagcacugacuucuaagua

SEQ ID NO: 2763840 - RNA, 20 nt, Human
aagcacugacuucuaaguaa

SEQ ID NO: 2763841 - RNA, 15 nt, Human
aagccauguuuauua

SEQ ID NO: 2763842 - RNA, 17 nt, Human
aagccauguuuauuaca

SEQ ID NO: 2763843 - RNA, 16 nt, Human
aagccauguuuauuac

SEQ ID NO: 2763844 - RNA, 19 nt, Human
aagcauuguaaaugugcuu

SEQ ID NO: 2763845 - RNA, 16 nt, Human
aagcacugacuucuaa

SEQ ID NO: 2763846 - RNA, 17 nt, Human
aagcacugacuucuaag

SEQ ID NO: 2763847 - RNA, 16 nt, Human
aagcacuaaacaaaga

SEQ ID NO: 2763848 - RNA, 14 nt, Human
uaaaaccacagcag

SEQ ID NO: 2763849 - RNA, 13 nt, Human
uaaaaccacagca

SEQ ID NO: 2763850 - RNA, 15 nt, Human
uaaaaccacagcagu

SEQ ID NO: 2763851 - RNA, 23 nt, Human
aagucagaucugccuaaggacuu

SEQ ID NO: 2763852 - RNA, 18 nt, Human
uaaaaaaaaaauugggga

SEQ ID NO: 2763853 - RNA, 14 nt, Human
uaaaaaaaaaauug

SEQ ID NO: 2763854 - RNA, 21 nt, Human
uaaaaaaaaaccugagcccca

SEQ ID NO: 2763855 - RNA, 13 nt, Human
uaaaagaauauuu

SEQ ID NO: 2763856 - RNA, 20 nt, Human
uaaaauaauuuuuauauuug

SEQ ID NO: 2763857 - RNA, 21 nt, Human
uaaaauacacacucaaaucaa

SEQ ID NO: 2763858 - RNA, 22 nt, Human
uaaaauaauuuuuauauuugaa

SEQ ID NO: 2763859 - RNA, 9 nt, Human
uaaaauggu

SEQ ID NO: 2763860 - RNA, 18 nt, Human
guuuggaccaaaaaccag

SEQ ID NO: 2763861 - RNA, 18 nt, Human
aagucagaucugccuaag

SEQ ID NO: 2763862 - RNA, 22 nt, Human
aagucagaucugccuaaggacu

SEQ ID NO: 2763863 - RNA, 21 nt, Human
aagucagaucugccuaaggac

SEQ ID NO: 2763864 - RNA, 19 nt, Human
aaguaaugauaacuggaaa

SEQ ID NO: 2763865 - RNA, 19 nt, Human
aaguauguuagugcaaauu

SEQ ID NO: 2763866 - RNA, 18 nt, Human
aaguauguuagugcaaau

SEQ ID NO: 2763867 - RNA, 12 nt, Human
aaggaaaaguuu

SEQ ID NO: 2763868 - RNA, 12 nt, Human
guuguuuguuua

SEQ ID NO: 2763869 - RNA, 17 nt, Human
guuuauuacaguauaau

SEQ ID NO: 2763870 - RNA, 13 nt, Human
guuuauuacagua

SEQ ID NO: 2763871 - RNA, 18 nt, Human
guuuaauauuaaagccau

SEQ ID NO: 2763872 - RNA, 15 nt, Human
guuuaauauuaaagc

SEQ ID NO: 2763873 - RNA, 14 nt, Human
guuuaauauuaaag

SEQ ID NO: 2763874 - RNA, 13 nt, Human
guuuaauauuaaa

SEQ ID NO: 2763875 - RNA, 14 nt, Human
guuuaugauuccac

SEQ ID NO: 2763876 - RNA, 15 nt, Human
aagggcuguuauaau

SEQ ID NO: 2763877 - RNA, 17 nt, Human
aaggggaauugaggaca

SEQ ID NO: 2763878 - RNA, 17 nt, Human
aagggcuguuauaaucu

SEQ ID NO: 2763879 - RNA, 21 nt, Human
gaaaagacuccaaagaaaugu

SEQ ID NO: 2763880 - RNA, 20 nt, Human
gaaaagacuccaaagaaaug

SEQ ID NO: 2763881 - RNA, 18 nt, Human
gaaaagacuccaaagaaa

SEQ ID NO: 2763882 - RNA, 23 nt, Human
gaacaaauuuacagagacagaaa

SEQ ID NO: 2763883 - RNA, 18 nt, Human
gaacaaauuuacagagac

SEQ ID NO: 2763884 - RNA, 17 nt, Human
gaacaaauuuacagaga

SEQ ID NO: 2763885 - RNA, 18 nt, Human
gaaaugaaagcagggacu

SEQ ID NO: 2763886 - RNA, 23 nt, Human
gaaaucaaauaugcaaagcacug

SEQ ID NO: 2763887 - RNA, 17 nt, Human
gaaaugaaagcagggac

SEQ ID NO: 2763888 - RNA, 21 nt, Human
gaaaucaaauaugcaaagcac

SEQ ID NO: 2763889 - RNA, 16 nt, Human
gaaaucaaauaugcaa

SEQ ID NO: 2763890 - RNA, 20 nt, Human
gaaacuuguguaaauacaau

SEQ ID NO: 2763891 - RNA, 16 nt, Human
gaaacuuguguaaaua

SEQ ID NO: 2763892 - RNA, 14 nt, Human
gaaacuuguguaaa

SEQ ID NO: 2763893 - RNA, 23 nt, Human
gaaacuucagcgguuuauauaag

SEQ ID NO: 2763894 - RNA, 21 nt, Human
cuugucucagauuuuauuaug

SEQ ID NO: 2763895 - RNA, 23 nt, Human
cuuggucucagugucaaugcagc

SEQ ID NO: 2763896 - RNA, 20 nt, Human
cugccuccccuccucugcuu

SEQ ID NO: 2763897 - RNA, 19 nt, Human
cugccuccccuccucugcu

SEQ ID NO: 2763898 - RNA, 14 nt, Human
cugccuccccuccu

SEQ ID NO: 2763899 - RNA, 18 nt, Human
cugccuccccuccucugc

SEQ ID NO: 2763900 - RNA, 17 nt, Human
cugccuccccuccucug

SEQ ID NO: 2763901 - RNA, 23 nt, Human
cuggaaaaguauguuagugcaaa

SEQ ID NO: 2763902 - RNA, 12 nt, Human
cuuaaaaauggu

SEQ ID NO: 2763903 - RNA, 20 nt, Human
cuuaaaaaugguuuaaaugg

SEQ ID NO: 2763904 - RNA, 13 nt, Human
cuuaaaaaugguu

SEQ ID NO: 2763905 - RNA, 22 nt, Human
cuguucacagccagacuggcac

SEQ ID NO: 2763906 - RNA, 12 nt, Human
cuguucacagcc

SEQ ID NO: 2763907 - RNA, 19 nt, Human
cuguucacagccagacugg

SEQ ID NO: 2763908 - RNA, 19 nt, Human
cuguuauaaucuuucacag

SEQ ID NO: 2763909 - RNA, 15 nt, Human
cugugaacuugaaau

SEQ ID NO: 2763910 - RNA, 17 nt, Human
cugugaacuugaaauuu

SEQ ID NO: 2763911 - RNA, 16 nt, Human
cugugaacuugaaauu

SEQ ID NO: 2763912 - RNA, 23 nt, Human
cugugagaugcuagaacucccuu

SEQ ID NO: 2763913 - RNA, 21 nt, Human
cugugagaugcuagaacuccc

SEQ ID NO: 2763914 - RNA, 20 nt, Human
cuguaagaaaauaucacuug

SEQ ID NO: 2763915 - RNA, 17 nt, Human
cuggugacugauucuuc

SEQ ID NO: 2763916 - RNA, 15 nt, Human
cuggugacugauucu

SEQ ID NO: 2763917 - RNA, 14 nt, Human
cuggugacugauuc

SEQ ID NO: 2763918 - RNA, 13 nt, Human
cuggugacugauu

SEQ ID NO: 2763919 - RNA, 23 nt, Human
cuggugcccugcuuucagauacu

SEQ ID NO: 2763920 - RNA, 21 nt, Human
cuggugcccugcuuucagaua

SEQ ID NO: 2763921 - RNA, 19 nt, Human
cuggugcccugcuuucaga

SEQ ID NO: 2763922 - RNA, 16 nt, Human
cuggugcccugcuuuc

SEQ ID NO: 2763923 - RNA, 15 nt, Human
cuggugcccugcuuu

SEQ ID NO: 2763924 - RNA, 14 nt, Human
gacgcucucuggcc

SEQ ID NO: 2763925 - RNA, 18 nt, Human
gacagucaccucauggaa

SEQ ID NO: 2763926 - RNA, 12 nt, Human
gacagcucugca

SEQ ID NO: 2763927 - RNA, 20 nt, Human
gaauuacauuuguauaaaau

SEQ ID NO: 2763928 - RNA, 18 nt, Human
gaauuacauuuguauaaa

SEQ ID NO: 2763929 - RNA, 15 nt, Human
gaauuacauuuguau

SEQ ID NO: 2763930 - RNA, 13 nt, Human
gaauuacauuugu

SEQ ID NO: 2763931 - RNA, 15 nt, Human
gaauuaacacaugau

SEQ ID NO: 2763932 - RNA, 14 nt, Human
gaauuaacacauga

SEQ ID NO: 2763933 - RNA, 22 nt, Human
gaaugauuaugaauuacauuug

SEQ ID NO: 2763934 - RNA, 14 nt, Human
gaaugauuaugaau

SEQ ID NO: 2763935 - RNA, 20 nt, Human
gaaugaauggcuaagcaaaa

SEQ ID NO: 2763936 - RNA, 15 nt, Human
gaaugaauggcuaag

SEQ ID NO: 2763937 - RNA, 14 nt, Human
gaaugaauggcuaa

SEQ ID NO: 2763938 - RNA, 22 nt, Human
gacuuuuuauggcacuaguauu

SEQ ID NO: 2763939 - RNA, 20 nt, Human
gagaugcuagaacucccuuu

SEQ ID NO: 2763940 - RNA, 16 nt, Human
gagaugcuagaacucc

SEQ ID NO: 2763941 - RNA, 21 nt, Human
gagauugugccccugcacucc

SEQ ID NO: 2763942 - RNA, 17 nt, Human
gagcuguucacagccag

SEQ ID NO: 2763943 - RNA, 20 nt, Human
gagcuguucacagccagacu

SEQ ID NO: 2763944 - RNA, 22 nt, Human
gagcuguucacagccagacugg

SEQ ID NO: 2763945 - RNA, 14 nt, Human
gagcagucaggaaa

SEQ ID NO: 2763946 - RNA, 14 nt, Human
gaggagaaacugga

SEQ ID NO: 2763947 - RNA, 12 nt, Human
gaggagaaacug

SEQ ID NO: 2763948 - RNA, 20 nt, Human
gaggacgcucucuggccuuc

SEQ ID NO: 2763949 - RNA, 21 nt, Human
gaggacgcucucuggccuucg

SEQ ID NO: 2763950 - RNA, 12 nt, Human
gaggcuccacuu

SEQ ID NO: 2763951 - RNA, 15 nt, Human
gaggcuccacuuggu

SEQ ID NO: 2763952 - RNA, 18 nt, Human
gaggcugagaugggagaa

SEQ ID NO: 2763953 - RNA, 17 nt, Human
gaggcuccacuuggucu

SEQ ID NO: 2763954 - RNA, 15 nt, Human
gaucugccuaaggac

SEQ ID NO: 2763955 - RNA, 12 nt, Human
gaucugccuaag

SEQ ID NO: 2763956 - RNA, 16 nt, Human
gaucugccuaaggacu

SEQ ID NO: 2763957 - RNA, 18 nt, Human
gauccagcagauuauuca

SEQ ID NO: 2763958 - RNA, 19 nt, Human
gauccagcagauuauucac

SEQ ID NO: 2763959 - RNA, 12 nt, Human
gaugauuucuau

SEQ ID NO: 2763960 - RNA, 23 nt, Human
gaugauuucuaugcugaguuugu

SEQ ID NO: 2763961 - RNA, 13 nt, Human
gaugauuucuaug

SEQ ID NO: 2763962 - RNA, 20 nt, Human
gauacuggauuguacuuugu

SEQ ID NO: 2763963 - RNA, 16 nt, Human
gauacuggauuguacu

SEQ ID NO: 2763964 - RNA, 22 nt, Human
gcaguuguugcccacagcugua

SEQ ID NO: 2763965 - RNA, 13 nt, Human
gcagugaugucac

SEQ ID NO: 2763966 - RNA, 22 nt, Human
gcagaacagugauuaccaggga

SEQ ID NO: 2763967 - RNA, 18 nt, Human
gcagaacagugauuacca

SEQ ID NO: 2763968 - RNA, 13 nt, Human
gcagaacagugau

SEQ ID NO: 2763969 - RNA, 12 nt, Human
gcagaacaguga

SEQ ID NO: 2763970 - RNA, 13 nt, Human
gcugcugaaacaa

SEQ ID NO: 2763971 - RNA, 18 nt, Human
gcuguauuuuaaaagaau

SEQ ID NO: 2763972 - RNA, 20 nt, Human
gcuguauuuuaaaagaauga

SEQ ID NO: 2763973 - RNA, 21 nt, Human
gcuguauuuuaaaagaaugau

SEQ ID NO: 2763974 - RNA, 15 nt, Human
ggaagccugauuaaa

SEQ ID NO: 2763975 - RNA, 21 nt, Human
ggacagucaccucauggaauu

SEQ ID NO: 2763976 - RNA, 18 nt, Human
ggacagucaccucaugga

SEQ ID NO: 2763977 - RNA, 17 nt, Human
ggacagucaccucaugg

SEQ ID NO: 2763978 - RNA, 19 nt, Human
ggaaaucaggguuaguauu

SEQ ID NO: 2763979 - RNA, 13 nt, Human
ggaaacugccagc

SEQ ID NO: 2763980 - RNA, 16 nt, Human
ggaaaaaauaacaaug

SEQ ID NO: 2763981 - RNA, 11 nt, Human
gccauguuuau

SEQ ID NO: 2763982 - RNA, 13 nt, Human
gccauguuuauua

SEQ ID NO: 2763983 - RNA, 22 nt, Human
gccauguuuauuacaguauaau

SEQ ID NO: 2763984 - RNA, 18 nt, Human
gccauguuuauuacagua

SEQ ID NO: 2763985 - RNA, 14 nt, Human
gccauguuuauuac

SEQ ID NO: 2763986 - RNA, 13 nt, Human
gcauuuagaugua

SEQ ID NO: 2763987 - RNA, 19 nt, Human
gcauuuaggccaugggaca

SEQ ID NO: 2763988 - RNA, 12 nt, Human
gcauuuagaugu

SEQ ID NO: 2763989 - RNA, 11 nt, Human
gccccaaaagg

SEQ ID NO: 2763990 - RNA, 12 nt, Human
gccuccauccug

SEQ ID NO: 2763991 - RNA, 14 nt, Human
gccuccauccugag

SEQ ID NO: 2763992 - RNA, 13 nt, Human
gccuccauccuga

SEQ ID NO: 2763993 - RNA, 22 nt, Human
gccucauguccacugguucuuc

SEQ ID NO: 2763994 - RNA, 22 nt, Human
gcguucauggaacgcguugaaa

SEQ ID NO: 2763995 - RNA, 23 nt, Human
gcuaaggacuuguuagaucuagu

SEQ ID NO: 2763996 - RNA, 12 nt, Human
gcguugaaauug

SEQ ID NO: 2763997 - RNA, 12 nt, Human
gcuaaggacuug

SEQ ID NO: 2763998 - RNA, 11 nt, Human
gcuaaggacuu

SEQ ID NO: 2763999 - RNA, 23 nt, Human
gccuucggccuccauccugaggc

SEQ ID NO: 2764000 - RNA, 20 nt, Human
gcuauuucuauauuuucauu

SEQ ID NO: 2764001 - RNA, 19 nt, Human
gcuauuucuauauuuucau

SEQ ID NO: 2764002 - RNA, 18 nt, Human
gcuauuucuauauuuuca

SEQ ID NO: 2764003 - RNA, 16 nt, Human
gcuauuucuauauuuu

SEQ ID NO: 2764004 - RNA, 15 nt, Human
gcuauuucuauauuu

SEQ ID NO: 2764005 - RNA, 13 nt, Human
gcuauuucuauau

SEQ ID NO: 2764006 - RNA, 11 nt, Human
gcuauuucuau

SEQ ID NO: 2764007 - RNA, 16 nt, Human
aaaauggguuuuacug

SEQ ID NO: 2764008 - RNA, 18 nt, Human
aaaaugguuuaaaugguc

SEQ ID NO: 2764009 - RNA, 16 nt, Human
aaaaugguuuaaaugg

SEQ ID NO: 2764010 - RNA, 15 nt, Human
aaaauauuuuaugau

SEQ ID NO: 2764011 - RNA, 18 nt, Human
aaaauauuuuaugaucca

SEQ ID NO: 2764012 - RNA, 17 nt, Human
aaaaucucaauauuuca

SEQ ID NO: 2764013 - RNA, 11 nt, Human
aaaauaauuuu

SEQ ID NO: 2764014 - RNA, 17 nt, Human
aaaauaauuuuuauauu

SEQ ID NO: 2764015 - RNA, 16 nt, Human
aaaauaauuuuuauau

SEQ ID NO: 2764016 - RNA, 14 nt, Human
aaaauacacacuca

SEQ ID NO: 2764017 - RNA, 14 nt, Human
ggucagugcaaaua

SEQ ID NO: 2764018 - RNA, 20 nt, Human
ggguuuuauuguuuaaaauc

SEQ ID NO: 2764019 - RNA, 13 nt, Human
aaauaugcaaagc

SEQ ID NO: 2764020 - RNA, 15 nt, Human
aaauaugcaaagcac

SEQ ID NO: 2764021 - RNA, 16 nt, Human
aaauaugcaaagcacu

SEQ ID NO: 2764022 - RNA, 17 nt, Human
aaauaugcaaagcacug

SEQ ID NO: 2764023 - RNA, 21 nt, Human
aaauaccaugccauuuaaagc

SEQ ID NO: 2764024 - RNA, 18 nt, Human
aaauauaugcuaagucuu

SEQ ID NO: 2764025 - RNA, 22 nt, Human
aaauaucacuugucaauaaaau

SEQ ID NO: 2764026 - RNA, 21 nt, Human
guacaaaguauuaagcauaua

SEQ ID NO: 2764027 - RNA, 20 nt, Human
guacaaaguauuaagcauau

SEQ ID NO: 2764028 - RNA, 16 nt, Human
aaagcagaacagugau

SEQ ID NO: 2764029 - RNA, 19 nt, Human
aaacuuuaugcuaagugaa

SEQ ID NO: 2764030 - RNA, 12 nt, Human
aaacuuuaugcu

SEQ ID NO: 2764031 - RNA, 22 nt, Human
aaagggcuguuauaaucuuuca

SEQ ID NO: 2764032 - RNA, 20 nt, Human
aaagggcuguuauaaucuuu

SEQ ID NO: 2764033 - RNA, 20 nt, Human
aaagggauggcaagaugugg

SEQ ID NO: 2764034 - RNA, 20 nt, Human
gguguuguacucaauuuuaa

SEQ ID NO: 2764035 - RNA, 19 nt, Human
gguguuguacucaauuuua

SEQ ID NO: 2764036 - RNA, 19 nt, Human
gguuuuauuguuuaaaauc

SEQ ID NO: 2764037 - RNA, 13 nt, Human
aaaaauacaaaaa

SEQ ID NO: 2764038 - RNA, 20 nt, Human
ggcuaagcuucacuguaaaa

SEQ ID NO: 2764039 - RNA, 16 nt, Human
ggccuucggccuccau

SEQ ID NO: 2764040 - RNA, 18 nt, Human
ggccuucggccuccaucc

SEQ ID NO: 2764041 - RNA, 16 nt, Human
cacaagacugcacauc

SEQ ID NO: 2764042 - RNA, 12 nt, Human
caauuuaaaaaa

SEQ ID NO: 2764043 - RNA, 23 nt, Human
caaugcuguauuuuaaaagaaug

SEQ ID NO: 2764044 - RNA, 14 nt, Human
caaugcuguauuuu

SEQ ID NO: 2764045 - RNA, 20 nt, Human
caauauuucagauaaucaca

SEQ ID NO: 2764046 - RNA, 12 nt, Human
caauauuucaga

SEQ ID NO: 2764047 - RNA, 13 nt, Human
caauaaaaaauua

SEQ ID NO: 2764048 - RNA, 17 nt, Human
caauaaaaaauuaugac

SEQ ID NO: 2764049 - RNA, 16 nt, Human
caauaaaaaauuauga

SEQ ID NO: 2764050 - RNA, 20 nt, Human
caaguauuagaauaccacag

SEQ ID NO: 2764051 - RNA, 14 nt, Human
caaguauuagaaua

SEQ ID NO: 2764052 - RNA, 23 nt, Human
caccucaaaauaccaugccauuu

SEQ ID NO: 2764053 - RNA, 21 nt, Human
caccuacaugagguacugaga

SEQ ID NO: 2764054 - RNA, 20 nt, Human
cacuuggucugugagaugcu

SEQ ID NO: 2764055 - RNA, 17 nt, Human
cacuuggucugugagau

SEQ ID NO: 2764056 - RNA, 21 nt, Human
caacuaucucauuuccaagca

SEQ ID NO: 2764057 - RNA, 19 nt, Human
caacccaaauguucaucaa

SEQ ID NO: 2764058 - RNA, 15 nt, Human
caaaguauuaagcau

SEQ ID NO: 2764059 - RNA, 14 nt, Human
caaaguauuaagca

SEQ ID NO: 2764060 - RNA, 21 nt, Human
caaaguauuaagcauauauuu

SEQ ID NO: 2764061 - RNA, 19 nt, Human
caaaguauuaagcauauau

SEQ ID NO: 2764062 - RNA, 17 nt, Human
caaaguauuaagcauau

SEQ ID NO: 2764063 - RNA, 16 nt, Human
caaaguauuaagcaua

SEQ ID NO: 2764064 - RNA, 15 nt, Human
caaauccuugaagau

SEQ ID NO: 2764065 - RNA, 17 nt, Human
auucuugccaaauauaa

SEQ ID NO: 2764066 - RNA, 18 nt, Human
auugacuuuuuauggcac

SEQ ID NO: 2764067 - RNA, 18 nt, Human
auucacaagacccaaaag

SEQ ID NO: 2764068 - RNA, 14 nt, Human
auuguaaaugugcu

SEQ ID NO: 2764069 - RNA, 15 nt, Human
auuguaaaugugcuu

SEQ ID NO: 2764070 - RNA, 17 nt, Human
auuguaaaugugcuuuu

SEQ ID NO: 2764071 - RNA, 23 nt, Human
auuguacaaaguauuaagcauau

SEQ ID NO: 2764072 - RNA, 20 nt, Human
auuguacaaaguauuaagca

SEQ ID NO: 2764073 - RNA, 22 nt, Human
auuguacaaaguauuaagcaua

SEQ ID NO: 2764074 - RNA, 19 nt, Human
auuguuuaaaaucauuucu

SEQ ID NO: 2764075 - RNA, 18 nt, Human
auuucuaugaaauauuau

SEQ ID NO: 2764076 - RNA, 15 nt, Human
auuucuaugaaauau

SEQ ID NO: 2764077 - RNA, 20 nt, Human
auuucuaugaaauauuaugu

SEQ ID NO: 2764078 - RNA, 19 nt, Human
caggugccaguuauggcua

SEQ ID NO: 2764079 - RNA, 16 nt, Human
cagucaccucauggaa

SEQ ID NO: 2764080 - RNA, 15 nt, Human
cagucacauuccaag

SEQ ID NO: 2764081 - RNA, 15 nt, Human
cagucaccucaugga

SEQ ID NO: 2764082 - RNA, 19 nt, Human
cagucaccucauggaauug

SEQ ID NO: 2764083 - RNA, 20 nt, Human
cagucugacuguuuccauca

SEQ ID NO: 2764084 - RNA, 13 nt, Human
cagcaguucagag

SEQ ID NO: 2764085 - RNA, 22 nt, Human
cagcaguugaaaagacuccaaa

SEQ ID NO: 2764086 - RNA, 16 nt, Human
cagagguugcagugag

SEQ ID NO: 2764087 - RNA, 17 nt, Human
cagagguugcagugagc

SEQ ID NO: 2764088 - RNA, 12 nt, Human
cagauccuggaa

SEQ ID NO: 2764089 - RNA, 21 nt, Human
cagcuccccucggagaagagc

SEQ ID NO: 2764090 - RNA, 22 nt, Human
cagcuccccucggagaagagcu

SEQ ID NO: 2764091 - RNA, 20 nt, Human
cagcuccccucggagaagag

SEQ ID NO: 2764092 - RNA, 14 nt, Human
caugauguuuagaa

SEQ ID NO: 2764093 - RNA, 23 nt, Human
ccacagcaguugaaaagacucca

SEQ ID NO: 2764094 - RNA, 17 nt, Human
ccacagcaguugaaaag

SEQ ID NO: 2764095 - RNA, 18 nt, Human
ccacagcaguugaaaaga

SEQ ID NO: 2764096 - RNA, 12 nt, Human
ccacagcaguug

SEQ ID NO: 2764097 - RNA, 17 nt, Human
cauuuguauaaaauaau

SEQ ID NO: 2764098 - RNA, 20 nt, Human
cauuuguauaaaauaauuuu

SEQ ID NO: 2764099 - RNA, 19 nt, Human
cauuuguauaaaauaauuu

SEQ ID NO: 2764100 - RNA, 17 nt, Human
ccaaauguucaucaaug

SEQ ID NO: 2764101 - RNA, 22 nt, Human
cccaggaauggagccugcacgg

SEQ ID NO: 2764102 - RNA, 20 nt, Human
cccaggaauggagccugcac

SEQ ID NO: 2764103 - RNA, 19 nt, Human
cccaggaauggagccugca

SEQ ID NO: 2764104 - RNA, 18 nt, Human
cccaggaauggagccugc

SEQ ID NO: 2764105 - RNA, 18 nt, Human
ccccugcacuccagccug

SEQ ID NO: 2764106 - RNA, 15 nt, Human
ccagcagauuauuca

SEQ ID NO: 2764107 - RNA, 22 nt, Human
ccaguauuguacaaaguauuaa

SEQ ID NO: 2764108 - RNA, 20 nt, Human
ccaguauuguacaaaguauu

SEQ ID NO: 2764109 - RNA, 19 nt, Human
ccaguuuuguuuggaccaa

SEQ ID NO: 2764110 - RNA, 16 nt, Human
ccaguuuuguuuggac

SEQ ID NO: 2764111 - RNA, 14 nt, Human
ccauacauuugugu

SEQ ID NO: 2764112 - RNA, 13 nt, Human
ccauacauuugug

SEQ ID NO: 2764113 - RNA, 22 nt, Human
ccauuuaaagcuuauuaaaacu

SEQ ID NO: 2764114 - RNA, 23 nt, Human
ccucauggaauuggagcucgugg

SEQ ID NO: 2764115 - RNA, 15 nt, Human
ccuguaaucacagcu

SEQ ID NO: 2764116 - RNA, 17 nt, Human
ccugucuugccuuuuuc

SEQ ID NO: 2764117 - RNA, 20 nt, Human
ccugucuugccuuuuucauu

SEQ ID NO: 2764118 - RNA, 19 nt, Human
ccugucuugccuuuuucau

SEQ ID NO: 2764119 - RNA, 13 nt, Human
cuagaacucccuu

SEQ ID NO: 2764120 - RNA, 12 nt, Human
cuagaacucccu

SEQ ID NO: 2764121 - RNA, 22 nt, Human
cuaaguaaaaccacagcaguug

SEQ ID NO: 2764122 - RNA, 23 nt, Human
cuaaguaaaaccacagcaguuga

SEQ ID NO: 2764123 - RNA, 20 nt, Human
cuaaguaaaaccacagcagu

SEQ ID NO: 2764124 - RNA, 18 nt, Human
cuacaugagguacugaga

SEQ ID NO: 2764125 - RNA, 20 nt, Human
cuacaugagguacugagagu

SEQ ID NO: 2764126 - RNA, 18 nt, Human
cuacauacuauggaauuu

SEQ ID NO: 2764127 - RNA, 16 nt, Human
cuacaaaaacacagca

SEQ ID NO: 2764128 - RNA, 17 nt, Human
cuacaaaaacacagcaa

SEQ ID NO: 2764129 - RNA, 18 nt, Human
cuacaaaaacacagcaag

SEQ ID NO: 2764130 - RNA, 15 nt, Human
cuacaaaaacacagc

SEQ ID NO: 2764131 - RNA, 23 nt, Human
cucaaaauaccaugccauuuaaa

SEQ ID NO: 2764132 - RNA, 17 nt, Human
cucaaaacugcacuguc

SEQ ID NO: 2764133 - RNA, 16 nt, Human
ccuuuuuuaaauaaau

SEQ ID NO: 2764134 - RNA, 18 nt, Human
cgcaggcccccaggugcc

SEQ ID NO: 2764135 - RNA, 19 nt, Human
cgcugauaagcguucaugg

SEQ ID NO: 2764136 - RNA, 15 nt, Human
cuccacuuggucugu

SEQ ID NO: 2764137 - RNA, 13 nt, Human
cuccacuuggucu

SEQ ID NO: 2764138 - RNA, 22 nt, Human
cuccacuuggucugugagaugc

SEQ ID NO: 2764139 - RNA, 21 nt, Human
cuccacuuggucugugagaug

SEQ ID NO: 2764140 - RNA, 17 nt, Human
cuccacuuggucuguga

SEQ ID NO: 2764141 - RNA, 16 nt, Human
cuccacuuggucugug

SEQ ID NO: 2764142 - RNA, 19 nt, Human
cuccccaugauguuuagaa

SEQ ID NO: 2764143 - RNA, 23 nt, Human
cuccacuuggucugugagaugcu

SEQ ID NO: 2764144 - RNA, 12 nt, Human
cuccugggcagc

SEQ ID NO: 2764145 - RNA, 17 nt, Human
cuccugggcagcugccu

SEQ ID NO: 2764146 - RNA, 16 nt, Human
cuccugggcagcugcc

SEQ ID NO: 2764147 - RNA, 15 nt, Human
cuccugggcagcugc

SEQ ID NO: 2764148 - RNA, 14 nt, Human
cuccugggcagcug

SEQ ID NO: 2764149 - RNA, 19 nt, Human
cuccugggcagcugccucc

SEQ ID NO: 2764150 - RNA, 18 nt, Human
cuccugggcagcugccuc

SEQ ID NO: 2764151 - RNA, 22 nt, Human
cuccugggcagcugccuccccu

SEQ ID NO: 2764152 - RNA, 20 nt, Human
cuccucugcuugccaucccu

SEQ ID NO: 2764153 - RNA, 17 nt, Human
cuccucugcuugccauc

SEQ ID NO: 2764154 - RNA, 16 nt, Human
cuccucugcuugccau

SEQ ID NO: 2764155 - RNA, 15 nt, Human
cuccucugcuugcca

SEQ ID NO: 2764156 - RNA, 21 nt, Human
cuccucugcuugccaucccuc

SEQ ID NO: 2764157 - RNA, 14 nt, Human
cuccucugcuugcc

SEQ ID NO: 2764158 - RNA, 12 nt, Human
cuccucugcuug

SEQ ID NO: 2764159 - RNA, 14 nt, Human
cucguuaauuugua

SEQ ID NO: 2764160 - RNA, 15 nt, Human
cugaaacaacaaaua

SEQ ID NO: 2764161 - RNA, 21 nt, Human
cucuuagaugcaguucugaag

SEQ ID NO: 2764162 - RNA, 22 nt, Human
cucuuagaugcaguucugaaga

SEQ ID NO: 2764163 - RNA, 16 nt, Human
cacaguuuucugagaa

SEQ ID NO: 2764164 - RNA, 17 nt, Human
cacaguuuucugagaaa

SEQ ID NO: 2764165 - RNA, 15 nt, Human
cacaguuuucugaga

SEQ ID NO: 2764166 - RNA, 19 nt, Human
cacaguuuucugagaaaga

SEQ ID NO: 2764167 - RNA, 22 nt, Human
caaaauuuuuucucuaggaaau

SEQ ID NO: 2764168 - RNA, 21 nt, Human
caaaauuuuuucucuaggaaa

SEQ ID NO: 2764169 - RNA, 16 nt, Human
caaaauuuuuucucua

SEQ ID NO: 2764170 - RNA, 19 nt, Human
caaauaugcaaagcacuga

SEQ ID NO: 2764171 - RNA, 21 nt, Human
caaauaugcaaagcacugacu

SEQ ID NO: 2764172 - RNA, 18 nt, Human
caaaaaccaguauuguac

SEQ ID NO: 2764173 - RNA, 20 nt, Human
caaaaaccaguauuguacaa

SEQ ID NO: 2764174 - RNA, 19 nt, Human
caaaaaccaguauuguaca

SEQ ID NO: 2764175 - RNA, 13 nt, Human
caaaaacacagca

SEQ ID NO: 2764176 - RNA, 14 nt, Human
caaaaacacagcaa

SEQ ID NO: 2764177 - RNA, 15 nt, Human
caaaaacacagcaag

SEQ ID NO: 2764178 - RNA, 17 nt, Human
caaaaacacagcaaggg

SEQ ID NO: 2764179 - RNA, 13 nt, Human
auuuuccugaaaa

SEQ ID NO: 2764180 - RNA, 21 nt, Human
caaaaauauuuuaugauccag

SEQ ID NO: 2764181 - RNA, 17 nt, Human
caaaaauauuuuaugau

SEQ ID NO: 2764182 - RNA, 15 nt, Human
caaaaauauuuuaug

SEQ ID NO: 2764183 - RNA, 14 nt, Human
caaaaauauuuuau

SEQ ID NO: 2764184 - RNA, 23 nt, Human
caaaaauauuuuaugauccagca

SEQ ID NO: 2764185 - RNA, 22 nt, Human
caaaaauauuuuaugauccagc

SEQ ID NO: 2764186 - RNA, 19 nt, Human
caaaaaucucaauauuuca

SEQ ID NO: 2764187 - RNA, 23 nt, Human
caaaacuucagacauagaauuaa

SEQ ID NO: 2764188 - RNA, 23 nt, Human
caauacaucccuuaccugggaaa

SEQ ID NO: 2764189 - RNA, 22 nt, Human
caaugugacuuaaugccacuaa

SEQ ID NO: 2764190 - RNA, 21 nt, Human
caagccagauuuuccugaaaa

SEQ ID NO: 2764191 - RNA, 17 nt, Human
caaggcugauuaaacca

SEQ ID NO: 2764192 - RNA, 17 nt, Human
uucugucuucacaacag

SEQ ID NO: 2764193 - RNA, 14 nt, Human
uugaugaagaaguu

SEQ ID NO: 2764194 - RNA, 13 nt, Human
uugaugaagaagu

SEQ ID NO: 2764195 - RNA, 23 nt, Human
uugaugaagaaguugauaugccu

SEQ ID NO: 2764196 - RNA, 21 nt, Human
uugaauuuuguguuagagauu

SEQ ID NO: 2764197 - RNA, 17 nt, Human
uugaauuuuguguuaga

SEQ ID NO: 2764198 - RNA, 22 nt, Human
uugaauuuauuggcuuuucuga

SEQ ID NO: 2764199 - RNA, 18 nt, Human
uugaauuuauuggcuuuu

SEQ ID NO: 2764200 - RNA, 15 nt, Human
uugaauuuauuggcu

SEQ ID NO: 2764201 - RNA, 17 nt, Human
uugacccacaagaaaug

SEQ ID NO: 2764202 - RNA, 14 nt, Human
uugacccacaagaa

SEQ ID NO: 2764203 - RNA, 14 nt, Human
uucuaugaaauauu

SEQ ID NO: 2764204 - RNA, 21 nt, Human
uucuaugaaauauuauguuaa

SEQ ID NO: 2764205 - RNA, 23 nt, Human
uucucuccucuccccaugauguu

SEQ ID NO: 2764206 - RNA, 21 nt, Human
uucugauagaggaagccugau

SEQ ID NO: 2764207 - RNA, 13 nt, Human
uucugauagagga

SEQ ID NO: 2764208 - RNA, 16 nt, Human
uucugagaaagacuau

SEQ ID NO: 2764209 - RNA, 21 nt, Human
uucugagaaagacuauucaaa

SEQ ID NO: 2764210 - RNA, 15 nt, Human
uucuacauacuaugg

SEQ ID NO: 2764211 - RNA, 18 nt, Human
uucggugagcuacaaaug

SEQ ID NO: 2764212 - RNA, 23 nt, Human
uucaguuauuauauuuacaaaug

SEQ ID NO: 2764213 - RNA, 18 nt, Human
uuccagauccuggaaauc

SEQ ID NO: 2764214 - RNA, 20 nt, Human
uuauuuuauuaugaaacuug

SEQ ID NO: 2764215 - RNA, 17 nt, Human
uucaaauccuugaagau

SEQ ID NO: 2764216 - RNA, 19 nt, Human
uuauuuuaauaauguuuca

SEQ ID NO: 2764217 - RNA, 17 nt, Human
uuauuuuaauaauguuu

SEQ ID NO: 2764218 - RNA, 16 nt, Human
uuauuuuauuaugaaa

SEQ ID NO: 2764219 - RNA, 15 nt, Human
uuauuuuauuaugaa

SEQ ID NO: 2764220 - RNA, 14 nt, Human
uuauuuuauuauga

SEQ ID NO: 2764221 - RNA, 20 nt, Human
uuauuuuaauaauguuucaa

SEQ ID NO: 2764222 - RNA, 20 nt, Human
uucagauacuggauuguacu

SEQ ID NO: 2764223 - RNA, 16 nt, Human
uucagauacuggauug

SEQ ID NO: 2764224 - RNA, 14 nt, Human
uucagagcugcccu

SEQ ID NO: 2764225 - RNA, 20 nt, Human
uucagauaaucacaauacau

SEQ ID NO: 2764226 - RNA, 20 nt, Human
uucagagcugcccucuccug

SEQ ID NO: 2764227 - RNA, 19 nt, Human
uucagagcugcccucuccu

SEQ ID NO: 2764228 - RNA, 18 nt, Human
uucagagcugcccucucc

SEQ ID NO: 2764229 - RNA, 17 nt, Human
uucagagcugcccucuc

SEQ ID NO: 2764230 - RNA, 15 nt, Human
uucagagcugcccuc

SEQ ID NO: 2764231 - RNA, 18 nt, Human
uuauaugcuauuucuaua

SEQ ID NO: 2764232 - RNA, 16 nt, Human
uuauaugcuauuucua

SEQ ID NO: 2764233 - RNA, 23 nt, Human
uuauaucugaggaauucuguaua

SEQ ID NO: 2764234 - RNA, 22 nt, Human
uuauaucugaggaauucuguau

SEQ ID NO: 2764235 - RNA, 14 nt, Human
uuauaucugaggaa

SEQ ID NO: 2764236 - RNA, 21 nt, Human
uuauaucugaggaauucugua

SEQ ID NO: 2764237 - RNA, 20 nt, Human
uuauaucugaggaauucugu

SEQ ID NO: 2764238 - RNA, 18 nt, Human
uuauaauuuugugaagca

SEQ ID NO: 2764239 - RNA, 17 nt, Human
uuauaauuuugugaagc

SEQ ID NO: 2764240 - RNA, 16 nt, Human
uuauaauuuugugaag

SEQ ID NO: 2764241 - RNA, 12 nt, Human
uuauaauuuaaa

SEQ ID NO: 2764242 - RNA, 15 nt, Human
uuauaauuuugugaa

SEQ ID NO: 2764243 - RNA, 14 nt, Human
uuauaauuuuguga

SEQ ID NO: 2764244 - RNA, 11 nt, Human
uuauaaucuuu

SEQ ID NO: 2764245 - RNA, 13 nt, Human
uuauauuugaaau

SEQ ID NO: 2764246 - RNA, 12 nt, Human
uuauauuugaaa

SEQ ID NO: 2764247 - RNA, 20 nt, Human
uuauauuuauuacuguaaga

SEQ ID NO: 2764248 - RNA, 16 nt, Human
uuauauuuacaaaugg

SEQ ID NO: 2764249 - RNA, 11 nt, Human
uuaucucaaaa

SEQ ID NO: 2764250 - RNA, 22 nt, Human
uuaugauuaaguaaugauaacu

SEQ ID NO: 2764251 - RNA, 16 nt, Human
uuauuacaguauaauu

SEQ ID NO: 2764252 - RNA, 14 nt, Human
uuauuacaguauaa

SEQ ID NO: 2764253 - RNA, 18 nt, Human
uuauggcuauaggugcua

SEQ ID NO: 2764254 - RNA, 16 nt, Human
uuggguguauugugcg

SEQ ID NO: 2764255 - RNA, 15 nt, Human
uuggguguauugugc

SEQ ID NO: 2764256 - RNA, 13 nt, Human
uuggguguauugu

SEQ ID NO: 2764257 - RNA, 16 nt, Human
uuggucugugagaugc

SEQ ID NO: 2764258 - RNA, 15 nt, Human
uuggucugugagaug

SEQ ID NO: 2764259 - RNA, 15 nt, Human
uuguacucaauuuua

SEQ ID NO: 2764260 - RNA, 14 nt, Human
uuguacucaauuuu

SEQ ID NO: 2764261 - RNA, 19 nt, Human
uugucuacaccauuaugug

SEQ ID NO: 2764262 - RNA, 22 nt, Human
uugucucagauuuuauuaugua

SEQ ID NO: 2764263 - RNA, 13 nt, Human
uugucucagauuu

SEQ ID NO: 2764264 - RNA, 20 nt, Human
uugucucagauuuuauuaug

SEQ ID NO: 2764265 - RNA, 16 nt, Human
uugucucagauuuuau

SEQ ID NO: 2764266 - RNA, 20 nt, Human
uugucuacaccauuaugugc

SEQ ID NO: 2764267 - RNA, 15 nt, Human
uugucuagugaaacu

SEQ ID NO: 2764268 - RNA, 23 nt, Human
uugugcgcuaaacuuuucugaua

SEQ ID NO: 2764269 - RNA, 22 nt, Human
uugugcgcuaaacuuuucugau

SEQ ID NO: 2764270 - RNA, 19 nt, Human
uugugcugggguuaucuga

SEQ ID NO: 2764271 - RNA, 12 nt, Human
uugugccccugc

SEQ ID NO: 2764272 - RNA, 17 nt, Human
uuguuagaucuaguuca

SEQ ID NO: 2764273 - RNA, 18 nt, Human
uuguguuuugcaagccag

SEQ ID NO: 2764274 - RNA, 17 nt, Human
uuguuguuuguuuaguc

SEQ ID NO: 2764275 - RNA, 14 nt, Human
uuguuuaaaaucau

SEQ ID NO: 2764276 - RNA, 21 nt, Human
uuucagauaaucacaauacau

SEQ ID NO: 2764277 - RNA, 21 nt, Human
uuucagauacuggauuguacu

SEQ ID NO: 2764278 - RNA, 13 nt, Human
uuucagauacugg

SEQ ID NO: 2764279 - RNA, 22 nt, Human
uuuauuguuuaaaaucauuucu

SEQ ID NO: 2764280 - RNA, 22 nt, Human
uuuauaauuuugugaagcaaaa

SEQ ID NO: 2764281 - RNA, 14 nt, Human
uuuauuauguaaau

SEQ ID NO: 2764282 - RNA, 17 nt, Human
uuuauuauguaaauccc

SEQ ID NO: 2764283 - RNA, 16 nt, Human
uuuauuauguaaaucc

SEQ ID NO: 2764284 - RNA, 17 nt, Human
uuuauggcacuaguauu

SEQ ID NO: 2764285 - RNA, 21 nt, Human
uuuaauaauuauaugcuauuu

SEQ ID NO: 2764286 - RNA, 18 nt, Human
uuuaauaauuauaugcua

SEQ ID NO: 2764287 - RNA, 14 nt, Human
uuuaauaauuauau

SEQ ID NO: 2764288 - RNA, 13 nt, Human
uuuaccacuugug

SEQ ID NO: 2764289 - RNA, 13 nt, Human
uuuaauaauguuu

SEQ ID NO: 2764290 - RNA, 21 nt, Human
uuguuuggaccaaaaaccagu

SEQ ID NO: 2764291 - RNA, 16 nt, Human
uuuaacaacagcuggu

SEQ ID NO: 2764292 - RNA, 19 nt, Human
uuuaacucuauaauguguu

SEQ ID NO: 2764293 - RNA, 22 nt, Human
uuuuucauuauuuuauuaugaa

SEQ ID NO: 2764294 - RNA, 13 nt, Human
uuuuucauuauuu

SEQ ID NO: 2764295 - RNA, 24 nt, Human
uuuggaccaaaaaccaguauugua

SEQ ID NO: 2764296 - RNA, 19 nt, Human
uuuguauaaaauaauuuuu

SEQ ID NO: 2764297 - RNA, 18 nt, Human
uuuguauaaaauaauuuu

SEQ ID NO: 2764298 - RNA, 17 nt, Human
uuuguauaaaauaauuu

SEQ ID NO: 2764299 - RNA, 22 nt, Human
uuuggaccaaaaaccaguauug

SEQ ID NO: 2764300 - RNA, 21 nt, Human
uuuggaccaaaaaccaguauu

SEQ ID NO: 2764301 - RNA, 18 nt, Human
uuuggaccaaaaaccagu

SEQ ID NO: 2764302 - RNA, 15 nt, Human
uuuccacagaagcuc

SEQ ID NO: 2764303 - RNA, 23 nt, Human
uuuuauaauuuugugaagcaaaa

SEQ ID NO: 2764304 - RNA, 21 nt, Human
uuuuauaauuuugugaagcaa

SEQ ID NO: 2764305 - RNA, 21 nt, Human
uuuuaaaguaacccuacaaaa

SEQ ID NO: 2764306 - RNA, 13 nt, Human
uuuuauauuuacu

SEQ ID NO: 2764307 - RNA, 18 nt, Human
uuuuauauuugaaauauu

SEQ ID NO: 2764308 - RNA, 13 nt, Human
uuuuauauuugaa

SEQ ID NO: 2764309 - RNA, 13 nt, Human
uuuucuuauuuca

SEQ ID NO: 2764310 - RNA, 16 nt, Human
ugcacugucaagauga

SEQ ID NO: 2764311 - RNA, 21 nt, Human
ugccuaaggacuucuuuaauu

SEQ ID NO: 2764312 - RNA, 13 nt, Human
ugccuaaggacuu

SEQ ID NO: 2764313 - RNA, 12 nt, Human
ugccuaaggacu

SEQ ID NO: 2764314 - RNA, 20 nt, Human
ugccuaaggacuucuuuaau

SEQ ID NO: 2764315 - RNA, 16 nt, Human
ugccuaaggacuucuu

SEQ ID NO: 2764316 - RNA, 15 nt, Human
ugccuaaggacuucu

SEQ ID NO: 2764317 - RNA, 14 nt, Human
ugccuaaggacuuc

SEQ ID NO: 2764318 - RNA, 17 nt, Human
ugcccugcuuucagaua

SEQ ID NO: 2764319 - RNA, 16 nt, Human
ugcccugcuuucagau

SEQ ID NO: 2764320 - RNA, 12 nt, Human
ugcccugcuuuc

SEQ ID NO: 2764321 - RNA, 17 nt, Human
ugcaugguuuagaaagc

SEQ ID NO: 2764322 - RNA, 19 nt, Human
ugcagauaaacaguaguga

SEQ ID NO: 2764323 - RNA, 17 nt, Human
ugcagauaaacaguagu

SEQ ID NO: 2764324 - RNA, 21 nt, Human
ugcauuauauuuauuacugua

SEQ ID NO: 2764325 - RNA, 24 nt, Human
ugauaguuguaccgcaaugugacu

SEQ ID NO: 2764326 - RNA, 15 nt, Human
ugagcagucaggaaa

SEQ ID NO: 2764327 - RNA, 17 nt, Human
ugagcagucaggaaaga

SEQ ID NO: 2764328 - RNA, 20 nt, Human
ugagcagucaggaaagagaa

SEQ ID NO: 2764329 - RNA, 20 nt, Human
ugagaugcuagaacucccuu

SEQ ID NO: 2764330 - RNA, 16 nt, Human
ugagaugcuagaacuc

SEQ ID NO: 2764331 - RNA, 14 nt, Human
ugagaugcuagaac

SEQ ID NO: 2764332 - RNA, 16 nt, Human
ugagacagcucugcau

SEQ ID NO: 2764333 - RNA, 14 nt, Human
ugagacagcucugc

SEQ ID NO: 2764334 - RNA, 18 nt, Human
ugagaaagacuauucaaa

SEQ ID NO: 2764335 - RNA, 16 nt, Human
ugagaaagacuauuca

SEQ ID NO: 2764336 - RNA, 17 nt, Human
ugagaaagacuauucaa

SEQ ID NO: 2764337 - RNA, 17 nt, Human
ugacugauucuucagca

SEQ ID NO: 2764338 - RNA, 16 nt, Human
ugacugauucuucagc

SEQ ID NO: 2764339 - RNA, 15 nt, Human
ugacugauucuucag

SEQ ID NO: 2764340 - RNA, 14 nt, Human
ugacugauucuuca

SEQ ID NO: 2764341 - RNA, 13 nt, Human
ugacugauucuuc

SEQ ID NO: 2764342 - RNA, 12 nt, Human
ugacucuuaaga

SEQ ID NO: 2764343 - RNA, 23 nt, Human
ugggguuaucugaagucagaucu

SEQ ID NO: 2764344 - RNA, 23 nt, Human
ugggcagcugccuccccuccucu

SEQ ID NO: 2764345 - RNA, 22 nt, Human
ugggcagcugccuccccuccuc

SEQ ID NO: 2764346 - RNA, 20 nt, Human
ugggcagcugccuccccucc

SEQ ID NO: 2764347 - RNA, 12 nt, Human
ugggauaaaugc

SEQ ID NO: 2764348 - RNA, 14 nt, Human
ugggauaaaugcca

SEQ ID NO: 2764349 - RNA, 13 nt, Human
ugggauaaaugcc

SEQ ID NO: 2764350 - RNA, 14 nt, Human
ugggacagggagga

SEQ ID NO: 2764351 - RNA, 23 nt, Human
uggccuucggccuccauccugag

SEQ ID NO: 2764352 - RNA, 20 nt, Human
uggccuucggccuccauccu

SEQ ID NO: 2764353 - RNA, 22 nt, Human
uggccuucggccuccauccuga

SEQ ID NO: 2764354 - RNA, 15 nt, Human
uggaccaaaaaccag

SEQ ID NO: 2764355 - RNA, 16 nt, Human
uggaacgcguugaaau

SEQ ID NO: 2764356 - RNA, 15 nt, Human
uggaacgcguugaaa

SEQ ID NO: 2764357 - RNA, 14 nt, Human
uggaacgcguugaa

SEQ ID NO: 2764358 - RNA, 22 nt, Human
ugcuucuguuuuauaauuuugu

SEQ ID NO: 2764359 - RNA, 17 nt, Human
ugcuucuguuuuauaau

SEQ ID NO: 2764360 - RNA, 19 nt, Human
uguauuuuaaaagaaugau

SEQ ID NO: 2764361 - RNA, 18 nt, Human
uguauuuuaaaagaauga

SEQ ID NO: 2764362 - RNA, 23 nt, Human
uguauagauuagagaguguugaa

SEQ ID NO: 2764363 - RNA, 23 nt, Human
uguauagaaccucuuugucuaca

SEQ ID NO: 2764364 - RNA, 21 nt, Human
uguauagauuagaauucugua

SEQ ID NO: 2764365 - RNA, 15 nt, Human
uguauagauuagaau

SEQ ID NO: 2764366 - RNA, 14 nt, Human
uguauaaaauaauu

SEQ ID NO: 2764367 - RNA, 13 nt, Human
uguauaaaauaau

SEQ ID NO: 2764368 - RNA, 21 nt, Human
uguaguguuggagaagaacug

SEQ ID NO: 2764369 - RNA, 20 nt, Human
uguaguguuggagaagaacu

SEQ ID NO: 2764370 - RNA, 19 nt, Human
uguaguguuggagaagaac

SEQ ID NO: 2764371 - RNA, 22 nt, Human
ugucucagauuuuauuauguaa

SEQ ID NO: 2764372 - RNA, 20 nt, Human
ugucucagauuuuauuaugu

SEQ ID NO: 2764373 - RNA, 16 nt, Human
ugucucagauuuuauu

SEQ ID NO: 2764374 - RNA, 17 nt, Human
ugucuacaccauuaugu

SEQ ID NO: 2764375 - RNA, 17 nt, Human
ugucuacacuaagagag

SEQ ID NO: 2764376 - RNA, 18 nt, Human
ugucuacaccauuaugug

SEQ ID NO: 2764377 - RNA, 22 nt, Human
ugucuacacuaagagagaauga

SEQ ID NO: 2764378 - RNA, 23 nt, Human
uggugacuuuggauaauaaggaa

SEQ ID NO: 2764379 - RNA, 19 nt, Human
uggugacuuuggauaauaa

SEQ ID NO: 2764380 - RNA, 18 nt, Human
uggugacuuuggauaaua

SEQ ID NO: 2764381 - RNA, 16 nt, Human
uggugacuuuggauaa

SEQ ID NO: 2764382 - RNA, 15 nt, Human
uggugacuuuggaua

SEQ ID NO: 2764383 - RNA, 14 nt, Human
uggguagacacaca

SEQ ID NO: 2764384 - RNA, 20 nt, Human
ugguucccuugaugaagaag

SEQ ID NO: 2764385 - RNA, 17 nt, Human
ugguucccuugaugaag

SEQ ID NO: 2764386 - RNA, 16 nt, Human
ugguucccuugaugaa

SEQ ID NO: 2764387 - RNA, 15 nt, Human
uguacaaaguauuaa

SEQ ID NO: 2764388 - RNA, 20 nt, Human
uguacaaaguauuaagcaua

SEQ ID NO: 2764389 - RNA, 19 nt, Human
uguacaaaguauuaagcau

SEQ ID NO: 2764390 - RNA, 18 nt, Human
uguacaaaguauuaagca

SEQ ID NO: 2764391 - RNA, 17 nt, Human
uguacaaaguauuaagc

SEQ ID NO: 2764392 - RNA, 21 nt, Human
uguacaaaguauuaagcauau

SEQ ID NO: 2764393 - RNA, 12 nt, Human
uguaaaauggug

SEQ ID NO: 2764394 - RNA, 11 nt, Human
uguaaaauggu

SEQ ID NO: 2764395 - RNA, 10 nt, Human
ucuggccuuc

SEQ ID NO: 2764396 - RNA, 18 nt, Human
ucuggccuucggccucca

SEQ ID NO: 2764397 - RNA, 17 nt, Human
ucuggccuucggccucc

SEQ ID NO: 2764398 - RNA, 22 nt, Human
ucuucagcaaaaauauuuuaug

SEQ ID NO: 2764399 - RNA, 21 nt, Human
ucuucagcaaaaauauuuuau

SEQ ID NO: 2764400 - RNA, 23 nt, Human
ucuucagcaaaaauauuuuauga

SEQ ID NO: 2764401 - RNA, 22 nt, Human
ucuuaaaguugaauuuauuggc

SEQ ID NO: 2764402 - RNA, 21 nt, Human
ucuuaaaguugaauuuauugg

SEQ ID NO: 2764403 - RNA, 20 nt, Human
ucuuaaaguugaauuuauug

SEQ ID NO: 2764404 - RNA, 19 nt, Human
ucuuaaaguugaauuuauu

SEQ ID NO: 2764405 - RNA, 16 nt, Human
ucuuaaaguugaauuu

SEQ ID NO: 2764406 - RNA, 12 nt, Human
ucuuaagaagac

SEQ ID NO: 2764407 - RNA, 18 nt, Human
ucuuaagaagacugcauu

SEQ ID NO: 2764408 - RNA, 12 nt, Human
ucuuaaaguuga

SEQ ID NO: 2764409 - RNA, 14 nt, Human
ucuuaaaguugaau

SEQ ID NO: 2764410 - RNA, 13 nt, Human
ucuuaaaguugaa

SEQ ID NO: 2764411 - RNA, 15 nt, Human
ucugucuucacaaca

SEQ ID NO: 2764412 - RNA, 14 nt, Human
ucugaggaauucug

SEQ ID NO: 2764413 - RNA, 18 nt, Human
ucugaggaauucuguaua

SEQ ID NO: 2764414 - RNA, 17 nt, Human
ucugaggaauucuguau

SEQ ID NO: 2764415 - RNA, 16 nt, Human
ucugaggaauucugua

SEQ ID NO: 2764416 - RNA, 15 nt, Human
ucugaggaauucugu

SEQ ID NO: 2764417 - RNA, 19 nt, Human
ucugcaucagcugcugaaa

SEQ ID NO: 2764418 - RNA, 21 nt, Human
ucugcaucagcugcugaaaca

SEQ ID NO: 2764419 - RNA, 14 nt, Human
ucugcaucagcugc

SEQ ID NO: 2764420 - RNA, 19 nt, Human
ucucuaggaaauauuuauu

SEQ ID NO: 2764421 - RNA, 23 nt, Human
ucucuggccuucggccuccaucc

SEQ ID NO: 2764422 - RNA, 16 nt, Human
ucccugcaauaaaaug

SEQ ID NO: 2764423 - RNA, 16 nt, Human
ucccuugaugaagaag

SEQ ID NO: 2764424 - RNA, 15 nt, Human
ucccuugaugaagaa

SEQ ID NO: 2764425 - RNA, 22 nt, Human
uccucugcuugccaucccuccc

SEQ ID NO: 2764426 - RNA, 21 nt, Human
uccucugcuugccaucccucc

SEQ ID NO: 2764427 - RNA, 19 nt, Human
uccucugcuugccaucccu

SEQ ID NO: 2764428 - RNA, 20 nt, Human
uccucugcuugccaucccuc

SEQ ID NO: 2764429 - RNA, 22 nt, Human
ucuagugagcagucaggaaaga

SEQ ID NO: 2764430 - RNA, 19 nt, Human
ucuagugagcagucaggaa

SEQ ID NO: 2764431 - RNA, 20 nt, Human
ucuaugcugaguuugugcug

SEQ ID NO: 2764432 - RNA, 16 nt, Human
ucuaugcugaguuugu

SEQ ID NO: 2764433 - RNA, 15 nt, Human
ucucaacuccaaacu

SEQ ID NO: 2764434 - RNA, 19 nt, Human
ucuauauuuucauucuccu

SEQ ID NO: 2764435 - RNA, 17 nt, Human
ucuaugaaauauuaugu

SEQ ID NO: 2764436 - RNA, 14 nt, Human
ucuaugaaauauua

SEQ ID NO: 2764437 - RNA, 13 nt, Human
ucuaugaaauauu

SEQ ID NO: 2764438 - RNA, 22 nt, Human
ucgugggacagucaccucaugg

SEQ ID NO: 2764439 - RNA, 21 nt, Human
ucguggaacaguuaccucugc

SEQ ID NO: 2764440 - RNA, 17 nt, Human
ucggccuccauccugag

SEQ ID NO: 2764441 - RNA, 18 nt, Human
ucggccuccauccugagg

SEQ ID NO: 2764442 - RNA, 13 nt, Human
ucguuaauuugua

SEQ ID NO: 2764443 - RNA, 17 nt, Human
uccuggcaauagucaaa

SEQ ID NO: 2764444 - RNA, 20 nt, Human
uccugccuaagugcagcccc

SEQ ID NO: 2764445 - RNA, 16 nt, Human
uccuuggacucauuuu

SEQ ID NO: 2764446 - RNA, 14 nt, Human
ucaccaaggcugau

SEQ ID NO: 2764447 - RNA, 16 nt, Human
ucacagucacauucca

SEQ ID NO: 2764448 - RNA, 13 nt, Human
ucacaagacccaa

SEQ ID NO: 2764449 - RNA, 18 nt, Human
ucacaagacccaaaaggc

SEQ ID NO: 2764450 - RNA, 17 nt, Human
ucacaagacccaaaagg

SEQ ID NO: 2764451 - RNA, 13 nt, Human
ucaaugcagcccc

SEQ ID NO: 2764452 - RNA, 21 nt, Human
ucaauaaaauccauacauuug

SEQ ID NO: 2764453 - RNA, 14 nt, Human
ucaauaaaauccau

SEQ ID NO: 2764454 - RNA, 15 nt, Human
uauuuucauucuccu

SEQ ID NO: 2764455 - RNA, 13 nt, Human
uauuuuauuauga

SEQ ID NO: 2764456 - RNA, 23 nt, Human
uauuuuauuaugaaacuugugua

SEQ ID NO: 2764457 - RNA, 18 nt, Human
uauuuuauuaugaaacuu

SEQ ID NO: 2764458 - RNA, 14 nt, Human
ucaaauaugcaaag

SEQ ID NO: 2764459 - RNA, 20 nt, Human
ucaaaucaagaaacuuaagg

SEQ ID NO: 2764460 - RNA, 14 nt, Human
ucaaauugugugaa

SEQ ID NO: 2764461 - RNA, 13 nt, Human
uauuacaguauaa

SEQ ID NO: 2764462 - RNA, 12 nt, Human
uauuacaguaua

SEQ ID NO: 2764463 - RNA, 16 nt, Human
uauuauucccauucua

SEQ ID NO: 2764464 - RNA, 12 nt, Human
uauguaaauccc

SEQ ID NO: 2764465 - RNA, 23 nt, Human
uauguaaaucccauuauucaaag

SEQ ID NO: 2764466 - RNA, 21 nt, Human
uauguaaaucccauuauucaa

SEQ ID NO: 2764467 - RNA, 20 nt, Human
uauguaaaucccauuauuca

SEQ ID NO: 2764468 - RNA, 19 nt, Human
uauguaaaucccauuauuc

SEQ ID NO: 2764469 - RNA, 15 nt, Human
uauguaaaucccauu

SEQ ID NO: 2764470 - RNA, 17 nt, Human
uauguacuucaugcugu

SEQ ID NO: 2764471 - RNA, 13 nt, Human
uauguacuucaug

SEQ ID NO: 2764472 - RNA, 16 nt, Human
ucauuuccaagcaagu

SEQ ID NO: 2764473 - RNA, 13 nt, Human
ucauuuccaagca

SEQ ID NO: 2764474 - RNA, 22 nt, Human
ucauuauuuuauuaugaaacuu

SEQ ID NO: 2764475 - RNA, 23 nt, Human
ucauuauuuuauuaugaaacuug

SEQ ID NO: 2764476 - RNA, 19 nt, Human
ucauuaucucaaaacugca

SEQ ID NO: 2764477 - RNA, 20 nt, Human
ucauuaucucaaaacugcac

SEQ ID NO: 2764478 - RNA, 13 nt, Human
ucauuaucucaaa

SEQ ID NO: 2764479 - RNA, 18 nt, Human
ucauaccuaucaucuuaa

SEQ ID NO: 2764480 - RNA, 14 nt, Human
uccacuuggucugu

SEQ ID NO: 2764481 - RNA, 16 nt, Human
uccacuuggucuguga

SEQ ID NO: 2764482 - RNA, 15 nt, Human
uccacuuggucugug

SEQ ID NO: 2764483 - RNA, 17 nt, Human
uccaccucccugcaaua

SEQ ID NO: 2764484 - RNA, 16 nt, Human
uccaccucccugcaau

SEQ ID NO: 2764485 - RNA, 15 nt, Human
uccaccucccugcaa

SEQ ID NO: 2764486 - RNA, 14 nt, Human
uccaccucccugca

SEQ ID NO: 2764487 - RNA, 13 nt, Human
uccaccucccugc

SEQ ID NO: 2764488 - RNA, 12 nt, Human
uccaccucccug

SEQ ID NO: 2764489 - RNA, 19 nt, Human
uccacagaagcuccaggua

SEQ ID NO: 2764490 - RNA, 17 nt, Human
ucaggcuagauguaugu

SEQ ID NO: 2764491 - RNA, 13 nt, Human
ucaggcuagaugu

SEQ ID NO: 2764492 - RNA, 18 nt, Human
ucagcuccccucggagaa

SEQ ID NO: 2764493 - RNA, 17 nt, Human
ucagcuccccucggaga

SEQ ID NO: 2764494 - RNA, 22 nt, Human
ucagagcugcccucuccugggc

SEQ ID NO: 2764495 - RNA, 21 nt, Human
ucagagcugcccucuccuggg

SEQ ID NO: 2764496 - RNA, 20 nt, Human
ucagagcugcccucuccugg

SEQ ID NO: 2764497 - RNA, 19 nt, Human
ucagagcugcccucuccug

SEQ ID NO: 2764498 - RNA, 18 nt, Human
ucagagcugcccucuccu

SEQ ID NO: 2764499 - RNA, 16 nt, Human
ggaggacgcucucugg

SEQ ID NO: 2764500 - RNA, 19 nt, Human
ggaggggagcaugggaagu

SEQ ID NO: 2764501 - RNA, 19 nt, Human
ggacgcucucuggccuucg

SEQ ID NO: 2764502 - RNA, 16 nt, Human
ggacgcucucuggccu

SEQ ID NO: 2764503 - RNA, 15 nt, Human
ggacgcucucuggcc

SEQ ID NO: 2764504 - RNA, 23 nt, Human
ggagaagagcuguucacagccag

SEQ ID NO: 2764505 - RNA, 14 nt, Human
ggagaagaacugaa

SEQ ID NO: 2764506 - RNA, 11 nt, Human
ggagaagaacu

SEQ ID NO: 2764507 - RNA, 15 nt, Human
ggagaagagcuguuc

SEQ ID NO: 2764508 - RNA, 20 nt, Human
ggacauuugcucauggaauu

SEQ ID NO: 2764509 - RNA, 17 nt, Human
ggacauuugcucaugga

SEQ ID NO: 2764510 - RNA, 16 nt, Human
ggacauuugcucaugg

SEQ ID NO: 2764511 - RNA, 13 nt, Human
ggcagcugccucc

SEQ ID NO: 2764512 - RNA, 12 nt, Human
ggcagcugccuc

SEQ ID NO: 2764513 - RNA, 11 nt, Human
ggcagcugccu

SEQ ID NO: 2764514 - RNA, 17 nt, Human
ggauuagggagagaaga

SEQ ID NO: 2764515 - RNA, 21 nt, Human
ggcagagguugcagugagccg

SEQ ID NO: 2764516 - RNA, 13 nt, Human
ggauucuuaaagu

SEQ ID NO: 2764517 - RNA, 20 nt, Human
gggaggacgcucucuggccu

SEQ ID NO: 2764518 - RNA, 17 nt, Human
gggaggacgcucucugg

SEQ ID NO: 2764519 - RNA, 15 nt, Human
ggcuuuguauagaac

SEQ ID NO: 2764520 - RNA, 21 nt, Human
gggacugaggggaggggagca

SEQ ID NO: 2764521 - RNA, 23 nt, Human
ggcuauaggugcuacaaaaacac

SEQ ID NO: 2764522 - RNA, 20 nt, Human
ggcuaguaucaaaagaaaga

SEQ ID NO: 2764523 - RNA, 16 nt, Human
ggcuccacuuggucug

SEQ ID NO: 2764524 - RNA, 18 nt, Human
gccuuggggcugaugcag

SEQ ID NO: 2764525 - RNA, 20 nt, Human
gccugagcgacagugagacu

SEQ ID NO: 2764526 - RNA, 17 nt, Human
gccugagcgacagugag

SEQ ID NO: 2764527 - RNA, 14 nt, Human
gcuagauguaugua

SEQ ID NO: 2764528 - RNA, 13 nt, Human
gcuagauguaugu

SEQ ID NO: 2764529 - RNA, 21 nt, Human
gcuauaggugcuacaaaaaca

SEQ ID NO: 2764530 - RNA, 19 nt, Human
gcuauaggugcuacaaaaa

SEQ ID NO: 2764531 - RNA, 20 nt, Human
gcuccauuuuuagugaaaua

SEQ ID NO: 2764532 - RNA, 21 nt, Human
gcuggaaaaguauguuagugc

SEQ ID NO: 2764533 - RNA, 23 nt, Human
gcuggaaaaguauguuagugcaa

SEQ ID NO: 2764534 - RNA, 23 nt, Human
gcugcccucuccugggcagcugc

SEQ ID NO: 2764535 - RNA, 22 nt, Human
gcugcccucuccugggcagcug

SEQ ID NO: 2764536 - RNA, 20 nt, Human
gcugcccucuccugggcagc

SEQ ID NO: 2764537 - RNA, 18 nt, Human
gcugcccucuccugggca

SEQ ID NO: 2764538 - RNA, 17 nt, Human
gcugcccucuccugggc

SEQ ID NO: 2764539 - RNA, 16 nt, Human
gcugcccucuccuggg

SEQ ID NO: 2764540 - RNA, 15 nt, Human
gcugcccucuccugg

SEQ ID NO: 2764541 - RNA, 14 nt, Human
gcugcccucuccug

SEQ ID NO: 2764542 - RNA, 13 nt, Human
gcugcccucuccu

SEQ ID NO: 2764543 - RNA, 21 nt, Human
gcugauuaaaccaaggcuaga

SEQ ID NO: 2764544 - RNA, 12 nt, Human
gcugcccucucc

SEQ ID NO: 2764545 - RNA, 21 nt, Human
gcugguguaugugugaaguga

SEQ ID NO: 2764546 - RNA, 23 nt, Human
gcuggucccagccagcaguucag

SEQ ID NO: 2764547 - RNA, 19 nt, Human
gcuucuguuuuauaauuuu

SEQ ID NO: 2764548 - RNA, 14 nt, Human
gcuuuguauagaac

SEQ ID NO: 2764549 - RNA, 13 nt, Human
gcuuuguauagaa

SEQ ID NO: 2764550 - RNA, 12 nt, Human
gcuuuguauaga

SEQ ID NO: 2764551 - RNA, 18 nt, Human
gcuugcccuguuaaaaga

SEQ ID NO: 2764552 - RNA, 23 nt, Human
gcaguucagagcugcccucuccu

SEQ ID NO: 2764553 - RNA, 22 nt, Human
gcaguucagagcugcccucucc

SEQ ID NO: 2764554 - RNA, 20 nt, Human
gcaguucagagcugcccucu

SEQ ID NO: 2764555 - RNA, 19 nt, Human
gcaguucagagcugcccuc

SEQ ID NO: 2764556 - RNA, 21 nt, Human
gcaguugaaaagacuccaaag

SEQ ID NO: 2764557 - RNA, 16 nt, Human
gcaguugaaaagacuc

SEQ ID NO: 2764558 - RNA, 19 nt, Human
gcaguugaaaagacuccaa

SEQ ID NO: 2764559 - RNA, 15 nt, Human
gcaguugaaaagacu

SEQ ID NO: 2764560 - RNA, 20 nt, Human
gcaucuagcaugucgucaaa

SEQ ID NO: 2764561 - RNA, 22 nt, Human
gcaucagcugcugaaacaacaa

SEQ ID NO: 2764562 - RNA, 23 nt, Human
gcaucagcugcugaaacaacaaa

SEQ ID NO: 2764563 - RNA, 19 nt, Human
gcacuguggguagacacac

SEQ ID NO: 2764564 - RNA, 15 nt, Human
gcacagccucuuaga

SEQ ID NO: 2764565 - RNA, 13 nt, Human
gcagauuauucac

SEQ ID NO: 2764566 - RNA, 23 nt, Human
gcagagguugcagugagccgaga

SEQ ID NO: 2764567 - RNA, 18 nt, Human
gcagagguugcagugagc

SEQ ID NO: 2764568 - RNA, 19 nt, Human
gccagacuggcacaguuuu

SEQ ID NO: 2764569 - RNA, 15 nt, Human
gccagacuggcacag

SEQ ID NO: 2764570 - RNA, 18 nt, Human
gccagacuggcacaguuu

SEQ ID NO: 2764571 - RNA, 23 nt, Human
gccaugggacagggaggacgcuc

SEQ ID NO: 2764572 - RNA, 22 nt, Human
gccaugggacagggaggacgcu

SEQ ID NO: 2764573 - RNA, 14 nt, Human
gauagaggaagccu

SEQ ID NO: 2764574 - RNA, 22 nt, Human
gauagaggaagccugauuaaag

SEQ ID NO: 2764575 - RNA, 21 nt, Human
gauagaggaagccugauuaaa

SEQ ID NO: 2764576 - RNA, 15 nt, Human
gauagaggaagccug

SEQ ID NO: 2764577 - RNA, 13 nt, Human
gauagcagggcau

SEQ ID NO: 2764578 - RNA, 19 nt, Human
gagugucuuaauuaaaaga

SEQ ID NO: 2764579 - RNA, 22 nt, Human
gagugaacaaauuuacagagac

SEQ ID NO: 2764580 - RNA, 19 nt, Human
gagugaacaaauuuacaga

SEQ ID NO: 2764581 - RNA, 21 nt, Human
gaguugaaaaucuuauaauuu

SEQ ID NO: 2764582 - RNA, 13 nt, Human
gauugugccccug

SEQ ID NO: 2764583 - RNA, 18 nt, Human
gaugcaguucugaagaag

SEQ ID NO: 2764584 - RNA, 16 nt, Human
gaugggaaagcauugu

SEQ ID NO: 2764585 - RNA, 13 nt, Human
gaucuuuaaaaua

SEQ ID NO: 2764586 - RNA, 14 nt, Human
gaucuuuaaaauac

SEQ ID NO: 2764587 - RNA, 14 nt, Human
gaggaauucuguau

SEQ ID NO: 2764588 - RNA, 17 nt, Human
gaggaauucuguauaga

SEQ ID NO: 2764589 - RNA, 16 nt, Human
gaggaauucuguauag

SEQ ID NO: 2764590 - RNA, 19 nt, Human
gaggcagagguugcaguga

SEQ ID NO: 2764591 - RNA, 21 nt, Human
gagcaggcuacugucagcucc

SEQ ID NO: 2764592 - RNA, 23 nt, Human
gagccugcacggugaauggcuuu

SEQ ID NO: 2764593 - RNA, 22 nt, Human
gagccugcacggugaauggcuu

SEQ ID NO: 2764594 - RNA, 17 nt, Human
gagccugcacggugaau

SEQ ID NO: 2764595 - RNA, 12 nt, Human
gagcuacaaaug

SEQ ID NO: 2764596 - RNA, 13 nt, Human
gagcuacaaaugc

SEQ ID NO: 2764597 - RNA, 14 nt, Human
gagcuacaaaugca

SEQ ID NO: 2764598 - RNA, 16 nt, Human
gagcugcccucuccug

SEQ ID NO: 2764599 - RNA, 15 nt, Human
gagcugcccucuccu

SEQ ID NO: 2764600 - RNA, 14 nt, Human
gagcugcccucucc

SEQ ID NO: 2764601 - RNA, 19 nt, Human
cucuuaagaagacugcauu

SEQ ID NO: 2764602 - RNA, 13 nt, Human
cucuuaagaagac

SEQ ID NO: 2764603 - RNA, 21 nt, Human
cucuggccuucggccuccauc

SEQ ID NO: 2764604 - RNA, 22 nt, Human
cucuggccuucggccuccaucc

SEQ ID NO: 2764605 - RNA, 16 nt, Human
cugagcaggauuuuaa

SEQ ID NO: 2764606 - RNA, 16 nt, Human
cugagaugugaacaca

SEQ ID NO: 2764607 - RNA, 20 nt, Human
cugagaugugaacacaucag

SEQ ID NO: 2764608 - RNA, 19 nt, Human
cugagaaagacuauucaaa

SEQ ID NO: 2764609 - RNA, 20 nt, Human
cugagaaagacuauucaaac

SEQ ID NO: 2764610 - RNA, 21 nt, Human
cugagaugugaacacaucagc

SEQ ID NO: 2764611 - RNA, 12 nt, Human
cugagaaagacu

SEQ ID NO: 2764612 - RNA, 13 nt, Human
cugagaaagacua

SEQ ID NO: 2764613 - RNA, 15 nt, Human
cugagaaagacuauu

SEQ ID NO: 2764614 - RNA, 18 nt, Human
cugagaaagacuauucaa

SEQ ID NO: 2764615 - RNA, 23 nt, Human
cucuuugucuacaccauuaugug

SEQ ID NO: 2764616 - RNA, 20 nt, Human
cugcaucagcugcugaaaca

SEQ ID NO: 2764617 - RNA, 18 nt, Human
cugaguuugugcuggugu

SEQ ID NO: 2764618 - RNA, 13 nt, Human
cugaguuugugcu

SEQ ID NO: 2764619 - RNA, 15 nt, Human
cugaggcuccacuug

SEQ ID NO: 2764620 - RNA, 21 nt, Human
cugaggcuccacuuggucugu

SEQ ID NO: 2764621 - RNA, 23 nt, Human
cugauuugacauagucuggcugu

SEQ ID NO: 2764622 - RNA, 22 nt, Human
cugauuugacauagucuggcug

SEQ ID NO: 2764623 - RNA, 21 nt, Human
cugauuugacauagucuggcu

SEQ ID NO: 2764624 - RNA, 22 nt, Human
cugcaauaaaauggguuuuacu

SEQ ID NO: 2764625 - RNA, 15 nt, Human
cugcaauaaaauggg

SEQ ID NO: 2764626 - RNA, 14 nt, Human
cuauuucuauauuu

SEQ ID NO: 2764627 - RNA, 18 nt, Human
cuauuucuauauuuucau

SEQ ID NO: 2764628 - RNA, 16 nt, Human
cuauuucuauauuuuc

SEQ ID NO: 2764629 - RNA, 13 nt, Human
cucacauuuauau

SEQ ID NO: 2764630 - RNA, 13 nt, Human
cucagauuuuauu

SEQ ID NO: 2764631 - RNA, 18 nt, Human
cucagauuuuauuaugua

SEQ ID NO: 2764632 - RNA, 17 nt, Human
cucagauuuuauuaugu

SEQ ID NO: 2764633 - RNA, 15 nt, Human
cucagauuuuauuau

SEQ ID NO: 2764634 - RNA, 16 nt, Human
cuaguaauuggaaagg

SEQ ID NO: 2764635 - RNA, 20 nt, Human
cuagugaaacucguuaauuu

SEQ ID NO: 2764636 - RNA, 18 nt, Human
cuagugaaagaggcagcu

SEQ ID NO: 2764637 - RNA, 19 nt, Human
cuagugaaagaggcagcuu

SEQ ID NO: 2764638 - RNA, 21 nt, Human
cuagugagcagucaggaaaga

SEQ ID NO: 2764639 - RNA, 18 nt, Human
cuaugcugaguuugugcu

SEQ ID NO: 2764640 - RNA, 23 nt, Human
cuauucaaacagucucaggaaau

SEQ ID NO: 2764641 - RNA, 18 nt, Human
cuauucaaacagucucag

SEQ ID NO: 2764642 - RNA, 16 nt, Human
cuauucaaacagucuc

SEQ ID NO: 2764643 - RNA, 15 nt, Human
cuauauuuucauucu

SEQ ID NO: 2764644 - RNA, 19 nt, Human
cuauauuuucauucuccua

SEQ ID NO: 2764645 - RNA, 21 nt, Human
cuauaggugcuacaaaaacac

SEQ ID NO: 2764646 - RNA, 22 nt, Human
cuauaggugcuacaaaaacaca

SEQ ID NO: 2764647 - RNA, 20 nt, Human
cuauaggugcuacaaaaaca

SEQ ID NO: 2764648 - RNA, 15 nt, Human
cuauaggugcuacaa

SEQ ID NO: 2764649 - RNA, 21 nt, Human
cucauuuccaagcaaguauua

SEQ ID NO: 2764650 - RNA, 13 nt, Human
cuccaaagaaaug

SEQ ID NO: 2764651 - RNA, 12 nt, Human
cuccaaagaaau

SEQ ID NO: 2764652 - RNA, 21 nt, Human
cuccaaacugacucuuaagaa

SEQ ID NO: 2764653 - RNA, 23 nt, Human
cuccaccucccugcaauaaaaug

SEQ ID NO: 2764654 - RNA, 11 nt, Human
cuccauccuga

SEQ ID NO: 2764655 - RNA, 12 nt, Human
cuccauccugag

SEQ ID NO: 2764656 - RNA, 13 nt, Human
cuccccuccucug

SEQ ID NO: 2764657 - RNA, 11 nt, Human
cuccccuccuc

SEQ ID NO: 2764658 - RNA, 13 nt, Human
cuccauccugagg

SEQ ID NO: 2764659 - RNA, 20 nt, Human
cuccccuccucugcuugcca

SEQ ID NO: 2764660 - RNA, 21 nt, Human
cuugccaucccucccuccacc

SEQ ID NO: 2764661 - RNA, 22 nt, Human
cuugccaucccucccuccaccu

SEQ ID NO: 2764662 - RNA, 19 nt, Human
cuuguaaaggaauuuaaaa

SEQ ID NO: 2764663 - RNA, 13 nt, Human
cuuuccacagaag

SEQ ID NO: 2764664 - RNA, 21 nt, Human
cuuuauuuucuauaauuuaaa

SEQ ID NO: 2764665 - RNA, 18 nt, Human
cuuuaaagggauggcaag

SEQ ID NO: 2764666 - RNA, 11 nt, Human
cuuuucugaua

SEQ ID NO: 2764667 - RNA, 22 nt, Human
gaaaacaauaacgauaaaagac

SEQ ID NO: 2764668 - RNA, 12 nt, Human
gaaaauaucacu

SEQ ID NO: 2764669 - RNA, 19 nt, Human
gaaaaucuuauaauuuaaa

SEQ ID NO: 2764670 - RNA, 19 nt, Human
gaaaauaacgauaaaagac

SEQ ID NO: 2764671 - RNA, 20 nt, Human
gaaaaucuuauaauuuaaaa

SEQ ID NO: 2764672 - RNA, 20 nt, Human
gaauaauccuaaacauauga

SEQ ID NO: 2764673 - RNA, 14 nt, Human
gaauacuuuauaaa

SEQ ID NO: 2764674 - RNA, 21 nt, Human
gaagccuuggggcugaugcag

SEQ ID NO: 2764675 - RNA, 18 nt, Human
gaaauuguauuacaaauc

SEQ ID NO: 2764676 - RNA, 16 nt, Human
gaaauauuauguuaaa

SEQ ID NO: 2764677 - RNA, 13 nt, Human
gaaauauuauguu

SEQ ID NO: 2764678 - RNA, 21 nt, Human
gaagaagcaccaaucaugaau

SEQ ID NO: 2764679 - RNA, 21 nt, Human
gaacuuguaaaggaauuuaaa

SEQ ID NO: 2764680 - RNA, 22 nt, Human
gaacuuccagauccuggaaauc

SEQ ID NO: 2764681 - RNA, 14 nt, Human
gaacucccuuucaa

SEQ ID NO: 2764682 - RNA, 15 nt, Human
gaacgcguugaaauu

SEQ ID NO: 2764683 - RNA, 16 nt, Human
gaacgcguugaaauug

SEQ ID NO: 2764684 - RNA, 22 nt, Human
gaacuagaguuuagcuggaaaa

SEQ ID NO: 2764685 - RNA, 21 nt, Human
gaacuagaguuuagcuggaaa

SEQ ID NO: 2764686 - RNA, 15 nt, Human
cugguguauguguga

SEQ ID NO: 2764687 - RNA, 14 nt, Human
cugggguuaucuga

SEQ ID NO: 2764688 - RNA, 23 nt, Human
cugucuugccuuuuucauuauuu

SEQ ID NO: 2764689 - RNA, 21 nt, Human
cugucuugccuuuuucauuau

SEQ ID NO: 2764690 - RNA, 18 nt, Human
cugucuucacaacagauu

SEQ ID NO: 2764691 - RNA, 12 nt, Human
cuguggugacuu

SEQ ID NO: 2764692 - RNA, 14 nt, Human
cuguggugacuuug

SEQ ID NO: 2764693 - RNA, 13 nt, Human
cuguggugacuuu

SEQ ID NO: 2764694 - RNA, 23 nt, Human
cuguggugacuuuggauaauaag

SEQ ID NO: 2764695 - RNA, 20 nt, Human
cuguggugacuuuggauaau

SEQ ID NO: 2764696 - RNA, 18 nt, Human
cuguggugacuuuggaua

SEQ ID NO: 2764697 - RNA, 17 nt, Human
cuguggugacuuuggau

SEQ ID NO: 2764698 - RNA, 15 nt, Human
cuguggugacuuugg

SEQ ID NO: 2764699 - RNA, 19 nt, Human
cuguuaaaagaugaaaaua

SEQ ID NO: 2764700 - RNA, 15 nt, Human
cuguuaaaagaugaa

SEQ ID NO: 2764701 - RNA, 16 nt, Human
cuguuaaaagaugaaa

SEQ ID NO: 2764702 - RNA, 23 nt, Human
cuuaagaagacugcauuauauuu

SEQ ID NO: 2764703 - RNA, 21 nt, Human
cuuaagaagacugcauuauau

SEQ ID NO: 2764704 - RNA, 19 nt, Human
cuuaauuaaaagaauauuu

SEQ ID NO: 2764705 - RNA, 20 nt, Human
cuuaauuaaaagaauauuuu

SEQ ID NO: 2764706 - RNA, 16 nt, Human
cuuaauuaaaagaaua

SEQ ID NO: 2764707 - RNA, 17 nt, Human
cuuaauuaaaagaauau

SEQ ID NO: 2764708 - RNA, 14 nt, Human
cuguuuuauaauuu

SEQ ID NO: 2764709 - RNA, 15 nt, Human
cuguuuuauaauuuu

SEQ ID NO: 2764710 - RNA, 17 nt, Human
cuucagcaaaaauauuu

SEQ ID NO: 2764711 - RNA, 12 nt, Human
cuucacaacaga

SEQ ID NO: 2764712 - RNA, 14 nt, Human
cuucacaacagauu

SEQ ID NO: 2764713 - RNA, 17 nt, Human
cuucaaauccuugaaga

SEQ ID NO: 2764714 - RNA, 23 nt, Human
cuucagcaaaaauauuuuaugau

SEQ ID NO: 2764715 - RNA, 20 nt, Human
cuucagcaaaaauauuuuau

SEQ ID NO: 2764716 - RNA, 15 nt, Human
cuucagccugaaaga

SEQ ID NO: 2764717 - RNA, 20 nt, Human
cuuccuuggacucauuuuaa

SEQ ID NO: 2764718 - RNA, 20 nt, Human
cuucggccuccauccugagg

SEQ ID NO: 2764719 - RNA, 19 nt, Human
cuucggccuccauccugag

SEQ ID NO: 2764720 - RNA, 17 nt, Human
ccucccuccaccucccu

SEQ ID NO: 2764721 - RNA, 20 nt, Human
ccucccuccaccucccugca

SEQ ID NO: 2764722 - RNA, 18 nt, Human
ccuccucugcuugccauc

SEQ ID NO: 2764723 - RNA, 13 nt, Human
ccuccucugcuug

SEQ ID NO: 2764724 - RNA, 16 nt, Human
ccuccucugcuugcca

SEQ ID NO: 2764725 - RNA, 14 nt, Human
ccuccauccugagg

SEQ ID NO: 2764726 - RNA, 22 nt, Human
ccuccaccucccugcaauaaaa

SEQ ID NO: 2764727 - RNA, 17 nt, Human
ccuccaccucccugcaa

SEQ ID NO: 2764728 - RNA, 15 nt, Human
ccuccaccucccugc

SEQ ID NO: 2764729 - RNA, 14 nt, Human
ccuccaccucccug

SEQ ID NO: 2764730 - RNA, 13 nt, Human
ccuccaccucccu

SEQ ID NO: 2764731 - RNA, 17 nt, Human
ccuaaauccauuuggaa

SEQ ID NO: 2764732 - RNA, 12 nt, Human
ccuaaauccauu

SEQ ID NO: 2764733 - RNA, 14 nt, Human
ccgugcuaaggacu

SEQ ID NO: 2764734 - RNA, 16 nt, Human
ccgugcuaaggacuug

SEQ ID NO: 2764735 - RNA, 15 nt, Human
ccgugcuaaggacuu

SEQ ID NO: 2764736 - RNA, 16 nt, Human
ccgggcguggugguga

SEQ ID NO: 2764737 - RNA, 13 nt, Human
cccacaagaaaug

SEQ ID NO: 2764738 - RNA, 20 nt, Human
cccacaagaaaugaaagcag

SEQ ID NO: 2764739 - RNA, 17 nt, Human
cccugcuuucagauacu

SEQ ID NO: 2764740 - RNA, 14 nt, Human
cccugcuuucagau

SEQ ID NO: 2764741 - RNA, 12 nt, Human
cccuccaccucc

SEQ ID NO: 2764742 - RNA, 14 nt, Human
cccuccaccucccu

SEQ ID NO: 2764743 - RNA, 17 nt, Human
cccuccaccucccugca

SEQ ID NO: 2764744 - RNA, 15 nt, Human
cccuccaccucccug

SEQ ID NO: 2764745 - RNA, 19 nt, Human
cccuccaccucccugcaau

SEQ ID NO: 2764746 - RNA, 15 nt, Human
cccucuccugggcag

SEQ ID NO: 2764747 - RNA, 14 nt, Human
cccucuccugggca

SEQ ID NO: 2764748 - RNA, 13 nt, Human
cccucuccugggc

SEQ ID NO: 2764749 - RNA, 12 nt, Human
cccucuccuggg

SEQ ID NO: 2764750 - RNA, 11 nt, Human
cccucuccugg

SEQ ID NO: 2764751 - RNA, 15 nt, Human
cccgugggguuccuc

SEQ ID NO: 2764752 - RNA, 22 nt, Human
ccugggcagcugccuccccucc

SEQ ID NO: 2764753 - RNA, 23 nt, Human
ccuggaaaucaggguuaguauug

SEQ ID NO: 2764754 - RNA, 11 nt, Human
ccugagcccca

SEQ ID NO: 2764755 - RNA, 20 nt, Human
ccugcacggugaauggcuuu

SEQ ID NO: 2764756 - RNA, 21 nt, Human
ccugcacggugaauggcuuug

SEQ ID NO: 2764757 - RNA, 16 nt, Human
ccugcaauaaaauggg

SEQ ID NO: 2764758 - RNA, 18 nt, Human
cgagcaggcuacugucag

SEQ ID NO: 2764759 - RNA, 20 nt, Human
ccuguuaaaagaugaaaaua

SEQ ID NO: 2764760 - RNA, 21 nt, Human
ccuguuaaaagaugaaaauau

SEQ ID NO: 2764761 - RNA, 20 nt, Human
ccuucggccuccauccugag

SEQ ID NO: 2764762 - RNA, 19 nt, Human
ccuucggccuccauccuga

SEQ ID NO: 2764763 - RNA, 14 nt, Human
ccuucggccuccau

SEQ ID NO: 2764764 - RNA, 20 nt, Human
ccuugaaaacuuuaugcuaa

SEQ ID NO: 2764765 - RNA, 14 nt, Human
ccuugaugaagaag

SEQ ID NO: 2764766 - RNA, 19 nt, Human
ccuuggggcugaugcaguu

SEQ ID NO: 2764767 - RNA, 14 nt, Human
ccaguuauggcuau

SEQ ID NO: 2764768 - RNA, 21 nt, Human
ccaguuauggcuauaggugcu

SEQ ID NO: 2764769 - RNA, 22 nt, Human
ccauuauucaaaguugccuaaa

SEQ ID NO: 2764770 - RNA, 17 nt, Human
ccauuauucaaaguugc

SEQ ID NO: 2764771 - RNA, 14 nt, Human
ccauuauucaaagu

SEQ ID NO: 2764772 - RNA, 20 nt, Human
ccauguuuauuacaguauaa

SEQ ID NO: 2764773 - RNA, 13 nt, Human
ccauguuuauuac

SEQ ID NO: 2764774 - RNA, 13 nt, Human
ccaugggauaaau

SEQ ID NO: 2764775 - RNA, 19 nt, Human
ccaugggacagggaggacg

SEQ ID NO: 2764776 - RNA, 16 nt, Human
ccaugggacagggagg

SEQ ID NO: 2764777 - RNA, 22 nt, Human
ccagccagcaguucagagcugc

SEQ ID NO: 2764778 - RNA, 23 nt, Human
ccagcaguucagagcugcccucu

SEQ ID NO: 2764779 - RNA, 22 nt, Human
ccagcaguucagagcugcccuc

SEQ ID NO: 2764780 - RNA, 21 nt, Human
ccagcaguucagagcugcccu

SEQ ID NO: 2764781 - RNA, 20 nt, Human
ccagcaguucagagcugccc

SEQ ID NO: 2764782 - RNA, 19 nt, Human
ccagcaguucagagcugcc

SEQ ID NO: 2764783 - RNA, 18 nt, Human
ccagcaguucagagcugc

SEQ ID NO: 2764784 - RNA, 13 nt, Human
ccagcaguucaga

SEQ ID NO: 2764785 - RNA, 14 nt, Human
ccaccucccugcaa

SEQ ID NO: 2764786 - RNA, 19 nt, Human
caugagguacugagaguga

SEQ ID NO: 2764787 - RNA, 16 nt, Human
caugagguacugagag

SEQ ID NO: 2764788 - RNA, 18 nt, Human
caugaagauguagaggag

SEQ ID NO: 2764789 - RNA, 19 nt, Human
caugaagauguagaggaga

SEQ ID NO: 2764790 - RNA, 21 nt, Human
cauauauuuuuauauuuacua

SEQ ID NO: 2764791 - RNA, 20 nt, Human
cauauauuuuuauauuuacu

SEQ ID NO: 2764792 - RNA, 18 nt, Human
cauauauuuuuauauuua

SEQ ID NO: 2764793 - RNA, 15 nt, Human
cauauauaacaaugc

SEQ ID NO: 2764794 - RNA, 19 nt, Human
cauagucuggcuguaccca

SEQ ID NO: 2764795 - RNA, 13 nt, Human
cauauauaacaau

SEQ ID NO: 2764796 - RNA, 23 nt, Human
caucccucccuccaccucccugc

SEQ ID NO: 2764797 - RNA, 22 nt, Human
caucccucccuccaccucccug

SEQ ID NO: 2764798 - RNA, 18 nt, Human
caucccuuaccugggaaa

SEQ ID NO: 2764799 - RNA, 20 nt, Human
caucccucccuccaccuccc

SEQ ID NO: 2764800 - RNA, 17 nt, Human
caugggauaaaugccau

SEQ ID NO: 2764801 - RNA, 16 nt, Human
caugggauaaaugcca

SEQ ID NO: 2764802 - RNA, 23 nt, Human
caugggauaaaugccaucaauaa

SEQ ID NO: 2764803 - RNA, 18 nt, Human
caugggauaaaugccauc

SEQ ID NO: 2764804 - RNA, 23 nt, Human
caugggacagggaggacgcucuc

SEQ ID NO: 2764805 - RNA, 20 nt, Human
cauggaauuggagcucgugg

SEQ ID NO: 2764806 - RNA, 23 nt, Human
cauguuuauuacaguauaauuaa

SEQ ID NO: 2764807 - RNA, 22 nt, Human
cauguuaaaccaugggauaaau

SEQ ID NO: 2764808 - RNA, 13 nt, Human
cauguuaaaccau

SEQ ID NO: 2764809 - RNA, 20 nt, Human
caugugcuaguaauuggaaa

SEQ ID NO: 2764810 - RNA, 11 nt, Human
cauuuggaaau

SEQ ID NO: 2764811 - RNA, 18 nt, Human
cauuuggaaaucuuuaaa

SEQ ID NO: 2764812 - RNA, 17 nt, Human
cauuuggaaaucuuuaa

SEQ ID NO: 2764813 - RNA, 21 nt, Human
cauuguaaaugugcuuuuaaa

SEQ ID NO: 2764814 - RNA, 13 nt, Human
cauucuggaauaa

SEQ ID NO: 2764815 - RNA, 17 nt, Human
cauuauuuuauuaugaa

SEQ ID NO: 2764816 - RNA, 16 nt, Human
cauuauucaaaguugc

SEQ ID NO: 2764817 - RNA, 22 nt, Human
cauuauucaaaguugccuaaau

SEQ ID NO: 2764818 - RNA, 21 nt, Human
cauuauucaaaguugccuaaa

SEQ ID NO: 2764819 - RNA, 18 nt, Human
cauuauucaaaguugccu

SEQ ID NO: 2764820 - RNA, 22 nt, Human
cauuccaacuaucucauuucca

SEQ ID NO: 2764821 - RNA, 13 nt, Human
caguccaugaaga

SEQ ID NO: 2764822 - RNA, 18 nt, Human
cagucaggaaagagaacu

SEQ ID NO: 2764823 - RNA, 15 nt, Human
cagucaggaaagaga

SEQ ID NO: 2764824 - RNA, 22 nt, Human
cagucaggaaagagaacuucca

SEQ ID NO: 2764825 - RNA, 21 nt, Human
caguauaauuaacauguuaaa

SEQ ID NO: 2764826 - RNA, 17 nt, Human
caguauaauuaacaugu

SEQ ID NO: 2764827 - RNA, 15 nt, Human
caguauaauuaacau

SEQ ID NO: 2764828 - RNA, 14 nt, Human
caguauaauuaaca

SEQ ID NO: 2764829 - RNA, 12 nt, Human
caguagugauag

SEQ ID NO: 2764830 - RNA, 12 nt, Human
caguauggcagc

SEQ ID NO: 2764831 - RNA, 15 nt, Human
cagugagacagcucu

SEQ ID NO: 2764832 - RNA, 16 nt, Human
cagugaaagaaaauaa

SEQ ID NO: 2764833 - RNA, 20 nt, Human
cagugaaagaaaauaacaau

SEQ ID NO: 2764834 - RNA, 17 nt, Human
cagugauuaccagggac

SEQ ID NO: 2764835 - RNA, 18 nt, Human
cagugauuaccagggacu

SEQ ID NO: 2764836 - RNA, 23 nt, Human
caggaugguucccuugaugaaga

SEQ ID NO: 2764837 - RNA, 21 nt, Human
caggaugguucccuugaugaa

SEQ ID NO: 2764838 - RNA, 16 nt, Human
caggauuuuaaucuuu

SEQ ID NO: 2764839 - RNA, 20 nt, Human
caggcccccaggugccaguu

SEQ ID NO: 2764840 - RNA, 14 nt, Human
caggcccccaggug

SEQ ID NO: 2764841 - RNA, 19 nt, Human
caggcccccaggugccagu

SEQ ID NO: 2764842 - RNA, 18 nt, Human
cagggacaggauaagagg

SEQ ID NO: 2764843 - RNA, 17 nt, Human
cagggcauggcugggaa

SEQ ID NO: 2764844 - RNA, 16 nt, Human
caggggacaggauggu

SEQ ID NO: 2764845 - RNA, 11 nt, Human
caggggacagg

SEQ ID NO: 2764846 - RNA, 14 nt, Human
caggcuacugucag

SEQ ID NO: 2764847 - RNA, 19 nt, Human
caggcuagauguauguacu

SEQ ID NO: 2764848 - RNA, 13 nt, Human
caggcuagaugua

SEQ ID NO: 2764849 - RNA, 14 nt, Human
cagcagauuauuca

SEQ ID NO: 2764850 - RNA, 19 nt, Human
cagcagauuauucacugau

SEQ ID NO: 2764851 - RNA, 15 nt, Human
cagcagauuauucac

SEQ ID NO: 2764852 - RNA, 19 nt, Human
cagcaagggugaugggaaa

SEQ ID NO: 2764853 - RNA, 22 nt, Human
cagcaagggugaugggaaagca

SEQ ID NO: 2764854 - RNA, 23 nt, Human
cagcaagggugaugggaaagcau

SEQ ID NO: 2764855 - RNA, 23 nt, Human
cagauuauucacugauuugacau

SEQ ID NO: 2764856 - RNA, 18 nt, Human
cagauuauucacugauuu

SEQ ID NO: 2764857 - RNA, 12 nt, Human
cagauuauucac

SEQ ID NO: 2764858 - RNA, 22 nt, Human
cagauuuuauuauguaaauccc

SEQ ID NO: 2764859 - RNA, 21 nt, Human
cagauuuuauuauguaaaucc

SEQ ID NO: 2764860 - RNA, 20 nt, Human
cagauuuuauuauguaaauc

SEQ ID NO: 2764861 - RNA, 18 nt, Human
cagauuuuauuauguaaa

SEQ ID NO: 2764862 - RNA, 16 nt, Human
cagauuuuauuaugua

SEQ ID NO: 2764863 - RNA, 15 nt, Human
cagauuuuauuaugu

SEQ ID NO: 2764864 - RNA, 13 nt, Human
cagauuuuauuau

SEQ ID NO: 2764865 - RNA, 17 nt, Human
cagcaaaaauauuuuau

SEQ ID NO: 2764866 - RNA, 15 nt, Human
cagauuuuccugaaa

SEQ ID NO: 2764867 - RNA, 14 nt, Human
cagauuuuccugaa

SEQ ID NO: 2764868 - RNA, 23 nt, Human
cagcaacgcaggcccccaggugc

SEQ ID NO: 2764869 - RNA, 19 nt, Human
cagcuacuugggaggcuga

SEQ ID NO: 2764870 - RNA, 16 nt, Human
cagccuaguugaucag

SEQ ID NO: 2764871 - RNA, 20 nt, Human
cagcucugcauacucauuag

SEQ ID NO: 2764872 - RNA, 20 nt, Human
cagcugcugaaacaacaaau

SEQ ID NO: 2764873 - RNA, 21 nt, Human
cagcugcugaaacaacaaaua

SEQ ID NO: 2764874 - RNA, 18 nt, Human
cagcuggugcccugcuuu

SEQ ID NO: 2764875 - RNA, 23 nt, Human
cagcuggugcccugcuuucagau

SEQ ID NO: 2764876 - RNA, 21 nt, Human
cagcuggugcccugcuuucag

SEQ ID NO: 2764877 - RNA, 20 nt, Human
cagcuggugcccugcuuuca

SEQ ID NO: 2764878 - RNA, 19 nt, Human
cagcuggugcccugcuuuc

SEQ ID NO: 2764879 - RNA, 18 nt, Human
cagcuguaugauucccag

SEQ ID NO: 2764880 - RNA, 18 nt, Human
caggaaccacaagacugc

SEQ ID NO: 2764881 - RNA, 23 nt, Human
cagcuuuccucaaaacuucagac

SEQ ID NO: 2764882 - RNA, 18 nt, Human
cagcuugaaacugagaug

SEQ ID NO: 2764883 - RNA, 23 nt, Human
caggaauggagccugcacgguga

SEQ ID NO: 2764884 - RNA, 17 nt, Human
caggaauggagccugca

SEQ ID NO: 2764885 - RNA, 15 nt, Human
caggaaguagaggag

SEQ ID NO: 2764886 - RNA, 16 nt, Human
caggaaguagaggagg

SEQ ID NO: 2764887 - RNA, 14 nt, Human
cagaucugccuaag

SEQ ID NO: 2764888 - RNA, 17 nt, Human
cagaucugccuaaggac

SEQ ID NO: 2764889 - RNA, 16 nt, Human
cagaucugccuaagga

SEQ ID NO: 2764890 - RNA, 23 nt, Human
cagaucugccuaaggacuucuuu

SEQ ID NO: 2764891 - RNA, 21 nt, Human
cagaucugccuaaggacuucu

SEQ ID NO: 2764892 - RNA, 20 nt, Human
cagaucugccuaaggacuuc

SEQ ID NO: 2764893 - RNA, 19 nt, Human
cagaucugccuaaggacuu

SEQ ID NO: 2764894 - RNA, 13 nt, Human
cagauccuggaaa

SEQ ID NO: 2764895 - RNA, 14 nt, Human
cagauccuggaaau

SEQ ID NO: 2764896 - RNA, 23 nt, Human
cagauaaauaguuuaugauucca

SEQ ID NO: 2764897 - RNA, 14 nt, Human
cagauaaacaguag

SEQ ID NO: 2764898 - RNA, 14 nt, Human
cagauaaucacaau

SEQ ID NO: 2764899 - RNA, 19 nt, Human
cagaaagcagaacagugau

SEQ ID NO: 2764900 - RNA, 18 nt, Human
cagaacagugauuaccag

SEQ ID NO: 2764901 - RNA, 23 nt, Human
cagaacagugauuaccagggacu

SEQ ID NO: 2764902 - RNA, 18 nt, Human
cagaaagcagaacaguga

SEQ ID NO: 2764903 - RNA, 20 nt, Human
cagaagcaacccaaauguuc

SEQ ID NO: 2764904 - RNA, 19 nt, Human
cagaagcaacccaaauguu

SEQ ID NO: 2764905 - RNA, 19 nt, Human
cagacauagaauuaacaca

SEQ ID NO: 2764906 - RNA, 17 nt, Human
cagacauagaauuaaca

SEQ ID NO: 2764907 - RNA, 14 nt, Human
caccucauggaauu

SEQ ID NO: 2764908 - RNA, 12 nt, Human
caccucauggaa

SEQ ID NO: 2764909 - RNA, 11 nt, Human
caccucaugga

SEQ ID NO: 2764910 - RNA, 10 nt, Human
caccucccug

SEQ ID NO: 2764911 - RNA, 14 nt, Human
caccucccugcaau

SEQ ID NO: 2764912 - RNA, 13 nt, Human
caccucccugcaa

SEQ ID NO: 2764913 - RNA, 17 nt, Human
cacucuccauuuaauaa

SEQ ID NO: 2764914 - RNA, 15 nt, Human
cacucuccauuuaau

SEQ ID NO: 2764915 - RNA, 19 nt, Human
cacuaguauuucuaugaaa

SEQ ID NO: 2764916 - RNA, 14 nt, Human
cacuaguauuucua

SEQ ID NO: 2764917 - RNA, 17 nt, Human
cacuaagagagaaugag

SEQ ID NO: 2764918 - RNA, 21 nt, Human
cacuaaauugacacuuaaaaa

SEQ ID NO: 2764919 - RNA, 16 nt, Human
cacucaaaucaagaaa

SEQ ID NO: 2764920 - RNA, 20 nt, Human
caccugucuugccuuuuuca

SEQ ID NO: 2764921 - RNA, 17 nt, Human
caccugucuugccuuuu

SEQ ID NO: 2764922 - RNA, 22 nt, Human
cacgagcaggcuacugucagcu

SEQ ID NO: 2764923 - RNA, 17 nt, Human
cacgagcaggcuacugu

SEQ ID NO: 2764924 - RNA, 19 nt, Human
cacgagcaggcuacuguca

SEQ ID NO: 2764925 - RNA, 20 nt, Human
cacgagcaggcuacugucag

SEQ ID NO: 2764926 - RNA, 23 nt, Human
cacggugaauggcuuuguauaga

SEQ ID NO: 2764927 - RNA, 20 nt, Human
cacggugaauggcuuuguau

SEQ ID NO: 2764928 - RNA, 13 nt, Human
cacuaaacaaaga

SEQ ID NO: 2764929 - RNA, 22 nt, Human
cacguucuuacuaguuucccuu

SEQ ID NO: 2764930 - RNA, 20 nt, Human
cacugccuucucaacuccaa

SEQ ID NO: 2764931 - RNA, 23 nt, Human
cacugauuugacauagucuggcu

SEQ ID NO: 2764932 - RNA, 21 nt, Human
cacugauuugacauagucugg

SEQ ID NO: 2764933 - RNA, 21 nt, Human
cacugacuucuaaguaaaacc

SEQ ID NO: 2764934 - RNA, 14 nt, Human
cacugacuucuaag

SEQ ID NO: 2764935 - RNA, 15 nt, Human
cacugacuucuaagu

SEQ ID NO: 2764936 - RNA, 16 nt, Human
cacugacuucuaagua

SEQ ID NO: 2764937 - RNA, 20 nt, Human
cacugacuucuaaguaaaac

SEQ ID NO: 2764938 - RNA, 14 nt, Human
cacugucaagauga

SEQ ID NO: 2764939 - RNA, 24 nt, Human
cacuguggguagacacacaugaag

SEQ ID NO: 2764940 - RNA, 22 nt, Human
cacuguggguagacacacauga

SEQ ID NO: 2764941 - RNA, 19 nt, Human
cacuguggguagacacaca

SEQ ID NO: 2764942 - RNA, 15 nt, Human
cacuuggucugugag

SEQ ID NO: 2764943 - RNA, 23 nt, Human
cacuugaacccgggaggcagagg

SEQ ID NO: 2764944 - RNA, 21 nt, Human
cacuugaacccgggaggcaga

SEQ ID NO: 2764945 - RNA, 20 nt, Human
cacuugaacccgggaggcag

SEQ ID NO: 2764946 - RNA, 14 nt, Human
caaaacugcacugu

SEQ ID NO: 2764947 - RNA, 17 nt, Human
caaaacugcacugucaa

SEQ ID NO: 2764948 - RNA, 18 nt, Human
caaaacugcacugucaag

SEQ ID NO: 2764949 - RNA, 16 nt, Human
caaacugacucuuaag

SEQ ID NO: 2764950 - RNA, 21 nt, Human
caaacugacucuuaagaagac

SEQ ID NO: 2764951 - RNA, 17 nt, Human
caaacugacucuuaaga

SEQ ID NO: 2764952 - RNA, 19 nt, Human
caagaaaugaaagcaggga

SEQ ID NO: 2764953 - RNA, 17 nt, Human
caagaaaugaaagcagg

SEQ ID NO: 2764954 - RNA, 15 nt, Human
caagaaaugaaagca

SEQ ID NO: 2764955 - RNA, 23 nt, Human
caacagcuggugcccugcuuuca

SEQ ID NO: 2764956 - RNA, 18 nt, Human
caaauguucaucaaugaa

SEQ ID NO: 2764957 - RNA, 14 nt, Human
caaauguucaucaa

SEQ ID NO: 2764958 - RNA, 12 nt, Human
caaauaugcaaa

SEQ ID NO: 2764959 - RNA, 13 nt, Human
caaauaugcaaag

SEQ ID NO: 2764960 - RNA, 20 nt, Human
caaggaaaaaauaacaauga

SEQ ID NO: 2764961 - RNA, 18 nt, Human
caaggaaaaaauaacaau

SEQ ID NO: 2764962 - RNA, 19 nt, Human
caauagucaaauuguguga

SEQ ID NO: 2764963 - RNA, 17 nt, Human
caauagucaaauugugu

SEQ ID NO: 2764964 - RNA, 21 nt, Human
caagggugaugggaaagcauu

SEQ ID NO: 2764965 - RNA, 23 nt, Human
caagggugaugggaaagcauugu

SEQ ID NO: 2764966 - RNA, 13 nt, Human
cacacugaagaag

SEQ ID NO: 2764967 - RNA, 21 nt, Human
cacagcaguugaaaagacucc

SEQ ID NO: 2764968 - RNA, 19 nt, Human
cacagcaguugaaaagacu

SEQ ID NO: 2764969 - RNA, 17 nt, Human
cacagccagacuggcac

SEQ ID NO: 2764970 - RNA, 18 nt, Human
cacagccagacuggcaca

SEQ ID NO: 2764971 - RNA, 18 nt, Human
cacaagaaaugaaagcag

SEQ ID NO: 2764972 - RNA, 21 nt, Human
cacaagaaaugaaagcaggga

SEQ ID NO: 2764973 - RNA, 20 nt, Human
cacaagaaaugaaagcaggg

SEQ ID NO: 2764974 - RNA, 22 nt, Human
caauuuuucuuauuucauuucu

SEQ ID NO: 2764975 - RNA, 19 nt, Human
acuucagcgguuuauauaa

SEQ ID NO: 2764976 - RNA, 18 nt, Human
acuucagcgguuuauaua

SEQ ID NO: 2764977 - RNA, 17 nt, Human
acuucagcgguuuauau

SEQ ID NO: 2764978 - RNA, 20 nt, Human
acuucaaauccuugaagauu

SEQ ID NO: 2764979 - RNA, 19 nt, Human
acuucaaauccuugaagau

SEQ ID NO: 2764980 - RNA, 14 nt, Human
acuuaaaaaugguu

SEQ ID NO: 2764981 - RNA, 13 nt, Human
acuuaaaaauggu

SEQ ID NO: 2764982 - RNA, 17 nt, Human
acuuuaugcuaagugaa

SEQ ID NO: 2764983 - RNA, 12 nt, Human
acuuuaugcuaa

SEQ ID NO: 2764984 - RNA, 22 nt, Human
acuugggaggcugagaugggag

SEQ ID NO: 2764985 - RNA, 22 nt, Human
acugauucuucagcaaaaauau

SEQ ID NO: 2764986 - RNA, 15 nt, Human
acugauucuucagca

SEQ ID NO: 2764987 - RNA, 13 nt, Human
acugauucuucag

SEQ ID NO: 2764988 - RNA, 12 nt, Human
acugauucuuca

SEQ ID NO: 2764989 - RNA, 17 nt, Human
acucugucucaguccau

SEQ ID NO: 2764990 - RNA, 15 nt, Human
acucugucucagucc

SEQ ID NO: 2764991 - RNA, 20 nt, Human
acucuuaagaagacugcauu

SEQ ID NO: 2764992 - RNA, 15 nt, Human
acucuuaagaagacu

SEQ ID NO: 2764993 - RNA, 14 nt, Human
acucuuaagaagac

SEQ ID NO: 2764994 - RNA, 22 nt, Human
accugucuugccuuuuucauua

SEQ ID NO: 2764995 - RNA, 21 nt, Human
accugucuugccuuuuucauu

SEQ ID NO: 2764996 - RNA, 19 nt, Human
accugucuugccuuuuuca

SEQ ID NO: 2764997 - RNA, 18 nt, Human
accucugccucagaaaac

SEQ ID NO: 2764998 - RNA, 17 nt, Human
accucugccucagaaaa

SEQ ID NO: 2764999 - RNA, 18 nt, Human
acuaguauuucuaugaaa

SEQ ID NO: 2765000 - RNA, 19 nt, Human
acuaguauuucuaugaaau

SEQ ID NO: 2765001 - RNA, 19 nt, Human
acggacgaaccuugaaaac

SEQ ID NO: 2765002 - RNA, 20 nt, Human
accaaggcugauuaaaccaa

SEQ ID NO: 2765003 - RNA, 19 nt, Human
accaaggcugauuaaacca

SEQ ID NO: 2765004 - RNA, 20 nt, Human
acaucccuuaccugggaaag

SEQ ID NO: 2765005 - RNA, 20 nt, Human
acagugauuaccagggacug

SEQ ID NO: 2765006 - RNA, 21 nt, Human
acagugauuaccagggacuga

SEQ ID NO: 2765007 - RNA, 23 nt, Human
aauuuauuggcuuuucugaucca

SEQ ID NO: 2765008 - RNA, 21 nt, Human
aauuuauuggcuuuucugauc

SEQ ID NO: 2765009 - RNA, 20 nt, Human
aauuuauuggcuuuucugau

SEQ ID NO: 2765010 - RNA, 19 nt, Human
aauuuauuggcuuuucuga

SEQ ID NO: 2765011 - RNA, 17 nt, Human
aauuuauuggcuuuucu

SEQ ID NO: 2765012 - RNA, 20 nt, Human
aauuggggauucuuaaaguu

SEQ ID NO: 2765013 - RNA, 17 nt, Human
aauuggggauucuuaaa

SEQ ID NO: 2765014 - RNA, 21 nt, Human
aaugguccgugcuaaggacuu

SEQ ID NO: 2765015 - RNA, 15 nt, Human
aauuggggauucuua

SEQ ID NO: 2765016 - RNA, 16 nt, Human
aauuggggauucuuaa

SEQ ID NO: 2765017 - RNA, 12 nt, Human
aauuuuggaauu

SEQ ID NO: 2765018 - RNA, 11 nt, Human
aauuuuggaau

SEQ ID NO: 2765019 - RNA, 18 nt, Human
aauuuugugaagcaaaau

SEQ ID NO: 2765020 - RNA, 17 nt, Human
aauuuugugaagcaaaa

SEQ ID NO: 2765021 - RNA, 13 nt, Human
aauuuugugaagc

SEQ ID NO: 2765022 - RNA, 21 nt, Human
acaaggaugaauuaaguuuuu

SEQ ID NO: 2765023 - RNA, 16 nt, Human
acaagaaaugaaagca

SEQ ID NO: 2765024 - RNA, 15 nt, Human
acaagaaaugaaagc

SEQ ID NO: 2765025 - RNA, 13 nt, Human
acaagaaaugaaa

SEQ ID NO: 2765026 - RNA, 18 nt, Human
acaauuuuguuucuguac

SEQ ID NO: 2765027 - RNA, 20 nt, Human
acaauuuuguuucuguacuu

SEQ ID NO: 2765028 - RNA, 16 nt, Human
acagaagcuccaggua

SEQ ID NO: 2765029 - RNA, 19 nt, Human
aaaggcagaagcaacccaa

SEQ ID NO: 2765030 - RNA, 19 nt, Human
aaagcauuguaaaugugcu

SEQ ID NO: 2765031 - RNA, 20 nt, Human
aaagcauuguaaaugugcuu

SEQ ID NO: 2765032 - RNA, 21 nt, Human
aaacccugucucuacuaaaaa

SEQ ID NO: 2765033 - RNA, 13 nt, Human
aaagaaacauuug

SEQ ID NO: 2765034 - RNA, 23 nt, Human
aaaaguuuaauauuaaagccaug

SEQ ID NO: 2765035 - RNA, 22 nt, Human
aaaaguuuaauauuaaagccau

SEQ ID NO: 2765036 - RNA, 21 nt, Human
aaaaguuuaauauuaaagcca

SEQ ID NO: 2765037 - RNA, 20 nt, Human
aaaaguuuaauauuaaagcc

SEQ ID NO: 2765038 - RNA, 19 nt, Human
aaaauccauacauuugugu

SEQ ID NO: 2765039 - RNA, 12 nt, Human
aacacaucagcu

SEQ ID NO: 2765040 - RNA, 23 nt, Human
aaauuggggauucuuaaaguuga

SEQ ID NO: 2765041 - RNA, 17 nt, Human
aaauuggggauucuuaa

SEQ ID NO: 2765042 - RNA, 22 nt, Human
aaauuggggauucuuaaaguug

SEQ ID NO: 2765043 - RNA, 20 nt, Human
aaauuggggauucuuaaagu

SEQ ID NO: 2765044 - RNA, 19 nt, Human
aaauuggggauucuuaaag

SEQ ID NO: 2765045 - RNA, 18 nt, Human
aaauuggggauucuuaaa

SEQ ID NO: 2765046 - RNA, 22 nt, Human
aaauugacacuuaaaaaugguu

SEQ ID NO: 2765047 - RNA, 20 nt, Human
aaauguucaucaaugaauga

SEQ ID NO: 2765048 - RNA, 17 nt, Human
aaauguucaucaaugaa

SEQ ID NO: 2765049 - RNA, 21 nt, Human
aaaucugugaacuugaaauuu

SEQ ID NO: 2765050 - RNA, 19 nt, Human
aaaucugugaacuugaaau

SEQ ID NO: 2765051 - RNA, 20 nt, Human
aaaucugugaacuugaaauu

SEQ ID NO: 2765052 - RNA, 14 nt, Human
aaaucuuaacuuga

SEQ ID NO: 2765053 - RNA, 14 nt, Human
aaccaguauuguac

SEQ ID NO: 2765054 - RNA, 13 nt, Human
aaccaguauugua

SEQ ID NO: 2765055 - RNA, 11 nt, Human
aaccaguauug

SEQ ID NO: 2765056 - RNA, 17 nt, Human
aacgcguugaaauugua

SEQ ID NO: 2765057 - RNA, 15 nt, Human
aacgcguugaaauug

SEQ ID NO: 2765058 - RNA, 14 nt, Human
aacgcguugaaauu

SEQ ID NO: 2765059 - RNA, 13 nt, Human
aacgcguugaaau

SEQ ID NO: 2765060 - RNA, 23 nt, Human
aacugagaugugaacacaucagc

SEQ ID NO: 2765061 - RNA, 20 nt, Human
aaugguccgugcuaaggacu

SEQ ID NO: 2765062 - RNA, 15 nt, Human
aauccaaugaaauga

SEQ ID NO: 2765063 - RNA, 16 nt, Human
aauccauacauuugug

SEQ ID NO: 2765064 - RNA, 17 nt, Human
aauccauacauuugugu

SEQ ID NO: 2765065 - RNA, 14 nt, Human
aauccauacauuug

SEQ ID NO: 2765066 - RNA, 16 nt, Human
aaugauaacuggaaac

SEQ ID NO: 2765067 - RNA, 15 nt, Human
aaugauaacuggaaa

SEQ ID NO: 2765068 - RNA, 14 nt, Human
aaugauaacuggaa

SEQ ID NO: 2765069 - RNA, 22 nt, Human
aaucauuucugcaucagcugcu

SEQ ID NO: 2765070 - RNA, 15 nt, Human
aaucaaauaugcaaa

SEQ ID NO: 2765071 - RNA, 16 nt, Human
aaucaaauaugcaaag

SEQ ID NO: 2765072 - RNA, 22 nt, Human
aaucaaauaugcaaagcacuga

SEQ ID NO: 2765073 - RNA, 12 nt, Human
aauauuaaagcc

SEQ ID NO: 2765074 - RNA, 13 nt, Human
aauauuaaagcca

SEQ ID NO: 2765075 - RNA, 15 nt, Human
aauauuaaagccaug

SEQ ID NO: 2765076 - RNA, 14 nt, Human
aauauuaaagccau

SEQ ID NO: 2765077 - RNA, 20 nt, Human
aauauuaaagccauguuuau

SEQ ID NO: 2765078 - RNA, 19 nt, Human
aauauuaaagccauguuua

SEQ ID NO: 2765079 - RNA, 18 nt, Human
aauauuaaagccauguuu

SEQ ID NO: 2765080 - RNA, 16 nt, Human
aauauuaaagccaugu

SEQ ID NO: 2765081 - RNA, 12 nt, Human
aauaauguuuca

SEQ ID NO: 2765082 - RNA, 19 nt, Human
aauaauguuucaaacauau

SEQ ID NO: 2765083 - RNA, 14 nt, Human
aauaauguuucaaa

SEQ ID NO: 2765084 - RNA, 10 nt, Human
aauaaaccau

SEQ ID NO: 2765085 - RNA, 22 nt, Human
aaguugauaugccuuuucccaa

SEQ ID NO: 2765086 - RNA, 17 nt, Human
aaguucugcagauaaac

SEQ ID NO: 2765087 - RNA, 15 nt, Human
aagcagggacuugaa

SEQ ID NO: 2765088 - RNA, 15 nt, Human
aagagaacuuccaga

SEQ ID NO: 2765089 - RNA, 23 nt, Human
aagacagugaaagaaaauaacaa

SEQ ID NO: 2765090 - RNA, 19 nt, Human
aagccagauuuuccugaaa

SEQ ID NO: 2765091 - RNA, 14 nt, Human
aagggauggcaaga

SEQ ID NO: 2765092 - RNA, 17 nt, Human
aagggauggcaagaugu

SEQ ID NO: 2765093 - RNA, 12 nt, Human
aaguagaggagg

SEQ ID NO: 2765094 - RNA, 24 nt, Human
agcaaaauuuuuucucuaggaaau

SEQ ID NO: 2765095 - RNA, 23 nt, Human
agcaaaauuuuuucucuaggaaa

SEQ ID NO: 2765096 - RNA, 19 nt, Human
agaucugccuaaggacuuc

SEQ ID NO: 2765097 - RNA, 19 nt, Human
agauguagaggagaaacug

SEQ ID NO: 2765098 - RNA, 16 nt, Human
agauguagaggagaaa

SEQ ID NO: 2765099 - RNA, 22 nt, Human
agaagagcuguucacagccaga

SEQ ID NO: 2765100 - RNA, 21 nt, Human
agaagagcuguucacagccag

SEQ ID NO: 2765101 - RNA, 21 nt, Human
agaagugaaaaucuacacucc

SEQ ID NO: 2765102 - RNA, 17 nt, Human
agaaugauuaugaauua

SEQ ID NO: 2765103 - RNA, 22 nt, Human
agaaugagagacacacugaaga

SEQ ID NO: 2765104 - RNA, 17 nt, Human
agaaugagagacacacu

SEQ ID NO: 2765105 - RNA, 19 nt, Human
agacccaaaaggcagaagc

SEQ ID NO: 2765106 - RNA, 17 nt, Human
agacccaaaaggcagaa

SEQ ID NO: 2765107 - RNA, 18 nt, Human
agacucugucucagucca

SEQ ID NO: 2765108 - RNA, 13 nt, Human
agaggaaugaagu

SEQ ID NO: 2765109 - RNA, 21 nt, Human
aggccaugggcacugugggua

SEQ ID NO: 2765110 - RNA, 15 nt, Human
agggacugaggggag

SEQ ID NO: 2765111 - RNA, 15 nt, Human
agggauuagggagag

SEQ ID NO: 2765112 - RNA, 13 nt, Human
aggaaguagagga

SEQ ID NO: 2765113 - RNA, 20 nt, Human
agcuccccucggagaagagc

SEQ ID NO: 2765114 - RNA, 17 nt, Human
agcuccccucggagaag

SEQ ID NO: 2765115 - RNA, 19 nt, Human
agcuccccucggagaagag

SEQ ID NO: 2765116 - RNA, 17 nt, Human
agcgacagugagacucu

SEQ ID NO: 2765117 - RNA, 20 nt, Human
augcugaguuugugcuggug

SEQ ID NO: 2765118 - RNA, 18 nt, Human
auggcuuuguauagaacc

SEQ ID NO: 2765119 - RNA, 19 nt, Human
auggcuuuguauagaaccu

SEQ ID NO: 2765120 - RNA, 18 nt, Human
augaugaucuuuaaaaua

SEQ ID NO: 2765121 - RNA, 21 nt, Human
augaugaucuuuaaaauacac

SEQ ID NO: 2765122 - RNA, 16 nt, Human
augaucuuuaaaauac

SEQ ID NO: 2765123 - RNA, 18 nt, Human
augguccgugcuaaggac

SEQ ID NO: 2765124 - RNA, 15 nt, Human
augguccgugcuaag

SEQ ID NO: 2765125 - RNA, 21 nt, Human
augucaaucagccuaguugau

SEQ ID NO: 2765126 - RNA, 16 nt, Human
augucaaucagccuag

SEQ ID NO: 2765127 - RNA, 15 nt, Human
augugaacacaucag

SEQ ID NO: 2765128 - RNA, 15 nt, Human
auguuccuagugaaa

SEQ ID NO: 2765129 - RNA, 16 nt, Human
auguuccuagugaaag

SEQ ID NO: 2765130 - RNA, 17 nt, Human
auguuccuagugaaaga

SEQ ID NO: 2765131 - RNA, 22 nt, Human
aucagcuugcccuguuaaaaga

SEQ ID NO: 2765132 - RNA, 13 nt, Human
aucagcuuauugu

SEQ ID NO: 2765133 - RNA, 17 nt, Human
aucaugaauuaguuuua

SEQ ID NO: 2765134 - RNA, 14 nt, Human
aucaaauaugcaaa

SEQ ID NO: 2765135 - RNA, 20 nt, Human
aucccauuauucaaaguugc

SEQ ID NO: 2765136 - RNA, 15 nt, Human
aucccauuauucaaa

SEQ ID NO: 2765137 - RNA, 14 nt, Human
aucccauuauucaa

SEQ ID NO: 2765138 - RNA, 19 nt, Human
auccucaguuuuugugaaa

SEQ ID NO: 2765139 - RNA, 23 nt, Human
augaaguccaagcauuuagaugu

SEQ ID NO: 2765140 - RNA, 20 nt, Human
augaaguccaagcauuuaga

SEQ ID NO: 2765141 - RNA, 21 nt, Human
augaaguacucauacauguua

SEQ ID NO: 2765142 - RNA, 13 nt, Human
augaaguacucau

SEQ ID NO: 2765143 - RNA, 19 nt, Human
aguugaaaagacuccaaag

SEQ ID NO: 2765144 - RNA, 20 nt, Human
aguugaaaagacuccaaaga

SEQ ID NO: 2765145 - RNA, 14 nt, Human
aguugaaaagacuc

SEQ ID NO: 2765146 - RNA, 18 nt, Human
aguugaaaagacuccaaa

SEQ ID NO: 2765147 - RNA, 19 nt, Human
aguucagagcugcccucuc

SEQ ID NO: 2765148 - RNA, 20 nt, Human
aguucagagcugcccucucc

SEQ ID NO: 2765149 - RNA, 22 nt, Human
aguucagagcugcccucuccug

SEQ ID NO: 2765150 - RNA, 21 nt, Human
aguucagagcugcccucuccu

SEQ ID NO: 2765151 - RNA, 23 nt, Human
aguucagagcugcccucuccugg

SEQ ID NO: 2765152 - RNA, 19 nt, Human
agugucaaugcagccccca

SEQ ID NO: 2765153 - RNA, 11 nt, Human
aguccaagcau

SEQ ID NO: 2765154 - RNA, 15 nt, Human
auagcagcuuauuca

SEQ ID NO: 2765155 - RNA, 20 nt, Human
auauauuuuuauauuuacua

SEQ ID NO: 2765156 - RNA, 19 nt, Human
auauauuuuuauauuuacu

SEQ ID NO: 2765157 - RNA, 18 nt, Human
auauauuuuuauauuuac

SEQ ID NO: 2765158 - RNA, 23 nt, Human
auauuucagauaaucacaauaca

SEQ ID NO: 2765159 - RNA, 14 nt, Human
auauuauguuaaaa

SEQ ID NO: 2765160 - RNA, 13 nt, Human
auauuauguuaaa

SEQ ID NO: 2765161 - RNA, 21 nt, Human
auaacaaugcuguauuuuaaa

SEQ ID NO: 2765162 - RNA, 20 nt, Human
auaacaaugcuguauuuuaa

SEQ ID NO: 2765163 - RNA, 19 nt, Human
auaacaaugcuguauuuua

SEQ ID NO: 2765164 - RNA, 17 nt, Human
auaacaaugcuguauuu

SEQ ID NO: 2765165 - RNA, 15 nt, Human
auaacaaugcuguau

SEQ ID NO: 2765166 - RNA, 14 nt, Human
auaacaaugaaagu

SEQ ID NO: 2765167 - RNA, 18 nt, Human
auaauguuucaaacauau

SEQ ID NO: 2765168 - RNA, 13 nt, Human
auaauguuucaaa

SEQ ID NO: 2765169 - RNA, 22 nt, Human
auaagccagacaucaacagaua

SEQ ID NO: 2765170 - RNA, 21 nt, Human
auaagccagacaucaacagau

SEQ ID NO: 2765171 - RNA, 14 nt, Human
auaagccagacauc

SEQ ID NO: 2765172 - RNA, 19 nt, Human
augagagacacacugaaga

SEQ ID NO: 2765173 - RNA, 17 nt, Human
augagagacacacugaa

SEQ ID NO: 2765174 - RNA, 14 nt, Human
augagagacacacu

SEQ ID NO: 2765175 - RNA, 13 nt, Human
augagagacacac

SEQ ID NO: 2765176 - RNA, 17 nt, Human
uuguauaaaauaauuuu

SEQ ID NO: 2765177 - RNA, 16 nt, Human
uuguaucacaaaucuu

SEQ ID NO: 2765178 - RNA, 14 nt, Human
uuguacaaaguauu

SEQ ID NO: 2765179 - RNA, 13 nt, Human
uuguacaaaguau

SEQ ID NO: 2765180 - RNA, 21 nt, Human
uuguacaaaguauuaagcaua

SEQ ID NO: 2765181 - RNA, 20 nt, Human
uuguacaaaguauuaagcau

SEQ ID NO: 2765182 - RNA, 17 nt, Human
uuguacaaaguauuaag

SEQ ID NO: 2765183 - RNA, 15 nt, Human
uuguacaaaguauua

SEQ ID NO: 2765184 - RNA, 15 nt, Human
uuguauaaaauaauu

SEQ ID NO: 2765185 - RNA, 16 nt, Human
uuguauaaaauaauuu

SEQ ID NO: 2765186 - RNA, 15 nt, Human
uuggggauucuuaaa

SEQ ID NO: 2765187 - RNA, 13 nt, Human
uuggggauucuua

SEQ ID NO: 2765188 - RNA, 13 nt, Human
augaaugaauggc

SEQ ID NO: 2765189 - RNA, 18 nt, Human
augaagauguagaggaga

SEQ ID NO: 2765190 - RNA, 17 nt, Human
augaaauauuauguuaa

SEQ ID NO: 2765191 - RNA, 13 nt, Human
augaaauauuaug

SEQ ID NO: 2765192 - RNA, 18 nt, Human
augaaauauuauguuaaa

SEQ ID NO: 2765193 - RNA, 15 nt, Human
uuggauaauaaggaa

SEQ ID NO: 2765194 - RNA, 21 nt, Human
uuggauaauaaggaaaaguuu

SEQ ID NO: 2765195 - RNA, 19 nt, Human
uuggauaauaaggaaaagu

SEQ ID NO: 2765196 - RNA, 15 nt, Human
augaaagcagggacu

SEQ ID NO: 2765197 - RNA, 13 nt, Human
aucuuuuucuaac

SEQ ID NO: 2765198 - RNA, 18 nt, Human
uugauggugguauguuuu

SEQ ID NO: 2765199 - RNA, 19 nt, Human
uugauggugguauguuuuc

SEQ ID NO: 2765200 - RNA, 14 nt, Human
aucucauuuccaag

SEQ ID NO: 2765201 - RNA, 23 nt, Human
aucucauuuccaagcaaguauua

SEQ ID NO: 2765202 - RNA, 21 nt, Human
aucucauuuccaagcaaguau

SEQ ID NO: 2765203 - RNA, 13 nt, Human
aucucaauauuuc

SEQ ID NO: 2765204 - RNA, 19 nt, Human
aucugugaacuugaaauuu

SEQ ID NO: 2765205 - RNA, 18 nt, Human
aucugugaacuugaaauu

SEQ ID NO: 2765206 - RNA, 17 nt, Human
aucugugaacuugaaau

SEQ ID NO: 2765207 - RNA, 13 nt, Human
aucugugaacuug

SEQ ID NO: 2765208 - RNA, 20 nt, Human
aucugccuaaggacuucuuu

SEQ ID NO: 2765209 - RNA, 19 nt, Human
aucugccuaaggacuucuu

SEQ ID NO: 2765210 - RNA, 18 nt, Human
aucugccuaaggacuucu

SEQ ID NO: 2765211 - RNA, 13 nt, Human
aucugccuaagga

SEQ ID NO: 2765212 - RNA, 17 nt, Human
aucugccuaaggacuuc

SEQ ID NO: 2765213 - RNA, 16 nt, Human
aucugccuaaggacuu

SEQ ID NO: 2765214 - RNA, 15 nt, Human
aucugccuaaggacu

SEQ ID NO: 2765215 - RNA, 14 nt, Human
aucugccuaaggac

SEQ ID NO: 2765216 - RNA, 21 nt, Human
aucugaggaauucuguauaga

SEQ ID NO: 2765217 - RNA, 20 nt, Human
aucugaggaauucuguauag

SEQ ID NO: 2765218 - RNA, 18 nt, Human
aucugaggaauucuguau

SEQ ID NO: 2765219 - RNA, 17 nt, Human
aucugaggaauucugua

SEQ ID NO: 2765220 - RNA, 16 nt, Human
aucugaggaauucugu

SEQ ID NO: 2765221 - RNA, 15 nt, Human
aucugaggaauucug

SEQ ID NO: 2765222 - RNA, 22 nt, Human
uugccuaaauccauuuggaaau

SEQ ID NO: 2765223 - RNA, 13 nt, Human
uugccuaaaucca

SEQ ID NO: 2765224 - RNA, 15 nt, Human
uugccuaaauccauu

SEQ ID NO: 2765225 - RNA, 14 nt, Human
uugccuaaauccau

SEQ ID NO: 2765226 - RNA, 13 nt, Human
uugcccuguuaaa

SEQ ID NO: 2765227 - RNA, 14 nt, Human
uuuagucuugucuc

SEQ ID NO: 2765228 - RNA, 22 nt, Human
uuuagcuggaaaaguauguuag

SEQ ID NO: 2765229 - RNA, 20 nt, Human
uuuagcuggaaaaguauguu

SEQ ID NO: 2765230 - RNA, 22 nt, Human
uuuauuacaguauaauuaacau

SEQ ID NO: 2765231 - RNA, 13 nt, Human
uuuauauaagcuu

SEQ ID NO: 2765232 - RNA, 23 nt, Human
uuuauuacaguauaauuaacaug

SEQ ID NO: 2765233 - RNA, 15 nt, Human
augcuagaacucccu

SEQ ID NO: 2765234 - RNA, 16 nt, Human
augcuagaacucccuu

SEQ ID NO: 2765235 - RNA, 23 nt, Human
auggaacgcguugaaauuguaau

SEQ ID NO: 2765236 - RNA, 22 nt, Human
augcugucuacacuaagagaga

SEQ ID NO: 2765237 - RNA, 20 nt, Human
auggcuaguaucaaaagaaa

SEQ ID NO: 2765238 - RNA, 17 nt, Human
uuuaauuuuggaauuuu

SEQ ID NO: 2765239 - RNA, 15 nt, Human
uuuaauuuuggaauu

SEQ ID NO: 2765240 - RNA, 14 nt, Human
uuuaauuuuggaau

SEQ ID NO: 2765241 - RNA, 17 nt, Human
augcaguucugaagaag

SEQ ID NO: 2765242 - RNA, 15 nt, Human
augcaguucugaaga

SEQ ID NO: 2765243 - RNA, 19 nt, Human
augcaguucugaagaagau

SEQ ID NO: 2765244 - RNA, 18 nt, Human
augcaguucugaagaaga

SEQ ID NO: 2765245 - RNA, 17 nt, Human
augccacuaaauugaca

SEQ ID NO: 2765246 - RNA, 15 nt, Human
augccacuaaauuga

SEQ ID NO: 2765247 - RNA, 14 nt, Human
uuguuuucauuauc

SEQ ID NO: 2765248 - RNA, 16 nt, Human
augauuucuaugcuga

SEQ ID NO: 2765249 - RNA, 13 nt, Human
augauuucuaugc

SEQ ID NO: 2765250 - RNA, 12 nt, Human
augauuucuaug

SEQ ID NO: 2765251 - RNA, 15 nt, Human
augcaaagcacugac

SEQ ID NO: 2765252 - RNA, 12 nt, Human
augauucccagc

SEQ ID NO: 2765253 - RNA, 22 nt, Human
augauuaugaauuacauuugua

SEQ ID NO: 2765254 - RNA, 21 nt, Human
augagagacacacugaagaag

SEQ ID NO: 2765255 - RNA, 20 nt, Human
augagagacacacugaagaa

SEQ ID NO: 2765256 - RNA, 23 nt, Human
augagagacacacugaagaagca

SEQ ID NO: 2765257 - RNA, 19 nt, Human
uuguguaaauacaauuuug

SEQ ID NO: 2765258 - RNA, 23 nt, Human
uugugugaaagguacuucaaauc

SEQ ID NO: 2765259 - RNA, 19 nt, Human
uugaaauauugacuuuuua

SEQ ID NO: 2765260 - RNA, 13 nt, Human
uucuguacuuuuu

SEQ ID NO: 2765261 - RNA, 19 nt, Human
uucuguacuuuuuggcaua

SEQ ID NO: 2765262 - RNA, 18 nt, Human
uucuguacuuuuuggcau

SEQ ID NO: 2765263 - RNA, 17 nt, Human
auccaguuuuguuugga

SEQ ID NO: 2765264 - RNA, 18 nt, Human
auccaguuuuguuuggac

SEQ ID NO: 2765265 - RNA, 21 nt, Human
auccaguuuuguuuggaccaa

SEQ ID NO: 2765266 - RNA, 20 nt, Human
auccaguuuuguuuggacca

SEQ ID NO: 2765267 - RNA, 13 nt, Human
auccauuuggaaa

SEQ ID NO: 2765268 - RNA, 19 nt, Human
auccauuuggaaaucuuua

SEQ ID NO: 2765269 - RNA, 17 nt, Human
auccauuuggaaaucuu

SEQ ID NO: 2765270 - RNA, 14 nt, Human
auccauacauuugu

SEQ ID NO: 2765271 - RNA, 13 nt, Human
uucuauaauuuaa

SEQ ID NO: 2765272 - RNA, 14 nt, Human
uucuauaauuuaaa

SEQ ID NO: 2765273 - RNA, 21 nt, Human
uucuaaguaaaaccacagcag

SEQ ID NO: 2765274 - RNA, 18 nt, Human
aucaauaaaaaauuauga

SEQ ID NO: 2765275 - RNA, 17 nt, Human
aucaauaaaaaauuaug

SEQ ID NO: 2765276 - RNA, 15 nt, Human
aucaauaaaaaauua

SEQ ID NO: 2765277 - RNA, 19 nt, Human
uucuaaguaaaaccacagc

SEQ ID NO: 2765278 - RNA, 20 nt, Human
uucuaaguaaaaccacagca

SEQ ID NO: 2765279 - RNA, 17 nt, Human
uucuaaguaaaaccaca

SEQ ID NO: 2765280 - RNA, 13 nt, Human
auauuuucauucu

SEQ ID NO: 2765281 - RNA, 17 nt, Human
auauuuucauucuccua

SEQ ID NO: 2765282 - RNA, 16 nt, Human
auauuuuuauauuuac

SEQ ID NO: 2765283 - RNA, 20 nt, Human
aucaaauaugcaaagcacug

SEQ ID NO: 2765284 - RNA, 12 nt, Human
uucccaaauuuc

SEQ ID NO: 2765285 - RNA, 18 nt, Human
uucccaacuccagaaagu

SEQ ID NO: 2765286 - RNA, 18 nt, Human
uucaaacagucucaggaa

SEQ ID NO: 2765287 - RNA, 14 nt, Human
uucaaacauauaua

SEQ ID NO: 2765288 - RNA, 17 nt, Human
auaggcguaacuaauuu

SEQ ID NO: 2765289 - RNA, 22 nt, Human
auaggaauugacccacaagaaa

SEQ ID NO: 2765290 - RNA, 23 nt, Human
uucacaagacccaaaaggcagaa

SEQ ID NO: 2765291 - RNA, 22 nt, Human
uucacaagacccaaaaggcaga

SEQ ID NO: 2765292 - RNA, 13 nt, Human
auagucuggcugu

SEQ ID NO: 2765293 - RNA, 20 nt, Human
auaguuguaccgcaauguga

SEQ ID NO: 2765294 - RNA, 17 nt, Human
auauaacaaugcuguau

SEQ ID NO: 2765295 - RNA, 19 nt, Human
auauauaacaaugcuguau

SEQ ID NO: 2765296 - RNA, 20 nt, Human
auuuggaaaucuuuaaaaaa

SEQ ID NO: 2765297 - RNA, 17 nt, Human
auuuggaaaucuuuaaa

SEQ ID NO: 2765298 - RNA, 18 nt, Human
auuuguaguguuggagaa

SEQ ID NO: 2765299 - RNA, 23 nt, Human
auuugguaaggggaauugaggac

SEQ ID NO: 2765300 - RNA, 22 nt, Human
auuuauuacuguaagaaaauau

SEQ ID NO: 2765301 - RNA, 13 nt, Human
auuuuauuaugua

SEQ ID NO: 2765302 - RNA, 14 nt, Human
auuuuauuauguaa

SEQ ID NO: 2765303 - RNA, 21 nt, Human
auuuuauuaugaaacuugugu

SEQ ID NO: 2765304 - RNA, 18 nt, Human
auuuuauuaugaaacuug

SEQ ID NO: 2765305 - RNA, 12 nt, Human
auuuuauuauga

SEQ ID NO: 2765306 - RNA, 11 nt, Human
auuuuauuaug

SEQ ID NO: 2765307 - RNA, 14 nt, Human
auuuuauuaugaaa

SEQ ID NO: 2765308 - RNA, 13 nt, Human
auuuuauuaugaa

SEQ ID NO: 2765309 - RNA, 15 nt, Human
auuuguaucacaaau

SEQ ID NO: 2765310 - RNA, 21 nt, Human
auuuguauaaaauaauuuuua

SEQ ID NO: 2765311 - RNA, 16 nt, Human
auuuuaauaauguuuc

SEQ ID NO: 2765312 - RNA, 15 nt, Human
auuuuaauaauguuu

SEQ ID NO: 2765313 - RNA, 14 nt, Human
auuuuaauaauguu

SEQ ID NO: 2765314 - RNA, 12 nt, Human
auuuuaauaaug

SEQ ID NO: 2765315 - RNA, 21 nt, Human
auugacccacaagaaaugaaa

SEQ ID NO: 2765316 - RNA, 20 nt, Human
auugacacuuaaaaaugguu

SEQ ID NO: 2765317 - RNA, 23 nt, Human
auugugcgcuaaacuuuucugau

SEQ ID NO: 2765318 - RNA, 14 nt, Human
auuguauuacaaau

SEQ ID NO: 2765319 - RNA, 13 nt, Human
auugugccccugc

SEQ ID NO: 2765320 - RNA, 19 nt, Human
auuuaaagcuuauuaaaac

SEQ ID NO: 2765321 - RNA, 16 nt, Human
auuuacaaaugggaaa

SEQ ID NO: 2765322 - RNA, 20 nt, Human
auuccacuuauaggaauuga

SEQ ID NO: 2765323 - RNA, 22 nt, Human
auuauuuuauuaugaaacuugu

SEQ ID NO: 2765324 - RNA, 21 nt, Human
auuauuuuauuaugaaacuug

SEQ ID NO: 2765325 - RNA, 14 nt, Human
auucaaacagucuc

SEQ ID NO: 2765326 - RNA, 15 nt, Human
auucaaacagucuca

SEQ ID NO: 2765327 - RNA, 13 nt, Human
auuacauuuguau

SEQ ID NO: 2765328 - RNA, 20 nt, Human
auuacauuuguauaaaauaa

SEQ ID NO: 2765329 - RNA, 15 nt, Human
auuacauuuguauaa

SEQ ID NO: 2765330 - RNA, 23 nt, Human
uuuuuuaaaaaagaaacauuugg

SEQ ID NO: 2765331 - RNA, 15 nt, Human
auuaaguaaugauaa

SEQ ID NO: 2765332 - RNA, 13 nt, Human
auuaaguaaugau

SEQ ID NO: 2765333 - RNA, 19 nt, Human
auuagagaguguugaaacg

SEQ ID NO: 2765334 - RNA, 18 nt, Human
auuagagaguguugaaac

SEQ ID NO: 2765335 - RNA, 17 nt, Human
auuagagaguguugaaa

SEQ ID NO: 2765336 - RNA, 16 nt, Human
auuagagaguguugaa

SEQ ID NO: 2765337 - RNA, 15 nt, Human
auuagagaguguuga

SEQ ID NO: 2765338 - RNA, 16 nt, Human
auuauauuuacaaaug

SEQ ID NO: 2765339 - RNA, 15 nt, Human
auuauuuuauuauga

SEQ ID NO: 2765340 - RNA, 18 nt, Human
auuaucucaaaacugcac

SEQ ID NO: 2765341 - RNA, 23 nt, Human
auuaucucaaaacugcacuguca

SEQ ID NO: 2765342 - RNA, 17 nt, Human
auuauauuuacaaaugg

SEQ ID NO: 2765343 - RNA, 15 nt, Human
auuauauuuacaaau

SEQ ID NO: 2765344 - RNA, 21 nt, Human
uuuucauuauuuuauuaugaa

SEQ ID NO: 2765345 - RNA, 15 nt, Human
uuuucauuauuuuau

SEQ ID NO: 2765346 - RNA, 16 nt, Human
uuuucuauaauuuaaa

SEQ ID NO: 2765347 - RNA, 14 nt, Human
uuuuauuauguaaa

SEQ ID NO: 2765348 - RNA, 13 nt, Human
uuuuauuauguaa

SEQ ID NO: 2765349 - RNA, 14 nt, Human
uuuuauaauuuugu

SEQ ID NO: 2765350 - RNA, 12 nt, Human
uuuuauuaugua

SEQ ID NO: 2765351 - RNA, 23 nt, Human
uuuuauggaggcuuugcauagau

SEQ ID NO: 2765352 - RNA, 19 nt, Human
uuuuauggcacuaguauuu

SEQ ID NO: 2765353 - RNA, 19 nt, Human
auguucaucaaugaaugaa

SEQ ID NO: 2765354 - RNA, 15 nt, Human
auguugacaugggac

SEQ ID NO: 2765355 - RNA, 19 nt, Human
auuaacauguuaaaccaug

SEQ ID NO: 2765356 - RNA, 17 nt, Human
auuaacauguuaaacca

SEQ ID NO: 2765357 - RNA, 15 nt, Human
auuaacauguuaaac

SEQ ID NO: 2765358 - RNA, 14 nt, Human
auuaacauguuaaa

SEQ ID NO: 2765359 - RNA, 13 nt, Human
auuaacauguuaa

SEQ ID NO: 2765360 - RNA, 11 nt, Human
auuaaagccau

SEQ ID NO: 2765361 - RNA, 21 nt, Human
auuaaagccauguuuauuaca

SEQ ID NO: 2765362 - RNA, 17 nt, Human
auuaaagccauguuuau

SEQ ID NO: 2765363 - RNA, 16 nt, Human
auuaaagccauguuua

SEQ ID NO: 2765364 - RNA, 12 nt, Human
auuaaagccaug

SEQ ID NO: 2765365 - RNA, 15 nt, Human
auuaaaagaauauuu

SEQ ID NO: 2765366 - RNA, 16 nt, Human
auuaaaagaauauuuu

SEQ ID NO: 2765367 - RNA, 18 nt, Human
auguuucaaacauauaua

SEQ ID NO: 2765368 - RNA, 21 nt, Human
auguuucaaacauauauaaca

SEQ ID NO: 2765369 - RNA, 13 nt, Human
uuuguuucuguac

SEQ ID NO: 2765370 - RNA, 12 nt, Human
uuuguuucugua

SEQ ID NO: 2765371 - RNA, 18 nt, Human
uuuguuucuguacuuuuu

SEQ ID NO: 2765372 - RNA, 15 nt, Human
uuugucuacaccauu

SEQ ID NO: 2765373 - RNA, 13 nt, Human
uuuuaaaaaagaa

SEQ ID NO: 2765374 - RNA, 14 nt, Human
uuuuaaaagaauga

SEQ ID NO: 2765375 - RNA, 12 nt, Human
uuugcucaugga

SEQ ID NO: 2765376 - RNA, 11 nt, Human
uuugcucaugg

SEQ ID NO: 2765377 - RNA, 15 nt, Human
auggcuauaggugcu

SEQ ID NO: 2765378 - RNA, 15 nt, Human
auaaauaguuuauga

SEQ ID NO: 2765379 - RNA, 22 nt, Human
auaaauagcuagacuggugacu

SEQ ID NO: 2765380 - RNA, 21 nt, Human
auaaauagcuagacuggugac

SEQ ID NO: 2765381 - RNA, 14 nt, Human
auaaauaaaaauaa

SEQ ID NO: 2765382 - RNA, 13 nt, Human
auaaauaaaaaua

SEQ ID NO: 2765383 - RNA, 22 nt, Human
auaacgauaaaagacagugaaa

SEQ ID NO: 2765384 - RNA, 18 nt, Human
auaauccuaaacauauga

SEQ ID NO: 2765385 - RNA, 14 nt, Human
aguuuaaauuguaa

SEQ ID NO: 2765386 - RNA, 17 nt, Human
aguugccuaaauccauu

SEQ ID NO: 2765387 - RNA, 11 nt, Human
aguugccuaaa

SEQ ID NO: 2765388 - RNA, 16 nt, Human
aguugccuaaauccau

SEQ ID NO: 2765389 - RNA, 15 nt, Human
aguugccuaaaucca

SEQ ID NO: 2765390 - RNA, 13 nt, Human
uguuucaaacaua

SEQ ID NO: 2765391 - RNA, 12 nt, Human
auaaaauaauuu

SEQ ID NO: 2765392 - RNA, 22 nt, Human
auaaaauaauuuuuauauuuga

SEQ ID NO: 2765393 - RNA, 19 nt, Human
aguuuucugagaaagacua

SEQ ID NO: 2765394 - RNA, 18 nt, Human
aguuuucugagaaagacu

SEQ ID NO: 2765395 - RNA, 23 nt, Human
aguuuucugagaaagacuauuca

SEQ ID NO: 2765396 - RNA, 18 nt, Human
uguuuauuacaguauaau

SEQ ID NO: 2765397 - RNA, 19 nt, Human
uguuuagucuugucucaga

SEQ ID NO: 2765398 - RNA, 18 nt, Human
uguuuagucuugucucag

SEQ ID NO: 2765399 - RNA, 17 nt, Human
uguuuagucuugucuca

SEQ ID NO: 2765400 - RNA, 13 nt, Human
uguuuagucuugu

SEQ ID NO: 2765401 - RNA, 24 nt, Human
aguucacucuccauuuaauaauua

SEQ ID NO: 2765402 - RNA, 22 nt, Human
aguucacucuccauuuaauaau

SEQ ID NO: 2765403 - RNA, 19 nt, Human
aguucggugagcuacaaau

SEQ ID NO: 2765404 - RNA, 21 nt, Human
aguguugaaacggaugauuuc

SEQ ID NO: 2765405 - RNA, 16 nt, Human
aguguuggagaagaac

SEQ ID NO: 2765406 - RNA, 14 nt, Human
aguguuggagaaga

SEQ ID NO: 2765407 - RNA, 18 nt, Human
aguguuggagaagaacug

SEQ ID NO: 2765408 - RNA, 17 nt, Human
aguguuggagaagaacu

SEQ ID NO: 2765409 - RNA, 14 nt, Human
agugcaaauuguca

SEQ ID NO: 2765410 - RNA, 21 nt, Human
agugcaaauugucacaggaca

SEQ ID NO: 2765411 - RNA, 18 nt, Human
agugcaaauugucacagg

SEQ ID NO: 2765412 - RNA, 17 nt, Human
uguggugacuuuggaua

SEQ ID NO: 2765413 - RNA, 16 nt, Human
uguggugacuuuggau

SEQ ID NO: 2765414 - RNA, 21 nt, Human
agugccuguaaucacagcuac

SEQ ID NO: 2765415 - RNA, 23 nt, Human
agguacuucaaauccuugaagau

SEQ ID NO: 2765416 - RNA, 20 nt, Human
ugguaaggggaauugaggac

SEQ ID NO: 2765417 - RNA, 17 nt, Human
agggcagggacaggaua

SEQ ID NO: 2765418 - RNA, 15 nt, Human
agucaggaaagagaa

SEQ ID NO: 2765419 - RNA, 16 nt, Human
agucaggaaagagaac

SEQ ID NO: 2765420 - RNA, 23 nt, Human
ugucauuugcuggagcucugccc

SEQ ID NO: 2765421 - RNA, 15 nt, Human
aguauuucuaugaaa

SEQ ID NO: 2765422 - RNA, 13 nt, Human
aguauuucuauga

SEQ ID NO: 2765423 - RNA, 22 nt, Human
aguauuucuaugaaauauuaug

SEQ ID NO: 2765424 - RNA, 20 nt, Human
ugucaaucagccuaguugau

SEQ ID NO: 2765425 - RNA, 21 nt, Human
ugucaauaaaauccauacauu

SEQ ID NO: 2765426 - RNA, 22 nt, Human
uguaaaucccauuauucaaagu

SEQ ID NO: 2765427 - RNA, 20 nt, Human
uguaaaucccauuauucaaa

SEQ ID NO: 2765428 - RNA, 19 nt, Human
uguaaaucccauuauucaa

SEQ ID NO: 2765429 - RNA, 13 nt, Human
uguaaaucccauu

SEQ ID NO: 2765430 - RNA, 18 nt, Human
uguaaaucccauuauuca

SEQ ID NO: 2765431 - RNA, 16 nt, Human
uguaaaucccauuauu

SEQ ID NO: 2765432 - RNA, 15 nt, Human
uguaauuauaucuga

SEQ ID NO: 2765433 - RNA, 14 nt, Human
uguaauuauaucug

SEQ ID NO: 2765434 - RNA, 13 nt, Human
uguaauuauaucu

SEQ ID NO: 2765435 - RNA, 12 nt, Human
uguacuuuuugg

SEQ ID NO: 2765436 - RNA, 16 nt, Human
uguacuuuuuggcaua

SEQ ID NO: 2765437 - RNA, 15 nt, Human
uguacuuuuuggcau

SEQ ID NO: 2765438 - RNA, 17 nt, Human
uguacuuuuuggcauaa

SEQ ID NO: 2765439 - RNA, 16 nt, Human
uguagaggagaaacug

SEQ ID NO: 2765440 - RNA, 18 nt, Human
uguagaggagaaacugga

SEQ ID NO: 2765441 - RNA, 15 nt, Human
aguaaaaccacagca

SEQ ID NO: 2765442 - RNA, 19 nt, Human
aguagauaggccaugggca

SEQ ID NO: 2765443 - RNA, 11 nt, Human
ugcucauggaa

SEQ ID NO: 2765444 - RNA, 14 nt, Human
ugcucauggaauug

SEQ ID NO: 2765445 - RNA, 18 nt, Human
aggaagccugauuaaaga

SEQ ID NO: 2765446 - RNA, 17 nt, Human
aggaagccugauuaaag

SEQ ID NO: 2765447 - RNA, 21 nt, Human
aggaagccugauuaaagaaug

SEQ ID NO: 2765448 - RNA, 12 nt, Human
aggaaauauuua

SEQ ID NO: 2765449 - RNA, 23 nt, Human
aggaaaucaaauaugcaaagcac

SEQ ID NO: 2765450 - RNA, 17 nt, Human
aggacacugauaugggu

SEQ ID NO: 2765451 - RNA, 23 nt, Human
aggaauggagccugcacggugaa

SEQ ID NO: 2765452 - RNA, 22 nt, Human
ugcuguauuuuaaaagaaugau

SEQ ID NO: 2765453 - RNA, 21 nt, Human
ugcuguauuuuaaaagaauga

SEQ ID NO: 2765454 - RNA, 13 nt, Human
ugcuguauuuuaa

SEQ ID NO: 2765455 - RNA, 12 nt, Human
ugcuaaggacuu

SEQ ID NO: 2765456 - RNA, 17 nt, Human
agcuugaaacugagaug

SEQ ID NO: 2765457 - RNA, 20 nt, Human
ugcuacaaaaacacagcaag

SEQ ID NO: 2765458 - RNA, 22 nt, Human
ugcuaaggacuuguuagaucua

SEQ ID NO: 2765459 - RNA, 18 nt, Human
ugcuaaggacuuguuaga

SEQ ID NO: 2765460 - RNA, 13 nt, Human
ugcuaaggacuug

SEQ ID NO: 2765461 - RNA, 15 nt, Human
ugcuacaaaaacaca

SEQ ID NO: 2765462 - RNA, 16 nt, Human
ugcuacaaaaacacag

SEQ ID NO: 2765463 - RNA, 17 nt, Human
ugcuacaaaaacacagc

SEQ ID NO: 2765464 - RNA, 18 nt, Human
ugcuacaaaaacacagca

SEQ ID NO: 2765465 - RNA, 19 nt, Human
ugcuacaaaaacacagcaa

SEQ ID NO: 2765466 - RNA, 16 nt, Human
agcugccuccccuccu

SEQ ID NO: 2765467 - RNA, 15 nt, Human
agcugccuccccucc

SEQ ID NO: 2765468 - RNA, 22 nt, Human
agcugcccucuccugggcagcu

SEQ ID NO: 2765469 - RNA, 16 nt, Human
agcuguucacagccag

SEQ ID NO: 2765470 - RNA, 19 nt, Human
agcuguucacagccagacu

SEQ ID NO: 2765471 - RNA, 22 nt, Human
uggcauaacauaaaucugugaa

SEQ ID NO: 2765472 - RNA, 21 nt, Human
uggcauaacauaaaucuguga

SEQ ID NO: 2765473 - RNA, 17 nt, Human
uggcauaacauaaaucu

SEQ ID NO: 2765474 - RNA, 18 nt, Human
uggcacaguuuucugaga

SEQ ID NO: 2765475 - RNA, 19 nt, Human
uggcacaguuuucugagaa

SEQ ID NO: 2765476 - RNA, 15 nt, Human
uggaaaucuuuaaaa

SEQ ID NO: 2765477 - RNA, 14 nt, Human
uggaaaucuuuaaa

SEQ ID NO: 2765478 - RNA, 13 nt, Human
uggaaaggcagcu

SEQ ID NO: 2765479 - RNA, 16 nt, Human
uggacuguggugacuu

SEQ ID NO: 2765480 - RNA, 15 nt, Human
uggacuguggugacu

SEQ ID NO: 2765481 - RNA, 22 nt, Human
uggacuguggugacuuuggaua

SEQ ID NO: 2765482 - RNA, 21 nt, Human
uggacuguggugacuuuggau

SEQ ID NO: 2765483 - RNA, 19 nt, Human
uggacuguggugacuuugg

SEQ ID NO: 2765484 - RNA, 17 nt, Human
uggacuguggugacuuu

SEQ ID NO: 2765485 - RNA, 13 nt, Human
uggagaagaacug

SEQ ID NO: 2765486 - RNA, 20 nt, Human
agccuuggggcugaugcagu

SEQ ID NO: 2765487 - RNA, 13 nt, Human
agcuagacuggug

SEQ ID NO: 2765488 - RNA, 21 nt, Human
agcuagacuggugacugauuc

SEQ ID NO: 2765489 - RNA, 17 nt, Human
agcuagacuggugacug

SEQ ID NO: 2765490 - RNA, 16 nt, Human
agcuagacuggugacu

SEQ ID NO: 2765491 - RNA, 14 nt, Human
agcuagacugguga

SEQ ID NO: 2765492 - RNA, 18 nt, Human
agcuacuugggaggcuga

SEQ ID NO: 2765493 - RNA, 17 nt, Human
agcuacuugggaggcug

SEQ ID NO: 2765494 - RNA, 18 nt, Human
agccccgugggguuccuc

SEQ ID NO: 2765495 - RNA, 18 nt, Human
agcccauggcacucuaug

SEQ ID NO: 2765496 - RNA, 20 nt, Human
agccucauguccacugguuc

SEQ ID NO: 2765497 - RNA, 15 nt, Human
agccucauguccacu

SEQ ID NO: 2765498 - RNA, 22 nt, Human
agccugaaagaggaaugaagua

SEQ ID NO: 2765499 - RNA, 16 nt, Human
agccauguuuauuaca

SEQ ID NO: 2765500 - RNA, 14 nt, Human
agccauguuuauua

SEQ ID NO: 2765501 - RNA, 13 nt, Human
agccauguuuauu

SEQ ID NO: 2765502 - RNA, 19 nt, Human
agccagacuggcacaguuu

SEQ ID NO: 2765503 - RNA, 14 nt, Human
agccagacuggcac

SEQ ID NO: 2765504 - RNA, 14 nt, Human
ugaugaucuuuaaa

SEQ ID NO: 2765505 - RNA, 17 nt, Human
ugaugaucuuuaaaaua

SEQ ID NO: 2765506 - RNA, 12 nt, Human
ugauuaaaccaa

SEQ ID NO: 2765507 - RNA, 14 nt, Human
ugauuaccagggac

SEQ ID NO: 2765508 - RNA, 22 nt, Human
ugauccaguuuuguuuggacca

SEQ ID NO: 2765509 - RNA, 20 nt, Human
ugauccagcagauuauucac

SEQ ID NO: 2765510 - RNA, 21 nt, Human
ugauccagcagauuauucacu

SEQ ID NO: 2765511 - RNA, 22 nt, Human
ugauccagcagauuauucacug

SEQ ID NO: 2765512 - RNA, 17 nt, Human
ugaugaagaaguugaua

SEQ ID NO: 2765513 - RNA, 23 nt, Human
agcauaaauguugacaugggaca

SEQ ID NO: 2765514 - RNA, 22 nt, Human
ugaguaacugauuuguaacaag

SEQ ID NO: 2765515 - RNA, 17 nt, Human
agcauuguaaaugugcu

SEQ ID NO: 2765516 - RNA, 18 nt, Human
agcauuguaaaugugcuu

SEQ ID NO: 2765517 - RNA, 17 nt, Human
agcaugucgucaaagcu

SEQ ID NO: 2765518 - RNA, 20 nt, Human
agcaugucgucaaagcugaa

SEQ ID NO: 2765519 - RNA, 12 nt, Human
ugauaugggucu

SEQ ID NO: 2765520 - RNA, 15 nt, Human
ugaaacggaugauuu

SEQ ID NO: 2765521 - RNA, 20 nt, Human
ugaaacggaugauuucuaug

SEQ ID NO: 2765522 - RNA, 19 nt, Human
ugaaacggaugauuucuau

SEQ ID NO: 2765523 - RNA, 18 nt, Human
ugaaacggaugauuucua

SEQ ID NO: 2765524 - RNA, 17 nt, Human
ugaaacggaugauuucu

SEQ ID NO: 2765525 - RNA, 23 nt, Human
ugaaacuuguguaaauacaauuu

SEQ ID NO: 2765526 - RNA, 17 nt, Human
ugaaacuuguguaaaua

SEQ ID NO: 2765527 - RNA, 19 nt, Human
ugaaacucguuaauuugua

SEQ ID NO: 2765528 - RNA, 22 nt, Human
ugaaacugagaugugaacacau

SEQ ID NO: 2765529 - RNA, 22 nt, Human
ugaaaaaguucugcagauaaac

SEQ ID NO: 2765530 - RNA, 20 nt, Human
ugaaaagcuccauuuuuagu

SEQ ID NO: 2765531 - RNA, 21 nt, Human
agacauagaauuaacacauga

SEQ ID NO: 2765532 - RNA, 14 nt, Human
agacauagaauuaa

SEQ ID NO: 2765533 - RNA, 18 nt, Human
agacaucaacagauaaau

SEQ ID NO: 2765534 - RNA, 17 nt, Human
agacaucaacagauaaa

SEQ ID NO: 2765535 - RNA, 15 nt, Human
ucuucacaacagauu

SEQ ID NO: 2765536 - RNA, 14 nt, Human
agaaucacuugaac

SEQ ID NO: 2765537 - RNA, 15 nt, Human
agacuauucaaacag

SEQ ID NO: 2765538 - RNA, 12 nt, Human
agacuauucaaa

SEQ ID NO: 2765539 - RNA, 14 nt, Human
agacuauucaaaca

SEQ ID NO: 2765540 - RNA, 16 nt, Human
agaugcaguucugaag

SEQ ID NO: 2765541 - RNA, 16 nt, Human
ugacacuuaaaaaugg

SEQ ID NO: 2765542 - RNA, 17 nt, Human
ugacacuuaaaaauggu

SEQ ID NO: 2765543 - RNA, 19 nt, Human
agauuuuauuauguaaauc

SEQ ID NO: 2765544 - RNA, 14 nt, Human
agauuuuauuaugu

SEQ ID NO: 2765545 - RNA, 18 nt, Human
agauuuuauuauguaaau

SEQ ID NO: 2765546 - RNA, 17 nt, Human
agauuuuauuauguaaa

SEQ ID NO: 2765547 - RNA, 16 nt, Human
agauuuuauuauguaa

SEQ ID NO: 2765548 - RNA, 15 nt, Human
agauuuuauuaugua

SEQ ID NO: 2765549 - RNA, 24 nt, Human
ugacuucuaaguaaaaccacagca

SEQ ID NO: 2765550 - RNA, 22 nt, Human
ugacuucuaaguaaaaccacag

SEQ ID NO: 2765551 - RNA, 23 nt, Human
ugacuucuaaguaaaaccacagc

SEQ ID NO: 2765552 - RNA, 15 nt, Human
ugacuucuaaguaaa

SEQ ID NO: 2765553 - RNA, 15 nt, Human
agauucccugagcag

SEQ ID NO: 2765554 - RNA, 23 nt, Human
agauuuuuuuguuguuuguuuag

SEQ ID NO: 2765555 - RNA, 19 nt, Human
agauuuuuuuguuguuugu

SEQ ID NO: 2765556 - RNA, 18 nt, Human
agauuuuuuuguuguuug

SEQ ID NO: 2765557 - RNA, 16 nt, Human
agauuuuuuuguuguu

SEQ ID NO: 2765558 - RNA, 15 nt, Human
agauuuuuuuguugu

SEQ ID NO: 2765559 - RNA, 23 nt, Human
agcaacgcaggcccccaggugcc

SEQ ID NO: 2765560 - RNA, 14 nt, Human
agauacuggauugu

SEQ ID NO: 2765561 - RNA, 17 nt, Human
agauacuggauuguacu

SEQ ID NO: 2765562 - RNA, 17 nt, Human
ugaauuuuguguuagag

SEQ ID NO: 2765563 - RNA, 21 nt, Human
ugaauuuuguguuagagauuu

SEQ ID NO: 2765564 - RNA, 22 nt, Human
ugaauggcuuuguauagaaccu

SEQ ID NO: 2765565 - RNA, 19 nt, Human
ugaauggcuuuguauagaa

SEQ ID NO: 2765566 - RNA, 18 nt, Human
ugaauggcuuuguauaga

SEQ ID NO: 2765567 - RNA, 17 nt, Human
ugaauggcuuuguauag

SEQ ID NO: 2765568 - RNA, 11 nt, Human
ugaauggcuuu

SEQ ID NO: 2765569 - RNA, 15 nt, Human
ugaauggcuuuguau

SEQ ID NO: 2765570 - RNA, 12 nt, Human
ugaauggcuuug

SEQ ID NO: 2765571 - RNA, 15 nt, Human
ugaauacuuuauaaa

SEQ ID NO: 2765572 - RNA, 14 nt, Human
agaagcuccaggua

SEQ ID NO: 2765573 - RNA, 13 nt, Human
agaaguugauaug

SEQ ID NO: 2765574 - RNA, 16 nt, Human
agaacucccuuucaac

SEQ ID NO: 2765575 - RNA, 15 nt, Human
agaacucccuuucaa

SEQ ID NO: 2765576 - RNA, 17 nt, Human
agaacucccuuucaaca

SEQ ID NO: 2765577 - RNA, 22 nt, Human
agaaccucuuugucuacaccau

SEQ ID NO: 2765578 - RNA, 21 nt, Human
agaagccccacccugccucac

SEQ ID NO: 2765579 - RNA, 20 nt, Human
ucugcccauccugccccuga

SEQ ID NO: 2765580 - RNA, 19 nt, Human
agaagcaccaaucaugaau

SEQ ID NO: 2765581 - RNA, 19 nt, Human
agaagcaacccaaauguuc

SEQ ID NO: 2765582 - RNA, 22 nt, Human
acuuugugcugggguuaucuga

SEQ ID NO: 2765583 - RNA, 15 nt, Human
agaaacuggaacucu

SEQ ID NO: 2765584 - RNA, 16 nt, Human
agaaacacaacuauau

SEQ ID NO: 2765585 - RNA, 16 nt, Human
agaaagacuauucaaa

SEQ ID NO: 2765586 - RNA, 18 nt, Human
agaaagcagaacagugau

SEQ ID NO: 2765587 - RNA, 17 nt, Human
agaaagcagaacaguga

SEQ ID NO: 2765588 - RNA, 20 nt, Human
agaaagcagaacagugauua

SEQ ID NO: 2765589 - RNA, 20 nt, Human
acuuccagauccuggaaauc

SEQ ID NO: 2765590 - RNA, 12 nt, Human
ucuaguucacuc

SEQ ID NO: 2765591 - RNA, 19 nt, Human
ucuaguucacucuccauuu

SEQ ID NO: 2765592 - RNA, 16 nt, Human
ucuaguucacucucca

SEQ ID NO: 2765593 - RNA, 13 nt, Human
ucuauaauuuaaa

SEQ ID NO: 2765594 - RNA, 18 nt, Human
acuucuaaguaaaaccac

SEQ ID NO: 2765595 - RNA, 19 nt, Human
acuucuaaguaaaaccaca

SEQ ID NO: 2765596 - RNA, 13 nt, Human
acuucuaaguaaa

SEQ ID NO: 2765597 - RNA, 21 nt, Human
acuucuaaguaaaaccacagc

SEQ ID NO: 2765598 - RNA, 17 nt, Human
ucucaaaacugcacugu

SEQ ID NO: 2765599 - RNA, 21 nt, Human
acuugaacccgggaggcagag

SEQ ID NO: 2765600 - RNA, 23 nt, Human
acuugaacccgggaggcagaggu

SEQ ID NO: 2765601 - RNA, 22 nt, Human
acugaagaagcaccaaucauga

SEQ ID NO: 2765602 - RNA, 22 nt, Human
acugucagcuccccucggagaa

SEQ ID NO: 2765603 - RNA, 23 nt, Human
acugucagcuccccucggagaag

SEQ ID NO: 2765604 - RNA, 17 nt, Human
ucuaccaaaaaucucaa

SEQ ID NO: 2765605 - RNA, 17 nt, Human
accaugggauaaaugcc

SEQ ID NO: 2765606 - RNA, 20 nt, Human
acccaaauguucaucaauga

SEQ ID NO: 2765607 - RNA, 16 nt, Human
acccaaauguucauca

SEQ ID NO: 2765608 - RNA, 14 nt, Human
ucagagcugcccuc

SEQ ID NO: 2765609 - RNA, 13 nt, Human
ucagagcugcccu

SEQ ID NO: 2765610 - RNA, 20 nt, Human
ucagaucugccuaaggacuu

SEQ ID NO: 2765611 - RNA, 18 nt, Human
ucagaucugccuaaggac

SEQ ID NO: 2765612 - RNA, 15 nt, Human
ucagaucugccuaag

SEQ ID NO: 2765613 - RNA, 13 nt, Human
ucagaucugccua

SEQ ID NO: 2765614 - RNA, 16 nt, Human
ucagagcugcccucuc

SEQ ID NO: 2765615 - RNA, 15 nt, Human
ucagagcugcccucu

SEQ ID NO: 2765616 - RNA, 17 nt, Human
ucagagcugcccucucc

SEQ ID NO: 2765617 - RNA, 15 nt, Human
ucaaaguugccuaaa

SEQ ID NO: 2765618 - RNA, 13 nt, Human
ucaaacagucuca

SEQ ID NO: 2765619 - RNA, 20 nt, Human
ucaaacagucucaggaaauc

SEQ ID NO: 2765620 - RNA, 21 nt, Human
ucaaacagucucaggaaauca

SEQ ID NO: 2765621 - RNA, 22 nt, Human
uauuuuaauaauguuucaaaca

SEQ ID NO: 2765622 - RNA, 19 nt, Human
uauuuuaauaauguuucaa

SEQ ID NO: 2765623 - RNA, 14 nt, Human
uauuuuaaaagaau

SEQ ID NO: 2765624 - RNA, 18 nt, Human
uauuuuaaaagaaugauu

SEQ ID NO: 2765625 - RNA, 13 nt, Human
accaaaaaccagu

SEQ ID NO: 2765626 - RNA, 12 nt, Human
accaaaaaccag

SEQ ID NO: 2765627 - RNA, 14 nt, Human
accaacacgagcag

SEQ ID NO: 2765628 - RNA, 19 nt, Human
accaacacgagcaggcuac

SEQ ID NO: 2765629 - RNA, 16 nt, Human
accacaagacugcaca

SEQ ID NO: 2765630 - RNA, 17 nt, Human
ucacagccagacuggca

SEQ ID NO: 2765631 - RNA, 23 nt, Human
ucacagccagacuggcacaguuu

SEQ ID NO: 2765632 - RNA, 16 nt, Human
ucacagaccuuugaac

SEQ ID NO: 2765633 - RNA, 13 nt, Human
ucaauuuaaaaaa

SEQ ID NO: 2765634 - RNA, 12 nt, Human
ucaauuuaaaaa

SEQ ID NO: 2765635 - RNA, 23 nt, Human
acauugguguuguacucaauuuu

SEQ ID NO: 2765636 - RNA, 22 nt, Human
acauugguguuguacucaauuu

SEQ ID NO: 2765637 - RNA, 16 nt, Human
acauugguguuguacu

SEQ ID NO: 2765638 - RNA, 14 nt, Human
acauugguguugua

SEQ ID NO: 2765639 - RNA, 23 nt, Human
ucaauauuucagauaaucacaau

SEQ ID NO: 2765640 - RNA, 20 nt, Human
uccauuuggaaaucuuuaaa

SEQ ID NO: 2765641 - RNA, 19 nt, Human
uccauuuggaaaucuuuaa

SEQ ID NO: 2765642 - RNA, 12 nt, Human
uccauuuggaaa

SEQ ID NO: 2765643 - RNA, 17 nt, Human
uccauuuaauaauuaua

SEQ ID NO: 2765644 - RNA, 12 nt, Human
uccauuuaauaa

SEQ ID NO: 2765645 - RNA, 22 nt, Human
uccaugaagauguagaggagaa

SEQ ID NO: 2765646 - RNA, 14 nt, Human
uccagugagacagc

SEQ ID NO: 2765647 - RNA, 20 nt, Human
acgcguugaaauuguaauua

SEQ ID NO: 2765648 - RNA, 18 nt, Human
acgcguugaaauuguaau

SEQ ID NO: 2765649 - RNA, 14 nt, Human
acgcguugaaauug

SEQ ID NO: 2765650 - RNA, 13 nt, Human
acgcguugaaauu

SEQ ID NO: 2765651 - RNA, 14 nt, Human
acgcucucuggccu

SEQ ID NO: 2765652 - RNA, 16 nt, Human
acgcucucuggccuuc

SEQ ID NO: 2765653 - RNA, 15 nt, Human
acgcucucuggccuu

SEQ ID NO: 2765654 - RNA, 14 nt, Human
acggaugauuucua

SEQ ID NO: 2765655 - RNA, 15 nt, Human
acggaugauuucuau

SEQ ID NO: 2765656 - RNA, 17 nt, Human
acgcucucuggccuucg

SEQ ID NO: 2765657 - RNA, 17 nt, Human
accugagccccaaaagg

SEQ ID NO: 2765658 - RNA, 12 nt, Human
accugagcccca

SEQ ID NO: 2765659 - RNA, 16 nt, Human
ucauaauaaguugcau

SEQ ID NO: 2765660 - RNA, 17 nt, Human
uccucuccccaugaugu

SEQ ID NO: 2765661 - RNA, 21 nt, Human
uccugaaaacccuugccaugu

SEQ ID NO: 2765662 - RNA, 23 nt, Human
uccgugcuaaggacuuguuagau

SEQ ID NO: 2765663 - RNA, 16 nt, Human
uccgugcuaaggacuu

SEQ ID NO: 2765664 - RNA, 18 nt, Human
uccgugcuaaggacuugu

SEQ ID NO: 2765665 - RNA, 17 nt, Human
uccgugcuaaggacuug

SEQ ID NO: 2765666 - RNA, 14 nt, Human
acuccagaaaguga

SEQ ID NO: 2765667 - RNA, 14 nt, Human
ucccuccaccuccc

SEQ ID NO: 2765668 - RNA, 17 nt, Human
ucccuccaccucccugc

SEQ ID NO: 2765669 - RNA, 15 nt, Human
ucccuccaccucccu

SEQ ID NO: 2765670 - RNA, 19 nt, Human
ucccuccaccucccugcaa

SEQ ID NO: 2765671 - RNA, 20 nt, Human
acucauuuuaaaaaauggaa

SEQ ID NO: 2765672 - RNA, 21 nt, Human
acuccaaacugacucuuaaga

SEQ ID NO: 2765673 - RNA, 20 nt, Human
acuagaguuuagcuggaaaa

SEQ ID NO: 2765674 - RNA, 24 nt, Human
uccccuccucugcuugccaucccu

SEQ ID NO: 2765675 - RNA, 18 nt, Human
uccccuccucugcuugcc

SEQ ID NO: 2765676 - RNA, 15 nt, Human
uccccuccucugcuu

SEQ ID NO: 2765677 - RNA, 14 nt, Human
uccccuccucugcu

SEQ ID NO: 2765678 - RNA, 13 nt, Human
acuauucaaacag

SEQ ID NO: 2765679 - RNA, 14 nt, Human
acuauucaaacagu

SEQ ID NO: 2765680 - RNA, 16 nt, Human
acuauucaaacagucu

SEQ ID NO: 2765681 - RNA, 18 nt, Human
acuauucaaacagucuca

SEQ ID NO: 2765682 - RNA, 13 nt, Human
acacaacuauauu

SEQ ID NO: 2765683 - RNA, 13 nt, Human
uaggauguugaaa

SEQ ID NO: 2765684 - RNA, 14 nt, Human
uagaggguguguaa

SEQ ID NO: 2765685 - RNA, 18 nt, Human
acaaaguauuaagcauau

SEQ ID NO: 2765686 - RNA, 13 nt, Human
acaaaguauuaag

SEQ ID NO: 2765687 - RNA, 16 nt, Human
acaaaguauuaagcau

SEQ ID NO: 2765688 - RNA, 15 nt, Human
acaaaguauuaagca

SEQ ID NO: 2765689 - RNA, 14 nt, Human
acaaaaacacagca

SEQ ID NO: 2765690 - RNA, 15 nt, Human
acaaaaacacagcaa

SEQ ID NO: 2765691 - RNA, 13 nt, Human
acaaaaacacagc

SEQ ID NO: 2765692 - RNA, 13 nt, Human
uagacacacauga

SEQ ID NO: 2765693 - RNA, 15 nt, Human
uagaaacacaacuau

SEQ ID NO: 2765694 - RNA, 16 nt, Human
uagaacucccuuucaa

SEQ ID NO: 2765695 - RNA, 17 nt, Human
uagaacucccuuucaac

SEQ ID NO: 2765696 - RNA, 23 nt, Human
uaugcuauuucuauauuuucauu

SEQ ID NO: 2765697 - RNA, 22 nt, Human
uaugcuauuucuauauuuucau

SEQ ID NO: 2765698 - RNA, 18 nt, Human
uaugcuauuucuauauuu

SEQ ID NO: 2765699 - RNA, 16 nt, Human
uaugcuauuucuauau

SEQ ID NO: 2765700 - RNA, 15 nt, Human
uaugcuauuucuaua

SEQ ID NO: 2765701 - RNA, 14 nt, Human
uaugcuauuucuau

SEQ ID NO: 2765702 - RNA, 18 nt, Human
acagcaagggugauggga

SEQ ID NO: 2765703 - RNA, 21 nt, Human
uaugaaacuuguguaaauaca

SEQ ID NO: 2765704 - RNA, 19 nt, Human
uaugaaacuuguguaaaua

SEQ ID NO: 2765705 - RNA, 14 nt, Human
uaugaaacuugugu

SEQ ID NO: 2765706 - RNA, 23 nt, Human
acagcuguaugauucccagccag

SEQ ID NO: 2765707 - RNA, 20 nt, Human
acagcuguaugauucccagc

SEQ ID NO: 2765708 - RNA, 19 nt, Human
acagcuguaugauucccag

SEQ ID NO: 2765709 - RNA, 14 nt, Human
acagcuguaugauu

SEQ ID NO: 2765710 - RNA, 14 nt, Human
uaucacaaaucuua

SEQ ID NO: 2765711 - RNA, 16 nt, Human
uaucacaaaucuuaac

SEQ ID NO: 2765712 - RNA, 20 nt, Human
uaucacaaaucuuaacuuga

SEQ ID NO: 2765713 - RNA, 14 nt, Human
acagaccuuugaac

SEQ ID NO: 2765714 - RNA, 19 nt, Human
acagaaagcagaacaguga

SEQ ID NO: 2765715 - RNA, 18 nt, Human
uauagauuagaauucugu

SEQ ID NO: 2765716 - RNA, 12 nt, Human
uauaggaauuga

SEQ ID NO: 2765717 - RNA, 19 nt, Human
uauaggaauugacccacaa

SEQ ID NO: 2765718 - RNA, 16 nt, Human
uauaggugcuacaaaa

SEQ ID NO: 2765719 - RNA, 19 nt, Human
acacuaagagagaaugaga

SEQ ID NO: 2765720 - RNA, 13 nt, Human
acacucaaaucaa

SEQ ID NO: 2765721 - RNA, 17 nt, Human
acacucaaaucaagaaa

SEQ ID NO: 2765722 - RNA, 13 nt, Human
aauuacauuugua

SEQ ID NO: 2765723 - RNA, 14 nt, Human
aauuacauuuguau

SEQ ID NO: 2765724 - RNA, 16 nt, Human
uaccaugccauuuaaa

SEQ ID NO: 2765725 - RNA, 19 nt, Human
uaccagggacugaggggag

SEQ ID NO: 2765726 - RNA, 13 nt, Human
aauguucaucaau

SEQ ID NO: 2765727 - RNA, 20 nt, Human
aauguucaucaaugaaugaa

SEQ ID NO: 2765728 - RNA, 16 nt, Human
aauguucaucaaugaa

SEQ ID NO: 2765729 - RNA, 23 nt, Human
aaugauuaugaauuacauuugua

SEQ ID NO: 2765730 - RNA, 22 nt, Human
aaugagagacacacugaagaag

SEQ ID NO: 2765731 - RNA, 23 nt, Human
uaauuauaucugaggaauucugu

SEQ ID NO: 2765732 - RNA, 22 nt, Human
uaauuauaucugaggaauucug

SEQ ID NO: 2765733 - RNA, 21 nt, Human
uaauuauaucugaggaauucu

SEQ ID NO: 2765734 - RNA, 19 nt, Human
uaauuauaucugaggaauu

SEQ ID NO: 2765735 - RNA, 19 nt, Human
uaauuauaugcuauuucua

SEQ ID NO: 2765736 - RNA, 18 nt, Human
uaauuauaugcuauuucu

SEQ ID NO: 2765737 - RNA, 14 nt, Human
uaauuauaugcuau

SEQ ID NO: 2765738 - RNA, 16 nt, Human
aaugauuucauucaau

SEQ ID NO: 2765739 - RNA, 21 nt, Human
uaauuuuuauauuugaaauau

SEQ ID NO: 2765740 - RNA, 19 nt, Human
uaauuuuuauauuugaaau

SEQ ID NO: 2765741 - RNA, 18 nt, Human
uaauuuuuauauuugaaa

SEQ ID NO: 2765742 - RNA, 22 nt, Human
uaauuccguagguuauuuucag

SEQ ID NO: 2765743 - RNA, 14 nt, Human
uacaccauuaugug

SEQ ID NO: 2765744 - RNA, 13 nt, Human
uacagaauuuuau

SEQ ID NO: 2765745 - RNA, 17 nt, Human
uacagagacagaaagca

SEQ ID NO: 2765746 - RNA, 20 nt, Human
aauguaagggaaacugccag

SEQ ID NO: 2765747 - RNA, 21 nt, Human
aaugcuguauuuuaaaagaau

SEQ ID NO: 2765748 - RNA, 20 nt, Human
aaugcuguauuuuaaaagaa

SEQ ID NO: 2765749 - RNA, 22 nt, Human
aaugcuguauuuuaaaagaaug

SEQ ID NO: 2765750 - RNA, 21 nt, Human
uacaaaaaaaaaaaaaaauua

SEQ ID NO: 2765751 - RNA, 16 nt, Human
aaucagccuaguugau

SEQ ID NO: 2765752 - RNA, 22 nt, Human
uaaggacuucuuuaauuuugga

SEQ ID NO: 2765753 - RNA, 16 nt, Human
uaaggacuucuuuaau

SEQ ID NO: 2765754 - RNA, 15 nt, Human
uaaggacuucuuuaa

SEQ ID NO: 2765755 - RNA, 14 nt, Human
uaaggacuucuuua

SEQ ID NO: 2765756 - RNA, 19 nt, Human
uaaggaaaaguuuaauauu

SEQ ID NO: 2765757 - RNA, 17 nt, Human
uaaggaaaaguuuaaua

SEQ ID NO: 2765758 - RNA, 21 nt, Human
uaaggaaaaguuuaauauuaa

SEQ ID NO: 2765759 - RNA, 16 nt, Human
uaaggaaaaguuuaau

SEQ ID NO: 2765760 - RNA, 13 nt, Human
uaagcauauauuu

SEQ ID NO: 2765761 - RNA, 14 nt, Human
uaagcaaaauguga

SEQ ID NO: 2765762 - RNA, 21 nt, Human
uaagcaaaaugugauauguac

SEQ ID NO: 2765763 - RNA, 15 nt, Human
uaagcaaaaugugau

SEQ ID NO: 2765764 - RNA, 18 nt, Human
uaaguuuuuuuuuaaaaa

SEQ ID NO: 2765765 - RNA, 19 nt, Human
uaaggacuuguuagaucua

SEQ ID NO: 2765766 - RNA, 16 nt, Human
uaaggacuuguuagau

SEQ ID NO: 2765767 - RNA, 15 nt, Human
uaaggacuuguuaga

SEQ ID NO: 2765768 - RNA, 13 nt, Human
uaaggacuuguua

SEQ ID NO: 2765769 - RNA, 18 nt, Human
uaagguuaccuuuguucc

SEQ ID NO: 2765770 - RNA, 13 nt, Human
uaaguaaaaccac

SEQ ID NO: 2765771 - RNA, 15 nt, Human
uaaguaaaaccacag

SEQ ID NO: 2765772 - RNA, 16 nt, Human
uaaguaaaaccacagc

SEQ ID NO: 2765773 - RNA, 17 nt, Human
uaaguaaaaccacagca

SEQ ID NO: 2765774 - RNA, 18 nt, Human
uaaguaaaaccacagcag

SEQ ID NO: 2765775 - RNA, 19 nt, Human
uaaguaaaaccacagcagu

SEQ ID NO: 2765776 - RNA, 20 nt, Human
uaaguaaugauaacuggaaa

SEQ ID NO: 2765777 - RNA, 16 nt, Human
aaucccauuauucaaa

SEQ ID NO: 2765778 - RNA, 14 nt, Human
aaucccauuauuca

SEQ ID NO: 2765779 - RNA, 21 nt, Human
aaucccauuauucaaaguugc

SEQ ID NO: 2765780 - RNA, 20 nt, Human
aauccucaguuuuugugaaa

SEQ ID NO: 2765781 - RNA, 13 nt, Human
uaagaagugaaaa

SEQ ID NO: 2765782 - RNA, 21 nt, Human
uaacuuccuuggacucauuuu

SEQ ID NO: 2765783 - RNA, 15 nt, Human
uaacauguuaaacca

SEQ ID NO: 2765784 - RNA, 12 nt, Human
uaacauguuaaa

SEQ ID NO: 2765785 - RNA, 20 nt, Human
aauagcuagacuggugacug

SEQ ID NO: 2765786 - RNA, 14 nt, Human
aauagcuagacugg

SEQ ID NO: 2765787 - RNA, 21 nt, Human
aauagcuagacuggugacuga

SEQ ID NO: 2765788 - RNA, 19 nt, Human
aauagucaaauugugugaa

SEQ ID NO: 2765789 - RNA, 18 nt, Human
aauaccaugccauuuaaa

SEQ ID NO: 2765790 - RNA, 23 nt, Human
aauaccacaggaaccacaagacu

SEQ ID NO: 2765791 - RNA, 23 nt, Human
aauacaucccuuaccugggaaag

SEQ ID NO: 2765792 - RNA, 16 nt, Human
uaaaugugcuuuuaaa

SEQ ID NO: 2765793 - RNA, 13 nt, Human
aagcauuguaaau

SEQ ID NO: 2765794 - RNA, 16 nt, Human
aagcauuuagauguau

SEQ ID NO: 2765795 - RNA, 20 nt, Human
aagcucacagaccuuugaac

SEQ ID NO: 2765796 - RNA, 14 nt, Human
aagcuccagguaga

SEQ ID NO: 2765797 - RNA, 13 nt, Human
aagcuccagguag

SEQ ID NO: 2765798 - RNA, 20 nt, Human
guuauuauauuuacaaaugg

SEQ ID NO: 2765799 - RNA, 23 nt, Human
aagaggaaugaaguacucauaca

SEQ ID NO: 2765800 - RNA, 17 nt, Human
aagacugcauuauauuu

SEQ ID NO: 2765801 - RNA, 16 nt, Human
aagacugcacaucaaa

SEQ ID NO: 2765802 - RNA, 13 nt, Human
aagaugaaaauau

SEQ ID NO: 2765803 - RNA, 14 nt, Human
aagaugaaaauauu

SEQ ID NO: 2765804 - RNA, 13 nt, Human
aagauguagagga

SEQ ID NO: 2765805 - RNA, 20 nt, Human
uaaaagacagugaaagaaaa

SEQ ID NO: 2765806 - RNA, 16 nt, Human
uaaaagaauauuuuaa

SEQ ID NO: 2765807 - RNA, 23 nt, Human
uaaaagaauauuuuaacuuccuu

SEQ ID NO: 2765808 - RNA, 12 nt, Human
uaaaagaaugau

SEQ ID NO: 2765809 - RNA, 14 nt, Human
aaguaaugauaacu

SEQ ID NO: 2765810 - RNA, 15 nt, Human
aaguauuaagcauau

SEQ ID NO: 2765811 - RNA, 14 nt, Human
aaguauuaagcaua

SEQ ID NO: 2765812 - RNA, 18 nt, Human
aaguauuaagcauauauu

SEQ ID NO: 2765813 - RNA, 17 nt, Human
aaguauuaagcauauau

SEQ ID NO: 2765814 - RNA, 16 nt, Human
aaguauuaagcauaua

SEQ ID NO: 2765815 - RNA, 13 nt, Human
aaguauuagaaua

SEQ ID NO: 2765816 - RNA, 16 nt, Human
aagucuuucacauuua

SEQ ID NO: 2765817 - RNA, 22 nt, Human
aagucuuauauauuguagauaa

SEQ ID NO: 2765818 - RNA, 22 nt, Human
guugccuaaauccauuuggaaa

SEQ ID NO: 2765819 - RNA, 17 nt, Human
guugccuaaauccauuu

SEQ ID NO: 2765820 - RNA, 19 nt, Human
guuuaauauuaaagccaug

SEQ ID NO: 2765821 - RNA, 20 nt, Human
guuuaauauuaaagccaugu

SEQ ID NO: 2765822 - RNA, 14 nt, Human
aagguacuucaaau

SEQ ID NO: 2765823 - RNA, 19 nt, Human
aagggugaugggaaagcau

SEQ ID NO: 2765824 - RNA, 13 nt, Human
aagguacuucaaa

SEQ ID NO: 2765825 - RNA, 21 nt, Human
guauaaaauaauuuuuauauu

SEQ ID NO: 2765826 - RNA, 15 nt, Human
guauaaaauaauuuu

SEQ ID NO: 2765827 - RNA, 16 nt, Human
guauauuuuauaucaa

SEQ ID NO: 2765828 - RNA, 16 nt, Human
aaauguaagggaaacu

SEQ ID NO: 2765829 - RNA, 17 nt, Human
guaguguuggagaagaa

SEQ ID NO: 2765830 - RNA, 20 nt, Human
guaguguuggagaagaacug

SEQ ID NO: 2765831 - RNA, 15 nt, Human
aaauggguuuuacug

SEQ ID NO: 2765832 - RNA, 14 nt, Human
aaauggguuuuacu

SEQ ID NO: 2765833 - RNA, 14 nt, Human
aaauuguaauuaua

SEQ ID NO: 2765834 - RNA, 15 nt, Human
aaauuguaauuauau

SEQ ID NO: 2765835 - RNA, 16 nt, Human
gucaaauugugugaaa

SEQ ID NO: 2765836 - RNA, 18 nt, Human
guauguacuucaugcugu

SEQ ID NO: 2765837 - RNA, 16 nt, Human
aacagauaaauaguuu

SEQ ID NO: 2765838 - RNA, 22 nt, Human
aacagugauuaccagggacuga

SEQ ID NO: 2765839 - RNA, 15 nt, Human
aacagugauuaccag

SEQ ID NO: 2765840 - RNA, 15 nt, Human
aacacagcaagggug

SEQ ID NO: 2765841 - RNA, 22 nt, Human
aacaaugcuguauuuuaaaaga

SEQ ID NO: 2765842 - RNA, 17 nt, Human
aacaaugcuguauuuua

SEQ ID NO: 2765843 - RNA, 16 nt, Human
aacacaacuauauugu

SEQ ID NO: 2765844 - RNA, 15 nt, Human
aacacaacuauauug

SEQ ID NO: 2765845 - RNA, 15 nt, Human
aacaaugcuguauuu

SEQ ID NO: 2765846 - RNA, 14 nt, Human
aacaaugcuguauu

SEQ ID NO: 2765847 - RNA, 12 nt, Human
aacaauaaaaga

SEQ ID NO: 2765848 - RNA, 20 nt, Human
aaauuuuuucucuaggaaau

SEQ ID NO: 2765849 - RNA, 15 nt, Human
gugaacuugaaauuu

SEQ ID NO: 2765850 - RNA, 14 nt, Human
gugaacuugaaauu

SEQ ID NO: 2765851 - RNA, 21 nt, Human
gugagaugcuagaacucccuu

SEQ ID NO: 2765852 - RNA, 12 nt, Human
aacugaaaucau

SEQ ID NO: 2765853 - RNA, 19 nt, Human
aacugcacugucaagauga

SEQ ID NO: 2765854 - RNA, 19 nt, Human
aacuggacugguucaaaug

SEQ ID NO: 2765855 - RNA, 17 nt, Human
aacugggacaggggaga

SEQ ID NO: 2765856 - RNA, 17 nt, Human
gugaugggaaagcauug

SEQ ID NO: 2765857 - RNA, 18 nt, Human
aacuuccagauccuggaa

SEQ ID NO: 2765858 - RNA, 21 nt, Human
aacuucagcgguuuauauaag

SEQ ID NO: 2765859 - RNA, 18 nt, Human
aacccaaguccaagcaua

SEQ ID NO: 2765860 - RNA, 23 nt, Human
aacccaaauguucaucaaugaau

SEQ ID NO: 2765861 - RNA, 16 nt, Human
aaccucuuugucuaca

SEQ ID NO: 2765862 - RNA, 18 nt, Human
aaccugagccccaaaagg

SEQ ID NO: 2765863 - RNA, 20 nt, Human
aaccugagccccaaaaggua

SEQ ID NO: 2765864 - RNA, 16 nt, Human
gucuuucacauuuaaa

SEQ ID NO: 2765865 - RNA, 18 nt, Human
aaccuugaaaacuuuaug

SEQ ID NO: 2765866 - RNA, 23 nt, Human
aacuaucucauuuccaagcaagu

SEQ ID NO: 2765867 - RNA, 21 nt, Human
aacuagaguuuagcuggaaaa

SEQ ID NO: 2765868 - RNA, 21 nt, Human
cuggaaaucaggguuaguauu

SEQ ID NO: 2765869 - RNA, 10 nt, Human
cugggacagg

SEQ ID NO: 2765870 - RNA, 18 nt, Human
cuggugacugauucuuca

SEQ ID NO: 2765871 - RNA, 22 nt, Human
cugggcagcugccuccccuccu

SEQ ID NO: 2765872 - RNA, 21 nt, Human
cugggcagcugccuccccucc

SEQ ID NO: 2765873 - RNA, 20 nt, Human
cugggcagcugccuccccuc

SEQ ID NO: 2765874 - RNA, 19 nt, Human
cugggcagcugccuccccu

SEQ ID NO: 2765875 - RNA, 16 nt, Human
cugggcagcugccucc

SEQ ID NO: 2765876 - RNA, 14 nt, Human
cuguacuuuuuggc

SEQ ID NO: 2765877 - RNA, 21 nt, Human
cugucagcuccccucggagaa

SEQ ID NO: 2765878 - RNA, 23 nt, Human
cugucagcuccccucggagaaga

SEQ ID NO: 2765879 - RNA, 18 nt, Human
cugugaacuugaaauuug

SEQ ID NO: 2765880 - RNA, 16 nt, Human
cugugagaugcuagaa

SEQ ID NO: 2765881 - RNA, 20 nt, Human
cuuuguauagaaccucuuug

SEQ ID NO: 2765882 - RNA, 11 nt, Human
cuuuguauaga

SEQ ID NO: 2765883 - RNA, 19 nt, Human
gaaaucaaauaugcaaagc

SEQ ID NO: 2765884 - RNA, 20 nt, Human
gaaaucaaauaugcaaagca

SEQ ID NO: 2765885 - RNA, 22 nt, Human
gaaauauuuauuuuaauaaugu

SEQ ID NO: 2765886 - RNA, 18 nt, Human
gaaauauuuauuuuaaua

SEQ ID NO: 2765887 - RNA, 18 nt, Human
gaaaucaaauaugcaaag

SEQ ID NO: 2765888 - RNA, 17 nt, Human
gaaaucaaauaugcaaa

SEQ ID NO: 2765889 - RNA, 17 nt, Human
gaaauauuuauuuuaau

SEQ ID NO: 2765890 - RNA, 14 nt, Human
gaaagacuauucaa

SEQ ID NO: 2765891 - RNA, 15 nt, Human
gaaagacuauucaaa

SEQ ID NO: 2765892 - RNA, 17 nt, Human
gaaagacuauucaaaca

SEQ ID NO: 2765893 - RNA, 15 nt, Human
cuucacuguaaaaua

SEQ ID NO: 2765894 - RNA, 22 nt, Human
cuucuaaguaaaaccacagcag

SEQ ID NO: 2765895 - RNA, 23 nt, Human
cuucuaaguaaaaccacagcagu

SEQ ID NO: 2765896 - RNA, 12 nt, Human
cuugaugaagaa

SEQ ID NO: 2765897 - RNA, 23 nt, Human
cuugccuuuuucauuauuuuauu

SEQ ID NO: 2765898 - RNA, 22 nt, Human
cuugccuuuuucauuauuuuau

SEQ ID NO: 2765899 - RNA, 20 nt, Human
cuugccuuuuucauuauuuu

SEQ ID NO: 2765900 - RNA, 15 nt, Human
cuugccuuuuucauu

SEQ ID NO: 2765901 - RNA, 14 nt, Human
cuugccuuuuucau

SEQ ID NO: 2765902 - RNA, 13 nt, Human
cuugaugaagaag

SEQ ID NO: 2765903 - RNA, 20 nt, Human
gaaugagagacacacugaag

SEQ ID NO: 2765904 - RNA, 23 nt, Human
gaaugagagacacacugaagaag

SEQ ID NO: 2765905 - RNA, 22 nt, Human
gaaugagagacacacugaagaa

SEQ ID NO: 2765906 - RNA, 13 nt, Human
gaauuuuguguua

SEQ ID NO: 2765907 - RNA, 22 nt, Human
gaauuuuguguuagagauuuuu

SEQ ID NO: 2765908 - RNA, 16 nt, Human
gaauuuuguguuagag

SEQ ID NO: 2765909 - RNA, 11 nt, Human
gaauuaguuuu

SEQ ID NO: 2765910 - RNA, 12 nt, Human
gacacacaugaa

SEQ ID NO: 2765911 - RNA, 13 nt, Human
gacacacugaaga

SEQ ID NO: 2765912 - RNA, 14 nt, Human
gacagugaaagaaa

SEQ ID NO: 2765913 - RNA, 17 nt, Human
gacagucaccucaugga

SEQ ID NO: 2765914 - RNA, 20 nt, Human
gacaguauggcagcuuuccu

SEQ ID NO: 2765915 - RNA, 16 nt, Human
gacacuuaaaaauggu

SEQ ID NO: 2765916 - RNA, 16 nt, Human
gacucuuaagaagacu

SEQ ID NO: 2765917 - RNA, 15 nt, Human
gacucuuaagaagac

SEQ ID NO: 2765918 - RNA, 17 nt, Human
gacucuuaagaagacug

SEQ ID NO: 2765919 - RNA, 22 nt, Human
gacuauucaaacagucucagga

SEQ ID NO: 2765920 - RNA, 15 nt, Human
gagaaucacuugaac

SEQ ID NO: 2765921 - RNA, 14 nt, Human
gagaaucacuugaa

SEQ ID NO: 2765922 - RNA, 18 nt, Human
gacuggugacugauucuu

SEQ ID NO: 2765923 - RNA, 15 nt, Human
gacuggugacugauu

SEQ ID NO: 2765924 - RNA, 12 nt, Human
gacuggugacug

SEQ ID NO: 2765925 - RNA, 14 nt, Human
gcacaguuuucuga

SEQ ID NO: 2765926 - RNA, 17 nt, Human
gcacaguuuucugagaa

SEQ ID NO: 2765927 - RNA, 18 nt, Human
gcacaguuuucugagaaa

SEQ ID NO: 2765928 - RNA, 19 nt, Human
gcagggacuugaacccaua

SEQ ID NO: 2765929 - RNA, 22 nt, Human
gcagcugccuccccuccucugc

SEQ ID NO: 2765930 - RNA, 18 nt, Human
gcagcugccuccccuccu

SEQ ID NO: 2765931 - RNA, 17 nt, Human
gcagcugccuccccucc

SEQ ID NO: 2765932 - RNA, 16 nt, Human
gcagcugccuccccuc

SEQ ID NO: 2765933 - RNA, 15 nt, Human
gcagcugccuccccu

SEQ ID NO: 2765934 - RNA, 13 nt, Human
gcagcugccuccc

SEQ ID NO: 2765935 - RNA, 12 nt, Human
gcagcugccucc

SEQ ID NO: 2765936 - RNA, 11 nt, Human
gcagcugccuc

SEQ ID NO: 2765937 - RNA, 23 nt, Human
gcauaacauaaaucugugaacuu

SEQ ID NO: 2765938 - RNA, 21 nt, Human
gcauaacauaaaucugugaac

SEQ ID NO: 2765939 - RNA, 15 nt, Human
gcauaacauaaaucu

SEQ ID NO: 2765940 - RNA, 14 nt, Human
gaugugaacacauc

SEQ ID NO: 2765941 - RNA, 16 nt, Human
gaugugaacacaucag

SEQ ID NO: 2765942 - RNA, 23 nt, Human
gauuagaauucuguauagauuag

SEQ ID NO: 2765943 - RNA, 15 nt, Human
gauuagaauucugua

SEQ ID NO: 2765944 - RNA, 14 nt, Human
gauuagaauucugu

SEQ ID NO: 2765945 - RNA, 14 nt, Human
gauuaccagggacu

SEQ ID NO: 2765946 - RNA, 18 nt, Human
gauuagagaguguugaaa

SEQ ID NO: 2765947 - RNA, 14 nt, Human
gauuagagaguguu

SEQ ID NO: 2765948 - RNA, 17 nt, Human
gauuagggagagaagau

SEQ ID NO: 2765949 - RNA, 16 nt, Human
gauuauucacugauuu

SEQ ID NO: 2765950 - RNA, 15 nt, Human
gauuauucacugauu

SEQ ID NO: 2765951 - RNA, 13 nt, Human
gauuauucacuga

SEQ ID NO: 2765952 - RNA, 22 nt, Human
gauccaguuuuguuuggaccaa

SEQ ID NO: 2765953 - RNA, 17 nt, Human
gauccaguuuuguuugg

SEQ ID NO: 2765954 - RNA, 11 nt, Human
gauccaguuuu

SEQ ID NO: 2765955 - RNA, 20 nt, Human
gauauguaccuaacgaagua

SEQ ID NO: 2765956 - RNA, 16 nt, Human
gaguuuagcuggaaaa

SEQ ID NO: 2765957 - RNA, 16 nt, Human
gaguuuaaauuguaau

SEQ ID NO: 2765958 - RNA, 20 nt, Human
gcuccacuuggucugugaga

SEQ ID NO: 2765959 - RNA, 16 nt, Human
gcugaaacaacaaaua

SEQ ID NO: 2765960 - RNA, 15 nt, Human
gcucugcccauccug

SEQ ID NO: 2765961 - RNA, 21 nt, Human
gcucugcccauccugccccug

SEQ ID NO: 2765962 - RNA, 12 nt, Human
gcuguauuuuaa

SEQ ID NO: 2765963 - RNA, 13 nt, Human
gcuguauuuuaaa

SEQ ID NO: 2765964 - RNA, 19 nt, Human
gcuuccuggcaauagucaa

SEQ ID NO: 2765965 - RNA, 11 nt, Human
gcuuuucugau

SEQ ID NO: 2765966 - RNA, 16 nt, Human
gcuuuucugauccagu

SEQ ID NO: 2765967 - RNA, 15 nt, Human
gcuuuucugauccag

SEQ ID NO: 2765968 - RNA, 12 nt, Human
gcuuuucugauc

SEQ ID NO: 2765969 - RNA, 13 nt, Human
ggaaaucuuuaaa

SEQ ID NO: 2765970 - RNA, 20 nt, Human
gccuccauccugaggcucca

SEQ ID NO: 2765971 - RNA, 16 nt, Human
gccuccauccugaggc

SEQ ID NO: 2765972 - RNA, 15 nt, Human
gccuccauccugagg

SEQ ID NO: 2765973 - RNA, 18 nt, Human
gcguugaaauuguaauua

SEQ ID NO: 2765974 - RNA, 15 nt, Human
gcuacugucagcucc

SEQ ID NO: 2765975 - RNA, 17 nt, Human
gcuacuugggaggcuga

SEQ ID NO: 2765976 - RNA, 24 nt, Human
gcguugaaauuguaauuauaucug

SEQ ID NO: 2765977 - RNA, 23 nt, Human
gcguugaaauuguaauuauaucu

SEQ ID NO: 2765978 - RNA, 18 nt, Human
gcuacaaaaacacagcaa

SEQ ID NO: 2765979 - RNA, 19 nt, Human
gcuacaaaaacacagcaag

SEQ ID NO: 2765980 - RNA, 17 nt, Human
gcuacaaaaacacagca

SEQ ID NO: 2765981 - RNA, 22 nt, Human
gccaugugcuaguaauuggaaa

SEQ ID NO: 2765982 - RNA, 22 nt, Human
gccaguuauggcuauaggugcu

SEQ ID NO: 2765983 - RNA, 21 nt, Human
gccagcaguucagagcugccc

SEQ ID NO: 2765984 - RNA, 20 nt, Human
gccagcaguucagagcugcc

SEQ ID NO: 2765985 - RNA, 19 nt, Human
gccagcaguucagagcugc

SEQ ID NO: 2765986 - RNA, 14 nt, Human
gccagcaguucaga

SEQ ID NO: 2765987 - RNA, 13 nt, Human
gccagcaguucag

SEQ ID NO: 2765988 - RNA, 12 nt, Human
ggauaaaugcca

SEQ ID NO: 2765989 - RNA, 22 nt, Human
ggauaauaaggaaaaguuuaau

SEQ ID NO: 2765990 - RNA, 12 nt, Human
ggauggcaagau

SEQ ID NO: 2765991 - RNA, 23 nt, Human
ggccuucggccuccauccugagg

SEQ ID NO: 2765992 - RNA, 22 nt, Human
ggccuucggccuccauccugag

SEQ ID NO: 2765993 - RNA, 14 nt, Human
aaagacuauucaaa

SEQ ID NO: 2765994 - RNA, 15 nt, Human
aaagacuauucaaac

SEQ ID NO: 2765995 - RNA, 17 nt, Human
aaagcagggacuugaac

SEQ ID NO: 2765996 - RNA, 16 nt, Human
ggugugaccacugcag

SEQ ID NO: 2765997 - RNA, 16 nt, Human
gguuuagaaagcuugc

SEQ ID NO: 2765998 - RNA, 13 nt, Human
aaaguugaauuua

SEQ ID NO: 2765999 - RNA, 12 nt, Human
aaaguugaauuu

SEQ ID NO: 2766000 - RNA, 22 nt, Human
aaaguugaauuuauuggcuuuu

SEQ ID NO: 2766001 - RNA, 16 nt, Human
aaaguugaauuuauug

SEQ ID NO: 2766002 - RNA, 19 nt, Human
aaaguuuaauauuaaagcc

SEQ ID NO: 2766003 - RNA, 16 nt, Human
aaaguuuaauauuaaa

SEQ ID NO: 2766004 - RNA, 14 nt, Human
aaaguuuaauauua

SEQ ID NO: 2766005 - RNA, 22 nt, Human
aaaguuuaauauuaaagccaug

SEQ ID NO: 2766006 - RNA, 21 nt, Human
aaaguuuaauauuaaagccau

SEQ ID NO: 2766007 - RNA, 20 nt, Human
aaaguuuaauauuaaagcca

SEQ ID NO: 2766008 - RNA, 20 nt, Human
aaauaauuuuuauauuugaa

SEQ ID NO: 2766009 - RNA, 18 nt, Human
aaauaauuuuuauauuug

SEQ ID NO: 2766010 - RNA, 15 nt, Human
aaauaauuuuuauau

SEQ ID NO: 2766011 - RNA, 15 nt, Human
aaaaugugauaugua

SEQ ID NO: 2766012 - RNA, 22 nt, Human
aaaauuuuuucucuaggaaaua

SEQ ID NO: 2766013 - RNA, 20 nt, Human
aaacaagcacuaaacaaaga

SEQ ID NO: 2766014 - RNA, 20 nt, Human
aaacagucucaggaaaucaa

SEQ ID NO: 2766015 - RNA, 15 nt, Human
gggcgugguggugag

SEQ ID NO: 2766016 - RNA, 19 nt, Human
aaaaguauguuagugcaaa

SEQ ID NO: 2766017 - RNA, 17 nt, Human
gggauuguaaaauggug

SEQ ID NO: 2766018 - RNA, 16 nt, Human
gggauuguaaaauggu

SEQ ID NO: 2766019 - RNA, 13 nt, Human
aaaaccacagcag

SEQ ID NO: 2766020 - RNA, 17 nt, Human
aaaagaugaaaauauuu

SEQ ID NO: 2766021 - RNA, 13 nt, Human
aaaacucauuuuu

SEQ ID NO: 2766022 - RNA, 22 nt, Human
aaaaauggaacauaaaauacaa

SEQ ID NO: 2766023 - RNA, 12 nt, Human
aaaaccacagca

SEQ ID NO: 2766024 - RNA, 14 nt, Human
aaaaauauuuuaug

SEQ ID NO: 2766025 - RNA, 19 nt, Human
gggacauuugcucauggaa

SEQ ID NO: 2766026 - RNA, 21 nt, Human
gggacauuugcucauggaauu

SEQ ID NO: 2766027 - RNA, 20 nt, Human
gggacauuugcucauggaau

SEQ ID NO: 2766028 - RNA, 20 nt, Human
cagccagacuggcacaguuu

SEQ ID NO: 2766029 - RNA, 22 nt, Human
cagcaguucagagcugcccucu

SEQ ID NO: 2766030 - RNA, 21 nt, Human
cagcaguucagagcugcccuc

SEQ ID NO: 2766031 - RNA, 20 nt, Human
cagcaguucagagcugcccu

SEQ ID NO: 2766032 - RNA, 19 nt, Human
cagcaguucagagcugccc

SEQ ID NO: 2766033 - RNA, 18 nt, Human
cagcaguucagagcugcc

SEQ ID NO: 2766034 - RNA, 19 nt, Human
cagccccgugggguuccuc

SEQ ID NO: 2766035 - RNA, 23 nt, Human
cagccugagcgacagugagacuc

SEQ ID NO: 2766036 - RNA, 22 nt, Human
cagccugagcgacagugagacu

SEQ ID NO: 2766037 - RNA, 22 nt, Human
caguauuguacaaaguauuaag

SEQ ID NO: 2766038 - RNA, 19 nt, Human
cagggaggacgcucucugg

SEQ ID NO: 2766039 - RNA, 22 nt, Human
cagggaggacgcucucuggccu

SEQ ID NO: 2766040 - RNA, 16 nt, Human
cagcuuauucacaaga

SEQ ID NO: 2766041 - RNA, 19 nt, Human
caggaaaucaaauaugcaa

SEQ ID NO: 2766042 - RNA, 21 nt, Human
caggaaaucaaauaugcaaag

SEQ ID NO: 2766043 - RNA, 24 nt, Human
caggacagcccuucuuuccacaga

SEQ ID NO: 2766044 - RNA, 23 nt, Human
caggacagcccuucuuuccacag

SEQ ID NO: 2766045 - RNA, 18 nt, Human
ccaaauguucaucaauga

SEQ ID NO: 2766046 - RNA, 20 nt, Human
ccaaaaaccaguauuguaca

SEQ ID NO: 2766047 - RNA, 19 nt, Human
ccaaaaaccaguauuguac

SEQ ID NO: 2766048 - RNA, 16 nt, Human
ccaaaaaccaguauug

SEQ ID NO: 2766049 - RNA, 21 nt, Human
cauucuccuaucaccugucuu

SEQ ID NO: 2766050 - RNA, 15 nt, Human
cauuaggauggcuag

SEQ ID NO: 2766051 - RNA, 17 nt, Human
cauagauucccugagca

SEQ ID NO: 2766052 - RNA, 18 nt, Human
cauagauucccugagcag

SEQ ID NO: 2766053 - RNA, 20 nt, Human
cauagcagcuuauucacaag

SEQ ID NO: 2766054 - RNA, 17 nt, Human
caucagcugcugaaaca

SEQ ID NO: 2766055 - RNA, 18 nt, Human
caucagcugcugaaacaa

SEQ ID NO: 2766056 - RNA, 15 nt, Human
caucagcugcugaaa

SEQ ID NO: 2766057 - RNA, 13 nt, Human
caucagcugcuga

SEQ ID NO: 2766058 - RNA, 20 nt, Human
caucagcuugcccuguuaaa

SEQ ID NO: 2766059 - RNA, 16 nt, Human
caugaauuaguuuuau

SEQ ID NO: 2766060 - RNA, 22 nt, Human
cacugguucuucuuggucucag

SEQ ID NO: 2766061 - RNA, 16 nt, Human
cacuugucaauaaaau

SEQ ID NO: 2766062 - RNA, 19 nt, Human
cacuuguguuuugcaagcc

SEQ ID NO: 2766063 - RNA, 22 nt, Human
cacuuguguuuugcaagccaga

SEQ ID NO: 2766064 - RNA, 17 nt, Human
cacuuguguuuugcaag

SEQ ID NO: 2766065 - RNA, 21 nt, Human
cacugcagaagacaguauggc

SEQ ID NO: 2766066 - RNA, 20 nt, Human
cacuagggcagggacaggau

SEQ ID NO: 2766067 - RNA, 21 nt, Human
cacuagggcagggacaggaua

SEQ ID NO: 2766068 - RNA, 14 nt, Human
caaguccaagcaua

SEQ ID NO: 2766069 - RNA, 15 nt, Human
caauucuugccaaau

SEQ ID NO: 2766070 - RNA, 17 nt, Human
caaugcuguauuuuaaa

SEQ ID NO: 2766071 - RNA, 16 nt, Human
caaugcuguauuuuaa

SEQ ID NO: 2766072 - RNA, 15 nt, Human
caaugcuguauuuua

SEQ ID NO: 2766073 - RNA, 18 nt, Human
cacaagacugcacaucaa

SEQ ID NO: 2766074 - RNA, 22 nt, Human
cacacaugaaguccaagcauuu

SEQ ID NO: 2766075 - RNA, 17 nt, Human
cacacaugaaguccaag

SEQ ID NO: 2766076 - RNA, 21 nt, Human
cacagccucuuagaugcaguu

SEQ ID NO: 2766077 - RNA, 17 nt, Human
cacagccucuuagaugc

SEQ ID NO: 2766078 - RNA, 14 nt, Human
auuguaauuauauc

SEQ ID NO: 2766079 - RNA, 14 nt, Human
auuguaaaauggug

SEQ ID NO: 2766080 - RNA, 13 nt, Human
auuguaaaauggu

SEQ ID NO: 2766081 - RNA, 13 nt, Human
auuguaauuauau

SEQ ID NO: 2766082 - RNA, 23 nt, Human
auuguaauaggcguaacuaauuu

SEQ ID NO: 2766083 - RNA, 16 nt, Human
auuacaguauaauuaa

SEQ ID NO: 2766084 - RNA, 15 nt, Human
auuacaguauaauua

SEQ ID NO: 2766085 - RNA, 14 nt, Human
auuacaguauaauu

SEQ ID NO: 2766086 - RNA, 12 nt, Human
auuacaguauaa

SEQ ID NO: 2766087 - RNA, 22 nt, Human
auucauagcagcuuauucacaa

SEQ ID NO: 2766088 - RNA, 19 nt, Human
auucauagcagcuuauuca

SEQ ID NO: 2766089 - RNA, 17 nt, Human
auucaaaguugccuaaa

SEQ ID NO: 2766090 - RNA, 22 nt, Human
auucaaaguugccuaaauccau

SEQ ID NO: 2766091 - RNA, 21 nt, Human
auucaaaguugccuaaaucca

SEQ ID NO: 2766092 - RNA, 20 nt, Human
auucaaaguugccuaaaucc

SEQ ID NO: 2766093 - RNA, 18 nt, Human
auucaaaguugccuaaau

SEQ ID NO: 2766094 - RNA, 18 nt, Human
auuaugaauuacauuugu

SEQ ID NO: 2766095 - RNA, 19 nt, Human
auucacaagacccaaaagg

SEQ ID NO: 2766096 - RNA, 16 nt, Human
auuagggagagaagau

SEQ ID NO: 2766097 - RNA, 15 nt, Human
auuaugaaacuugug

SEQ ID NO: 2766098 - RNA, 14 nt, Human
auuaugaaacuugu

SEQ ID NO: 2766099 - RNA, 21 nt, Human
auuaugaaacuuguguaaaua

SEQ ID NO: 2766100 - RNA, 20 nt, Human
auuaugaaacuuguguaaau

SEQ ID NO: 2766101 - RNA, 18 nt, Human
auuaugaaacuuguguaa

SEQ ID NO: 2766102 - RNA, 17 nt, Human
auuaugaauuacauuug

SEQ ID NO: 2766103 - RNA, 14 nt, Human
auuaugaauuacau

SEQ ID NO: 2766104 - RNA, 14 nt, Human
auuuuaugauccag

SEQ ID NO: 2766105 - RNA, 16 nt, Human
auuuuaugauccagca

SEQ ID NO: 2766106 - RNA, 15 nt, Human
auuuuaugauccagc

SEQ ID NO: 2766107 - RNA, 17 nt, Human
auuuuauagcuacuaau

SEQ ID NO: 2766108 - RNA, 19 nt, Human
auuuuauagcuacuaauuu

SEQ ID NO: 2766109 - RNA, 13 nt, Human
auuuggaaaucuu

SEQ ID NO: 2766110 - RNA, 12 nt, Human
auuuggaaaucu

SEQ ID NO: 2766111 - RNA, 11 nt, Human
auuuggaaauc

SEQ ID NO: 2766112 - RNA, 17 nt, Human
auuugcucauggaauug

SEQ ID NO: 2766113 - RNA, 14 nt, Human
auuugcucauggaa

SEQ ID NO: 2766114 - RNA, 15 nt, Human
caaaaggcagaagca

SEQ ID NO: 2766115 - RNA, 20 nt, Human
caaaaaaaaaaaaaaauuag

SEQ ID NO: 2766116 - RNA, 20 nt, Human
caaagcacugacuucuaagu

SEQ ID NO: 2766117 - RNA, 22 nt, Human
caaagcacugacuucuaaguaa

SEQ ID NO: 2766118 - RNA, 15 nt, Human
caacacgagcaggcu

SEQ ID NO: 2766119 - RNA, 23 nt, Human
caacacgagcaggcuacugucag

SEQ ID NO: 2766120 - RNA, 16 nt, Human
ccguagguuauuuuca

SEQ ID NO: 2766121 - RNA, 20 nt, Human
ccucauguccacugguucuu

SEQ ID NO: 2766122 - RNA, 15 nt, Human
ccucauguccacugg

SEQ ID NO: 2766123 - RNA, 13 nt, Human
ccucugcuugcca

SEQ ID NO: 2766124 - RNA, 16 nt, Human
ccagcagauuauucac

SEQ ID NO: 2766125 - RNA, 22 nt, Human
ccagcagauuauucacugauuu

SEQ ID NO: 2766126 - RNA, 21 nt, Human
ccagcagauuauucacugauu

SEQ ID NO: 2766127 - RNA, 15 nt, Human
ccagauccuggaaau

SEQ ID NO: 2766128 - RNA, 23 nt, Human
cccgggaggcagagguugcagug

SEQ ID NO: 2766129 - RNA, 23 nt, Human
cccauuguggucacaggaaguag

SEQ ID NO: 2766130 - RNA, 22 nt, Human
cccauuguggucacaggaagua

SEQ ID NO: 2766131 - RNA, 20 nt, Human
cccagccagcaguucagagc

SEQ ID NO: 2766132 - RNA, 17 nt, Human
cccagccagcaguucag

SEQ ID NO: 2766133 - RNA, 16 nt, Human
cccagccagcaguuca

SEQ ID NO: 2766134 - RNA, 23 nt, Human
cuaguugaucagcuuauugucua

SEQ ID NO: 2766135 - RNA, 19 nt, Human
cuagaacucccuuucaaca

SEQ ID NO: 2766136 - RNA, 18 nt, Human
cuagaacucccuuucaac

SEQ ID NO: 2766137 - RNA, 17 nt, Human
cuagaacucccuuucaa

SEQ ID NO: 2766138 - RNA, 16 nt, Human
cuagaacucccuuuca

SEQ ID NO: 2766139 - RNA, 13 nt, Human
cuaaacuuuucug

SEQ ID NO: 2766140 - RNA, 15 nt, Human
cuacaugagguacug

SEQ ID NO: 2766141 - RNA, 23 nt, Human
cuaagugaaauaagccagacauc

SEQ ID NO: 2766142 - RNA, 20 nt, Human
cuaagugaaauaagccagac

SEQ ID NO: 2766143 - RNA, 17 nt, Human
ccuuuuucauuauuuua

SEQ ID NO: 2766144 - RNA, 15 nt, Human
ccuuuuucauuauuu

SEQ ID NO: 2766145 - RNA, 16 nt, Human
cgacagugagacucug

SEQ ID NO: 2766146 - RNA, 15 nt, Human
cgacagugagacucu

SEQ ID NO: 2766147 - RNA, 16 nt, Human
cucccugcaauaaaau

SEQ ID NO: 2766148 - RNA, 14 nt, Human
cucccugcaauaaa

SEQ ID NO: 2766149 - RNA, 15 nt, Human
cucuuagaugcaguu

SEQ ID NO: 2766150 - RNA, 11 nt, Human
cucucuggccu

SEQ ID NO: 2766151 - RNA, 12 nt, Human
cucucuggccuu

SEQ ID NO: 2766152 - RNA, 20 nt, Human
cucuuagaugcaguucugaa

SEQ ID NO: 2766153 - RNA, 21 nt, Human
uguuaaaagaugaaaauauuu

SEQ ID NO: 2766154 - RNA, 22 nt, Human
ugugugaaagguacuucaaauc

SEQ ID NO: 2766155 - RNA, 21 nt, Human
ugugugaaagguacuucaaau

SEQ ID NO: 2766156 - RNA, 20 nt, Human
ugugugaaagguacuucaaa

SEQ ID NO: 2766157 - RNA, 19 nt, Human
uguguuuugcaagccagau

SEQ ID NO: 2766158 - RNA, 13 nt, Human
uguguuuugcaag

SEQ ID NO: 2766159 - RNA, 17 nt, Human
uguuuaaaaucauuucu

SEQ ID NO: 2766160 - RNA, 18 nt, Human
uguuuaaaaucauuucug

SEQ ID NO: 2766161 - RNA, 14 nt, Human
uguuuaaaaucauu

SEQ ID NO: 2766162 - RNA, 20 nt, Human
uguuggagaagaacugaaau

SEQ ID NO: 2766163 - RNA, 19 nt, Human
uguuggagaagaacugaaa

SEQ ID NO: 2766164 - RNA, 14 nt, Human
uguuggagaagaac

SEQ ID NO: 2766165 - RNA, 17 nt, Human
uguuggagaagaacuga

SEQ ID NO: 2766166 - RNA, 16 nt, Human
uguuggagaagaacug

SEQ ID NO: 2766167 - RNA, 20 nt, Human
uguugacaugggacauuugc

SEQ ID NO: 2766168 - RNA, 11 nt, Human
uuaauauuaaa

SEQ ID NO: 2766169 - RNA, 17 nt, Human
uuaauauuaaagccaug

SEQ ID NO: 2766170 - RNA, 16 nt, Human
uuaauauuaaagccau

SEQ ID NO: 2766171 - RNA, 14 nt, Human
uuaauauuaaagcc

SEQ ID NO: 2766172 - RNA, 13 nt, Human
uuaauauuaaagc

SEQ ID NO: 2766173 - RNA, 23 nt, Human
uuaagcauauauuuuuauauuua

SEQ ID NO: 2766174 - RNA, 19 nt, Human
uuaauauuaaagccauguu

SEQ ID NO: 2766175 - RNA, 18 nt, Human
uuaauauuaaagccaugu

SEQ ID NO: 2766176 - RNA, 12 nt, Human
uuacagaagccc

SEQ ID NO: 2766177 - RNA, 20 nt, Human
uuacauuuguauaaaauaau

SEQ ID NO: 2766178 - RNA, 23 nt, Human
uguuucuguacuuuuuggcauaa

SEQ ID NO: 2766179 - RNA, 22 nt, Human
uguuucuguacuuuuuggcaua

SEQ ID NO: 2766180 - RNA, 11 nt, Human
uguuucuguac

SEQ ID NO: 2766181 - RNA, 15 nt, Human
uuaaaaaaaaaauug

SEQ ID NO: 2766182 - RNA, 22 nt, Human
uuaaaaaaaaaccugagcccca

SEQ ID NO: 2766183 - RNA, 14 nt, Human
uuaaagccauguuu

SEQ ID NO: 2766184 - RNA, 12 nt, Human
uuaaagccaugu

SEQ ID NO: 2766185 - RNA, 20 nt, Human
uuaaagccauguuuauuaca

SEQ ID NO: 2766186 - RNA, 18 nt, Human
uuaaagccauguuuauua

SEQ ID NO: 2766187 - RNA, 18 nt, Human
uuaaaauacacacucaaa

SEQ ID NO: 2766188 - RNA, 15 nt, Human
uguaccgcaauguga

SEQ ID NO: 2766189 - RNA, 16 nt, Human
uguaccgcaaugugac

SEQ ID NO: 2766190 - RNA, 22 nt, Human
uguaguguuggagaagaacuga

SEQ ID NO: 2766191 - RNA, 21 nt, Human
uguauugugcgcuaaacuuuu

SEQ ID NO: 2766192 - RNA, 15 nt, Human
uguaugauucccagc

SEQ ID NO: 2766193 - RNA, 19 nt, Human
ugugcuaguaauuggaaag

SEQ ID NO: 2766194 - RNA, 19 nt, Human
uggaacgcguugaaauugu

SEQ ID NO: 2766195 - RNA, 17 nt, Human
uggaacgcguugaaauu

SEQ ID NO: 2766196 - RNA, 18 nt, Human
uggaacgcguugaaauug

SEQ ID NO: 2766197 - RNA, 22 nt, Human
uggaauaauccuaaacauauga

SEQ ID NO: 2766198 - RNA, 23 nt, Human
uggaaacuucagcgguuuauaua

SEQ ID NO: 2766199 - RNA, 20 nt, Human
uggaacauaaaauacaaugu

SEQ ID NO: 2766200 - RNA, 21 nt, Human
uggaacauaaaauacaauguu

SEQ ID NO: 2766201 - RNA, 11 nt, Human
uggagggaagc

SEQ ID NO: 2766202 - RNA, 12 nt, Human
uggggauucuua

SEQ ID NO: 2766203 - RNA, 16 nt, Human
uggggauucuuaaagu

SEQ ID NO: 2766204 - RNA, 13 nt, Human
uggggauucuuaa

SEQ ID NO: 2766205 - RNA, 20 nt, Human
uggggauucuuaaaguugaa

SEQ ID NO: 2766206 - RNA, 18 nt, Human
uggggauucuuaaaguug

SEQ ID NO: 2766207 - RNA, 21 nt, Human
ugguauguuuucaggcuagau

SEQ ID NO: 2766208 - RNA, 16 nt, Human
uggcuuccuggcaaua

SEQ ID NO: 2766209 - RNA, 13 nt, Human
uggcuuuucugau

SEQ ID NO: 2766210 - RNA, 17 nt, Human
uggcuuuucugauccag

SEQ ID NO: 2766211 - RNA, 14 nt, Human
uggcuuuucugauc

SEQ ID NO: 2766212 - RNA, 19 nt, Human
uggcuuuucugauccaguu

SEQ ID NO: 2766213 - RNA, 18 nt, Human
uggcuuuucugauccagu

SEQ ID NO: 2766214 - RNA, 21 nt, Human
uggcuugaguuuaaauuguaa

SEQ ID NO: 2766215 - RNA, 14 nt, Human
ugggaguacaaaag

SEQ ID NO: 2766216 - RNA, 19 nt, Human
ugccaaauauaaauaaaaa

SEQ ID NO: 2766217 - RNA, 22 nt, Human
ugccaaauauaaauaaaaauaa

SEQ ID NO: 2766218 - RNA, 17 nt, Human
ugccaaauauaaauaaa

SEQ ID NO: 2766219 - RNA, 18 nt, Human
ugccaaauauaaauaaaa

SEQ ID NO: 2766220 - RNA, 20 nt, Human
ugccacuaaauugacacuua

SEQ ID NO: 2766221 - RNA, 12 nt, Human
ugccaucccucc

SEQ ID NO: 2766222 - RNA, 11 nt, Human
ugccaucccuc

SEQ ID NO: 2766223 - RNA, 22 nt, Human
ugcaguucugaagaagauggua

SEQ ID NO: 2766224 - RNA, 19 nt, Human
ugcaguucugaagaagaug

SEQ ID NO: 2766225 - RNA, 14 nt, Human
ugcaguucugaaga

SEQ ID NO: 2766226 - RNA, 18 nt, Human
ugcaguucugaagaagau

SEQ ID NO: 2766227 - RNA, 17 nt, Human
ugcaguucugaagaaga

SEQ ID NO: 2766228 - RNA, 16 nt, Human
ugcaguucugaagaag

SEQ ID NO: 2766229 - RNA, 15 nt, Human
ugcaguucugaagaa

SEQ ID NO: 2766230 - RNA, 19 nt, Human
ugcagugagccgagauugu

SEQ ID NO: 2766231 - RNA, 18 nt, Human
ugcacggugaauggcuuu

SEQ ID NO: 2766232 - RNA, 14 nt, Human
ugcacggugaaugg

SEQ ID NO: 2766233 - RNA, 17 nt, Human
ugcugaaacaacaaaua

SEQ ID NO: 2766234 - RNA, 19 nt, Human
ugcuaagcauuccaacuau

SEQ ID NO: 2766235 - RNA, 15 nt, Human
ugcuaagcauuccaa

SEQ ID NO: 2766236 - RNA, 15 nt, Human
ugccuucucaacucc

SEQ ID NO: 2766237 - RNA, 18 nt, Human
ugccuguaaucacagcua

SEQ ID NO: 2766238 - RNA, 17 nt, Human
uccucugcuugccaucc

SEQ ID NO: 2766239 - RNA, 16 nt, Human
uccucugcuugccauc

SEQ ID NO: 2766240 - RNA, 15 nt, Human
uccucugcuugccau

SEQ ID NO: 2766241 - RNA, 14 nt, Human
uccucugcuugcca

SEQ ID NO: 2766242 - RNA, 21 nt, Human
uccugaggcuccacuuggucu

SEQ ID NO: 2766243 - RNA, 16 nt, Human
uccugaggcuccacuu

SEQ ID NO: 2766244 - RNA, 15 nt, Human
uccugaggcuccacu

SEQ ID NO: 2766245 - RNA, 17 nt, Human
uccuugcaucaauuuuu

SEQ ID NO: 2766246 - RNA, 16 nt, Human
ucggccuccauccuga

SEQ ID NO: 2766247 - RNA, 15 nt, Human
ucggccuccauccug

SEQ ID NO: 2766248 - RNA, 13 nt, Human
ucucagauuuuau

SEQ ID NO: 2766249 - RNA, 15 nt, Human
ucucagauuuuauua

SEQ ID NO: 2766250 - RNA, 14 nt, Human
ucucagauuuuauu

SEQ ID NO: 2766251 - RNA, 19 nt, Human
ucucagauuuuauuaugua

SEQ ID NO: 2766252 - RNA, 18 nt, Human
ucucagauuuuauuaugu

SEQ ID NO: 2766253 - RNA, 17 nt, Human
ucucagauuuuauuaug

SEQ ID NO: 2766254 - RNA, 16 nt, Human
ucucagauuuuauuau

SEQ ID NO: 2766255 - RNA, 16 nt, Human
ucuauauuuucauucu

SEQ ID NO: 2766256 - RNA, 15 nt, Human
ucuauauuuucauuc

SEQ ID NO: 2766257 - RNA, 14 nt, Human
ucuauauuuucauu

SEQ ID NO: 2766258 - RNA, 13 nt, Human
ucuauauuuucau

SEQ ID NO: 2766259 - RNA, 15 nt, Human
ucuacuaaaaauaca

SEQ ID NO: 2766260 - RNA, 19 nt, Human
ucuacuaaaaauacaaaaa

SEQ ID NO: 2766261 - RNA, 12 nt, Human
ucuacuaaaaau

SEQ ID NO: 2766262 - RNA, 19 nt, Human
ucauggaauuggagcucgu

SEQ ID NO: 2766263 - RNA, 21 nt, Human
ucauggaauuggagcucgugg

SEQ ID NO: 2766264 - RNA, 18 nt, Human
ucaguccaugaagaugua

SEQ ID NO: 2766265 - RNA, 15 nt, Human
ucagauacuggauug

SEQ ID NO: 2766266 - RNA, 14 nt, Human
ucagauacuggauu

SEQ ID NO: 2766267 - RNA, 20 nt, Human
ucagauacuggauuguacuu

SEQ ID NO: 2766268 - RNA, 19 nt, Human
ucagauacuggauuguacu

SEQ ID NO: 2766269 - RNA, 16 nt, Human
ucagauacuggauugu

SEQ ID NO: 2766270 - RNA, 22 nt, Human
ucagcuccccucggagaagagc

SEQ ID NO: 2766271 - RNA, 21 nt, Human
ucagcuccccucggagaagag

SEQ ID NO: 2766272 - RNA, 16 nt, Human
ucagcugcugaaacaa

SEQ ID NO: 2766273 - RNA, 16 nt, Human
ucuucuuggucucagu

SEQ ID NO: 2766274 - RNA, 19 nt, Human
ucuugccaaauauaaauaa

SEQ ID NO: 2766275 - RNA, 22 nt, Human
ucuuaggguuaugauuaaguaa

SEQ ID NO: 2766276 - RNA, 13 nt, Human
ucuuauaauuuaa

SEQ ID NO: 2766277 - RNA, 14 nt, Human
ucuuauaauuuaaa

SEQ ID NO: 2766278 - RNA, 12 nt, Human
ucuugucucaga

SEQ ID NO: 2766279 - RNA, 15 nt, Human
ucuugucucagauuu

SEQ ID NO: 2766280 - RNA, 14 nt, Human
ucuugucucagauu

SEQ ID NO: 2766281 - RNA, 17 nt, Human
ucuuuccacagaagcuc

SEQ ID NO: 2766282 - RNA, 21 nt, Human
ucugccuaaggacuucuuuaa

SEQ ID NO: 2766283 - RNA, 20 nt, Human
ucugccuaaggacuucuuua

SEQ ID NO: 2766284 - RNA, 23 nt, Human
ucugccuaaggacuucuuuaauu

SEQ ID NO: 2766285 - RNA, 14 nt, Human
ucugucucagucca

SEQ ID NO: 2766286 - RNA, 15 nt, Human
ugagcaggauuuuaa

SEQ ID NO: 2766287 - RNA, 20 nt, Human
ugagcaggauuuuaaucuuu

SEQ ID NO: 2766288 - RNA, 20 nt, Human
ugagaaagacuauucaaaca

SEQ ID NO: 2766289 - RNA, 15 nt, Human
ugagaaagacuauuc

SEQ ID NO: 2766290 - RNA, 22 nt, Human
ugacuuuggauaauaaggaaaa

SEQ ID NO: 2766291 - RNA, 20 nt, Human
ugacuuuggauaauaaggaa

SEQ ID NO: 2766292 - RNA, 16 nt, Human
ugacuuuggauaauaa

SEQ ID NO: 2766293 - RNA, 15 nt, Human
ugacuuuggauaaua

SEQ ID NO: 2766294 - RNA, 14 nt, Human
ugacuuuggauaau

SEQ ID NO: 2766295 - RNA, 13 nt, Human
ugacuuuggauaa

SEQ ID NO: 2766296 - RNA, 12 nt, Human
ugacuuuggaua

SEQ ID NO: 2766297 - RNA, 13 nt, Human
ugacucuuaagaa

SEQ ID NO: 2766298 - RNA, 16 nt, Human
ugacucuuaagaagac

SEQ ID NO: 2766299 - RNA, 15 nt, Human
ugacucuuaagaaga

SEQ ID NO: 2766300 - RNA, 14 nt, Human
ugacucuuaagaag

SEQ ID NO: 2766301 - RNA, 18 nt, Human
ugaacuugaaauuugaau

SEQ ID NO: 2766302 - RNA, 14 nt, Human
ugaacuugaaauuu

SEQ ID NO: 2766303 - RNA, 13 nt, Human
ugaacuugaaauu

SEQ ID NO: 2766304 - RNA, 15 nt, Human
ugaaugaauggcuaa

SEQ ID NO: 2766305 - RNA, 17 nt, Human
ugaccacugcagaagac

SEQ ID NO: 2766306 - RNA, 16 nt, Human
ugaccacugcagaaga

SEQ ID NO: 2766307 - RNA, 14 nt, Human
ugaauuaaguuuuu

SEQ ID NO: 2766308 - RNA, 13 nt, Human
ugaauuacauuug

SEQ ID NO: 2766309 - RNA, 16 nt, Human
uaccuaucaucuuaag

SEQ ID NO: 2766310 - RNA, 22 nt, Human
uaccaaaaaucucaauauuuca

SEQ ID NO: 2766311 - RNA, 22 nt, Human
uaccuaacgaaguauccuucag

SEQ ID NO: 2766312 - RNA, 15 nt, Human
uacuaaaauggacug

SEQ ID NO: 2766313 - RNA, 17 nt, Human
uacuaaaauggacugug

SEQ ID NO: 2766314 - RNA, 23 nt, Human
uacuaaaauggacuguggugacu

SEQ ID NO: 2766315 - RNA, 23 nt, Human
uaccuuuguucccaaauuucaua

SEQ ID NO: 2766316 - RNA, 23 nt, Human
uacugucagcuccccucggagaa

SEQ ID NO: 2766317 - RNA, 23 nt, Human
uacaguucggugagcuacaaaug

SEQ ID NO: 2766318 - RNA, 12 nt, Human
uacaauuuuguu

SEQ ID NO: 2766319 - RNA, 16 nt, Human
uacaauuuuguuucug

SEQ ID NO: 2766320 - RNA, 15 nt, Human
uacaauuuuguuucu

SEQ ID NO: 2766321 - RNA, 17 nt, Human
uacaauuuuguuucugu

SEQ ID NO: 2766322 - RNA, 14 nt, Human
uacacuccagugag

SEQ ID NO: 2766323 - RNA, 17 nt, Human
uacacacucaaaucaag

SEQ ID NO: 2766324 - RNA, 16 nt, Human
uacacacucaaaucaa

SEQ ID NO: 2766325 - RNA, 12 nt, Human
uacaaaguauua

SEQ ID NO: 2766326 - RNA, 14 nt, Human
uacaaaguauuaag

SEQ ID NO: 2766327 - RNA, 13 nt, Human
uacaaaguauuaa

SEQ ID NO: 2766328 - RNA, 19 nt, Human
uacaaaguauuaagcauau

SEQ ID NO: 2766329 - RNA, 18 nt, Human
uacaaaguauuaagcaua

SEQ ID NO: 2766330 - RNA, 16 nt, Human
uacaaaguauuaagca

SEQ ID NO: 2766331 - RNA, 15 nt, Human
uacaaaguauuaagc

SEQ ID NO: 2766332 - RNA, 12 nt, Human
uaauuuuuauau

SEQ ID NO: 2766333 - RNA, 18 nt, Human
uaauuuugugaagcaaaa

SEQ ID NO: 2766334 - RNA, 17 nt, Human
uaauuuuuauauuugaa

SEQ ID NO: 2766335 - RNA, 16 nt, Human
uaauuuuuauauuuga

SEQ ID NO: 2766336 - RNA, 13 nt, Human
uaauuuugugaag

SEQ ID NO: 2766337 - RNA, 18 nt, Human
uagacuggugacugauuc

SEQ ID NO: 2766338 - RNA, 20 nt, Human
uagacuggugacugauucuu

SEQ ID NO: 2766339 - RNA, 23 nt, Human
uagacuggugacugauucuucag

SEQ ID NO: 2766340 - RNA, 21 nt, Human
uagacuggugacugauucuuc

SEQ ID NO: 2766341 - RNA, 13 nt, Human
uagaauucuguau

SEQ ID NO: 2766342 - RNA, 11 nt, Human
uagaauucugu

SEQ ID NO: 2766343 - RNA, 21 nt, Human
uagaauucuguauagauuaga

SEQ ID NO: 2766344 - RNA, 16 nt, Human
uagaauucuguauaga

SEQ ID NO: 2766345 - RNA, 15 nt, Human
uagaauucuguauag

SEQ ID NO: 2766346 - RNA, 14 nt, Human
uagaauucuguaua

SEQ ID NO: 2766347 - RNA, 23 nt, Human
uagaauaccacaggaaccacaag

SEQ ID NO: 2766348 - RNA, 18 nt, Human
uagaauuaacacaugauc

SEQ ID NO: 2766349 - RNA, 16 nt, Human
uagaauuaacacauga

SEQ ID NO: 2766350 - RNA, 15 nt, Human
uagaauuaacacaug

SEQ ID NO: 2766351 - RNA, 20 nt, Human
uagauuagagaguguugaaa

SEQ ID NO: 2766352 - RNA, 15 nt, Human
uagauuagaauucug

SEQ ID NO: 2766353 - RNA, 14 nt, Human
uagauuagaauucu

SEQ ID NO: 2766354 - RNA, 20 nt, Human
uagauuagaauucuguauag

SEQ ID NO: 2766355 - RNA, 19 nt, Human
uagauuagaauucuguaua

SEQ ID NO: 2766356 - RNA, 17 nt, Human
uagauuagaauucugua

SEQ ID NO: 2766357 - RNA, 16 nt, Human
uagauuagaauucugu

SEQ ID NO: 2766358 - RNA, 14 nt, Human
uagauaggccaugg

SEQ ID NO: 2766359 - RNA, 20 nt, Human
uaggugcuacaaaaacacag

SEQ ID NO: 2766360 - RNA, 22 nt, Human
uaggugcuacaaaaacacagca

SEQ ID NO: 2766361 - RNA, 23 nt, Human
uaggugcuacaaaaacacagcaa

SEQ ID NO: 2766362 - RNA, 18 nt, Human
uaggugcuacaaaaacac

SEQ ID NO: 2766363 - RNA, 17 nt, Human
uaguauuguccaggucu

SEQ ID NO: 2766364 - RNA, 20 nt, Human
uauagaaccucuuugucuac

SEQ ID NO: 2766365 - RNA, 21 nt, Human
uauagaaccucuuugucuaca

SEQ ID NO: 2766366 - RNA, 23 nt, Human
uauaucugaggaauucuguauag

SEQ ID NO: 2766367 - RNA, 19 nt, Human
uauauaacaaugcuguauu

SEQ ID NO: 2766368 - RNA, 17 nt, Human
uauauaacaaugcugua

SEQ ID NO: 2766369 - RNA, 13 nt, Human
uauauaacaaugc

SEQ ID NO: 2766370 - RNA, 14 nt, Human
uaucaaaagaaaga

SEQ ID NO: 2766371 - RNA, 16 nt, Human
uauauuuucauucucc

SEQ ID NO: 2766372 - RNA, 21 nt, Human
uauauuuuuuguuaaaugauu

SEQ ID NO: 2766373 - RNA, 20 nt, Human
uauauuugaaauauugacuu

SEQ ID NO: 2766374 - RNA, 16 nt, Human
uauaugcuucuguuuu

SEQ ID NO: 2766375 - RNA, 14 nt, Human
uauaugcuucuguu

SEQ ID NO: 2766376 - RNA, 17 nt, Human
uaaccaggggccaugaa

SEQ ID NO: 2766377 - RNA, 21 nt, Human
uaagaaaauaucacuugucaa

SEQ ID NO: 2766378 - RNA, 14 nt, Human
uaagagagaaugag

SEQ ID NO: 2766379 - RNA, 13 nt, Human
uaagagagaauga

SEQ ID NO: 2766380 - RNA, 15 nt, Human
uaacuggaaacuuca

SEQ ID NO: 2766381 - RNA, 23 nt, Human
uaaaugccaucaauaaaaaauua

SEQ ID NO: 2766382 - RNA, 16 nt, Human
uaaaugccaucaauaa

SEQ ID NO: 2766383 - RNA, 20 nt, Human
uaaauggcuuccuggcaaua

SEQ ID NO: 2766384 - RNA, 20 nt, Human
uaaauugacacuuaaaaaug

SEQ ID NO: 2766385 - RNA, 16 nt, Human
uaaaugugccuucauu

SEQ ID NO: 2766386 - RNA, 16 nt, Human
uaauaaggaaaaguuu

SEQ ID NO: 2766387 - RNA, 13 nt, Human
uaagugaaauaag

SEQ ID NO: 2766388 - RNA, 21 nt, Human
uaauauuaaagccauguuuau

SEQ ID NO: 2766389 - RNA, 20 nt, Human
uaauauuaaagccauguuua

SEQ ID NO: 2766390 - RNA, 17 nt, Human
uaauauuaaagccaugu

SEQ ID NO: 2766391 - RNA, 16 nt, Human
uaauauuaaagccaug

SEQ ID NO: 2766392 - RNA, 15 nt, Human
uaauauuaaagccau

SEQ ID NO: 2766393 - RNA, 21 nt, Human
uaauuaacauguuaaaccaug

SEQ ID NO: 2766394 - RNA, 20 nt, Human
uaauuaacauguuaaaccau

SEQ ID NO: 2766395 - RNA, 22 nt, Human
uaauguuucaaacauauauaac

SEQ ID NO: 2766396 - RNA, 22 nt, Human
uaaugauaacuggaaacuucag

SEQ ID NO: 2766397 - RNA, 17 nt, Human
uaaugauaacuggaaac

SEQ ID NO: 2766398 - RNA, 23 nt, Human
uaaugauaacuggaaacuucagc

SEQ ID NO: 2766399 - RNA, 13 nt, Human
uaaagccauguuu

SEQ ID NO: 2766400 - RNA, 11 nt, Human
uaaagccaugu

SEQ ID NO: 2766401 - RNA, 20 nt, Human
uaaagccauguuuauuacag

SEQ ID NO: 2766402 - RNA, 15 nt, Human
uaaagccauguuuau

SEQ ID NO: 2766403 - RNA, 14 nt, Human
uaaaguguuugaaa

SEQ ID NO: 2766404 - RNA, 18 nt, Human
uaaaaaugguuuaaaugg

SEQ ID NO: 2766405 - RNA, 15 nt, Human
uaaaaaugguuuaaa

SEQ ID NO: 2766406 - RNA, 19 nt, Human
uaaaaaugguuuaaauggu

SEQ ID NO: 2766407 - RNA, 22 nt, Human
uaaaacaagcacuaaacaaaga

SEQ ID NO: 2766408 - RNA, 18 nt, Human
uaaaaucauuucugcauc

SEQ ID NO: 2766409 - RNA, 22 nt, Human
uaaaaucauuucugcaucagcu

SEQ ID NO: 2766410 - RNA, 17 nt, Human
uaaaauccauacauuug

SEQ ID NO: 2766411 - RNA, 15 nt, Human
uaaaauccauacauu

SEQ ID NO: 2766412 - RNA, 10 nt, Human
uaaaaucauu

SEQ ID NO: 2766413 - RNA, 13 nt, Human
uaaaaucauuucu

SEQ ID NO: 2766414 - RNA, 17 nt, Human
guuuagaaagcuugccc

SEQ ID NO: 2766415 - RNA, 20 nt, Human
guuuauauaagcuuguauuc

SEQ ID NO: 2766416 - RNA, 21 nt, Human
guuuagcuggaaaaguauguu

SEQ ID NO: 2766417 - RNA, 20 nt, Human
guuuagcuggaaaaguaugu

SEQ ID NO: 2766418 - RNA, 18 nt, Human
guuuagucuugucucaga

SEQ ID NO: 2766419 - RNA, 15 nt, Human
gugcuacaaaaacac

SEQ ID NO: 2766420 - RNA, 20 nt, Human
gugcuacaaaaacacagcaa

SEQ ID NO: 2766421 - RNA, 15 nt, Human
guggugacuuuggau

SEQ ID NO: 2766422 - RNA, 13 nt, Human
guggugacuuugg

SEQ ID NO: 2766423 - RNA, 16 nt, Human
guggugacuuuggaua

SEQ ID NO: 2766424 - RNA, 21 nt, Human
guguaaguagauaggccaugg

SEQ ID NO: 2766425 - RNA, 13 nt, Human
guuacagaagccc

SEQ ID NO: 2766426 - RNA, 21 nt, Human
guuaaaccaugggauaaaugc

SEQ ID NO: 2766427 - RNA, 18 nt, Human
guuaaaccaugggauaaa

SEQ ID NO: 2766428 - RNA, 20 nt, Human
guuaaaagaugaaaauauuu

SEQ ID NO: 2766429 - RNA, 14 nt, Human
guuaaaagaugaaa

SEQ ID NO: 2766430 - RNA, 16 nt, Human
guuaaaagaugaaaau

SEQ ID NO: 2766431 - RNA, 23 nt, Human
guucauggaacgcguugaaauug

SEQ ID NO: 2766432 - RNA, 22 nt, Human
guucauggaacgcguugaaauu

SEQ ID NO: 2766433 - RNA, 16 nt, Human
guucaucaaugaauga

SEQ ID NO: 2766434 - RNA, 19 nt, Human
guucacucuccauuuaaua

SEQ ID NO: 2766435 - RNA, 19 nt, Human
guucagagcugcccucucc

SEQ ID NO: 2766436 - RNA, 17 nt, Human
guucagagcugcccucu

SEQ ID NO: 2766437 - RNA, 16 nt, Human
guucagagcugcccuc

SEQ ID NO: 2766438 - RNA, 15 nt, Human
guucagagcugcccu

SEQ ID NO: 2766439 - RNA, 22 nt, Human
guucagagcugcccucuccugg

SEQ ID NO: 2766440 - RNA, 20 nt, Human
guucagagcugcccucuccu

SEQ ID NO: 2766441 - RNA, 23 nt, Human
guucagagcugcccucuccuggg

SEQ ID NO: 2766442 - RNA, 14 nt, Human
guucagagcugccc

SEQ ID NO: 2766443 - RNA, 13 nt, Human
guucagagcugcc

SEQ ID NO: 2766444 - RNA, 19 nt, Human
guuaucugaagucagaucu

SEQ ID NO: 2766445 - RNA, 23 nt, Human
guuaccucugccucagaaaacaa

SEQ ID NO: 2766446 - RNA, 22 nt, Human
guugaaacggaugauuucuaug

SEQ ID NO: 2766447 - RNA, 21 nt, Human
guugaaacggaugauuucuau

SEQ ID NO: 2766448 - RNA, 15 nt, Human
guugaaauuguaauu

SEQ ID NO: 2766449 - RNA, 20 nt, Human
guugaaauuguaauuauauc

SEQ ID NO: 2766450 - RNA, 16 nt, Human
guugaaauuguaauua

SEQ ID NO: 2766451 - RNA, 14 nt, Human
guugaauuuauugg

SEQ ID NO: 2766452 - RNA, 22 nt, Human
guugaauuuauuggcuuuucug

SEQ ID NO: 2766453 - RNA, 21 nt, Human
guugaauuuauuggcuuuucu

SEQ ID NO: 2766454 - RNA, 20 nt, Human
guugauggugguauguuuuc

SEQ ID NO: 2766455 - RNA, 21 nt, Human
guugauggugguauguuuuca

SEQ ID NO: 2766456 - RNA, 17 nt, Human
guugaaaagacuccaaa

SEQ ID NO: 2766457 - RNA, 22 nt, Human
guugaaaagacuccaaagaaau

SEQ ID NO: 2766458 - RNA, 23 nt, Human
guugaaaagacuccaaagaaaug

SEQ ID NO: 2766459 - RNA, 13 nt, Human
guucugaagaaga

SEQ ID NO: 2766460 - RNA, 12 nt, Human
guucugaagaag

SEQ ID NO: 2766461 - RNA, 15 nt, Human
guucugaagaagaug

SEQ ID NO: 2766462 - RNA, 14 nt, Human
guucugaagaagau

SEQ ID NO: 2766463 - RNA, 16 nt, Human
gugacaagcucacaga

SEQ ID NO: 2766464 - RNA, 13 nt, Human
gugaacacaucag

SEQ ID NO: 2766465 - RNA, 21 nt, Human
gugaacaaauuuacagagaca

SEQ ID NO: 2766466 - RNA, 20 nt, Human
gugcuaaggacuuguuagau

SEQ ID NO: 2766467 - RNA, 14 nt, Human
gugcuaaggacuug

SEQ ID NO: 2766468 - RNA, 13 nt, Human
gugcuaaggacuu

SEQ ID NO: 2766469 - RNA, 12 nt, Human
gugcuaaggacu

SEQ ID NO: 2766470 - RNA, 21 nt, Human
gugcgcuaaacuuuucugaua

SEQ ID NO: 2766471 - RNA, 17 nt, Human
gugcgcuaaacuuuucu

SEQ ID NO: 2766472 - RNA, 21 nt, Human
gucucagauuuuauuauguaa

SEQ ID NO: 2766473 - RNA, 17 nt, Human
gucucagauuuuauuau

SEQ ID NO: 2766474 - RNA, 14 nt, Human
gucucagauuuuau

SEQ ID NO: 2766475 - RNA, 16 nt, Human
gucucagauuuuauua

SEQ ID NO: 2766476 - RNA, 15 nt, Human
gucucagauuuuauu

SEQ ID NO: 2766477 - RNA, 13 nt, Human
gucugacuguuuc

SEQ ID NO: 2766478 - RNA, 23 nt, Human
gucggguuuuauuguuuaaaauc

SEQ ID NO: 2766479 - RNA, 18 nt, Human
gucgucaaagcugaaaug

SEQ ID NO: 2766480 - RNA, 15 nt, Human
gucuugucucagauu

SEQ ID NO: 2766481 - RNA, 22 nt, Human
gucuugucucagauuuuauuau

SEQ ID NO: 2766482 - RNA, 20 nt, Human
gucuugucucagauuuuauu

SEQ ID NO: 2766483 - RNA, 20 nt, Human
gucuugccuuuuucauuauu

SEQ ID NO: 2766484 - RNA, 18 nt, Human
gucuugccuuuuucauua

SEQ ID NO: 2766485 - RNA, 17 nt, Human
gucuugccuuuuucauu

SEQ ID NO: 2766486 - RNA, 16 nt, Human
gucuugccuuuuucau

SEQ ID NO: 2766487 - RNA, 15 nt, Human
gucuugccuuuuuca

SEQ ID NO: 2766488 - RNA, 23 nt, Human
gucugugagaugcuagaacuccc

SEQ ID NO: 2766489 - RNA, 22 nt, Human
gucugugagaugcuagaacucc

SEQ ID NO: 2766490 - RNA, 21 nt, Human
gucugugagaugcuagaacuc

SEQ ID NO: 2766491 - RNA, 17 nt, Human
gucugugagaugcuaga

SEQ ID NO: 2766492 - RNA, 16 nt, Human
gucugugagaugcuag

SEQ ID NO: 2766493 - RNA, 15 nt, Human
gucugugagaugcua

SEQ ID NO: 2766494 - RNA, 14 nt, Human
guauagauuagaau

SEQ ID NO: 2766495 - RNA, 19 nt, Human
guauagaaccucuuugucu

SEQ ID NO: 2766496 - RNA, 21 nt, Human
guaugugugaagugagugagu

SEQ ID NO: 2766497 - RNA, 17 nt, Human
guauguuagugcaaauu

SEQ ID NO: 2766498 - RNA, 18 nt, Human
gcuauaggugcuacaaaa

SEQ ID NO: 2766499 - RNA, 23 nt, Human
guauaauuaacauguuaaaccau

SEQ ID NO: 2766500 - RNA, 22 nt, Human
guauaauuaacauguuaaacca

SEQ ID NO: 2766501 - RNA, 19 nt, Human
guauaauuaacauguuaaa

SEQ ID NO: 2766502 - RNA, 17 nt, Human
guauaauuaacauguua

SEQ ID NO: 2766503 - RNA, 15 nt, Human
guauaauuaacaugu

SEQ ID NO: 2766504 - RNA, 10 nt, Human
guauaauuaa

SEQ ID NO: 2766505 - RNA, 14 nt, Human
guauaauuaacaug

SEQ ID NO: 2766506 - RNA, 13 nt, Human
guauaauuaacau

SEQ ID NO: 2766507 - RNA, 15 nt, Human
guaguguuggagaag

SEQ ID NO: 2766508 - RNA, 14 nt, Human
guaguguuggagaa

SEQ ID NO: 2766509 - RNA, 18 nt, Human
gucagaucugccuaagga

SEQ ID NO: 2766510 - RNA, 16 nt, Human
gucagaucugccuaag

SEQ ID NO: 2766511 - RNA, 21 nt, Human
gucagaucugccuaaggacuu

SEQ ID NO: 2766512 - RNA, 20 nt, Human
gucagaucugccuaaggacu

SEQ ID NO: 2766513 - RNA, 19 nt, Human
gucagaucugccuaaggac

SEQ ID NO: 2766514 - RNA, 19 nt, Human
gucagcuccccucggagaa

SEQ ID NO: 2766515 - RNA, 21 nt, Human
guauuaagcauauauuuuuau

SEQ ID NO: 2766516 - RNA, 18 nt, Human
guauuaagcauauauuuu

SEQ ID NO: 2766517 - RNA, 15 nt, Human
guauuaagcauauau

SEQ ID NO: 2766518 - RNA, 17 nt, Human
guauuaagcauauauuu

SEQ ID NO: 2766519 - RNA, 16 nt, Human
guauuaagcauauauu

SEQ ID NO: 2766520 - RNA, 20 nt, Human
guauuuuaaaagaaugauua

SEQ ID NO: 2766521 - RNA, 13 nt, Human
guauuuuaaucac

SEQ ID NO: 2766522 - RNA, 18 nt, Human
guauuuuaaaagaaugau

SEQ ID NO: 2766523 - RNA, 15 nt, Human
gucaaugcagccccc

SEQ ID NO: 2766524 - RNA, 22 nt, Human
gucaauaaaauccauacauuug

SEQ ID NO: 2766525 - RNA, 23 nt, Human
gucaauaaaauccauacauuugu

SEQ ID NO: 2766526 - RNA, 23 nt, Human
gucagcuccccucggagaagagc

SEQ ID NO: 2766527 - RNA, 21 nt, Human
gucagcuccccucggagaaga

SEQ ID NO: 2766528 - RNA, 22 nt, Human
gucagcuccccucggagaagag

SEQ ID NO: 2766529 - RNA, 18 nt, Human
uuuuuaaaaaagaaacau

SEQ ID NO: 2766530 - RNA, 21 nt, Human
uuuuggcauaacauaaaucug

SEQ ID NO: 2766531 - RNA, 18 nt, Human
uuuuggucuggagggaag

SEQ ID NO: 2766532 - RNA, 13 nt, Human
uuuuccugaaaac

SEQ ID NO: 2766533 - RNA, 14 nt, Human
uuuuccugaaaacc

SEQ ID NO: 2766534 - RNA, 19 nt, Human
uuuuucucuaggaaauauu

SEQ ID NO: 2766535 - RNA, 17 nt, Human
uuucuuauuucauuucu

SEQ ID NO: 2766536 - RNA, 18 nt, Human
uuugaaucaucaagucuu

SEQ ID NO: 2766537 - RNA, 22 nt, Human
uuuccucaaaacuucagacaua

SEQ ID NO: 2766538 - RNA, 13 nt, Human
uuucugagaaaga

SEQ ID NO: 2766539 - RNA, 22 nt, Human
uuuggaauuuuccuccuuucuc

SEQ ID NO: 2766540 - RNA, 16 nt, Human
uuuggauaauaaggaa

SEQ ID NO: 2766541 - RNA, 16 nt, Human
uuuguauaaaauaauu

SEQ ID NO: 2766542 - RNA, 14 nt, Human
uuuguauaaaauaa

SEQ ID NO: 2766543 - RNA, 13 nt, Human
uuuguauaaaaua

SEQ ID NO: 2766544 - RNA, 15 nt, Human
uuuuaaaagaaugau

SEQ ID NO: 2766545 - RNA, 21 nt, Human
uuuuaaaagaaugauuaugaa

SEQ ID NO: 2766546 - RNA, 20 nt, Human
uuuuaauaauguuucaaaca

SEQ ID NO: 2766547 - RNA, 23 nt, Human
gccaucccucccuccaccucccu

SEQ ID NO: 2766548 - RNA, 18 nt, Human
gccaucccucccuccacc

SEQ ID NO: 2766549 - RNA, 24 nt, Human
gccaucaauaaaaaauuaugacau

SEQ ID NO: 2766550 - RNA, 19 nt, Human
gccaugggcacugugggua

SEQ ID NO: 2766551 - RNA, 22 nt, Human
gccuccccuccucugcuugcca

SEQ ID NO: 2766552 - RNA, 20 nt, Human
gccuccccuccucugcuugc

SEQ ID NO: 2766553 - RNA, 16 nt, Human
gccuccccuccucugc

SEQ ID NO: 2766554 - RNA, 19 nt, Human
gccuccccuccucugcuug

SEQ ID NO: 2766555 - RNA, 17 nt, Human
gccuccccuccucugcu

SEQ ID NO: 2766556 - RNA, 16 nt, Human
gcccugcuuucagaua

SEQ ID NO: 2766557 - RNA, 14 nt, Human
gcccugcuuucaga

SEQ ID NO: 2766558 - RNA, 20 nt, Human
gccgggcgugguggugagug

SEQ ID NO: 2766559 - RNA, 23 nt, Human
gccuaaauccauuuggaaaucuu

SEQ ID NO: 2766560 - RNA, 22 nt, Human
gccuaaauccauuuggaaaucu

SEQ ID NO: 2766561 - RNA, 21 nt, Human
gccuaaauccauuuggaaauc

SEQ ID NO: 2766562 - RNA, 19 nt, Human
gccuaaauccauuuggaaa

SEQ ID NO: 2766563 - RNA, 13 nt, Human
gccuaaauccauu

SEQ ID NO: 2766564 - RNA, 12 nt, Human
gccuaaauccau

SEQ ID NO: 2766565 - RNA, 23 nt, Human
gccuuuuucauuauuuuauuaug

SEQ ID NO: 2766566 - RNA, 13 nt, Human
gcuaaacuuuucu

SEQ ID NO: 2766567 - RNA, 17 nt, Human
gcuaaacuuuucugaua

SEQ ID NO: 2766568 - RNA, 15 nt, Human
gcuaaacuuuucuga
